United States Patent 8,067,671 (METHODS FOR GENETIC CONTROL OF PLANT PEST INFESTATION AND COMPOSITIONS THEREOF) - sequence listing, part 52

SEQ ID NO: 139434 - protein, 84 aa, Heterodera glycines
  Coding regions on vcDNA: vcDNA=SeqID_65857; Strand=+; Position=1 -164,225-315
MIYLFPFSFKGNLSRIILPHLNFDLLGIEFYVKFPTNLLFTIAFSSNAPFLYMFSTDHQKAFRSQFKRIFGKNESKHLIVAFAN

SEQ ID NO: 139435 - protein, 81 aa, Heterodera glycines
  Coding regions on vcDNA: vcDNA=SeqID_65858; Strand=+; Position=1 -78,132-299
MRSFFFASLALVLICASTTVSKPHPTPAPSAKTNEKGCYQVCFVVVCINICPKAKVGIFLFIKLWVQNLCAKIIQFNCQER

SEQ ID NO: 139436 - protein, 128 aa, Heterodera glycines
  Coding regions on vcDNA: vcDNA=SeqID_65859; Strand=-; Position=1 -158,268-495
  Homolog annotation: Hit_ID=NP_502593.1; Match level="QueryCoverage =96%, HitCoverage=12%, E-value=1e-26, Identity=52%"; Hit description =vesicle docking protein (4O210) [Caenorhabditis elegans] emb|CAB05553.1| Hypothetical protein K09B11.9 [C
MLDLLCKVLLSQLGVSVEVLAESVITVAETIRANYANQEFFAQSTVADQDGVRPALLILLLSMTSERQPFRLRLAVFYCFLCYLYDNEKGKVKVSQFIGLFATFIIFYQIIDMLLPQNDNRSSEEEGN

SEQ ID NO: 139437 - protein, 64 aa, Heterodera glycines
  Coding regions on vcDNA: vcDNA=SeqID_65860; Strand=+; Position=1-196
  Homolog annotation: Hit_ID=NP_494571.1; Match level="QueryCoverage =100%, HitCoverage=6%, E-value=5e-13, Identity=54%"; Hit description =AdaPTin or adaptin-related protein (apt-5) [Caenorhabditis elegans] gb|AAK73904.1| Adaptin or adaptin-rel
VNNVTAVLDAMLRIKLSVVPGPLLSVFVQNIAKLYTFQLCKLEADDDWDGIETLDNLLTSKLPE

SEQ ID NO: 139438 - protein, 121 aa, Heterodera glycines
  Coding regions on vcDNA: vcDNA=SeqID_65861; Strand=-; Position=1-584
CMCRTPSPRSARVYLCKRFKCNAHELHVLFKSLEKRRDIVEHLRSVQLRTAHLRPSVRNFPVRCNDLSILDTHSAPAYRGYLGITVFLFVLFVGNKKFKGPDALLHKAWHPLAPPQLAVRR

SEQ ID NO: 139439 - protein, 155 aa, Heterodera glycines
  Coding regions on vcDNA: vcDNA=SeqID_65862; Strand=-; Position=1 -162,481-786
  Homolog annotation: Hit_ID=NP_506158.1; Match level="QueryCoverage =64%, HitCoverage=14%, E-value=1e-09, Identity=31%"; Hit description =predicted CDS, putative protein family member (5N108) [Caenorhabditis elegans] pir||T22808 hypothetical p
TEQGTAESENESNTSSGSVKLLENDAELDSNNTSNTNEIASNVNLRAANVSDVPTTSEQIVSVPDASQNVSTENDEISLNNLTTVLPTEETVTVTTTVSTTTAAPTTTTITTTTATSTTTTVAKQQTSRKPVKFAMSEDDHPHVFLLGDECKVDN

SEQ ID NO: 139440 - protein, 205 aa, Heterodera glycines
  Coding regions on vcDNA: vcDNA=SeqID_65863; Strand=+; Position=1-618
RERKEAATTTGQRRTDATHSAAGRPTSAQPTKKQRTSQARRTRHRHKATQQPDTGGHTGSTERETTAPTQGSTPKAWDARQLPRKAGQRPQASTNDRGPTADGGKRGGQREPNRTAGRRRRGTTRGKSQQQEHPQRPRHDESPAQATARKPEPDSTPTEAGTPTAPEEHEKAQTRAATGGENKGQGRMQSERMTRPYKEFLVHGQ

SEQ ID NO: 139441 - protein, 65 aa, Heterodera glycines
  Coding regions on vcDNA: vcDNA=SeqID_65864; Strand=-; Position=1 -88,260-369
MAFRDPKNLRNRNSDPKNVGTRNFVPSLLSPSQASPAITGRRRIFVAISSAVGAGAAPISGEGGR

SEQ ID NO: 139442 - protein, 235 aa, Heterodera glycines
  Coding regions on vcDNA: vcDNA=SeqID_65865; Strand=+; Position=1 -183,746-966,1022-1179,1456-1601
MKGRPVPLQSVMDCSKQLCAFSELAVAEHFPTFLRPSDAVAYLESYVRTFELARHMKLGTEVFLCTRRGEWILPLLQSDGQKPWDWPFSSRWHFWGRRWVPKCLRNFCWEMSAQSVSPDCSQNNGIGRPMHRLLSANLTFGAEQLCPLLASGRIRIRPNILSLSDSNLVEFADRTVEQHVDALVICTGAAVFPRAQRTHATANSLFDEGRIGETPLCRVHGNAKDTKAHTDGTRH

SEQ ID NO: 139443 - protein, 24 aa, Heterodera glycines
  Coding regions on vcDNA: vcDNA=SeqID_65866; Strand=+; Position=1 -39,695-730
MPISQFMDESQRESRQNSHFYVYN

SEQ ID NO: 139444 - protein, 97 aa, Heterodera glycines
  Coding regions on vcDNA: vcDNA=SeqID_65867; Strand=+; Position=1 -138,541-696
MPPLILREWKPYMREFDGCYETNGQRSGDCPLTDHSDASFGGDFFHAEDEFTLSHIPFLGDAEDDTSFCAELMKTFQDGIHGTVKGCGEFVGPPICL

SEQ ID NO: 139445 - protein, 88 aa, Heterodera glycines
  Coding regions on vcDNA: vcDNA=SeqID_65868; Strand=-; Position=1 -70,111-221,286-368
  Homolog annotation: Hit_ID=CAE73159.1; Match level="QueryCoverage =95%, HitCoverage=37%, E-value=1e-28, Identity=66%"; Hit description =Hypothetical protein CBG20552 [Caenorhabditis briggsae]
MTFRLVVNIPGTEVDKGDVLSEYVGSGPPQDTGLHRYVYLIYQQKNTIKDTEHGHLTNRSGDNRGGWKTEKFAKKHELGDPVAGNFYQ

SEQ ID NO: 139446 - protein, 61 aa, Heterodera glycines
  Coding regions on vcDNA: vcDNA=SeqID_65869; Strand=-; Position=1-185
MWQNQKGSERRNGDGKRKGIRATAGPKGPHNGKGKGGHSSRRGQGGHSHRQRAAKAGCSER

SEQ ID NO: 139447 - protein, 71 aa, Heterodera glycines; identical to SEQ ID NO: 124984
  Coding regions on vcDNA: vcDNA=SeqID_65870; Strand=-; Position=1-217

SEQ ID NO: 139448 - protein, 95 aa, Heterodera glycines
  Coding regions on vcDNA: vcDNA=SeqID_65871; Strand=+; Position=1-661
LFEYPKRTLEKIDFFVFGAVPPNRCAQIYGETESFWSSFPIACTLILRWIFAPHNCLSTPNGHLKKSIFLFSGQSPRTDAPRFMGRPNPSGIASL

SEQ ID NO: 139449 - protein, 37 aa, Heterodera glycines
  Coding regions on vcDNA: vcDNA=SeqID_65872; Strand=+; Position=1 -9,494-598
MKTLNVSHNLFSGCALFDMVLLHQKVIHEELGCFKIP

SEQ ID NO: 139450 - protein, 49 aa, Heterodera glycines
  Coding regions on vcDNA: vcDNA=SeqID_65873; Strand=-; Position=1 -3,136-282
MVFTKPDMVERFFPDPKEAHTVEAIRKVQAMSWALGDDENEAKEIKKAN

SEQ ID NO: 139451 - protein, 42 aa, Heterodera glycines
  Coding regions on vcDNA: vcDNA=SeqID_65874; Strand=-; Position=1 -78,334-384
MNYTEDNLDEDTKKKIESLLDDRFCANLTIIPKNCDFYILFG

SEQ ID NO: 139452 - protein, 52 aa, Heterodera glycines
  Coding regions on vcDNA: vcDNA=SeqID_65875; Strand=-; Position=1 -17,176-299,1199-1216
MGGIFRFIWILCLYHQLNAIGLLEVAEHECAHLAINEIGEIYFQFLNLNLEN

SEQ ID NO: 139453 - protein, 230 aa, Heterodera glycines
  Coding regions on vcDNA: vcDNA=SeqID_65876; Strand=+; Position=1 -72,127-177,233-418,460-557,604-790,837-932
  Homolog annotation: Hit_ID=CAE59495.1; Match level="QueryCoverage =84%, HitCoverage=58%, E-value=6e-42, Identity=42%"; Hit description =Hypothetical protein CBG02880 [Caenorhabditis briggsae]
MQVTDCGKHFLIKFKQKFLPREIRWSDYQFLVMQLAVGGDLLSFLQKCGPVSETTCHNWMLQIVAALDYLHRKGIAHRDLKLENVLLCENGVIKVTDYGFSKQSSDLSSTFCGSRSYSSPEILLGIAYDMFKSDIWSLGVAAFIMITNTMPFHEDLPNQQIVDSQRKRRYKYPSWLNITKQCRTAIDALLTYQPAFRPNIFECAKLEWFAQDSASLWCGGRRAGVGVMGQ

SEQ ID NO: 139454 - protein, 125 aa, Heterodera glycines
  misc_feature (15)..(15): Xaa can be any naturally occurring amino acid
  Coding regions on vcDNA: vcDNA=SeqID_65877; Strand=-; Position=1 -180,284-379,585-658,826-862
  Homolog annotation: Hit_ID=NP_490889.1; Match level="QueryCoverage =96%, HitCoverage=38%, E-value=1e-31, Identity=55%"; Hit description =hydroxymethylglutaryl-coa lyase (34.3 kD) (1C227) [Caenorhabditis elegans] gb|AAK73908.1| Hypothetical pr
EIREWRVQEIKKKFXRQLKCRYCPTATKVTLIDRLSDCGLKTIEATSFVSPKWVPQMADHAEVISRCKKFAGVSYPVLVPNLAGLHNAIKNGNVREIAVFCAASDAFTRQRPNKNIQINTKKRTK

SEQ ID NO: 139455 - protein, 83 aa, Heterodera glycines
  Coding regions on vcDNA: vcDNA=SeqID_65878; Strand=-; Position=1 -172,732-811
MKPKFLFAIIFAFFIGFSIFEGTSSYEWDSDNLANNVQTFAEFMDDLYEDYKEKGKMDIPWLNKSKLYTENGYSEKQKRKGSI

SEQ ID NO: 139456 - protein, 103 aa, Heterodera glycines
  Coding regions on vcDNA: vcDNA=SeqID_65879; Strand=+; Position=1 -48,325-588
MKKFFGGSKAKPAPKQQLAGFEFNPFLIDQGILMSQAPAPSLRTRNARGDTREGLVVNRRSGRKEWGRGIGIGLILKWWLLLPSCPCFTQSFCHCLPLCPRGL

SEQ ID NO: 139457 - protein, 81 aa, Heterodera glycines
  Coding regions on vcDNA: vcDNA=SeqID_65880; Strand=-; Position=1 -80,1230-1395
MYIVRHFGVAREWKKIGIEIGLIGISRVFFGFNLRPTCLGKSTRTLKIACEEWNICGLFIFVVFVSSCPNNATAIPLHRLD

SEQ ID NO: 139458 - protein, 36 aa, Heterodera glycines
  Coding regions on vcDNA: vcDNA=SeqID_65881; Strand=+; Position=1-109
MGCTGDSEEAAAAMSASLSIGQKRVCRRWMSQRTIR

SEQ ID NO: 139459 - protein, 69 aa, Heterodera glycines
  Coding regions on vcDNA: vcDNA=SeqID_65882; Strand=-; Position=1 -80,129-258
MPPYSNAILCIHKLPSINLLFICGQCSTPFLSLSFVLAKFLPFFTKMVQNLGKCMAAEQMNTVASDPNK

SEQ ID NO: 139460 - protein, 85 aa, Heterodera glycines
  Coding regions on vcDNA: vcDNA=SeqID_65883; Strand=+; Position=1-255
MVEMGTEIQTSRNELKAFQEEVDKAKNITLEHVEKNDLKKAKKSADVAKGIARQAKTKYTSTLEGYNDKSEKGFSGIVIGLMRRS

SEQ ID NO: 139461 - protein, 25 aa, Heterodera glycines
  Coding regions on vcDNA: vcDNA=SeqID_65884; Strand=+; Position=1-75
TCTCGVVVKLSTFHNFSPGFNSPLG

SEQ ID NO: 139462 - protein, 25 aa, Heterodera glycines
  Coding regions on vcDNA: vcDNA=SeqID_65885; Strand=-; Position=1-75
TCTCGVVVKLSTFHNFSPGFNSPLG

SEQ ID NO: 139463 - protein, 185 aa, Heterodera glycines
  Coding regions on vcDNA: vcDNA=SeqID_65886; Strand=-; Position=1 -22,1479-1553,1605-1710,1774-1835,1889-2094
  Homolog annotation: Hit_ID=XP_215362.1; Match level="QueryCoverage =90%, HitCoverage=78%, E-value=5e-32, Identity=45%"; Hit description =similar to RIKEN cDNA 1700023F20 [Rattus norvegicus]
HYLFFSKYTCHQLGSGALVVQLPQPSLVETMRLLLWDCDLLLWDCDDRSVYSFFIEVSTDQCKWMKVADVNERSCRSWQTVHFIRCRSWQTVHFIRQPVVFIRIVGTSNSANEVFHCVTSNSANEVFHCVHFECPAMETDSVSEENGSPDCDVSSQRPLKTTFPPSIGVPSSSSILASSQNALDS

SEQ ID NO: 139464 - protein, 262 aa, Heterodera glycines
  Coding regions on vcDNA: vcDNA=SeqID_65887; Strand=+; Position=1 -93,139-284,366-531,995-1143,1720-1882,1973-2044
MAGPDSRFILEFFNREAKEIGVTQELLNNSQQSDQLIQAYYFLCDLIFENVGTTKENECEVATDLTRARPKMIIRTQQHSNLVFNKLFDGSNEFLYSDLLQPDPRRTKMHIAQLIRLYTTKCDIAKELSAVDNHIDECKKLFAQEEENRKRLDNNIVNSPERIIEELSNMEVEVEDIRRKNDQAVDEKELAKQLKEKKDDIRQHQQEIKRKDRSFIILTDTYDDSVAKLFKNLSLVEQKVQVSRSNLLSLFNESEIFGPFNQ

SEQ ID NO: 139465 - protein, 87 aa, Heterodera glycines
  Coding regions on vcDNA: vcDNA=SeqID_65888; Strand=-; Position=1 -30,453-609,877-953
MCAPIETQTAAREIIIPSFYNVANFPGVIGAIDCTHVRIIPPASAHEKDYFNRKGYPSINVQECANIDHGSSCAAQHCNRSQFARFS

SEQ ID NO: 139466 - protein, 107 aa, Heterodera glycines
  Coding regions on vcDNA: vcDNA=SeqID_65889; Strand=+; Position=1 -108,410-625
MARERCLIQILEFSPPLRVAQCQERHRTFLLQQQLAVDLEERKIALDLMRTTEEKKRNTIHGSRSMDHPIRSLCIRILIHGFFDPRISDSWITIRGSDPDLYAYGYG

SEQ ID NO: 139467 - protein, 296 aa, Heterodera glycines
  Coding regions on vcDNA: vcDNA=SeqID_65890; Strand=-; Position=1 -181,584-750,1241-1418,1728-1852,2403-2510,3459-3590
  Homolog annotation: Hit_ID=NP_495617.1; Match level="QueryCoverage =59%, HitCoverage=37%, E-value=7e-37, Identity=53%"; Hit description =cell division cycle 2-like 1 (83.6 kD) (2H991) [Caenorhabditis elegans] gb|AAA62523.1| Hypothetical prote
MSDEEEEKEQQRGEKEQKRTAAVGGRRGEGGAATGQSPQQQHQAALTRMSSDPQELIMEEYFGMDERHFRSRAGTVDTEMNGANTNGEEDDVMDIGDDELIENKEFEQLTEEEKALLSPEMLSQKEDKYQRRLVSMLPVYYPGISGCRSVAEYECLNKISEGTFGVVYRAQNKRTDEIVALNRLKMEKEHQGFPITSLREIHMLLKCGAHPNIVNVRIGDFGLAREFGDPIKPYTPVVVTLWYRAPELLLGTKWPAKSEQNRRPIRDVGAGGGRAQQQPPPRPTGGFTLRFDAPKF

SEQ ID NO: 139468 - protein, 58 aa, Heterodera glycines
  Coding regions on vcDNA: vcDNA=SeqID_65891; Strand=+; Position=1 -113,397-460
MTLKTNPKVFYNNAKNKTEEFVICADEAESEECAGKYWALFDLSGPFSTEHLPNDPKK

SEQ ID NO: 139469 - protein, 137 aa, Heterodera glycines
  Coding regions on vcDNA: vcDNA=SeqID_65892; Strand=-; Position=1 -213,552-753
QASAEHYQKRIRLSLLINARVLVSLKTAIDLDDALFALDRAQLDPAELGGTVPLADKLQMSIDDLRQFHRSEGARVVILVLSNDEQQRLNADEHQSRRIIKGLDRLSASLFILHFAPRGAPPSAGPLSAQFNGSALG

SEQ ID NO: 139470 - protein, 458 aa, Heterodera glycines
  Coding regions on vcDNA: vcDNA=SeqID_65893; Strand=+; Position=1 -124,612-1085,1138-1266,1390-1739,1970-2269
MVSIGGNVQQINAVKTVFDQCLLMNTHASMLYGVYPLHTSAHILNQKIFSILVTGMFSTELSKRSHSSESLEYTFFVIKILAFVHQLKDKKSAKNKIEICWKVLSDSGETMTSNESIDVLKPILAEFEDQFGGTNKMPKNYQNLIQSYGKFLMEFLHLDEKFRSEFYERTAEREKLMNIFLIVDKEKTFLDNQFWKHFDVHSTENNVEEGSSNSEIKFMKKYKECPNVKQPNFLENSEIANEDKEAHALMKSYIDLMKNAQNVQTNGQMNKLTENLETNAAVWVSKEQINELLKFDESINDKSEEFIEKISQYKMEWYKMATKNGQNVDNYKLLFSFYKFLNTLIEDDELKLNKNWNLHKLILRVLPICAKNTCALSDEKMAAEFKQKMKNSQNWNDQIHFHALTQLINKFDEFTHVLCYGSGEISNNLMRERLSLIVPEKAFGAIEAFHPEIMGYRK

SEQ ID NO: 139471 - protein, 496 aa, Heterodera glycines
  Coding regions on vcDNA: vcDNA=SeqID_65894; Strand=+; Position=1 -199,449-949,993-1514,1565-1701,1744-1875
MSDDRKFDLNVAEGWDNIFPNLLNIDAMNINHEKKNEYKKWIGQLHKNAIIKLSREDNVFAQQLRKEYSSSENVLFRRFLVDLVGESKNDEEIWKTIQVDKSDEIVTENKFNNLNLIENLSPKKGTKEKIVEKSKCKNKKPKKKNKNTENIKKNENTSKIEDAIECENEIEPEQISEIRNKANSNEEIDHIFWGKSPNNSQTKFDGIKLANFEDENFVAKIFTQIFENFQKNPDNFVGLFSSAQLLHFGIYANEICNRIKLINQLKEALPEIGIDHIENIENEWDQLKSVDLSSLKNCNKLITTLFLLLKQIVAKMDKFEVPNEQIVNSNEENFVKHLLIRQKFAKFIVEQYEKHNWSNLSQENKIGIMKAIFVDENIDDELIEKYLLESIKMFIMNYEKFNSQIKMDKNIFEISKPNQFMEQNAKLYFEISKGWQEIDYDEKTSKTVKKFNKFKNVIEQNGYSDDDLTAKFKKTIELKSMFEQWVINRGYFIFKI

SEQ ID NO: 139472 - protein, 203 aa, Heterodera glycines
  Coding regions on vcDNA: vcDNA=SeqID_65895; Strand=-; Position=1 -258,336-628,693-753
MTATFFHHLRQMAPSILNECPSLRFVNFYAGDLFAEFPCDDSAAASDGQAFAKWLFTPLQNNVPKVFKCDSHNDDSLATKLDVFKLTFSSASSPVNFIVSIWFDASPLPIPVVPFSITNKSTGEQLMLKEIDDKSRRFLLIRCPIVRDADKWAKWEKEALGWHIRDQCNQMRINITGSDKIGDGLLNGLLGLSEWKLRNGRSV

SEQ ID NO: 139473 - protein, 71 aa, Heterodera glycines
  Coding regions on vcDNA: vcDNA=SeqID_65896; Strand=+; Position=1-216
MANEKGNFECENKEIKRSFESAVYNAFAEDILMGHLNALSNLLKPKKGEEKPIQMGKAEEQQKDGTNNWCK

SEQ ID NO: 139474 - protein, 99 aa, Heterodera glycines
  Coding regions on vcDNA: vcDNA=SeqID_65897; Strand=-; Position=1 -89,251-413,616-737,997-1051
QSDNAHLWQCHCYRCHLHHQTDLVQVAFEAFSQQSWDQRSRFVSPQKCRPSCAIRPDVVQPCQSLHFPAQFGLPNSASPFCDCRPSHCSLHLFIRHVYY

SEQ ID NO: 139475 - protein, 205 aa, Heterodera glycines
  misc_feature (8)..(8): Xaa can be any naturally occurring amino acid
  misc_feature (71)..(71): Xaa can be any naturally occurring amino acid
  Coding regions on vcDNA: vcDNA=SeqID_65898; Strand=-; Position=1 -338,629-797,3316-3382,3586-3634
  Homolog annotation: Hit_ID=CAE60144.1; Match level="QueryCoverage =91%, HitCoverage=27%, E-value=3e-34, Identity=43%"; Hit description =Hypothetical protein CBG03693 [Caenorhabditis briggsae]
VPVIIISXLIRCDSSQVPPTSSDSATSPPLSSASHFQQQQHSPFWARRAAGRNGRFGRCLPASYSIIGTLXPITALRVPLYRTVFSVVRFYSFWRTCTSFHRIVTMIEVIYFGGRSPRGLPDFQKRLFVQYLWRNAKPSDKARVQREFDPRRQRLLKYVTDTAARKRFKSFWQSTLLNLLMLERNGGKSEAKIKVGQSRQNGTNK

SEQ ID NO: 139476 - protein, 29 aa, Heterodera glycines
  Coding regions on vcDNA: vcDNA=SeqID_65899; Strand=+; Position=1-88
SDDLKAKRAHKQQKKQWERRKSTGKISSL

SEQ ID NO: 139477 - protein, 179 aa, Heterodera glycines
  Coding regions on vcDNA: vcDNA=SeqID_65900; Strand=+; Position=1-539
  Homolog annotation: Hit_ID=NP_702063.1; Match level="QueryCoverage =100%, HitCoverage=5%, E-value=2e-14, Identity=20%"; Hit description =hypothetical protein PF14_0175 [Plasmodium falciparum 3D7] gb|AAN36787.1| hypothetical protein [Plasmodiu
MALNSSAFQSLGLNPPTFQSMGLNSSAFQSLGLNPPTFQSTGLNPPTFQSTGLNPPTFQSVGLNPPAFQSLGLNSSAFQSLGLNPPTFQSMGLNSSAFQSLGLNPPAFQSLGLNSSAFQSLGLNPPTFQSMGLNRPAFNHWDSILLHFNHWDSTLQHFNRRDSIIRLSNRWDSTHQHSN

SEQ ID NO: 139478 - protein, 183 aa, Heterodera glycines
  Coding regions on vcDNA: vcDNA=SeqID_65901; Strand=+; Position=1-552
MKLFPLLLLIILFLIVKIGAEKKKLQQKSFGEIFGEKWQEKEEEKRNEQKKREIIEKYYKIKEKIKQKGRKYPTKEWDKINSKIAKKLGTNRNYIQKWIKELGLNQKKFYKSKSDEEKRQIIQKFIKMKNEFKQKRKYSAKEWHQNYAEICKKIGVGHDTIKKWKNQCGISCKITEKEKTGKN

SEQ ID NO: 139479 - protein, 18 aa, Heterodera glycines
  Coding regions on vcDNA: vcDNA=SeqID_65902; Strand=-; Position=1-54
MRIMRKAKCEKRNLGPSL

SEQ ID NO: 139480 - protein, 26 aa, Heterodera glycines
  Coding regions on vcDNA: vcDNA=SeqID_65903; Strand=-; Position=1-80
MAFFVEFYSSWCGHCIEYKPHFVRFA

SEQ ID NO: 139481 - protein, 175 aa, Heterodera glycines
  Coding regions on vcDNA: vcDNA=SeqID_65904; Strand=+; Position=1 -54,173-249,293-575,622-735
MANSNHNQLQQGQSALGNNVFCTDGTHNIQFLNGCVTQIGQPLPPLCLIVVSIDHRPEQQTPAGLLSVTNVVLRNADGHRIEASGWQTQAGVLASLSIGTAYWFMNCMARSRYQRLDCWYRIGVDGRNATIIPHPIHQQTTNARPNESVGLRHSIASILGEQIQVFTNQLKLCII

SEQ ID NO: 139482 - protein, 28 aa, Heterodera glycines
  Coding regions on vcDNA: vcDNA=SeqID_65905; Strand=+; Position=1-85
IFFVCVSNIVRLFDRARQEKATVGTKFA

SEQ ID NO: 139483 - protein, 91 aa, Heterodera glycines
  Coding regions on vcDNA: vcDNA=SeqID_65906; Strand=+; Position=1 -96,153-330
TAKLVPTVAFSCLALSNNLTIFETQQKKFLTKKWLSLFSHFFTAKLVPTVAFFCLALSNIFFLIFLPQTWYQQLPSLVWPYQTILRYLKRK

SEQ ID NO: 139484 - protein, 116 aa, Heterodera glycines
  Coding regions on vcDNA: vcDNA=SeqID_65907; Strand=+; Position=1 -51,325-624
MSAAEFSAKLRELTASKSTDVERMSKDFEEICSIREKCNDGKKRRLKIRLGPDVLVNRSLYELAVDPHSRCTEISWTSKTKRFSSYTIPSDGASSNLIPSDGVKLALSAQVITKYA

SEQ ID NO: 139485 - protein, 254 aa, Heterodera glycines
  Coding regions on vcDNA: vcDNA=SeqID_65908; Strand=+; Position=389 -441,927-1353,1400-1684
MHRPHNLKEAEGEVQKAIYFDPSVFTFIGLFNNRLPQSCTAMLDISNENVHILRHIMHSIWPTFKDAVSALRLTPCSFRLLRRFAPTMLCCCPGLQSIGFNSDILPEFPADDSAMVSDGQALAKWLFTPRRDNVPNNLLIEFANPVVVKSQWSAVEAIKTQFLAATSRVSFKLTLLNRQSADSSETVVPIVPFEPLHNAATGEQLTLEQQDANIYCIERLPIGGDKHDWVTHMLGELNKKNHFNLFFDESGVSL

SEQ ID NO: 139486 - protein, 217 aa, Heterodera glycines
  Coding regions on vcDNA: vcDNA=SeqID_65909; Strand=+; Position=1 -110,166-410,454-752
  Homolog annotation: Hit_ID=AAL93203.1; Match level="QueryCoverage =89%, HitCoverage=28%, E-value=1e-13, Identity=29%"; Hit description =transposase [Bactrocera dorsalis]
MHKQLFNIKLFYKEIDAVRTAMVYGLEKRFFDLRFKRCIAISTFLDPRFKDRLVMEDAEVFRERVRPWLFEEASIAFNQIENEENDLIATTSIESPPAKRNESFFAQMEEIANFAQEKTQIASQSDINSEFNELLSFDRAPINSDPFEWWKKHGPKLPMLSKLAMKYLSAPATSVPSEQTFKVARDVYDYRRSRLKPKTAEMLIFLNKAIPMLDYKY

SEQ ID NO: 139487 - protein, 74 aa, Heterodera glycines
  Coding regions on vcDNA: vcDNA=SeqID_65910; Strand=-; Position=1-273
  Homolog annotation: Hit_ID=AAS21248.1; Match level="QueryCoverage =87%, HitCoverage=10%, E-value=7e-09, Identity=43%"; Hit description =transposase [Anopheles gambiae]
SDPFEWWKKHGPKLPMLSKLAMKYLSAPATSVPSEQTFKVARDVYDYRRSRLKPKTAEMLIFLNKAIPMLDYKY

SEQ ID NO: 139488 - protein, 106 aa, Heterodera glycines
  Coding regions on vcDNA: vcDNA=SeqID_65911; Strand=+; Position=1 -155,337-416,567-650
  Homolog annotation: Hit_ID=AAC51180.1; Match level="QueryCoverage =94%, HitCoverage=71%, E-value=1e-25, Identity=47%"; Hit description =kruppel-related zinc finger protein
WPYFFQQRPMAQPKMAIKKRFSCTLCTKSFDWFSDLKRDMRVHTGEKPFVVKFCDKAFARKHHLDCHQRIHTGDRPYKCDHCGKRFSDGSAMKRHQRIHTGEKPYG

SEQ ID NO: 139489 - protein, 71 aa, Heterodera glycines
  Coding regions on vcDNA: vcDNA=SeqID_65912; Strand=-; Position=1-687
SSGYREATPEGFGLPINLGASVRGDCPENKNKSIFSSVRLGYSNNYGGAKIQRRIKVQAIGKLFRKDSVSP

SEQ ID NO: 139490 - protein, 80 aa, Heterodera glycines
  Coding regions on vcDNA: vcDNA=SeqID_65913; Strand=-; Position=1-242
  Homolog annotation: Hit_ID=XP_223980.2; Match level="QueryCoverage =100%, HitCoverage=8%, E-value=2e-18, Identity=56%"; Hit description =similar to RPGR-interacting protein [Rattus norvegicus]
GAHDEIEEGKEEEKKEEGADEEKKEEGEEEEKKGEGEEEEKKEEGEEEEKKEEGEEEEKKEEGEEEEKKGEGEEEEKKKS

SEQ ID NO: 139491 - protein, 122 aa, Heterodera glycines
  Coding regions on vcDNA: vcDNA=SeqID_65914; Strand=+; Position=1 -118,256-393,554-665
MERKTVGRTVTRDTATTSAKDMNMVGYGGGAYGDYGKGYARRKGRLHTAAKSTNCNSRANTVDLSTSTATESITTTVRQSNAIKFASENANAYQQQKKVYSPYKARYYTRQFCRYTAASSPR

SEQ ID NO: 139492 - protein, 54 aa, Heterodera glycines
  Coding regions on vcDNA: vcDNA=SeqID_65915; Strand=-; Position=1 -54,533-643
MSDEEFEEIERIVLGLDEPDTDLYDRVAYLDMVKQHQQEQRRKLAMLREVERYF

SEQ ID NO: 139493 - protein, 95 aa, Heterodera glycines; identical to SEQ ID NO: 128262
  Coding regions on vcDNA: vcDNA=SeqID_65916; Strand=-; Position=1-662

SEQ ID NO: 139494 - protein, 24 aa, Heterodera glycines
  Coding regions on vcDNA: vcDNA=SeqID_65917; Strand=+; Position=1-80
RTLSTAVRQRSSKIYSMPQILLAG

SEQ ID NO: 139495 - protein, 24 aa, Heterodera glycines
  Coding regions on vcDNA: vcDNA=SeqID_65918; Strand=+; Position=1-80
RTLSTAVRQRSSKIYSMPQILWAG

SEQ ID NO: 139496 - protein, 33 aa, Heterodera glycines
  Coding regions on vcDNA: vcDNA=SeqID_65919; Strand=-; Position=1-101
VSSAVLLHIYLYFNLSSINLFICSSLRHFGDRT

SEQ ID NO: 139497 - protein, 507 aa, Heterodera glycines
  misc_feature (122)..(122): Xaa can be any naturally occurring amino acid
  misc_feature (133)..(133): Xaa can be any naturally occurring amino acid
  misc_feature (196)..(196): Xaa can be any naturally occurring amino acid
  Coding regions on vcDNA: vcDNA=SeqID_65920; Strand=-; Position=1 -338,388-1561
  Homolog annotation: Hit_ID=NP_491240.1; Match level="QueryCoverage =100%, HitCoverage=38%, E-value=3e-78, Identity=35%"; Hit description= zn-finger, CCHC type and RNA-directed DNA polymerase  and Integrase, catalytic domain containing protein
LNKEQFNCLMLLTALKSHNDSALRKDFVEAFSGRGEITYDGVVEDLINFQATIVEAKAIEAPTNWRNVNAVNRPVKQNNSPKMQVAKVPEKRQANKCWRCGAADHWGSECRSNVKVCNNGGXSNVKVCNNGGXRPKENGCELVIYNGMVNPKNDADSLRTKIRFNQKPIAFALDTGSDVNVVDEDSHLEAGSPPIXKCTEIGRAFDGTPIRFIGKGFGTFEFGGILIANEPFYVAKRGSLNLLAAKQWTNLDLDGIKQRISEHVINSCRATDQIGKHILELRKEFPGVCEDALGHCIKEKAQLKLKEGVAPIYRKARPVPHHSKEVIERELDRLEGLGIIRKVEHLDWAAPILVVKKADGNARLCIDYSTGLNDALIDYQHPLPIPEDIFATLKGQFFSQIDLKDAYFQVELDDESKKLCGLSTHKGNFAMERLPFGVKAAPSIFQSIMDKMLAGLNFATAYLDDIIVASRSFTDHIQHLKDVFSRLQSYGFRVKMTKCTFFQRKLS

SEQ ID NO: 139498 - protein, 76 aa, Heterodera glycines
  Coding regions on vcDNA: vcDNA=SeqID_65921; Strand=+; Position=1 -73,136-198,933-1025
MPLIVLLIAFLISDVTFAMENEKNGKPSAPADGKAPSPSSEPPQNESSFETPKAPLKGDDEDSSPKCPGAPLKATQ

SEQ ID NO: 139499 - protein, 224 aa, Heterodera glycines
  Coding regions on vcDNA: vcDNA=SeqID_65922; Strand=+; Position=1-672
  Homolog annotation: Hit_ID=EAL49477.1; Match level="QueryCoverage =100%, HitCoverage=53%, E-value=4e-50, Identity=42%"; Hit description= hypothetical protein 42.t00003 [Entamoeba histolytica HM-1:IMSS]
KEEVKKPEEKRQKEAEEEKRIEEQEKRRKAEEEKTEEKKPKEAEEEKRMEEEEKRRMDGEEKRRKAEEEKPEEKKRKKAEEKKRTMNEEHKKRMDGEEKRRKVEEEKPEEKNPKEAGEEKRMDEEERRRKAEEEKPEEKKPKEAEEEKRMEEEEKRRMDGEEKRRKETEEQRRNEEKKRKKAEEKKRLDEEEKRRMDGEEKRRKEVEEEKQKDEEEMRQKAKEE

SEQ ID NO: 139500 - protein, 25 aa, Heterodera glycines
  Coding regions on vcDNA: vcDNA=SeqID_65923; Strand=-; Position=1-79
NCRKPCMDNFFSLRWLPTDPTVPFG

SEQ ID NO: 139501 - protein, 53 aa, Heterodera glycines
  Coding regions on vcDNA: vcDNA=SeqID_65924; Strand=-; Position=1-161
MKVTRKKANDANGWGHGKTEGHSLSVLTFFMSFPCYLLFFPSAALTSLIRLIV

SEQ ID NO: 139502 - protein, 222 aa, Heterodera glycines
  Coding regions on vcDNA: vcDNA=SeqID_65925; Strand=+; Position=1 -141,175-368,442-515,568-606,691-784
  Homolog annotation: Hit_ID=NP_491372.1; Match level="QueryCoverage =95%, HitCoverage=86%, E-value=5e-37, Identity=43%"; Hit description =BBP-like protein 2 (1F16) [Caenorhabditis elegans] gb|AAL08031.1| Hypothetical protein C41D11.9 [Caenorha
SSAFQLLPGGCVLCSECALSAVFALRFPSVCLLGDFIVVNCTQSAACANVPAVVRLQAKCRFCWQLEQSEIMCEACANVPAVVRLQAKCRFCWQLEQSEIMCEERKNCSTNELTLYMIKCWEKPNAIYAGRRHFFKNVRTHWTSGHSWRKALFLSFTLGGFGVDRFYLGYRKSAIGKLFYLGYRKSAIGKLFSFGGLGVWTLLDIVLIDFGYIQPADESLYI

SEQ ID NO: 139503 - protein, 207 aa, Heterodera glycines
  Coding regions on vcDNA: vcDNA=SeqID_65926; Strand=+; Position=1-621
MPGKTSFYTFGSRLPAQQMICRVIAAAEEGKDECQTTLLLDPGSHVDGADTELIQQLEPQPIDKRPLTVQVFGGKKQRIRSATYRLRLKRTDGKLESIEVSEVPQICTPIRTELIESGATPDSDPRTITQTTQPQIMIGIRKFWDYVVGFRKIESGAHVIDTVFGQVLCGEGTQASSGATPAASILTTMPCGNIHQTRTNKRQQIGE

SEQ ID NO: 139504 - protein, 71 aa, Heterodera glycines
  Coding regions on vcDNA: vcDNA=SeqID_65927; Strand=-; Position=1 -67,311-459
MSASHSQKNPELNMKCMCYGQPVGPLERSLNLQPICLLNGRLTSYTHRAREDEKLDNSKMTVFNSTYFKGK

SEQ ID NO: 139505 - protein, 189 aa, Heterodera glycines
  Coding regions on vcDNA: vcDNA=SeqID_65928; Strand=+; Position=1 -70,154-480,763-935
MKLLFYSLLFTVLLLFADYAFGYGKQPKTGLERRPQWGLELNSKADGKLGQNKFWDRYGRPASHGIWHGSVALLTRNGHEWARAKQQFGRIGHGGGFNGQPGKGTRENEMEKYKQEQAEKQKKKGGGSTDRKINNYSFTFIYFFANIALFRRPRLRPPHFAFRLAQMPNSLALSNAQSLCPPFPTEIQN

SEQ ID NO: 139506 - protein, 47 aa, Heterodera glycines
  Coding regions on vcDNA: vcDNA=SeqID_65929; Strand=-; Position=1 -35,166-272
LILHSDWHKCQIRWHFQMRNHFALRFQQKFKIELTSEKVHKRDAEYS

SEQ ID NO: 139507 - protein, 55 aa, Heterodera glycines
  Coding regions on vcDNA: vcDNA=SeqID_65930; Strand=+; Position=1 -99,187-255
MGMNIMLLNAINVDLPNRSAFVTGGRSKPFVTEERYTNRWATVLKIETLQEYHGI

SEQ ID NO: 139508 - protein, 89 aa, Heterodera glycines
  Coding regions on vcDNA: vcDNA=SeqID_65931; Strand=-; Position=1 -68,216-312,531-638
  Homolog annotation: Hit_ID=NP_506031.1; Match level="QueryCoverage =74%, HitCoverage=14%, E-value=1e-24, Identity=71%"; Hit description =Alpha-N-Acetylgalactosaminidase precursor (51.4 kD) (5M569) [Caenorhabditis elegans] emb|CAB00120.1| Hypo
MNVFILLFSIISMAYSLDNGLARTPPMGWMSWTKFYCQTDCAKHPFSCINEQLYMDMADRLAEDGFREVGYQFVHIDDCAEKADSQGRI

SEQ ID NO: 139509 - protein, 95 aa, Heterodera glycines
  Coding regions on vcDNA: vcDNA=SeqID_65932; Strand=-; Position=1 -11,76-352
MNRRWICSDVWMDILPSFDHAQLGLKMALLSDRFDALVDMHFDGKSELTIWKEISINKDEGPTPKLSERIDGKRVAFPLPDRPLPTKIRFRDLWI

SEQ ID NO: 139510 - protein, 46 aa, Heterodera glycines
  Coding regions on vcDNA: vcDNA=SeqID_65933; Strand=+; Position=1 -36,291-395
MNLKTMTQVSSKKKIEELRICVKDAKRKRSIGCQILLTLMDKTLKV

SEQ ID NO: 139511 - protein, 19 aa, Heterodera glycines
  Coding regions on vcDNA: vcDNA=SeqID_65934; Strand=+; Position=1-63
FGREILFFETKLKTYITYI

SEQ ID NO: 139512 - protein, 23 aa, Heterodera glycines
  Coding regions on vcDNA: vcDNA=SeqID_65935; Strand=-; Position=1-69
MYSMIYISDTIVSKNEYGKKEYT

SEQ ID NO: 139513 - protein, 33 aa, Heterodera glycines
  Coding regions on vcDNA: vcDNA=SeqID_65936; Strand=+; Position=1-101
FSIFEKESCIERFSRDVHTNDDDDDDNNDDDDD

SEQ ID NO: 139514 - protein, 260 aa, Heterodera glycines
  Coding regions on vcDNA: vcDNA=SeqID_65937; Strand=+; Position=1 -56,407-551,606-699,744-966,1228-1492
MTAKQLIKAMKRNYLALQKAVEIVRSTKETAKISLNHIDAQISIISIGNLFFNVFVRLRSPKIENVKAFQSSLCVQNCPDGAKMDKYSAFLNSNKENKELCSKIVGELTAKDGEDKSANRRHNWISSICEKDLAKASAAKATKNAFPTTHWLNSLIYAATEIEVASVNGQFYNDSRQTIDKIFDGDPLSKNDKVSPFIDSGRLSDKKAINGHQNKAKEFEWLPHSKHKYFSSKAYDKSLSLALPSLLIFLQICFIIYYVY

SEQ ID NO: 139515 - protein, 113 aa, Heterodera glycines
  Coding regions on vcDNA: vcDNA=SeqID_65938; Strand=-; Position=1 -203,284-422
MDKHRLFKSLSAIMLFVVGSYFFICVFVLLASSMPSQPFFTFHVFPSILALLTCVAASSNAPLLFIFSKDYRLAFRKQFAEWPLIGKWLNRIGNVQVNVVRNVNMNVSSTIPL

SEQ ID NO: 139516 - protein, 71 aa, Heterodera glycines
  Coding regions on vcDNA: vcDNA=SeqID_65939; Strand=+; Position=1 -59,231-387
MTSKSQFRKWKNMAKESQIRLLTNDCVQKGAVEEQTGQRKKPPEKRGKEQLHGEHSMAKPSKCPKLTITNN

SEQ ID NO: 139517 - protein, 16 aa, Heterodera glycines
  Coding regions on vcDNA: vcDNA=SeqID_65940; Strand=-; Position=1 -11,64-103
MIISKNMKDRIELTQK

SEQ ID NO: 139518 - protein, 33 aa, Heterodera glycines
  Coding regions on vcDNA: vcDNA=SeqID_65941; Strand=+; Position=1 -29,1230-1302
MHPKRMAKFCSTITSLPTIDLKKEKKSICQVTI

SEQ ID NO: 139519 - protein, 26 aa, Heterodera glycines
  Coding regions on vcDNA: vcDNA=SeqID_65942; Strand=+; Position=1-81
AIVATKRKKKKKKKKRIKATEMSSAD

SEQ ID NO: 139520 - protein, 107 aa, Heterodera glycines
  Coding regions on vcDNA: vcDNA=SeqID_65943; Strand=+; Position=1 -225,266-364
MGSLTYSDGDDDEAPVQGTHSASLRSAPLFNFVNAAPFGVHGWLAHFGKPYIGTTQFEIDRGAEAFEPNADVGAMGYSEALITNFNKMINFPKKNPIQTILFYYRIW

SEQ ID NO: 139521 - protein, 80 aa, Heterodera glycines
  Coding regions on vcDNA: vcDNA=SeqID_65944; Strand=-; Position=1-243
AFLRATNSSVNFIIHFELFEPKPIEPFELVNEQTKEKLTLSKESENNWVMKRCQIGQIVQWKDEKLNNVSIILSGVNCIG

SEQ ID NO: 139522 - protein, 71 aa, Heterodera glycines
  Coding regions on vcDNA: vcDNA=SeqID_65945; Strand=-; Position=1 -184,270-301
MFISGTFSCDAFYNDAFFADAFSTDAFSTDRFSGHEADFTIIMNLFLFFAIFHATFLPLTYFYWGINSRAV

SEQ ID NO: 139523 - protein, 15 aa, Heterodera glycines
  Coding regions on vcDNA: vcDNA=SeqID_65946; Strand=+; Position=1 -33,193-207
MIIRIAHSMEKSMVF

SEQ ID NO: 139524 - protein, 203 aa, Heterodera glycines
  Coding regions on vcDNA: vcDNA=SeqID_65947; Strand=+; Position=1-612
MADKTTINLILQRLEVIERKVNNNNNAVPVQLNEQLQSIVDRLCDIERKIDTANNTNCNATDSEDKERKRSLVLIGLPESTKEKPTERAKEDADMVSNVLDALDVEVCPQMVYRMGRRNDGKRRGSRLVKVVLPASTFQRFALAQWGRRRNVLRAKNEEWDRLLVRPSLTKEEQKAEHEARVKKREEYEQKRDGVTIRGQKNN

SEQ ID NO: 139525 - protein, 63 aa, Heterodera glycines
  Coding regions on vcDNA: vcDNA=SeqID_65948; Strand=-; Position=1 -13,576-754
MVQLDKLTAILGEKVPSLSDEAANWPMLRRADAINFRLEQWANATCSKLYLAISVGGNENKIK

SEQ ID NO: 139526 - protein, 165 aa, Heterodera glycines
  Coding regions on vcDNA: vcDNA=SeqID_65949; Strand=-; Position=1 -156,206-321,445-512,564-662,900-955
  Homolog annotation: Hit_ID=NP_492511.2; Match level="QueryCoverage =80%, HitCoverage=29%, E-value=9e-33, Identity=46%"; Hit description =putative protein family member, with at least 3 transmembrane domains, of ancient origin (1K45) [Caenorha
MPFRRDEYGGQWNSEETVSINPWFYEDEEAEDADAAKQISPLTMAGVVLAYLALGAILLPLFKGQFDFVNGLFYSYLCFTAIEYGHLIPENDAFIPFVLLYMCVGLAISTIALDIGSNYVKKLYYLGKRATSIAHASFFYGGKQLRGQAIGISEDALEKVDLDRM

SEQ ID NO: 139527 - protein, 201 aa, Heterodera glycines
  Coding regions on vcDNA: vcDNA=SeqID_65950; Strand=-; Position=1-606
MGRPREQLVGEQEEILGHASAVQEFHPLMRKLNERQKVSAKLLLGNECCLIYQNAPPGVGKTYVASIVAAILLSINENVKIAIVTSANLPLAKLAQELDEVLGSDEMEESGSIAFFSGYAKEKYREMVEKLKRHILVSKLTSEEIQSKLEERSEENHDKRDVREYRQNYELRPRLTQERKMASLYAPSGELENCFRYGIYG

SEQ ID NO: 139528 - protein, 283 aa, Heterodera glycines
  Coding regions on vcDNA: vcDNA=SeqID_65951; Strand=+; Position=1 -613,2632-2814,2861-2914
MPVQITNEQSQYPQQQPQQLPQSPSSDSDQKEQLQPVPVSTQEETSQQVQPASPVAEPSEAAEAATEVPAPSGSAATGYGGAESPAAAGDRLQEVQEEPNAADELSATTNEVQKPNKTMNLDNFDFSQQEEKSKTDRTEQKAKHQQTTAEQSPIGAEATAANASAKTNNENADLFVEPIDVSQLQLTNDTECNSEELRRIITNVGDIVRIIDEDEGKGYFAQTVAFITDDYTNQFAMVIWLLPKLSRNSFPKPFEFNADRFQHGFAEERPVPIKACKKIPISK

SEQ ID NO: 139529 - protein, 123 aa, Heterodera glycines
  Coding regions on vcDNA: vcDNA=SeqID_65952; Strand=+; Position=1 -106,157-272,321-468
  Homolog annotation: Hit_ID=CAE71051.1; Match level="QueryCoverage =99%, HitCoverage=21%, E-value=2e-15, Identity=35%"; Hit description =Hypothetical protein CBG17893 [Caenorhabditis briggsae]
MANRQSNVLAPDECSNLTRNTRSIVRHFEAFVRKFGEEPFDEFERKGFWKMLTVKDFSGDTMIIVTVHPHPNSEITDNAKTKLREFFLPSDPFRDEAAQFNVTSFYWQEQANAGDERIYEHVA

SEQ ID NO: 139530 - protein, 49 aa, Heterodera glycines
  Coding regions on vcDNA: vcDNA=SeqID_65953; Strand=-; Position=1-192
CRFVCSHMAEPLALDPYRKYRNVHMLIPCYFLFCTNELKIFVLFSRINR

SEQ ID NO: 139531 - protein, 212 aa, Heterodera glycines
  Coding regions on vcDNA: vcDNA=SeqID_65954; Strand=+; Position=1 -39,129-165,252-293,395-473,522-570,616-720,882-1067
  Homolog annotation: Hit_ID=CAG09701.1; Match level="QueryCoverage =93%, HitCoverage=26%, E-value=4e-27, Identity=38%"; Hit description =unnamed protein product [Tetraodon nigroviridis]
GGGEGPPPPPPPPVVLDVCCGAGTVSNSFLVSYKKIEKICCVGICVGIELNREAVRDARKNASENGFDANCVYIDGEAEKIFKELEANCVYIDGEAEKIFKELEYHMPFGCPLNSYHMPFGCPLNSSQIFGVIDPPRAGVSDKVIIGCRRLNSLRTLCYVSCDPKAATKNLIDLCRPPSRKFDGDPFRIVDIQPVDLFPQTEHVEWVIKLKR

SEQ ID NO: 139532 - protein, 238 aa, Heterodera glycines
  Coding regions on vcDNA: vcDNA=SeqID_65955; Strand=-; Position=1 -368,479-826
MSAKIIRVPKIACDLSLEKNGVSKNRNYAQKASQTILALPIPSTIAFIHPIMSAKIIRVPKIACDLRLAKNGVSKNRNYAQKAFQPILALPIPSTIAFIHPIMNAKIIRVPKIACDLSLEKMVVPKIACDLSLAKNGVSKNRNYAQKASQTILALPIPSTIAFIHPIMSAKIIRVPKIACDLSLAKNGLSKNRNYAQKASQTILALPIPSTIAFIHPIMSAEIIRVPKIACDLSLEKM

SEQ ID NO: 139533 - protein, 102 aa, Heterodera glycines
  Coding regions on vcDNA: vcDNA=SeqID_65956; Strand=-; Position=1 -105,449-651
MHDANAHWVEGDCVFIANATTTRMIIPRGNNGGFEEVPVPTVAQPSYVLGFRGTIHFNGTLSDNALAFFRHALPPPTTLYRFSVLDEFYRANGLLSPFKTTE

SEQ ID NO: 139534 - protein, 48 aa, Heterodera glycines
  Coding regions on vcDNA: vcDNA=SeqID_65957; Strand=-; Position=1-147
HPHVQANVWQGTDPGVEKRTNRRLRTLNYCTYGTAGSVRRRTIAPFDG

SEQ ID NO: 139535 - protein, 46 aa, Heterodera glycines
  Coding regions on vcDNA: vcDNA=SeqID_65958; Strand=-; Position=1 -55,98-183
MYGATPRAIEYAEKATCFVSSDEMEFDLPNVGSFQRAEKSFAGNAI

SEQ ID NO: 139536 - protein, 44 aa, Heterodera glycines
  Coding regions on vcDNA: vcDNA=SeqID_65959; Strand=+; Position=1 -33,187-285
MAGPGRLPNFLGVRNAVMENGLRNRNRRGRLKRVSLKKKAQIPR

SEQ ID NO: 139537 - protein, 44 aa, Heterodera glycines
  Coding regions on vcDNA: vcDNA=SeqID_65960; Strand=-; Position=1 -95,117-154
IITFVPLLITIVPLLITFLPLLITFILLLSLLYLFKSHLYLFIK

SEQ ID NO: 139538 - protein, 296 aa, Heterodera glycines
  Coding regions on vcDNA: vcDNA=SeqID_65961; Strand=+; Position=1 -228,418-461,508-538,876-1059,1219-1321,2611-2702,2751-2807,2873 -2911,3293-3404
  Homolog annotation: Hit_ID=NP_498637.2; Match level="QueryCoverage =48%, HitCoverage=25%, E-value=2e-27, Identity=48%"; Hit description =neurotransmitter-gated ion-channel subunit family member (3I480) [Caenorhabditis elegans] gb|AAA19062.2|
MTPNLLAFCLCPIPQIKCQFFVCLITNLNSDQPSDKSSGDQFLGRLFLRRPFRLCAHYAWRFVTACVDVSVWQCATCLDVWMIFSVIFIFMTLVELSIICQLNRWERERQIGSKVLGHWLNQIRKTRKQTGRASDYSGGSGADGSGAGGGIRKRFLLSPLKRITHSPSPSPPPRAQIQNALSISRSATATDLPSKEKSPPSPILGRQMCNNNNNNNNNITAATGGGEMIRVSSVSRWATFREGFAGAGGGDTRTAGSEEAKAPLFEDNLAPAEEAEPVQLEARMVHPFGPSGPQMD

SEQ ID NO: 139539 - protein, 25 aa, Heterodera glycines
  Coding regions on vcDNA: vcDNA=SeqID_65962; Strand=+; Position=1-80
LFPLSYLVFNLTYCIYYLGKIGRPL

SEQ ID NO: 139540 - protein, 168 aa, Heterodera glycines
  Coding regions on vcDNA: vcDNA=SeqID_65963; Strand=-; Position=1 -99,144-181,476-599,696-778,857-923,975-1069
  Homolog annotation: Hit_ID=CAE59982.1; Match level="QueryCoverage =100%, HitCoverage=18%, E-value=4e-38, Identity=42%"; Hit description= Hypothetical protein CBG03474 [Caenorhabditis briggsae]
MSIGIFAAQLRLRAKQIFCISPSTINTCGAINTVCFDKTGTLTEDGIDKELNGDPLDLVLFRKTGWIMDEPTESAVVDETSMYDMLQPTVVRSPPLHSAVESDVELAIIRQFTFSSSLQRMAVVVHNPNEDSHIHHLYCKGAPEKIASLCVPETVPNDFQTYVDNYAQ

SEQ ID NO: 139541 - protein, 44 aa, Heterodera glycines
  Coding regions on vcDNA: vcDNA=SeqID_65964; Strand=-; Position=1 -3,456-587
MRRIVMIVFKFVKDWTTQNQSVINNRSRWTNATETIKMEINFNY

SEQ ID NO: 139542 - protein, 104 aa, Heterodera glycines
  Coding regions on vcDNA: vcDNA=SeqID_65965; Strand=-; Position=1 -258,315-371
MWWFHEIPTPPPPQFLPTQQGRLKMRYQGHDYYKKFEGANGQVYWNCVRFPQRLGACKGKAQVVNGIVRQRIRTTIRLTIIRLPRNDPKCDNTQETVDRTQPKN

SEQ ID NO: 139543 - protein, 72 aa, Heterodera glycines
  Coding regions on vcDNA: vcDNA=SeqID_65966; Strand=-; Position=1-217
MDGTAAVPGTSQQPPFGTATDMAHFSNALQLRQLQLLQLQKQQQAAQVAKNLSFLVQQQQTVRSGEIGYFTQ

SEQ ID NO: 139544 - protein, 86 aa, Heterodera glycines
  Coding regions on vcDNA: vcDNA=SeqID_65967; Strand=-; Position=1 -231,286-315
MNPKNFVPFGLKSKKMRPNSLKLTLPWTHLTSGLTHRICSAMNRNRSSLFGLKFFAKGWNPIAMNGLNWTKIFLPKLLVMNGGCYD

SEQ ID NO: 139545 - protein, 187 aa, Heterodera glycines
  Coding regions on vcDNA: vcDNA=SeqID_65968; Strand=+; Position=1 -187,336-712
  Homolog annotation: Hit_ID=NP_508993.2; Match level="QueryCoverage =92%, HitCoverage=26%, E-value=3e-27, Identity=34%"; Hit description =fatty ligase long (79.9 kD) (XG556) [Caenorhabditis elegans] gb|AAA80409.2| Hypothetical protein C46F4.2
MPNQKDGVTGGKRIEQELAVFDLPFYIVALAFFLKAFFRLYDLLVFVPFKLFADPELEKERSRLSDAWQNLGQSGTVSNWLYLFIHAFMFELRLHRGHNCMGTRDILNVVEEQQPDGKAFQKLALGKCNWMNYEHVDEVIVEVASGLSNLGIVQGQKVVIFSETRKEWMISAIACFKLGLPSALYYK

SEQ ID NO: 139546 - protein, 56 aa, Heterodera glycines
  Coding regions on vcDNA: vcDNA=SeqID_65969; Strand=+; Position=1 -32,120-258
MNYITKNERAKIFGQKGKQQINVESANGTLRFSEGLCLLKSGTLIRCPSRAMSRPS

SEQ ID NO: 139547 - protein, 22 aa, Heterodera glycines
  Coding regions on vcDNA: vcDNA=SeqID_65970; Strand=-; Position=1-66
MAIYFFEKFSMQQTLSNMKRSA

SEQ ID NO: 139548 - protein, 40 aa, Heterodera glycines; identical to SEQ ID NO: 130849
  Coding regions on vcDNA: vcDNA=SeqID_65971; Strand=-; Position=1 -66,123-179

SEQ ID NO: 139549 - protein, 29 aa, Heterodera glycines
  Coding regions on vcDNA: vcDNA=SeqID_65972; Strand=-; Position=1 -66,123-146
MAISFFEKFSMQQTLSNMKRSAKNGYLFF

SEQ ID NO: 139550 - protein, 29 aa, Heterodera glycines
  Coding regions on vcDNA: vcDNA=SeqID_65973; Strand=-; Position=1 -66,123-146
MAIYFFEKCSMQQTLSNMKRSAKNGYLFF

SEQ ID NO: 139551 - protein, 93 aa, Heterodera glycines
  Coding regions on vcDNA: vcDNA=SeqID_65974; Strand=+; Position=1 -10,477-553,609-749,921-974
MDGGLLANNPSLELLDEISKENALAKQHNEPQYELECFVSLGTGKAPTEPVGTTSLEIGTELIGAIKNLAGILMDQASHSPGKKYGFPYNWNP

SEQ ID NO: 139552 - protein, 59 aa, Heterodera glycines
  Coding regions on vcDNA: vcDNA=SeqID_65975; Strand=+; Position=1 -78,643-744
MMILANGAGPNATDSAAMLPLAHVLEKKKTGTKSEESTVKKPECVDVEEAIRNECSKWH

SEQ ID NO: 139553 - protein, 190 aa, Heterodera glycines
  Coding regions on vcDNA: vcDNA=SeqID_65976; Strand=+; Position=1 -114,675-849,1316-1392,1448-1582,2217-2288
  Homolog annotation: Hit_ID=NP_872170.1; Match level="QueryCoverage =56%, HitCoverage=11%, E-value=6e-14, Identity=38%"; Hit description =ankyrin and patatin family member (5V188) [Caenorhabditis elegans] emb|CAD54162.1| Hypothetical protein W
MLIEMESLMYGEGLQAGGHEKNFVQKNFNWVIGTSTGAIVYYRNIRWPKTFPTCQIRNFTSDLNEYNPYKTNIWLAARYSSAAPTYFESRDKFMDGGLLANNPSLELLDEISKENALAKQHNEPQYELECFVSLGTGKAPTEPVGTTSLEIGIIGAIKNLAGILMDQPQQQPAPMSIYERFNKEVCEKNP

SEQ ID NO: 139554 - protein, 59 aa, Heterodera glycines
  Coding regions on vcDNA: vcDNA=SeqID_65977; Strand=+; Position=1 -78,639-740
MMILANGADPNATDSAAMSPLAHVLEKKKTGTKSEESTVKKPDVWMLRKQFGRSGSKWH

SEQ ID NO: 139555 - protein, 89 aa, Heterodera glycines
  Coding regions on vcDNA: vcDNA=SeqID_65978; Strand=+; Position=1 -77,132-272,446-499
LLANNPSLELLDEISKENALAKQHNEPQYELECFLSLGTGKAPTEPVGTTSLEIGTELIGAIKNLAGILMDQASHSPGKKYGFPYNWNP

SEQ ID NO: 139556 - protein, 49 aa, Heterodera glycines
  Coding regions on vcDNA: vcDNA=SeqID_65979; Strand=+; Position=1 -78,958-1029
MMILANGAGPNATDSAAMSPLAHVLEPQQQPAPMSIYERFNKEVCEKNP

SEQ ID NO: 139557 - protein, 239 aa, Heterodera glycines
  Coding regions on vcDNA: vcDNA=SeqID_65980; Strand=+; Position=1 -78,643-849,1362-1475,1684-1826,2183-2358
  Homolog annotation: Hit_ID=XP_394049.1; Match level="QueryCoverage =68%, HitCoverage=21%, E-value=4e-20, Identity=35%"; Hit description =similar to CG6718-PB [Apis mellifera]
MMILANGADPNATDSAAMSPLAHVLEKKKTGTKSEESTVKKPECVDVEEAIWKEWQQMALKTRRNEQRKTPRRTGMGVRALSLDGGGIRGIVLVQMLIEMESLMYGEGLQAGGHEKNFVQKNFNWIIGTSTGAIVALALVSGTSLIDALRLYLRLKDSVFGARAQLIGYNAQNLETFLQAQLFTTATYVGQKPPRLVKFRNFTSDLNEYNPYKTNIWLAARYSSAAPTYFESRDKFMDG

SEQ ID NO: 139558 - protein, 44 aa, Heterodera glycines
  Coding regions on vcDNA: vcDNA=SeqID_65981; Strand=+; Position=1 -62,170-242
MNVKLSDGKGSFADRVLLMERLCPMVNKMGVAANKSNLIMQPLE

SEQ ID NO: 139559 - protein, 132 aa, Heterodera glycines
  Coding regions on vcDNA: vcDNA=SeqID_65982; Strand=-; Position=1 -199,584-783
MSPPASNLASPYPSSAQPTRRQRKDRPQLSDSCPDHLLPQFCQSVRANPPAPCIGPEWPLAERGGENQPHGPNRSDHGPNSVGQTVVADQCSAVPRPQPPEGPSVGGDAFAHRKADAFLCQSVENCVIKMAK

SEQ ID NO: 139560 - protein, 415 aa, Heterodera glycines
  Coding regions on vcDNA: vcDNA=SeqID_65983; Strand=+; Position=1 -85,645-898,1202-1372,1707-1730,1902-1935,2042-2160,2211-2251,2585 -2637,2698-2777,3254-3468,3971-4114
  Homolog annotation: Hit_ID=NP_509361.1; Match level="QueryCoverage =98%, HitCoverage=62%, E-value=1e-138, Identity=63%"; Hit description= methylenetetrahydrofolate dehydrogenase (XI700) [Caenorhabditis elegans] ref|NP_509360.1| methylenetetra
KFFPLYRLHEATQSDEALFNRLVPKNKEGKRPLCDAQKRRLQRLGLPAVEDAEQLSTDQRRQFARLNLDRDQIYLGRVVDLNDRMLRRVEIGHGPQEQKHKRTTEYAITVSSELMAILAQCMGLADLRERIGKIVVANDRDMNPITADDLCVAGALAVLMKDTVKPNLMQTLEGTPVFVHSGPFANIAHGNNSSILADQVALKLVGSDGFVITEAGFGADIGMEKFFNIKCRTSGLCRTSGLWPNAVVIVTVRALKMHGGGPPVVPGNPLNPLPFEYLNPNLELVAKGCDTNLRKQIENAQLFGVPVLICVNKFGTDSDDELGLVVDKARQFGAEAEVSDHWARGGAGAIKLAETLIKVCQRMPPPAKFLYSLEESIEQKCRIIATKIYGAKDIEFSDEAKRKAEQFKCQGFAGL

SEQ ID NO: 139561 - protein, 133 aa, Heterodera glycines
  Coding regions on vcDNA: vcDNA=SeqID_65984; Strand=+; Position=1-402
  Homolog annotation: Hit_ID=EAA22695.1; Match level="QueryCoverage =56%, HitCoverage=2%, E-value=4e-09, Identity=40%"; Hit description =hypothetical protein [Plasmodium yoelii yoelii]
MENGKRQSEQSQRMEATKTEEKKPLKQIMFLDDYEQVQGEEEGNEMANGREGQRREGGKEGEEEEKEEEAFEEEENEEEEEMFFFKPSGGHALSKDKRTRKWAIPKGHSVLRVPQGYFPNPPNWRLLTKKALF

SEQ ID NO: 139562 - protein, 86 aa, Heterodera glycines
  Coding regions on vcDNA: vcDNA=SeqID_65985; Strand=-; Position=1 -62,356-723
KNRFILFFGAVPPNRCAQIYGETESFGNSFPIACTLILRWIFAPHNCLSTPNGHLKKSIFLFSGQSPRTDAPRFMGRPNPSGIASL

SEQ ID NO: 139563 - protein, 124 aa, Heterodera glycines
  Coding regions on vcDNA: vcDNA=SeqID_65986; Strand=-; Position=1 -50,100-247,298-474
MVFTGIDRLIGIAFLEFYDNLKKRLYLALLTILSVVYGVCFSASVYQNAIMEGDELTTGSYGDFLKNKSILNTISFMLISMSFIIYVCLGIVVHLKASGKKRKEKAYGPLVGNEIADTSLHCIQ

SEQ ID NO: 139564 - protein, 79 aa, Heterodera glycines
  Coding regions on vcDNA: vcDNA=SeqID_65987; Strand=+; Position=1 -19,68-160,240-367
  Homolog annotation: Hit_ID=NP_495749.1; Match level="QueryCoverage =93%, HitCoverage=13%, E-value=2e-20, Identity=60%"; Hit description =nucleostemin (62.3 kD) (2I572) [Caenorhabditis elegans] emb|CAA88860.1| Hypothetical protein K01C8.9 [Cae
MAKYCLKKQSKRLTCKKKFKIQRKVREHSRKLKKMSKESERKKKTEKQISVPSKCPFKEEILMEAEQKRTEAKVSPKKH

SEQ ID NO: 139565 - protein, 272 aa, Heterodera glycines
  Coding regions on vcDNA: vcDNA=SeqID_65988; Strand=+; Position=1 -131,293-378,561-910,1012-1263
MSNEEENVEEQREFSPQQQQQGELRYFHEGFTYVKDRLSADGTKEGREDTDEADSHGDGTGPMTQSATAIVKVEAGDSLTNAILGILPQQSADDAEAGSTGNGPMHSAEHHQHETDQQQQMISSGTGAASVEGNAIAAGVRRHSLLGPIPIRSQQQQSVEGQQSTIGQPMVRNLPPATVRTANFAQNHPQQSLVNSQHPTVANNCHSEQHFAGRKRRAFPPPPQSSALPLNGFSNCVGEDGETVELRLKRLKCELIEVGAAANCERNTTKWH

SEQ ID NO: 139566 - protein, 291 aa, Heterodera glycines
  Coding regions on vcDNA: vcDNA=SeqID_65989; Strand=+; Position=1 -410,450-529,576-928
  Homolog annotation: Hit_ID=AAP68908.1; Match level="QueryCoverage =98%, HitCoverage=78%, E-value=9e-34, Identity=34%"; Hit description =Collagen protein 51 [Caenorhabditis elegans] pir||T15143 hypothetical protein T28F2.8 - Caenorhabditis ele
MSDLPTGTVTVAVILSVISLSAILVGVPLMLNDLVNLQLEFGLKSQAHLDMSNVLWRDIMKEVATIGQWDKREQKQTIRKRRQCAKGGQLTTRNKCRSDGSGNIGGGGASSPSATCPQGARGAPGVPGAPGEPGQSGQDGQPGTGQDGQPGTSGFSGFPEDFAQQCPTCPIGPPPIGPPGPPGYKGRRGFRGEKGPIGTHLNSPMASFNFNFKGPPGSPGRDGHPGEQLMNGLSRVRGNCTVFLSGDEGPEGEIGLHGDLGEPGPRGPPGETGIGYAKGEPGPKGEHGQPG

SEQ ID NO: 139567 - protein, 406 aa, Heterodera glycines
  misc_feature (405)..(405): Xaa can be any naturally occurring amino acid
  Coding regions on vcDNA: vcDNA=SeqID_65990; Strand=-; Position=1 -321,402-521,576-722,778-886,931-1015,1121-1254,1314-1381,2117-2162
  Homolog annotation: Hit_ID=NP_510101.1; Match level="QueryCoverage =98%, HitCoverage=90%, E-value=6e-85, Identity=42%"; Hit description =neuropeptide receptor NPR1 family member (XN154) [Caenorhabditis elegans] pir||T19340 hypothetical protei
AFFNECVDMNHFLWEFQRDPTSRPITAAIFAVVYSLIVLVGVSGNICVLLSIGRTRSLQTVSNLFIFALSCSDIVVCCVSATFTPYTAFTKVWVFGVALCSLANFTAGTGTSLCFSIFVLAAISVDRFLLIRFPLNNQLRHNHALLIIPILCLILCLFAMFVSFPMIFTQKLLRMEGYCGEFCVEDWGTNELYREIYGTLLLIVQFFVPLLIITICYIGIVQFFVPLLIITICYIGISVRLNRVSRISSDQKTDQWAMWLRHRQSMADRRRQRTNRMFQWAMWLRHRQSMADRRRQRTNRMFILMYVFADFSWIWFILFNLLRDLGLLPYFIREQEFLYGIITHAIAMTSTIWNPILYALLNFQLRSAIWNPILYALLNFQLRSAFLRLVPDGTRRNGRMEGGGXK

SEQ ID NO: 139568 - protein, 30 aa, Heterodera glycines
  Coding regions on vcDNA: vcDNA=SeqID_65991; Strand=-; Position=1-92
KGMLLLSQRSTDGAVRGQRSKRPIRSRSRP

SEQ ID NO: 139569 - protein, 51 aa, Heterodera glycines
  Coding regions on vcDNA: vcDNA=SeqID_65992; Strand=-; Position=1 -38,462-579
MPKIKSKCEWMREKIFYLFKGNEQMPKKGGTASRIDFGNCPRQYHWQSATQ

SEQ ID NO: 139570 - protein, 104 aa, Heterodera glycines
  Coding regions on vcDNA: vcDNA=SeqID_65993; Strand=-; Position=1-721
LRWIFAPHNCLSTPNGHLKKSIFFVFGAVPPNRCAQIYGETESFGNSFPIACTLILRWIFAPHNCLSTPNGHLKKSIFLFSGQSPRTDAPRFMGRPNPSGVASL

SEQ ID NO: 139571 - protein, 236 aa, Heterodera glycines
  Coding regions on vcDNA: vcDNA=SeqID_65994; Strand=-; Position=1 -209,279-747,819-851
MALLSDRFDVLVDTHFDGKSELTIWKAIAIRKDKGPKPKLSVQIDDKFVDFPLPDHSLPSKIRFKELRINYIDHSVLTFIRSNKPIWDRRGTKLDLDVPSDNPTDVQPIWDVFVRQIWPIFATNIRQLGFEDGNHLDNLLRRTSPTLLTDLDQLISIDCGYLCPDGIADDGPNGIADQALTKWLHTPTKNGQPKRLYRYNYFGPQNLEWVNNFKEVARHIFLLISLIKKSKMDFLA

SEQ ID NO: 139572 - protein, 82 aa, Heterodera glycines
  Coding regions on vcDNA: vcDNA=SeqID_65995; Strand=+; Position=1 -144,260-364
MRTLIASLSTDKLVNLLNIEYAPEGTDKQLTPLMLATVLGDAQMAQIFLEKGADPHRMCLKKINTDDNLISELREEGEKMDK

SEQ ID NO: 139573 - protein, 34 aa, Heterodera glycines
  Coding regions on vcDNA: vcDNA=SeqID_65996; Strand=+; Position=1 -18,1417-1503
MAALQQRIALEKAINQEKSPFITLIFFNFYTAFC

SEQ ID NO: 139574 - protein, 74 aa, Heterodera glycines
  Coding regions on vcDNA: vcDNA=SeqID_65997; Strand=-; Position=1 -20,50-254
MKEQKMRTNIDNEKEKRKRRGKARRKNKRTNERTNERTSLFCCGSNFAVIVMEKGKWLEAKSEAPQGNYLKKDP

SEQ ID NO: 139575 - protein, 89 aa, Heterodera glycines
  Coding regions on vcDNA: vcDNA=SeqID_65998; Strand=-; Position=1 -118,705-856
MFNDDQATFVFMNPAHSQEQLVAERDLVKEMLQQALVRHHGPTVGQGRLGARAGGQAANSATKCAFVGHVQAFGGLQTDHSVRLLVLPL

SEQ ID NO: 139576 - protein, 78 aa, Heterodera glycines
  Coding regions on vcDNA: vcDNA=SeqID_65999; Strand=-; Position=1-237
MSSARNELQAKATEMAMRINNAKAVKEERKRMASTKPESLVRRRWRLRSSGSTTTSPAEIWPRLTRLARKSWRVRRPC

SEQ ID NO: 139577 - protein, 78 aa, Heterodera glycines
  Coding regions on vcDNA: vcDNA=SeqID_66000; Strand=-; Position=1-548
NKKIDFFKCPFGVLNHLWGAKIQRRIKVQAIGKLFPKEFGLPIKSGRIGAGGLPRKQKNRFFSSVRLGYSNNYGEQKS

SEQ ID NO: 139578 - protein, 256 aa, Heterodera glycines
  Coding regions on vcDNA: vcDNA=SeqID_66001; Strand=+; Position=1-768
MEPRKRSSNFSIDHILSAPKKPRQGFLINELLGVVHFLGSVQQGEGTSKEAKDYVKKLDNSIEHMAKFHYVKVKSKFTITDLPSTPEALLAGIFQHCIDEAIVESRERNIEPTHLGCMISSPMLEGGDIPIPIRQMTNNTLDTILNQFKKVAQSKQQKNVSLWGEPFTVTITTLDRNGLPSKRRVKGGARRPVKTAVHHRINDQCLIKIRNNDNHFCLFYALQATMVDKTCNWTRWKFLDYLHDRHEKQGQLHHDT

SEQ ID NO: 139579 - protein, 47 aa, Heterodera glycines
  Coding regions on vcDNA: vcDNA=SeqID_66002; Strand=+; Position=1-141
MATEIMALFGLTDSAWLDSRHFTRRCCRIGVNLFTCRMIFTKLDSEW

SEQ ID NO: 139580 - protein, 138 aa, Heterodera glycines
  Coding regions on vcDNA: vcDNA=SeqID_66003; Strand=-; Position=1 -88,636-737,983-1081,1489-1616
MFYARHFVSLVLILALSIDGVNGGPKREKGRTGNSSIGSSNLSANPFHYGQQPTDNRQSMPSSGSYWRDLISQVEGSAAGNAFNSSSNFAAPQPPTGGNQQDEVLDVEPINTFYPSAGGHGFAQGRSSKGSKRKGGRH

SEQ ID NO: 139581 - protein, 46 aa, Heterodera glycines
  Coding regions on vcDNA: vcDNA=SeqID_66004; Strand=-; Position=1 -17,472-595
MCARVGKKSDHWRGEDAEENHNVIEFLTANSKDMILRKSVRHFYAF

SEQ ID NO: 139582 - protein, 21 aa, Heterodera glycines
  Coding regions on vcDNA: vcDNA=SeqID_66005; Strand=-; Position=1 -54,567-578
MRTRPIWQVKQRLLTSQKKGF

SEQ ID NO: 139583 - protein, 103 aa, Heterodera glycines
  Coding regions on vcDNA: vcDNA=SeqID_66006; Strand=-; Position=1-310
MSNNPLQPTTSLTDTNELHLLEMLTFEEEEEEASQGRIIASASQNEDQTRNLSRETCTNEFGVKSVASASKIEGECTGLMEGNGAGNSETNKNINENIASASQ

SEQ ID NO: 139584 - protein, 52 aa, Heterodera glycines
  Coding regions on vcDNA: vcDNA=SeqID_66007; Strand=-; Position=1-155
CASALCRHTSFSARIFAISSSCSSSSLALLLLLLRLMSLKYCAGPSRQSSNS

SEQ ID NO: 139585 - protein, 187 aa, Heterodera glycines
  Coding regions on vcDNA: vcDNA=SeqID_66008; Strand=-; Position=1-564
MINLWKLFGTGFRFTEISGPRIPMINLWKLFGSGFRFTEILGTSDSNDQFMEIFGTRFRLTEILGPRIPMINLWKIFGTGFRFTEIWGPGIPMINLWKIFGTGFRFTEILGPRIPMNNLWKFLAPDFDLRKFGGLGFQLQFMENFWNGISIYGNLGASDSNYNLWKIFGTGFRFTEILGPRIPMINL

SEQ ID NO: 139586 - protein, 72 aa, Heterodera glycines
  Coding regions on vcDNA: vcDNA=SeqID_66009; Strand=-; Position=1 -130,170-258
MILKKEKKTKSHKENEEEEEEEEEEESSSSSSSNEVSDQQSNDGSDAQSGPNEYGQLRLNNLKQCHNKCYDL

SEQ ID NO: 139587 - protein, 88 aa, Heterodera glycines
  Coding regions on vcDNA: vcDNA=SeqID_66010; Strand=+; Position=1 -179,245-332
  Homolog annotation: Hit_ID=NP_500992.1; Match level="QueryCoverage =100%, HitCoverage=21%, E-value=1e-14, Identity=44%"; Hit description= DNA-damage inducible protein (43.7 kD) (4H289) [Caenorhabditis elegans] gb|AAD47115.1| Hypothetical prot
MTTNFLIVLQTLDSKSSNKGAQTSILSESCARRCDILKYVDRRYRVQAHGIGGSQKMVGRIFACQVQVDDNVFACPFEVMSDRDVDIL

SEQ ID NO: 139588 - protein, 211 aa, Heterodera glycines
  Coding regions on vcDNA: vcDNA=SeqID_66011; Strand=+; Position=1 -60,201-670,2422-2526
MSVMPNNDQQKQNLDTKTSQENGQLSDSHETAVIKAPSGGNRKVPKNCWKKVNIDLEYNTSREISRRRQLAWRGERRGGETYGRRDQPKEQRKGSARVAEESSARKDEAAEKRDRNEAQKETAGEAEDGRAEGGGDEETARKRTTAPTGGTKTKNGPNEDGAETGTDQQQQQSRDYWYSDEMSNGYYYQHSGSHGWKKTGTDQPQQQPRDY

SEQ ID NO: 139589 - protein, 64 aa, Heterodera glycines
  Coding regions on vcDNA: vcDNA=SeqID_66012; Strand=-; Position=1 -173,627-647
AGQTPLASQCHPPQIPRRNSFQLITIRNIVEGLRNASEPISTSQEKLSRYPCEDEAKTLLCCAL

SEQ ID NO: 139590 - protein, 20 aa, Heterodera glycines
  Coding regions on vcDNA: vcDNA=SeqID_66013; Strand=-; Position=1-63
DYFLKHLVDWGIIRDCGINR

SEQ ID NO: 139591 - protein, 241 aa, Heterodera glycines
  Coding regions on vcDNA: vcDNA=SeqID_66014; Strand=+; Position=1-728
  Homolog annotation: Hit_ID=XP_345024.1; Match level="QueryCoverage =99%, HitCoverage=88%, E-value=9e-23, Identity=26%"; Hit description =similar to SPAC23A1.17 [Rattus norvegicus]
FQSLALNPPAFQSLGLNPPTFQSLVLNPTAFQSLGLNPPAFQSLALNPPAFQSLGLNSAFQSLGLNPPAFQSLGLNPPAFQSLGLNPPTFQSLVLNPTAFQSLGLNPTAFQSLGLNSPAFQSLEPKSFQSLALNPPAFQSLGLNPPTFQSLGLNPTAFQSLGLNPTAFQSLGLNPPAFQSLGLNPPAFQSLALNPPAFQSLALNPPAFQSLGLNPLAFQSLGLNPPAFQSLGLNPPAFQSL

SEQ ID NO: 139592 - protein, 81 aa, Heterodera glycines
  Coding regions on vcDNA: vcDNA=SeqID_66015; Strand=+; Position=1 -15,456-686
MVLHSQLRGVHIAKLAWPPRGVQSPYLSKAMAAIEENRSLSLYALAVGTALAAALWFGRGRTSPPPGNRFLAEPSADSLLT

SEQ ID NO: 139593 - protein, 103 aa, Heterodera glycines
  Coding regions on vcDNA: vcDNA=SeqID_66016; Strand=-; Position=1 -72,249-488
  Homolog annotation: Hit_ID=NP_502432.1; Match level="QueryCoverage =83%, HitCoverage=9%, E-value=1e-21, Identity=57%"; Hit description =RNA Binding Domain protein (98.0 kD) (rbd-1) [Caenorhabditis elegans] emb|CAB05631.1| Hypothetical protein
ANLKELTQLFSAFGELNFIRLPKKPGSEGHRGFCFAEFLSVSDAHRAMDALVHSTHLYGRRLVLEWAKPSEESAEEKRQRTQDRMAMAAGVAGAKKRPKMRSF

SEQ ID NO: 139594 - protein, 18 aa, Heterodera glycines
  Coding regions on vcDNA: vcDNA=SeqID_66017; Strand=+; Position=1-56
YSEAIPEGFGLPINLGAS

SEQ ID NO: 139595 - protein, 36 aa, Heterodera glycines
  Coding regions on vcDNA: vcDNA=SeqID_66018; Strand=-; Position=1 -48,113-175
MHSFKLFASLFLVLCVVSLVICQDKPAAVKRGHLLN

SEQ ID NO: 139596 - protein, 58 aa, Heterodera glycines
  Coding regions on vcDNA: vcDNA=SeqID_66019; Strand=-; Position=1 -39,987-1124
MKFSINSFAKVENVTALTYRMIEMCHVGVPFRWGSHTRCIRPATAAPCLTNERGNAEH

SEQ ID NO: 139597 - protein, 29 aa, Heterodera glycines
  Coding regions on vcDNA: vcDNA=SeqID_66020; Strand=+; Position=1 -18,503-571
MDTRFVIRLHLPTIDKFEKNFMINDHVMQ

SEQ ID NO: 139598 - protein, 214 aa, Heterodera glycines
  Coding regions on vcDNA: vcDNA=SeqID_66021; Strand=-; Position=1 -98,162-527,894-1014,1676-1735
MIKKNLSLTVFKHDKKNFKFCFETKKLKGYRIHSIYADQLNGALPELVKLYFNDAPPNTNRRTLTMQMCVVTNCEPKNCCKLTVCYVGQMNPANGPLNSRFELENFEKSEIAEKCRKAQKKSWPQFGDKVLHGFELSYYYVNKSLMVSTSFNPISQYFAFNESNVTKCIDVILGENGYLDGYVQGERKQLHETYKKGDGLYKCKGKQCKDSMPK

SEQ ID NO: 139599 - protein, 16 aa, Heterodera glycines
  Coding regions on vcDNA: vcDNA=SeqID_66022; Strand=-; Position=1-49
EAIPEGFGLPINLGAS

SEQ ID NO: 139600 - protein, 207 aa, Heterodera glycines
  Coding regions on vcDNA: vcDNA=SeqID_66023; Strand=-; Position=1 -117,177-270,310-608,665-778
MDAILATDWLHNAFPERKTTTTTTTISSVEEELDDAVKAEEQISWLKIIEEEEERGNELQTGEMEVERAKEIEPPKRQHLQSKCSCNEKQKSVPLIDFLCQHYKCSVKELHVLLQTLNKRREISEMLRSQLQLRTNHLRPAWKNFRVHCNELTIHPAQTAYAMRGYLGITVRIYYYVKHGVKLVYPQLPCVLQFGGGAIVLCFRLSV

SEQ ID NO: 139601 - protein, 344 aa, Heterodera glycines
  Coding regions on vcDNA: vcDNA=SeqID_66024; Strand=+; Position=1-1035
MRHAMRMFLVPEDVFQSVFVQHHTTAAAAADGADGTPIGLLRSRIQQIERSRELNEEQKAAQYHQEFKRLNKLVREQEEQPINVRLQHEKEREKNSATPLPPPQTINHSTPKRLEKNIVPSAFGLRRQRHHYTQKAGALSNRRPAQKQQRKAAAAETPNSSGNGETEKEEGNGDDGEQWDDAQSSSSTASTGGAAAKRVLRARDGEAGKGGGETADRLQTKHNYQMTKNALITHIRKKGHSLGVSDQGKVLRADGSEFKTSNVEAIVSHLLNRDKRSEFKRPPVGYKEFADKAREDPLLKKYLFPEQPLQFGKGLTDFRHGKRHKKKCEGGGGKSVFRFKPTLW

SEQ ID NO: 139602 - protein, 140 aa, Heterodera glycines
  Coding regions on vcDNA: vcDNA=SeqID_66025; Strand=-; Position=1 -94,136-224,654-815,1158-1235
MESHTTHKLPSTYTDEQLLAEQLLAFIDLKFGGIGNEIAHHGNEQGGKGDMRSIRSAAYTYVVKQIFGLKKTGLFALPTVLSTDVESQMQKIITERKCAVVARLQQPEIKDKTEQKNVLAFKSFCKGPFFHIFDSVQNLV

SEQ ID NO: 139603 - protein, 45 aa, Heterodera glycines
  Coding regions on vcDNA: vcDNA=SeqID_66026; Strand=-; Position=1-135
GTAGGNNAKGPAGGGVQLGDLLQHPEMLRQLVGQVPVDSSEATTK

SEQ ID NO: 139604 - protein, 388 aa, Heterodera glycines
  misc_feature (261)..(261): Xaa can be any naturally occurring amino acid
  misc_feature (287)..(287): Xaa can be any naturally occurring amino acid
  misc_feature (385)..(385): Xaa can be any naturally occurring amino acid
  Coding regions on vcDNA: vcDNA=SeqID_66027; Strand=+; Position=1 -330,408-570,624-847,892-976,1004-1144
  Homolog annotation: Hit_ID=NP_498606.1; Match level="QueryCoverage =85%, HitCoverage=60%, E-value=3e-51, Identity=36%"; Hit description =glycosyl transferase (53.6 kD) (3I378) [Caenorhabditis elegans] gb|AAK18871.1| Hypothetical protein B0361
IFFTFSLSLRPFSFMVLFRVRLRFGPSISPYRLRFVFLRFRWLLEAHNYPRFTLLGQMFAGFVLGCEALCRHCPEWFMDTTGCPLTLPLFRWIACAKTMCYVHYPLITTEMVALVMVALVDSRAVSYNNSSQIASSIVLTNAKLFYYRLISLLYCACGTSSQVTMANGSWTASHIANLWFCQWTASHIANLWFCQPKVVFPPCNVEILSNLENRTEQLLAGGNPSLILSVGQIRPEKNHLEQLRIFAEVRRRLKERDFLFXKIKLVIAGGCRNAGDWDRKERDFLFXKIKLVIAGGCRNAGDWDRVDFLKNSDEAVQSDCDIAWQLNVPFAELTDLVDFLKNSDEAVQSDCDIAWQLNVPFAELTDLLRVCLNRHRIRIKFLSIXIFF

SEQ ID NO: 139605 - protein, 47 aa, Heterodera glycines
  Coding regions on vcDNA: vcDNA=SeqID_66028; Strand=-; Position=1 -102,278-319
MVKKAENNLKKFTNEWDEMVKKAMLEGNLKLNKMICIKIKAMREKIY

SEQ ID NO: 139606 - protein, 47 aa, Heterodera glycines
  Coding regions on vcDNA: vcDNA=SeqID_66029; Strand=+; Position=1-143
MPPSADGHRSFEMTCGRCPTLRGSCLTSHAFGVLPYVGAVVYRSVLH

SEQ ID NO: 139607 - protein, 64 aa, Heterodera glycines
  Coding regions on vcDNA: vcDNA=SeqID_66030; Strand=+; Position=1 -125,352-421
MCKRILIQPNVWQFAAVFTMNPRTLAGIRKKTELLFGILDNSKFLMTFADRLLRTDFCGPLFLG

SEQ ID NO: 139608 - protein, 66 aa, Heterodera glycines
  Coding regions on vcDNA: vcDNA=SeqID_66031; Strand=+; Position=1 -88,470-582
MNDCLSFIIRCNSYQILRLFFIKLNRQISRVDGSPKRIQKEEKQLALLLLYASHNFGKLKLFKCDD

SEQ ID NO: 139609 - protein, 33 aa, Heterodera glycines
  Coding regions on vcDNA: vcDNA=SeqID_66032; Strand=-; Position=1 -40,125-186
MCVKFIDRFLDKQHMIETIKFFIKKFMSLVQNS

SEQ ID NO: 139610 - protein, 44 aa, Heterodera glycines
  Coding regions on vcDNA: vcDNA=SeqID_66033; Strand=+; Position=1 -104,294-324
MPDQMRFGTRKLEEKGGKKERRMNERHLTNGTRKRFLWAFENCI

SEQ ID NO: 139611 - protein, 81 aa, Heterodera glycines
  Coding regions on vcDNA: vcDNA=SeqID_66034; Strand=-; Position=1 -39,562-768
MAFPYLVNVPLIEDLEAREANTTYVSTGPSPHTIQALIPRLHWSWASFSFDHIHDLINYCYVGANERRFIVSLLPPHGHGV

SEQ ID NO: 139612 - protein, 142 aa, Heterodera glycines
  Coding regions on vcDNA: vcDNA=SeqID_66035; Strand=-; Position=1 -76,948-1122,1389-1566
  Homolog annotation: Hit_ID=CAF91175.1; Match level="QueryCoverage =28%, HitCoverage=5%, E-value=7e-09, Identity=68%"; Hit description =unnamed protein product [Tetraodon nigroviridis]
MRSSAGDRISRPTFGRWSDSDQKQRDCVSVKILNARAWSRSRDRSHLTLPRELEDLTPEVEDFYKKAALRTKAELGPPLVHGGRLVNFPKVRMRLILCEIAQQPLTPKSFNEPASGVEMLAMLHAIVPKKPFLKGEARIACG

SEQ ID NO: 139613 - protein, 77 aa, Heterodera glycines
  Coding regions on vcDNA: vcDNA=SeqID_66036; Strand=-; Position=1 -110,227-350
MARMALDLRYVALHEIGHALGLRHSTYRHSVMNSYYRQNLALLDEQTEEFKLSKDDKAAIWELFGEKCHQKKKRRKS

SEQ ID NO: 139614 - protein, 56 aa, Heterodera glycines
  Coding regions on vcDNA: vcDNA=SeqID_66037; Strand=+; Position=1-173
RKKLQQKSFGEIFGEKWEEKEEEKREIIGKFYKIKEKIKEKGRNIQQKNGVKSMRK

SEQ ID NO: 139615 - protein, 108 aa, Heterodera glycines
  Coding regions on vcDNA: vcDNA=SeqID_66038; Strand=+; Position=1 -99,360-587
MLSLMVLTLLRMESSELCGTKIHYAREFMKCALFCMRTTLTWLVSYIFVVFDTSVGVPSGPLVQNRLIVSLVWHKPGFRRLVIAKVLSLGLHIRALDICAYVQNRVQT

SEQ ID NO: 139616 - protein, 46 aa, Heterodera glycines
  Coding regions on vcDNA: vcDNA=SeqID_66039; Strand=+; Position=1-205
ILINIEIKTHKKIYSLLFRQLVKSFRMIPNLSRFDRFKKVRSDKSL

SEQ ID NO: 139617 - protein, 480 aa, Heterodera glycines
  Coding regions on vcDNA: vcDNA=SeqID_66040; Strand=+; Position=1 -364,1180-2256
  Homolog annotation: Hit_ID=NP_507780.1; Match level="QueryCoverage =49%, HitCoverage=15%, E-value=1e-15, Identity=28%"; Hit description =predicted CDS, DNA polymerase type B, organellar and viral family member (5T899) [Caenorhabditis elegans]
MRNVPRNTRGEICELRFLPLEDTQRPDLLMEVLIQHLLDRVLDGHPPPSLVGLQLHPPGFDRPYVIRLRPPEQNNAAALAAAIERLNEQSAAGIDLFAGTTVAKVLAVWPLEPIRADPQRGAPMDARGQRQRQPICQWRRVCRDCGRIAYQGKHQCPRQQTADNGNCRRCDGPHTAEEPCFIQPICDLSARQRASVAVDNDDNSDDNGDDDGEDDVLPLRLCFFDAETSQDSPLQLNNRLVQKHVPLLIIAEVICERCLQVGISVNDGLGRRAPDCVCMPGMVRGQQLRQWSSPPFANTRGDNTAVPMEAPTFNQRRFYFHSFDNEADDPVDQFLDFLTHHGPKKAHTVCIAHNGGKYDFHLILEALHRRNQPPKRLCTTGLKIYSMRLSGSHQRRVTFKDSINYFFCELDALVKSFDLPEHQATVKPFFPYLYIQRQHLLQRLDTLPAREFYSPDTMKAEKRAKFLRWHANNNGNGFQL

SEQ ID NO: 139618 - protein, 168 aa, Heterodera glycines
  Coding regions on vcDNA: vcDNA=SeqID_66041; Strand=-; Position=1-506
PNDDCYDYHLIEHAPAPMDARGQRQRQPICQWRRVCRDCGRIAYQGKHQCPRQQTADNGNCRRCDGPHTAEEPCFIQPICDLSARQRASVAVDNDDNSDDNGDDDGEDDVLPLRLCFFDAETSQDSPLQLNNRLVQKHVPLLIIAEVICERCLQVGISVNDGLGRRAP

SEQ ID NO: 139619 - protein, 701 aa, Heterodera glycines
  Coding regions on vcDNA: vcDNA=SeqID_66042; Strand=+; Position=1 -1009,1061-1244,2102-2716,2764-3061
  Homolog annotation: Hit_ID=NP_507780.1; Match level="QueryCoverage =49%, HitCoverage=23%, E-value=2e-41, Identity=31%"; Hit description =predicted CDS, DNA polymerase type B, organellar and viral family member (5T899) [Caenorhabditis elegans]
MVRGQQLRQWSSPPFANAPGDNTAVPVDAPTFNQRRFYFHSFDNEAADPVDQFLDFLTHHGPKKAHTVCIAHNGGKYDFHLILESLHRRNLPPKHLCTTGLKIYSMRLSGNHQRRVTFKDSINYFFCELDALVKSFDLANDQATVKPFFPYLFIQRQHLLQRLDTLPAREFYSPETMKAEKRAKFLRWHADSNNGNGFQLREQLIMYCANDVAILRESAIRFRQLIADNTQGLDPFLNASTAAGLALATLRRCFLAPNRLVHSPEGGYLRGRRASAESQRYIRFFELENPGAQVQCAHWSVGEAHIEDTGYRVDGLWRRDAPLRPLAIEWLGCYYHGCPKCFPDRQQRLAAGRTAEDLYERTERRLFELEHEHGCEIHKVWACQWSERLRHDPELKRRGKLAQRVGRTEIRYTRTPAEFHELLEDPSLDKLDFVHVSEYMDRCVVRKRPEFAKAPLTNCLPVASFVTSYARLHLYDYIEQVLAIDGAELLYCGMLFFHKTFGVHAYALDTDSIYYVNKMGGPCVAEGEALGQMKREHTDRRIVEFVAGGPKNYGIRHTARDGTDERANLKIRSFRLSYAAQQLLNFEAMKELTLATYKIDGPIDDVLDNDDLYVYGGGEHRAIRVNFPHIDRNAYADLYTHEAHKDYRPFYAKGRVRPGMQTRPFGYVEDDGPPNDGQRTERRKRNFVDHDPAQPGHSGWF

SEQ ID NO: 139620 - protein, 124 aa, Heterodera glycines
  Coding regions on vcDNA: vcDNA=SeqID_66043; Strand=-; Position=1 -166,228-436
MDLILATDWINNAYPEMDLQDANKEPTKKQEEEADDPSWISLIDEEMKREPLAPIGTPKKCACAERRRPVPLVDHLCKRFKCNAHELHVLFKSLEKRRDIVEHLRSSTAHRPPAPVRAQFSGPL

SEQ ID NO: 139621 - protein, 573 aa, Heterodera glycines
  Coding regions on vcDNA: vcDNA=SeqID_66044; Strand=+; Position=1 -318,711-986,1041-1671,1740-2236
  Homolog annotation: Hit_ID=NP_502797.1; Match level="QueryCoverage =23%, HitCoverage=38%, E-value=4e-15, Identity=33%"; Hit description =HASI (4P602) [Caenorhabditis elegans] emb|CAB16520.1| Hypothetical protein Y57G11C.19 [Caenorhabditis ele
MDAFQQFKREDGQFRHPFTMIVSGSTGSGKSEWIMRLLRNVDKMISTPVERVIYSYGELNTNVMNLQRAGKVANVPVTVHSGVPRAEQVRECAKKEKTLLVLDDLVTLCNAKKAKALIRYASDEQLLCLVEICLNILKGRVPLRPRYLNKLKAHAQVLRRLASTRCSRSAKKVLLQHGDGLPAIVGLIASIALPLIADHTKRYLLVPEEIYQSLAAPPPSDGTPIGLVRTRIKQIKNDDAINEAERAVKYEQEVKRLNKLTKDEDERPVGVKLENLSDVVDAMPKPVNVTRPIVVSTRRHLKVGRARKENVEQLEDTDDDDDYQNPRSSSSNKRQPTQTEILKLIYKNAQSLGVSEEGQVLRAGGRPFITSSVDDIVSHLLNKDKRGQNKEPTAFKEFVERARQNPLLTIIMDLKKLRLREFLYKDLSSPVAFTSVEPLLREARKSQPKINRNDVQNYLTSQRTYTLHRQAKRRYRRLPTLAPGLHTEWQADLAIFDRLGKQNRGFKYLLVCIDTLSRQVFVEPVKTKTSANMIIAFNRIFKRSKIYPVEGVNRSGKGIHCPGSTAVLPHKRR

SEQ ID NO: 139622 - protein, 303 aa, Heterodera glycines
  Coding regions on vcDNA: vcDNA=SeqID_66045; Strand=-; Position=1 -18,630-761,856-912,1110-1317,1439-1537,1755-1955,2521-2594,2648-2770
  Homolog annotation: Hit_ID=AAH46935.1; Match level="QueryCoverage =67%, HitCoverage=58%, E-value=4e-15, Identity=27%"; Hit description =LOC398559 protein [Xenopus laevis]
MSNCSVNRLPHTLKKGEDDQLLKRSDLIDTLNTEFSCPICLDLLKNTMVTECLHRFCSECIKKCIYKGNIWPDREQYEALQREKAQKWSKHFDVVALQRSIAEGMRAQAKALIRHSNADVNEPTTTKRAEGSGQVANKAKKASPPIQHNAICAPKKLCLLPRHVMENDIANADFYTDSSSESPSSSSGKDTSFDPTSDAGKGTQLSKSLIVDVDVGLFNKSVDDRFIGQLTSREAELGVEELRVKFVNICKNMAKVELSFFVQLYNNKMTRLYANESMCTVLALARRPNFFDYPTVFFNIEAI

SEQ ID NO: 139623 - protein, 225 aa, Heterodera glycines
  Coding regions on vcDNA: vcDNA=SeqID_66046; Strand=+; Position=1 -181,224-450,820-1089
MYRLLSKVDQYPEASRIVFDRTDVAKPTLSLSGVSEYFLNIKLEKTEREGNWSQRPLRLEQKKYAAQDAHCLNRIFRIVASKLKRLKDNELAKELKRHSLIDFNEEKAKPTMAIPLLSGQLVRVKEGEEDFILNVQLALQMPDNEVVNVPIATDGTTPPSLLVRNLLDELRIILRPSDMWSRCVECNKRSFVRIPKRIVQTLCFMTAVRHSAEWMGVDEQVDKFQ

SEQ ID NO: 139624 - protein, 166 aa, Heterodera glycines
  Coding regions on vcDNA: vcDNA=SeqID_66047; Strand=+; Position=1 -111,816-1006,1047-1245
MVEVAIAQIKTLLENEVPKAVFWMDHLNLRDHFPFNTHALQFSSDVRDHYFRRLFESKLPERACHFAELLELSEHDYIPELRHYCQQNADEVQRIRNQIRKDIAIRLQNQQIEEQCVCELTPGHQIVLVDTWPKLEQLIDHLRHDNEELFGIDAEWRPHYLCAAEK

SEQ ID NO: 139625 - protein, 56 aa, Heterodera glycines
  Coding regions on vcDNA: vcDNA=SeqID_66048; Strand=+; Position=1 -73,517-614
MVIFWVGIFVADFKKMKRDTEAEKITFSWKGPAVPIDAVGPGPSFSKSRTWNRDLG

SEQ ID NO: 139626 - protein, 86 aa, Heterodera glycines
  Coding regions on vcDNA: vcDNA=SeqID_66049; Strand=+; Position=1 -84,739-915
MFKAISKFCAILIIDIFGIDATVALHAAQEEKIVWQREKHSTHETKSNADWLNQAEGGRQAGNEREKLLAREKIKDTLLGREKREK

SEQ ID NO: 139627 - protein, 76 aa, Heterodera glycines
  Coding regions on vcDNA: vcDNA=SeqID_66050; Strand=-; Position=1-228
MSAALKPSDYKIFPKSQKCVPSNGTESTASGATEDSFSAEDRKTDWRSIYLAALVCFFGQVQFSIFLNSQFAFMKT

SEQ ID NO: 139628 - protein, 59 aa, Heterodera glycines
  Coding regions on vcDNA: vcDNA=SeqID_66051; Strand=+; Position=1 -89,565-655
MNLFFFLIGTEQHGSWDWLVVVIAMININDLRFADVIDAIWPVDPPTLRMALSRDETDK

SEQ ID NO: 139629 - protein, 109 aa, Heterodera glycines
  Coding regions on vcDNA: vcDNA=SeqID_66052; Strand=-; Position=1 -274,329-385
WICNYVWLDILPSFDYAQLGLQMALLSYRFNALVDAHFDGKPELTLWKTTKIRKQIGVPKSVLANYADSVQFPLADHPLPNKIRFKDLRISYIDHSVIAFLRSNQQIFD

SEQ ID NO: 139630 - protein, 38 aa, Heterodera glycines
  Coding regions on vcDNA: vcDNA=SeqID_66053; Strand=-; Position=1-3,53- 166
MNQWHGRCCKSMHHNFSSIVKMPAEEVPWPNVAVPSEA

SEQ ID NO: 139631 - protein, 51 aa, Heterodera glycines
  Coding regions on vcDNA: vcDNA=SeqID_66054; Strand=-; Position=1 -108,336-383
  Homolog annotation: Hit_ID=P30757; Match level="QueryCoverage=70%, HitCoverage=29%, E-value=4e-09, Identity=80%"; Hit description =Histone H2B pir||S16084 histone H2B - sipunculid (Sipunculus nudus)
MPPKPSGKGAKKAVKSTKAVRTGDKKRRKARKESYSYPCKVWGASDKFLKK

SEQ ID NO: 139632 - protein, 201 aa, Heterodera glycines
  misc_feature (172)..(172): Xaa can be any naturally occurring amino acid
  misc_feature (178)..(178): Xaa can be any naturally occurring amino acid
  Coding regions on vcDNA: vcDNA=SeqID_66055; Strand=-; Position=1 -59,174-286,550-983
  Homolog annotation: Hit_ID=CAE59886.1; Match level="QueryCoverage =83%, HitCoverage=15%, E-value=5e-36, Identity=46%"; Hit description =Hypothetical protein CBG03367 [Caenorhabditis briggsae]
WVYAYRVNYDTLNWRMLIAQLHKNHQEIPTMSRMQLIVDGETFLRQSANTQLFVQLLSYLAHEDDLGVLLVGLDALHALLELFSASDVFGTMLVHFVPVIHQLDRQLSLTAAHGTDPELAALWLLSPLRLAKLYQLRCAANLGTCAETKQVHWTKNGTTKCWDKHAQIWHLXFLVQSXYSGRVNVRQSLAGAPVARPSDRF

SEQ ID NO: 139633 - protein, 73 aa, Heterodera glycines
  Coding regions on vcDNA: vcDNA=SeqID_66056; Strand=+; Position=1-222
FVWLVAFFGTAFLNITFGLALSLLFSLAMFGLRKLNDAIATKGRRASPESSADSERQLAKLPQIVNVTLAEEK

SEQ ID NO: 139634 - protein, 60 aa, Heterodera glycines
  Coding regions on vcDNA: vcDNA=SeqID_66057; Strand=+; Position=1-181
TVSFFLINTRNHQIKTTKQLRILPHEYTVSINNLCLLRLFSFLFRLFSLWPLLRCVFRLS

SEQ ID NO: 139635 - protein, 98 aa, Heterodera glycines
  Coding regions on vcDNA: vcDNA=SeqID_66058; Strand=+; Position=1-297
MHKTVPKLKITLPKLDLNDPASLAAFASPESLDSQELDEDDILLDNEWNEPMDDEEEEEEDEDMMMMEEDDDNNDVGDLFDVEDVPPAEAMLRCSQNR

SEQ ID NO: 139636 - protein, 95 aa, Heterodera glycines; identical to SEQ ID NO: 125597
  Coding regions on vcDNA: vcDNA=SeqID_66059; Strand=+; Position=1-818

SEQ ID NO: 139637 - protein, 272 aa, Heterodera glycines
  Coding regions on vcDNA: vcDNA=SeqID_66060; Strand=-; Position=1 -115,169-215,261-369,763-946,1579-1808,1922-2055
  Homolog annotation: Hit_ID=AAV34698.1; Match level="QueryCoverage =40%, HitCoverage=42%, E-value=4e-09, Identity=38%"; Hit description =IC5 [Globodera pallida]
MNTEKDMIKAIETKIIALEEHKKNEEIFIGVLKDRFGKELLKAVHPDIRKNIVEKFSYPKQNYWDANASHNDLEVFGTESLKVYYKGDGSVFAHSDLPPKRCHWTEVLAKIGTVVHIKAMANFGSMDQAILEMRTFLVAISSVVALIWPLVGWFISFGFAVKQKTKLDGIILYEKGIYVYESDGEIWLGNSKEKRTNYEYSYGIGDTVGMGINLATRQLFCTKNGLRLGFSDLLVDPSFADDSFHPFLTLGHSDDKIEANFGPNFKFDLATL

SEQ ID NO: 139638 - protein, 105 aa, Heterodera glycines
  Coding regions on vcDNA: vcDNA=SeqID_66061; Strand=-; Position=1 -228,882-971
MSLNRFCAICCSQMYRRHWSQIISKYLLAIILLFALAISAPILWHSVCFRLSEVRTPLGQGQHKMDGPVFMEIPTQQIYYNITKMFAICHLAFLLFAYPLMCRRI

SEQ ID NO: 139639 - protein, 34 aa, Heterodera glycines
  Coding regions on vcDNA: vcDNA=SeqID_66062; Strand=+; Position=1-104
SFSSSIDWYFFRKNFDFFPEIEKIFGLSGTFESR

SEQ ID NO: 139640 - protein, 27 aa, Heterodera glycines
  Coding regions on vcDNA: vcDNA=SeqID_66063; Strand=+; Position=1 -73,203-213
MSEVGTRKSEVGIPCHPWYTMVKKGVL

SEQ ID NO: 139641 - protein, 64 aa, Heterodera glycines
  Coding regions on vcDNA: vcDNA=SeqID_66064; Strand=+; Position=1-192
MVQLANGGGAIGDEVGTEAEQQQRDRMGPAKKKTKRPAEREQNDDQQQKGQRRAKEREDKEEKK

SEQ ID NO: 139642 - protein, 36 aa, Heterodera glycines
  Coding regions on vcDNA: vcDNA=SeqID_66065; Strand=-; Position=1-109
MSEEKFEDVDGSIIGQKRQNTENGGPASKKANVIES

SEQ ID NO: 139643 - protein, 207 aa, Heterodera glycines
  Coding regions on vcDNA: vcDNA=SeqID_66066; Strand=-; Position=1 -101,195-357,600-679,1065-1269,1388-1456
  Homolog annotation: Hit_ID=NP_506356.2; Match level="QueryCoverage =97%, HitCoverage=43%, E-value=8e-55, Identity=54%"; Hit description =calcium-binding EF-hand containing protein (5O34) [Caenorhabditis elegans] emb|CAB01132.2| Hypothetical p
DELTEAMKRRDTTLTIHLFGRRGQNTLSFDEFQNFFYHRLQREIIEIEFHEFARGKTRISTVDFARLVLRYSILHKEEHSPYIRRAYERSQFHCQGVTLQQFEQFSMFLNNLEEFSKAVRLYSLADIPVSQSEFIRAVKCSTGFSLDSALVRVIYKIFDANADDKLSYREFIAVMSDRLSRGLKQRTEQMFWLNSFKECVRNKLSGI

SEQ ID NO: 139644 - protein, 183 aa, Heterodera glycines
  misc_feature (182)..(182): Xaa can be any naturally occurring amino acid
  Coding regions on vcDNA: vcDNA=SeqID_66067; Strand=+; Position=1 -27,188-283,339-636,681-721
  Homolog annotation: Hit_ID=NP_477414.1; Match level="QueryCoverage =91%, HitCoverage=94%, E-value=1e-47, Identity=53%"; Hit description =CG5788-PA [Drosophila melanogaster] gb|AAF57787.1| CG5788-PA [Drosophila melanogaster] gb|AAS93730.1| RE4
TASSRRLQKELSEMRGNNSGAVRVLEVDESNLLRWSLMLYPDREPYNKGAFRVNVDFPTEYPFDREPYNKGAFRVNVDFPTEYPFKPPSVTFATKIYHPNIDDKGQVCLGIILAENWKPATRAEQVMNALLSLIAEPEIAHPLRSDLAEEFQRDKKKFFKNAEDYTKKYADYTKKYAERRDXV

SEQ ID NO: 139645 - protein, 104 aa, Heterodera glycines
  Coding regions on vcDNA: vcDNA=SeqID_66068; Strand=-; Position=1 -104,243-451
LTIHQKDQYQAQNGPTKYEPKAEGQHVTSSVTTAEAGKYSSSSGHASSSESEEEDRWEEPRKRSRNRERDERNGRHGEGEDKAAKRWYKSDESKEEKRDGKGRE

SEQ ID NO: 139646 - protein, 58 aa, Heterodera glycines
  Coding regions on vcDNA: vcDNA=SeqID_66069; Strand=-; Position=1 -75,250-349
MIRSLLGSPLETTPLRRPPAGDFRPELETMFGSQKYRKPRKCNKQNAKLLKVFVGAGQ

SEQ ID NO: 139647 - protein, 52 aa, Heterodera glycines
  Coding regions on vcDNA: vcDNA=SeqID_66070; Strand=-; Position=1 -31,91-219
QFTKSSSNLMKQFPSSFESPNLWNFLNKTTNDDREKEEMKWNEIYLLPSYPN

SEQ ID NO: 139648 - protein, 251 aa, Heterodera glycines
  Coding regions on vcDNA: vcDNA=SeqID_66071; Strand=+; Position=1 -339,415-831
  Homolog annotation: Hit_ID=XP_313035.1; Match level="QueryCoverage =84%, HitCoverage=28%, E-value=9e-15, Identity=25%"; Hit description =ENSANGP00000011760 [Anopheles gambiae]
MASQAEMANLFRQLTDALQNIATQTNPNPNKQNSDLFTTINSQLSEFVYNPETDSTFDIWHDRFGAFIEKDGQQMPDDMKTRLLLGKMSSQDYARYSESILPQNPTDLGYQATRAPSQSVMDFAEQVNACCEKAQMALSKEEIKALIFVSGLNSGDRDLRERCLKLLEESRTKNVAIKFVAIVEECRTILSLRSAAAALEQPGQCFNANAIALKPQQAKERHSRHQKFSPSSRRENSGNQSRSPSLNIRRS

SEQ ID NO: 139649 - protein, 459 aa, Heterodera glycines
  Coding regions on vcDNA: vcDNA=SeqID_66072; Strand=+; Position=1 -641,960-1698
  Homolog annotation: Hit_ID=XP_318550.1; Match level="QueryCoverage =82%, HitCoverage=48%, E-value=3e-36, Identity=37%"; Hit description =ENSANGP00000020240 [Anopheles gambiae]
MLYGRKFTLLTDHKPLISIFGSKNGIPIYTASRLSRWALTLFNTISNLVHFHQRFWTGRCSLSIDHAAPRGTADDDHVIATAQTIPISIQVQKIQLNMPRLPLSMFCMHQLPVTATEVAEKTKQDEELQEVLQNCRNHWPKTAHSSLLSAFYTQRARLTEVDGCLLMGDRVVIPSSLRNRILTALHFTHPGTVRMKSLAKQFVYWPRMDLDIDREHGIRHTFAPPYHPMSNGRAERFVDTLKRQLKKCGETDSHWVQNSLLAFRSTPNASLNGKTPAELFLGSPVRTILSLVRPDEKKKHSDTTDKQYRHKMAQQFNRHYGTKQRTFCTDNPVQFANYRNGSKMWLSGRIVSGNGVVWRIYSPQLNAVVTRHSNQIRKSFPIPYRDSSEPNEQQDQDEQQQEAPQSPRHVRFADEENEPLEHVQIIEPRRSTRQRKQTQIFDMDTTRAKYDLVNPGQNI

SEQ ID NO: 139650 - protein, 82 aa, Heterodera glycines
  Coding regions on vcDNA: vcDNA=SeqID_66073; Strand=-; Position=1 -42,502-708
MPKEMASSNGFIGRLDNVANLELFTKVRILSDGQTFLEAANSVQSAQQTEGAANEMPFTYVDKVRICDTANGDEVNQLNAYS

SEQ ID NO: 139651 - protein, 227 aa, Heterodera glycines
  Coding regions on vcDNA: vcDNA=SeqID_66074; Strand=-; Position=1-686
  Homolog annotation: Hit_ID=KGZQHL; Match level="QueryCoverage=38%, HitCoverage=82%, E-value=1e-20, Identity=35%"; Hit description =histidine-rich glycoprotein precursor - Plasmodium lophurae emb|CAA25698.1| histidine-rich protein [Plasmodium
LNPPTFQSLALNPPTFQSLALNPPAFQSLVLNPPALQSLALNPPTFQSLGLNPALQSLALNPPTFQSLALNPPTFQSLALNPPTFQSLGLNPRALQSLGLNPPTFQSLGLNPPTFQSLGLNPPTFQSLVLNPPAFQSLDSTHQHFNHWHSTHQHFNHWHSTHQHFNHCYSTHQHFNHWDSTHHHFNHWHSTHQHFNHCHSTHHHFNHWYSTHQHYNHCYSTHQHYNH

SEQ ID NO: 139652 - protein, 114 aa, Heterodera glycines
  Coding regions on vcDNA: vcDNA=SeqID_66075; Strand=-; Position=1 -52,313-605
MPFCHFSFAAVESRELIYPIEVKHLALFLLDFYKEFCDQNEQFAFCLATQANILDTFHVELKHRSTEVMKSEKPQNGGQLLLFIELEKRLKMKKQRPADQTGGAICRFAGKETA

SEQ ID NO: 139653 - protein, 181 aa, Heterodera glycines
  Coding regions on vcDNA: vcDNA=SeqID_66076; Strand=+; Position=1 -327,745-960
  Homolog annotation: Hit_ID=NP_506637.1; Match level="QueryCoverage =55%, HitCoverage=58%, E-value=6e-13, Identity=46%"; Hit description =one IG domain (oig-3) [Caenorhabditis elegans] emb|CAB55046.1| Hypothetical protein Y50E8A.3 [Caenorhabdi
MYGTSNVYGLTVVMGRMLMEGNSPLVIPIHPRNGRRFTSEEITTDSVDCMHHFNKLFVLITKTLSEMGEIREDQNNSNYSPNIVHKQKMSQQQMQSKMCKDKTSKPLTKQVDQLLYELPQQNKFSINSLCQPPEFLKVFSDMRCLVGEKAVFDCVLLGSPRPEGDFQFISEALCLIMLNFQ

SEQ ID NO: 139654 - protein, 72 aa, Heterodera glycines
  Coding regions on vcDNA: vcDNA=SeqID_66077; Strand=-; Position=1 -51,95-262
  Homolog annotation: Hit_ID=CAE66237.1; Match level="QueryCoverage =75%, HitCoverage=9%, E-value=7e-15, Identity=61%"; Hit description =Hypothetical protein CBG11481 [Caenorhabditis briggsae]
MTATITWNSPKKNHGPEQYFLLFAQEPAPQFQYWRRFEIGKSKRFTLTDLSPDTRQKFIILIYLIIRAANFM

SEQ ID NO: 139655 - protein, 39 aa, Heterodera glycines
  Coding regions on vcDNA: vcDNA=SeqID_66078; Strand=-; Position=1-118
NVSSSAICTFCCFIWGAWDAIVAAIITVISHCLRYLSFK

SEQ ID NO: 139656 - protein, 47 aa, Heterodera glycines
  Coding regions on vcDNA: vcDNA=SeqID_66079; Strand=+; Position=1 -106,301-338
MDKVGEGHSLGGHRRDPRGRTGVRAAVQRGGGRGPGKNAKFLSFYCY

SEQ ID NO: 139657 - protein, 100 aa, Heterodera glycines
  Coding regions on vcDNA: vcDNA=SeqID_66080; Strand=+; Position=1 -96,1067-1273
MQNIRECFLVITNIKCILQFVFSLLTIFLIQQDNGDGSCKGKGVIVGLALTKQPIIARVLIFNLMTKLPWKSILIQSSDLFGPFRFITPLHCRTKSKSIF

SEQ ID NO: 139658 - protein, 95 aa, Heterodera glycines; identical to SEQ ID NO: 124528
  Coding regions on vcDNA: vcDNA=SeqID_66081; Strand=-; Position=1-854

SEQ ID NO: 139659 - protein, 65 aa, Heterodera glycines
  Coding regions on vcDNA: vcDNA=SeqID_66082; Strand=-; Position=1 -73,123-184,445-505
LEKSAIIGPTDGTDSSVTIQFVTMSTLSPFWAVLLKEQTYLVEIMLNNGQNPNEHVTFMCDEIKQ

SEQ ID NO: 139660 - protein, 47 aa, Heterodera glycines
  Coding regions on vcDNA: vcDNA=SeqID_66083; Strand=+; Position=1-143
MNSDGMDCDEICALEEKWRRMNESKTKDGTEMGRKKQTTVFGRYEWT

SEQ ID NO: 139661 - protein, 79 aa, Heterodera glycines
  Coding regions on vcDNA: vcDNA=SeqID_66084; Strand=-; Position=1 -28,647-858
MRSMKWRVPVSYLILFINFFLHAYVYGGGKSKYRSADQKLNGSSLADQKQPNVDKQRNGTILLMGNNNNANEATPRRDG

SEQ ID NO: 139662 - protein, 52 aa, Heterodera glycines
  Coding regions on vcDNA: vcDNA=SeqID_66085; Strand=-; Position=1 -6,317-469
MPVKFWSCTGPGILTKTGTGLTGTRKVETGTSVFVRVRDREKAVTNREFIFQ

SEQ ID NO: 139663 - protein, 26 aa, Heterodera glycines
  Coding regions on vcDNA: vcDNA=SeqID_66086; Strand=-; Position=1 -12,87-155
MAVLMIIISFINHSCRSHDLLNEYEH

SEQ ID NO: 139664 - protein, 29 aa, Heterodera glycines
  Coding regions on vcDNA: vcDNA=SeqID_66087; Strand=-; Position=1 -3,353-439
MYFSSLKMIISLSKQPIHMELPLVTYLIF

SEQ ID NO: 139665 - protein, 41 aa, Heterodera glycines
  Coding regions on vcDNA: vcDNA=SeqID_66088; Strand=-; Position=1 -39,159-245
MNTQRFAVGPIRAFWSLSRLKGGSSDKKENCVTSLLINLEK

SEQ ID NO: 139666 - protein, 123 aa, Heterodera glycines
  Coding regions on vcDNA: vcDNA=SeqID_66089; Strand=+; Position=1-369
MSAKIIRVPKIACDLSLAKNGVSKNRNYAQKAPQTILALPIPSTIAFIHPIMSAKIIRVPKIACDLSLAKNGVSKNRNYAQKASQTILALPIPSTIAFIHPIMSDKIIRVPKIACDLSLAKNG

SEQ ID NO: 139667 - protein, 78 aa, Heterodera glycines
  Coding regions on vcDNA: vcDNA=SeqID_66090; Strand=+; Position=1-414
NRNYAQKAFQTILALPIPSTIAFIHPIMSAKIIRVPKIACDLSLEKNGLSKNRNYAQKASQTILALPFLLQSPLYIPL

SEQ ID NO: 139668 - protein, 49 aa, Heterodera glycines
  Coding regions on vcDNA: vcDNA=SeqID_66091; Strand=-; Position=1 -76,424-497
MTSTEVHNVIAFGGMARYVEKNVDRGAMYSLGGGGGGASREGADDGLKD

SEQ ID NO: 139669 - protein, 721 aa, Heterodera glycines
  Coding regions on vcDNA: vcDNA=SeqID_66092; Strand=-; Position=1 -393,711-986,1041-1671,1740-2602
  Homolog annotation: Hit_ID=AAA93301.1; Match level="QueryCoverage =38%, HitCoverage=76%, E-value=1e-43, Identity=37%"; Hit description =HASI
MDAFQQFKREDGQFRHPFTMIVSGSTGSGKSEWIMRLLRNVDKMISTPVERVIYSYGELNTNVMNLQRAGKVGNVPVTVHSGVPRAEQVRECAKKVKTLLVLDDLVVGMSQQYLDALFTRGSHNWGVSVILTLCNAKKAKALIRYASDEQLLCLVEICLNILKGRVPLRPRYLNKLKAHAQVLRRLARTRCSRSAKKVLLQHGDGLPAIVGLIASIALPLIADHTKRYLLVPEEIYQSLAAPPPSDGTPIGLVRTRIKQIKNDAAINEAERAVKYEQEVKRLNKLTKDEDERPVGVKLENLSDVVDAMPKPVNVTRPIVVSTRRHLKVGRAQKENVEQLEDTDDDDDYQNPRSSSSNKRQPTQTEILKLIYKNAQSLGVSEEGQVLRAGGRPFITSSVDDIVSHLLNKDKRGQNKEPTAFKEFVERARQNPLLTIIMDLKKLRLLEFLYKDLSSPVAFTSVEPLLREARKSQPKINRNDVQNYLTSQRTYTLHRQAKRRYRRLPTLAPGLHTEWQADLAIFDRIAKQNHGFKYLLVCIDTLSRQVFAEPVKTKTSANMIIAFDRIFKRSKYIPWKVLTDQGKEFTARAVQQFFRTKDVEHFCMLTSPQFHAGMAERANRSIKERLYRYFTERNTYKWIDVVQDIVCAINHSTNSSIGMCPADVNFKNAEALRQKLHDAVENVVRRKPKYRVGDRVRIEKYKHVFQKGYLPRFTNELFTVAE

SEQ ID NO: 139670 - protein, 72 aa, Heterodera glycines
  Coding regions on vcDNA: vcDNA=SeqID_66093; Strand=+; Position=1 -127,969-1058
MDLQDANKENKEPTKKQEEEADDPSWISLIDEEMKREPLAPIGVAQAGNLCGIVPDADVKFSEATAAAPIQF

SEQ ID NO: 139671 - protein, 38 aa, Heterodera glycines; identical to SEQ ID NO: 130615
  Coding regions on vcDNA: vcDNA=SeqID_66094; Strand=+; Position=1 -52,124-188

SEQ ID NO: 139672 - protein, 99 aa, Heterodera glycines
  Coding regions on vcDNA: vcDNA=SeqID_66095; Strand=-; Position=1 -220,270-346
NVSLFERIVSILCVFGVFVGLFAFLWSLVILFDLFSGWENKPRWALPALAFSTFSLASVAAVIYLFRGCSENDNFVSHLTSSPSSPSSSPVAKCSLHYS

SEQ ID NO: 139673 - protein, 181 aa, Heterodera glycines
  Coding regions on vcDNA: vcDNA=SeqID_66096; Strand=+; Position=1 -102,163-362,451-651,948-971
  Homolog annotation: Hit_ID=CAE64343.1; Match level="QueryCoverage =99%, HitCoverage=29%, E-value=3e-54, Identity=59%"; Hit description =Hypothetical protein CBG09029 [Caenorhabditis briggsae]
YQFFLQLRHDIQTGRLDCPREAVIDLAALALQSEFGDFSPEFGDFSPKEHSMEFVSEFRFHPAQDEHMERDILHSYATKCSGMSPSQAELAFLNNARLLDFYGVDMHPVEGRDGNTYRLGLTPVGMQVFDGRQKIGLFVWEKIQRLDFRGRKLTLVVEEDLEQPVSQISQFWGLAFSLFSH

SEQ ID NO: 139674 - protein, 159 aa, Heterodera glycines
  Coding regions on vcDNA: vcDNA=SeqID_66097; Strand=-; Position=1 -84,199-351,467-709
MAYDYGGFKSESNCSCPNSQLIATKFIVAEYDCDDDHDSAKILGGMRKINRAGLSALTGLGLSSPRQSSFSMQKRKYAEVQFKCEQCGQIVHKTYEIRQNGTKWDTFGRHTDIHPVKISGPIYNRTYEDVERIYDDMWSDYSVGTRNTKDWVEEMIHRL

SEQ ID NO: 139675 - protein, 44 aa, Heterodera glycines
  Coding regions on vcDNA: vcDNA=SeqID_66098; Strand=+; Position=1-133
MTESDEGTNWVESHPCRCGAKNWTASHMERVMVKLCCGSEEVQN

SEQ ID NO: 139676 - protein, 145 aa, Heterodera glycines
  Coding regions on vcDNA: vcDNA=SeqID_66099; Strand=+; Position=1 -67,133-437,482-547
MNVIQSKTVIKKKSQWKPLEIGTTKIPDPEELPFGIVQTAFRASDRMRTTSEDSAESFDAYGPEWEGKGRGIGNRREFSSPNMTSSGRRMSITERLFGRPVPQERRNSLGEEQMGQEKPKSIAENKDFKELMKRQRKILGDDEWQ

SEQ ID NO: 139677 - protein, 70 aa, Heterodera glycines
  Coding regions on vcDNA: vcDNA=SeqID_66100; Strand=-; Position=1 -89,304-427
MALAGFDTSKEKMPDNPCDTMLINALIMAWKKFDDKDAIILIVAGKLYRDYEQYQLNYLMENVGNVKLAF

SEQ ID NO: 139678 - protein, 151 aa, Heterodera glycines
  misc_feature (130)..(130): Xaa can be any naturally occurring amino acid
  misc_feature (148)..(148): Xaa can be any naturally occurring amino acid
  Coding regions on vcDNA: vcDNA=SeqID_66101; Strand=+; Position=1 -186,266-528
  Homolog annotation: Hit_ID=NP_492749.2; Match level="QueryCoverage =67%, HitCoverage=24%, E-value=3e-23, Identity=53%"; Hit description =abnormal CHEmotaxis CHE-13, intraflagellar transport protein CHE-13, similar to mammalian Hippi gene (46.
SNERRNGRSESANGDKKKKVKEEGPGRLYDAFAQAELVAERLKLLDYEREFVPLGDSLKPILRHRHYFALSTNIGEQFHLFTSLCAWLIRKSGVDPSMEMPHEFDDPNATIAQILESLKAKVAGGGRRGXRETVETLDRAFPPTNPNXDLH

SEQ ID NO: 139679 - protein, 72 aa, Heterodera glycines
  Coding regions on vcDNA: vcDNA=SeqID_66102; Strand=-; Position=1 -80,220-358
MNGYSILCVMLLVELVVVPIVNGSPVVKYQLGKRISFLKIIEQILRLNVLLFQYFLTFLESKFLLFFLFNFY

SEQ ID NO: 139680 - protein, 48 aa, Heterodera glycines
  Coding regions on vcDNA: vcDNA=SeqID_66103; Strand=-; Position=1 -76,119-186
  Homolog annotation: Hit_ID=NP_503027.1; Match level="QueryCoverage =95%, HitCoverage=33%, E-value=1e-15, Identity=80%"; Hit description =small nuclear ribonucleoprotein, small nuclear ribonucleoprotein SNR- 1 (14.8 kD) (snr-1) [Caenorhabditis
MTAIGVPIKILHEAEGHIVTLETTIGEVYRGKLNEAEDNMNCQMSDVT

SEQ ID NO: 139681 - protein, 171 aa, Heterodera glycines
  Coding regions on vcDNA: vcDNA=SeqID_66104; Strand=-; Position=1 -403,862-974
MQAILTQKNRTKLQHNGHSYIFHKPSADGEVRFWSCEHHHAKDIRCKGRLHTNLNNNVLREVGNHQCEPSAARMEAQRVITKIKRRAEQTMEPPATIRSLSLQNVATPVLAQLPTKNAIKKVFSLFFVMRFLCLGKWPKCLSREMAGREVAVGKWLDPFDEKRQSLIFNDA

SEQ ID NO: 139682 - protein, 30 aa, Heterodera glycines
  Coding regions on vcDNA: vcDNA=SeqID_66105; Strand=-; Position=1-90
VIKNLLKNNPPVSIKGPVSNYVPLSEEVAK

SEQ ID NO: 139683 - protein, 101 aa, Heterodera glycines
  misc_feature (42)..(42): Xaa can be any naturally occurring amino acid
  misc_feature (56)..(56): Xaa can be any naturally occurring amino acid
  misc_feature (75)..(75): Xaa can be any naturally occurring amino acid
  misc_feature (87)..(87): Xaa can be any naturally occurring amino acid
  Coding regions on vcDNA: vcDNA=SeqID_66106; Strand=+; Position=1 -41,80-341
  Homolog annotation: Hit_ID=CAE71161.1; Match level="QueryCoverage =77%, HitCoverage=20%, E-value=3e-12, Identity=48%"; Hit description =Hypothetical protein CBG18017 [Caenorhabditis briggsae]
RGICSRWLLDNPIRFGGVGHVVQIDEALIARRKYHRGHRVRXIWLFGMYDVHTNNXVVRIVPDRSRATLLPIIEXFVVAGSSIHSDXMGAYMGGAIQPSLS

SEQ ID NO: 139684 - protein, 99 aa, Heterodera glycines
  Coding regions on vcDNA: vcDNA=SeqID_66107; Strand=+; Position=1 -159,216-356
LLMMLALVMIHPPNPCAIDQPRRRFIRVSLALFPSGRNDQKFADAFHNCHYVSIFVHYFPLFFSLFLSLQTPNIAIACKLLLCLGQAEGQVLLGEGQKN

SEQ ID NO: 139685 - protein, 39 aa, Heterodera glycines
  Coding regions on vcDNA: vcDNA=SeqID_66108; Strand=-; Position=1 -109,287-297
MRVDFKYALAIQVRIHAMRSTFKSKTRFRAFEHEPIGFN

SEQ ID NO: 139686 - protein, 21 aa, Heterodera glycines
  Coding regions on vcDNA: vcDNA=SeqID_66109; Strand=+; Position=1-65
LCFIFSVNFINLSFKSINVYL

SEQ ID NO: 139687 - protein, 244 aa, Heterodera glycines
  Coding regions on vcDNA: vcDNA=SeqID_66110; Strand=-; Position=1 -79,125-261,313-390,448-590,635-715,766-809
  Homolog annotation: Hit_ID=NP_723791.2; Match level="QueryCoverage =100%, HitCoverage=94%, E-value=5e-55, Identity=41%"; Hit description= CG5547-PC, isoform C [Drosophila melanogaster] gb|AAN10827.2| CG5547 -PC, isoform C [Drosophila melanogas
DQEARSPWTCISRFLPSTQTIMQFSEGRAPTPEDRIVYVCGSRAPTPEDRIVYVCGSFDLFHIGHLCFLEEARRLGDYLIVGIYSDQDVNSYKGQNYPIMDVNSYKGQNYPIMTLHERVLSVLAYKPVSEVVIGPVSEVVIGAPLCVTKELIDRFRINFVVQGIRTEHHTATEEADCYEVPKHLGIFKHLGIFKTVDSGNEMTTERIIERIIKNRLEFEQRNRAKERKERLEFEQRNRAKERKE

SEQ ID NO: 139688 - protein, 169 aa, Heterodera glycines
  Coding regions on vcDNA: vcDNA=SeqID_66111; Strand=+; Position=1-508
  Homolog annotation: Hit_ID=AAO52297.1; Match level="QueryCoverage =72%, HitCoverage=10%, E-value=2e-11, Identity=34%"; Hit description =similar to Plasmodium falciparum. Cell differentiation protein rcd1, putative [Dictyostelium discoideum]
MVAHEGVISGHLDRPFSNGAAAAAAAVHHQQQQQQLFHQRHHQLQQQQHHHHHHQQQQHAKQHPSSSVGDCGEEPMDSASGAGTFCASSSTISNTTSSSNMVEKCEPSTVADEAGEPMPANIASSNSGNNTNNNNAMMECNSSNKLEMGQPPNGSTTTAPKQHPSTRGT

SEQ ID NO: 139689 - protein, 26 aa, Heterodera glycines
  misc_feature (4)..(4): Xaa can be any naturally occurring amino acid
  Coding regions on vcDNA: vcDNA=SeqID_66112; Strand=-; Position=1-84
QINXFVVSFNSFLCSLSEYNFLIFLT

SEQ ID NO: 139690 - protein, 41 aa, Heterodera glycines
  Coding regions on vcDNA: vcDNA=SeqID_66113; Strand=+; Position=1-170
KQKMGKIIKLIAWLKFNQINISWYHSIALIVLFQNIIFLYF

SEQ ID NO: 139691 - protein, 72 aa, Heterodera glycines
  Coding regions on vcDNA: vcDNA=SeqID_66114; Strand=+; Position=1 -102,140-256
MKNARISLGDSISKFLIQFRTFGASIRSSLSRQLELMDTRNGLYNKKNTVTLGIQFTVEGEDGGEQQAMEAD

SEQ ID NO: 139692 - protein, 42 aa, Heterodera glycines; identical to SEQ ID NO: 128558
  Coding regions on vcDNA: vcDNA=SeqID_66115; Strand=+; Position=1-126

SEQ ID NO: 139693 - protein, 376 aa, Heterodera glycines
  misc_feature (165)..(166): Xaa can be any naturally occurring amino acid
  Coding regions on vcDNA: vcDNA=SeqID_66116; Strand=+; Position=1 -71,141-244,573-629,817-1095,1870-2067,2508-2648,2809-2964,3206-3320
  Homolog annotation: Hit_ID=CAE59319.1; Match level="QueryCoverage =96%, HitCoverage=38%, E-value=1e-146, Identity=69%"; Hit description= Hypothetical protein CBG02659 [Caenorhabditis briggsae]
AQKRSRRRSKYRAFVVKPPPASRSLPIQPLPIQPLLVFVNPKSGGNKGAKALNTLCWLLNPRQVFDVNVMRGPKYGLDMFRKHSSMRILVCGGDGTVGWVLSTLDQLGWPAYPPIALLPLGTGNDLSRAMGWGGTFSSDEPLAEVLAAIQTETSITHLDRWGRTXXPIGDKRLYEAADAVQNQLPLSVMNNYFSIGADAHVALQFHQSRSANPQMLNSRFKNRIAYGGLGTIDLFKRTWKDLSEYINVECDGVDITAKIREFKFHCILFHNISFYAGGTVPWGAGDGSRPSPCDGKIEVLGFTTATLAALQMGGKGERIAQCSKVRIETSKPIPMQVDGEPCLLGPSLIHLSFHNKGKAIKQLISLLSISPSLYSR

SEQ ID NO: 139694 - protein, 182 aa, Heterodera glycines
  Coding regions on vcDNA: vcDNA=SeqID_66117; Strand=+; Position=1 -137,483-894
MCRRRRQGRSRLTAKQHNVAGRASGCCWPARLRHVQRLGGTAERHRCVQRGGGHFPRVASPGAESDGGRRVHIGGGGGHQQQSGHFHFGRRFPFNECPGGGHRRTRIGVHTGQNEVTSNTTFVPDLKNREKDKSFSLTQTVPGFPIDRAQILIDVRAKAFSLAFSRSLIIYGPESTLIWKLP

SEQ ID NO: 139695 - protein, 64 aa, Heterodera glycines
  Coding regions on vcDNA: vcDNA=SeqID_66118; Strand=-; Position=1-252
FRLICSFSFSSSSINCHSFPFQVLAFRPLLFWRTFVRFVVTFRALRFRQIVAASAFAGRLHAAL

SEQ ID NO: 139696 - protein, 770 aa, Heterodera glycines
  Coding regions on vcDNA: vcDNA=SeqID_66119; Strand=-; Position=1 -70,123-1252,1431-1589,1637-2590
  Homolog annotation: Hit_ID=CAE59237.1; Match level="QueryCoverage =95%, HitCoverage=92%, E-value=4e-89, Identity=37%"; Hit description =Hypothetical protein CBG02561 [Caenorhabditis briggsae]
MNKAFATIVLLVVLLAVEVQNRSIVKRANQQNAYGDEPVVPSGAHQAAPAPAEQNAPTVQQPSPVSPPEQAQAGAQPSPNAAPTATQPQQGEAAAVPYSGGANAGAQPSKPAEAAASAPAAAEQAPAAAPAQSQPAQAAPAPATAEQAPASAAQPAAGGYAAANAGEQKKPAESAPAPSAAEQAQAAAPAPASQPAQSAPAPAEQPAAAPAPAAAEQAPAVAAQPAAGGYGGANAGEQQKPAEAAPAPVEQPAAVPAPAQPAPAQPAPAQAAPAGYGNAAEQPKPAEAAPAPAAAEQAPAAAPAPPQPAESAPAPAAAEQPKPAEAAPTPAAQPAEHPAESAPAQQAAPSPAASSGYGAAAAEQPKPAESAPAPAVAEQAPAPAQSQPAESAPGAAAPSEAPKPAENAPPASNASPTEAGSASAAAAPSGGAAVYGNAQPSAGIPSVSAPTSEGSAAAPPSEANPAQGEQPAPAAQSQAQPAEAAPAPAAAEQPKPAEAAPAPAAQPAQAAQPAAGYGGAEQQKPAEAAPAPAAVEQPKPAEAAPAPAVAEQAPAASPAQSQPAQAAPAPAAAEQAPVAAAQPAAGGYGGANAGEQQKPAEAAPAPAAVEQPKPAEAAPAPAVAEQAPAAAPAQSQPAQAPASVYGGAEQQKPAEAAPAPAAAAAPAPAESAPAQSAPSAAAGYGGAESAPAAAQPAPAGANAAAPAEQPAPANAGGPSGAAPAPEASAQPQPSASAPAEQAKPAESAAAGSPPYAGGAAPKTAPSGYGA

SEQ ID NO: 139697 - protein, 629 aa, Heterodera glycines
  misc_feature (65)..(65): Xaa can be any naturally occurring amino acid
  misc_feature (103)..(103): Xaa can be any naturally occurring amino acid
  misc_feature (112)..(112): Xaa can be any naturally occurring amino acid
  misc_feature (186)..(186): Xaa can be any naturally occurring amino acid
  misc_feature (194)..(194): Xaa can be any naturally occurring amino acid
  misc_feature (225)..(225): Xaa can be any naturally occurring amino acid
  misc_feature (270)..(270): Xaa can be any naturally occurring amino acid
  misc_feature (282)..(282): Xaa can be any naturally occurring amino acid
  misc_feature (320)..(320): Xaa can be any naturally occurring amino acid
  misc_feature (367)..(367): Xaa can be any naturally occurring amino acid
  misc_feature (430)..(430): Xaa can be any naturally occurring amino acid
  misc_feature (433)..(433): Xaa can be any naturally occurring amino acid
  misc_feature (492)..(492): Xaa can be any naturally occurring amino acid
  misc_feature (550)..(550): Xaa can be any naturally occurring amino acid
  misc_feature (580)..(580): Xaa can be any naturally occurring amino acid
  misc_feature (602)..(602): Xaa can be any naturally occurring amino acid
  Coding regions on vcDNA: vcDNA=SeqID_66120; Strand=+; Position=1 -453,583-840,1294-2356,3614-3683,3775-3836
  Homolog annotation: Hit_ID=AAC14589.1; Match level="QueryCoverage =100%, HitCoverage=94%, E-value=4e-91, Identity=40%"; Hit description= minor ampullate silk protein MiSp1 [Nephila clavipes]
AADSAGFACSAGAEAAVGAAEASGAGAAPLGPPAFAGAGCSAGAAAFAPAGAGCAAAGADSAPPXPAAAEGAGAGADSAGAGAAAAAGAGAASAGFCCSAPPXTEAGAWGDXAGAAAGACSATAGAGAASAGFGCSTAAGAGAASAAAGACSATAGAGAASAGFGCSTAAGAGAASAGFCCSAPPXPAAGCAAXAGCAAGAGAASAGFGCSAAAGAGAASAGWAXDCAAGAGSGADSAGWDCAGAGACSATAGAGADSAGFGCSAAAAPXPELAAGDGAACXAGADSAGCSAGCAAGVGAASAGFGCSAAAGAGADSAGXGGAGAAAGACSAAAGAGAASAGFGCSAAFPYPAGAAWAGAGCAGAGXAGAGTAAGCSTGAGAASAGFCCSPALAPPYPPAAGCAATAGACSAAAGAGAAAGCSAGAGADXAGXDAGAGAAACACSAADGAGADSAGFFCSSVGCGVSAGAGCAADAGACSAVAGAGAAWAGXDCAGAAAGACSAAAGADAAASAGFEGCAPAFAPPLYGTAAASPCCGCVAVGAAFGLGXAPACACSGGLTGLGCCTVGAFCSAGAGAAXCAPEGTGGGGEEGRRQSGLGLXALAGTAAGSADVPRGNNGSGGGGGGGE

SEQ ID NO: 139698 - protein, 75 aa, Heterodera glycines
  Coding regions on vcDNA: vcDNA=SeqID_66121; Strand=-; Position=1 -169,314-372
MASQYHRLNQSPVFRTPGLAKLFSQKQEQLHRQQMMMAILNEAPVDTPPLTDDEDYVNVGECIMGYGSAANSYIE

SEQ ID NO: 139699 - protein, 52 aa, Heterodera glycines
  Coding regions on vcDNA: vcDNA=SeqID_66122; Strand=-; Position=1 -93,217-282
MRFRFRRCVLLLLGTVLTALLIILLVTQRHTSTNQQGGHSSNGDEIGTNEGN

SEQ ID NO: 139700 - protein, 68 aa, Heterodera glycines
  Coding regions on vcDNA: vcDNA=SeqID_66123; Strand=-; Position=1 -18,288-476
MLLSPALLIMLYNAFKPRREAGQFQNFVPHFTVESPSTLLDNYVSMSTVAFGQLWNGKWKYQMGCALF

SEQ ID NO: 139701 - protein, 62 aa, Heterodera glycines
  Coding regions on vcDNA: vcDNA=SeqID_66124; Strand=+; Position=1-390
LLIMLYNAFKPRREAGQFQNFVPHFTVESPSTLLDNYVSMSTVAFGQLWNGKWKYQMGCALF

SEQ ID NO: 139702 - protein, 289 aa, Heterodera glycines
  Coding regions on vcDNA: vcDNA=SeqID_66125; Strand=+; Position=1 -294,349-538,592-783,893-1086
  Homolog annotation: Hit_ID=E86336; Match level="QueryCoverage=53%, HitCoverage=35%, E-value=3e-36, Identity=66%"; Hit description =hypothetical protein F14O10.11 - Arabidopsis thaliana gb|AAF88160.1| Contains weak similarity to an unknown pr
MENNVNDIEIGKVGEIAEEEEEEEEEKEEEEEEEEEEEEEEEKEEEEEEEKEEEEEEEEEEEEEEEKEEEEEEEEEEEKEEEEEEEKEEEKAKEEKTELPNKNVKKNYSEEKKQKLVKKLLKLKEKLKGKIPQQKIDKAFANKVGRDFATIRKWKREFGLTEKRREYSTKEKGEIVEKFARLKKAFANEKCEEKKTAREIDSKIEKIIGFGIATIYLWKRELALTEKCPRKKYSSEDKMKIVQRYDEMKAETPYLRLKDIAKMLEVPERTLIAMRRELSTEQSPKASSN

SEQ ID NO: 139703 - protein, 34 aa, Heterodera glycines
  Coding regions on vcDNA: vcDNA=SeqID_66126; Strand=-; Position=1-104
GWLFFYNIQRQLRTVRLARENHPPFFPWAMSDSD

SEQ ID NO: 139704 - protein, 95 aa, Heterodera glycines
  Coding regions on vcDNA: vcDNA=SeqID_66127; Strand=-; Position=1 -31,74-144,475-660
MKIVYCNWKSENFTIVKLSFDLSCIFLYRIFSPAKNSEVKIRKLFEVKMSLMFKNTKENAEKEKVEMEEETDEQKWKKYRNKFLGFLNSPLLPIV

SEQ ID NO: 139705 - protein, 232 aa, Heterodera glycines
  Coding regions on vcDNA: vcDNA=SeqID_66128; Strand=-; Position=1 -604,725-817
MLALAVTSPSMKTTHADIDKPPGCEAVNVSNGQRIGETCGGSGSYATGDCSRSGGTAAAYLLGSGARIRSTGCFIYPHRKDKKWVSSLWSLVKGWNPSLWALVKGWSPNIPFRFIKITTSVLKGGVITADDVRELTRGLTALELDAKVRALKEKNDRMYDQITARLRQQTDAITRLRALKSVRRRRPAVGQTKKKTSVSGTVAAKRQKTVPRNDQEIAGRHRKVIIDDSSEE

SEQ ID NO: 139706 - protein, 305 aa, Heterodera glycines
  Coding regions on vcDNA: vcDNA=SeqID_66129; Strand=+; Position=1 -78,136-199,256-473,591-640,680-788,835-965,1013-1139
  Homolog annotation: Hit_ID=NP_492117.1; Match level="QueryCoverage =98%, HitCoverage=42%, E-value=2e-88, Identity=60%"; Hit description =atp-dependent clp protease atp-binding clpx like (63.6 kD) (1I153) [Caenorhabditis elegans] emb|CAA98115.
SALNEEEPQIRLEKSNIVLLGPSGVGKTKTFVTQVLARILDVPIALCDCTSTSMTQAGYVGEDVESVLQKLLQNAQGNVEKAQRGIVFLDEIDKIAATREAISHAYRDVSGEGVQHALLKMVEGTVVNVKTGRKGQQVIRESVPMDTTDILFIASGAFNGLGQQVIRESVPMDTTDILFIASGAFNGLERVVSRRLDKRTVGFGAALLENSITAALLENSITDDDKEQQVIKKRDKLFLQADQGDMIKFGMIPELVGRFPVLVPFVGRFPVLVPFHSFDKQMLIRVLTEPKNSLLAQMKFQFSDN

SEQ ID NO: 139707 - protein, 204 aa, Heterodera glycines
  Coding regions on vcDNA: vcDNA=SeqID_66130; Strand=-; Position=1 -114,190-283,332-480,735-813,1105-1283
  Homolog annotation: Hit_ID=NP_491896.1; Match level="QueryCoverage =97%, HitCoverage=46%, E-value=2e-55, Identity=48%"; Hit description =metalloenzyme (59.2 kD) (1H147) [Caenorhabditis elegans] gb|AAB96720.1| Hypothetical protein F57B10.3a [C
MRQITKCMGGLQNLQDLPTKVALPKRLHIKTMTQYNAEFPFPILFPPVSHQNVLAEWLSKLKVSQFHCAESEKYAHVTFFFNGGREEAFEGEEHVMVPSPRVATYDKKPEMNCEGIADKVVKQIELGKHPFIMCNFAAPDMVGHTVPFACSSTSHSFKSAPPITAEGVPRARALCDVAPTVLYLMGLTKPEEMDGQNLLGTAAN

SEQ ID NO: 139708 - protein, 169 aa, Heterodera glycines
  Coding regions on vcDNA: vcDNA=SeqID_66131; Strand=-; Position=1 -243,612-728,1151-1298
  Homolog annotation: Hit_ID=CAE67217.1; Match level="QueryCoverage =72%, HitCoverage=22%, E-value=8e-43, Identity=68%"; Hit description =Hypothetical protein CBG12654 [Caenorhabditis briggsae]
MINNHLVENKCVLIVIDGWGLTEEEHGNAIANANTPVMDQLCSGNWQQLEAHGEHVGLDKERMGNSKCGHLNIGAGRVIDQDIIRINLAVRNGQLIENREVIDAAEQAINGNGRLHLLGLVAYEALVGGVGEQCEPANAVQLVNKRYAIQEETDEFLTPIVFSDEARVK

SEQ ID NO: 139709 - protein, 111 aa, Heterodera glycines
  Coding regions on vcDNA: vcDNA=SeqID_66132; Strand=+; Position=1 -39,114-213,267-322,377-517
MTFFFTNSESRSRGIASHRVNQMPPEKDKAANIEPTGSDYPDSEDEMAILEWFDKPISEDILNLSKHPPPQNKIHNLQPARENDDDDLDIIAYICKNMNEGWGLGWGLMHY

SEQ ID NO: 139710 - protein, 84 aa, Heterodera glycines
  Coding regions on vcDNA: vcDNA=SeqID_66133; Strand=+; Position=1 -135,478-597
MKLKPNPVKQREHRTRLEKYINSEACADDTAVFDMFPHCADDFAPGIASHRVNQMPPEKDKAANIEPTGSDYPDSEDESYILFI

SEQ ID NO: 139711 - protein, 80 aa, Heterodera glycines
  Coding regions on vcDNA: vcDNA=SeqID_66134; Strand=-; Position=1-243
MDGKDVDKDEVNTMKTMQFKRSEQQMPLRNGRDIQLADLGRANKEDLLKKEDASRTDDNLTGSLISKSHFDLKAKQSIGR

SEQ ID NO: 139712 - protein, 100 aa, Heterodera glycines
  Coding regions on vcDNA: vcDNA=SeqID_66135; Strand=-; Position=1 -162,798-937
  Homolog annotation: Hit_ID=NP_508380.2; Match level="QueryCoverage =100%, HitCoverage=24%, E-value=3e-37, Identity=70%"; Hit description= lysophosphatidic acid acyltransferase (XC686) [Caenorhabditis elegans] gb|AAF39832.2| Acyltransferase-li
VNAPIYPIAMKYDSRFGDAFWNSSEQSYFRYLLQMMTSWALICHVWYLPPMTKEPGESAISLANRVKKAIAVRGGLVDLDWDGQLKRYKVPARMVDEQRE

SEQ ID NO: 139713 - protein, 144 aa, Heterodera glycines
  Coding regions on vcDNA: vcDNA=SeqID_66136; Strand=-; Position=1 -73,144-469
  Homolog annotation: Hit_ID=NP_508380.2; Match level="QueryCoverage =68%, HitCoverage=20%, E-value=4e-26, Identity=60%"; Hit description =lysophosphatidic acid acyltransferase (XC686) [Caenorhabditis elegans] gb|AAF39832.2| Acyltransferase-lik
MRIGSRAFSALIFFHDSHNKAQSGGICVANHTSPIDVICVANHTSPIDVVILGSDTAYALIGQKHGGVIGLIQRALSRASSHIWFERSEAKDRSLVCNRWVFVLKKCGKVPQIFHFHCNCARDGIYKIYLRNLLAFSIMMILIF

SEQ ID NO: 139714 - protein, 107 aa, Heterodera glycines
  Coding regions on vcDNA: vcDNA=SeqID_66137; Strand=-; Position=1 -232,623-714
MSHRQFLLQNSMPIFIHFLKFISVHYLSPFPPRHYHPRDVHPALGRAGPVPAAGVPIPNVRQFARMARHSGLHVLHKGRAVGLVEYADTDQRQLLPISEVLKNKQIN

SEQ ID NO: 139715 - protein, 56 aa, Heterodera glycines
  Coding regions on vcDNA: vcDNA=SeqID_66138; Strand=-; Position=1-168
  Homolog annotation: Hit_ID=NP_508379.1; Match level="QueryCoverage =82%, HitCoverage=7%, E-value=5e-09, Identity=68%"; Hit description =lysophosphatidic acid acyltransferase (69.9 kD) (XC686) [Caenorhabditis elegans] gb|AAF39831.1| Acyltransf
MSLLLLSATAEHLLVLSAFFFPPALLIVLLVVVLATFGKSLGLRERYVSILIRIFE

SEQ ID NO: 139716 - protein, 78 aa, Heterodera glycines
  Coding regions on vcDNA: vcDNA=SeqID_66139; Strand=+; Position=1 -216,267-287
MILQLAIDTANEWQLNEIMDVIIREIFDQNLEEMFKKAEEKAKKDKPSRAYTINNDKHNIILYSKFDDQNTWFNDALF

SEQ ID NO: 139717 - protein, 113 aa, Heterodera glycines
  Coding regions on vcDNA: vcDNA=SeqID_66140; Strand=+; Position=1 -139,370-572
  Homolog annotation: Hit_ID=NP_996669.1; Match level="QueryCoverage =95%, HitCoverage=66%, E-value=1e-12, Identity=34%"; Hit description =similar to Hypothetical protein CBG21647 [Homo sapiens]
MIRRGGTMIKRGTTVIKGGTKVIKRGTKMIRRGTTMIRRGTAVIRRGTTLIRRGTTVIRRGATVIRRGTTAIRRGTTVIRRGTKVIRRGATEIRRGTTGIRRGTNLMKRYNSD

SEQ ID NO: 139718 - protein, 282 aa, Heterodera glycines
  Coding regions on vcDNA: vcDNA=SeqID_66141; Strand=-; Position=1 -223,336-971
  Homolog annotation: Hit_ID=XP_311331.1; Match level="QueryCoverage =98%, HitCoverage=100%, E-value=2e-41, Identity=36%"; Hit description= ENSANGP00000001657 [Anopheles gambiae]
CEPSSDHCTSSNPCCTSSNLCCTSSNHCCTSSNHFCTSSNHCCTSSSNCTSSNLCCTSSNHCCTSSNLCCTSSTSSNHCCTSSNLCCTSSNHCCTSSSNTSSNPCCTSSNLCCTSSNHFCTSSNHCCTSSNRCCTSSNHCCTSSNHCCTSSNQCCTSFNSLCTSFSLMTSFNHCCTSSNHCCTSSDHFCTSFNHCCTSFNHCCTSSNHCCTSSDHFCTSFNQICTPSNNGTSSDHCCTSSNHCCTSSNHFCTSFNHFCSSFNHCCTSFNHCSTSSNHCCTSS

SEQ ID NO: 139719 - protein, 212 aa, Heterodera glycines
  Coding regions on vcDNA: vcDNA=SeqID_66142; Strand=+; Position=1-639
  Homolog annotation: Hit_ID=NP_415836.1; Match level="QueryCoverage =100%, HitCoverage=63%, E-value=1e-116, Identity=100%"; Hit description=putative LACI-type transcriptional regulator [Escherichia coli K12] gb|AAC74402.1| putative LACI-type
MIKGIIMLSSPADESFFAQLDKYDIPVVVIGKVEGQYAHVYSVDTDNFGDSIALTDALIESGHQNIACLHAPLDVHVSVDRVNGYKQSLAAHNIAVRDEWIVDGGYTHETALKAARQLLSQSPLPEAVFATDSLKLMSIYRAAAEKNIAIPQQLAVVGYSNETLSFILTPAPGGIDVPTQELGQQSCELLFRLISGKPSPQNITVATHMTLK

SEQ ID NO: 139720 - protein, 87 aa, Heterodera glycines
  Coding regions on vcDNA: vcDNA=SeqID_66143; Strand=+; Position=1 -96,135-302
MPKQNEIVLKYSFLDLTWFLDIEAVFYAISKTKKCLVVKTIFHISLHNFVSSARIETGIRPLERAARALQEGMERNSYFWDFFRNQN

SEQ ID NO: 139721 - protein, 279 aa, Heterodera glycines
  Coding regions on vcDNA: vcDNA=SeqID_66144; Strand=-; Position=1 -418,476-573,678-1001
MMELASLAVPLLKDDGQNKLLLMKLLQKCVSHFLCRANFLDLNEKNNFELEKSKWHELGKIQSAFCKEMEKGEILKVTEEKTKNMAIQFANYFEEMKINEENIRTNVQNANDKFVKYFGKESDKILKNLFDAFKVFVESVNNQKMCRFRHQISIAKHMQSLATELLRSALATVTVSTAGLQQTQRRRKRMHSFDGVQQPRQSQAGRSQVGAVQHQEHRPNWRCNCVLTIAFLSLGTLFYAFFLLIQKASEAHALFFLFAFITFVLSLGTYFKFCSLICQ

SEQ ID NO: 139722 - protein, 94 aa, Heterodera glycines
  Coding regions on vcDNA: vcDNA=SeqID_66145; Strand=+; Position=1 -154,215-335,915-924
MRLLISKTGILDVTITRHHKSWHSFLFPTLLNFVEFKICNFKNQREILGIEGVACLINYKYFETRRMEMRKSFQIGHELCKNVTAFKRELFGSL

SEQ ID NO: 139723 - protein, 56 aa, Heterodera glycines
  Coding regions on vcDNA: vcDNA=SeqID_66146; Strand=+; Position=1 -58,170-282
MIRRTNFACTTRRGDFVSREKFNNISVSVILMREDKQFLRDLTFNRKAISIVEHLN

SEQ ID NO: 139724 - protein, 23 aa, Heterodera glycines
  Coding regions on vcDNA: vcDNA=SeqID_66147; Strand=+; Position=1 -50,294-315
MICAKLHLVKWSKGVNQTNKSLQ

SEQ ID NO: 139725 - protein, 37 aa, Heterodera glycines
  Coding regions on vcDNA: vcDNA=SeqID_66148; Strand=-; Position=1 -29,82-164
MDENNHKLISQLIARMGCTVLAILHRTTGLAEFDWII

SEQ ID NO: 139726 - protein, 105 aa, Heterodera glycines
  Coding regions on vcDNA: vcDNA=SeqID_66149; Strand=+; Position=1-318
MVQPLAKSDGRNAIEQRLVVDGGRGIIGQAKAKVVPKSAREEERMLGAEAELNSSKRDLMSANELPKTPTNDRAESNPTLSKSITSSTKIFPLSSGTARRRAFRG

SEQ ID NO: 139727 - protein, 159 aa, Heterodera glycines
  Coding regions on vcDNA: vcDNA=SeqID_66150; Strand=-; Position=1-479
NAVPNSPIIVEEQQSQAPNSPSIIIVEEEQSHCQQEQQPKQTVDAVAVPAKSAPPDSVVVVVAAVEHQQQQQQPPPPPPLSSSSHCPPPPSVPCTSASPSIATSSIVLTSTSSAAPPAAVEQQQQQPPPPAQQNNNSSNQPGQRRRPGSAAGGLVASFV

SEQ ID NO: 139728 - protein, 22 aa, Heterodera glycines
  Coding regions on vcDNA: vcDNA=SeqID_66151; Strand=-; Position=1-81
KSIKNLKMRIHARFSGNKLNRA

SEQ ID NO: 139729 - protein, 42 aa, Heterodera glycines
  Coding regions on vcDNA: vcDNA=SeqID_66152; Strand=+; Position=1-129
NCTKLTSFLKKKVKKIYDFSSKISEVGIPTPKMSKIGSLSVP

SEQ ID NO: 139730 - protein, 48 aa, Heterodera glycines
  Coding regions on vcDNA: vcDNA=SeqID_66153; Strand=+; Position=1 -80,149-215
MAAYRMERIYSVIGTILFIVAFICMVWYLIDYDINRGQLIAATVKIKN

SEQ ID NO: 139731 - protein, 104 aa, Heterodera glycines
  Coding regions on vcDNA: vcDNA=SeqID_66154; Strand=+; Position=1 -203,661-708,1148-1210
FSTVVVPLLIIVVPLLPWPSVMPTRTRNPKPDTRNPKFFSTRNPNSKFFECSTRNPNPKFFSTHGITEDGDLGVKMLGAEQAKELLKQPCHPGLKQCCALFCPS

SEQ ID NO: 139732 - protein, 73 aa, Heterodera glycines
  Coding regions on vcDNA: vcDNA=SeqID_66155; Strand=-; Position=1 -60,545-706
MVLEGTWQAESEVTDEGMGWIRSKAYGSRQYKNKFIKRMRRRYGICAHLRRIHIRNYSIPISFLMSKPMAKFG

SEQ ID NO: 139733 - protein, 30 aa, Heterodera glycines
  Coding regions on vcDNA: vcDNA=SeqID_66156; Strand=-; Position=1 -82,233-243
MVKKGTIMVKKGTIMVLKLNKGNRLLKRVL

SEQ ID NO: 139734 - protein, 38 aa, Heterodera glycines
  Coding regions on vcDNA: vcDNA=SeqID_66157; Strand=-; Position=1 -64,529-581
MALCDLTWVCHGMVWHLLVWEEFSSRRGDLKTLSLFFC

SEQ ID NO: 139735 - protein, 106 aa, Heterodera glycines
  Coding regions on vcDNA: vcDNA=SeqID_66158; Strand=-; Position=1 -99,141-278,427-510
METGILFFNLLRRGYIIGGRQINGDWHIKRVYTAQQQQNAAVVGAKVCVECGQRIVHQTVPQSQLNANAIGVASVGCTSMNAIAKLVKKVRSAKCAKANKAKNEKE

SEQ ID NO: 139736 - protein, 92 aa, Heterodera glycines
  Coding regions on vcDNA: vcDNA=SeqID_66159; Strand=-; Position=1-276
MKKASLLLCMGRVFFFEQWHLFVTAMEMYRMQRVDTVVAYVMSVHPTLYELMRLYERDGLLRVRANMEMPTETVHGTADKFNPNGETEWSNQ

SEQ ID NO: 139737 - protein, 24 aa, Heterodera glycines
  Coding regions on vcDNA: vcDNA=SeqID_66160; Strand=+; Position=1-76
ITGVSIIAVLFLVFLMLSQNLVRF

SEQ ID NO: 139738 - protein, 73 aa, Heterodera glycines
  Coding regions on vcDNA: vcDNA=SeqID_66161; Strand=+; Position=1 -84,998-1135
MELTSGWYGDRYVGFVYPEEGISKEAEQPVELLAAVVGAGEFVEFETGNMPICDEALFPAAAETNTLNIMQKL

SEQ ID NO: 139739 - protein, 126 aa, Heterodera glycines
  Coding regions on vcDNA: vcDNA=SeqID_66162; Strand=-; Position=1 -161,522-741
MQVKNHFLKFESPIFLIDGSYAIASSNSVNQSLHACLISDVVPSLPSNGSLMFSYWTSPFVVLNVCQKIDQIPLNLTTMCQQTPLVQGPGPANVTIGASTGPFQVAKSVLYHYFFVCFIDKKSNNL

SEQ ID NO: 139740 - protein, 83 aa, Heterodera glycines
  Coding regions on vcDNA: vcDNA=SeqID_66163; Strand=-; Position=1-252
MPNLNCVEFDDTCAWHNCQTPAAQLMWFRTSANISSDQMMTTTGTGVMPSWDFAISKIRIFFSFFYWCPTKTKSFDEFSMKIY

SEQ ID NO: 139741 - protein, 133 aa, Heterodera glycines
  Coding regions on vcDNA: vcDNA=SeqID_66164; Strand=-; Position=1 -300,379-480
MSEPIRTALATMVEKLINRMEIVHPIIEAQERTEEGFDKLRQERVLLTGLLERIEVKNKEWDAYIRDIGAEAQNEENERYRLLSHRGRHFYDWVEEGRETIKNQKERKMRMKLGNQLMKLELIFLEEIIGTKE

SEQ ID NO: 139742 - protein, 131 aa, Heterodera glycines
  Coding regions on vcDNA: vcDNA=SeqID_66165; Strand=+; Position=1 -114,178-306,352-622
  Homolog annotation: Hit_ID=CAE67661.1; Match level="QueryCoverage =54%, HitCoverage=3%, E-value=1e-14, Identity=56%"; Hit description =Hypothetical protein CBG13224 [Caenorhabditis briggsae]
NQQTVQDRASNCADEVLHFMGCELLALRPPELFLFSRQIAFGLHQLLRANAANLHASEHWEMFFILLESVGAAAYRDESTGQKWSRCVSGDMLAIPFSCPHRPFPKTVLRFSNVALSYWHSIYPDTIQPLF

SEQ ID NO: 139743 - protein, 121 aa, Heterodera glycines
  misc_feature (118)..(118): Xaa can be any naturally occurring amino acid
  Coding regions on vcDNA: vcDNA=SeqID_66166; Strand=-; Position=1 -31,544-585,887-1115,1414-1486
  Homolog annotation: Hit_ID=CAE67661.1; Match level="QueryCoverage =71%, HitCoverage=4%, E-value=4e-20, Identity=56%"; Hit description =Hypothetical protein CBG13224 [Caenorhabditis briggsae]
FSTISWMSETALCPLVRISNRNLFRASNCADEVLHFMGCELLALRPPELFLFSRQIAFGLHQLLRANAANLHASEHWEMFFILLESVGAAAYRDESTGQKWKVSKVNNQNLSFVDVPXMNF

SEQ ID NO: 139744 - protein, 69 aa, Heterodera glycines
  Coding regions on vcDNA: vcDNA=SeqID_66167; Strand=+; Position=1 -104,200-306
  Homolog annotation: Hit_ID=CAE60765.1; Match level="QueryCoverage =89%, HitCoverage=16%, E-value=2e-12, Identity=54%"; Hit description =Hypothetical protein CBG04453 [Caenorhabditis briggsae]
FDYSTMREKTPELYEHLAQSALVIFKGDMNYRKLEALCGFCPTTLLALRTLKAETVAGVPLESLRKKKE

SEQ ID NO: 139745 - protein, 75 aa, Heterodera glycines
  Coding regions on vcDNA: vcDNA=SeqID_66168; Strand=-; Position=1 -108,199-318
MSVKFCELGKSTDSGKEEHEMLFTPELDGQMYGLQNLHFQAVEQPEIEQGYSTSQLHSELEHDVKILQANSMGKS

SEQ ID NO: 139746 - protein, 210 aa, Heterodera glycines
  Coding regions on vcDNA: vcDNA=SeqID_66169; Strand=-; Position=1 -71,139-316,371-550,614-817
  Homolog annotation: Hit_ID=CAE71859.1; Match level="QueryCoverage =84%, HitCoverage=24%, E-value=3e-20, Identity=31%"; Hit description =Hypothetical protein CBG18903 [Caenorhabditis briggsae]
MGKVSLGTLRKPEKKHNKVISPYGLPRKEETKKMISSFVRLSVLVFIVVIVMVVDHFYFRLLQIVVTHGKILRGQKGGNSLNIVVNGSGAVAELLRNVLQFNYSKDLDTDLDNLHCLTQPNAPNWTFNAWYLMGPLVLMFLLQVFLGFVVQRFVLFFVLGLMFPRRAKARIIHLYNKMLFGRVNLDKLSAAKKNVNERQMSSNANDGSDD

SEQ ID NO: 139747 - protein, 101 aa, Heterodera glycines
  Coding regions on vcDNA: vcDNA=SeqID_66170; Strand=-; Position=1-306
MRNEYKQKGRKYSTKEWKRNYAVIGKKIGVGQGVIGQWKKQFGLSGKRISEKEKMEKMKMYWQMKGENPKMSDEKISKILKINQRTIFKWKKQFEEELNED

SEQ ID NO: 139748 - protein, 111 aa, Heterodera glycines
  Coding regions on vcDNA: vcDNA=SeqID_66171; Strand=+; Position=1-336
MKTFKHFQLKQRHRERRDQQLDEFKRELKEEEALALGEVEEEDEQTREERHQRAMLRHRRTEREEAPLEQEDLEEEADEASQLKCHFDPPIYSFRFQKLYSFKPFTFTDLG

SEQ ID NO: 139749 - protein, 93 aa, Heterodera glycines
  Coding regions on vcDNA: vcDNA=SeqID_66172; Strand=+; Position=1-281
MLIDEINALHEMMMALEADFEEAEREAKTHPDINGGDLVHNIIFPEPDGMAFDECQNGTAADQTEKAAENGVDQEDEADEADQLKNKLKQNLE

SEQ ID NO: 139750 - protein, 135 aa, Heterodera glycines
  Coding regions on vcDNA: vcDNA=SeqID_66173; Strand=-; Position=1-408
GDANCGTAAGGGDGTNSAGQSSSSSSASSPTVGQRTPRKRSDAGMGSAEPAGPLPSIPEEDANSRNSCSGTRERRRATASSTTMTSSAAPSTASSEVAMVDTVGTTTEAASAVEDQAHQLRAVQATQSPPPLAGE

SEQ ID NO: 139751 - protein, 127 aa, Heterodera glycines
  Coding regions on vcDNA: vcDNA=SeqID_66174; Strand=+; Position=1-382
MRQINAFRRKRVAQLESKTRKCIFRFRETSNGLQPARNVPASRGGVRLGTPTADSAGRFPLRPPPVPPFPCSFPFPFRSVTFPVRSSASSLSPLFSDIFREFFGDPLSSSDFHRSPFFAFPANGGMK

SEQ ID NO: 139752 - protein, 127 aa, Heterodera glycines; identical to SEQ ID NO: 133730
  Coding regions on vcDNA: vcDNA=SeqID_66175; Strand=+; Position=1-384

SEQ ID NO: 139753 - protein, 226 aa, Heterodera glycines
  Coding regions on vcDNA: vcDNA=SeqID_66176; Strand=-; Position=1 -391,438-727
MLFNAEYFFILYFAFLFCSADALGDNPSNGPVILNPSKFVHNHRENEMSERNPLKDQNFGNKSAKPIAADKYSQLVGPSTNVAKEWLERNNPKKVKSPSRKDTIGKIGKSRLQKSSTNDEKMEKEPQLAKAGTFASHRLASSSPSSASAHDMTKANRYGKSAVYSSRVGQPVGLTRNATGIGRTVNLDKKVPSHGFATGGFSSRLMEGMANINARMNMKKNALRPF

SEQ ID NO: 139754 - protein, 367 aa, Heterodera glycines
  Coding regions on vcDNA: vcDNA=SeqID_66177; Strand=+; Position=1 -193,253-497,547-717,852-952,989-1060,1171-1344
  Homolog annotation: Hit_ID=CAG02177.1; Match level="QueryCoverage =97%, HitCoverage=42%, E-value=3e-44, Identity=33%"; Hit description =unnamed protein product [Tetraodon nigroviridis]
LNDAIEEEAKTVLDNVKMAFAEVLDQTEWLRNETDKAKAKEKLAKMSNFIGKAPAIGNPKDPEDEFINCIVNQQNWQFDSLREFINCIVNQQNWQFDSLRGNCAFSDAPVANRRLGQPGPILWDGRPEVNGYNIYHWNSMQVTGGMLRPPFIASNQSLAQNFGSVGFIIGHELGHSFDSYGYSVGFIIGHELGHSFDSYGYEYNADGVKDEKWWSKASKNSFVKRKKCFVDQYSAYKVNGLSVNGTHTVFENIADNVGIRASFAALKARLAKAQEQMQIEEEKLSAQEQMQIEEEKLSNEQLFFLSYAYSWCGRTTRERMAKYVKRDPHAPREVRVNLALANFPEFASAFGCASGTPMNPEKRCTLW

SEQ ID NO: 139755 - protein, 156 aa, Heterodera glycines
  Coding regions on vcDNA: vcDNA=SeqID_66178; Strand=+; Position=1 -100,175-350,445-639
MPLRQHFKSYAGRADNAISVYDVANRHIDNELFTFLETYEHSKGSDFHRSQIARKMLMFHNKCIDERTRAKQAGLSIEMLIKRLKTMRSDGFSTTDMMIEMFPQIPFLFLQKWIDKHIAVQINFGLFYNVWPLPNWDEDVRALLKDLLKVAFDFAF

SEQ ID NO: 139756 - protein, 160 aa, Heterodera glycines
  Coding regions on vcDNA: vcDNA=SeqID_66179; Strand=-; Position=1-485
  Homolog annotation: Hit_ID=AAC47744.1; Match level="QueryCoverage =50%, HitCoverage=26%, E-value=3e-11, Identity=40%"; Hit description =histidine secretory acid phosphatase [Leishmania donovani]
QQQQAQFGQMSVSDNGTASPPPAGNGSYRAKRSPCCDFGSYPFMEPPSRYGGFRYPFMGPPPRRGGFRRGGRRRGPTGSTASPSSTNSAALADQFIVNNETETTPTPTEGTESSRSTDGTTATNTDGTTAANTDGTTAANTDGTTAANTDGTTATDNGQS

SEQ ID NO: 139757 - protein, 267 aa, Heterodera glycines
  Coding regions on vcDNA: vcDNA=SeqID_66180; Strand=+; Position=1-804
MKFAKTMLMIPEAEYLALRSAMNSGDYLQNEKASLDAKISQNLQDPDISEDLKAKRHDWLYKERRTVKGILENRPQKVVIEKHVPGPNVAPYLGLNNQSKPQETEEPRKIIIPRKRLEEQTPDPESDNDTLEELTPEPQTTSTLKTHIPIKTIIHPTLLNGLFRYVKENKDLFKITAAGKVQSNMNLPIENSNYRDVLLYLAGKKDETPRGAKFLKDRLLKDPTVKDMVDKSKVMWGRGRKKAIKSIKTPGIVREKKPFKPLIWARL

SEQ ID NO: 139758 - protein, 139 aa, Heterodera glycines
  Coding regions on vcDNA: vcDNA=SeqID_66181; Strand=+; Position=1 -741,906-990
LFEYPKRTLEKIDFFVFGAVPPNRCAQIYGETESFGNSFPIACTLILRWIFAPHNCLSTPNGHLKNRFFYFINIFSESALKRTKFYLHVSLGTLMLFLSKREMEKNFFKNFSLYFGYIVLLLVGCLEQWNHAHPSDLAS

SEQ ID NO: 139759 - protein, 127 aa, Heterodera glycines
  Coding regions on vcDNA: vcDNA=SeqID_66182; Strand=-; Position=1 -42,94-239,282-478
  Homolog annotation: Hit_ID=CAE67427.1; Match level="QueryCoverage =92%, HitCoverage=12%, E-value=8e-29, Identity=53%"; Hit description =Hypothetical protein CBG12917 [Caenorhabditis briggsae]
VHEKELLFLNEQTKAEIHIEIINDDEYEKSEEFFVEMGTPEWRDGKGQVGPKEGQPDGRPILGEHSRCKILITEDKEFKNFIDKMVTNANVGFLVGTHSWKQQFAEALTVEDIDGGGHSLGKLKDTD

SEQ ID NO: 139760 - protein, 184 aa, Heterodera glycines
  Coding regions on vcDNA: vcDNA=SeqID_66183; Strand=+; Position=1 -265,606-893
  Homolog annotation: Hit_ID=NP_034068.2; Match level="QueryCoverage =98%, HitCoverage=14%, E-value=5e-49, Identity=55%"; Hit description =coatomer protein complex subunit alpha [Mus musculus] dbj|BAC31555.1| unnamed protein product [Mus muscul
VALEAAKVLDDKTIWVALGEAALLQGNHQIVEMAYQRTKDFERLAFLYLITGNREKLQKMLKIAQIRKDVHGQFQCALMLGDAQERTKVLKELGQLPLAYLSSVTHSLDEDAEQLRAELEQRQIAVPETNTSATPLLPMTPLNPLVDNWPQLTVSTGPFDAQQLLAATAASSGGGTLSTAIGKS

SEQ ID NO: 139761 - protein, 80 aa, Heterodera glycines
  Coding regions on vcDNA: vcDNA=SeqID_66184; Strand=+; Position=1 -123,231-347
MAEEIGTTEIAIEPLVTTTPKTTLTMGAKLKKPLLNKLNKMDPGELRHLVADMQSRLAQVEDTNVDPPCKAQHNAVEERD

SEQ ID NO: 139762 - protein, 339 aa, Heterodera glycines
  Coding regions on vcDNA: vcDNA=SeqID_66185; Strand=+; Position=1 -216,264-404,451-630,782-795,849-1092,1359-1531,1588-1639
  Homolog annotation: Hit_ID=NP_741192.1; Match level="QueryCoverage =96%, HitCoverage=59%, E-value=5e-55, Identity=35%"; Hit description =HepA-related protein HARP (3H483) [Caenorhabditis elegans] gb|AAM22029.1| Hypothetical protein C16A3.1c [
MSFQTKSYSATIQLTDEQRERVKQNRERALRIQAEKAEQRIKQGPTAAASQLLPHMDGMAISNNKPPPLIGERLVCPRPIQIQPPITTKNSNSPRPSTSSVQKVLVQMDFSLINANRFKVQFTPFNRDVVDKLKSIPSRPFNADDKTWSFLIDDYESTKKALNGLNRTVNLKLAEIPFDRCGVSVGIERDGRILIADEMGLGKSIQALAIANYYRNEWPLLIVCPSSVKYAWMGQFKRFMPNANVYIIEKQSDPLPISRNTSVAIKIANRVILLSGTPALSRPSELFTQVRMIDPKIFPSWVKYAVRYCGGKKGRFGFEAKGRSNPDELKTVMDKIMIR

SEQ ID NO: 139763 - protein, 70 aa, Heterodera glycines
  Coding regions on vcDNA: vcDNA=SeqID_66186; Strand=-; Position=1 -62,450-600
MAPTYYDLNSFPDGSDAKRKLDSLHRALSILSQPMTKYPCQPSYAPANIEHAQNPSARLDELGLPLGSLT

SEQ ID NO: 139764 - protein, 258 aa, Heterodera glycines
  Coding regions on vcDNA: vcDNA=SeqID_66187; Strand=-; Position=1 -278,330-354,414-608,652-786,830-880
  Homolog annotation: Hit_ID=CAE64301.1; Match level="QueryCoverage =99%, HitCoverage=30%, E-value=1e-90, Identity=65%"; Hit description =Hypothetical protein CBG08977 [Caenorhabditis briggsae]
RNPLTGRPYTQRFWDLLKKRMGLPVWDYREKFMELLNKNQCITLVGETGSGKTTQIPQWCMDFAREKGALANRKYMVSCTQPRRVAAMSVATRVAEELDVSVAEELDVSLGQEVGYLGQEVGYSIRFEDCVSDRTVLKYCTDGMLLREAMNNPLLEQYNVVLLDEAHERTLATDILMGLIKEIIRQRQEIIRQRQDLKIVVMSATLDAGKFQNYFDSCPLLSVPGRTFPVEIFYTPEPERDYTPEPERDYWEAAVRTV

SEQ ID NO: 139765 - protein, 50 aa, Heterodera glycines
  Coding regions on vcDNA: vcDNA=SeqID_66188; Strand=-; Position=1-152
QVQQQQAVISEQDHQLQHFKQHKMMEEVIQDHERRRSVVVMGLPESQKQK

SEQ ID NO: 139766 - protein, 92 aa, Heterodera glycines
  Coding regions on vcDNA: vcDNA=SeqID_66189; Strand=+; Position=1-278
MSATKLPGVNTRRDPANTDHEDASSPYPLGFIATLHRIGAGAAADGQPWPERNLSLGRSMQMADADCALGGLRVVAELMLAAERTRQNGTDE

SEQ ID NO: 139767 - protein, 291 aa, Heterodera glycines
  Coding regions on vcDNA: vcDNA=SeqID_66190; Strand=-; Position=1 -34,66-413,482-975
  Homolog annotation: Hit_ID=NP_996669.1; Match level="QueryCoverage =87%, HitCoverage=93%, E-value=1e-22, Identity=29%"; Hit description =similar to Hypothetical protein CBG21647 [Homo sapiens]
MIRRSAPLIRRVNRRGATVIRKGTTVIRRGEIVIRRGTTVIRKCTTVIRRGATVIRKGKAVIRRGATVIRRGTTVIRKGTTVIRRGATVIRRGTTVIRKGTTVIRRGATVIRKGTTVIRRGATVIRKVIRRGATVIRKGTTVIRRGTTVIRKGTTVIRRGTTVIRKGTTVIRRGATVIRKGTTVIRRGTTVIRKGTTVIRRGAKVIRRGTAVIRRGTKVIRRGATVIRPLFRQKKNMKLKINVIFMISGQKIAQKNHFQAIFEEKFCPSENQMGLPFRQEIRNNFSGDNFF

SEQ ID NO: 139768 - protein, 278 aa, Heterodera glycines
  misc_feature (2)..(2): Xaa can be any naturally occurring amino acid
  Coding regions on vcDNA: vcDNA=SeqID_66191; Strand=+; Position=1-846
  Homolog annotation: Hit_ID=XP_311331.1; Match level="QueryCoverage =97%, HitCoverage=100%, E-value=4e-33, Identity=36%"; Hit description= ENSANGP00000001657 [Anopheles gambiae]
FXVSYFSSGEKVSDNCCTSSNHFCTSSNHCCTSSNHFCTSSNHCCTFSNHCCTSSNHCCTFSNHCCTSSNHCCTFSNHCCTSSNHCCTFSNHCCTSSNHCCTFSNHCCTSSNHCCTFSNHCCTSSNHSCTSSSRTFSNHCCTSSNHCCTFSNHCCTSSNHCCTFSSCTSSNHCCTSSNHCCTFSNHCCTSSNHCCTSSNHCFTFSNHCCTSSNHCCTFSNHCCTSSNHYFTSSNHCCTFSNHCCTSSIHCCTFSNSCCTSSNQWCTSSNHCSTFSNHC

SEQ ID NO: 139769 - protein, 344 aa, Heterodera glycines
  Coding regions on vcDNA: vcDNA=SeqID_66192; Strand=-; Position=1 -361,792-979,1240-1461,1705-1968
MFCQLLLFGFLLAISIVTVCAAKREINLSIYPPPISNDYNYRIKICCNQNSNSGAAVEVPFSLHQQKLIAEHTLCGTKNSEQNVNEGQFLENGKNGINQSRYQENKGCQMSHPLNNFFLKSTDKQLNGKQTQLGTVAQNKFNFTISMPAKAEENLTQCANNELFIEIVKIFATGFLNQREEKLLKLERMTIEQFKRTDKLEYDFEEEYCKKFEIISHMEKQPFEFTLRISKASGVSSQNFILQQDFVVYKKTLTGGTKIYRINDEMWNNYSSFKIDFNKSDVSPLNTVESTNDNHTIQQRGNSNIQVNKKQISMAKSTVTQNGKAKVIVQGEQQRKKQGTRTVQ

SEQ ID NO: 139770 - protein, 124 aa, Heterodera glycines
  misc_feature (28)..(28): Xaa can be any naturally occurring amino acid
  Coding regions on vcDNA: vcDNA=SeqID_66193; Strand=+; Position=1-373
KFKIFLKIHGFSGSGLAQNSRSNDKFRXKDSICLAINLFLSIKESLTYALLSAGLMLCANVTILAHISHRNFLHMDSDETLLLQWHVVPSTDPLLIGTIFAALILCSVVYLVDVWVVYRQRRWR

SEQ ID NO: 139771 - protein, 92 aa, Heterodera glycines
  Coding regions on vcDNA: vcDNA=SeqID_66194; Strand=-; Position=1-279
ESLTYALLSAGLMLCANVTILAHISHRNFLHMDSDETLLLQWHVVPSTDPLLIGTIFAALILCSVVYLVDVWVVYRQRRWRTWVTDKSNYKI

SEQ ID NO: 139772 - protein, 141 aa, Heterodera glycines
  Coding regions on vcDNA: vcDNA=SeqID_66195; Strand=-; Position=1 -68,113-275,809-1003
MQKTKSDDVLETISSTVQFHSEWYLGSERQFVHDFNTSIRKSIKCKQCRTNLFCCSAAYYDEEFLKSGQWLAKIAEICICLFIILVSLFNNGFYGEVGLSIAVAAASLTISCAFVVIKLRTLNRWATQKQWFIMVVIYSSL

SEQ ID NO: 139773 - protein, 21 aa, Heterodera glycines
  Coding regions on vcDNA: vcDNA=SeqID_66196; Strand=+; Position=1-65
FIKVTILVKSVNKRQFQFQFI

SEQ ID NO: 139774 - protein, 199 aa, Heterodera glycines
  Coding regions on vcDNA: vcDNA=SeqID_66197; Strand=+; Position=1-598
  Homolog annotation: Hit_ID=XP_355243.2; Match level="QueryCoverage =100%, HitCoverage=24%, E-value=3e-19, Identity=23%"; Hit description= proteoglycan 4 [Mus musculus]
TPNRVDPRLPLDDNTQTPNRVDPRLPLDDNTQTPNRVDPRLPLDDNTQTPNRVDPRLPLDVNTQTPNRVDPRLPLDDNTQTPNRVDPRLPLDDNTQTPNRVDPRLPLDDNTQTPNRVDPRLPLDDNTQTPNRVDPRLPLDVNTQTPNRVDPRLPLDVNTQTPNRVDPRLPLDDNTQTPNRVDPRLPLDVNTQTPNRVDP

SEQ ID NO: 139775 - protein, 29 aa, Heterodera glycines
  Coding regions on vcDNA: vcDNA=SeqID_66198; Strand=-; Position=1-216
WLTKTSSNLALSILIQIAPNFFYSLTRPY

SEQ ID NO: 139776 - protein, 68 aa, Heterodera glycines
  Coding regions on vcDNA: vcDNA=SeqID_66199; Strand=+; Position=1 -76,139-269
MAFVNSLSSNTKTIHFLKKSLLLAHNYCTFSREWSEMEYERHAEDTLVALTEYLDTLPDRVDCESVSI

SEQ ID NO: 139777 - protein, 167 aa, Heterodera glycines
  Coding regions on vcDNA: vcDNA=SeqID_66200; Strand=-; Position=1-501
MSSLFDSTWEGHLQHIKFWRSEVALDGIKHLNPLIKVKRSLGESISNVQLVKGADGTMAVVGLATAPGDSAHVQMVMQAELPDISLGDDFEQDETKQRPTLELQPLFSHKTEAEHSTDASPRKIPPELALHYERMRGQMVDGVDDFKLHEKSGAVLFTTAKEISIFK

SEQ ID NO: 139778 - protein, 89 aa, Heterodera glycines
  Coding regions on vcDNA: vcDNA=SeqID_66201; Strand=+; Position=1-270
MKSIRTLIEQQQLLKAPKRTRKSSDFDDNSHNYLPNPVCFHAEQKRNKIKKTAMENPRQNPSKMLAEVHADTKDEIFVAMGIDLTLAAE

SEQ ID NO: 139779 - protein, 63 aa, Heterodera glycines
  Coding regions on vcDNA: vcDNA=SeqID_66202; Strand=+; Position=1 -51,107-247
MAKTLLHDSEGTTKKGEERETKRISSNSALFEPLKWRLRDKLAQSLLDGTEQLNMQSQKIEIL

SEQ ID NO: 139780 - protein, 45 aa, Heterodera glycines
  Coding regions on vcDNA: vcDNA=SeqID_66203; Strand=-; Position=1 -108,161-187
QNLCAVCSVLSADVSLLPFGHPLSLAPEHKSPLGKSPLFAPINAL

SEQ ID NO: 139781 - protein, 310 aa, Heterodera glycines
  Coding regions on vcDNA: vcDNA=SeqID_66204; Strand=+; Position=1 -774,822-980
IKRKISERKGTKGSRASSAASSCRSLSPVSSLAATTPPKPAAKTPQITPATKGTQAKKHLAIDSKPGPSNRFSGESVAVVPPPAPKVQQKKPTAQTDQHAEATTSATTASKAFLTRAEPNGNCFFNAICLTLFGSENHADQLRKRMCTFLRTILADQRLFLRQNPNYNTRETFLTRIDRMLLHGTDEGITTLEEYAGRREKNRDWAQVNDSMLLAMLFQRTVVIITPNLSRREIERQNPQWNYANQNLYVYFPDGEMRQSLRNVPVDQLQKFTMVQDVGTHVDRRPVNNAIVLYYNGLNHFDTVTFVMQN

SEQ ID NO: 139782 - protein, 633 aa, Heterodera glycines
  Coding regions on vcDNA: vcDNA=SeqID_66205; Strand=+; Position=1 -1854,1936-1983
  Homolog annotation: Hit_ID=XP_320889.1; Match level="QueryCoverage =94%, HitCoverage=71%, E-value=1e-83, Identity=31%"; Hit description =ENSANGP00000012033 [Anopheles gambiae] ref|XP_313651.1| ENSANGP00000013044 [Anopheles gambiae] ref|XP_314
MSDKLENLLQKLLTAQADQQTQFTQALNSLVNNNPDKEQASLFSTINSQISEFVYEPENDQTFQTWFERFGEYITTDGKLLTDAMKVRVVVGKLGSQEYSKYVERILPQKTGDLNFNDTIKKLEDIFCGTKSLFVRRYDCFRMAKAPSQAVLDFASHVSAECEKSKMQLTKEEMKAFIFVSGLDEGDRDLRERCLRMMEEARQRNATITFASLIEECRSILSLRSTAAAFSQSSSLGAQTNSISVRPQQITERSSRPASKGQNRTFNHRSPSVQSHRSDQQRKPPPPFPCKWCKQMHWNNECRNRNKCTKCGKFGHNSSTCRSRNYSNDRKFNRGSMTVMSVHDSSEPWIDIHCKINAYPVKLMADSGSKMAVIQTCLWEEIGKPPLNHCTANGTSYSGDEFEISGWFNCQVTYGDITLTLKCFVTPKGVMNLFGLPWIRAFETALQRPIATTLPMPLPTAASHQSMAIPSSTELADLLKQNFPDVFSSELGHCTKMRAHLYLKPGAQPVFCRPRPVPHGARDAVDAELDRLLKIGAIKPVDFSKWAAPIVAVKKKSGDIRVCIDFSTGLNDRLELNRHPLPRPDDIFNLIRGATVFSLIDFKDAYLQIELDYESKQLKLTDQLIAGLPDVHE

SEQ ID NO: 139783 - protein, 568 aa, Heterodera glycines
  Coding regions on vcDNA: vcDNA=SeqID_66206; Strand=+; Position=1-1707
  Homolog annotation: Hit_ID=XP_318550.1; Match level="QueryCoverage =85%, HitCoverage=48%, E-value=5e-90, Identity=37%"; Hit description =ENSANGP00000020240 [Anopheles gambiae]
MIYGRQFTLLTDHKPLISIFGSKGGIPIYTGSRLQRWALILLNYDFKIKYISTKEFGKVDMLSRLIAKQREDDGDDHVIANINQFPISEEEEQLDLCANAVDYIFQANIEQLPVTALEVAEATKQDEVLSEVSQFCRNEWPRKVQSPLIEPYFTHRSKISEIQGCLHFGDRVIIPAKLRQRILTALHFSHPGIVRMKALARQFVYWPRINLDIERWSRNCADCSLAAKMPAKVPLQPWPTSHEVFERLHMDFAGPCADGNKYLIIIDAYSRWPEVIKMHSTTARFVIDQFVWLFSRYGYPKQIVTDNGPPLKSSKIFDFCRKHGIEQVFAPPYHPMLNGRAERFVDTFKRQMAKCSRTDSNWVQNSLLAYRSTPSDILSGKTPAELFLGRKIRTIFSLLKPKQESQHQQPRTDHKTQQMEAQFNKKHNTHERIFKVGDKVLFINYRDNKKFWLFGKIVRGSGVMWRIEAPCLSAIVTRHSNQIRLFNPIPYKETDQIQHSPQRGQAQNPPEQIQVEREITPPRAPKKVRFADEQPHHHEQPAEEEQIQETPNLRRSTRVRKAPDRLDL

SEQ ID NO: 139784 - protein, 280 aa, Heterodera glycines
  Coding regions on vcDNA: vcDNA=SeqID_66207; Strand=+; Position=1-843
  Homolog annotation: Hit_ID=EAL49477.1; Match level="QueryCoverage =95%, HitCoverage=27%, E-value=7e-12, Identity=24%"; Hit description =hypothetical protein 42.t00003 [Entamoeba histolytica HM-1:IMSS]
MDSPKAPEVVPFEDEQLSAEEKQILNDIEVLKTKLEETNKRKSELKKQNEEKEKIKQVDEVILEDDEEEEEEDQTPKMSKKPRLDPVVAKCVVEKVINEKWEGNDLVVMDPRGKGSMEEQNDEESRRKEDLVRIGRRNDHNEAWREFLTTTTSLDREKEERLKAMGKIGLGENGRRMAEKSMRAAEKTIFESPCLQPEGMRRNVINELESQEERERRKRFATRTPPSGQAFANSVWAEKDWKRDDEGEKDEKEEPVFTKIIKIQRKLKEANEELKMLQKR

SEQ ID NO: 139785 - protein, 732 aa, Heterodera glycines
  Coding regions on vcDNA: vcDNA=SeqID_66208; Strand=-; Position=1 -1462,2054-2275,3485-3944,4081-4135
  Homolog annotation: Hit_ID=NP_498959.1; Match level="QueryCoverage =21%, HitCoverage=7%, E-value=1e-19, Identity=41%"; Hit description =zn-finger, CCHC type and RNA-directed DNA polymerase  and Integrase, catalytic domain containing protein (
MALWIPERVRLGRADANEGEIFGRPAAHSTSINENYGRLNMQNLSSPHISYGSVLRNRADEARRVERLENQRGQELMDRRANLGEFSLLRGREVQREGDRNGQRPRQIEQRNELADGNFLRREMYDQRGNEHRRVDRLAEERERRNDFYRNHEQHPEIDQMRMGERNFGENFVGFPRMSENLALQMYRMTLATQYASILREIPTIEGTEGRDKIHDFFLTVETLTADWEPEKQVNVLKTRLRGKALKALNIALSKFGPNPPFKILKAEIASTLRETDCREASAFTELTQFGKRTPNEDLMSFGEKIYRLVKCSYTGLNETQLDEIAKKFFVMNINDGDLARFLECQSRPGQTFDELLMLANRIHLADPERVRAKIESKSGRTQQNQPFHNRNWNRTDSNTQFQNRQQNYGNFWGNRRNFPNQNQTQNQSQNWRNNQPIRFTGGNAMPLNANPPEQESERANPRSANTIFLKKGETEKESSSVNVRQLETKKFLIMDQMDTESLLDYDEEQQQNEPVLKMSGKDEEAALKKLGVIEETEKENTPVKSGGTFVEPCIVEAEEKEIIVDDVVLKYPNFEMAQKDANFRFHVYTDASANGLGAVLCQKDISGQMRPVCYASRRCSDAERRYGPTVLECLGIKFATTKFKHYIAWLPTVVVTDHKALPAMFRTKNSVGNARVDRWIMELGAPFQLEVIYSPGKTNYVADALSRAFPNDLHFWIKDASQQIRNFDKNC

SEQ ID NO: 139786 - protein, 93 aa, Heterodera glycines
  Coding regions on vcDNA: vcDNA=SeqID_66209; Strand=+; Position=1 -113,1161-1329
MTGAVRVSRQERQVSFLGGSQQGFWGKVRVKYGEKNDRNSSLECQKWNNNLRLVRINNLMNVSETWYVYANSVTDQKCVDQVFMVNEFISDKW

SEQ ID NO: 139787 - protein, 73 aa, Heterodera glycines
  Coding regions on vcDNA: vcDNA=SeqID_66210; Strand=+; Position=1 -93,237-365
MPFVAFSGIILNFSVFVMTYFYIETEKHHLQEIIRSLPSDYFVLVGVVGRILDTANYVYTFTSALCWVDVLLR

SEQ ID NO: 139788 - protein, 574 aa, Heterodera glycines
  Coding regions on vcDNA: vcDNA=SeqID_66211; Strand=-; Position=1 -117,352-500,558-770,811-991,1036-1266,1317-1587,1630-1767,1810 -2104,2146-2275
  Homolog annotation: Hit_ID=EAA45732.2; Match level="QueryCoverage =89%, HitCoverage=92%, E-value=2e-30, Identity=25%"; Hit description =ENSANGP00000025171 [Anopheles gambiae str. PEST]
MVLNRGDASTKGMWSHLKSMHLEEYNELQLQEPEKPKNKTRSESHFRKIVIPRMAENLQQKIKDKIGTGYYSITSDGWQLPTKSPSLQSVTIHSVDENFVRSDFVLNVAPIYDAHTGENLADHIEKCLINNGFSMEKLVMMVRDDAKNMIKTCRILEIESFQCVNHFLHLTICDVLKEPKLSDLIEKVREWVKECRTTKGAALFRKKQNEQGQKTTKLIMSVPTRWNSTYAMLSQFRQQKKTILALEFDRMHSEIRTVKRAKVEKISNDLPRIDAVDFDLLRHVCSILDIFDAETRKFSTETSIAASVIPTLKKIRDFLALTPFNSSVQFLANSLANAIDRRVSNLAHNTALQIATILDPRFAYDENIWRKNLWPDIEEELKNFAKSIEGQKNVSVDDEQLDDQNAAFSGLVHHDNVDLSALDEGGSSDESVRYDIWVTPKSPGAGSIPSTLSGEINADLNSKIESQLAHYKAIVRPAIDADVFCWWRDNAPKFPELARLARIFLTTPATSVCSERVFSKAGLLYANSLRNRLSGEMAQNLLIIKANMNKLFLGPSNDIDEDEKDDENNDNEAK

SEQ ID NO: 139789 - protein, 192 aa, Heterodera glycines
  Coding regions on vcDNA: vcDNA=SeqID_66212; Strand=+; Position=1 -189,276-362,411-584,728-856
MFMISFIIMKLFQNLVLFKFQLFILTREIPKDGLDTARAAESRADHVLLLGSTIILTVECVCELVEISYFSPKKKMHFVTKLLDIFYSLFTQLANWFEIYCLKKIAAVNDDLVKRIRNTMPFVAFSGIILNFSVFVMTYFYIETEKHHLQEIIRSLPSDYFVLVGVVGRILDTANYVYTFTSALCWVDVLLR

SEQ ID NO: 139790 - protein, 194 aa, Heterodera glycines
  Coding regions on vcDNA: vcDNA=SeqID_66213; Strand=+; Position=1 -156,217-364,931-1211
MTQHVNPDQIYKWVSEHGNFGGKNPLLVSEIVSVIDLFRTMPHFNMLEPKDQAILLSFVAIPLIYLNARFYSSKINSPIVKIIPNSSFSPLYLYYKNPFYAAVTGLSAAGRLTLQHLSEHYANLLMHYLRTNYGNIAGAHRYAELVHLAESVFFNAERHREFFTYLAMVTDQGRFHAAIPPIFTPMILHGTLDE

SEQ ID NO: 139791 - protein, 59 aa, Heterodera glycines
  Coding regions on vcDNA: vcDNA=SeqID_66214; Strand=-; Position=1-710
LGPIKLISRKSRMNSHFQIFYRFLNVWIFFWLTKTSSNLALSILIQIAPNFFYSLTRPY

SEQ ID NO: 139792 - protein, 74 aa, Heterodera glycines
  Coding regions on vcDNA: vcDNA=SeqID_66215; Strand=-; Position=1-516
IIFIQKIFFWVFGAVPLNRCAQIYGETESFGNSFPIACTLILRWIFAPHNCLSTPNGHLKKSIFLFSGQSPRTD

SEQ ID NO: 139793 - protein, 62 aa, Heterodera glycines
  Coding regions on vcDNA: vcDNA=SeqID_66216; Strand=+; Position=1-189
ITKFVGKKWAKDQEKIYTDSAEFVSDTKTLIGKEHPDLVLNTDQSGFELESALIWRQKETNK

SEQ ID NO: 139794 - protein, 242 aa, Heterodera glycines
  Coding regions on vcDNA: vcDNA=SeqID_66217; Strand=+; Position=1 -526,568-770
  Homolog annotation: Hit_ID=XP_522969.1; Match level="QueryCoverage =95%, HitCoverage=87%, E-value=9e-31, Identity=34%"; Hit description =PREDICTED: similar to putative protein family member (XC187) [Pan troglodytes]
MQWKPEVRTKVIRRGAKVIRRGTTVIKGGTKVIKGGTKVIRRGTKMIRRGTKVIKGGTKVIKGGTKVIKRGTKMIRRGTNLIRRGTNLIRRGITVIKSGTKVIQRGTSVIKKRTKLIKGGTKVIKRGTKMIKRGTKVIQRGTSVIKKRTKLIKGGTKVIKRGTKMIKRGTKMIRRGTNLIRRVITVIKSGTKVIQRGISVIKKRTKVIRRGAKVLRRGTKVIQKRTKVIQRGTSVIKNTYKE

SEQ ID NO: 139795 - protein, 300 aa, Heterodera glycines
  Coding regions on vcDNA: vcDNA=SeqID_66218; Strand=+; Position=1-903
MEVFPCVNISLQDISYRPMNECRLYIPVTAHFPDRAIAAFLDPELRIISLTAQQASCNSYRFHHLQLRSNPNIWLWIDSRTGTARRMPKDYVHELYETTINQTNSNLELHPLIFHAWQLDNESDATRFPHINEFINSEQFKDKLEQHITARTEALGALKGGIEGFTMRWLKGLIDEAITWWIRVACVYSTFLMLRGIVLPCTLAYLLNPIRVTLLSLVGVRPHSTFRPTVSKPLGIEEGMPLHEMPQTPKPPARRAEHRSMSPIKLDMIARTARYQQPRTQSHLDLTEDSPFGRPRRKEF

SEQ ID NO: 139796 - protein, 341 aa, Heterodera glycines
  Coding regions on vcDNA: vcDNA=SeqID_66219; Strand=+; Position=1-1023
  Homolog annotation: Hit_ID=CAA82797.1; Match level="QueryCoverage =83%, HitCoverage=43%, E-value=4e-21, Identity=27%"; Hit description =gag protein [Ascaris lumbricoides]
MSGPIQKGIINALKALDNAKSATSLLLHPDPDLSNWENAVNLEAQFDRVVKEIRTIEMQMDSLRDSSNAWIELLARLTGDDKDNGEKEYVKFDKNEKIADRYDAATTKLRDLRDLEATLSAAAKLHRGRADREAKADQLANPQQQPPMPPAMAAPMTMPTFTAPLYQFQPIQLDKFFGQKRKWPEFYESFKSAIGSQSISKAQKLNLLRNLLGGEARELIASFRLEDANYETVLQLLKDTYGAPEEHIRSLHFELANLKPCRSLRETKDFLLQLERLTRELNNAGEDIEGPQVFLMLEKKLTPPFLRSILTKKGEDPANWTTTKFRDVLTEAVRKEVQIQE

SEQ ID NO: 139797 - protein, 181 aa, Heterodera glycines; identical to SEQ ID NO: 124594
  Coding regions on vcDNA: vcDNA=SeqID_66220; Strand=-; Position=1 -96,135-252,468-628,667-837

SEQ ID NO: 139798 - protein, 28 aa, Heterodera glycines
  Coding regions on vcDNA: vcDNA=SeqID_66221; Strand=-; Position=1-86
MAHAKKENLCMRKAVPVPVRSFVLSNSR

SEQ ID NO: 139799 - protein, 35 aa, Heterodera glycines
  Coding regions on vcDNA: vcDNA=SeqID_66222; Strand=+; Position=1 -95,139-151
MTAQNAINFLFHSLDNLMPFLLLAFFICISTKFIF

SEQ ID NO: 139800 - protein, 385 aa, Heterodera glycines
  Coding regions on vcDNA: vcDNA=SeqID_66223; Strand=+; Position=1 -702,934-1389
MIFDEFVALAARAEATQKASKLSMLKANNSRRFDSEFQMPRYSPRPMQQHFRQENFPQANNQQQNRPTCYNYGKFGHFARQCSEPQRNQGTQNNNSSATNFVRQNFLVEQQEKPPQQNQNLFVGGISMSPADVEKLFGKDGTENETKNLNKVSIGRIMALKVSVCGLTAKAMLDGGAQISMVSSKFFAKLLTEKRIGTEQLRPSRHNTRVIDINGNAVECIGIVSLPIVRKGKCSNATAIFTNSGTKSEVESKRTSEFCATKSSHRPSFRQKRKKAEKAPKNIVPNVENRIIRNCDEKGHKKFGPKEQLGKKFEVQSGDGENSVKSGRIFRGKNSEVQLGTIEILEGRKEFERKRLKLGRNSQREKIGRNVSLDGNGPRRIMAQI

SEQ ID NO: 139801 - protein, 54 aa, Heterodera glycines
  Coding regions on vcDNA: vcDNA=SeqID_66224; Strand=+; Position=1 -121,661-704
MSRETLPFDRGWVELTASCPDSTSTSADRQPMMRGLRCNGILKGWKITNKNRTE

SEQ ID NO: 139802 - protein, 15 aa, Heterodera glycines
  Coding regions on vcDNA: vcDNA=SeqID_66225; Strand=+; Position=1 -3,154-198
MAKGQRKSSKKKWDK

SEQ ID NO: 139803 - protein, 55 aa, Heterodera glycines
  Coding regions on vcDNA: vcDNA=SeqID_66226; Strand=-; Position=1-194
FEYPKRTLEKIDFFVFGAVPPTRCAQIYGETESCRNSFPIACTLFLRWIFAPIIV

SEQ ID NO: 139804 - protein, 66 aa, Heterodera glycines
  Coding regions on vcDNA: vcDNA=SeqID_66227; Strand=+; Position=1 -120,171-251
MDQLISGLLGGGGGGEANSGDNQPQQGGGGSGNQLADMAGELIGGFLGGGGGGSGALGGGAGGGVK

SEQ ID NO: 139805 - protein, 58 aa, Heterodera glycines
  Coding regions on vcDNA: vcDNA=SeqID_66228; Strand=-; Position=1-447
FINIFSETALKRTKFYLQVILGTQMLTLSKREMNKNLKIFNCFLNMRKILGLTFFFIS

SEQ ID NO: 139806 - protein, 93 aa, Heterodera glycines
  Coding regions on vcDNA: vcDNA=SeqID_66229; Strand=-; Position=1 -102,885-1064
MADPSPVTQKALAAEEAAMAATLLESLLSSSTMVNPINFLRSMPAHQLSTSSSSANGAKSVDNRHQNPLAEDGTTTEESEEKDEEEEEEEEQI

SEQ ID NO: 139807 - protein, 87 aa, Heterodera glycines
  Coding regions on vcDNA: vcDNA=SeqID_66230; Strand=-; Position=1-263
MNASMAMPTITTTTTFGLVQPTMAQKHVVWHRTRANVSKAVVQQQQLQTGEIQAVQRRQRHRVPAITTNGHHQQKITTTITIIFSIK

SEQ ID NO: 139808 - protein, 236 aa, Heterodera glycines
  Coding regions on vcDNA: vcDNA=SeqID_66231; Strand=-; Position=1 -206,1462-1634,2133-2463
MHELRHAQEIRQMYEEKLQRVNKMHTKMCRFTELMNERKRDNERVADATRERLAYDAHWHATLHEWHADQSPPTVGRAQCQAVQQARPAMLRMTYYDYDGTGRRHIGQKVMAQPQQQQQHYADNLRGSAASCSSSSRDCSSAEDNDDDNEHPQQQRDQQVPATQPPPAGGAEAVDAQKRRKSCRHCKTNKRNMQMMMMKLHHQLPATTTAMVPQITAQQQQKVVVGQLQEEARMGS

SEQ ID NO: 139809 - protein, 176 aa, Heterodera glycines
  Coding regions on vcDNA: vcDNA=SeqID_66232; Strand=+; Position=1 -115,488-581,794-918,1018-1214
CQLFVRCRPLPNLFHWKAWLLQQLLSRNGPPDAQQQSHGAGAATDRSQEHWDEFNKTAAEMKGKAKVLLHFPSAHWWIKFAGEELLSWTTGGFIQAQVTPDKMVLNFYSGQGSVCLDQTPLVGSLLGKLPFVNHNCKSLYGTTTLCPRDKPKCREEAAAQDKTGWFSGPWWCMKLC

SEQ ID NO: 139810 - protein, 147 aa, Heterodera glycines
  Coding regions on vcDNA: vcDNA=SeqID_66233; Strand=-; Position=1-444
MKSGAAKKKLQQKTFKEIFGEKWEEKENEQKKREIVEKFNKIKAKIKQKERKYSAKEWNKIELKIGKKLGTNRNKIYKWIKELGLYKCHNKSKTDVQKIEIVQKFNAMKNEYKQKGRKYSRKEWHQNYAEICKKIGVTQGVIRKWKK

SEQ ID NO: 139811 - protein, 23 aa, Heterodera glycines
  Coding regions on vcDNA: vcDNA=SeqID_66234; Strand=+; Position=1-98
KPKLFGLFKKELKIFKNFIHLPF

SEQ ID NO: 139812 - protein, 134 aa, Heterodera glycines
  Coding regions on vcDNA: vcDNA=SeqID_66235; Strand=+; Position=1-403
MDEPNFGRGRAEHGQRVVDRADQSHGGRTGQSDGYHEETEQLRTVRARNEQTVWHVKTRQIWHFRTRNANEKVRKADELDRHLKPLIGRMSGRGILRNDRFSLQNAYNSRRKALQKQDDVDEVLELLAPSADVP

SEQ ID NO: 139813 - protein, 163 aa, Heterodera glycines
  Coding regions on vcDNA: vcDNA=SeqID_66236; Strand=+; Position=1 -51,182-352,1743-2012
  Homolog annotation: Hit_ID=NP_500006.1; Match level="QueryCoverage =45%, HitCoverage=17%, E-value=7e-21, Identity=60%"; Hit description =protein kinase (4B641) [Caenorhabditis elegans]
MKYKTNPIKADYKIGNNVLGVGINGKVVECEHRTDGKKFALKILRDIPKAKREAELHFVASGHANIVNVYDIYEQYKFIKIGRDGKCISDDASGRRAHQTNGRRAKRTFGEAEKTDNGGGRAKRDTAGGDNDGRGGLKMTKRERMPNTAQQRRLIKLPDQTNS

SEQ ID NO: 139814 - protein, 244 aa, Heterodera glycines
  misc_feature (6)..(6): Xaa can be any naturally occurring amino acid
  Coding regions on vcDNA: vcDNA=SeqID_66237; Strand=-; Position=1 -74,119-142,194-227,277-405,473-670,734-838
  Homolog annotation: Hit_ID=NP_506055.1; Match level="QueryCoverage =97%, HitCoverage=33%, E-value=3e-80, Identity=65%"; Hit description =elongation protein 3 homolog (5M660) [Caenorhabditis elegans] emb|CAB01454.1| Hypothetical protein ZK863.
FNRIVXVKAVCECFHMSKDTGYKVVIHMMPNLVIHMMPNLPNVDIERDIEQPNVDIERDIEQFIELFENPEFRPDGLKIYPTLVIFIELFENPEFRPDGLKIYPTLVIRGTGLYELWSANKYQSYPPQVLVDLVAQILSLVPPWTRVYRVQRDIPMPLVTSGVEYGNLREHAMARMKQLGVKCRDVRTREVGIQEIHEKVRPYQVEIHEKVRPYQVELVRRDYSANGGWETFLSYEDPDQDILI

SEQ ID NO: 139815 - protein, 50 aa, Heterodera glycines
  Coding regions on vcDNA: vcDNA=SeqID_66238; Strand=-; Position=1-155
QWKPDGEKTKKLERLIAEMIAVDILPIRCVEKTGFQRVLKFLAPNYEPKY

SEQ ID NO: 139816 - protein, 30 aa, Heterodera glycines
  Coding regions on vcDNA: vcDNA=SeqID_66239; Strand=+; Position=1-91
MHVYGTAQFPASFPFYPPNMTFLTDILHPN

SEQ ID NO: 139817 - protein, 57 aa, Heterodera glycines
  Coding regions on vcDNA: vcDNA=SeqID_66240; Strand=-; Position=1-172
MTQSSADVEADVVENICVKSYTDKNEDQNGQRIKGIKDLIDEQDNYKMIEFLKYEIE

SEQ ID NO: 139818 - protein, 270 aa, Heterodera glycines
  Coding regions on vcDNA: vcDNA=SeqID_66241; Strand=-; Position=1 -76,173-259,306-383,436-485,636-770,1290-1524,1583-1646
  Homolog annotation: Hit_ID=CAE60721.1; Match level="QueryCoverage =88%, HitCoverage=14%, E-value=1e-72, Identity=59%"; Hit description =Hypothetical protein CBG04396 [Caenorhabditis briggsae]
IMLLLFITNSLIMLIFLPLQFAVAQSPVAGAGPNIGPGGGATLFTGGTDNLLYGVNLVPFGPEVGDHKNLVPFGPEVGDHKVHPGFLTAGQTIDLYMYFPYYGLYMYFPYYGGLYNYTTLSVNGYMAFATVLDQGPTINVGPEATDWPRQQDPAMIAPYLCKQQIPQSSNVALRAGIYYRLIMRQSIFGRGTATNIGPDIGTMPESSFFGFRFRKCPAASDNYVRCDSNGDYFLDQMMRWLQEGVAGAAAGVAGAAAKGADAALVVTWYN

SEQ ID NO: 139819 - protein, 108 aa, Heterodera glycines
  Coding regions on vcDNA: vcDNA=SeqID_66242; Strand=+; Position=1-327
EGGTLLAPDRAAYLRHFNVNVVGTVATTAAFLPLLRKAAATNSEGQTEEQQAAPVVRVVNIGGALGCIGKVFLKPSECPYQNMAYGMSKAKTKGQIDGRRDNLKKWKK

SEQ ID NO: 139820 - protein, 120 aa, Heterodera glycines
  Coding regions on vcDNA: vcDNA=SeqID_66243; Strand=+; Position=1-363
MLLKAMPTKSIPKKAENEKISGESAEERWQMGQTKQMADAKCGGPKDEKGKKRSDKLIRHLFIGGKQCQIGRSDRRIDDDQRGNERTREKSDQSAVEREENEQRSEHQIDLAKAYTYHFS

SEQ ID NO: 139821 - protein, 139 aa, Heterodera glycines
  Coding regions on vcDNA: vcDNA=SeqID_66244; Strand=-; Position=1-419
  Homolog annotation: Hit_ID=NP_701782.1; Match level="QueryCoverage =100%, HitCoverage=19%, E-value=3e-30, Identity=42%"; Hit description= hypothetical protein PFL2110c [Plasmodium falciparum 3D7] gb|AAN36506.1| hypothetical protein PFL2110c [
KVEEEQKAEEKVEEEQKAEEKVEEEQKAEEKVEEEQKVEEEQKVEEEQKAEEKAEEKVEEEQKAEEKVEEEQKVEEEQKVEEKVEEEQKAEEKVEEEQKVEEEQKAEEKVEEEQKVEEEQKVEEKQKVEEEQKVEEEQK

SEQ ID NO: 139822 - protein, 57 aa, Heterodera glycines
  Coding regions on vcDNA: vcDNA=SeqID_66245; Strand=+; Position=1-171
MPPIPIIPSERTAQPHQQQQHRIVPPPPPGPPPPATHGSQSGGGGGAGGIHHQPSLE

SEQ ID NO: 139823 - protein, 177 aa, Heterodera glycines
  misc_feature (176)..(176): Xaa can be any naturally occurring amino acid
  Coding regions on vcDNA: vcDNA=SeqID_66246; Strand=+; Position=1-539
  Homolog annotation: Hit_ID=CAB91581.1; Match level="QueryCoverage =94%, HitCoverage=10%, E-value=2e-32, Identity=43%"; Hit description =putative protein [Arabidopsis thaliana] pir||T48965 hypothetical protein F4M19.60 - Arabidopsis thaliana r
EYIFKSIDDAESKGAPILPEVLNKLQINSLPDHELKLKTNCVTKLIRNLNVNMGLCNGTRLQILDIEKNVLRVMILTGDRIGEIDFIPRISLIEDKIPYVLKRHQYPLKLAFCMTINSAQQTFEKIGVDLTRDVFAHGQLYVALSRTRSWERIKIKYSNENNKKAKNIVWLETLIXI

SEQ ID NO: 139824 - protein, 381 aa, Heterodera glycines
  Coding regions on vcDNA: vcDNA=SeqID_66247; Strand=+; Position=1 -283,330-564,610-732,777-1112,1565-1599
  Homolog annotation: Hit_ID=NP_499260.1; Match level="QueryCoverage =95%, HitCoverage=19%, E-value=1e-134, Identity=70%"; Hit description= clathrin heavy (3L297) [Caenorhabditis elegans] emb|CAA83003.1| Hypothetical protein T20G5.1 [Caenorhabd
ISSFCNCHILLLPLIIVCDRHDMVQDLVLYLYRSNLMKSIEVFVSKVNPKRLPIVVGALLNVDCSEDQIKQLIQITRGKFDIDELVEEVEKRNRLKLLNSWLELKLLNSWLESRVHEGNQDQATHNALAKIYIDSNNNPERFLRENQFYDSRVIGKYCEKRDPHYALLAYERGRCDSELIAVCNENSLFKNLARYLVVCNENSLFKNLARYLVRRRDSDLWGVVLAESNPHRRQLIDQVVQTTLSETSDPDDITITVRVVQTTLSETSDPDDITITVRAFISADLPNELIELLEKIVLENSAFTENRNQNLLILTAMKADSSRVMEYIQKLDNYDAPDIANIAITDKLYEEAFAIFRKFGVNASAIKVTFENSNSFYIPIC

SEQ ID NO: 139825 - protein, 60 aa, Heterodera glycines
  Coding regions on vcDNA: vcDNA=SeqID_66248; Strand=+; Position=1 -90,688-780
MAWMTPNYVRNNANNRNNNNVPQQQRPAGSFLHLLPFSWCIDFLRLFSTFYAERSFRYIH

SEQ ID NO: 139826 - protein, 133 aa, Heterodera glycines
  Coding regions on vcDNA: vcDNA=SeqID_66249; Strand=-; Position=1 -180,1136-1241,1311-1426
MEQLERKCQANGFSEKPKELKTLGESLHKVETRIYRLRNALNAYKLRIDNARRFKEIIGELQKQTVLLKFINSTILNNTYQNGTTKERSGKAVVQAVRSTDAEANSPGQGNLNACVEHHGVVSFGRKGSSNEF

SEQ ID NO: 139827 - protein, 64 aa, Heterodera glycines
  Coding regions on vcDNA: vcDNA=SeqID_66250; Strand=-; Position=1-196
FGHDGRDGRDYVILSKQTTTEPSLTVPEKYCNGHNNDNNGTLTPPTAAETSREAKKGKKGCRKK

SEQ ID NO: 139828 - protein, 39 aa, Heterodera glycines
  Coding regions on vcDNA: vcDNA=SeqID_66251; Strand=-; Position=1 -94,538-563
MVLSMTVVNLFILMAVVIYLLLFLAIRNVSTALIMTTSV

SEQ ID NO: 139829 - protein, 73 aa, Heterodera glycines
  Coding regions on vcDNA: vcDNA=SeqID_66252; Strand=-; Position=1 -134,272-359
MKSLLFFTIFFLFLLFVIATPPASKEPRNVEEMEQINNEIKEEGMKPRSSKNPGLPRPGHGFLNWVLKVTKDN

SEQ ID NO: 139830 - protein, 30 aa, Heterodera glycines
  Coding regions on vcDNA: vcDNA=SeqID_66253; Strand=-; Position=1 -48,1099-1143
MTRQSTNSKCGKTKLIFYAFSVNFIVTLDS

SEQ ID NO: 139831 - protein, 71 aa, Heterodera glycines
  Coding regions on vcDNA: vcDNA=SeqID_66254; Strand=+; Position=1 -94,421-542
MFTFYCSVHIDSVPTIQCRRFSADDSVTTIQLILLGILSLGPRVGKFSSLNVSSTLFAANPAPILDPEPGI

SEQ ID NO: 139832 - protein, 37 aa, Heterodera glycines
  Coding regions on vcDNA: vcDNA=SeqID_66255; Strand=-; Position=1-111
  Homolog annotation: Hit_ID=NP_505722.1; Match level="QueryCoverage =97%, HitCoverage=7%, E-value=6e-10, Identity=75%"; Hit description =PRO1512 (51.4 kD) (5L81) [Caenorhabditis elegans] emb|CAA97339.1| Hypothetical protein T21C9.12 [Caenorhab
YKKGHYFVKRPALDYFLDMVGYPNFELVIYTSETMMQ

SEQ ID NO: 139833 - protein, 27 aa, Heterodera glycines
  Coding regions on vcDNA: vcDNA=SeqID_66256; Strand=+; Position=1 -26,490-547
MESLIINKKPSERQSTMTELKGHCRRK

SEQ ID NO: 139834 - protein, 164 aa, Heterodera glycines
  misc_feature (95)..(95): Xaa can be any naturally occurring amino acid
  Coding regions on vcDNA: vcDNA=SeqID_66257; Strand=-; Position=1 -150,612-968
  Homolog annotation: Hit_ID=NP_507109.1; Match level="QueryCoverage =84%, HitCoverage=26%, E-value=2e-27, Identity=36%"; Hit description =cytochrome family member (59.6 kD) (5Q759) [Caenorhabditis elegans] emb|CAB07604.1| Hypothetical protein
KFERSSESIDKRAKKSGDSFLDTLLDMEGNDTLEPEELREQVDTFMFAGHDTTSHALIWTLWCIACHPQYQRLIHAEIDATRNECQGNCGGNFVXASDVNELRYMDRCIRESLRMFPAVPVVERQLQNDLAVNGKVWPRGALAVVAPILIHNEQVKHSIQNEST

SEQ ID NO: 139835 - protein, 75 aa, Heterodera glycines
  Coding regions on vcDNA: vcDNA=SeqID_66258; Strand=+; Position=1-228
VNFVNEKEFDVEELTKFNEKAQELKSKNGRSNDKPKVIGNEKTVPKTDNGGQKRGQNGKRWAEKSWHWGINSEED

SEQ ID NO: 139836 - protein, 171 aa, Heterodera glycines
  Coding regions on vcDNA: vcDNA=SeqID_66259; Strand=-; Position=1 -61,108-559
  Homolog annotation: Hit_ID=AAO85452.1; Match level="QueryCoverage =100%, HitCoverage=31%, E-value=5e-66, Identity=76%"; Hit description= putative gland protein G12H04 [Heterodera glycines]
MALSALLLLLPLLLNVQNIPDESVQSDVKAVDSAISSLEQWKDPRNSLASLDSQLTEPQRALAKMFWELETIEKEKPKAPPQFDLGLFLEALEAMVEMNEEAKEVKLRKDKLTEWAGGEKANEGKEGKTKEEETVPEVRVNENGKVEVTNGAGGDGKMEVKRGKDENGNEQ

SEQ ID NO: 139837 - protein, 101 aa, Heterodera glycines
  Coding regions on vcDNA: vcDNA=SeqID_66260; Strand=-; Position=1 -74,121-178,225-312,405-487
SSNLICDRSGVQKISFQTGKELAQRYTNINRQYEPMYLAPPESEKGKGVHGCFPRVEDTFRKIVAKCYGDILIVSHQGPVAALQRMLTGSMEFGGSATVSK

SEQ ID NO: 139838 - protein, 231 aa, Heterodera glycines
  Coding regions on vcDNA: vcDNA=SeqID_66261; Strand=-; Position=1 -172,1389-1561,1680-2030
  Homolog annotation: Hit_ID=NP_508395.1; Match level="QueryCoverage =50%, HitCoverage=35%, E-value=2e-17, Identity=41%"; Hit description =DumPY : shorter than wild-type DPY-3, collagen family member (29.6 kD) (dpy-3) [Caenorhabditis elegans] g
MPSPIRLFTLFSLFLFLLLLLPFLSFAALSPREKRQFSFTDGFSSGTILQPGGGGLLVTSPEGEETTTPVSGCVPGPPGPPGPPGPAGQKGPQGKCGDNASKRKREAAAVPKEFMTNLEPNVPVKRAKEGEAVAKTHFARGHVKGGCPPGPPGEPGTPGPPGPPGDPAPCPKHMKSEAQSVDGKQLANRNKRGETVLNAAKEGTEVKRQIVRHGFVFGQIAVGETVPKVQN

SEQ ID NO: 139839 - protein, 198 aa, Heterodera glycines
  misc_feature (14)..(14): Xaa can be any naturally occurring amino acid
  misc_feature (158)..(158): Xaa can be any naturally occurring amino acid
  Coding regions on vcDNA: vcDNA=SeqID_66262; Strand=+; Position=1 -26,644-731,1022-1087,1356-1428,1537-1886
  Homolog annotation: Hit_ID=NP_649481.1; Match level="QueryCoverage =92%, HitCoverage=33%, E-value=7e-30, Identity=44%"; Hit description =CG12586-PA [Drosophila melanogaster] gb|AAF52115.2| CG12586-PA [Drosophila melanogaster]
LLFYISTLVFWSLXHSQGPGSPSSPASPGGPAGPGGPMGAGSPGGPGGPGVPGSPGGPGGPHFPWGPFCPAGPGGPGGPGGPGTPGGPMSSVPPPPPVEGGVSDVSSVGHSHAHRRRAFWRKMFTLEKQPTPIFFFFEKTGDSQKKGKAIESGLINNXNPLGLSILSFLSSFRRRIVFCCFVATSESDINEMDKEQKQ

SEQ ID NO: 139840 - protein, 64 aa, Heterodera glycines
  Coding regions on vcDNA: vcDNA=SeqID_66263; Strand=+; Position=1 -38,94-250
MPTNDGRREPSENNGGMRERTDDTARPIQRGHFAKRTVHRLDNRTKGMPKWEWNYILKIIQNKN

SEQ ID NO: 139841 - protein, 78 aa, Heterodera glycines
  Coding regions on vcDNA: vcDNA=SeqID_66264; Strand=+; Position=1 -46,106-293
MGHHNSATFLFGLLLGYFLPELAAQLSKDEQDYCVKFSNNLRSNVATGNQQNKGGGKLPSATNMLELAYNETIGQTAQ

SEQ ID NO: 139842 - protein, 66 aa, Heterodera glycines
  Coding regions on vcDNA: vcDNA=SeqID_66265; Strand=-; Position=1-201
MAKKVPKNVRLLLTCRSVKGVAHAIVGCIHGQSQAVATSVHHRPAKNQYENIHDQDGPGMESIAII

SEQ ID NO: 139843 - protein, 18 aa, Heterodera glycines
  Coding regions on vcDNA: vcDNA=SeqID_66266; Strand=+; Position=1-56
YREATPEGFGLPINLGAS

SEQ ID NO: 139844 - protein, 56 aa, Heterodera glycines
  Coding regions on vcDNA: vcDNA=SeqID_66267; Strand=+; Position=1 -130,178-218
MSNSDIKKTIDIWIGEAEKSDLQQREIWVFIGVEEKFVIEGNFEIVGGLAELRTIY

SEQ ID NO: 139845 - protein, 48 aa, Heterodera glycines
  Coding regions on vcDNA: vcDNA=SeqID_66268; Strand=-; Position=1-144
KHDIIEIALLIYIPILISQIWHQRIFFPFQQPTAPVNAVPQQQQQAAQ

SEQ ID NO: 139846 - protein, 105 aa, Heterodera glycines
  Coding regions on vcDNA: vcDNA=SeqID_66269; Strand=-; Position=1 -129,491-619,689-748
VLPAANEGGTSGGSEQQQAEAAQQKPGQSSSENSAPSAADGPRVSAGNDVGGSSASDEQNRAGPIAAQPQKQGPSNASSAPPAEAQSLGQQEQQPHVEKVEGKKY

SEQ ID NO: 139847 - protein, 18 aa, Heterodera glycines
  Coding regions on vcDNA: vcDNA=SeqID_66270; Strand=+; Position=1-56
YREAILEGFGLPINLGAS

SEQ ID NO: 139848 - protein, 87 aa, Heterodera glycines; identical to SEQ ID NO: 129852
  Coding regions on vcDNA: vcDNA=SeqID_66271; Strand=-; Position=1-816

SEQ ID NO: 139849 - protein, 132 aa, Heterodera glycines
  Coding regions on vcDNA: vcDNA=SeqID_66272; Strand=+; Position=1 -192,1639-1845
MAAQQQKANSAFKKKLKDNLRKKMDEKIKRDFEKGWFYNVKLSSEVTEREKLRNWWANGATIIEFVHHSGKKLTNFDHFGLPIGACRVQPFGQGMERRRPNAIGLDISEPIGDINDQSDSGRPLALKFPFLI

SEQ ID NO: 139850 - protein, 54 aa, Heterodera glycines
  Coding regions on vcDNA: vcDNA=SeqID_66273; Strand=-; Position=1-163
TEKVGSDQLAIQVFGGKKVKLQSGRYKVKLKRLDGEWESIELSEVPTICTPIRT

SEQ ID NO: 139851 - protein, 867 aa, Heterodera glycines
  Coding regions on vcDNA: vcDNA=SeqID_66274; Strand=+; Position=1-2602
  Homolog annotation: Hit_ID=CAA82797.1; Match level="QueryCoverage =57%, HitCoverage=62%, E-value=1e-16, Identity=22%"; Hit description =gag protein [Ascaris lumbricoides]
MERHDDDQFNENANQGDPPPSDQQDERRAIGAQPAKPKTILEAHGLGTSQPGVTPAVTKNLRSGLIAVRSARDQIERAAGTLAARIVDARELMDDDYTRGEALEHAARMMAMERGFGEVKRIFEGHFEKGIAEAGAAPDERQDFFYDSIAAPLPAATKYLRLREHPTPAELLQIAAEHLGDLRAMRQTFEDEERESISRSSRSVETENNQAEEELPRAMPRRSMQEWETSFREAYVRQHDELFGQQQPLVNQAERVATPVMSNMAALIQRRSNAPSVASVRVNNPVREWMARNQGVGNGPPAQAQQPTQAQRPLQAVQQRLEQLTLNDPRANFPRAAPHFHVRREEPPTRDRTRAQGVFPSRPHRPDESAGMLTTFEAVRLQPPTFSGRPEDWTTFWAYFQRAVDDKQIPGFEKQLHLLRCLKEGSPARRAVEVYPPSDGNYPVVVQLLKERFGDTNDLQRAIRAQLLHLQPAKDNVSSLTAVIDEFERGVCQLEQLGANVDDESFGPLLEAKLPVHILTELRIRESTMGANWTVREFRKAVGVQVKCMRAAESALAAMKGPERRHEQRSEPERGGRNARTGQGFQRAFMIRDQPPEKRTSNEATTRTEVAMPPIRPTNPNRVPLGSYSRPMGAHSQAQDGQGGQPRQGCSLCGQTGHQPSRCGKYGSAQAKRRRLIEQRRCLKCLGSDHTAQQCTRKTACRTCEQMDHHWLICWKGERRNEPPSHSRTEDAQQNRTMIIREIEAKHLRTPPPTESSKDGMGAKGEDPPLLDGEQRAFTTVGQQLPAYLMVCPVVVASEDGMTECNTNLLLDPASHGDYGDAALIKQLGTEKVGSDQLAIQVFGGKKVKLQSGRYKVKLKRLDGEWE

SEQ ID NO: 139852 - protein, 1379 aa, Heterodera glycines
  Coding regions on vcDNA: vcDNA=SeqID_66275; Strand=+; Position=1 -4113,4731-4757
  Homolog annotation: Hit_ID=NP_508324.1; Match level="QueryCoverage =84%, HitCoverage=42%, E-value=1e-137, Identity=30%"; Hit description= predicted CDS, peptidase family A16 and RNA-directed DNA polymerase and Integrase, catalytic domain and
MPSVKAIDQFWSVEAIGIRDDPTQDADTEAIIQFERSVRQHDDGRYSIRLPWREEHPELPSNYAVAYRRLIGLLQRLQRTPGVLEQYQGVIEEQLRAGVIEEATVGTGSTEYFIPHQAVITPKKLRVVYDASAHAKGVPSLNDCPLRGPVWLPDLAGMLIRFRACQVPVLADVEKAFLMVGIEEADREVCKFLWARDPLGPLTTANLVPYRFRRLAFGLTPSPFCLAAVVRHHLRKYNSEFAEQLIRDTYVDNVLIPADTIEEATAKAREAKRMFTDAKMNLREFLTNDRGLNDSFSEADALGKTTAKVLGLEWDSVDDSIQISFPGVTPEGECRQTRRTVLKTIARLFDPLGLLAPATLPAKQYFQRLWDTTHNWDTPLEPDDARDWNRVLASWEGGLITIPRAVRAGGVQPGQLHVFTDASETAYAAVAYLRSEGADGRFHSRLLMAKSRLKPKKAAATYTIPRMELMGLVLGTRLAAFVKAQLHRPISEEHTWSDSMIALQWVKNRAPQPQFVANRLAEIRRATATTFHHVPTGFNPADSATRGLSPAQLQNYDLWWKGPKWLTSPWATWPKELDFQVDSAEDEAILPDEATTTALVTRREHSPEQPKEWSEELLNRCSRWVKALRVMAWARRFANNARRKAEDMHGTMGGSDPSRRKAAIRGQIVALPTHDEETDAKWAIVRATQRNCQPRDGMRTELDENGVQRLISRIGWCEEAELSRPVILPKRSRAGALIIDDIHVRLHHMGTDGTLSEFLRSWWCPSARQQVRQVLGQCKRCRRLRGMPYPLPTMPQLPMDRVRRRLPFESVGLDYLGPTVTLDDKGQRRKTWVLLITCLTTRAIYVDATRDLSANSFISALRRFIARRGAPSRILSDNAPTFTVVGKTLAEFGMPGDNPIDFADSRGIKWRFTPQHTPWAGGIFERAVQLVKRALQKTLGSTVLDYDGLVTLLAEIEATVNSRPITYVNGNSGEPLPLRPIDLIQENGRLWVDPPHPSAQRGDEPRDPTHKQLAKHWRDSQQRLEHFWRRWHREYLMTLRERAGWHHPQRRVNAPGAPEVGDVVLVEDKFHPRNLWAMGRIEELRGSDGHTRSVLIRMANGRIWGRPVSKICPLERSPEMGEAQDQPDEAVQEEELGAVAGTEAEGQPGEDNNAPRGLSGSEGEKTVEAEEVAQDEAEEGPIPPSFVQNEVGSTSPVSQTNDRSLLETMNRETEAEKADSPEGANSMRGIEPRRSLRVRRIREVWSPDRYAPKRRGIGGPLVSLAMLIMLVYPTVTFGCQPTIRSEIVGKQSLELPTTMLPCHMRCTERGVKVLSKQRLEKMEICCPDGCWAIVPTSTEISYELPSSESRMRSDQLLLLLGAAGQPDMQPATFKDKFFL

SEQ ID NO: 139853 - protein, 83 aa, Heterodera glycines
  Coding regions on vcDNA: vcDNA=SeqID_66276; Strand=-; Position=1-250
RHCDLRGADSDHDGSYSRFVGIRDPPHVGRTSGIKCHRSKQSTSFGRLKRSEFATTQHKTPTRRRSSNSNDQCGNTTTDGTAF

SEQ ID NO: 139854 - protein, 62 aa, Heterodera glycines
  Coding regions on vcDNA: vcDNA=SeqID_66277; Strand=-; Position=1 -73,1155-1270
MAAAEQSQQNEMGEVQQKTAENAAAAAAEAFDGGCGGRGRGGNVQKHALAQHTAPIWPQSRL

SEQ ID NO: 139855 - protein, 95 aa, Heterodera glycines; identical to SEQ ID NO: 130684
  Coding regions on vcDNA: vcDNA=SeqID_66278; Strand=+; Position=1-663

SEQ ID NO: 139856 - protein, 16 aa, Heterodera glycines
  Coding regions on vcDNA: vcDNA=SeqID_66279; Strand=-; Position=1-49
EAIPEGFGLPINLGAS

SEQ ID NO: 139857 - protein, 70 aa, Heterodera glycines
  Coding regions on vcDNA: vcDNA=SeqID_66280; Strand=+; Position=1 -116,526-622
MAPPGDENDGKSNAQNDNAAFDDNDDAMLRRDCEGQIASSLLSNWHSDAVTEDQIRPIVARISAIPLCVF

SEQ ID NO: 139858 - protein, 72 aa, Heterodera glycines
  Coding regions on vcDNA: vcDNA=SeqID_66281; Strand=-; Position=1 -202,357-373
MLCMLGFLVMRSICSKRNSFVKSYPATTLPMIIGVNTAVTAPIMSPTLIRSRSFRDLAFSVMFSAEFVTRSI

SEQ ID NO: 139859 - protein, 73 aa, Heterodera glycines
  Coding regions on vcDNA: vcDNA=SeqID_66282; Strand=-; Position=1 -186,355-390
MKSISQISQMIIAMCFLLLLLSPPNAIGQNLCQWDSGKCVDRGCPYGCPYDTEPECGCTSPKPDSVPKIRSKP

SEQ ID NO: 139860 - protein, 64 aa, Heterodera glycines
  Coding regions on vcDNA: vcDNA=SeqID_66283; Strand=-; Position=1-243
GRSKPISLEAENETNQQKKGLKQGRRMMFALILTYYIEKTAILINFTSTFETFSPLFREFFAPI

SEQ ID NO: 139861 - protein, 84 aa, Heterodera glycines
  Coding regions on vcDNA: vcDNA=SeqID_66284; Strand=-; Position=1 -151,586-689
  Homolog annotation: Hit_ID=NP_508656.1; Match level="QueryCoverage =65%, HitCoverage=91%, E-value=1e-10, Identity=49%"; Hit description =putative endoplasmic reticulum protein, with a transmembrane domain (XE407) [Caenorhabditis elegans] gb|A
MPIVDGNDAVDIQLIRAKRFFQNERSWNMEQILEAILCVFIPPAAVLIHGGHDMLLHMVINIVLWICGWIPGMIHAFWYCFYRD

SEQ ID NO: 139862 - protein, 96 aa, Heterodera glycines
  Coding regions on vcDNA: vcDNA=SeqID_66285; Strand=-; Position=1-433
MRILPPYFSDHFMLFIHQPQNTTTNRQHIFHIWITKKKPDDDFDQPHQFFNCFFLQFLNLFKQFACFFAPPSSPPPPTHLFGLYAFIEIFLISFNE

SEQ ID NO: 139863 - protein, 48 aa, Heterodera glycines
  Coding regions on vcDNA: vcDNA=SeqID_66286; Strand=-; Position=1 -96,453-503
MIYNLLFCCMITACFINVGTCIYDINIGERPKGYTGPGVRPGRPDSVN

SEQ ID NO: 139864 - protein, 39 aa, Heterodera glycines
  Coding regions on vcDNA: vcDNA=SeqID_66287; Strand=+; Position=1 -53,1955-2021
MNVPVCFVANLYNQQQQQPFTVQEENIREHLIGNPRQLE

SEQ ID NO: 139865 - protein, 47 aa, Heterodera glycines
  Coding regions on vcDNA: vcDNA=SeqID_66288; Strand=+; Position=1-149
HFLSFLSNAITNHSSNLSLLLSNWVISHYSQMGGFVGVPLIVYVLSV

SEQ ID NO: 139866 - protein, 33 aa, Heterodera glycines
  Coding regions on vcDNA: vcDNA=SeqID_66289; Strand=+; Position=1-101
LTKVVAKVPEKGQLLVGDDKVEPVLLAQGTQLL

SEQ ID NO: 139867 - protein, 211 aa, Heterodera glycines
  Coding regions on vcDNA: vcDNA=SeqID_66290; Strand=+; Position=1 -69,124-330,417-608,660-736
  Homolog annotation: Hit_ID=AAP30754.1; Match level="QueryCoverage =99%, HitCoverage=96%, E-value=3e-77, Identity=70%"; Hit description =putative gland protein G11A06 [Heterodera glycines]
SVSLLTIVAIFCLLCKCCISAPHPCCPGSQKVVSLMAPCCPGSQKVVSLMANYVGTFAHSFSKSSLCSDAKSVAGALKGQLIGCSKGGDATLLADIEASLANHSSDECAHSLGFVRAMFTIAASASSHASNNSEWQALSAKFGQQISEIDSKCAEFGISIAKVSFEGPKGDHSQRNVPGTNNVIAMDHSQRNVPGTNNVIAMPGLTGSHKQ

SEQ ID NO: 139868 - protein, 230 aa, Heterodera glycines
  Coding regions on vcDNA: vcDNA=SeqID_66291; Strand=+; Position=1-1383
FQQKQLRSAQACAWAAKATEQVVMTQRWPGIRASRTWEEPSRRWTQLRGQCTGTHTSTPDFPVRTLPQAKGLRALMSRVFSNASTLVPRQGVPIHELIGLVNHGNTPLTRIPTPPPTLGSASPVLSSPQHLCLRQHLHKSINSPNFFNTQTSCMFYSFRQLPIAGETEATTKVAPQQQPSPFNAEHKRKQALKPRRPRSPQRNRFFFPATISQKRPNHHTHPRQLTNAKH

SEQ ID NO: 139869 - protein, 132 aa, Heterodera glycines
  Coding regions on vcDNA: vcDNA=SeqID_66292; Strand=+; Position=1 -106,644-772,814-977
  Homolog annotation: Hit_ID=NP_502244.1; Match level="QueryCoverage =85%, HitCoverage=23%, E-value=1e-09, Identity=29%"; Hit description =BTB domain containing (67.7 kD) (4M616C) [Caenorhabditis elegans] emb|CAB01179.1| Hypothetical protein F3
MSDVDKLSDRMKRLLCTGVDADVHFLVGQDDKKEAKGNEDPIEIPDVDIEAFKTMLSFIYTDDLNGVNGDNAIEVLYAAKKYNLPSLIKACVGVPIAKLDNVFIAFAKARLLAEKVQNKEISLKLIYFSLIS

SEQ ID NO: 139870 - protein, 328 aa, Heterodera glycines
  Coding regions on vcDNA: vcDNA=SeqID_66293; Strand=+; Position=1 -177,229-469,526-703,749-966,1160-1332
  Homolog annotation: Hit_ID=NP_508867.2; Match level="QueryCoverage =97%, HitCoverage=35%, E-value=2e-54, Identity=36%"; Hit description =angiotensin Converting enzyme-like Non-peptidase (100.7 kD) (acn-1) [Caenorhabditis elegans] gb|AAA98719.
PTAGDKATCLLKFADLPSMLYSQNTGTNQCLELWQKWRLSAGSNLTQSYAELIEFSNKGAKLNGYSDAGAMWRSVYELPAQFGFYSASQIDISRQMDLLYSQLAPLYQQLHSYFRARLAAVYAQKANEDSEKGGQQLSRDGPLPIHLLKSLSGDSWTVHYEQTKPFPEEMPAEEQKIANEMVDSFRAQNYTVRTMFSKVYRFMKFVGFERLPRTFWTSSIFTRNWSKDMICNPATAYNMVKNHGICSNSPDTVLDERTAGRLPGESVCPIDLSAALAGAFGIVALHPDYLRAQKLVSVKTERNAEAEVNRLYREALEDIVKLPFAIVA

SEQ ID NO: 139871 - protein, 90 aa, Heterodera glycines
  Coding regions on vcDNA: vcDNA=SeqID_66294; Strand=-; Position=1 -149,686-753,906-961
MYKMMSSPRFSRNAAGMKRQIGPGHRRLPTTSSSRAASIHSSNCSLMFRQSKFWTPPAKRNSRRCATNTFGRALENGIMKALLDLDYSLD

SEQ ID NO: 139872 - protein, 128 aa, Heterodera glycines
  Coding regions on vcDNA: vcDNA=SeqID_66295; Strand=+; Position=1 -84,134-433,2146-2148
MINSASTILIVFNITFQFLFTCSNANPSGDDKILIAIMKGYPKIKISEYSKHKYEAHLGILYFIKTNWQCDKIEAEFEEHERTECQKYRKYLDILYEYLCREYFGTPTIKPKFVFKGRIEIEGPIIDA

SEQ ID NO: 139873 - protein, 92 aa, Heterodera glycines
  Coding regions on vcDNA: vcDNA=SeqID_66296; Strand=-; Position=1-304
MIGRAVRNRHFIFEGIFIFILYPRKMAISFFEKFYTSQKRLGMSRRAVHNHHFISQRIFIFRGYPRKMDIFFFDKFYTHTNALEHDREGGAQ

SEQ ID NO: 139874 - protein, 85 aa, Heterodera glycines
  Coding regions on vcDNA: vcDNA=SeqID_66297; Strand=-; Position=1-280
MIGRAVRNRPFIFEGIFKFILYPRKMAISFFEKFYTSQKRLRMRRRAVHNRHFISQRIFIFRGYPRKMAISFFDKFYTHTNAQRA

SEQ ID NO: 139875 - protein, 114 aa, Heterodera glycines
  Coding regions on vcDNA: vcDNA=SeqID_66298; Strand=+; Position=1 -105,185-424
MLTKRILVTFSGQKSPVPKCPVISGRKFFSSDAFNVDRNCTRHGGELVANVLKVIECIKLGLVTTFVMKINSFISVKKYFFNIFKYFNFILRIHLCPDGTKILCMIFSGWLLFS

SEQ ID NO: 139876 - protein, 121 aa, Heterodera glycines
  Coding regions on vcDNA: vcDNA=SeqID_66299; Strand=-; Position=1-364
MRNVPRNTRGEICELRFLPLEDTQRPDLLMEVLIQHLLDRVLDGHPPPSLVGLQLHPPGFDRPYVIRLRPPEQNNAAALAAAIERLNEQSAAGIDLLAGTTVAKVLAVWPLEQIRADPQRG

SEQ ID NO: 139877 - protein, 42 aa, Heterodera glycines
  Coding regions on vcDNA: vcDNA=SeqID_66300; Strand=-; Position=1 -101,247-274
MTSSEREQETAFGENPQIGTGEDSANALGNGQNRHIQFVWTG

SEQ ID NO: 139878 - protein, 170 aa, Heterodera glycines
  Coding regions on vcDNA: vcDNA=SeqID_66301; Strand=-; Position=1 -77,132-381,1090-1272
  Homolog annotation: Hit_ID=NP_506022.1; Match level="QueryCoverage =91%, HitCoverage=36%, E-value=4e-21, Identity=61%"; Hit description =voltage gated CLC-type chloride channel subunit, CLC7 like, expressed in gamma-aminobutyric acid-ergic ne
MRNFGLSSDQRPLIWSRTDRRFSHNSLDPNEDPVSGIERVSSTSTLFSRRRREERLREQEEVRRRQFSGSRKLSDGASEHTLSEKYESLDYELIENELYRAAEKDKGHQEGPMIHSGAVVAAGISQGRCLSLPVDFGLFKYFRNDREKRDFVSAGAAAGVSAAFASPIGG

SEQ ID NO: 139879 - protein, 110 aa, Heterodera glycines
  Coding regions on vcDNA: vcDNA=SeqID_66302; Strand=+; Position=1 -51,110-229,274-433
  Homolog annotation: Hit_ID=NP_506597.1; Match level="QueryCoverage =86%, HitCoverage=8%, E-value=1e-15, Identity=45%"; Hit description =tRNA modification enzyme (5P0) [Caenorhabditis elegans] emb|CAB03994.1| Hypothetical protein C53A5.2 [Caen
MQNFLSQKGFDLRKLKTEAPTAKLLKDIPLADALRPSASDLLYNEKWRHISPIHMKEIDASDSVITDEGFAYFLECRNIEKLRLNFCDYFADEAIARLAQGRQSKTLKGI

SEQ ID NO: 139880 - protein, 337 aa, Heterodera glycines
  Coding regions on vcDNA: vcDNA=SeqID_66303; Strand=-; Position=1 -89,219-389,446-558,652-727,1222-1380,1439-1658,1685-1748
  Homolog annotation: Hit_ID=CAE72187.1; Match level="QueryCoverage =92%, HitCoverage=96%, E-value=3e-67, Identity=41%"; Hit description =Hypothetical protein CBG19295 [Caenorhabditis briggsae]
PLFISLMTLPPSLFAFDMPTLDPAIPTQSPHLAPSSDSCVGQCALIFTDQMRSQLGSEHSTGLLNLNYNEFLAAFSNSSFFDSFCNIYHQFNFCIYHQFNFCYTKCPQGFMQELLSRSAEIVDHFCVWNYKEIKTKFGCLVALDREMSKKCLHSCAGVTSLMQNFKHLAMNSDPTEAEKYLGESCEYVGCTLHCDVPAIDSLCGTDTAELVVNLTKKSFDSLQRMALDVVNLTKKSFDSLQRMALDTGAIGKWPTLCDDIRTYVVPKKHEKPSQNDKNESSINGALQTDGVANLHLVIGILIRHNNILVVRVTVWLIRHNNILVVRVTVWLLVPMLI

SEQ ID NO: 139881 - protein, 48 aa, Heterodera glycines
  Coding regions on vcDNA: vcDNA=SeqID_66304; Strand=-; Position=1-145
  Homolog annotation: Hit_ID=NP_643009.1; Match level="QueryCoverage =100%, HitCoverage=10%, E-value=2e-21, Identity=95%"; Hit description= NADH-ubiquinone oxidoreductase NQO1 subunit [Xanthomonas axonopodis pv. citri str. 306] gb|AAM37545.1| N
RISQFFHKESCGQCTPCREGTGWMHRVLERIVAGKATMEDLHQLKAVA

SEQ ID NO: 139882 - protein, 70 aa, Heterodera glycines
  Coding regions on vcDNA: vcDNA=SeqID_66305; Strand=-; Position=1-213
  Homolog annotation: Hit_ID=NP_638857.1; Match level="QueryCoverage =98%, HitCoverage=22%, E-value=4e-27, Identity=86%"; Hit description =porphobilinogen deaminase [Xanthomonas campestris pv. campestris str. ATCC 33913] gb|AAM42781.1| porphobi
MLRGEADCAVHSLKDVPMELDAPFALPAMLTRHDPADGFVSNLYASLEALPIGARVGTSSLRRQAQLRAL

SEQ ID NO: 139883 - protein, 67 aa, Heterodera glycines
  Coding regions on vcDNA: vcDNA=SeqID_66306; Strand=+; Position=1 -87,131-247
MLALFASIFECIFLLFSTFGALASVMRPKMKGFLLLALLPLVTFLPETMAKSIQAAEMSEMNDELSD

SEQ ID NO: 139884 - protein, 49 aa, Heterodera glycines
  Coding regions on vcDNA: vcDNA=SeqID_66307; Strand=-; Position=1 -136,220-233
  Homolog annotation: Hit_ID=AAH85620.1; Match level="QueryCoverage =89%, HitCoverage=8%, E-value=8e-13, Identity=72%"; Hit description =Unknown (protein for MGC:86603) [Danio rerio]
MFASGSTDNIKLWKFPNGDFVQNLSGHNTMINSLVVNENGVLISGVLTA

SEQ ID NO: 139885 - protein, 234 aa, Heterodera glycines
  Coding regions on vcDNA: vcDNA=SeqID_66308; Strand=-; Position=1 -182,716-864,972-1292,1330-1382
  Homolog annotation: Hit_ID=CAD48139.1; Match level="QueryCoverage =90%, HitCoverage=37%, E-value=7e-41, Identity=43%"; Hit description =hypothetical protein [Brugia malayi]
MANHSSEHNRVTDEAGSTATDHQPLTAKDKALHNYVFRSMKRAHDMFLHDYEKFPENDEKAERIWRNTKIRSDFRHVMNAVEEAKKRKAAEVLRLPKSNREAIAAVVSNENAPLAITAGDGADFTGNLMVATVPSKPQQDNANLRALLPSRANLITKPKWHAPWKLYRSFIGCLPLKSKVLYRFRVISGHTGWVRAVDVEPNNEWFASGGADRIIKAYLGLGKQTFEIVVDRTH

SEQ ID NO: 139886 - protein, 96 aa, Heterodera glycines
  Coding regions on vcDNA: vcDNA=SeqID_66309; Strand=+; Position=1 -107,224-404
  Homolog annotation: Hit_ID=NP_498138.2; Match level="QueryCoverage =97%, HitCoverage=21%, E-value=9e-12, Identity=43%"; Hit description =putative cytoplasmic protein of bilaterial origin (50.0 kD) (3G415) [Caenorhabditis elegans] gb|AAA81060.
MVISQIAKTLWSHKKKSIFAVIATAYGANALRARLRDDRIRYSFAERARKYGLVSFGPAQRLRRVTVLVNRESGGRRAADLFKRNALPLLNLAGLQ

SEQ ID NO: 139887 - protein, 28 aa, Heterodera glycines
  Coding regions on vcDNA: vcDNA=SeqID_66310; Strand=-; Position=1 -55,398-429
MCSGCSTSTFRNQRQNRAEKCIGLLKLL

SEQ ID NO: 139888 - protein, 145 aa, Heterodera glycines
  Coding regions on vcDNA: vcDNA=SeqID_66311; Strand=+; Position=1 -162,230-502
MPAADSPPTFTFSFTELVPMESSTAHQRKTPGESGRDNGGHSTRGKQFHALFAEVHIPVEEDEAKLVAELQEKNSNRLLAAMNSLNEETDGIGNEEECEESDEEKEGKYEGSERREATASQSPAENPKGEEKERVEGNEEENEEE

SEQ ID NO: 139889 - protein, 106 aa, Heterodera glycines
  Coding regions on vcDNA: vcDNA=SeqID_66312; Strand=-; Position=1 -73,125-286,335-420
MSLLIKSKTNASLFLFLLVLFVVQAFRFVSADLLCRNCGHSVTTASALKNVVSPKAFEHWNMTVLGVETVVQVFKNSVPEKFNLITVNGADLKFAGKSYVEDTWYL

SEQ ID NO: 139890 - protein, 85 aa, Heterodera glycines
  Coding regions on vcDNA: vcDNA=SeqID_66313; Strand=+; Position=1-258
  Homolog annotation: Hit_ID=XP_341340.1; Match level="QueryCoverage =80%, HitCoverage=25%, E-value=2e-13, Identity=50%"; Hit description =similar to elongation protein 3 homolog; likely ortholog of mouse elongation protein 3 homolog (S. cerevi
MALNESEGTVVNGKLSAKELFTRCVNEIIAQLIVAQKEGRDVNLNKLKCEIASKYGIKTQPKLVDIIGAVPPQFKAIIEELRDAN

SEQ ID NO: 139891 - protein, 88 aa, Heterodera glycines
  misc_feature (60)..(60): Xaa can be any naturally occurring amino acid
  Coding regions on vcDNA: vcDNA=SeqID_66314; Strand=+; Position=1-315
CETECAIFGINASSEFRAGDSEHWSALFPGKLDYFFLPIGLRLINCMAISLLICTLLQTXLLRLRSGIFKDDEEEGKKIIFIPKNGLL

SEQ ID NO: 139892 - protein, 34 aa, Heterodera glycines
  Coding regions on vcDNA: vcDNA=SeqID_66315; Strand=+; Position=1-105
WPFGGLKQLWGAKIQRKIKGQAIGKLFPKDSVSP

SEQ ID NO: 139893 - protein, 114 aa, Heterodera glycines
  Coding regions on vcDNA: vcDNA=SeqID_66316; Strand=-; Position=1 -119,625-849
FVAEGKNFEAIAASLGGKWSADDVANFYSLNQLELRLDYLISLYERAKADERNVPALRANTARNNGQQQKKVPAANGGKKNNNNGVPPVVKQQIVVIRQAEQRGETVAKREDGG

SEQ ID NO: 139894 - protein, 55 aa, Heterodera glycines
  Coding regions on vcDNA: vcDNA=SeqID_66317; Strand=+; Position=1 -63,114-217
SQLPPASIRPFGRPPFTPGRSELRQIELRRFIQQIEAEESLKTKRNERTSHRPSV

SEQ ID NO: 139895 - protein, 20 aa, Heterodera glycines
  Coding regions on vcDNA: vcDNA=SeqID_66318; Strand=-; Position=1 -29,137-170
MIIRISNMLWPLIFGAFNFK

SEQ ID NO: 139896 - protein, 132 aa, Heterodera glycines
  Coding regions on vcDNA: vcDNA=SeqID_66319; Strand=+; Position=1 -97,211-509
MADVLEAFSPPCSLGTFLQDMTIYAGCPSLHMSLMVFLLRNQLLVQLHTFFFLLPLPSNDANDNCKANQQQQQHNHSQRERGRRDSGASNDDAKEGEEGGEEDGTETAAEQPQQQWVGPPPPPAAELGLSPE

SEQ ID NO: 139897 - protein, 50 aa, Heterodera glycines
  Coding regions on vcDNA: vcDNA=SeqID_66320; Strand=+; Position=1 -129,454-477
MHSDVIMEWKVRKEFVEVVANAMRNYAAISQAMDSEEISTYFKIWIFPWK

SEQ ID NO: 139898 - protein, 18 aa, Heterodera glycines
  Coding regions on vcDNA: vcDNA=SeqID_66321; Strand=+; Position=1-56
YREATPEGFGLPINMGAS

SEQ ID NO: 139899 - protein, 143 aa, Heterodera glycines
  Coding regions on vcDNA: vcDNA=SeqID_66322; Strand=+; Position=1 -124,177-272,318-526
MVSTRNKTGKFMKLSNSGTEANRKRKEWRQERARKGGSTPKTLKQTEAEATADGEGTSTQAAESGPSTSALDLRPRSSPRPLSATPIRRHVGVRPKTTDKATNMDLTTTDNATNTDLTTMDKATDVNLADDDAATLTEQLDRQ

SEQ ID NO: 139900 - protein, 19 aa, Heterodera glycines
  Coding regions on vcDNA: vcDNA=SeqID_66323; Strand=-; Position=1-58
DCWGRGFESHRASYLLCST

SEQ ID NO: 139901 - protein, 94 aa, Heterodera glycines
  Coding regions on vcDNA: vcDNA=SeqID_66324; Strand=-; Position=1 -161,264-389
ISALAGVVPYPVTDDSSLLLLDPALATACPLINIIDSPKLLEGTDNEKTENLEAELIAMEESLKELDNNQLKMETMGEEKKTEKAPVEEGKNSP

SEQ ID NO: 139902 - protein, 99 aa, Heterodera glycines
  Coding regions on vcDNA: vcDNA=SeqID_66325; Strand=+; Position=1-300
MNFVNDRVEGDLYRTNNSVEAWHRNLNALFRSPSPRLSIFLRKVRQEESHWRQQVKDFANNPANGIRGKGMKRKQTYVDQDMNLNELYVTRNNRHPLQY

SEQ ID NO: 139903 - protein, 55 aa, Heterodera glycines
  Coding regions on vcDNA: vcDNA=SeqID_66326; Strand=+; Position=1-166
  Homolog annotation: Hit_ID=NP_642202.1; Match level="QueryCoverage =100%, HitCoverage=10%, E-value=1e-24, Identity=96%"; Hit description= lysyl-tRNA synthetase heat inducible [Xanthomonas axonopodis pv. citri str. 306] gb|AAM36738.1| lysyl-tR
MHYIPGGAAAKPFTTHHNALDLDLYLRVAPELYLKRLTVGGLERVYEINRNFRNE

SEQ ID NO: 139904 - protein, 27 aa, Heterodera glycines
  Coding regions on vcDNA: vcDNA=SeqID_66327; Strand=+; Position=1-81
IDLRFKKTRAMRRELNKHELSLKTHKQ

SEQ ID NO: 139905 - protein, 140 aa, Heterodera glycines
  Coding regions on vcDNA: vcDNA=SeqID_66328; Strand=-; Position=1-421
  Homolog annotation: Hit_ID=AAV82746.1; Match level="QueryCoverage =100%, HitCoverage=31%, E-value=5e-52, Identity=66%"; Hit description= IS4-like transposase [Idiomarina loihiensis L2TR] gb|AAV82638.1| IS4 -like transposase [Idiomarina loihien
PLSHWNGLTLLAVDGTLWRTPDTPENDAAFGRTANEHARSDWPQLRMVCQMEVTSHLLTGVSFGSVSETSEVDLAAQLAEQTPEHSLTILDKGFYALGLLHHWSASGAEKHWILPLRKDAQYRVRVKGGAGQELVELKLS

SEQ ID NO: 139906 - protein, 176 aa, Heterodera glycines
  Coding regions on vcDNA: vcDNA=SeqID_66329; Strand=+; Position=1 -200,574-669,723-959
NVKLINSNKCVNTDNLFAEKRNPGTGGLKCYDEIKHQSYDCSCHGDKKCLAEEKWAHDAFLCPIIKVNSIQIKGSRQRVFTNPKDFRYNWTRIEVDCYKADAGTVSFWGYSNPETKEIIRVDEVHCLTYETARVPKRFKSLQVEEQPPMKKLSPSPFLANNASSLIHVFVPFVGHP

SEQ ID NO: 139907 - protein, 89 aa, Heterodera glycines
  Coding regions on vcDNA: vcDNA=SeqID_66330; Strand=+; Position=1-270
MKKIYLYANLTKSSQNIRDRYFEKSLDLDLDSMLDLDFLDKNPGKSRSRKNPGSSRPGSRPGPGFFEIFLKSKQMPEKINYLLEASKNI

SEQ ID NO: 139908 - protein, 62 aa, Heterodera glycines
  Coding regions on vcDNA: vcDNA=SeqID_66331; Strand=+; Position=1 -89,518-617
MIIFSMFLKNKLCQILIGKIYKSMCLALVLFKINYFYGIILANLTHLRSELLAMDLYNINKY

SEQ ID NO: 139909 - protein, 87 aa, Heterodera glycines
  Coding regions on vcDNA: vcDNA=SeqID_66332; Strand=-; Position=1 -179,239-325
EVIEVEDAKVEQYKNKSLSGAKLRDFVGFWVLGLDMIPWDAQRMRLFVIRHCNCSLEAWFLRPSDSEPTDPKEASMGTGRFEDRYGI

SEQ ID NO: 139910 - protein, 178 aa, Heterodera glycines
  Coding regions on vcDNA: vcDNA=SeqID_66333; Strand=-; Position=1 -170,432-552,625-847
  Homolog annotation: Hit_ID=AAF73254.1; Match level="QueryCoverage =100%, HitCoverage=45%, E-value=2e-48, Identity=52%"; Hit description= alcohol dehydrogenase class 3 [Branchiostoma floridae]
IAGHEATDIVESVGPGVHGFCPGVHVIPAPIPQCRSCEHCYAPESNLCKLFQFGPEAQTMLDGTTRFKCRGQDVYHFIGTSTFSEYTVVLESCICKINPKAPLINPKAPLDIVVALGCGFTTGYGNPFNVAPVVPGSTVGIWGIGAIGLGVMLGCKERGAKNIIAVDPEPKKLQIGEK

SEQ ID NO: 139911 - protein, 56 aa, Heterodera glycines
  Coding regions on vcDNA: vcDNA=SeqID_66334; Strand=+; Position=1 -60,127-237
MGVEKFILKKTLYKIIPLGENSIKITFTVRKMGFDKFIGGKKTLQNNTPGRREWET

SEQ ID NO: 139912 - protein, 21 aa, Heterodera glycines
  Coding regions on vcDNA: vcDNA=SeqID_66335; Strand=-; Position=1-64
MPGPGPGFHVGPGPGFPGQKS

SEQ ID NO: 139913 - protein, 30 aa, Heterodera glycines
  Coding regions on vcDNA: vcDNA=SeqID_66336; Strand=-; Position=1 -24,86-154
MEFVLEWQNLENEHSKKNFKKTDHLINMQK

SEQ ID NO: 139914 - protein, 164 aa, Heterodera glycines
  Coding regions on vcDNA: vcDNA=SeqID_66337; Strand=+; Position=1 -234,299-556
  Homolog annotation: Hit_ID=AAP30770.1; Match level="QueryCoverage =73%, HitCoverage=41%, E-value=3e-22, Identity=48%"; Hit description =putative gland protein G17G01 [Heterodera glycines]
MSILPAAVFLFSKHHHHITHSRSIVLLHHSFIHRLSSVTRRIMRKFAYFKLCQAVLTSVFLWQILSTHQFCGEFDEPTAFFNSAVSSSSAGGHCDHQFTLIGMDSTTGEYGAVPDKQKWHMQLMASSGGGQGQPIDEQQQQQKNQMEEFSSKLPTVGRHCIPIA

SEQ ID NO: 139915 - protein, 145 aa, Heterodera glycines
  Coding regions on vcDNA: vcDNA=SeqID_66338; Strand=+; Position=1 -108,347-439,483-716
  Homolog annotation: Hit_ID=CAE56179.1; Match level="QueryCoverage =100%, HitCoverage=46%, E-value=5e-24, Identity=38%"; Hit description= Hypothetical protein CBG23799 [Caenorhabditis briggsae]
MRMRTALVNEEEKLKLLPLESQTNRIDGVWNLSSDQYNVSIPFLQLRSCRIRDSRFGHALVLETSLRSGEYILGFQIKPEERLEFTCKAVQALLSAFQSSPIFGVQYSRQEAAFSQQQEQRQAMVPNITEEKEPEEKALRVDAFA

SEQ ID NO: 139916 - protein, 15 aa, Heterodera glycines
  Coding regions on vcDNA: vcDNA=SeqID_66339; Strand=+; Position=1-50
LKPSIACSVLGTAKH

SEQ ID NO: 139917 - protein, 38 aa, Heterodera glycines
  Coding regions on vcDNA: vcDNA=SeqID_66340; Strand=+; Position=1 -83,192-225
MRENVHQNVVANPSEMWGIIIVTNIYKSFSKNLSVNKN

SEQ ID NO: 139918 - protein, 41 aa, Heterodera glycines
  Coding regions on vcDNA: vcDNA=SeqID_66341; Strand=+; Position=1-128
TSLFCVETGQLDSRHLDSGGVWTVKHIWTEVDNFVQCTLRK

SEQ ID NO: 139919 - protein, 44 aa, Heterodera glycines
  Coding regions on vcDNA: vcDNA=SeqID_66342; Strand=-; Position=1-135
MNRILSKNLFNRFFVGYENLPSCRHYPTLRSSANAPKPDDLYEP

SEQ ID NO: 139920 - protein, 277 aa, Heterodera glycines
  Coding regions on vcDNA: vcDNA=SeqID_66343; Strand=+; Position=1-831
  Homolog annotation: Hit_ID=NP_920205.1; Match level="QueryCoverage =94%, HitCoverage=17%, E-value=5e-29, Identity=33%"; Hit description =putative DNA helicase homolog [Oryza sativa (japonica cultivar -group)] gb|AAP52492.1| putative DNA helica
MYFRPSPTDGGAQLEVNGLIYDNSHVVPYNPYILLRYRVHHNVLFAYGNKANIKYALKYPFKGPGHCYVECKQESGNKIGIDEPAQYAKMNFRGATEAYAIVHSLPFAKLSHQVVKLSIHMPNQQPIVYRAFQLVSKAQQIQQGELPETQCSAYWKQWQNEWKHDPKLKGMLFEKVPEHFIWAKDKWNKRKYNLTKRPPIGRIVPVPPSDPERFALYSLMRHFPGDPDHLKMVNGLLCTSFTEAAIMHGLLEDDKIWDKTLAEAALSRWPDQMRWLF

SEQ ID NO: 139921 - protein, 1415 aa, Heterodera glycines
  Coding regions on vcDNA: vcDNA=SeqID_66344; Strand=-; Position=1-4248
  Homolog annotation: Hit_ID=NP_491240.1; Match level="QueryCoverage =87%, HitCoverage=92%, E-value=0.0, Identity=35%"; Hit description=zn- finger, CCHC type and RNA-directed DNA polymerase  and Integrase, catalytic domain containing protein fa
MNAEQIQQLLTALLQGNAASSISQANLASSIDSRISKFVYDPENGQTFEQWHKRFGILIEEDGKDLTEQAKVRLLLGKLGDEEYTKYRDTISPELPDKASWAESINRLKELFAETRSLFVRRYECFRIRQHPNQDISSLVAQINAACEHANLSLTKEQLKCMILVISLRDEHHDLRQKCLKMMEEAEKSGTTVTLKKLEEELKAIQIVKDSALSLLSTPASTNAIRTRPQQWRESKTKAKSANAVQQNHPAQQKPATGGKAIRGQPTQPCGSCGGTDHWRSDCRFREATCHTCQKQGHIANVCRKGAFTTKNQRRSFHTVQVKATCLQIGTTQGRWWKILVEINGTKIEMNVDTGAQATVLTIETWTKLGQPKLLPTDIETRNCNDVTFNTIGKFICLVSIKGQPAKKLTAYVTEELNYDLFGLPWIEATELIPKEIMFPETHTSVGIRASSAAPFQEIADVKSLTTALKENFPDVFGKELGQCTKIKAHLILKSDARPVFCKARPVPHGSLEAVNTELDRLLQIGAINPIEFSHWAAPILAVKKKNGKIRVCIDFSTGLNNALELNRHPLPRPDDIYAAISGAAFFTNLDLKDAYLQMELDDESKQLCVLNTHRGLFQCQRLPFGVKSAPAIFQHLMDQICAGIPGAFAYLDDGLIASKTLEEHLSAIHQLFTRFKAYGLCIQLEKCKFLQKELLFLGHIVSANGIRPDPGRSDAIRKLPVPHDKSTLRSFLGALTYYSRFIKKMRELRAPLDQLLRKDELWNWGEDQQKAFEKAKEIMLSDLLLTHFDPSLPIIVAADASKDGIGATISHIFPDKTEKVIEHASSVLSEAQRNYSQVEKEALALIFAVQKFHRMIFGRKFTLLTDHKPLISIFGSKKGIPIYAACRLQRWALILSNYEFDIRYINTTAFGQVDMLSRLIANYPRPEEDILIAKICTETECFIGTILQARINHLPVTATEIAEMTEKDEILQKVAKFSKEGWSQKCNDPDLAPFFPKRNEILQIENCLLYQNRVIIPTILRDRTLKALHMAHPGIVRMKALARQHVYWPGMDSAIEKLVKSCEECQIAQKAAPKAPLSPWNATKRPFERVHIDFAGPCQDGHVYLLLVDSFSKWPEVYQMNTMTAKATISVLRLIINRLGIPEEIVSDNGRQFRSSEFSEFCKEFGIRHMFTPLFHPQSNGQVERFVDTFKRAMQKCSKKDKNWAEKMLLSYRTTPNSAINGHSPDQLFFGRKLRTQLSLTHPTGKVNETIDKTIFHQKQEKYRTKMAQNFNEKHGVKSNEFLPTDPVLVLNYQHGKTHWLQGTVIERLNNSPTYRVNVPRLGRNIHRHANQMRRRYVFEESLGFVGPAQVANDPNHHSPAHQNHPTPARQNTTPKCQKRKQPDEIHPTTANSPPMALRRSSRNTKPPIRFSPG

SEQ ID NO: 139922 - protein, 288 aa, Heterodera glycines
  Coding regions on vcDNA: vcDNA=SeqID_66345; Strand=+; Position=1 -378,994-1211,1788-1922,2238-2318,4179-4246
  Homolog annotation: Hit_ID=CAE61800.1; Match level="QueryCoverage =93%, HitCoverage=73%, E-value=8e-88, Identity=61%"; Hit description =Hypothetical protein CBG05763 [Caenorhabditis briggsae]
KPLNTITVIPVILIEYQYDNESIKTYRNGKNIKIQKFPLLLVEIPPMVNQAKQVAMSPRDQGNSVRWRDANDRLLDSVRSVGDAITGMPSARGTQPPPAQTRYQPTVTPVPVEQYNHAASAYPPGEPLVHNRLIVREEMPAPRRPTPPVEISPAPRPPPPPELDEEEETRAFWERYQLPNAQYQPILSAAHNLHQLRQWSSNENDIVAAAKRMAILMARLSQLVRGEGGNKKDLIDCAKAIADSSEEVTRLAVQLARLCTDIKMRMDWLYKSTRKKWRSSSLKLLMDG

SEQ ID NO: 139923 - protein, 153 aa, Heterodera glycines
  Coding regions on vcDNA: vcDNA=SeqID_66346; Strand=+; Position=1 -109,166-422,510-605
  Homolog annotation: Hit_ID=NP_741348.1; Match level="QueryCoverage =93%, HitCoverage=16%, E-value=6e-58, Identity=71%"; Hit description =ATP-dependent RNA helicase (4D454) [Caenorhabditis elegans]
MDTEHAEVDFEDEGDYEQLNANQNRKQKKAGGWQSMGLDHSVFKGILRKGYRQPTPIQRKAIPLMCDGRDLVAMSRTGSGKTAAFVVPLLQRLKQRDARGIRALLFSPTRELALQTFKIVKELGRFTGLYCACLIGGDSMDEQFNALHQHPDM

SEQ ID NO: 139924 - protein, 341 aa, Heterodera glycines
  Coding regions on vcDNA: vcDNA=SeqID_66347; Strand=+; Position=1-1026
MKPWLSYVKRFYDKDNWVLSWKSRRILDELHDLKNEGRWFLYHATNGAQLTISRTFDGTRPFAEFRYVEEGHLVDLTPNQVIFRQTVPDEPEESPVSNNKKLEEKAEKPARNDKRTTLATRKVEEYCTAEMKQNSYCYDIFKPCDATHETCAKSATYSALAENRHKLEEFNNCHASCLFEALIFSWLSRNTNLPGNEVSRMHEELIKPTTELEEVAKLFHDEQIVKNKRGLGKDQQVMKVIEIWRNSCDRFGELFTKPAMQQIKFRPILIEHNGQYNQWINRQNTRMAELFSKMRTKAQHPTYLSYNCTTVIVGDNVAELFPPHYLMMPNGSRISQRTHAD

SEQ ID NO: 139925 - protein, 51 aa, Heterodera glycines
  Coding regions on vcDNA: vcDNA=SeqID_66348; Strand=-; Position=1-155
MQTLHDASLVKSLLKNAQISCRRCENSRLLQGYNTINNINPAYQNDQNYHT

SEQ ID NO: 139926 - protein, 72 aa, Heterodera glycines
  Coding regions on vcDNA: vcDNA=SeqID_66349; Strand=+; Position=1-219
MPKMRCLGVLSRALGVQPAAVLSWPIITAVMMLGATATTGFRSAIEFRRLGDARNSEIRVRISPLALTATDT

SEQ ID NO: 139927 - protein, 23 aa, Heterodera glycines
  Coding regions on vcDNA: vcDNA=SeqID_66350; Strand=+; Position=1-69
MRIMRKAKCEKRNLGPSLICSCN

SEQ ID NO: 139928 - protein, 159 aa, Heterodera glycines
  Coding regions on vcDNA: vcDNA=SeqID_66351; Strand=-; Position=1-482
KSTELANKFPAINPIFLHYHFNDHMKLISVVKTLNDISKCFWQSNIICNKLVLVNEVDFNYEIKEEENWFSKFKQNFMEKINGTKNGPKNVPSNEFEENIRQEFEQKMNKMYENTKRNSKDEKAKLEKAIGNSENNEEKKILEKEYDDKFGTFISSPFS

SEQ ID NO: 139929 - protein, 20 aa, Heterodera glycines
  Coding regions on vcDNA: vcDNA=SeqID_66352; Strand=-; Position=1 -57,274-279
MKEKWSDNRAAIDFLIKTKL

SEQ ID NO: 139930 - protein, 281 aa, Heterodera glycines
  misc_feature (36)..(36): Xaa can be any naturally occurring amino acid
  misc_feature (48)..(48): Xaa can be any naturally occurring amino acid
  misc_feature (58)..(59): Xaa can be any naturally occurring amino acid
  misc_feature (135)..(135): Xaa can be any naturally occurring amino acid
  misc_feature (151)..(151): Xaa can be any naturally occurring amino acid
  misc_feature (218)..(218): Xaa can be any naturally occurring amino acid
  misc_feature (275)..(275): Xaa can be any naturally occurring amino acid
  Coding regions on vcDNA: vcDNA=SeqID_66353; Strand=+; Position=1-856
  Homolog annotation: Hit_ID=BAB33421.1; Match level="QueryCoverage =96%, HitCoverage=96%, E-value=6e-90, Identity=68%"; Hit description =putative senescence-associated protein [Pisum sativum]
SKNIAILPRRDSDLEAFSHNPSDGSFAPLVYRPSTXTKCLNLRFLSYXAGLLLATGLXXGKTNLSHDGLNPAHVPYWWVNNPTLGEFCFAMIGRADIEGSKSDVAMDAWPPQASYPCGNFSDTSCWKLYTLKDRXATLSRSVFVLKIRIKXAFAFLLYERFPSSLSSLGHLRYALTDVPPQSNSPPDTVIGRGSPGNRVARLNTKMDTRRTPVLPIKXGIDESSGISLAPCGSHLCYTSHDSSQSQTRVKLNRVFFPAKFAKPVPLAVVSLDSRXGQWESR

SEQ ID NO: 139931 - protein, 25 aa, Heterodera glycines
  Coding regions on vcDNA: vcDNA=SeqID_66354; Strand=+; Position=1 -35,117-158
KYNVSYEFSFICNHAKTATRKWPRE

SEQ ID NO: 139932 - protein, 267 aa, Heterodera glycines
  Coding regions on vcDNA: vcDNA=SeqID_66355; Strand=+; Position=1-804
MKFAKKMLMIPEAEYLALRSAMNSGDYLQNEKASLDAKISQNLQDPDISEDLKAKRHDWLYKERRTVKGILENRPQKVVIENHVPGPNVAPYLGLNNQSKPQETEEPRKIIIPRKRLKEQTPDPESDNDTLEELSPEPQTTSTLKTPVPIKTIIHPTLLNGLFRYVKENKDLFKITAAGKVQSNMNLPIENSNYRDVLLYLAGKKDETPRGAKFLKDRLLKDPTVKDMVDKSKVMWGRGRKKAIKSIKTPGIVRVKKPFKPLIWARL

SEQ ID NO: 139933 - protein, 146 aa, Heterodera glycines
  Coding regions on vcDNA: vcDNA=SeqID_66356; Strand=-; Position=1 -158,679-867,1874-1967
EKLDEYCSNDTDILMKARIKLRKIFIDITKDKETPNGIDVMRLSTTIASSCMKNVIETYERAGKLLSEKLWGGPALNRRLWLSGPVFYQLNYRPCPLQLRLKKVVFGDLIMVRKNMDSQLKWNGWGYNHSFFALSASGQIMMHSDE

SEQ ID NO: 139934 - protein, 419 aa, Heterodera glycines
  Coding regions on vcDNA: vcDNA=SeqID_66357; Strand=-; Position=1-1259
  Homolog annotation: Hit_ID=EAL49477.1; Match level="QueryCoverage =99%, HitCoverage=44%, E-value=2e-47, Identity=30%"; Hit description =hypothetical protein 42.t00003 [Entamoeba histolytica HM-1:IMSS]
MMRKKRKRRRRRKRNRGKDRRKEEKLDVESEGTEEDKEGKEKEEGEEDKEEKTEVGKMERKKRQKKQKKSCSPEKLVKEKKEKLEGCREKKDEGEEASSVKEDEKKRENDDDEKEGEKDTNKKAEEEEKEKMRKKSKRRKRNRNGEAQLKKHFYEMDGEEKDKEEEKEEEKEVNGKKKERKEKMEGEKKKREEEKEEMEEEEKKREEEKEEREEEEKEETEEEEKEEREEEGNKREEEKEERKGHEKQTEDEEKPKRISKKKKKYKVEAAQVKEEKTKIWERKWQGLSKEERLECRYRKSCYATGTKPPIRRWATQEEGDEDEKRGHGWEEWHNLWVTMAIKNEVKEEEAIEGWHGMDERHKKLKCQYRKSCYERMEQRTEDDGTANETQRNRRKEAKQREKPKKVEDITRKTKARETS

SEQ ID NO: 139935 - protein, 377 aa, Heterodera glycines
  Coding regions on vcDNA: vcDNA=SeqID_66358; Strand=-; Position=1 -619,736-945,1253-1555
MDLLLFFLFYALFFCASFNRMSASPRKDRRGPIFDVSPPRGRLCAAASEDRQNDQTPLIDLATSEDRPNDQPPLINLPKEGQSSSKRQSKHRRGSSAIPLFADAYFPFLAQSSDTNRHASPPTVPRQFMAPMDGDISGTNNQPSPPKHRRHRSDILIFASSTQTNDHSHKQNNVNVAKSRRTRRPSISQSDAIAKQLNELVIQERIYNQTPTQYPKMPINKWTNLRLPVHSEQLRAGGKFDVKEKCPEATNEFDKIVEFMDDTGKWIKIEIEQGKAVVIYLRDLLGNPLQIEEPMNLSFGGKKRFLRTNGTEILYPTEIIYSWMNFQLPVNAEHLEMGGQFDVKEKCPEETREFDKIAEFMDDTGKWVKIEIIQRKA

SEQ ID NO: 139936 - protein, 18 aa, Heterodera glycines
  Coding regions on vcDNA: vcDNA=SeqID_66359; Strand=+; Position=1-54
MLFNFFVILFKRNYEKQK

SEQ ID NO: 139937 - protein, 133 aa, Heterodera glycines
  Coding regions on vcDNA: vcDNA=SeqID_66360; Strand=-; Position=1 -45,93-214,308-542
MNNSTNTTMDPTNTTLGYVISSNFVPLCFLFGLKIPILVMAFFLSTTPIYLTFKSKILRGNCNFLIALNFFNLSLQLPAALISATVVLTGQIQIRLANCFPLQIGPYIGATAQWTICFAIALDRLVGLFFPFL

SEQ ID NO: 139938 - protein, 83 aa, Heterodera glycines
  Coding regions on vcDNA: vcDNA=SeqID_66361; Strand=-; Position=1 -56,197-392
MLLLSFLFVFFLSVSKSEDCCDVCFNAYVLCNYSCQTLRPAEGGAAGDGTKFRHCRANCRMDLAECAFRCGPDCPRPNDVLIG

SEQ ID NO: 139939 - protein, 104 aa, Heterodera glycines
  Coding regions on vcDNA: vcDNA=SeqID_66362; Strand=+; Position=1 -211,502-605
MAKLKIFFFAFLILSQNLTISKPIRRKERELGTLAAIAIISAIVLTPIILGSVATGIVIGYTLKDGSGREYLKGTKRRHTRSGQIEIFLFYLSKMELPVSLNSC

SEQ ID NO: 139940 - protein, 31 aa, Heterodera glycines
  Coding regions on vcDNA: vcDNA=SeqID_66363; Strand=-; Position=1-96
AMIVHLRSCANRREQKQLTHRKDAFCSLNII

SEQ ID NO: 139941 - protein, 161 aa, Heterodera glycines
  Coding regions on vcDNA: vcDNA=SeqID_66364; Strand=-; Position=1 -271,302-513
MVEMGTEIQTSRNELKSFQEEVDKAKNITLEHVEKNDMKEAKKSADVAKGIARQAKTKYTSTLEEYNDKSEKGFSGMVVRLNEALGGHFKQAEKGPQKRERLANEDVQFNYDSIDQKFIVYLSFAVTHIDLSKHLAYVLGFKNTRLFHAEEATYMPDLTGG

SEQ ID NO: 139942 - protein, 266 aa, Heterodera glycines
  Coding regions on vcDNA: vcDNA=SeqID_66365; Strand=-; Position=1-801
MKFAKKMLMIPEAEYLALRSAMNSGDYLQNEKASLDAKISQNLQDPGISEDLKAKRHDWLYKERRTVKGILENRPQKVVIENHVPGPNVAPYLGLNTQSKPQETDEHRKIIIPRKRLEEQTPDPESDNDTINELTPEPQTTSTLKPIPIKTIIHPTLLNGLFRYVKENKDLFKITAAGKVQSNMNLPIENSNYRDVLLYLAGKKDETPRGAKFLKDRLLKDPTVKDMVDKSKVMWGRGRKKAIKSIKTPGIVREKRPLQPLIWARL

SEQ ID NO: 139943 - protein, 99 aa, Heterodera glycines
  Coding regions on vcDNA: vcDNA=SeqID_66366; Strand=+; Position=1 -130,1298-1467
MSPLRFFVALFLITLAILAGTHGTVENSVDGGPNMASPIIRERRLFREPQLHSSAECLCRVGDDAKSAKQKGQQMLGRDGQSGDNSKNGNEMYYLQLRF

SEQ ID NO: 139944 - protein, 218 aa, Heterodera glycines
  Coding regions on vcDNA: vcDNA=SeqID_66367; Strand=-; Position=1-658
SWILSKVCTNIGQLSIEIYNNNNNKELPEINELKQIVTEICKEKSDVQNAIKSFYAKNDIGTIVEKAMKNGQHILEVMKQKEDENELECNNQLNEFSQFAKKFQMEFPEILKNSTVNELMDKELLKPSDLFEFVLNKLEFEHFASERNSTGANGGAAKKLSADAKKVSHRRRKRSGDPIPFPLLIIAFFVFAYYTHIFTSPILFIFMAFCLFLAARLS

SEQ ID NO: 139945 - protein, 135 aa, Heterodera glycines
  Coding regions on vcDNA: vcDNA=SeqID_66368; Strand=-; Position=1 -194,451-664
MNSVLEGIYNGVPMICVPFFGDQFYNAESLARQQIGLVVDRLHYKGTVQQQLTLALAIALKLNESNVSENKIEMDKLTTISAALHQKNIPNIISDAFRVIEDEMCTNDRKTTVIGDLLTRNEASYEPVGWPELII

SEQ ID NO: 139946 - protein, 50 aa, Heterodera glycines
  Coding regions on vcDNA: vcDNA=SeqID_66369; Strand=-; Position=1 -46,328-434
MTFYASLVGYTGRNNKILSVKSAFGILMSKSVTVNDILSSLVGYTGRNNS

SEQ ID NO: 139947 - protein, 48 aa, Heterodera glycines
  Coding regions on vcDNA: vcDNA=SeqID_66370; Strand=-; Position=1 -46,200-300
MTFSASLVGYTGRNNKILSVQSAFGILMSKSGTVNDILCFSCWIHGKK

SEQ ID NO: 139948 - protein, 42 aa, Heterodera glycines
  Coding regions on vcDNA: vcDNA=SeqID_66371; Strand=-; Position=1-127
MANKFLIAAFILTIAIFVNGQSEAPNNSSEMASEESNSEESG

SEQ ID NO: 139949 - protein, 71 aa, Heterodera glycines
  Coding regions on vcDNA: vcDNA=SeqID_66372; Strand=-; Position=1 -105,401-509
MGRSKSMPSLRGPTNIQQLVDKMWEKDTERVNESMGEAPMNEQRRAKFDTLWALITRSEIYRMAYDYLDRL

SEQ ID NO: 139950 - protein, 159 aa, Heterodera glycines
  Coding regions on vcDNA: vcDNA=SeqID_66373; Strand=-; Position=1 -169,227-534
MLGQFISSPPRTLIMAFLLAIIMPIFVVGPKIGSIGNQYQIHPPEKYKIIVVFYAPAEFQTNAQGEIKFSFDDRVFKNPFVNQELQDSNTVKVAVYVYGGQNNELRLLHPFKMFEYNHANERKLVRKVNYTDFEKDRKRNDYRLHEVFHVAFKDLPLVE

SEQ ID NO: 139951 - protein, 17 aa, Heterodera glycines
  Coding regions on vcDNA: vcDNA=SeqID_66374; Strand=-; Position=1-53
MRIFILGLPNLPPFYKE

SEQ ID NO: 139952 - protein, 30 aa, Heterodera glycines; identical to SEQ ID NO: 126607
  Coding regions on vcDNA: vcDNA=SeqID_66375; Strand=-; Position=1-90

SEQ ID NO: 139953 - protein, 22 aa, Heterodera glycines
  Coding regions on vcDNA: vcDNA=SeqID_66376; Strand=-; Position=1-66
FLWIAHTEIFCGSPTLSFFVDR

SEQ ID NO: 139954 - protein, 20 aa, Heterodera glycines
  Coding regions on vcDNA: vcDNA=SeqID_66377; Strand=+; Position=1-65
SRRWMLLLNSLNFSWSIRGL

SEQ ID NO: 139955 - protein, 130 aa, Heterodera glycines
  Coding regions on vcDNA: vcDNA=SeqID_66378; Strand=+; Position=1 -48,904-1171,1250-1326
  Homolog annotation: Hit_ID=NP_500081.1; Match level="QueryCoverage =71%, HitCoverage=11%, E-value=1e-21, Identity=54%"; Hit description =CaLPain family member (clp-6) [Caenorhabditis elegans] gb|AAF36079.1| Calpain family protein 6 [Caenorhab
MAAFGAKMARKVQFVERDGLFEDPEFPVETIPMYFTEGPVPIRWLRPGEIADHPQFINQGPIAGDVRQGSIGNCWALAAASVLAQYGPLFYRVVPPDQGFGQNYAGINCVLGQLHLTMSQFCLGQLRLRI

SEQ ID NO: 139956 - protein, 68 aa, Heterodera glycines
  Coding regions on vcDNA: vcDNA=SeqID_66379; Strand=+; Position=1 -94,185-297
MHAFCARAIHHRACQSKAKQQRWCFERIKGIESVNRLLEKYICNLSTILRSELEMINFTIQTSFRCSN

SEQ ID NO: 139957 - protein, 15 aa, Heterodera glycines
  Coding regions on vcDNA: vcDNA=SeqID_66380; Strand=+; Position=1-45
MKIKIALPPENLLEV

SEQ ID NO: 139958 - protein, 62 aa, Heterodera glycines
  Coding regions on vcDNA: vcDNA=SeqID_66381; Strand=-; Position=1-186
MAIKYGPKIAKYGHKMAKIAKYGHKWQKCQNMDINFSKLSAKFLQIYWLKLHMRYISKFFDS

SEQ ID NO: 139959 - protein, 47 aa, Heterodera glycines; identical to SEQ ID NO: 132970
  Coding regions on vcDNA: vcDNA=SeqID_66382; Strand=+; Position=1-144

SEQ ID NO: 139960 - protein, 76 aa, Heterodera glycines
  Coding regions on vcDNA: vcDNA=SeqID_66383; Strand=-; Position=1-461
YQKGRWRKNFLKIFPYILVISFCFWWGAWNSGIMRTRPIWQVKQRLLTSQKVRCRDETNQHCLPRGTRHGPPKEWI

SEQ ID NO: 139961 - protein, 64 aa, Heterodera glycines; identical to SEQ ID NO: 129150
  Coding regions on vcDNA: vcDNA=SeqID_66384; Strand=-; Position=1-762

SEQ ID NO: 139962 - protein, 113 aa, Heterodera glycines
  Coding regions on vcDNA: vcDNA=SeqID_66385; Strand=+; Position=1 -235,307-413
MPVQLEMVNANQKSSGAILIWSPGREWTKKQTLAQNGLRKVLKRVLTMPIIGPMFPEENLGQEINLLNAQVIRWKMQEAIIHLWHGNDLSALNELNKPTEFIETVSYTFVALF

SEQ ID NO: 139963 - protein, 97 aa, Heterodera glycines
  Coding regions on vcDNA: vcDNA=SeqID_66386; Strand=-; Position=1 -84,253-462
MRKNFNNSIAAAAGGGELCQQAPAFSNKLRSLVFIFTTTVWTALSLLPFRLLMLYWMYLVDIDHFCVEKCQWLQWIYNFAWAFLCLLKLNPARKRIG

SEQ ID NO: 139964 - protein, 185 aa, Heterodera glycines
  Coding regions on vcDNA: vcDNA=SeqID_66387; Strand=-; Position=1 -93,171-315,381-700
  Homolog annotation: Hit_ID=NP_741821.1; Match level="QueryCoverage =67%, HitCoverage=30%, E-value=9e-12, Identity=35%"; Hit description =receptor 1 family member (XH246) [Caenorhabditis elegans] gb|AAM51520.1| Hypothetical protein C25B8.7 [Ca
MSVHNDSHGEDCNATSNCHASRWLEDSSQNLFDNSLIGLSLISIVANILVIICARRLFVYNCDTIHIYIASMTFGDLVVVFCQIFESFESRRPFLGVVPCICVYLLRCLGIAVSALVAGVAERRQTAFFYFPIYYRVIKSVRRALRMCAVIWTVSLGRENFLIFVELRKASIILKLKRKLIKSLT

SEQ ID NO: 139965 - protein, 64 aa, Heterodera glycines
  Coding regions on vcDNA: vcDNA=SeqID_66388; Strand=-; Position=1 -54,192-332
MLNNFLFRLDPICCESPQGHSLLAPIQSKRHTGRFCVENGNLPIPCQWHRHNGIGSFIILSFIM

SEQ ID NO: 139966 - protein, 80 aa, Heterodera glycines
  Coding regions on vcDNA: vcDNA=SeqID_66389; Strand=-; Position=1-245
CNHGYRISSIRRVNSAHQRKGIVLGSFAIECQPIVSSGKTNLKVGNGENKEERNGRKRNNTPKCQIIYIKTLAWSDGFDF

SEQ ID NO: 139967 - protein, 68 aa, Heterodera glycines
  Coding regions on vcDNA: vcDNA=SeqID_66390; Strand=-; Position=1-325
AVLVRFITAPNLLASQQSLLNLPDRTGAHDSTVPSTPPKAKRYNQNIKKNFLKNFFSIFLLVGKASEC

SEQ ID NO: 139968 - protein, 116 aa, Heterodera glycines
  Coding regions on vcDNA: vcDNA=SeqID_66391; Strand=-; Position=1 -102,160-249,306-386,444-518
MFPGDDGYESEDDEIHLPPPPIPPQIDHPPPNVLEIRVGPIHDGQQPMPLRVLPQIVHRPLNFPAVRVQPVQQPIPLRDVPLFVNPPPNVPVIRVQPMPQPLPLRDMPQIHHPPRN

SEQ ID NO: 139969 - protein, 62 aa, Heterodera glycines
  Coding regions on vcDNA: vcDNA=SeqID_66392; Strand=-; Position=1-481
IIFIQKIFFWVFGAVPLNRCAQIYGETESFGNSFPIVCTLILRWIFAPHNCLSTPNGHLKKS

SEQ ID NO: 139970 - protein, 20 aa, Heterodera glycines
  Coding regions on vcDNA: vcDNA=SeqID_66393; Strand=+; Position=1-65
TDQKRTKLCRDTERKRNNLF

SEQ ID NO: 139971 - protein, 36 aa, Heterodera glycines
  Coding regions on vcDNA: vcDNA=SeqID_66394; Strand=-; Position=1 -45,347-412
MSEFKKWGRENSKSEVTYSVIADNAHIPLGNTVASA

SEQ ID NO: 139972 - protein, 36 aa, Heterodera glycines
  Coding regions on vcDNA: vcDNA=SeqID_66395; Strand=-; Position=1-109
ARTARRTDGQRMRRDEKEVCAIQAEDENIVDEINIH

SEQ ID NO: 139973 - protein, 61 aa, Heterodera glycines
  Coding regions on vcDNA: vcDNA=SeqID_66396; Strand=+; Position=1-184
MASQPPNLVEETEKPIIDVTKAKEWRSAEDGVETGRRPENSSGQGRLLLRPLRAHHQRKRK

SEQ ID NO: 139974 - protein, 365 aa, Heterodera glycines
  Coding regions on vcDNA: vcDNA=SeqID_66397; Strand=+; Position=1 -184,438-544,593-772,1025-1268,1545-1767,1807-1966
  Homolog annotation: Hit_ID=NP_504309.1; Match level="QueryCoverage =65%, HitCoverage=44%, E-value=6e-12, Identity=24%"; Hit description =UDP-glucoronosyl/UDP-glucosyl transferase family member (60.9 kD) (5F366) [Caenorhabditis elegans] gb|AAC
MDVWDFGALALFHKIGTKNVVLTHNFPIMSHMYKYMEEAGWQTENSELFNYQKQILGKGVPELFSAVINDKNVGKAGAYKEKHNESSDIFSKVYEIADQKFKDLFTDNAFPTLEQLFRDAKALFVNTRPLLDYDIGSLPKRVKFIGGIDLMQPDHKDALPQVFGQQKPVIVFSMSSLLEPSKMPLDKFEAVIQGLGMCKEKEVIWKYAKQEDNGRKSFLQMHAPNVHLVEHYDQATVIGNEKTELVISECDIRIVMDALSSGKALLCLPMFAEQFYVSEKLRRMGAAVVLDPRSDSFTPEGIFKSIGEALTKRRVARVFGSKVEEFLGFLGSRVATLGVNDSRAQSQVLENYDSSLSSSPNNLLY

SEQ ID NO: 139975 - protein, 81 aa, Heterodera glycines
  Coding regions on vcDNA: vcDNA=SeqID_66398; Strand=+; Position=1 -112,515-648
MANFDDVLALCSHHKVVPIVRANAMGASSKFGSQQQRAGVMPMVAPTWHGGSVQLWPNNSNWPTNEHFRFWHKQRRHATLE

SEQ ID NO: 139976 - protein, 38 aa, Heterodera glycines; identical to SEQ ID NO: 130615
  Coding regions on vcDNA: vcDNA=SeqID_66399; Strand=+; Position=1 -52,124-188

SEQ ID NO: 139977 - protein, 24 aa, Heterodera glycines
  Coding regions on vcDNA: vcDNA=SeqID_66400; Strand=+; Position=1-76
ITGVSIIAVLFLVFLMPSQNLVRF

SEQ ID NO: 139978 - protein, 41 aa, Heterodera glycines; identical to SEQ ID NO: 134937
  Coding regions on vcDNA: vcDNA=SeqID_66401; Strand=-; Position=1-193

SEQ ID NO: 139979 - protein, 30 aa, Heterodera glycines; identical to SEQ ID NO: 129978
  Coding regions on vcDNA: vcDNA=SeqID_66402; Strand=-; Position=1-163

SEQ ID NO: 139980 - protein, 133 aa, Heterodera glycines
  Coding regions on vcDNA: vcDNA=SeqID_66403; Strand=+; Position=1 -107,773-1069
IHVKKLLIRRPTTIWSEFIKYSISVSKIFVYVKKQVVDSFDPEEAQCIAKSQKCFSMATVLLDIAYIEANFGCLPGAITRLEKKGFTIHESANNLCEVREDVFSFTGEIGAKIRRKFDSVIAKNPGFDTICDI

SEQ ID NO: 139981 - protein, 66 aa, Heterodera glycines
  Coding regions on vcDNA: vcDNA=SeqID_66404; Strand=-; Position=1-201
ILPGIVLTKMSQEVTHLEKPGFFSPTPEKFVNSALRTVGHADETTGCFAHQIQAILFCRLFLGNQT

SEQ ID NO: 139982 - protein, 36 aa, Heterodera glycines
  Coding regions on vcDNA: vcDNA=SeqID_66405; Strand=-; Position=1-108
IKVNVEASNQVENVLFMLNMSKLVRRKKGICLKSRS

SEQ ID NO: 139983 - protein, 70 aa, Heterodera glycines
  Coding regions on vcDNA: vcDNA=SeqID_66406; Strand=+; Position=1 -36,504-680
MKSFSWNQTNWTMFFLIRATKFSIQHRNLVLLFMTTMAQQQKAHFTTFMESVVLGIICANDSVKTAETQR

SEQ ID NO: 139984 - protein, 179 aa, Heterodera glycines
  Coding regions on vcDNA: vcDNA=SeqID_66407; Strand=+; Position=1 -47,173-290,411-580,708-917
  Homolog annotation: Hit_ID=NP_492614.1; Match level="QueryCoverage =81%, HitCoverage=30%, E-value=4e-38, Identity=51%"; Hit description =innexin, putative gap junction protein, OPUs gap junctional protein (inx-20) [Caenorhabditis elegans] emb
GLIFSFSVFIFCLLSLIHYHENYLSVLYLSIKMLFLSIVFLQSCLMNRFLQTDDYPRREAHTKETLFVHLAWSDSGNFPRVTFCDIDVRILGAMQRHTVQCILVINIFTEKVFLLLWLWYSLLLLITVFNLFGWLFALLPFSARRDFILRHLRMANVKFEKEEEVRSKGTERVKRTQFK

SEQ ID NO: 139985 - protein, 210 aa, Heterodera glycines
  Coding regions on vcDNA: vcDNA=SeqID_66408; Strand=-; Position=1-631
  Homolog annotation: Hit_ID=NP_608540.1; Match level="QueryCoverage =82%, HitCoverage=64%, E-value=9e-17, Identity=26%"; Hit description =CG2839-PA [Drosophila melanogaster] gb|AAF51469.2| CG2839-PA [Drosophila melanogaster]
MQNPFSTRKPKFQIRKQLLSLIDAAYELNKISIFFFDSKFSEENKYKLKNLFKNSNGPELLNEEELNYKINEEEKEEEEEVKESKEKMEAKSAKKPEERIKGQSAIELDQRIKEKSAKNQEQRMKGQSAKESKEKMKEQSAKKPEERLKGKNAKNPEERSKEQSAKIFPDKITKKVKRKTNEKIGKKVEKKSTEEKKDDNKAKERINKKG

SEQ ID NO: 139986 - protein, 41 aa, Heterodera glycines
  Coding regions on vcDNA: vcDNA=SeqID_66409; Strand=+; Position=1 -48,276-353
MPQKPTAATKEPLDKKENVARHLLDVVDKGISDQSDHEKTE

SEQ ID NO: 139987 - protein, 399 aa, Heterodera glycines
  Coding regions on vcDNA: vcDNA=SeqID_66410; Strand=-; Position=1 -301,411-612,654-748,846-1157,1215-1381
  Homolog annotation: Hit_ID=NP_505789.1; Match level="QueryCoverage =98%, HitCoverage=66%, E-value=9e-52, Identity=30%"; Hit description =organic -like transporter family member (5L416) [Caenorhabditis elegans] emb|CAC35887.1| Hypothetical pro
KRTELKLSQSLQLVGIIPGSFVFGWLSDLYGRRLTMLSALVLWVFAMLATSFSASLVIFTVLRFVVCFFNAGIAVTLIVFTSELYPKKHRFCLMNLITWAPNYILFGILASFIPNWQHLQRVLALFALPCMGLILFLSESPRFLISARKMKEAKEAIIRMHKFDGKRRPYDEKALDALLEKELQQMLELSDGKRRPYDEKALDALLEKELQQMLELSVTKKKYNYLHLFYNTKFTMYTLSVSFSLFVVTLITYALVYNIEKMSGNIFLNMIWMGMFKYTMNLAIAFADLKFKWLGRKLSHLLSEVLVLAALGLFVTLRLTGVSKLPMALSLVAAVGFCGILFNSSLVAAVGFCGILFNSDKLAGSELFPTGVRNLSCSFGQICSRIGVVGAPMLFFLVR

SEQ ID NO: 139988 - protein, 103 aa, Heterodera glycines
  Coding regions on vcDNA: vcDNA=SeqID_66411; Strand=-; Position=1-312
MSNNLADKISGDERPKEATETKPLLSDGIAGEGIHGQSQRDGTAKADLVNDAERTEEDERKEDDLKLDDCFRMGWYMLIVCTLSQLLLFVEVGQQKPIPPICQ

SEQ ID NO: 139989 - protein, 342 aa, Heterodera glycines
  misc_feature (112)..(112): Xaa can be any naturally occurring amino acid
  Coding regions on vcDNA: vcDNA=SeqID_66412; Strand=-; Position=1 -99,151-371,629-737,777-953,1006-1137,1190-1253,2186-2292
  Homolog annotation: Hit_ID=CAE70853.1; Match level="QueryCoverage =95%, HitCoverage=84%, E-value=3e-50, Identity=37%"; Hit description =Hypothetical protein CBG17638 [Caenorhabditis briggsae]
RRKSTAWTLTLLSCFAGGVFMGTCFLDIFPHINEHYEHYEHFRDKSQWEIEFPLPQFFICCGFFLVYLLEELILKVFASRFYYLVRKMHISTRSVSNANRSKPWPNLVPKHXSPLLCSVDLLKSFTFAFAISFHSVLEGLAMGFQETPTGITTLFFSETPTGITTLFFSLIIHKAIEAFSVGLQLSKSRSNSLVCCLISAYALMTPLGAIFGDFITTLNMDEIKKEAIITLNMDEIKKEAIIIILESLAGGTFIYVTFLEVLAHERAKEHSHLIQLGAIFLGFLVIQLGAIFLGFLVINALQLYEQHRMNGHWHSKSERKSDESSVRRMPLHPNTFPKQQMA

SEQ ID NO: 139990 - protein, 34 aa, Heterodera glycines
  Coding regions on vcDNA: vcDNA=SeqID_66413; Strand=-; Position=1-101
CLSTPNGHLKKSIFLFSGQSPRTDAPRFMGRPNP

SEQ ID NO: 139991 - protein, 133 aa, Heterodera glycines
  Coding regions on vcDNA: vcDNA=SeqID_66414; Strand=+; Position=1 -159,209-290,383-544
  Homolog annotation: Hit_ID=NP_495006.2; Match level="QueryCoverage =100%, HitCoverage=19%, E-value=4e-27, Identity=43%"; Hit description= exocyst complex component sec6 (90.7 kD) (2F661) [Caenorhabditis elegans] gb|AAA79344.3| Hypothetical pr
MHEIFARLQSIPSARIKLKELSKANSQHSQYAIAMDNIKHICNLADTIEKTHDFILDGKLLLAHKNVMELENARDDLMFELLKTYFSDVDKLIEDLGKQIWYICSRALEAVQGNDSALQQLVSALRIIEREER

SEQ ID NO: 139992 - protein, 210 aa, Heterodera glycines
  Coding regions on vcDNA: vcDNA=SeqID_66415; Strand=+; Position=1-632
  Homolog annotation: Hit_ID=XP_497907.1; Match level="QueryCoverage =88%, HitCoverage=62%, E-value=1e-25, Identity=45%"; Hit description =PREDICTED: similar to mKIAA1114 protein [Homo sapiens]
FQSLGTQPTNIPIKWHSTHQHFNHWGLNPPTFQSLALNPPTFQSLALNPPTFQSLGLNPPTFQSLALNPPTFQSLALNPPTFQSLALNPPTFQSLALNPPTFQSLALNPPTFQSLALNPPTFQSLGLNPPTFQSLALNPPTFQSLGLNPPTFQSLALNPPTFQSLALNPPTFQSLGLNPPTFQSLALNSPAFQSLGLNPPTFQSLGLNPR

SEQ ID NO: 139993 - protein, 219 aa, Heterodera glycines
  Coding regions on vcDNA: vcDNA=SeqID_66416; Strand=+; Position=1-660
MHPTEIPRQMHQQPPREERGWQQQNSVLYRPVARQQQNFPVYENQMLPPQSQNLAVLSSLEYNMVLERIPDLNGKEGTDEVKRFFKKFDAYTDSWPDEKRIKGIESKVYGRAERAFEAAKAVIPIRYELLRGEMMRQLEETDSKNLNAFDELMLGVRRKPNESIDDLAGRISGLVKRAYPGLSFQLSDEFSIKYLIRSIGDPTLSLNLELIRIINNFEK

SEQ ID NO: 139994 - protein, 188 aa, Heterodera glycines
  Coding regions on vcDNA: vcDNA=SeqID_66417; Strand=+; Position=1-593
  Homolog annotation: Hit_ID=AAB30592.1; Match level="QueryCoverage =100%, HitCoverage=87%, E-value=3e-38, Identity=52%"; Hit description= stage-specific S antigen homolog [Leishmania donovani infantum] pir||A56010 amastigote-specific protein A
KWTANVGAANVGPQIGPQKSGPQMSGPNVGPQVGPQKSGPQMSGPQMSGPQMSGPNVGPKVGPQKSGPNVGAANVGPKVGPQKSGPQMSGPQMSGPQKSGPQMSGPNVGPQKSGPQMSGPQMSGPNVGPQVGPQKSGPQMSGPQMSGPQVGPKVGPQKSGPQMSGPQVGPKVGPQMSGPQMSGPQMSG

SEQ ID NO: 139995 - protein, 1223 aa, Heterodera glycines
  Coding regions on vcDNA: vcDNA=SeqID_66418; Strand=+; Position=1 -281,575-782,829-1389,1436-1697,1737-2055,2101-2656,2699-3199,3248 -3523,3569-3768,3813-4205,4253-4367
  Homolog annotation: Hit_ID=NP_001004509.1; Match level="QueryCoverage= 83%, HitCoverage=70%, E-value=1e-108, Identity=29%"; Hit description =si:busm1-180o5.3 [Danio rerio] emb|CAD60788.1| novel protein similar to DNA polymerases [Danio rerio]
MKRKVRMFGVAITGAGLAFPVWVPYRAYPQNNADVIMEEINELGQSGDGDENKKMLLLSEPITMKITCVTMPSGEGPRNVHKFDFGFKEHQRIGIVNTDKFCLFYALASSMNYLIMDKYSFIRFMKNLARQKEAAVELLRNCRIDGNEISYGVEQLPNVQKYWDEIYPGKYRVVAFEKSADPRKSICVLWKAPMGREKVVPIFLENGHWDGLKNYVCFFNRGRKFCIDCECFFDKDVKHTFECRARCYYCNRVRGMPCEKESGVKIECPKCHRYFYNWECYNYHQGHQTCKLWRRCVICDKTYRFNPKKGHECGETYCQLCSVSHDPKRGCYIIPIEEKEEKDVYRIVVWDSETSQDSIYKGDQKEHVINYISVRVTCTECCDDKNRTNCKICGEERIKDWSEAEGHEPTKDFVEWILTAFTNYDTYIFAHNAGRFDGHFVFNYLCRTGKNPLPLINGLKIYEFKVQNSKKHSKLIWRDSCLLMPVKLESLKATFNLDCEDKPFFPCYYNKKENYGIRLEHLPPMEDYSPGSMNKDKFIKFEKWYNENKETPFYLDEELRNYCRNDTEILLLSIIEFRRILINDITKGFDPLPRSCTNAGVAMNIFKAMFLLTEQLSIVPEKGYERCDRASVMAIKYLEWRSQRDRIEIRHAGNGREVKIGNYKLDGFIANNGARDKCIEVMGCYIHGCLNCYDPAAELIGGRTAQELNDETQERLVELRKTLDVEEVWGCQIEKELKKDEEMRGFFDDRGNEKGPIDPRMAYAGGRTGPMKLFAKSDEKKKISVYDIVSLYPSVNYGTAYPIGLPEIIIPKSDEINVNWTRPEDLKFNGLYKVRVHPPRGLRIPVLQLKCDERLLFPLCWRCASTFKKETTRCDYNCPHDEAQRRYVATYTSVELAKALECGYTVDRFYRAWHYEEEADDLFKGYVRLFLKLKEEASSFPKGVETDEQKNIWREEYKEKYGIDIELAKVKKNPGLRYISKLMLNSLWGKFSMRNCLNKNAVIDRASEFYKIACDHKIELCDIVEYSEEAIRLIYRDKEDFVMEHKSSNIVISLWTTSMARLKLLEFMREAESNGGEILYTDTDSIFVLHDRDVEPITTGKYLGEMSEEYGGYEIEEYCCGGAKQYALKMRSKQTGETEYVMKIRGITFDVDNRKTLHYDTFREMVLNYGKGEVDPAFFVYKNDFGPTRDSKVVTREKHKMYRPVCQKGIIDEELNVMPFGFC

SEQ ID NO: 139996 - protein, 231 aa, Heterodera glycines
  Coding regions on vcDNA: vcDNA=SeqID_66419; Strand=+; Position=1 -188,233-625,671-785
  Homolog annotation: Hit_ID=NP_507780.1; Match level="QueryCoverage =82%, HitCoverage=13%, E-value=3e-10, Identity=29%"; Hit description =predicted CDS, DNA polymerase type B, organellar and viral family member (5T899) [Caenorhabditis elegans]
MRNCLNKNAVIDRASEFYKIACDHKIEMCDIVEYSDDAIRLIYRDKEDFVLEHKSSNIIISLWTTSMARLKLLEFMREAESHGGEILYTDTDSIFVLHDREVEPITTGKFLGQMSEEYGGYEIEEYCCGGAKQYALKMKNKQTGETEYVMKIRGITFDVDNRKTLHYDTFREMVLNYGKGEVDPAFFVYKNDFGPTRDSKVVTREKHKMYKPVCQKGIIDEELNVMPFGFC

SEQ ID NO: 139997 - protein, 47 aa, Heterodera glycines
  Coding regions on vcDNA: vcDNA=SeqID_66420; Strand=-; Position=1-141
MDDGERTMSINIQKFVNGWCFFVIPMTSTLEDTPGFELIRNGTTSIK

SEQ ID NO: 139998 - protein, 27 aa, Heterodera glycines
  Coding regions on vcDNA: vcDNA=SeqID_66421; Strand=+; Position=1-83
NSALVLIWQKIKPFFLRTHGCSIHPTK

SEQ ID NO: 139999 - protein, 43 aa, Heterodera glycines
  Coding regions on vcDNA: vcDNA=SeqID_66422; Strand=-; Position=1-287
CFAVPRTGRQWIALNLQEIRLAISGCKQLLGNELFFEVCQTPY

SEQ ID NO: 140000 - protein, 90 aa, Heterodera glycines
  Coding regions on vcDNA: vcDNA=SeqID_66423; Strand=+; Position=1-305
GGRCAIYLLFLREFLNLYSIPEKCLSLFFEKFYTSQKRLRMRRRAVHNRHFISQRIFIFRGYPRKMAISFFDKFYTHTNALEHDREGGAQ

SEQ ID NO: 140001 - protein, 23 aa, Heterodera glycines
  Coding regions on vcDNA: vcDNA=SeqID_66424; Strand=+; Position=1-231
YIRMARNRNNNCGIASHASFPLV

SEQ ID NO: 140002 - protein, 221 aa, Heterodera glycines
  Coding regions on vcDNA: vcDNA=SeqID_66425; Strand=+; Position=1 -204,436-650,694-940
MHIERISCAAHDLNLCVKDCFSKEKDEMAQIFEKCRKIVGTLKHSAKLMDDLKDVQGELGLPKAKLLQELLKPTEEVSLHYCKEILSARIPLARTLVSTLERVDLSVTIDGEIKIINEVEQMRTRLIEAVKKRFLQKENSTFLDPRFKDRFSDESDIFFARVARFLKDEGTEENDILENLEDEVNSTRILPPAKRACSIVEIMQNIASCTKKGGTKIAILI

SEQ ID NO: 140003 - protein, 103 aa, Heterodera glycines
  Coding regions on vcDNA: vcDNA=SeqID_66426; Strand=+; Position=1 -24,70-216,519-659
MNGDCTGAAWRRPIPRCKTVKELNMDVVIEYSGRAAELKLIGEATSGSGKDITKATDECICALATALDESPMWEMNEDELKKFFDDWDAKSALLLPAALPGQN

SEQ ID NO: 140004 - protein, 221 aa, Heterodera glycines
  Coding regions on vcDNA: vcDNA=SeqID_66427; Strand=-; Position=1 -61,146-229,648-1085,1152-1234
  Homolog annotation: Hit_ID=ZP_00327932.1; Match level="QueryCoverage =84%, HitCoverage=37%, E-value=8e-36, Identity=57%"; Hit description =COG2340: Uncharacterized protein with SCP/PR1 domains [Trichodesmium erythraeum IMS101]
MLLMVVLFGFISMGHGTYQRKLPSAEERAEVKAFKIELHGTGTGAENPDFFPPPVRPPTASTLLPTAPAPTHVRPQTAPTPSPTATAPTPSPAAPTPSPTAPAPTPSPTAPAPTPSPTAPAPTPSPTAPAPTPSPTATAPTPSPAAPTPSPTAPAPTPSPTATAPTPSPTTPAPTPLPTAPAPTTTPETDPMKIALSILRKLGKEDGNKDGDYEKHQNLKL

SEQ ID NO: 140005 - protein, 27 aa, Heterodera glycines
  Coding regions on vcDNA: vcDNA=SeqID_66428; Strand=-; Position=1-83
NSALVLIWQKIKPFFLRTHGCSIHPTK

SEQ ID NO: 140006 - protein, 38 aa, Heterodera glycines; identical to SEQ ID NO: 130624
  Coding regions on vcDNA: vcDNA=SeqID_66429; Strand=+; Position=1-324

SEQ ID NO: 140007 - protein, 196 aa, Heterodera glycines
  Coding regions on vcDNA: vcDNA=SeqID_66430; Strand=+; Position=1 -67,226-300,411-479,577-679,802-824,882-905,958-996,1046-1167
  Homolog annotation: Hit_ID=NP_499689.1; Match level="QueryCoverage =90%, HitCoverage=30%, E-value=2e-66, Identity=67%"; Hit description =UNCoordinated locomotion UNC-25, glutamic acid decarboxylase, mutation leads to shrinker phenotype family
AWDPIPQIADICTRHKLWLHVDAAWGGGLLLSPEHRHKLAGIEKADSVTWNPHKLMGAPLQCSACFVRRELLFQTNQMSADYLFQQDKPYDVSYDTGDKAMQCGRHNDIFKLWLMWRSKLWLMWRSKGMEGYRRQINQLMGMEGYRRQINQLMDLAKDLAKYFTDKIKRTEGFEMVLDEVIIHRREKWRYCKKVVG

SEQ ID NO: 140008 - protein, 38 aa, Heterodera glycines
  Coding regions on vcDNA: vcDNA=SeqID_66431; Strand=-; Position=1-340
RFLNVWIFFWLTKTSSNLVLSILFQIAPNFFYSLTRPY

SEQ ID NO: 140009 - protein, 50 aa, Heterodera glycines
  Coding regions on vcDNA: vcDNA=SeqID_66432; Strand=-; Position=1-368
IFKCLDFFWLTKTSSNLVLSILFQIAPNFFYSLTSPIKLISRKSRMNSHF

SEQ ID NO: 140010 - protein, 44 aa, Heterodera glycines
  Coding regions on vcDNA: vcDNA=SeqID_66433; Strand=-; Position=1-396
IKFLKIFNSFLNRPKSLGLTFFSETDQKRTKLCRDTERKRNNLF

SEQ ID NO: 140011 - protein, 174 aa, Heterodera glycines
  Coding regions on vcDNA: vcDNA=SeqID_66434; Strand=+; Position=1-522
MRTKNLPSKLSNSEVLTSDASSSSVESPAGTIYESFDALSIDSSKAAASPEGSANVGAEIVIEGTESNENPAGSGYDEVRNEGSNVTFKAMEVALDQVDAEGFANNGFDDEEPEACPPAKDVSKSSLLYLVSQAGDGYVIACKKSPKSKPNWPFFMNIEDKLIESAPGFQRKLE

SEQ ID NO: 140012 - protein, 63 aa, Heterodera glycines
  Coding regions on vcDNA: vcDNA=SeqID_66435; Strand=+; Position=1-503
LTSKNNSLPKSFLQPLIANIISFRFKAIHCLPVSAQQSTNRVFDSLQKIIPYPKVFYNHILPI

SEQ ID NO: 140013 - protein, 59 aa, Heterodera glycines
  Coding regions on vcDNA: vcDNA=SeqID_66436; Strand=+; Position=1-177
MAPGGGTTSTQKGGKQGDGGGGSGGEAANGGGGIAITTGEGGGSGGEAANGGGGIAITT

SEQ ID NO: 140014 - protein, 181 aa, Heterodera glycines
  Coding regions on vcDNA: vcDNA=SeqID_66437; Strand=-; Position=1 -220,583-907
  Homolog annotation: Hit_ID=CAD22154.1; Match level="QueryCoverage =98%, HitCoverage=53%, E-value=1e-37, Identity=45%"; Hit description =pherophorin-dz1 protein [Volvox carteri f. nagariensis]
FPPIDCPVALAFNPPPPAFPPLPLLSHSLVTPIPAGPLLFSPPPLPPPVPVPAPPPPPPIMFQPLSPPQPLPPKVFCIAPAYCAPPLPPPLPPPPPPTVVMAMPPPPFAASPPLPPPSPVVMAMPPPPFAASPPLPPPPSPCLPPFCVEVVPPPGAMVAAAGPPLAPFPSPPPYPLHPIEG

SEQ ID NO: 140015 - protein, 292 aa, Heterodera glycines
  Coding regions on vcDNA: vcDNA=SeqID_66438; Strand=+; Position=1 -165,780-843,1067-1306,1685-1826,1938-2123,2184-2264
  Homolog annotation: Hit_ID=NP_505054.1; Match level="QueryCoverage =63%, HitCoverage=73%, E-value=1e-13, Identity=41%"; Hit description =putative protein of ancient origin (39.6 kD) (5I465) [Caenorhabditis elegans] gb|AAK85512.1| Hypothetical
MEIRWPGRSPSQWKHSHGHSPNCPQSFATTPDWTVPKSFRMCEPNTAKGIANLALGLSFVAGALRHFDLLRLFVPPENVAKDEPTIGVWHILPASLSAEKERSMDDAEMEQSLNEGPNALFIYLHGNSFDRTTSHRCELYNILSAMDFHVLAVDYRAARRGQKSPVQFALPLFALVQHDHCPPADSVGTENEFGRANPTVRSREVACPILVLHAEDDHIIPVNLGKKLVKSAREAHREVTYLEFESILEYKHKYIHRAPELPDVIREFLERGHLQKRSKNRIEQGNEGVKVE

SEQ ID NO: 140016 - protein, 161 aa, Heterodera glycines
  Coding regions on vcDNA: vcDNA=SeqID_66439; Strand=-; Position=1 -103,167-681
  Homolog annotation: Hit_ID=Q99LR1; Match level="QueryCoverage=91%, HitCoverage=38%, E-value=5e-33, Identity=42%"; Hit description =Protein C20orf22 homolog
MDDAEMEQSLNEGPNALFIYLHGNSFDRTTSHRCELYNILSAMDFHVLAVDYRGYGDSTGHPNEDGVNADAHAIYDYARLKAPSKDIYVWGHSMGTGVATRLVAELSDAGRAPKALVLESPFNNVWFPFSLPFRFLPWFNTTIVHPLIQSGLRMNSDERIQ

SEQ ID NO: 140017 - protein, 160 aa, Heterodera glycines
  Coding regions on vcDNA: vcDNA=SeqID_66440; Strand=+; Position=1 -103,159-538
  Homolog annotation: Hit_ID=CAE73908.1; Match level="QueryCoverage =100%, HitCoverage=33%, E-value=5e-60, Identity=70%"; Hit description= Hypothetical protein CBG21516 [Caenorhabditis briggsae]
MVRAICIHNHPIPNTNDAPSCQIIIPQKQVGRSFDIYVSCVSNSNQVTPKPWFIATVSTTVETENPEAEIQPALQLLGPIFEKLYQEELKMRRFFRFVTISDLYEPVDMGYESQIFISRSFDATTHFETTCLDVLDIFKRGTTEEFDFSKITHLSLEDNE

SEQ ID NO: 140018 - protein, 18 aa, Heterodera glycines
  Coding regions on vcDNA: vcDNA=SeqID_66441; Strand=+; Position=1-67
FLCSLHGFNTQIFVEFIS

SEQ ID NO: 140019 - protein, 135 aa, Heterodera glycines
  misc_feature (21)..(21): Xaa can be any naturally occurring amino acid
  Coding regions on vcDNA: vcDNA=SeqID_66442; Strand=+; Position=1 -80,328-629,725-753
  Homolog annotation: Hit_ID=XP_528497.1; Match level="QueryCoverage =99%, HitCoverage=11%, E-value=2e-48, Identity=69%"; Hit description =PREDICTED: similar to Paired box protein Pax-5 (B-cell specific transcription factor) (BSAP) [Pan troglod
CAAAMPMPKMPCRRLPFRSFXPVPIPGHTGINQLGGVFVNGRPLPNYVRNQIVEMNSRGVRPCDISRQLRVSHGCVSKILGRFYQTGSVKPGVIGGSKPKVATREVTEAIARYKAVNPTMFAWEIRDKLVEEGIC

SEQ ID NO: 140020 - protein, 253 aa, Heterodera glycines
  Coding regions on vcDNA: vcDNA=SeqID_66443; Strand=-; Position=1 -216,420-651,698-804,857-1063
QSFNEFRLLAMAMFCYGLALKWACHKSVKGSDGADSALLSLCAAELTTLLRTNLHADSQLEAEMHECDRNMVLLSFLRCYSSSVPSKDCAQFGTSVTSFLQIDTTDPIALSELRFDVLPLLLANAWPLRRNIHFLRRLAFILAYSSNLNYHLVLDPLLMGLSKCSTRENVFLCCSPENVAITDVKIFLVRLSSYMKLCKLYDEGVFVFPWIFHCAPNVQQQQFWSYINSLLDGKQESERSQFYSSKYKSRDRR

SEQ ID NO: 140021 - protein, 34 aa, Heterodera glycines
  Coding regions on vcDNA: vcDNA=SeqID_66444; Strand=-; Position=1 -25,106-185
MNLFISLTGLLQEYLLPEFCTCCPTIRRHLFPFI

SEQ ID NO: 140022 - protein, 66 aa, Heterodera glycines
  Coding regions on vcDNA: vcDNA=SeqID_66445; Strand=-; Position=1 -126,853-927
MPLDALLKNALPFLASSLNDSSGGGGGSATDYPAKAPDQILSFSTMFYCEKVLQIRPKFAWQFATV

SEQ ID NO: 140023 - protein, 63 aa, Heterodera glycines
  Coding regions on vcDNA: vcDNA=SeqID_66446; Strand=+; Position=1-285
LANFVTSSTQISKIFSRRRLSAPPDLHFPLFLQVFCLKTAKIWSFLVKKCSCYPAVEKKLLVK

SEQ ID NO: 140024 - protein, 127 aa, Heterodera glycines
  Coding regions on vcDNA: vcDNA=SeqID_66447; Strand=-; Position=1 -219,624-788
  Homolog annotation: Hit_ID=AAF31449.1; Match level="QueryCoverage =100%, HitCoverage=39%, E-value=6e-40, Identity=64%"; Hit description= 60S acidic ribosomal protein P0 [Sarcophaga crassipalpis]
VFDNGAVYSPDVLDVTTADLLARFQQGVLNVAALSLGIGYPTKASAPHLIANAFKNLLAVAAETDVTFKEAEKVKEYLADPSKFVSAVAAAAPAAGGAPDAKEEAAPAKKEEEKEESDDDMGFGLFD

SEQ ID NO: 140025 - protein, 51 aa, Heterodera glycines
  Coding regions on vcDNA: vcDNA=SeqID_66448; Strand=-; Position=1-155
GIFWQIFVGCNHPPKTQLTRPVLPWLARYFVGAGDRELHFLDEPQRGLNRP

SEQ ID NO: 140026 - protein, 86 aa, Heterodera glycines
  Coding regions on vcDNA: vcDNA=SeqID_66449; Strand=-; Position=1-556
KNRFIFVFGAVPPNRCAQIYGETESFGNSFPIACTLILRWIFAAHNCLSTPNGHLKKSIFLFSGQSPRTDAPRFMGRPNPSGIASL

SEQ ID NO: 140027 - protein, 75 aa, Heterodera glycines
  Coding regions on vcDNA: vcDNA=SeqID_66450; Strand=+; Position=1 -193,607-641
MGQNRRIDGLGGQIGLGGRAVGSSEAEDADAGRSAGERFVEGKQRAMDKVRGQFGRRGEAVQGKSTRPIVSLGVL

SEQ ID NO: 140028 - protein, 39 aa, Heterodera glycines
  Coding regions on vcDNA: vcDNA=SeqID_66451; Strand=-; Position=1 -62,816-873
MANNHFWTYPYPYWARHRGYLDYAAIPYTYWSRAYCTEL

SEQ ID NO: 140029 - protein, 37 aa, Heterodera glycines
  Coding regions on vcDNA: vcDNA=SeqID_66452; Strand=-; Position=1-206
ILINIEIKTYKKIYSLLFRLSSSRAFGRYQIIRIRSF

SEQ ID NO: 140030 - protein, 75 aa, Heterodera glycines
  Coding regions on vcDNA: vcDNA=SeqID_66453; Strand=-; Position=1 -39,92-278
RFGKETSPRGVTTLSFCSWDIRLGICPSGAYNGRTFAHGLSCRAPSAYGHSTLALRESPQAKGKNLDALGTFCDK

SEQ ID NO: 140031 - protein, 48 aa, Heterodera glycines
  Coding regions on vcDNA: vcDNA=SeqID_66454; Strand=+; Position=1-157
DCTYLIAEKIQDQFPNVDRLIAKRNPSLSKRLTESKNLEMYLICNFNQ

SEQ ID NO: 140032 - protein, 88 aa, Heterodera glycines
  Coding regions on vcDNA: vcDNA=SeqID_66455; Strand=+; Position=1 -96,135-305
MPKQKEIVLKYSFLDLTWFLDIEAVFYAISKTKKCLVVKTIFHISLHNFVSSARIETGIRPLERAARALQEGMERKNSYFWDFFRNQN

SEQ ID NO: 140033 - protein, 96 aa, Heterodera glycines
  Coding regions on vcDNA: vcDNA=SeqID_66456; Strand=+; Position=1 -96,135-252,293-369
MPKQNEIVLKYSFLDLTWFLDIEAVFYAISKTKKCLVVKTIFHISLHNFVSSARIETGIRPLERAARALQEEIRINSPMWANILGPQPQALCFSQF

SEQ ID NO: 140034 - protein, 93 aa, Heterodera glycines
  Coding regions on vcDNA: vcDNA=SeqID_66457; Strand=+; Position=1 -193,289-377
MNIEIFIVGVHEPVFQNSNRANLELALPSNIDFKHILKLINHTYQCAVFLRLSKVLIAFLLLLSSIEYNHKQFQLLPMKLCKKNDVDFYARVY

SEQ ID NO: 140035 - protein, 15 aa, Heterodera glycines
  Coding regions on vcDNA: vcDNA=SeqID_66458; Strand=-; Position=1-46
MKFSASLVGYTGRNN

SEQ ID NO: 140036 - protein, 48 aa, Heterodera glycines
  Coding regions on vcDNA: vcDNA=SeqID_66459; Strand=-; Position=1 -46,200-300
MKFSASLVGYTGRNNKILSVISSFGILMSKSVTVNEILCFSCWIHGKK

SEQ ID NO: 140037 - protein, 98 aa, Heterodera glycines
  Coding regions on vcDNA: vcDNA=SeqID_66460; Strand=+; Position=1 -52,404-646
MHPSSSSSPKITSIGQQEPKTPKHEAKNAATTVDGCDGGTTATTPKSTANSQQQQSAEKENNRSSSRTRSSRERKKQNSSGEEEGDREDEKGKDREKN

SEQ ID NO: 140038 - protein, 348 aa, Heterodera glycines
  Coding regions on vcDNA: vcDNA=SeqID_66461; Strand=-; Position=1-1047
  Homolog annotation: Hit_ID=EAL49477.1; Match level="QueryCoverage =78%, HitCoverage=57%, E-value=6e-31, Identity=34%"; Hit description =hypothetical protein 42.t00003 [Entamoeba histolytica HM-1:IMSS]
MIAEVERLLTRKRSAPVHESFGNIDDDDEEEGEILDVSFVEEEEDNTGEAPLNPLSYLTKQSAAQQETLRHEKWAQEERKRREEEQRKQRENERRRREEEERRRKTEEDRRKTAEKAAKEKKAKEEKEASEKKAREEKLAREKKEEQRIAKEKKGDKETKDKKAEEERVAKERKAEDERVAKERKAEEERVAKAEAERVAMVTKAEEERAAKAEAERVAMVTNAEEERAAKAEAVRAENETKKKQAEEKQLEELKRQQQAIRKQKELELLKEFRPWRGGYMRLVHGKDPTPDVHYLHETDDYHFVNAVHKYRVWHSELPWEAPEFNPSAHIQQNIGEFRELFEQGGVR

SEQ ID NO: 140039 - protein, 95 aa, Heterodera glycines
  Coding regions on vcDNA: vcDNA=SeqID_66462; Strand=-; Position=1 -193,238-332
MDESKRENFSPQNDDDVITIGDNNTQTLLDLQPGPSKSGRKPRLDKIHEEIASAMKKVKAMEAEVDESPKKQPTNVFEYPTIFWKLARPKVLANI

SEQ ID NO: 140040 - protein, 130 aa, Heterodera glycines
  Coding regions on vcDNA: vcDNA=SeqID_66463; Strand=+; Position=1 -277,432-547
MVLPLTAALSKLLNCKPENLAEYLNNPEAVNKANAYLAGKKLKTTYQGRDSKTKEVKFGTFSVKAAAETYAFEGFLGKFPKIQFRSNTHAFRELLAVEEGSESEPVERPAAETDYLDYLNFRSGWQSTLY

SEQ ID NO: 140041 - protein, 66 aa, Heterodera glycines
  Coding regions on vcDNA: vcDNA=SeqID_66464; Strand=-; Position=1-199
MDESKRENFSPQNDDDVITIGDNNNNTQTLLDLQPGPSKRGRKPRLDKIHEEIASAMKKAKAMEAE

SEQ ID NO: 140042 - protein, 130 aa, Heterodera glycines
  Coding regions on vcDNA: vcDNA=SeqID_66465; Strand=+; Position=1 -277,431-546
MVLPLTAALSKLLNCKPENLAEYLNNPEAVNKANAYLAGKKLKTTYQGRDSKTKEVKFGTFSVKAAAETYAFEGFLGKFPKILFRSNTYAFRELLAVEEGGESQPVERPAAETDYLDYLNFRSGWQSTLY

SEQ ID NO: 140043 - protein, 87 aa, Heterodera glycines; identical to SEQ ID NO: 129152
  Coding regions on vcDNA: vcDNA=SeqID_66466; Strand=-; Position=1-840

SEQ ID NO: 140044 - protein, 104 aa, Heterodera glycines
  Coding regions on vcDNA: vcDNA=SeqID_66467; Strand=-; Position=1 -17,66-130,191-267,316-392,566-642
MWLEFIAKLAQKENPEKLGSSLLFRKCEPNSPRKKIQKNQGRRYYSENVVGIHSQTRPERKSRKIRVVATIPKMWLEFIAKLAQKENPEKLGSSLLFRKCGWNS

SEQ ID NO: 140045 - protein, 110 aa, Heterodera glycines
  Coding regions on vcDNA: vcDNA=SeqID_66468; Strand=-; Position=1 -67,122-259,352-479
MMTASNVFESMFRFDDKKPETETPSAKTDSSVEIPDISANAFKVMLSFIYAEDLSGLNGENAMAVLYAANKYNVSSLVKACLEFPINELPNVFFAYFQALLLNENVKFGF

SEQ ID NO: 140046 - protein, 228 aa, Heterodera glycines
  Coding regions on vcDNA: vcDNA=SeqID_66469; Strand=-; Position=1-684
  Homolog annotation: Hit_ID=XP_320889.1; Match level="QueryCoverage =94%, HitCoverage=25%, E-value=4e-22, Identity=32%"; Hit description =ENSANGP00000012033 [Anopheles gambiae] ref|XP_313651.1| ENSANGP00000013044 [Anopheles gambiae] ref|XP_314
MCAAHHEWLTKQKGPKLGKKMNALRIGGLMVNILNGSTRLMEVTIWVNDNPIKFVLDSGADLTVLDEVAHMAIGKPRLTHCNEQAVYHDGTSCKLLGKGTARFSFGGKTINGQYYVTKKGSLNLLGIDMLDAFGLLDAFRREVEKAMNVNLVKKEAKKSPILQQETTLAALQTKFPLVFVEGLGHCTKAKAHLELRPEAVPVYCRPRPVPYNTRLVVEEELDRLLEQK

SEQ ID NO: 140047 - protein, 114 aa, Heterodera glycines
  Coding regions on vcDNA: vcDNA=SeqID_66470; Strand=-; Position=1-342
MFGLTEFASNSSAFDGGEIRCVLKRLYSDFIVIEIPSDGHVLRPNSAAAPAAQNGAAGTECEKCQEDATTTTTVPPSDDGKGEKPTRLTDQQFDQMQRVAAGTDEEGKMDIDLK

SEQ ID NO: 140048 - protein, 130 aa, Heterodera glycines
  Coding regions on vcDNA: vcDNA=SeqID_66471; Strand=+; Position=1-392
MKEEVKKITENLDTLQSRVQILEFEMDGEIQRTEWIDDGHSVEHDQLPLHSANGKEPNGGEGQNEMHVDDCEIMIMDPFLGGITPLEGYDGNPGISFSRWVARFEDMLALSQYTETQKLSRLRILLKGQA

SEQ ID NO: 140049 - protein, 263 aa, Heterodera glycines
  Coding regions on vcDNA: vcDNA=SeqID_66472; Strand=-; Position=1 -75,134-427,480-902
  Homolog annotation: Hit_ID=Q94637; Match level="QueryCoverage=100%, HitCoverage=15%, E-value=3e-37, Identity=31%"; Hit description =Vitellogenin 6 precursor gb|AAB49749.1| vitellogenin pir||T18561 vitellogenin vit-6 [similarity] - Oscheius s
MFVNGLAECGTKNCVAELAKRIKSKQVSQANAVKALLALTQLPAPSDNILEEMEQLCSSEPVESQPTTKQSCWLTFGALVNEVCQHKTEKNAEECAGETANCAQSGFSKKGQCPMDKKQKYKEAMLAVYQNSGCIYDKIVALSALGNAGMDNSLKELENIIKDPREPRVVRVMAIHATRRLQVTEPWEVQSVLLPVFLNTREQPHVRIAAFANLMNENGQPEPHVVDQLMYTIANEPNKEVQAYAYRMMKAMAKSQKPNEKQM

SEQ ID NO: 140050 - protein, 211 aa, Heterodera glycines
  Coding regions on vcDNA: vcDNA=SeqID_66473; Strand=-; Position=1 -409,754-980
MRTFALLALVAAILCLSAGRRTFPNTSPRVGFLNFGTRNSPNSAIKPFQQKNTEYTFIYNAQIASGLQSEENAANPQQKAVTRIQCLAKIQFASERHGQLQLEECQAGQQNEQMSEAQEVQPMELFEQVIGQVCGVGGSKLINRKTKHNECPDQITLEGACQTTYTINRAWSGQQFNVTKTINFKKCQKIADVANGFQTDPPQAQCAQCQQ

SEQ ID NO: 140051 - protein, 76 aa, Heterodera glycines
  Coding regions on vcDNA: vcDNA=SeqID_66474; Strand=+; Position=1-231
MGTGKLDTGKLDTVGILDTKGKLDTVGILDTKGKLDTVGILDTKGKLDTVGILDTKGKLDTVGILDTGKLDTKFLF

SEQ ID NO: 140052 - protein, 28 aa, Heterodera glycines
  Coding regions on vcDNA: vcDNA=SeqID_66475; Strand=+; Position=1-84
MPPRPPPPPPPPPPPPPCPSPLMLLVLE

SEQ ID NO: 140053 - protein, 255 aa, Heterodera glycines
  misc_feature (151)..(151): Xaa can be any naturally occurring amino acid
  Coding regions on vcDNA: vcDNA=SeqID_66476; Strand=-; Position=1 -52,108-141,192-346,434-586,1003-1058,1120-1181,1223-1329
  Homolog annotation: Hit_ID=T20855; Match level="QueryCoverage=100%, HitCoverage=59%, E-value=1e-59, Identity=51%"; Hit description =hypothetical protein F13G3.5 - Caenorhabditis elegans sp|Q19420|MYOP_ CAEEL Probable inositol-1(or 4)-monophos
VAAGILYELTDAPTWIIDPIDGTTNPIDGTTNFVHRIPFIGICVGLAINKSLCAGIPFIGICVGLAINKSLCAGIVFNPITDELYTAIEGKGALKNGFPISVSSAKALDQSVICQTFGQHNIKEKGEKWLDNAFGNLRSAVLSGTPLVHFXVINFMFLAQGSLDAYVEYGIHSWDMAAAVVIVKDMAAAVVIVKEAGGTVTDPTGAEFDLMSRKVLCASTAEFDLMSRKVLCASTSQLAQQISKVLTHVDFEKEA

SEQ ID NO: 140054 - protein, 98 aa, Heterodera glycines
  Coding regions on vcDNA: vcDNA=SeqID_66477; Strand=+; Position=1 -7,126-219,517-712
MEPNQNLYAKFVLFPHLAIVYYETKIIKNNRNISTISIGIWTKSDDTFYKYSNNGFIFGHSATGLRGYPSFAEGDTIGCGANLTSMEIIYTTNGQKFE

SEQ ID NO: 140055 - protein, 80 aa, Heterodera glycines
  Coding regions on vcDNA: vcDNA=SeqID_66478; Strand=+; Position=1-243
QQKQIETNEQIENEAQKTVEKTHQCPEKRTKGKNGRTAKQSAEKMGQKKGAPGQSDSENNPTKELPYSLYFNSALDFCSP

SEQ ID NO: 140056 - protein, 123 aa, Heterodera glycines
  Coding regions on vcDNA: vcDNA=SeqID_66479; Strand=+; Position=1-372
  Homolog annotation: Hit_ID=AAC98928.1; Match level="QueryCoverage =93%, HitCoverage=21%, E-value=1e-15, Identity=42%"; Hit description =ankyrin homolog [Litomosoides sigmodontis]
MIFKIFSKRIFALFKVRQQDDQEAGAAGRVAVMKEPRSRADTLPPQHPICTLSLTLPDYIGPLPCISAQADMQRGDKQQPPDGGAPRVPSVSERYAEALHANLAEAYPNVPLELVAKRIGGDW

SEQ ID NO: 140057 - protein, 61 aa, Heterodera glycines
  Coding regions on vcDNA: vcDNA=SeqID_66480; Strand=+; Position=1 -87,414-512
GHDDAFSVITLDRVVEQFFRWRLMLPRVKIVKNGLCSGDNIVYANPCKTRSYIRHAEQMGE

SEQ ID NO: 140058 - protein, 25 aa, Heterodera glycines
  Coding regions on vcDNA: vcDNA=SeqID_66481; Strand=+; Position=1 -40,139-176
MPTAHFMRYVLITGATDGIGKQASK

SEQ ID NO: 140059 - protein, 76 aa, Heterodera glycines
  Coding regions on vcDNA: vcDNA=SeqID_66482; Strand=+; Position=1 -91,173-312
MNVMKTGEEHDITNFKLGKTQKVCICLWSEVPLCHDTRPFPTLFLKSAEAPIDKWTQRDQLEISCTTCEFWGSNIQ

SEQ ID NO: 140060 - protein, 952 aa, Heterodera glycines
  Coding regions on vcDNA: vcDNA=SeqID_66483; Strand=-; Position=1 -478,991-3371
  Homolog annotation: Hit_ID=NP_510671.1; Match level="QueryCoverage =81%, HitCoverage=79%, E-value=1e-97, Identity=30%"; Hit description =predicted CDS, endonuclease/exonuclease/phosphatase family and RNA -directed DNA polymerase (XR69) [Caenor
MLHETSTQDTRAVLEEDRREHSVVLMGVPESDSGLSSTRRAIADQQQVLDILDVCEIEAMPTKVYRMGQRKEGRPRLLKVEMPTRKMTQSFLRNKNRLKNSKFQAVSVRPSLSPEQLKERHNLINCCKTARDQFPNHNFIVYAGHVIPRNDVSVFRDDPENCCILGDFNLGTKDLTIKNKKPFPLSNFGNLFCDFFNKYNLTSCINEPTREQSFLDLILSTKTDLINAVEVKGGLLDTDHLTILFDFCVLKQNATKKQIILRNFTKSNTFLFDAYLSSFLPQLLQKFYTVEDKYAIFFSSVRRNLEINIPETILSIKSAKNFYPPHLLASIREKARLYKLMKENRGKYEPLYKSISLHIKTQIRNIQSRKENKILSGDKNRLFSYLRKYFKPVEDPPVIQYNTLFVSDSTSKAEIFAKIFSENFTVNNYSLDFDTSFSSPTINDVEFNIISVGKVLKTLPNRNNTSPDGITFRLLKNCSLSFTPFVTEIFRLSLDTGKLPTIWKQSIIIPLHKQGEKSNPMNYRPIALTCSLCKIMEKFIVWAISDFLLKNNLFSEHQFGFIKGRSTTTQLISTLENWYDGIYNNKNIDCVYIDFRKAFDVIPHNLLLYKVHRIGIRGKILNWISDFLSNRTFRVRVDNTLSSEYKMSSGVPQGSVLGPLLFLIYINDLPELIPKQISIKLYADDVKLYSVHKTKNDRIAMHHALNILSDWSKKWYIKISINKTFIIYFGKNNPREQYKINDNAICEVETIRDLGILIDNKFTFSEHISKITRNAYYRMRLLFRVIKSKKISVWKNIYVSYIRPLLEYSPESWNPQLKSHIIKIEKCQKYFTRIAFRKCCLPYIPYDQQLQFFKLATLEKRRKIFDLLTTYKILHGFTHLDPNSLFKRTNLNTRNKSFFRLNVKLQSKKSSKSFVNRSVKAWNALDKTLMSSSLNTFKKLLELTLDSESANV

SEQ ID NO: 140061 - protein, 72 aa, Heterodera glycines
  Coding regions on vcDNA: vcDNA=SeqID_66484; Strand=+; Position=1 -95,136-259
MSRGQMDKNKGAQSNNKVISSRDSDQMEEKGKKGKVIKWKKRESDQMEEKGKGSNGRKGKVIKWKKKTRKGK

SEQ ID NO: 140062 - protein, 122 aa, Heterodera glycines
  Coding regions on vcDNA: vcDNA=SeqID_66485; Strand=-; Position=1 -44,195-315,459-662
MERENLDSSGSDFRGKPIGKSTKLLQYPKDRKSLRLIPEGMGISNFVCAKSTVSKKSAWPKIMQDCAEDALGNAPIEESAANYQAASVRVKKAIDLRGPAKYVPSFRQFLKNCCVVYQQQQI

SEQ ID NO: 140063 - protein, 16 aa, Heterodera glycines
  Coding regions on vcDNA: vcDNA=SeqID_66486; Strand=-; Position=1-49
EAIPEGFGLPINLGAS

SEQ ID NO: 140064 - protein, 60 aa, Heterodera glycines
  Coding regions on vcDNA: vcDNA=SeqID_66487; Strand=-; Position=1 -123,287-346
MFAPKFLLALLVCVAFAIGTKHGKTARKMAKNNVAKDELEQHKIYTNPWKGVNKKLIPIS

SEQ ID NO: 140065 - protein, 88 aa, Heterodera glycines
  Coding regions on vcDNA: vcDNA=SeqID_66488; Strand=-; Position=1-267
MLFWASLAITKPQKAPVAPAIQTPQTNVPTLAKENGPEPKEASEDTSKSSQVDKTITENENPNPLSNIDKFLLQLESFRKQFPQCFDK

SEQ ID NO: 140066 - protein, 56 aa, Heterodera glycines
  Coding regions on vcDNA: vcDNA=SeqID_66489; Strand=-; Position=1 -110,170-230
MSKAMKCLLMKSERTFSQLSQIYSAKRTSLSADHSKNGNSIIILTIKFVKYFNFLD

SEQ ID NO: 140067 - protein, 108 aa, Heterodera glycines
  Coding regions on vcDNA: vcDNA=SeqID_66490; Strand=+; Position=1-327
MFSEFEVNYLRNLANQIAQNAYVAKPLTVQTNIHNLTITLAIFRKIIAELETNPNVFILDSLKSDKEIATNFLHLCVSLLDAKFEHFQNQVLARLNEFDRIRKGILDG

SEQ ID NO: 140068 - protein, 340 aa, Heterodera glycines
  misc_feature (335)..(335): Xaa can be any naturally occurring amino acid
  Coding regions on vcDNA: vcDNA=SeqID_66491; Strand=-; Position=1 -98,170-259,311-337,378-428,490-544,596-699,843-941,1102-1235,1316 -1484
  Homolog annotation: Hit_ID=CAE62349.1; Match level="QueryCoverage =92%, HitCoverage=90%, E-value=9e-98, Identity=63%"; Hit description =Hypothetical protein CBG06425 [Caenorhabditis briggsae]
MDEEKRKQRQKRKKKFLGTLSYKLEYDFDKSNLTVLTVGIVSAESLPAMDLGGTSDPYVKLFLLPDKKKKFQTRDKKKKFQTRVQRKSLNPVFNESFVQRKSLNPVFNESFQFKVPFNEINSQTLVLNVFVPFNEINSQTLVLNVFDFDRFGKHDQIGQISIPLGKIDLDFDRFGKHDQIGQISIPLGKIDLATTIEKTAPIEAPPENRLGDVCLALRYVPNKNKLTVVVMECKNLKKMPYVKIYLMAQNKRLEKKKTTIKMKTLNPYYNESFSFEVSPEKMQRRVHLHVIVSDYDRVGSNERIGHVRKGGKATMVETSEFTRDRDLTLEKSNLXLFLSE

SEQ ID NO: 140069 - protein, 119 aa, Heterodera glycines
  Coding regions on vcDNA: vcDNA=SeqID_66492; Strand=+; Position=1 -321,624-662
MFLSNLLAFYSSVFPFLRMFYMFNILPDDFWRDALLCREFGGHVRQNHEPRGDVRVPGGHRHQRRGKGPDLAADLCPRDTARQKWAGRLPGPSVLRRHRLGEHPKRSRLVEAPLLFLTP

SEQ ID NO: 140070 - protein, 89 aa, Heterodera glycines
  Coding regions on vcDNA: vcDNA=SeqID_66493; Strand=+; Position=1 -106,216-337,581-622
MVVTSALDDLQRKARLLENEIDAQLISLNKFNPSDALSSYSYNSNQTKGQGKRAVFDSLTTDIENKLSKLSEINDARRINGHRIGVIGE

SEQ ID NO: 140071 - protein, 15 aa, Heterodera glycines
  Coding regions on vcDNA: vcDNA=SeqID_66494; Strand=+; Position=1-47
MRIHARFSGNKLNMA

SEQ ID NO: 140072 - protein, 36 aa, Heterodera glycines
  Coding regions on vcDNA: vcDNA=SeqID_66495; Strand=+; Position=1 -53,212-269
MTFIFSHNVFYVTFYAKNFDFLFEFAFKVLIGSKWM

SEQ ID NO: 140073 - protein, 36 aa, Heterodera glycines
  Coding regions on vcDNA: vcDNA=SeqID_66496; Strand=+; Position=1-222
KCMREKNEHTFPISISLLTFVVKCHQLILIKIIWWY

SEQ ID NO: 140074 - protein, 265 aa, Heterodera glycines
  Coding regions on vcDNA: vcDNA=SeqID_66497; Strand=+; Position=1 -112,161-262,467-557,598-704,745-771,833-973,1056-1157
  Homolog annotation: Hit_ID=CAE70581.1; Match level="QueryCoverage =92%, HitCoverage=18%, E-value=1e-92, Identity=71%"; Hit description =Hypothetical protein CBG17239 [Caenorhabditis briggsae]
FLSRDKRHLNKNLFKDPSGIFDLIEVVGNGTYGQVYKGRHLKTQALAAIKGRHLKTQALAAIKIMNINEDEEEEIKAEINMLKKYSHHPNIATYYGAFIKKLPSSTGKHDQLWLVMEFCGSGMEFCGSGSVTDLIKSFKGGYLKEEWIAYICKEILSGLSHLHKNNGLSHLHKNNVIHRDIKGQVIHRDIKGQNVLLTDTAEVKLVDFGVSAQLDRTVGKRNTFIGTPYWMAPEVIACDENPESTYDSRSDLRVETSHLQLAIFH

SEQ ID NO: 140075 - protein, 133 aa, Heterodera glycines
  Coding regions on vcDNA: vcDNA=SeqID_66498; Strand=+; Position=1 -244,287-427,615-631
MATLCAKEPNWLDETHQCRRRLSILVSDGEMKASEMTECRAKKAGSTNAEDLADNEEKPTHTELIPLYSSEQQNNSGKMDSGIFEWTGSDGENGGATTADREENNEKEDTDSNCENHADDSTTRSRKRFAAIT

SEQ ID NO: 140076 - protein, 58 aa, Heterodera glycines
  Coding regions on vcDNA: vcDNA=SeqID_66499; Strand=-; Position=1 -139,320-357
MPKAAKSNAVLNRHWISKFPEGTYSTDGKINPGLYKLIDIAKILIGGFLAHKNPSPIY

SEQ ID NO: 140077 - protein, 40 aa, Heterodera glycines
  Coding regions on vcDNA: vcDNA=SeqID_66500; Strand=-; Position=1 -12,1136-1246
MLMKDANGKQKEIHKDEENLPLILLYCLANGKRLDLYVCN

SEQ ID NO: 140078 - protein, 875 aa, Heterodera glycines
  misc_feature (154)..(154): Xaa can be any naturally occurring amino acid
  misc_feature (777)..(777): Xaa can be any naturally occurring amino acid
  Coding regions on vcDNA: vcDNA=SeqID_66501; Strand=-; Position=1 -82,349-420,481-507,570-669,724-837,950-1112,1174-1334,1401-1645,1822- 1881,1934-2047,2111-2404,2462-2543,2591-2647,2710-2822,2881-2967,3056- 3201,3623-3931,3993-4043
  Homolog annotation: Hit_ID=CAE69829.1; Match level="QueryCoverage =97%, HitCoverage=85%, E-value=0.0, Identity=61%"; Hit description =Hypothetical protein CBG16150 [Caenorhabditis briggsae]
NQFCSHCKDFIWGLNKQGFQCQVCTLVVHKRCHEFVSFACPGADKGVDSDDPRQQHDPRQQHRWEATTYSSPTFCDHCGSLLATTYSSPTFCDHCGSLLYGLIHQGMKCQCCYTSVHHRCVHHRCVKYVPNMCGMDHTEKRGRIDLGTFIQVKXYRGKEIQARNLIPMDPNGLSDPYVKLKLIPFEDEQGKAKQKTRTIKATLNPIWDEHFQFKLEPSDKDRRLSVEVKLEPSDKDRRLSVEVWDWDRTSRNDFMGSLSFGISELIKEPMNGWFKLLNDEEGEYYNIPIPPEDEKDIERLQKKMADLHGQRKGALGEEGRAKSVTKQRQSATALENRVQRHKEVVKAADFNFITVLGKGSFGKVLLGEHKHLKELFAIKILKKDVIIQDDDVECTMVEKRVLALPKDVIIQDDDVECTMVEKRVLALPDKPPFLLALHSCFQTMDRLDRLYFVMEFVNGGDLMYQIQQVGKFKEPVAVFYSAEIACGLFYLHSKGIIYRDLKLDNVMLERDGHIKITDFGMCKEGIQGDTTTKTFCGTPDYIAPEIILYQPIILYQPYGKSVDWWAYGVLLFEMLAGQPPFDGEDEDELFTAITEHNVQPPFDGEDEDELFTAITEHNVSYPSYPKSMSKESVLICKGFLSKAPSKRLGCSADGERQVKPSKEHCPSKEHCFFRRIDWHKIETRQVQPPFKPKISNKFATENSNKFATENFDPLFLRLPLKLTPPEWDILEGMKGDEFILFDHFNSQYFADISLHCTFKVKFIRHNSKMSFAVLIAXASFFVICAFLVLIFGIGVVFSSLCSMFAFLFCVFQRSADDTSNFDSEFTGEAPKLTPVDRLFLMNLDQNEFEGFTFVNAEFNEFEGFTFVNAEFTPQG

SEQ ID NO: 140079 - protein, 149 aa, Heterodera glycines
  Coding regions on vcDNA: vcDNA=SeqID_66502; Strand=+; Position=1 -257,303-384,439-507,559-600
  Homolog annotation: Hit_ID=NP_491672.1; Match level="QueryCoverage =99%, HitCoverage=30%, E-value=1e-50, Identity=68%"; Hit description =proteasome Regulatory Particle, ATPase-like, S6a (48.1 kD) (rpt-5) [Caenorhabditis elegans] gb|AAC19196.1
MLELLNQLDGFQPNDDIKVEWWSKPINSHSFCFHLTQVIAATNRVDVLDPALLRSGRFDRKIEFPAPNEKGREQILRIHSRRMNVDKNVNFVELSRCIEDFNGAQCRAVCVEAGMVALRRDSTKILHEDFMDGILEVQGLKKNNLVYYG

SEQ ID NO: 140080 - protein, 124 aa, Heterodera glycines
  Coding regions on vcDNA: vcDNA=SeqID_66503; Strand=-; Position=1 -165,439-648
MQYNAFKPRREAGQFQNFVPHFTVESPSTLLDNYVSMSTVAFGQLWNGKMGISDGLLIILYNAFKPRREAGQFQNFVPHFTVESPSTLLDNYVSMSTVAFGQLWNGKMGISDGVRSFLKIPLFV

SEQ ID NO: 140081 - protein, 76 aa, Heterodera glycines; identical to SEQ ID NO: 128275
  Coding regions on vcDNA: vcDNA=SeqID_66504; Strand=+; Position=1 -81,223-529

SEQ ID NO: 140082 - protein, 16 aa, Heterodera glycines
  Coding regions on vcDNA: vcDNA=SeqID_66505; Strand=-; Position=1-51
SPLFIRRITGEIDGIM

SEQ ID NO: 140083 - protein, 221 aa, Heterodera glycines
  Coding regions on vcDNA: vcDNA=SeqID_66506; Strand=+; Position=1 -179,242-425,595-780,835-950
  Homolog annotation: Hit_ID=NP_492821.1; Match level="QueryCoverage =99%, HitCoverage=20%, E-value=8e-44, Identity=44%"; Hit description =of Ty 16 (116.9 kD) (1L369) [Caenorhabditis elegans] gb|AAF39835.1| Hypothetical protein F55A3.3 [Caenorh
MMVMPTPLMEELYELLLTTETTVIEALKPGTSMSAAYEAGIRHFRSKKPDFLQYLVKNFGFVTGIEFRESQFLINDRCAHKVHPNMAFVVAVGLQNFPNQSTENGKKMMSIFLSDTILICEDGPNDVLTMVAKSRLRSNAIRFREDEQQQQHHQQQQKANRDTQEMANGGRNKRSVVLQEQTRHKQTNEEKRKERQRELAEQLNREARERLSIKSGGVEAQ

SEQ ID NO: 140084 - protein, 30 aa, Heterodera glycines
  Coding regions on vcDNA: vcDNA=SeqID_66507; Strand=-; Position=1-89
VAFQNFAQHFLVNLQKSLRFDQSVGIFVNV

SEQ ID NO: 140085 - protein, 120 aa, Heterodera glycines
  Coding regions on vcDNA: vcDNA=SeqID_66508; Strand=+; Position=1 -45,274-472,670-726,771-832
MSSRASDAIQELRRMDRAGRGNFRLRYSPMAAVELTLLGQRLEDRARRHRMAIGAIASTSTSNGANGAGGSAEGDAANNENDNVPADQNAHGGNASGDGNVPSFGATIERTWRDLVDVAA

SEQ ID NO: 140086 - protein, 56 aa, Heterodera glycines
  Coding regions on vcDNA: vcDNA=SeqID_66509; Strand=-; Position=1-168
MHWPRKCRKLRPNWKNKLKMASILAMCLLFAAVTLATSNGSEEIIADANNGDLAMT

SEQ ID NO: 140087 - protein, 52 aa, Heterodera glycines
  Coding regions on vcDNA: vcDNA=SeqID_66510; Strand=-; Position=1 -84,265-339
MPFFVTGGGNLALMTMLTSNRWKKKSKMECAKPKLCCPPNWKTKLKMASIFI

SEQ ID NO: 140088 - protein, 24 aa, Heterodera glycines
  Coding regions on vcDNA: vcDNA=SeqID_66511; Strand=-; Position=1 -52,295-317
MEKACKIWRDYIDFSALELLELAS

SEQ ID NO: 140089 - protein, 70 aa, Heterodera glycines
  Coding regions on vcDNA: vcDNA=SeqID_66512; Strand=-; Position=1-324
LFEYPKRTLEKIDFFVFGVVPLNRCAHIYGETESFGNSFPIACTLILRWIFARHNCLSTLYGHLKKSIFL

SEQ ID NO: 140090 - protein, 93 aa, Heterodera glycines
  Coding regions on vcDNA: vcDNA=SeqID_66513; Strand=-; Position=1-281
MPTMNTKVYEQNHALCFSTEPVKQCPRGTTTNGGEEADQQLSGEKPKRVHFVCMDRAESEARRLMRQLRRGQRSVKVSSAQGESFSEMMDEPQ

SEQ ID NO: 140091 - protein, 424 aa, Heterodera glycines
  Coding regions on vcDNA: vcDNA=SeqID_66514; Strand=+; Position=1 -90,151-411,468-596,653-793,850-990,1047-1175,1232-1615
  Homolog annotation: Hit_ID=AAK31375.1; Match level="QueryCoverage =91%, HitCoverage=36%, E-value=1e-20, Identity=20%"; Hit description =ppg3 [Leishmania major]
MLFLFPLPLILLLLVAIVLVSQCCGGCVKKKGGSKTDKPTEQGEGPAPEGGSKEQPTDKGATAATGDSKTKTRPGPTPCQEGGTTSKGDSKTDKPKAQEEGTSKGGSINTKNAPNAQVGPTASRRPKQTSGGSQMDKLKAQEEGTSKGGSSSTKNAPNAMVSTNAPSIAKGGGTTSKGDSKTDKPKDKKEATSKGGSSSTKNAPNAMVTTNAPSIAKGGGTTSKGDSKTDKPKAQEEGTSKGGSINTKNAPNAQVGPTASRRPKQTSGGSQMDKLKAQEEGTSKGGSSSTKNAPNAMVSTNAPSIAKGGGTTSKGDSKTDKPKDKKEATSKGGSSTTNNAPNAMVDEATSKMRQSINNLTNSQVSTNAPSIAKGGGTTSKGDSKTDKLKAQEEGTSKGGSSSTKNAPNAMVDEATSKGGRASIT

SEQ ID NO: 140092 - protein, 28 aa, Heterodera glycines
  Coding regions on vcDNA: vcDNA=SeqID_66515; Strand=-; Position=1-85
VFLDSNRQNDFDTHSLLIRLYILFQIKE

SEQ ID NO: 140093 - protein, 56 aa, Heterodera glycines
  Coding regions on vcDNA: vcDNA=SeqID_66516; Strand=+; Position=1-170
MCLNRVVLGPEITRRPAAMPFWADLAQGNNDNRDGANWRGSAAFRTLAKGGGVEPI

SEQ ID NO: 140094 - protein, 218 aa, Heterodera glycines
  Coding regions on vcDNA: vcDNA=SeqID_66517; Strand=-; Position=1 -64,182-391,497-879
  Homolog annotation: Hit_ID=AAN32892.1; Match level="QueryCoverage =76%, HitCoverage=77%, E-value=8e-75, Identity=85%"; Hit description =secretory protein 4D06 [Heterodera glycines]
MSSLLLSIFSMVFLVCCHAMPKFPCCPGSQQVVAVMSKYIDTFSAADVDKSTVCSTAKNTVDGIKSDLFSRGGCPSGGEAQIVGEIDRQLKNIAKMEINYEDECPYNLGFARAMFDLAAAAAGHAGTDTKWQNMKGQFEQESQAIKAIGQELNITVTDVHVGHPSKGKQKNLSKYLFKMISKDFPRIKMCQVQAMWLPTLAKRVRLAMERMANRCHLI

SEQ ID NO: 140095 - protein, 40 aa, Heterodera glycines
  Coding regions on vcDNA: vcDNA=SeqID_66518; Strand=+; Position=1 -80,173-215
MTFFVHFFHFLRKCRKIAICEIPIQIRFCQNWLPPSVFVL

SEQ ID NO: 140096 - protein, 439 aa, Heterodera glycines
  Coding regions on vcDNA: vcDNA=SeqID_66519; Strand=-; Position=1 -154,224-396,512-639,786-874,987-1162,1207-1316,1594-1763,1853-2172
  Homolog annotation: Hit_ID=AAH63222.1; Match level="QueryCoverage =54%, HitCoverage=40%, E-value=2e-45, Identity=36%"; Hit description =Hypothetical protein MGC76255 [Xenopus tropicalis] ref|NP_989189.1| hypothetical protein MGC76255 [Xenopus
MFYNSTKKCQVVPTIGENVRPIAFNELHANANAFPFGHRSANVAKMAQMGKTIMAPFAPFSEHSKRKLSTNSAAAAEEANGTKAGTAIDPREYPQAPRRNVADNYHGIEVPDPYRALENPDANVTRQFVSQLNQISQPFLEASPLRQKMNQTLTNMWNYAEFFKPSFHGDLFYYYRNSGLQSQSVLYQSNSMDEPGKVFLDPNTLSKDGTTAVTMESFSKDGTVFAYGISEKGSDAATVKFKQSNGDELPDQIADVRFSGLSWLSDGTGLFYSVMARYGQVSSDGRFLFVSFGGNANDQMFYCDLPADNNRITGPLKMKPLFDQFDADYEVSKKSIKTQNSTMVNSIFELINHLINLTYKWTDGGLRRTLGTDFHQQRCANVQIDQSESRGQHDTEAARGHKGGPKAKNAICLPREQRQTVGLLHGQCEGANDQGTIIK

SEQ ID NO: 140097 - protein, 33 aa, Heterodera glycines
  Coding regions on vcDNA: vcDNA=SeqID_66520; Strand=-; Position=1-103
RDEPKRGGGGSQFGEFGAAGLDGNETAPFEPEQ

SEQ ID NO: 140098 - protein, 38 aa, Heterodera glycines
  Coding regions on vcDNA: vcDNA=SeqID_66521; Strand=-; Position=1-165
IFFSETALKRTKFYLQVILGTQMLSLSKREMNKKSKNF

SEQ ID NO: 140099 - protein, 150 aa, Heterodera glycines
  Coding regions on vcDNA: vcDNA=SeqID_66522; Strand=+; Position=1 -56,453-554,599-695,747-944
MILKLKAPILLYCFVQCLSVYLKIDGKAEGVVRADIGKKDAKSVFTVEGAEFILNFNVTQVGFWQLVGATVERIEVKGSSDFLNKNLNVDKKWTLEPSVVPSTNINGFKDYSFACGQTNPIVWALKDSNDYAVGITLNNVQVERKKDHQL

SEQ ID NO: 140100 - protein, 318 aa, Heterodera glycines
  Coding regions on vcDNA: vcDNA=SeqID_66523; Strand=-; Position=1 -77,162-337,542-813,870-996,1122-1259,1311-1475
PGSSNNGFWPRPVNNALPLGTNRQQLTASSFANSAQVRPSTAAKTSNVPFNASVGSIDTSVGSTAPGLVIQEDYSMDEAESDNDARLHTDSAKTDPMLKTAFASGHQNGIPEQPPLDLLEPDNEPLSLHQVKLSNMDRRAFDSAPNKEFTPHELELRPHLSFLERYREDPNSNSCIRLENVPKMVYAEQLAEFLGVQFDAPYENIARMQNGVLYINLPNEAMATKAAIRNMNILNGHQIAITQLKRAEMADAIRQNMIIIREMYRVSVVARGFPLVTQLNEVVALFERFNLNKDGAEKCTVKPSDTVSTFLLTFASSQ

SEQ ID NO: 140101 - protein, 637 aa, Heterodera glycines
  Coding regions on vcDNA: vcDNA=SeqID_66524; Strand=-; Position=1 -190,1573-1997,2397-2538,2587-2878,2931-3122,3172-3327,3422-3935
  Homolog annotation: Hit_ID=EAL31242.1; Match level="QueryCoverage =72%, HitCoverage=68%, E-value=3e-20, Identity=25%"; Hit description =GA20165-PA [Drosophila pseudoobscura]
MEQVIADAQALAGAAKQQSAPSGAVQHLGQQQTAGVKFTADDKSAKLADQSAKDGAQWKFQSEVALPAVSSSPSISTAFAPQQTIAPLYQQLFGGDSWKNPQLQLPQNVPSQQLAASGQGSHSQLLFHEQAAPPVSQSAPVPVFPGSTQPSFGGVPPSSLGRLLGSPSKTQQQLPNIPQQPPGFPPPLNVPSQPLQAAGVAQQSQPRPSNPSYAGDGFFNQQPAAGYHNQRFQTPNQPIQVYNQQQNRPTGQAPSHHQAQFGMPNQGPIAGQYRPSRPPFGRRGGAHGGAVQQQFGGPTHGVGGFPNAYSESKPMGGAHYQQQQHFQPRQTHYQQRFEGGINGPKRKRSRSPSGPMDPRKRFYQGPSAHGNEFKPSAQFSPNSAAFQSEPLVKERVCVQLSNVPYKATFFDVKQYLSTTNAECVKVTRVYQPDRNYSDRWIVEFDNERDARSVIRYHGEINNRTIRTERITARKADEQYAVMEPDDKDRGDKRSSDDPNSRRERGRGERADRDRPRERERDRGTNRSRSPRGRNGRGRSNDQSRSEKGAATSSTSSSTAAATTTVWAKEERTKPSDEKKEEETDRDKQAKEQQQRQRPAQQQQPPAADSANPMGPLNLVSNAAVFGAFSFPENHANN

SEQ ID NO: 140102 - protein, 128 aa, Heterodera glycines
  Coding regions on vcDNA: vcDNA=SeqID_66525; Strand=-; Position=1 -123,181-266,317-415,915-991
  Homolog annotation: Hit_ID=EAL23424.1; Match level="QueryCoverage =66%, HitCoverage=12%, E-value=4e-14, Identity=49%"; Hit description =hypothetical protein CNBA0740 [Cryptococcus neoformans var. neoformans B-3501A]
MNVFRSALLNAGFRCSISHCNPRAVKTDAPTSFLWDVCREWAKRNGITAKGMAEAGEDSPRSRILAKETKCEINFSTHPGCRTKRPFQANDNKPKHLLPLDNGKQMTKFEETKSKLEAEFEKLRNLEK

SEQ ID NO: 140103 - protein, 116 aa, Heterodera glycines
  Coding regions on vcDNA: vcDNA=SeqID_66526; Strand=-; Position=1-351
MTCAYAKLLGPCFKTGRTDDRLLHRERTTESPSWTELVAGTCRTRPPPTPSSSQHGPETIAQFTQSKQHSPDPGTRPRKAGLNTELTQLLRASQRTPPANAPFATEQKDSKPQSGG

SEQ ID NO: 140104 - protein, 18 aa, Heterodera glycines
  Coding regions on vcDNA: vcDNA=SeqID_66527; Strand=+; Position=1-56
YREAIPEGFGLPINLGAS

SEQ ID NO: 140105 - protein, 224 aa, Heterodera glycines
  Coding regions on vcDNA: vcDNA=SeqID_66528; Strand=-; Position=1-674
  Homolog annotation: Hit_ID=NP_504187.1; Match level="QueryCoverage =92%, HitCoverage=13%, E-value=4e-25, Identity=35%"; Hit description =predicted CDS, integrase, catalytic domain containing protein family member (5E782) [Caenorhabditis elega
PKKMPDLCGMIMRFRLKKYVLIGDIEKAFLQVGLDTSDRDTTRYLWIKKETINELNLTKRDVEMKDIEIRRFKRLPFGVNASPFLLAAVIELHLSKIEPMYENFKNLNTHDTDLNLSDKKDKFEKLCRELAENAYVDDFVMMCEDHNEIKFKHFWIKEIFKIASMNLREFISNHEESNNEIQKIEGSEIPKLSKLLGIKWNVENDELTIPINIPIIAKGTTKRN

SEQ ID NO: 140106 - protein, 316 aa, Heterodera glycines
  Coding regions on vcDNA: vcDNA=SeqID_66529; Strand=+; Position=1 -141,258-482,643-813,872-980,1347-1385,1430-1652
  Homolog annotation: Hit_ID=CAE60134.1; Match level="QueryCoverage =83%, HitCoverage=34%, E-value=2e-65, Identity=45%"; Hit description =Hypothetical protein CBG03680 [Caenorhabditis briggsae]
VRLCFAQQFVFANSLLKLISSVCYAQLAPPTTRNFRCFSNGCCDQHEWCRFWASIGECLSNADWMAINCQLACSTCSRANSASAPPTRPPPPPAPAATRPFITEVITTATMASVTARTSAETIAGSCEEISRNPSTAATQLAKSGLLNPIESRQSLSLDDITRAVSSGCVPEVCAVARDDCSRSLCYHLSFRTMDGMCNNLNKPLMGASFRPYLRHLPAEYSNGFSEPVHLAGVGKPNAREASVHLAGVGKPNAREASRLILASAQVVSHDQLNSLLMQWGQFISHDMARTVSDCPPSSPPLSDHFFRRFPLNDRF

SEQ ID NO: 140107 - protein, 65 aa, Heterodera glycines
  Coding regions on vcDNA: vcDNA=SeqID_66530; Strand=-; Position=1 -120,846-923
MALGGWKRKRARLRSLQNLNRLFVRPALTKEQLKEEYEARNQFSKSDSLHHFLLYFFTCPVDIAI

SEQ ID NO: 140108 - protein, 50 aa, Heterodera glycines
  Coding regions on vcDNA: vcDNA=SeqID_66531; Strand=-; Position=1-150
PGLKCPAEAKNFFYFREKIEIFPKKIPVDRARKTMFWKWSPFFWENSLKI

SEQ ID NO: 140109 - protein, 133 aa, Heterodera glycines
  Coding regions on vcDNA: vcDNA=SeqID_66532; Strand=-; Position=1 -88,136-285,343-504
  Homolog annotation: Hit_ID=NP_492860.1; Match level="QueryCoverage =84%, HitCoverage=25%, E-value=2e-21, Identity=48%"; Hit description =kin protein like (46.4 kD) (1L626) [Caenorhabditis elegans] emb|CAA21720.1| Hypothetical protein Y52B11A.
MNSTVWHTLTGFVMYLGKSGKCKIDENEKGWHIQYIDQEEELRRQKLQQRAKQEKDDEERMHEQLQRQIERQAEGGGWIAKEKQGTEDGDEVAKEPQELIRNDDTKIAFSVGMKKPMITDIKPTTTAFFKIGG

SEQ ID NO: 140110 - protein, 18 aa, Heterodera glycines
  Coding regions on vcDNA: vcDNA=SeqID_66533; Strand=+; Position=1-56
YREAIPEGFGLPINLGAS

SEQ ID NO: 140111 - protein, 76 aa, Heterodera glycines
  Coding regions on vcDNA: vcDNA=SeqID_66534; Strand=-; Position=1 -80,634-784
MTNKCETTEKGQLSAEERMAKRLTRKEAWNFEKKPGTGPGFMNRTRTGFRIKKSYFNRTPDHFTFSKKNTGPGLPD

SEQ ID NO: 140112 - protein, 36 aa, Heterodera glycines
  Coding regions on vcDNA: vcDNA=SeqID_66535; Strand=-; Position=1 -4,170-276
MGIENVAANLIGGDKLQWTAEEKEQIDQIWHFIGRH

SEQ ID NO: 140113 - protein, 176 aa, Heterodera glycines
  Coding regions on vcDNA: vcDNA=SeqID_66536; Strand=+; Position=1 -277,536-627,690-849
  Homolog annotation: Hit_ID=CAE68235.1; Match level="QueryCoverage =92%, HitCoverage=22%, E-value=4e-28, Identity=38%"; Hit description =Hypothetical protein CBG13909 [Caenorhabditis briggsae]
VVAVFQEANLDPAYLFSQLDPGARKQNIARSKPQNQLQISQPLRVLVFRFRNGECFLLVVTDIAARGVDIPLLDFAVNFHFPPKAKLFVHRVADSVLIGAFPDTMAHLETEFLRSIEQNSIEIRKAENAMAKYQRTRQQPSAESVRRVKAEFRHISPGPHPFFADPVLFPDLALEQ

SEQ ID NO: 140114 - protein, 125 aa, Heterodera glycines
  Coding regions on vcDNA: vcDNA=SeqID_66537; Strand=+; Position=1-378
  Homolog annotation: Hit_ID=CAC35733.1; Match level="QueryCoverage =96%, HitCoverage=21%, E-value=8e-13, Identity=32%"; Hit description =cyclophilin-RNA interacting protein [Paramecium tetraurelia]
MKIALGKEERRKRKRGKGKIRSKKRKRRKRMKIALGKEERRKRKRGKGKIRSKKEGRKRRKRMKIALGKEEKEREREKGKIRSKKEEEKEEEKDENSIGEGGETEEKERKRKNSKQGGGERRGKG

SEQ ID NO: 140115 - protein, 117 aa, Heterodera glycines
  Coding regions on vcDNA: vcDNA=SeqID_66538; Strand=+; Position=1 -341,415-427
MTGIERTFDALYVPFSPYLFAACFLPAESPCLPRVIESLRLFSSILTNWFQSIHLVGCPLRLVTILMGQIQQFLLAKHCPNGCTLREKMANPSNCIAKITTNKRTLIGSTISRSYLA

SEQ ID NO: 140116 - protein, 236 aa, Heterodera glycines
  Coding regions on vcDNA: vcDNA=SeqID_66539; Strand=-; Position=1 -345,387-485,533-796
MLLKSPPPSMHALRTSRRRSADLNAYISPSGERTVSSSSLLNRTFLTHLILLICIFTGSPVWADLAATIRNPSVCPIRPLSKAISLDRSVEHTKRSTSIDVNANECEKKREDKDKKLTDPMLRSRQSAFTGQKGKPRRFCGRKKCASENELIDGGDQLQSSANFYLSHHSTTSSSVSPSSFCPSKDSHNSSGIEGPSSADSESFNAKTKQSADRATENVGQSRGNVKFDDTIMKGN

SEQ ID NO: 140117 - protein, 165 aa, Heterodera glycines
  Coding regions on vcDNA: vcDNA=SeqID_66540; Strand=+; Position=1 -33,239-702
  Homolog annotation: Hit_ID=AAM98028.1; Match level="QueryCoverage =61%, HitCoverage=5%, E-value=4e-18, Identity=46%"; Hit description =Inositol triphosphate receptor protein 1, isoform g [Caenorhabditis elegans]
MTSRECIVEVKVAYLQFLLHCYIDTDIELKDASNGEYLDAILEDAIADMGKLSTRLRQMDYQPKFGPEIVALERYVCQTVTEVLVRVFEPASYGHSAHIDIRVGHLDNGTPKRGAFAHLAAAKTLFDHNAAAERVAERRAEGATPLELLQELVPYCGMCEKTDEI

SEQ ID NO: 140118 - protein, 113 aa, Heterodera glycines
  Coding regions on vcDNA: vcDNA=SeqID_66541; Strand=+; Position=1 -108,163-396
  Homolog annotation: Hit_ID=AAP30770.1; Match level="QueryCoverage =100%, HitCoverage=43%, E-value=2e-45, Identity=74%"; Hit description= putative gland protein G17G01 [Heterodera glycines]
MEKIVYFKLMQIVLTFAFIWQLMSLHEFCGTFADPKACIHDISVGHCKRFAFIGKDSKSGEFGVVFDHHKWHDQLSMSSTNGRSFEEQQHQFMDELATKLPPAGRLCIPITVN

SEQ ID NO: 140119 - protein, 84 aa, Heterodera glycines
  Coding regions on vcDNA: vcDNA=SeqID_66542; Strand=+; Position=1-255
MSAHPTACGPLASSGNTLPTGGGGGGEVVPFGGVGGGEVVPFGGVGGGEVVPFNGGDGDGVVLDGNNPITNIDMKNLNGINYFR

SEQ ID NO: 140120 - protein, 312 aa, Heterodera glycines
  Coding regions on vcDNA: vcDNA=SeqID_66543; Strand=+; Position=1-938
  Homolog annotation: Hit_ID=NP_921821.1; Match level="QueryCoverage =62%, HitCoverage=10%, E-value=6e-10, Identity=26%"; Hit description =putative helicase [Oryza sativa (japonica cultivar-group)] gb|AAP54108.1| putative helicase [Oryza sativa
MAIILNGEFHRRISSMQAGTTQIPGFGQLYILDPVEAMEQRRKNPTFTGEKITNEEEFVQGHQLSDETLEVLEQMIQENHPAASAYKQAREQLQELLKQQRTEELRFFRMTLLDERSAPGAMKDPKLHPHQIITPSTGEGMFAIHADLNGAPAPKGIWVENKQGQLNEIAPLSPWTDSLTYPLIKPKGDDGYKIGIPYAKPAQRKRKSDMSDDMFDNQAMSDDDICDTESIASSGSEASMQSVTSRYDKSKRFVSLRDYCKYHLAIRDENLEWQYHHILSCGGGLGQRWVLDQASKMTGKLPLFCAVQTWTG

SEQ ID NO: 140121 - protein, 226 aa, Heterodera glycines
  Coding regions on vcDNA: vcDNA=SeqID_66544; Strand=+; Position=1 -280,328-721,858-864
  Homolog annotation: Hit_ID=NP_500195.2; Match level="QueryCoverage =85%, HitCoverage=37%, E-value=8e-10, Identity=27%"; Hit description =tc5 transposase and CENP-B protein and Tc5 transposase, C-terminal family member (60.5 kD) (4D135) [Caeno
MYVNPKNILFLLQKYFEKYNEETPLNGSEIAIAKNFASEIERCLKNNEELDFMEELVFDQNAEYVKIEGQLSDSDFDYNSEEEIDQINSSFGSENSSGSSFFTSPVKKVPRDDFASFSDKKKALQFYRSADKGHRSLSCMKSTYKAKNIYAVANTSHIMTKQLMVEWVDKVLCPALRPNQKSLLIVDSWTGWNNFHPKNGIELAVKQIPKHGTGICQPLDVYVFRH

SEQ ID NO: 140122 - protein, 581 aa, Heterodera glycines
  Coding regions on vcDNA: vcDNA=SeqID_66545; Strand=-; Position=1 -71,590-715,803-912,1024-1105,1149-1293,1340-1428,1486-1524,1569 -1675,1719-1822,1874-1944,1993-2167,2233-2327,2374-2443,2501-2565
  Homolog annotation: Hit_ID=NP_872090.1; Match level="QueryCoverage =94%, HitCoverage=75%, E-value=4e-97, Identity=37%"; Hit description =SH3 domain and phox-like family member (64.0 kD) (4O826) [Caenorhabditis elegans] emb|CAD56254.1| Hypothe
KTVRGAQQIDDDFDDDWSEEDEEASMSSQKQAASVGAAKMKNINRSRVTVGSGGGGGDSMDRITARFSNFVKSGMESYILATTKFSGQPGESHEIILVGSSLKWKCADDYGYTCMVTKPKKESKLKGLKSFIAYSLTCSLTGIQVARRYKGLKSFIAYSLTCSLTGIQVARRYKHFDWLHEQLSAKYLPIPIPPLPEKQVAGLYEDDLIQHRRSVLQLLYEDDLIQHRRSVLQLWVNKICRHPVLSQSGVWRHFISGVWRHFISCTDENQWKKGKRLAEKDEYVGGNFNQWKKGKRLAEKDEYVGGNFFNCITAPTEQLNLQDFEQQIENFARSEQQIENFARSSRSLEESCKILYERITEAQKRLIGPHKSNWQKLAQSFELVGQSHKSNWQKLAQSFELVGQSLDMDQTLANNPVKSAIKVSANNLHTLANNPVKSAIKVSANNLHRIGSQHEDHGKKDLEQLLEFLYVSKGVYASIPDTVNIFKMHENKRLQKEGKISDGDVMLFVGRVDVCAYAMLAETHQQEERLAETHQQEERDLDLAIAFGSFFSQQSAFYHNQQSAFYHNIGNQFSQLAELFK

SEQ ID NO: 140123 - protein, 150 aa, Heterodera glycines
  Coding regions on vcDNA: vcDNA=SeqID_66546; Strand=+; Position=1 -91,691-1049
  Homolog annotation: Hit_ID=CAE68981.1; Match level="QueryCoverage =61%, HitCoverage=14%, E-value=1e-28, Identity=60%"; Hit description =Hypothetical protein CBG14965 [Caenorhabditis briggsae]
MGLLDQQLALRWINDNIAQFGGNPNKVTLFGESAGGASAAAHLFAPDSHRLFRSLIAKSGAIVNNWATKPKVAIRDISMRLAHRLNCSMSTMVDWKRRRRHRHRPRRQRHDRRRRSGPSPDNNSDDEEGTVAVANQVIACMSRVPAQIIQ

SEQ ID NO: 140124 - protein, 27 aa, Heterodera glycines
  Coding regions on vcDNA: vcDNA=SeqID_66547; Strand=-; Position=1-84
LAIHIYAKNGTIGIIPNQKICKKFVLR

SEQ ID NO: 140125 - protein, 165 aa, Heterodera glycines
  Coding regions on vcDNA: vcDNA=SeqID_66548; Strand=+; Position=1 -211,670-804,910-1059
MGVHFVVDFVVLSLPSIPKLNFGAQNLRPILKVLENKLQNLIYETNLIEEYDPKKRAHLKWKLEEELFLDDTDEDKVQRILNQIDKMNNEDASKKYHELNNVSNETKRMNQIKVERHSYELKILEFLLPKEELSRLNHLLDETVMIGGTLTKFRAVYAILELWAK

SEQ ID NO: 140126 - protein, 40 aa, Heterodera glycines
  misc_feature (3)..(3): Xaa can be any naturally occurring amino acid
  Coding regions on vcDNA: vcDNA=SeqID_66549; Strand=+; Position=1-301
NKXKRKKINLFFLINKKHCQRQCLPKKDKNFSKKAKKMKI

SEQ ID NO: 140127 - protein, 53 aa, Heterodera glycines; identical to SEQ ID NO: 126996
  Coding regions on vcDNA: vcDNA=SeqID_66550; Strand=+; Position=1-352

SEQ ID NO: 140128 - protein, 44 aa, Heterodera glycines
  Coding regions on vcDNA: vcDNA=SeqID_66551; Strand=+; Position=1 -60,223-297
MVAAKKFLRILPIQTESYRLLEDEQIYLFGLLSIAKEFILFANI

SEQ ID NO: 140129 - protein, 87 aa, Heterodera glycines
  Coding regions on vcDNA: vcDNA=SeqID_66552; Strand=+; Position=1 -148,375-490
MSADYAKRVIENEQLKNDLTNGRTDGQQRNKPKRQQKENGNGNVIKHHFEINGEYAIDPLVLGQFPPKYVQGSNNTYPHNSMSNEKS

SEQ ID NO: 140130 - protein, 25 aa, Heterodera glycines
  Coding regions on vcDNA: vcDNA=SeqID_66553; Strand=+; Position=1-76
MNFYIIFFLVIFSTFFCQLLIVGAT

SEQ ID NO: 140131 - protein, 29 aa, Heterodera glycines
  Coding regions on vcDNA: vcDNA=SeqID_66554; Strand=+; Position=1-92
GIRFSNEEKMNKMNIYSKMKNEKPSLSYK

SEQ ID NO: 140132 - protein, 247 aa, Heterodera glycines
  Coding regions on vcDNA: vcDNA=SeqID_66555; Strand=+; Position=1 -261,666-837,1110-1418
MALVRFDEAKSNRGKILLSRLGFEYSFENFSRLEEGWEYWKCPRRPPYCPGRASVQIPWLVDENGSRYKMGRITAEHNHGAIFGQLAVGDVGLDVLPVENIVLPDALLNRVICNEIFNGHRMIVFCSASALEILRQYNTECAIDAIRDSVGNNWAPQRLMSDFESAAINSTRIVFANSTQSGCLFHFGQAIYCRIQRLPNLHTQYLQNVELQRNIRSLQALAFVPVDLVYNYFCILVSTLHPTAELQ

SEQ ID NO: 140133 - protein, 97 aa, Heterodera glycines
  Coding regions on vcDNA: vcDNA=SeqID_66556; Strand=+; Position=1 -266,449-476
TTSPVSTAGAGDSLPNGTTTTAATAGDVTPKTGGGGDEDEKMEEDYVGGAAAGGATAGSVPPKKTSTGAAATGSATAAGAKPTAAAEQRIILFTVVW

SEQ ID NO: 140134 - protein, 46 aa, Heterodera glycines
  Coding regions on vcDNA: vcDNA=SeqID_66557; Strand=+; Position=1 -88,158-210
MFEQGIALEVIERTLNVPTVELKCRFARLWMGILCNTYFSWIPQML

SEQ ID NO: 140135 - protein, 92 aa, Heterodera glycines
  Coding regions on vcDNA: vcDNA=SeqID_66558; Strand=+; Position=1-279
MFVVKQTRNGHERGGTEQQNVQHNKKVGDEQTTKAGQNATMDVNLSGKTNGLRPYEYSNSSMLILVRYGKATVMKKRYDKEGGEKEGGGGVS

SEQ ID NO: 140136 - protein, 37 aa, Heterodera glycines
  Coding regions on vcDNA: vcDNA=SeqID_66559; Strand=-; Position=1 -39,158-232
MDGAALLPASDNPVLKKKSSSLNPILDIDAIVEAPKT

SEQ ID NO: 140137 - protein, 93 aa, Heterodera glycines
  Coding regions on vcDNA: vcDNA=SeqID_66560; Strand=+; Position=1 -105,527-703
MDWIGRMNHLQFKGSINRSKRTLVENALKSESWAYKAFKPTRPFDEAAERGKRELLEKYTEEYNALQEELRQAEEQQRNGGMPKRRKRERLSR

SEQ ID NO: 140138 - protein, 48 aa, Heterodera glycines
  Coding regions on vcDNA: vcDNA=SeqID_66561; Strand=-; Position=1-144
MEKKILIKLILGLAGSGYPTGSRPGYPVFSIPGPGLGFLKIQYPVPDP

SEQ ID NO: 140139 - protein, 76 aa, Heterodera glycines
  Coding regions on vcDNA: vcDNA=SeqID_66562; Strand=+; Position=1 -84,1144-1290
MSKGETSKNSKKEVKREKEKAHKKKYERAPSPSPSAVKTRQKAEVELNEYLRDQKIKSRANPSLYWETNSQMAIDW

SEQ ID NO: 140140 - protein, 31 aa, Heterodera glycines
  Coding regions on vcDNA: vcDNA=SeqID_66563; Strand=+; Position=1 -57,276-314
MYGTSLENAIASDCSGAYKDGLVAIVKGYYH

SEQ ID NO: 140141 - protein, 86 aa, Heterodera glycines
  Coding regions on vcDNA: vcDNA=SeqID_66564; Strand=+; Position=1 -153,750-857
MFKPTIKLCAKTRKYSKIGLQPRRRGWKIRGSGLSGLEVSGFGVGVAKSFGKKTSNGIELTTESNVNGTNLYTTFQMSEIEQIFFI

SEQ ID NO: 140142 - protein, 153 aa, Heterodera glycines
  Coding regions on vcDNA: vcDNA=SeqID_66565; Strand=-; Position=1 -235,1185-1411
MVDSPTPTRRWLTRRRRLADGRLADADSPMVDSPTPTRRWLTRRRRLADGRLADANSPMVDSPTPTRRWSTRRRQLADAHLLGRYNTDANFALHSRMITAIAFIPEEDIIRSLQELEDHTLDHYPELATIFEWFTNTYVGRGTRAPPKFSYDM

SEQ ID NO: 140143 - protein, 119 aa, Heterodera glycines
  Coding regions on vcDNA: vcDNA=SeqID_66566; Strand=+; Position=1-360
MRIFIVKITSAAKCVELFGVCNNYRVDYRSFDAQPILGLEPHFHTVMELAIGTAQFSHFLLEISNGVTLLELNGQLGLVKNNVNNFRVTLLTFSKNLVTPSPTRTALGQKRAKLFGSNT

SEQ ID NO: 140144 - protein, 46 aa, Heterodera glycines
  Coding regions on vcDNA: vcDNA=SeqID_66567; Strand=-; Position=1 -95,426-471
MPTCPLIRHWVRGNVVELIERRIPSTKKGVEREKSRTNLKETDGMD

SEQ ID NO: 140145 - protein, 286 aa, Heterodera glycines
  Coding regions on vcDNA: vcDNA=SeqID_66568; Strand=-; Position=1 -457,565-965
MSSPILDIIHGLVNRIEVELNREIPINPGQNATPNTIQRHLYRAKNACDELSEILEEIQGKRVEMAESLQKIAVAARENKERVYVDFCTQLDIEAKINRAVIKKNEWQNKKEQLEDIFDINPQNSLNSTILTPRNQPIKRVKILQIQLKNLMEGEAKELIEGIPISEDGYQIAIDLLLEKYGKSTKLIRALNQEINLFPQSDTVEEDEKLYIKFEKICRQLSSLNQDMDLSPHYLSLEGKLSPLVLDKYFVIKDAEDNQNWNTTKFRNALSRAIEQIKNRQEVRQK

SEQ ID NO: 140146 - protein, 1415 aa, Heterodera glycines
  Coding regions on vcDNA: vcDNA=SeqID_66569; Strand=+; Position=1-4248
  Homolog annotation: Hit_ID=XP_318550.1; Match level="QueryCoverage =70%, HitCoverage=99%, E-value=0.0, Identity=40%"; Hit description =ENSANGP00000020240 [Anopheles gambiae]
MDPNQLKLILEAVLKASAGQVNNSAALATSIDARLSTFDYDPELGHTYDVWLKRYGQTIAQDGQALSDQSKVQLLIGKLGEVEYKRYIDSIAPKSQNDFNWDETTAKLKHLFGETRSLFLRRFDCFQIRQDAHQDVQSLIALINSSCENADLSLSKEELKCMILIIALRDEFTDLRQKCLQRLEDSRTSGRSTSLQELGEECRKYQIIKESALSLGSNPCSTSAIRAKPQQIKDKQKPKTKPQQSHKGQNFLPKNSTAPKGKVDQRDQPCYSCGGKSHWQKDCWFKNSTCEKCGRNGHIAKACKSGTEIRRVRAVATDSVKDTHIHTVSIKPKCMAIEGSSNKWWEVIIQINGMDHPMNVDTAAQITVIKTDSWQKLGKPKLGKTAITVRNCNEKAFSIEGKFKCQVSYKGRTASLIAYVSDEIHQDLLGMPWIEELEIIPKELMFPNSSQIVNSLPTKPISSQISDEKSLISALQTNYANTFGPELGHCTKFRAHLILKKEAKPVYCKARPVPHGALDEVNAEIDRLSKIGAIKPIEFSHWAAPILAVKKKSGKTRVCIDFSTGLNDAIELHRHPLPRPEDIYNAVGGAKFFSRLDLRDAYLQLELSEASKNLCVLNTHRGLFQCQRLPFGVKSAPAIFQGLMDKIIAGIPGAFVYLDDVVIANKSLTDHTSTIFAVFDKISEYGLRIQLEKCSFLQKETLFLGHIISENGIRPDPSRAEAIEKMPAPTDKSTLRSFLGALTYYGKFIKPMRELRGPLDELLKKEAKWEWGVEQQKSFEKAKEIMLSDLLLTHFDPELPIVVAADASKDGIGATISHIFPDKSERVIEHASCTFNAAQHNYSQIEKEALGLVFAVQKFHRMLYGRKFTLLTDHKPLLAIFGSKKGIPIYAASRLQRWALILSNYEFDIKYVNTNSFGNADVLSRLIANYPRPNEDILIANICEKTECYVNFVFQAKVEQLPITAKEIADQTKTDEVLQQISKFTNKGWPQKCTDTDLMPFYPKRDQITEIDGCLTYGDRVIIPTTLRRQILKSLHFAHPGIVRMKAIAKNHVYWPGINSEIERTVRQCDDCQMAAKNPTKAQIQPWKAADEVFERIHLDFAGPCEDGQTYLVVVDAYSNWPEVWEMSRATSEKTVAMLKSFVHRMGIPREIVSDNGTQFRSAEFANFCKEFDIRHTFTPPYHPMSNGAAERFVDIFKRAMKKCRKEGKDWIPKALLAYRTTPSAVLDGHSPDELFLGRRMRTKISLVHPTNQKMPKVDLKNFGNFQQNYRQKMKRQFNDKNGAKPIIFQNGEPVFIWNLKGNKANWLPATIIERVGNSPTYRVDVQTLRRAVHRHANQIRRRFPMEMETSQIGQANGNILAGNQPNRTPIKEIEKAKSPIGQNQNAPRRSARAKRAPQQLNMDPSKRKYDVFRP

SEQ ID NO: 140147 - protein, 212 aa, Heterodera glycines
  Coding regions on vcDNA: vcDNA=SeqID_66570; Strand=+; Position=1 -65,1216-1392,1464-1557,1746-1819,1864-1953,1998-2018
  Homolog annotation: Hit_ID=AAO85459.1; Match level="QueryCoverage =93%, HitCoverage=85%, E-value=4e-47, Identity=47%"; Hit description =putative gland protein G20E03 [Heterodera glycines]
LSKPNLSPPGSPKVFEKICSKCDLIKCPNGKVCGYFVGIAKLGKGPFEKNEYPKCVSDPSELNVTTPNDGNAHIEVDGPGCKSVECAEGFQCQCKSVECAEGFQCQVRITIDKHGDRPYAQIIGGFPQCVNASGSFQEPNYFIVGGPGCDQLPSPCPSGTKCVTIVGICDQLPSPCPSGTKCVTIVGIAKYGKYPWAQFFEPVCTFFEPVCT

SEQ ID NO: 140148 - protein, 67 aa, Heterodera glycines
  Coding regions on vcDNA: vcDNA=SeqID_66571; Strand=-; Position=1 -157,264-307
MSVSPVISRMLSVEMKEKQQRMITLDELGVDMDQFMEFLEAITYLNGPFMPNPTNVLMLLKLADYFQ

SEQ ID NO: 140149 - protein, 70 aa, Heterodera glycines
  Coding regions on vcDNA: vcDNA=SeqID_66572; Strand=+; Position=1-389
CNLAIHRSLKTGASRPFFNFLGDIRPLRSLRTGASRPFLIFWGIFGRFAASGWALRARFLIFWGTFGRFA

SEQ ID NO: 140150 - protein, 97 aa, Heterodera glycines
  Coding regions on vcDNA: vcDNA=SeqID_66573; Strand=-; Position=1 -86,160-367
MMRKFPDIPAEFLTVLLQIREDIGRSEAKNIAEEALNNTRYHPRGDAQVRRLFQLCKSGGSGGRRALPALESTVQNMFATIITTTKSTTVSSNLGFK

SEQ ID NO: 140151 - protein, 24 aa, Heterodera glycines
  Coding regions on vcDNA: vcDNA=SeqID_66574; Strand=-; Position=1 -52,295-317
MEKACKIWRDYIDFSALELLELAS

SEQ ID NO: 140152 - protein, 27 aa, Heterodera glycines
  Coding regions on vcDNA: vcDNA=SeqID_66575; Strand=-; Position=1-129
KELKIFKIFIHLPFDRKSIREPYLTFN

SEQ ID NO: 140153 - protein, 31 aa, Heterodera glycines
  Coding regions on vcDNA: vcDNA=SeqID_66576; Strand=+; Position=1-94
QPFRAVTEFCSCCTQSWSAARVMVSRRALSN

SEQ ID NO: 140154 - protein, 37 aa, Heterodera glycines
  Coding regions on vcDNA: vcDNA=SeqID_66577; Strand=+; Position=1 -59,117-171
MDNFCTVKENMKQLLQLFPWKTTQIVCGTNLWLAICI

SEQ ID NO: 140155 - protein, 49 aa, Heterodera glycines
  Coding regions on vcDNA: vcDNA=SeqID_66578; Strand=+; Position=1 -54,299-394
MRIMRKAKCEKRNLGPSLGKKGPKKIHIIITFMLIKKPIAPSDQINPSG

SEQ ID NO: 140156 - protein, 72 aa, Heterodera glycines
  Coding regions on vcDNA: vcDNA=SeqID_66579; Strand=+; Position=1-219
MSSFRKSMLRCLEMFLCADQGTISDKCLCLEADPCPLAKSKKATISRTNHFKRYSRPKVDSEAGAYNLEKII

SEQ ID NO: 140157 - protein, 126 aa, Heterodera glycines
  Coding regions on vcDNA: vcDNA=SeqID_66580; Strand=-; Position=1 -67,175-488
MKLYFIHILPLICSVHVVLTEVDSTDLLYADYILAPSDFPEEKRESIKRLIFFKYYDNSIDTTIANMTKTVIAVSQLSYNTNASNFVLSKVLQKLNKLNETWKEYQASFNLSEIVGKKVDSLKTVQ

SEQ ID NO: 140158 - protein, 56 aa, Heterodera glycines
  Coding regions on vcDNA: vcDNA=SeqID_66581; Strand=+; Position=1 -100,668-738
MRLNNKQNFMSPFLNKQFMQAGGGLVNDYGGTEGMFSGEDDAYPPAGDDSCIPFLY

SEQ ID NO: 140159 - protein, 152 aa, Heterodera glycines
  Coding regions on vcDNA: vcDNA=SeqID_66582; Strand=+; Position=1 -3,288-531,1098-1309
MAHLSLAQIFGDADAVPKLSPPIQLYDFIAPRAYANWPKVVGQALNKRKQLHEKIDDNEDKEQLQQGERFINIPSIKNIFNKALPYLVKVMPNVAPTLCALKGCPPGMLGQFGGIGGFPGGGGFPGAYPGGGGFPGGFQGKKYPGMAYDPYA

SEQ ID NO: 140160 - protein, 89 aa, Heterodera glycines
  Coding regions on vcDNA: vcDNA=SeqID_66583; Strand=+; Position=1 -16,64-137,196-375
  Homolog annotation: Hit_ID=CAE63107.1; Match level="QueryCoverage =78%, HitCoverage=9%, E-value=3e-16, Identity=50%"; Hit description =Hypothetical protein CBG07402 [Caenorhabditis briggsae]
MKNYYRNSFIQFWSGFVPVLNRMGGKDVSEDHHLLPSHFDRTTFFGVPRPFGAISNIPFPPPPPPPPPTPFPKELHDKMMAQGAANGWA

SEQ ID NO: 140161 - protein, 24 aa, Heterodera glycines
  Coding regions on vcDNA: vcDNA=SeqID_66584; Strand=-; Position=1 -52,295-317
MEKACKIWRDYIDFSALELLELAS

SEQ ID NO: 140162 - protein, 194 aa, Heterodera glycines
  Coding regions on vcDNA: vcDNA=SeqID_66585; Strand=+; Position=1 -100,165-375,424-471,551-774
  Homolog annotation: Hit_ID=CAE59594.1; Match level="QueryCoverage =100%, HitCoverage=25%, E-value=3e-49, Identity=52%"; Hit description= Hypothetical protein CBG03001 [Caenorhabditis briggsae]
GGPNSVYVDNAPVYDPELLGGRLPLLGICYGFQLINKHFGGSVSLQPRREDGRTQIQVSPKSDLFHSLKPDQFVLLTHGDGVTPETSAKNGFQPIGFSGEFVAAIENTERRIYGLQFHPEADLTDQGIQIIDNFLRRICSLKCHYTLRNREQMCEERIRSAVGEKGEVLVLVSGGVDSTVCAALCTKALGAEKV

SEQ ID NO: 140163 - protein, 219 aa, Heterodera glycines
  Coding regions on vcDNA: vcDNA=SeqID_66586; Strand=-; Position=1 -116,161-281,333-455,499-797
  Homolog annotation: Hit_ID=CAE66385.1; Match level="QueryCoverage =94%, HitCoverage=22%, E-value=6e-54, Identity=50%"; Hit description =Hypothetical protein CBG11647 [Caenorhabditis briggsae]
MTLPSCSKDGAASLSPMSFKEPNACPMLERMHYQRITGRFCDACIFVKDRQFSAHRMVLAAHSPYFDSILRHNKIAKEKIIVNCQDPTVFDRILNYMYSGSVTIDRAIVVELLKLANNLLMIRLKNYCADYLMRYIDVANCLAIRDLASRYNLPRLQKHANEFFDSNINGLFGLLCVKSKSRFRCLLENADVLGWEPIKLVELLEMPRHASNVRADVYL

SEQ ID NO: 140164 - protein, 134 aa, Heterodera glycines
  Coding regions on vcDNA: vcDNA=SeqID_66587; Strand=+; Position=1 -78,518-664,798-974
  Homolog annotation: Hit_ID=CAE59319.1; Match level="QueryCoverage =100%, HitCoverage=13%, E-value=9e-54, Identity=73%"; Hit description= Hypothetical protein CBG02659 [Caenorhabditis briggsae]
MLNSRFKNRIAYGGLGTIDLFKRTWKDLSEYINVECDGVDITAKIREFKFHCILFHNISFYAGGTVPWGAGDGVQENCGEVFSRPSPCDGKIEVLGFTTATLAALQMGGKGERIAQCSKVRIETSKPIPMQVDG

SEQ ID NO: 140165 - protein, 268 aa, Heterodera glycines
  Coding regions on vcDNA: vcDNA=SeqID_66588; Strand=+; Position=1 -163,217-330,380-536,589-728,815-929
  Homolog annotation: Hit_ID=CAE56905.1; Match level="QueryCoverage =99%, HitCoverage=57%, E-value=1e-75, Identity=54%"; Hit description =Hypothetical protein CBG24746 [Caenorhabditis briggsae]
LRTGDHLILADDGYGGTQRYFRDISVPQHGVQLSFVDLTNLNELRKAIRPNTKMVWFESPSNPLLKVVDIAAVMVWFESPSNPLLKVVDIAAVSKIVKAHNSECLVLVDNTFMSPFFFMSPFFQNPLALGADVVLHSLTKYINGHSDVVMGCLITDSERLEAHFLFQQLAVGSVPSSFDVYLVLRVGSVPSSFDVYLVLRGIKTLHLRMRQHHSNAISVARWLETDPRVERLYPELESHPQHEVHKKQTSGMSGMITVYLRTDWKDLE

SEQ ID NO: 140166 - protein, 436 aa, Heterodera glycines
  Coding regions on vcDNA: vcDNA=SeqID_66589; Strand=+; Position=1 -64,131-953,2393-2582,2633-2864
  Homolog annotation: Hit_ID=CAE64512.1; Match level="QueryCoverage =32%, HitCoverage=25%, E-value=6e-28, Identity=46%"; Hit description =Hypothetical protein CBG09248 [Caenorhabditis briggsae]
MSDDEDYMSSAFLAKVEDVKPGVGTGREGRRILRINANREEAIERQRVEKPKSKAELERDRLMEGLNDPIRAESKGFQLLAKMGYKEGMRMGRSAADEQQMDSRTKEPILIQLRIDRSGVGMDEHRKEKQRDLCEAHMERMKRQADNEVGRNWKMMGGESIFKGRIGHRFPKTQKGSNGNEATDLGDPKTEKDVPRDGHAVGIARELSETLDLFRMGKTIPDEFWFWPIYSNNNELVDMVEVVDKSNQSMDENKRTKREPSEGAEGQVERYTYGNGEEAPMALNLNELDNRHLEERNHRVLLEAAQHVTRFIGLSPVDNAKKEKWLYAFGIVPMRNLPRGELVSQPQNCSEFPYMEILQDYLRQKAEENERRKAAEGAAVQFFYDMQTVEEDQTDVGEGRKRRRGGGRPTDGQRRPRLDPKACWFCLSNAEAEKHL

SEQ ID NO: 140167 - protein, 172 aa, Heterodera glycines
  misc_feature (27)..(27): Xaa can be any naturally occurring amino acid
  Coding regions on vcDNA: vcDNA=SeqID_66590; Strand=+; Position=1 -207,387-497,541-687
  Homolog annotation: Hit_ID=CAE64512.1; Match level="QueryCoverage =97%, HitCoverage=28%, E-value=2e-29, Identity=41%"; Hit description =Hypothetical protein CBG09248 [Caenorhabditis briggsae]
SLPLLFSAWDGSPGRFLPVIFSHFSLXHLQFQFVPIPKTKSKALRSTFLNLARLKNIEFSFLKDEDNLWDLVGEGSPYFYAEFPDGSKMLSRSMAQFPLQFGREVFANKALLDCEEKVDWRNCVFANKALLDCEEKVDWRNCSLGKKEEEKLTIALKEGFKPFAFTGDSSGD

SEQ ID NO: 140168 - protein, 27 aa, Heterodera glycines
  Coding regions on vcDNA: vcDNA=SeqID_66591; Strand=-; Position=1-83
MPPPPTAMTLGDEAGGAAVGNGPPPTA

SEQ ID NO: 140169 - protein, 272 aa, Heterodera glycines
  Coding regions on vcDNA: vcDNA=SeqID_66592; Strand=+; Position=1 -265,613-915,1127-1266,1460-1568
  Homolog annotation: Hit_ID=NP_492444.1; Match level="QueryCoverage =78%, HitCoverage=25%, E-value=4e-14, Identity=30%"; Hit description =MIZ type zinc finger containing protein family member, GEX (Gut on EXterior) Interacting protein GEI-17 (
SNTGVHHQQQSYPAVGGGPLPTAAPPASSPSVIAVGGGGMLHPGSNAAAAAGMARAPTFNHHTQQQQQMFNNQSAAAFYAAYQHQFFQMAPHNFVNPQAAHLHHQQPPNNPLAAAASAAAAAADAAQQHHQPQHHHQTAEWASSTTAATCSSQSVPATAATGCCPQHGAGGQSVRDLRTVELPFYDQIKVIVPITELPPYPVPIRPGDARASHSFSVPSEDIQKVHYRIEEQPLPRYELQLRMFLLETSEEQQDAFPPGSTVRVDEHGVQLP

SEQ ID NO: 140170 - protein, 52 aa, Heterodera glycines
  Coding regions on vcDNA: vcDNA=SeqID_66593; Strand=+; Position=1 -114,240-284
MKKPSVTIQKEEEKQPAQAKSKSPSPRPAKSPSPNPKECVLISHLSIHDTVS

SEQ ID NO: 140171 - protein, 63 aa, Heterodera glycines
  Coding regions on vcDNA: vcDNA=SeqID_66594; Strand=-; Position=1-361
NRNYAQKASQTILALPIPSTIAFIHPIMSAKIIRVPKIACDLSLAKNGVSKIVITLKKLLKQF

SEQ ID NO: 140172 - protein, 180 aa, Heterodera glycines
  Coding regions on vcDNA: vcDNA=SeqID_66595; Strand=-; Position=1-543
  Homolog annotation: Hit_ID=XP_392462.1; Match level="QueryCoverage =88%, HitCoverage=4%, E-value=1e-13, Identity=31%"; Hit description =similar to CG18255-PA [Apis mellifera]
NSNGFTCAEPMYESLSDTEEVELKVKKVEEAKAKRLEDSQKMLQNEVEKLKKELVELKKKEVSRKRKRLTKTEKVEGNKVPTNVKEVQETEDGEKKDEKELKGIGNERDLKEVNEEEKEKKDKKGKEEAKKKEIVLIDSEEDWKKVSQHEDEVSLGPEEEDDEERKLLIFSLPTNRLIFI

SEQ ID NO: 140173 - protein, 142 aa, Heterodera glycines
  Coding regions on vcDNA: vcDNA=SeqID_66596; Strand=-; Position=1 -254,439-511,1843-1944
  Homolog annotation: Hit_ID=CAE70434.1; Match level="QueryCoverage =64%, HitCoverage=16%, E-value=5e-18, Identity=50%"; Hit description =Hypothetical protein CBG17010 [Caenorhabditis briggsae]
MADVQIAAGGGANFRLGRGTIIVPQISCVLFDEKVHPALSFNFIYFRFLLKVFPNARRFLPERFLNQMGQLERFEELIPFGLGKRVCMGESLARMELFLFTANFFRNFTVGPDHTGTGNSRSGPGPVQLYLLNVYKIKGTNL

SEQ ID NO: 140174 - protein, 66 aa, Heterodera glycines
  Coding regions on vcDNA: vcDNA=SeqID_66597; Strand=+; Position=1-201
MDEEEGKEVRIGLRGEKGEKWNGRRGGGEGSGRVKMRERNRENEKRGKEKKRGTEKGRGKAKRNGN

SEQ ID NO: 140175 - protein, 50 aa, Heterodera glycines
  Coding regions on vcDNA: vcDNA=SeqID_66598; Strand=+; Position=1-183
PKKSIFFQKMIYQKLICKIFKCDSKPILVVFMAFCAYFTFYEEFFSKNNH

SEQ ID NO: 140176 - protein, 54 aa, Heterodera glycines
  Coding regions on vcDNA: vcDNA=SeqID_66599; Strand=-; Position=1 -371,502-642
KSFLQPHIANLISCRLKAIHCLPVSAQQSTNRVFDFLQKIIHYPKVFYNHLLPI

SEQ ID NO: 140177 - protein, 154 aa, Heterodera glycines
  Coding regions on vcDNA: vcDNA=SeqID_66600; Strand=+; Position=1-465
MGEIKIMKNNLNKMRRDLYRNFEETKIKILEILKKDGEKMGKLKEENDQKFEVQKATHRKTFENVTKNIEDEAEIGQMKRECSLFFQRFEECHRFTEEKIYELATKNGEIRKNLMQINVGGKALQTVGLQIRLTLFDGIERAMESEQSIWGNEK

SEQ ID NO: 140178 - protein, 92 aa, Heterodera glycines
  Coding regions on vcDNA: vcDNA=SeqID_66601; Strand=-; Position=1 -87,550-632,695-776,844-867
MSSSTAELNPEDGGHPPQNTAVAIEQSQQAIHPPAQSGSGKIAAWASPNADDTEPYGICAKILIVLSYIITIITFPISVFMCIKIVQQYERA

SEQ ID NO: 140179 - protein, 95 aa, Heterodera glycines
  Coding regions on vcDNA: vcDNA=SeqID_66602; Strand=-; Position=1 -29,194-826
MFEYPKRTLEKIDFFVFGAVPPNRCAQIYGETESFRNSFPIACTLILRWIFAPHKCLSTPNGHLKKSIFLFSGQSPRTDAPRFMGRPNPSGIASL

SEQ ID NO: 140180 - protein, 16 aa, Heterodera glycines
  Coding regions on vcDNA: vcDNA=SeqID_66603; Strand=-; Position=1-49
EAIPEGFGLPINLGAS

SEQ ID NO: 140181 - protein, 131 aa, Heterodera glycines
  Coding regions on vcDNA: vcDNA=SeqID_66604; Strand=-; Position=1 -83,176-298,346-533
MIFAFNCGLMAMFCAAFDRLFAVALPFKHSVIFTKYKYQYLFSHLFICINYGAFIVYNLLKFAFQNAGKPTTGLVSESFQDYVNDFFTDGIYILSLCSACCYMAIFVIIRCKNGGKNVPILHFCQLKYIYY

SEQ ID NO: 140182 - protein, 130 aa, Heterodera glycines
  misc_feature (36)..(36): Xaa can be any naturally occurring amino acid
  misc_feature (48)..(48): Xaa can be any naturally occurring amino acid
  misc_feature (58)..(59): Xaa can be any naturally occurring amino acid
  Coding regions on vcDNA: vcDNA=SeqID_66605; Strand=+; Position=1-399
  Homolog annotation: Hit_ID=BAB33421.1; Match level="QueryCoverage =90%, HitCoverage=41%, E-value=5e-44, Identity=74%"; Hit description =putative senescence-associated protein [Pisum sativum]
SKNIAILPRRDSDLEAFSHNPSDGSFAPLVYRPSTXTKCLNLRFLSYXAGLLLATGLXXGKTNLSHDGLNPAHVPYWWVNNPTLGEFCFAMIGRADIEIKSDVAMDAWPPQASYPCGNFSDTSCWLYTFK

SEQ ID NO: 140183 - protein, 26 aa, Heterodera glycines
  Coding regions on vcDNA: vcDNA=SeqID_66606; Strand=+; Position=1-79
MKHQQQRHQLTNKMPTSMPATTTTTR

SEQ ID NO: 140184 - protein, 224 aa, Heterodera glycines
  Coding regions on vcDNA: vcDNA=SeqID_66607; Strand=-; Position=1 -582,623-715
  Homolog annotation: Hit_ID=AAO51818.1; Match level="QueryCoverage =93%, HitCoverage=12%, E-value=1e-24, Identity=38%"; Hit description =similar to Kaposi's sarcoma-associated herpesvirus (KSHV) (Human herpesvirus 8). ORF73 homolog [Dictyostel
MNQAGAPLVQHQQFVLVPAFPFHTEHRHQQQQQQQNVQRRQQQPQFLPFTPTQQPQQNIAYQRHQFVQQPQDHDYQHLDHHQQQQQQLQQFQNAAPEPQQPQQTILQNQSVGSPQQQQQQQQSLIQQQQHEQATSQQILPHQTPQFQQQQPQEEQTNRLPQPPAPQQQQQILYQLQPMQPYQGEVQHIYNEIHADEMLIQSTSAGANRATGGGPNAKIIESLNS

SEQ ID NO: 140185 - protein, 44 aa, Heterodera glycines
  Coding regions on vcDNA: vcDNA=SeqID_66608; Strand=-; Position=1-136
HLLELKSAGEGQQNPFVFIAEARWNPSDHNFEVLNTETPRGIQK

SEQ ID NO: 140186 - protein, 159 aa, Heterodera glycines
  Coding regions on vcDNA: vcDNA=SeqID_66609; Strand=+; Position=1 -158,243-324,695-931
  Homolog annotation: Hit_ID=CAE63549.1; Match level="QueryCoverage =100%, HitCoverage=18%, E-value=2e-49, Identity=51%"; Hit description= Hypothetical protein CBG08035 [Caenorhabditis briggsae]
MCGRTVLFVPGCDHAGIATQVVVEKKLKRERGLSRHDLGRADFVKEVWKWKNEKGHIIYDQLKKMGAGVDWDRVVFMMDPVEKREITGRTLLSVPGHAEKVEVGVLVLFAYPLEEEVVEEDGSKTREIVVATTRLETMLGDVAIAVHPEDARYKRIIGK

SEQ ID NO: 140187 - protein, 172 aa, Heterodera glycines
  Coding regions on vcDNA: vcDNA=SeqID_66610; Strand=-; Position=1 -98,1197-1277,2090-2173,2446-2515,2564-2587,2927-3061
  Homolog annotation: Hit_ID=NP_509937.1; Match level="QueryCoverage =91%, HitCoverage=45%, E-value=4e-33, Identity=44%"; Hit description =putative protein of bilaterial origin (36.9 kD) (XM208) [Caenorhabditis elegans] emb|CAA91471.1| Hypothet
NSQKILLPSLLSIKFSRPFLIKNSPILVNAPSSVFQVTYLGNMLTIMGKGDTSIDRPLEGAGATFGQQQAQQLAMRLCVCRSGLRAETTLFSVTEYFTHRITWSAAPSQYPRVFCWIYKRVFCWIYKHEGKRMKPELRCHAVLCRRADEPQQMHQTLRRHLQSALQVSNRRE

SEQ ID NO: 140188 - protein, 45 aa, Heterodera glycines
  Coding regions on vcDNA: vcDNA=SeqID_66611; Strand=+; Position=1-138
DRVCSPAGTTIAGLRELERSGVRSAFIEALSASTRRATEMAPKTN

SEQ ID NO: 140189 - protein, 36 aa, Heterodera glycines
  Coding regions on vcDNA: vcDNA=SeqID_66612; Strand=-; Position=1 -33,106-183
MANPIATKKQKRCEFKKSFDIIFGVLRGILALSNDP

SEQ ID NO: 140190 - protein, 187 aa, Heterodera glycines
  Coding regions on vcDNA: vcDNA=SeqID_66613; Strand=-; Position=1 -110,455-541,887-1046,1549-1757
  Homolog annotation: Hit_ID=NP_505460.1; Match level="QueryCoverage =79%, HitCoverage=38%, E-value=3e-26, Identity=38%"; Hit description =i-12 protein (5K16) [Caenorhabditis elegans] emb|CAA94746.1| Hypothetical protein C50F4.12 [Caenorhabditi
SARLPPIPSVQPATDCQTCRGVPLLVEHPAGTYRCPRQFHLRADELRLAIVKEPRLIQFGVGPIQGLILALNQTCGFTQQCLQQIVLKDPRVFLSEKPHVLTSYNYLAYVMRITNEQIVAFPLALRCPLSALRRRHEFLFRLRKANYVPETADHITLEQFCHPSDRFFAEEIARTPIADFNRFIKIV

SEQ ID NO: 140191 - protein, 168 aa, Heterodera glycines
  Coding regions on vcDNA: vcDNA=SeqID_66614; Strand=-; Position=1 -255,603-770,1048-1131
MSQAFGHQLLLLRCRRPSFSPSSSSALFCPLFRATAAAFATVGAKKQSTAQHQGEQQQKQAQQVQQQPLKNAKLQMGNNRRMARLAHADDESADQLAAREDWAHFEMVERQLDELLEHHADKLDEEGDVLGVDMVADPLNEAGGLEPGLLPYKKTTWSFFSFIHSLSY

SEQ ID NO: 140192 - protein, 368 aa, Heterodera glycines
  misc_feature (63)..(63): Xaa can be any naturally occurring amino acid
  misc_feature (264)..(264): Xaa can be any naturally occurring amino acid
  Coding regions on vcDNA: vcDNA=SeqID_66615; Strand=-; Position=1 -102,168-324,378-481,524-645,695-742,788-868,945-1036,1192-1237,1280 -1391
  Homolog annotation: Hit_ID=CAE72855.1; Match level="QueryCoverage =90%, HitCoverage=76%, E-value=3e-68, Identity=41%"; Hit description =Hypothetical protein CBG20154 [Caenorhabditis briggsae]
DAMHAEMFIIFIVSMVVHKIILMLKRRHFRSYRFATLVGLWFATLVGLWLIPFMVSLKNGWWXFILSWTVFTSSNIFVWRRVNQPAISGSTQLVYKYFFMHKLSYIFGILVYKYFFMHKLSYIFGIVGYFSLVFTVIGINSVFGISSNLSLDISSNLSLDFGVHLLFYCLYYGVLGRDLAHSLTDRLACKIGYFTHDGLPKRYQYFTHDGLPKRYQQNGICAVCGNNLHTVVQPKQFQQNGICAVCGNNLHTVVQPKQFQFVGXSEWRKTYALACTYALACNHVFHEFCIRGWCVVGKLQPCPYCKEKVDLKRMFKNPWEKPHLFYGKLLDWTLKPHLFYGKLLDWTLDWEAYLMYMHVKDAITYLLF

SEQ ID NO: 140193 - protein, 49 aa, Heterodera glycines
  Coding regions on vcDNA: vcDNA=SeqID_66616; Strand=-; Position=1-147
CLSTPNGHLKKSIFLFSGQSPRPDAPQIYGETESFRNSFPIAWTLILRW

SEQ ID NO: 140194 - protein, 125 aa, Heterodera glycines
  Coding regions on vcDNA: vcDNA=SeqID_66617; Strand=+; Position=1 -132,183-455
KTLTIKNVNLISKIKNGECGKKKHSRENQGFLGKMLNSSDGGGRGNNERGLRLPMGEEKDEPAETERGSFSPCANQQLEPNISGGGGRGNNERGLRLPMGEEKDEPAETERSSFSPCANQQLEPN

SEQ ID NO: 140195 - protein, 271 aa, Heterodera glycines
  misc_feature (26)..(26): Xaa can be any naturally occurring amino acid
  misc_feature (35)..(35): Xaa can be any naturally occurring amino acid
  Coding regions on vcDNA: vcDNA=SeqID_66618; Strand=-; Position=1 -155,220-245,296-323,387-417,491-557,645-770,1053-1166,1359-1409,1458- 1526
  Homolog annotation: Hit_ID=CAA77131.1; Match level="QueryCoverage =76%, HitCoverage=45%, E-value=6e-55, Identity=57%"; Hit description =GBR-2 protein [Ascaris suum]
HDGLRMVTETQLRPALLLIEKDKMNXLYLFCPVFXLPPFFSYYLIQLYIPCVMLVVVSWVMLVVVSWVSFWLDKDAVVSFWLDKDAVPARVSLGVTTPARVSLGVTTLLTMTTQASGINSKLPPVSYIKAVDVWIGAVDVWIGACLAFIFAALLEYALVNYYGRREFMNIEKRGKSGIQECLCPPSQHLSPGLFCPKSPTKSQQQPQKQLLTVPGLRHLFGSGVDLSKRVDIVSRVAFPTLYLAFLWSVSRVAFPTLYLAFLWSFSLLFRP

SEQ ID NO: 140196 - protein, 20 aa, Heterodera glycines
  Coding regions on vcDNA: vcDNA=SeqID_66619; Strand=+; Position=1-60
FLFAFEFGYILPIDHSPTPT

SEQ ID NO: 140197 - protein, 104 aa, Heterodera glycines
  Coding regions on vcDNA: vcDNA=SeqID_66620; Strand=+; Position=1 -42,215-373,477-569
  Homolog annotation: Hit_ID=NP_499057.3; Match level="QueryCoverage =98%, HitCoverage=5%, E-value=8e-42, Identity=75%"; Hit description =CoLlagen, Basement membrane type, abnormal EMBryogenesis EMB-9, ZYGote defective : embryonic lethal ZYG-6
RGWTPLWSGYSFAMHTAAGAEGTGQNFESPGSCLETFFAVPFIECHGKGTCNYYATNHGFWLAVVEQYNQFRKYNQFRKPMPQTLKAGGLKDRVSRCQVCRKGG

SEQ ID NO: 140198 - protein, 64 aa, Heterodera glycines
  Coding regions on vcDNA: vcDNA=SeqID_66621; Strand=+; Position=1 -144,441-491
MSNCGSDQQIDQQNRPLHDQPQRYIDEDISLTVDQKFEQEAKKPLIEQNVIKTLILLSMSLNLL

SEQ ID NO: 140199 - protein, 67 aa, Heterodera glycines
  Coding regions on vcDNA: vcDNA=SeqID_66622; Strand=-; Position=1 -77,473-599
MLVFTTIFLSLECLEIFTYKNNLHKIYFLIVFVICPRFCCFKKNVQTGSIGDAKYVLILMRERKRNK

SEQ ID NO: 140200 - protein, 51 aa, Heterodera glycines
  Coding regions on vcDNA: vcDNA=SeqID_66623; Strand=-; Position=1 -117,725-763
MVDLEGDKDDDDDNINNNEDAQLDMIFNEGGSGSSRRKEFFFLWKTVLLFF

SEQ ID NO: 140201 - protein, 97 aa, Heterodera glycines
  Coding regions on vcDNA: vcDNA=SeqID_66624; Strand=+; Position=1 -136,203-264,315-410
MPSLNGLGEFMKLFKKSPEQQHFQQMGRPCSSGTVNVQQRHNGCEVTIGTKRQRSTCTKRSIGTDEHSDFIGAEVVKKAALSKPYEQFELQKPSQIG

SEQ ID NO: 140202 - protein, 33 aa, Heterodera glycines
  Coding regions on vcDNA: vcDNA=SeqID_66625; Strand=-; Position=1-99
MAERKEFRRMFDETKMPKANPHFDQLLISFKSG

SEQ ID NO: 140203 - protein, 36 aa, Heterodera glycines
  Coding regions on vcDNA: vcDNA=SeqID_66626; Strand=-; Position=1 -65,125-169
NEFCILSTPSLSRRTAVNARFLASDSRSNSLNDFFN

SEQ ID NO: 140204 - protein, 74 aa, Heterodera glycines
  Coding regions on vcDNA: vcDNA=SeqID_66627; Strand=+; Position=1-222
MKYSLLRPFVNRIFTPGKEQQQLVQRNQNEFGMVKTNAGQSAILLRFVSWISGREQIEQHFSRFGKIKETLMFY

SEQ ID NO: 140205 - protein, 331 aa, Heterodera glycines
  Coding regions on vcDNA: vcDNA=SeqID_66628; Strand=-; Position=1 -267,457-558,867-980,1088-1180,1252-1431,1476-1571,1620-1761
  Homolog annotation: Hit_ID=NP_504466.1; Match level="QueryCoverage =54%, HitCoverage=42%, E-value=2e-18, Identity=28%"; Hit description =putative protein, with a coiled coil-4 domain (5G45) [Caenorhabditis elegans] pir||T34108 hypothetical pr
MGGGDEWRPMECQSKKKNSFHFFGILRQAPPAFARLRSFTDSSFSSVTLPPMGAYEAEEDDALPASGPNRPLPTPAVIGAIEASSGATSSDADQTEVDDELSQFVPMQAARAHWMQLHKQNMQTSFTLIMDNVDDEPSLCQILQELGANHFFYDANETHFKMMREEFLLSLDECVVGTNEQINDELEQDWDQLWAKMESNLAFGLAVQRHNYLAHCVTGKEMDTVRSQWQNLLEAKCRMDALGASVREGGIQTFADGLNRIGLGIETNNEVKRQFTVAVNDLLWAMAQAIELWEPGTGFLRLCAEIDSRCGGAFDVIRTSSSALLRTAFIA

SEQ ID NO: 140206 - protein, 252 aa, Heterodera glycines
  Coding regions on vcDNA: vcDNA=SeqID_66629; Strand=-; Position=1 -151,199-261,383-478,553-695,766-905,1296-1406
  Homolog annotation: Hit_ID=CAE71975.1; Match level="QueryCoverage =91%, HitCoverage=25%, E-value=3e-82, Identity=68%"; Hit description =Hypothetical protein CBG19049 [Caenorhabditis briggsae]
DICNCSILRGKELVDKFYFTTAFKIPDWNVRTSLLLIWRNITARYSDFQALVFDENNFALVFDENNFFSDQMLELKNTTLSSLGTAILAMIFICVLFIADSSIVFWVSFMLVSMDIGVCGYLVSMDIGVCGYLSLWGSDLDPTTVVNILMSIGLCIDFATHVGYRTYRSRCRDPDQRISDSLGAIGWPVVQAGVSTFLGIIVMLLVPSHVVRMAQTMVLVVATGLFHGLFLLPIIIRSFAYGVGDPVHQCDS

SEQ ID NO: 140207 - protein, 100 aa, Heterodera glycines
  Coding regions on vcDNA: vcDNA=SeqID_66630; Strand=+; Position=1 -189,300-413
MHSITTTAITIPAIITAMVATIIPTTTVMAAITMAMGIITMGTVAMATTTVTTTEATPATQAMEVPVLTCPAFIAPMPKCADGDERRKAGKREAESEEDK

SEQ ID NO: 140208 - protein, 244 aa, Heterodera glycines
  Coding regions on vcDNA: vcDNA=SeqID_66631; Strand=+; Position=1-735
TQPINISISETQFSGFPIAGTQPTSISISETQFSGFPIAGTQPTSISISKTQLSDFPIAGTQPTNISITGTQPTNISITGTQPTNISIYEINSQAFQSLELNPPAFQSLGLKSPAFQTMDSNLRHSKHWDSTHQLSMTFQSLELNPPAFQSLRLNYQTFQSLELNPPAFQSLGLKSPAFQTMDSNLRHSKHWDSTHQLSMTFQSLGLNPPVFQSPGLNPPAFQSLGLNPPAFQSLGLNPPHFNL

SEQ ID NO: 140209 - protein, 121 aa, Heterodera glycines
  Coding regions on vcDNA: vcDNA=SeqID_66632; Strand=-; Position=1-366
KKPKGAADDQAEPKKKPEGVDEKPKSEKKPKEEENQADEPKKAPELKTAENSEKPPVAQEKAPPNGTAEDDVQVGKQGEEHKKQEAMQQAADQQPNQTKRRPRVGTDADGRQKSGKKDLIF

SEQ ID NO: 140210 - protein, 113 aa, Heterodera glycines
  Coding regions on vcDNA: vcDNA=SeqID_66633; Strand=+; Position=1 -67,357-409,574-629,782-831,1112-1223
  Homolog annotation: Hit_ID=F89530; Match level="QueryCoverage=96%, HitCoverage=31%, E-value=4e-34, Identity=64%"; Hit description =protein H28G03.1 [imported] - Caenorhabditis elegans
ATTSQHRKLFIGGLSHETTDEQLRDYYSKWGKVIDCIVIRDPVTRQSRGFGFVTYATIEMADSAMADRPHTIAGKVVDPKRAIPREQMLQATSCPPAFLDVEPPSDCKLFLSG

SEQ ID NO: 140211 - protein, 32 aa, Heterodera glycines
  Coding regions on vcDNA: vcDNA=SeqID_66634; Strand=+; Position=1 -33,437-502
MINGRKVDIARQQGTAAQHHRHVKPKSPPLKC

SEQ ID NO: 140212 - protein, 112 aa, Heterodera glycines
  misc_feature (106)..(106): Xaa can be any naturally occurring amino acid
  Coding regions on vcDNA: vcDNA=SeqID_66635; Strand=+; Position=1 -173,384-462,1368-1454
  Homolog annotation: Hit_ID=NP_510486.2; Match level="QueryCoverage =92%, HitCoverage=22%, E-value=4e-31, Identity=60%"; Hit description =putative prenylated protein (50.8 kD) (XP595) [Caenorhabditis elegans] emb|CAB01745.2| Hypothetical prote
QQVHTEDISVPWGQAPDPLDQQFGKWRLSVFQDVQESWDASKLYFLYDPVADESCQTTGGRKAMTCLAVFDTNRKCFVGEIPLRAPTRLKRPFTIRCPWEGGKCAXGLQWYV

SEQ ID NO: 140213 - protein, 147 aa, Heterodera glycines
  Coding regions on vcDNA: vcDNA=SeqID_66636; Strand=+; Position=1-444
MLRPNTAVPGITHQLRKKPSLSLRLWVLNTQMTCAYAKLLGPCFKTGRTDDRLLHRERTTESPSWTELVAGTCRTRPPPTPSSSQHGPETIAQFTQSKQHSPDPGTRPRKAGLKTELTQLLRASQRTPPANAPFATEQKDSKPQSGG

SEQ ID NO: 140214 - protein, 99 aa, Heterodera glycines; identical to SEQ ID NO: 135530
  Coding regions on vcDNA: vcDNA=SeqID_66637; Strand=-; Position=1-345

SEQ ID NO: 140215 - protein, 180 aa, Heterodera glycines
  Coding regions on vcDNA: vcDNA=SeqID_66638; Strand=-; Position=1-540
MAALIQRRPNAPSVASDRVNNPVREWMARNQGGENEPPTQQQPQAQQPMQAEQQRFERLTLNDQGQAFPRASYHVRTRREEHPTRERLRTQGAAPSHHHRSETRAETLTTFETVRLQPPTFSGKPEDWTTFWAYFQRAVDDKPIPGFEKQLHLLRCLKEGSPARRAVEVYPPSDGNYPVE

SEQ ID NO: 140216 - protein, 45 aa, Heterodera glycines
  Coding regions on vcDNA: vcDNA=SeqID_66639; Strand=-; Position=1-136
MLRRVDINVANNTPIAHGVGKGRTPKIFGGTAGQLKDLGRKPKED

SEQ ID NO: 140217 - protein, 115 aa, Heterodera glycines
  Coding regions on vcDNA: vcDNA=SeqID_66640; Strand=-; Position=1 -241,289-492
GSVALFDTLSLSPLSVLRQTHCSFVTALSFLPQRSCDVKDLGHIGETISHNLPSKRCFLPGICADFRCALVSVSVDRTIQVHQFPFPTQSSFSAFLFRLSILTSVLYVLLWTLFA

SEQ ID NO: 140218 - protein, 101 aa, Heterodera glycines
  Coding regions on vcDNA: vcDNA=SeqID_66641; Strand=-; Position=1-438
ALPIPSTIAFIHPIMSAKIIRLPKIACDLSLEKNGLSKNRNYAQKASQTILALPIPSTIAFIHPIMSAKIIRVPKIACDLSLEKNGQVKIVITLKKLLKQF

SEQ ID NO: 140219 - protein, 1514 aa, Heterodera glycines
  Coding regions on vcDNA: vcDNA=SeqID_66642; Strand=-; Position=1 -1033,1172-4680
  Homolog annotation: Hit_ID=NP_498959.1; Match level="QueryCoverage =76%, HitCoverage=55%, E-value=1e-139, Identity=29%"; Hit description= zn-finger, CCHC type and RNA-directed DNA polymerase  and Integrase, catalytic domain containing protein
MVVKTSTFGVETDSMLDGGAQISLISANFLYQLVKEKNLDFDSLEPSQTNVRVLDVNGKMVPCLLKVNLPIHRRGLKSEVKIAVHVTKAPIGFDMLIGTNGLGKLGFKLYDEANDSMVEFENSELNSKNLLTVIYGTTIEPRSTKILEMGVNENYEASELLISSDNSNDLHVEPTVAIANEGKIIVPVTNRSHSKIALEKGQKVGEVEPIFELGESDDMLISPVIVSMLSEPNGETLEKQQLLWETVQKNVGILNEEQSEELRELCEGFGEIFAARDEDLTQTNLVQHKIETGDAPPIKIKMRNVPYAYREKIAAMLQDYLGRGVIQSSISPWASPIVLVPKRDGYWQIKMEDNSVEKTAFTTEYGLYEFKVMPFGLTNAVATFQRFMTRLFDGMINDFVFIYIDDILIASESFEEHTKHLHEVFERIKAAGLKLKMSKCKMCAEELPFLGHILTRSGIKMDADKVKPVVDLPIPKNKKELHSLLGFLTYYRKFIHSFGTIAAPLFKLLSEKVEFKICDDEIKIINYLKGKIVEDVLLYFPDFEAAQNDQSRRFIIMTDASKMGISAILSQPDAEKRIRPIYFASRQCNVHESRYSATELEALAVRFGVKKFAQFVTMIPTRVITDHKALIWMFRSKNETGNARIDRWLLELNSRFILKVEYQPGKKNIIADVLSRSGTGNEIEESEQNSEEIAFIGKIRTTENDLENFGLMEERQEWVEQTKIGEMKPIYEFLERKVLPNDQRDQQRVIDKCHKFVVFKDLLYLSEKEGKMRLFVPQKFRNELVKNRHEGICAGHMSGKKLFKQLSEEYFWPNMLTDCIRAHESCRICAHTRISRANEPPLNVVKSLEPLELVCMDILDVGPSQSNKKYICVIVDHFTKYLVAEPIPDKSAESVAKVFVEKFILVYGTPQKIHSDRGKEFLNATMEEISKVLDIKRSFTAGYDPQANGLAERINRIIIGILKKSTASNWTWDERLAYGVFAYNITPSNVTGYSPFLLMFGRNAKFPLDKHVPFRVNPVYTIDSGKYIQLFRENLLNMLEEAQKNSEEAREQSKIWYDSRPKVTANKFQKGEKVMVVFPGQNRRSPHKKLLWSHFGPYLITEIGDSSANLVPIDKKEITPIKVPIERLVKVPKGVPDISTLPKGKNPFKNDLKLLSMYAGIRSEICEMTGNKCREIGGKSESQLGTIASDCLGGNWKSDSFSEPMDVGSVSAGFGWTSECSGGGSGHELCEKITLGSIDPVLNMSNLGSAVVKTPLQALLSIFLLRSGVASSLTAAQTLVQTIVGAEPKLELCMYTGKRGDQISTGKYPTEEDQRQALEKWVGSCFVARQALTESGYKPLSMQMPEGVNSLPDSEKNKWHEVFKDSSWALERVRATIVHKASRFLAHDRVLLGDSSAEMLAKHINSSYCIGGESSMADLIRQFQPIVLSSRVKALLILAGRDSLMQGETEKSIAAQFEMIVSLCQRFPHVQIFWCPPPYVHAKATECEELITKMHAIISKSPITPIFAPEKGRS

SEQ ID NO: 140220 - protein, 564 aa, Heterodera glycines
  Coding regions on vcDNA: vcDNA=SeqID_66643; Strand=-; Position=1 -178,213-1726
MIIRSPPLTRQRALNLRTFAQNQNAAVEEQQQQQQVEGVHGENEPLVNAPISPGLNRNLMKWKQQQQIEIRRRLLHVSIQSNLPPRANGGGNNGAEQQQIRNANVGHEDFVEGLREVLRPNFGNLLVREEGVRMRFVENGTENRHFERINRNLVRETAPNSRHVSQSELIGCTSTPINFNGELHNFPIVSNQIRHREIYEDFGPYREHENFRSSQIQIRQQPALARQQQNANFGFLPCERQHNEFVGRHLFEDGRQKMHPTEIPRQMHQQPPREERGWQQQNSVLYRPVARQQQNFTVYENQMLPPQSQNLAVLSSLEYNMVLERIPDLNGKEGTDEVKRFFKKFDAYTDSWPDEKRIKGLESKVYGRAERAFEAAKAVIPIKYELLRGEMMRQLEETDSKNLNAFDELMLGVRRKPNESIDDLAGRISGLVKRAYPGLSFQLSDEFSIKYLIRSIGDPTLSLNLELIRTPRMSLDHFVSLAARAESTQRATQRFVSAEKSKIDRNETQFREPRRNFSREYQRQHEFQPIFRDWQPEFQPNNGPIRQNNPSFEPKLWKCYNCNE

SEQ ID NO: 140221 - protein, 71 aa, Heterodera glycines
  Coding regions on vcDNA: vcDNA=SeqID_66644; Strand=+; Position=1 -139,405-481
MYFNLLLFCAFFVSLARTAAQTVQQHEHVHLWKITHSEMKKPSYLLGTTHVPWKILYNKCKFFNYCAVLQK

SEQ ID NO: 140222 - protein, 98 aa, Heterodera glycines
  Coding regions on vcDNA: vcDNA=SeqID_66645; Strand=-; Position=1 -11,75-360
MNRRWICNDVWMDIFPSFDHAQLGLKLALISPRFNALVDKHFNGKSELTIWRPIEISKGIGTKPKLSVITINYGTSAYFPLPDRPLPKKIRFKHLQIK

SEQ ID NO: 140223 - protein, 25 aa, Heterodera glycines
  Coding regions on vcDNA: vcDNA=SeqID_66646; Strand=+; Position=1-75
PRDCPLSPIDCPLSPRDSSNRLAVA

SEQ ID NO: 140224 - protein, 249 aa, Heterodera glycines
  Coding regions on vcDNA: vcDNA=SeqID_66647; Strand=-; Position=1 -413,772-880,1128-1261,1696-1791
  Homolog annotation: Hit_ID=NP_726165.1; Match level="QueryCoverage =57%, HitCoverage=18%, E-value=1e-09, Identity=31%"; Hit description =CG11061-PB, isoform B [Drosophila melanogaster] gb|AAF46804.2| CG11061-PB, isoform B [Drosophila melanoga
TNASTVRHFAVDASSPLADAIPPPGEQQRQQPYDNGENGTQIERTTALGHQQQGEEAKEGTTTNNLATQMEALCRENALYRRTNERLEYWLTALESENESIGEYIALYRFQRTQIQQRIAEKDAALLQLQQQNTQLTAILTELRNAMLAIMQKSDANAATLPTATAKLSVDNCSAITEGNDEHSDCANPTDQQKQQIHPPPMDQLSADRLMRILERSEAISRQATCMAANQAQIHCTGCVECQGELFNI

SEQ ID NO: 140225 - protein, 283 aa, Heterodera glycines
  Coding regions on vcDNA: vcDNA=SeqID_66648; Strand=-; Position=1 -172,480-622,951-1253,2113-2343
  Homolog annotation: Hit_ID=CAE59026.1; Match level="QueryCoverage =92%, HitCoverage=28%, E-value=2e-13, Identity=27%"; Hit description =Hypothetical protein CBG02303 [Caenorhabditis briggsae]
MKAQLEQSIEQQRSELTMRDIYIKQLTRQTANNTTEFEKCADAIGQQNVAHQQSSGGEIQQKRDDDLKWHRNKVLELQKQLQLVQEQQQIENSLANANAKRLVEQLDSVKAQNAQLESFNNVLEERLRILQQKLLLNDNSPPPSNNNNRNENANLTNSADGQQNLLPETEHLSEMNGLMKSVKELTGENEKLASKLCESEQLVQEKDVSLLAAQLQNEKATVSRAVAQNVELKSQLKELQDRLIAVINESAAKEDERTTAMATVERLTKQLLNANNNEEEDEL

SEQ ID NO: 140226 - protein, 141 aa, Heterodera glycines
  Coding regions on vcDNA: vcDNA=SeqID_66649; Strand=+; Position=1 -158,340-422,490-613,665-731
MQQIPILSLSNFLPIFSLISVPFLLSFPSTAFGCSCAPTKFNESMCVAKWVSHVKVLQNTTTTNSHRIFTVRHLEVFKSPNGTAHNDQLIGKESAVWTPIFTAACGVRELDTEKEYLLAGTVDNLGTKKINLCLFIPIEDG

SEQ ID NO: 140227 - protein, 26 aa, Heterodera glycines
  Coding regions on vcDNA: vcDNA=SeqID_66650; Strand=+; Position=1-124
VDRLRIQFDGHRLNSGGGLTDQRVGF

SEQ ID NO: 140228 - protein, 19 aa, Heterodera glycines
  Coding regions on vcDNA: vcDNA=SeqID_66651; Strand=-; Position=1-59
SISNIVCVFGRARLEKANV

SEQ ID NO: 140229 - protein, 19 aa, Heterodera glycines
  Coding regions on vcDNA: vcDNA=SeqID_66652; Strand=-; Position=1-59
TFAFSSLALPNTHTIFEML

SEQ ID NO: 140230 - protein, 19 aa, Heterodera glycines
  Coding regions on vcDNA: vcDNA=SeqID_66653; Strand=-; Position=1-59
TFAFSSLALPNTHTIFEML

SEQ ID NO: 140231 - protein, 19 aa, Heterodera glycines
  Coding regions on vcDNA: vcDNA=SeqID_66654; Strand=-; Position=1-59
TFSFSSLALPNTHTIFEML

SEQ ID NO: 140232 - protein, 19 aa, Heterodera glycines
  Coding regions on vcDNA: vcDNA=SeqID_66655; Strand=-; Position=1-59
TFAFSSLALPNTHTIFEML

SEQ ID NO: 140233 - protein, 59 aa, Heterodera glycines
  Coding regions on vcDNA: vcDNA=SeqID_66656; Strand=-; Position=1 -152,498-525
MKQQQMMDELSSVKTQVEKIGQEQQQQKKEQQEKQEEDAKGKYGNIKGILRKKRRILRF

SEQ ID NO: 140234 - protein, 46 aa, Heterodera glycines
  Coding regions on vcDNA: vcDNA=SeqID_66657; Strand=-; Position=1-258
CTPSGSEPAPSPLKMMPQNPQSHRDSEVLSMLKVKSDHVFVISVIK

SEQ ID NO: 140235 - protein, 95 aa, Heterodera glycines
  Coding regions on vcDNA: vcDNA=SeqID_66658; Strand=-; Position=1-697
MFEYPKRTLEKIDFFVFGAVPPNRCAQIYGETESFRNSFPIACTLILRWIFAPHNCLSTPNGHLKKSIFLFSGQSPRTDAPRFMGRPNPSGIASL

SEQ ID NO: 140236 - protein, 161 aa, Heterodera glycines
  Coding regions on vcDNA: vcDNA=SeqID_66659; Strand=+; Position=1 -41,92-175,269-339,466-520,599-645,706-838
  Homolog annotation: Hit_ID=CAE61968.1; Match level="QueryCoverage =96%, HitCoverage=52%, E-value=1e-48, Identity=60%"; Hit description =Hypothetical protein CBG05969 [Caenorhabditis briggsae]
ILAEDGFDFREIKEFTQLLHSPEFTQLLHSPRRVPPPRYICHICYQPGHYFLSDCPARFNSPYEELTPYQGRKKCYGEFQCEQCKRKWTSQNSVANEAQSCIKCHVPVFPHKQLPVDLPVDKAVALGLVRIFCSLFSCFQKRMLGHGFLEARKKNEWYKLS

SEQ ID NO: 140237 - protein, 122 aa, Heterodera glycines
  Coding regions on vcDNA: vcDNA=SeqID_66660; Strand=+; Position=1 -134,185-417
ETTSGFVGIVPQRFLNIFFDATADEESHFGESSTRENERSNDLTDQLKPWDVPIFQSSNVPSIQKQGSFSCRSSLSGYDSAQWVDSTDAAISHRPPPRPPPPKLCQTTSEVTSPRRHFHQSH

SEQ ID NO: 140238 - protein, 195 aa, Heterodera glycines
  Coding regions on vcDNA: vcDNA=SeqID_66661; Strand=-; Position=1 -177,221-298,564-896
MGVPVPTRPPLPRRPPFRPLPFRSVIAKFLRFFVSVPTDGLAKYVTNLWRIVASIRAKMVLLALSTRTVPSASSVVVRTDGEGFYLFVLSSPRRFPLRFRAHRPAAVLSVRLSLLPQCRLFRFFPHRLFHFDNFTTKECFRPPLSLRVVGKCQLRTRAVCVRADLQNRTTKSTALGRKGTVSDGRTKGTAADNGE

SEQ ID NO: 140239 - protein, 115 aa, Heterodera glycines
  Coding regions on vcDNA: vcDNA=SeqID_66662; Strand=+; Position=1 -72,287-560
TLPKDSVPVEWEHFSAKEVIVDPKMAHTYVTELAGGIPSARGTKYSYTYESRVEEEGNNELLEQSQRRREETDEEEMKQQQPITELRREEEEHELGRELRRGEDGTERHCTSTQK

SEQ ID NO: 140240 - protein, 119 aa, Heterodera glycines
  Coding regions on vcDNA: vcDNA=SeqID_66663; Strand=-; Position=1 -100,405-664
MRLYFGDSYQKIYKTKIGNSIKEIMMPLADLHRVAVHLNFNPENLVVSNKNNAVSVRRLFSKVESTPLKLIGLEGAFFLEMGRNIEKINDDEIEGHHHFSQTANGRYMAPEYLDKKVYT

SEQ ID NO: 140241 - protein, 20 aa, Heterodera glycines
  Coding regions on vcDNA: vcDNA=SeqID_66664; Strand=-; Position=1 -28,119-153
MSTSWTYLAMVKLAKKARAN

SEQ ID NO: 140242 - protein, 282 aa, Heterodera glycines
  Coding regions on vcDNA: vcDNA=SeqID_66665; Strand=-; Position=1-849
MPITFQGSLGGAPPPPPPPPPPLWKGGGGKSPVSFADAIRQKAIDRGGSVGAEPEEKAPQAKAPPPPPPPAKTAVPLSPIAPALSPIRSRRPTPFPRNLAPISDESAQQLTPISRRRGTPLVRKVTESAEEDPQRLGRVRRIFASEESDGSQVEKAATRRRHSTASVSSALSFAGSEVTTPTKSRKRKGTALPKRKAAQRAIIETEAEEQSEEIELGRKGRNKWTEDQMEEIELGRKGRNKRVDVWVEEQRTMGQKADESAEFVPFSGELVNERFAYDKMPG

SEQ ID NO: 140243 - protein, 19 aa, Heterodera glycines
  Coding regions on vcDNA: vcDNA=SeqID_66666; Strand=+; Position=1-61
GSPPEPMRPDLWGDRILRE

SEQ ID NO: 140244 - protein, 105 aa, Heterodera glycines
  Coding regions on vcDNA: vcDNA=SeqID_66667; Strand=+; Position=1 -96,141-362
MKNLLQKCRELDKWATAKAIVLALVSSYNELRLIPQDTVDHESGDSQALPNQETIVDQDSEHFQALRELAKRLALSFGVDSFKNREALAVIHHVNKRNVSKLPDF

SEQ ID NO: 140245 - protein, 152 aa, Heterodera glycines
  Coding regions on vcDNA: vcDNA=SeqID_66668; Strand=+; Position=1-457
FFSFFSANWVPTVAFFGLALSNNLTILKTQTKKFLTKNGYLFFSFFTANLVPTVAFSCLALSNNLTIFETQTKKFSKNGYLFFLIFLPQTWYQQLPSFVWPYQTILRYLKRKQKKFLTKNGYLFFLIFLPQTWYQQLPSLVWPYQTILRYLK

SEQ ID NO: 140246 - protein, 41 aa, Heterodera glycines
  Coding regions on vcDNA: vcDNA=SeqID_66669; Strand=-; Position=1-236
LKITILAFCHYFFTISTFFGKFLNKNAIKPKNTPLRIDLKK

SEQ ID NO: 140247 - protein, 139 aa, Heterodera glycines
  Coding regions on vcDNA: vcDNA=SeqID_66670; Strand=+; Position=1 -135,395-677
  Homolog annotation: Hit_ID=XP_313537.1; Match level="QueryCoverage =51%, HitCoverage=8%, E-value=2e-19, Identity=63%"; Hit description =ENSANGP00000018921 [Anopheles gambiae]
MPTTLGIALVHGYQRVDPDLILPTMRANVERQLDLIAKGKADYQTIKNQTLEIFRQKFLNFVQNINLVDALFGGECRQLIGPINQLIRPIKQFLNSPFYPIRFIYIAGRLGQTVSNVAMAALHEAARDAGPTIVLPDLR

SEQ ID NO: 140248 - protein, 88 aa, Heterodera glycines; identical to SEQ ID NO: 124691
  Coding regions on vcDNA: vcDNA=SeqID_66671; Strand=-; Position=1 -96,135-305

SEQ ID NO: 140249 - protein, 73 aa, Heterodera glycines
  Coding regions on vcDNA: vcDNA=SeqID_66672; Strand=+; Position=1-222
MARVASPPLPADGTALAERIKEAEAREEAALTVDADETVADRPPFVVDGIDEVLADDSEHLRVVIVAKGNKSD

SEQ ID NO: 140250 - protein, 67 aa, Heterodera glycines
  Coding regions on vcDNA: vcDNA=SeqID_66673; Strand=-; Position=1-202
CNGIAAGLAFLSTTVLDLCADAAAGAGDLDVMARVASPPLPADGTALAERIKEAEAREEAALTVDAD

SEQ ID NO: 140251 - protein, 203 aa, Heterodera glycines
  misc_feature (6)..(6): Xaa can be any naturally occurring amino acid
  misc_feature (13)..(13): Xaa can be any naturally occurring amino acid
  misc_feature (194)..(194): Xaa can be any naturally occurring amino acid
  misc_feature (198)..(198): Xaa can be any naturally occurring amino acid
  Coding regions on vcDNA: vcDNA=SeqID_66674; Strand=-; Position=1 -155,443-493,1540-1700,2167-2298,2527-2650
  Homolog annotation: Hit_ID=NP_741734.1; Match level="QueryCoverage =85%, HitCoverage=11%, E-value=5e-84, Identity=86%"; Hit description =UNCoordinated locomotion UNC-2, voltage-gated Calcium Channel Alpha subunit (unc-2) [Caenorhabditis elega
CDFQKXLNYFNYXELFPRVEQREWRLRPLYYDNTIQRMLTLFVVTTSEGWPGIRQNSMDTTYEDQGPSPYYRVEVALFYVMFFIVFPFFFVNIFVALIIITFQEQGEAELSEGDLDKNQKQCIDFALNARPRSLFMPEDKNSMKYRIWRLVTSTPFEYFIMAMIVLNTIILMMKFHGNSPEYEKVLRMFCIYFXIKFXINQLF

SEQ ID NO: 140252 - protein, 77 aa, Heterodera glycines
  Coding regions on vcDNA: vcDNA=SeqID_66675; Strand=+; Position=1 -3,336-521,1203-1247
MVTLGQFSFALFLESDDDQGDKNVDEEEREHDEKHHIKQCHLHTIIRRWALKRVKMGICDWLSAHKEHLDLSNDSKD

SEQ ID NO: 140253 - protein, 206 aa, Heterodera glycines
  Coding regions on vcDNA: vcDNA=SeqID_66676; Strand=-; Position=1 -123,375-515,929-1035,1088-1193,1275-1307,1360-1399
  Homolog annotation: Hit_ID=NP_741734.1; Match level="QueryCoverage =100%, HitCoverage=56%, E-value=6e-79, Identity=53%"; Hit description= UNCoordinated locomotion UNC-2, voltage-gated Calcium Channel Alpha subunit (unc-2) [Caenorhabditis eleg
EESPFGGPKPLVPYSSMFLAPQTQFPCWVHSVVATKYFEMVVMAVICASSISLAAEDPVDDDNPRNKILQYFDYCFTGVFACEMLLKLIDQGVILHRGSYCRDFWNVLDGVVVACALVGFAFSGTAGATGKNLSTIKSLRGTAGATGKNLSTIKSLRVLRVLRPLKTIKRIPKLKAVFDCVVNSLKNVFNILLNVFNILLVYFLFQ

SEQ ID NO: 140254 - protein, 209 aa, Heterodera glycines
  misc_feature (163)..(163): Xaa can be any naturally occurring amino acid
  misc_feature (166)..(166): Xaa can be any naturally occurring amino acid
  Coding regions on vcDNA: vcDNA=SeqID_66677; Strand=-; Position=1 -28,138-274,413-472,658-778,997-1073,1448-1610,1835-1906
  Homolog annotation: Hit_ID=AAP13107.1; Match level="QueryCoverage =96%, HitCoverage=10%, E-value=1e-79, Identity=74%"; Hit description =high voltage activated calcium channel alpha-1 subunit [Caenorhabditis elegans] gb|AAP82640.2| Uncoordinat
CFYMLKFYFISLRNLVRSLLHSMRSIISLLFLLFLFIVIFALLGMQLFGGKFNFQNMHPYTHFDTFPIALITVFQILTGEDWNEVMYLAIESQGGVYGGGMVYCVYFIVLVLFGNYTLLNVFLAIAVDNLANAQELTAADEADEKANGIEDESETLGNKYSNXNNXDYDEHDLEAGPDGEFTRELDGLEEECDEEESPFGPKPLCIFRM

SEQ ID NO: 140255 - protein, 86 aa, Heterodera glycines
  Coding regions on vcDNA: vcDNA=SeqID_66678; Strand=-; Position=1 -77,364-406,795-935
  Homolog annotation: Hit_ID=NP_741734.1; Match level="QueryCoverage =94%, HitCoverage=9%, E-value=6e-24, Identity=48%"; Hit description =UNCoordinated locomotion UNC-2, voltage-gated Calcium Channel Alpha subunit (unc-2) [Caenorhabditis elegan
MAPLLQIGLLVLFAIVIFAIIGLVSASNKSSSTGAYNCDVTNDSLGSTYNWAYFIPLIVLGSFFMLNLVLGVLSGEFAKERRVQLI

SEQ ID NO: 140256 - protein, 222 aa, Heterodera glycines
  Coding regions on vcDNA: vcDNA=SeqID_66679; Strand=-; Position=1 -130,171-223,270-291,340-419,465-628,674-731
  Homolog annotation: Hit_ID=CAE61810.1; Match level="QueryCoverage =86%, HitCoverage=92%, E-value=2e-57, Identity=57%"; Hit description =Hypothetical protein CBG05777 [Caenorhabditis briggsae]
IRRMSSTKSSHVVFETSMGAMSIELYWQHAPRTCMNFQELARKGYYNNTIFYYNNTIFHRIIADFMVQGGDPTRTGGGDPTRTGRGGTSIYGSRRGGTSIYGSRFADEISDELRHTGAGIISMANSGPNISMANSGPNTNGSQFFITLGPTQHLDGKHTIFGRLATGMKVLQKIGQVTTDNSDRPTNDVKIVKAYPRSEILSNPTNDVKIVKAYPRSEILSN

SEQ ID NO: 140257 - protein, 303 aa, Heterodera glycines
  Coding regions on vcDNA: vcDNA=SeqID_66680; Strand=+; Position=1 -114,177-347,392-511,563-662,712-818,862-938,1002-1224
  Homolog annotation: Hit_ID=CAE73363.1; Match level="QueryCoverage =83%, HitCoverage=70%, E-value=2e-94, Identity=49%"; Hit description =Hypothetical protein CBG20797 [Caenorhabditis briggsae]
MGPSRGPTIAKTRGIRDGAGRAMGGHWGIERSQRRVEMYPIQKPELFQHFGTSAQPQGILLSGPPGCGKTLLAKAVANETGMSFISVKGPELLSMYVGESERAVRTVFQRARDSAPCVVFFDEIDALCPKRSQRENSGSSRLVNQLLTEMDGLDGRRNVFLIGATNRPDIVDPAITRPGRFDKILFVDFPSPSERADILQKATKNGTHPRISPSVRFDAFASNSSLDFFTGADLVALVHEATLCALRERIDQNDSRIDSVQSHHFEEALRRIRPSVRQSDREHYDKLREKYAAGTETKPMDNE

SEQ ID NO: 140258 - protein, 109 aa, Heterodera glycines
  Coding regions on vcDNA: vcDNA=SeqID_66681; Strand=+; Position=1-330
MGVAVTAVAVTVGEATGVGHTVAAVTAAEIMEVAVTAVAVTVVEAMGVGHTVAAVTMVEAMASGGYGGRNFGNVGLTAGRGTMALVVVTVVADMANSLCKMKQGFLSFR

SEQ ID NO: 140259 - protein, 384 aa, Heterodera glycines
  misc_feature (9)..(9): Xaa can be any naturally occurring amino acid
  misc_feature (345)..(345): Xaa can be any naturally occurring amino acid
  Coding regions on vcDNA: vcDNA=SeqID_66682; Strand=-; Position=1 -60,2415-3552
  Homolog annotation: Hit_ID=NP_510671.1; Match level="QueryCoverage =98%, HitCoverage=39%, E-value=5e-73, Identity=39%"; Hit description =predicted CDS, endonuclease/exonuclease/phosphatase family and RNA -directed DNA polymerase (XR69) [Caenor
IQCKKQFYXLLKRTIRLRFINSCGRLEAIINGKNVDCIYIDFQKAFDSVPHELLSYKLEKIGIRGKLLMWIKDFLSNRTFRVKIGDDLSSSKVGSGVPQGSVLGPLLFLIYINDLPDALPSEVRIKLYADDVKLYISDTEIMHKALHNLSEWANKWQIRISIKKTFVLHLGNKNPKEIYKIDGNIINVADTIRDLGINIDNKLQFSNHVTQITKNAYLRMRSLFRVIKSKSSRIWIILYKTYVRPLLEYAPEVWNPSLLKNIKKIEKCQKYFTKRVLFKCSLPPIPYQNRLEYLQLPTLESRRKLSDLFMAHKIIYGRTEIPLKYSNLLNALTFPFIDLTRNINXAKKPFARVTKIWNQLDKKLIEINSLSFKNTTISFPVIPE

SEQ ID NO: 140260 - protein, 27 aa, Heterodera glycines
  Coding regions on vcDNA: vcDNA=SeqID_66683; Strand=+; Position=1 -77,494-500
MFFIYLLIENKIQFNSVDLSVDNLFFF

SEQ ID NO: 140261 - protein, 34 aa, Heterodera glycines
  Coding regions on vcDNA: vcDNA=SeqID_66684; Strand=-; Position=1-104
IFRLHHGEVIAGMDRAMTSMCEGERRRVVIPAAL

SEQ ID NO: 140262 - protein, 267 aa, Heterodera glycines
  Coding regions on vcDNA: vcDNA=SeqID_66685; Strand=+; Position=1-804
MKFAKKMLMIPEAEYLALRSAMNSGDYLQNEKASLDAKISQNLQDPGISEDLKAKRHDWLYKERRTVKGILENRPQKVVIENHVPGPNVAPYLGLNNQSKLQETDEPRKIIIPKKRLEEQTPDPESDNDTINELTPEPQTTSTLKTPIPIKTIIHPTLLNGLFRYVKENKDLFKITAAGKVQSNMNLPIENSNYRDVLLYLAGKKDETPRGAKFLKDRLLKDPTVKDMVDKSKVMWGRGRKKAIKSIKTPGIVREKKPFKPLIWARL

SEQ ID NO: 140263 - protein, 131 aa, Heterodera glycines
  Coding regions on vcDNA: vcDNA=SeqID_66686; Strand=+; Position=1 -195,743-943
MCFGGKGTSQDYPSFMAKIRWPMEASSHGLCGNILWKDVSRHCRRIFQVARNIRDEFHRFEPLRLIRQGKGGFNVFMVHLVLFKSATFVSLMKWIKTVPLLETNNKSPMSPTNKSKFDVQNVNGVQQRNWI

SEQ ID NO: 140264 - protein, 91 aa, Heterodera glycines
  Coding regions on vcDNA: vcDNA=SeqID_66687; Strand=+; Position=1-276
MDPKNGQLSRAMRNRAVELAFGMDTVSVTAAASAIKPPVWSANAVDVVSAVPLLPRAELLSSSLNSIATPIVPASSKQLQLVSQLQHKLDG

SEQ ID NO: 140265 - protein, 135 aa, Heterodera glycines
  Coding regions on vcDNA: vcDNA=SeqID_66688; Strand=-; Position=1 -74,479-669,721-863
  Homolog annotation: Hit_ID=AAV34698.1; Match level="QueryCoverage =74%, HitCoverage=44%, E-value=3e-11, Identity=37%"; Hit description =IC5 [Globodera pallida]
MNLILWDLINIFCLLNNKFFKGQLNTISIGIWTKSDDTFYKYSNNGFIFGHSATGLGGYPSFAEGDTIGCGANLTSMEIIYTKNGQKLNTSNLFVFDNELLPFVQVNTLGDVIEADFGPVFEYKNVSDLFATQIA

SEQ ID NO: 140266 - protein, 222 aa, Heterodera glycines
  Coding regions on vcDNA: vcDNA=SeqID_66689; Strand=+; Position=1 -85,125-189,233-316,438-482,535-628,949-1054,1148-1337
MNFWHFAIVLLHLCMQMLSEPTAEVQENVKNIRVEINDLRENISRLFTKFTKIELEQKQIEEALNDQLLVTQEQKSAVNETRETEQLKTLEFKPKNQWSVNKSDSELFIFKPKHLKAIHRGKEIGRRRELIAESVLLPYFEVVYYETKIIRKQLNIEGSSSIGIGLFGKSLYMYGDNGFIFGHNVNGFWGYPSFEEGDTIGCGANLTSMEIIYTKNGQKLSE

SEQ ID NO: 140267 - protein, 53 aa, Heterodera glycines
  Coding regions on vcDNA: vcDNA=SeqID_66690; Strand=+; Position=1-691
WSFFKKSSNIIKIITKRREYIQIYKICISKWVIEVSNQGTKLFYVHFNKLFPA

SEQ ID NO: 140268 - protein, 47 aa, Heterodera glycines; identical to SEQ ID NO: 139606
  Coding regions on vcDNA: vcDNA=SeqID_66691; Strand=-; Position=1-141

SEQ ID NO: 140269 - protein, 53 aa, Heterodera glycines; identical to SEQ ID NO: 128752
  Coding regions on vcDNA: vcDNA=SeqID_66692; Strand=+; Position=1-160

SEQ ID NO: 140270 - protein, 49 aa, Heterodera glycines
  Coding regions on vcDNA: vcDNA=SeqID_66693; Strand=+; Position=1 -54,95-307
ACHKSVKGSDGADSALLSLCAAELTTLLRTNLHADSQLEAEMHECDRNM

SEQ ID NO: 140271 - protein, 48 aa, Heterodera glycines
  Coding regions on vcDNA: vcDNA=SeqID_66694; Strand=+; Position=1-145
LMPIKIRPSIVFKNLIFCKSRLSFEFRSARRSIGLLHLACARTPLLRR

SEQ ID NO: 140272 - protein, 44 aa, Heterodera glycines
  Coding regions on vcDNA: vcDNA=SeqID_66695; Strand=-; Position=1 -43,92-183
MANVANDYLMRRYPSRRKACRDPLALPCVGSPYSALNELNFDEK

SEQ ID NO: 140273 - protein, 30 aa, Heterodera glycines
  Coding regions on vcDNA: vcDNA=SeqID_66696; Strand=-; Position=1-91
MPLSECQKHQKNEGSKGVDKEDKYVNNIIL

SEQ ID NO: 140274 - protein, 95 aa, Heterodera glycines
  Coding regions on vcDNA: vcDNA=SeqID_66697; Strand=+; Position=1 -175,552-665
LNVSTNIFLSQFLLKFCQIQTSAFMNSIMVNDSLLLNNFIWDKISQQNETKIMTPYTEFLFDLDSNRFNGFLIVITNKMHITRRVVPPVSASILT

SEQ ID NO: 140275 - protein, 80 aa, Heterodera glycines
  Coding regions on vcDNA: vcDNA=SeqID_66698; Strand=+; Position=1-243
VRADGQTADPFSLVFSCAAAEQKGLNSNTSSTVPRAQNAAAASRPTDPRPNAIQTVHAASAAAVGGGDFLIPLYILLKIK

SEQ ID NO: 140276 - protein, 21 aa, Heterodera glycines
  Coding regions on vcDNA: vcDNA=SeqID_66699; Strand=+; Position=1-122
KDVIHLPFDRKSIREPYLTFN

SEQ ID NO: 140277 - protein, 166 aa, Heterodera glycines
  Coding regions on vcDNA: vcDNA=SeqID_66700; Strand=-; Position=1 -259,545-783
MSSVEDEEDSGTNAGDDGWMVVKKESFKKLCDFYEKRRRVECGGGTVAADPFAEQLEREFREATMADNNSNNRTDERVDEKLTAESEPKKADEFVKEVGQEPAAEVYVAQIVDLTTEKDGKSEKSEKVVHNSSVKEGKGTFFKTTPCVHSVVMRGVCAGCGQDFRQ

SEQ ID NO: 140278 - protein, 1100 aa, Heterodera glycines
  Coding regions on vcDNA: vcDNA=SeqID_66701; Strand=-; Position=1 -2906,3024-3418
  Homolog annotation: Hit_ID=NP_504188.1; Match level="QueryCoverage =21%, HitCoverage=62%, E-value=6e-18, Identity=26%"; Hit description =predicted CDS, gag protein like (5E786) [Caenorhabditis elegans] gb|AAB63928.1| Hypothetical protein ZC13
MSELLRISIAPMVVRLKMYIETAQENLGKELADQSVRADLIAERQNLCKTISLLEKYNGKWEAIFLRVKGQALQDEEQNYRDFKPEGKAFMHWVDQARGLVDTIEGALGLSELGDAIPQPNQPAQVVQQPQLVHQRHDVTLPPITLPKFSGEPREWPLFWKLFETSVESLQIEDFKKHIYLLGCLPEKSVARRAIDLYPPSDENYPRVVEILKKRFGDEKTMVESLQAELLHLPKPAESVQSLRQFSESIERICHQLLDYGENEQNKFMASTIKSKLPYHLLTQVVEKEMRAGGAFNCTELRRAITSIVEVKEEVQRCTQVFRGEEKPRNFPPHSNGGRANQGRGTPFRFSQPFRQEWQWRPMERNEPVRRMSPQPNRSFSAINKSQTPISDRGSNRLCSLCEAKGHAPSRCTKYTTPGARRKRLADQDRCINCLIMGHNSLNCTSPRRCSQCGERHHFMVCYGGEKQWNIPPQVQRNNFHGMGTESPPNQFIQGHERPDNRNDSVGMMSPQVNRSFLTLTSPQFSQRKIGTGTRQTCSLCCAMGHPPSRCPQYSTPGARRRRLAKQRKCFNCLMKDHKAQQCQSPKRCLKCGGKHHYMICYHGDAPIGSTPQQIREGRTVQKKQSSKQRGEFPRSKTLYSGVSSRVEDKPSESIAFDCSSTSGLKNVTNKSHSFFCRAMVMPKHDHQKMIEKSVLFDQPSQISYQSDSHFGEQKTPKVTPTDKKICGCCIKKNGVVSHSVFSIRINRMDNKWEETLPNRTEQSIIALTLCFYISISLMVLSILKALSIGRKTIAWLMIQLKVSLLCFEDQSTPCFQEGRQRGAIPQFCTARHILQIMAFTVILACLFPLPVKGGTETNAYPTNHCNECKLLCFNKGVKAKIPKEINKVELCCAENCYIHENVKQLTYELPKEILLNDFQCEGHFWMDSKHMFKKDMLCPAVDECELIECYFCIEQLANPTCYPLISSMPIIYLAGPNRLPKERRPRATASQNWTSRRVYRTMAFVVLMANSLQDLTGAETIAVMAKSEKCIKNATSMRCIVENSAMLTLLPVGQTNTLLLKTDEGVILGSINVVLKALALECQSFTKAWQRSYAINVLA

SEQ ID NO: 140279 - protein, 120 aa, Heterodera glycines
  Coding regions on vcDNA: vcDNA=SeqID_66702; Strand=+; Position=1-377
MALTREPFTIDFNCKNRQEAIDFNCSLGVQACTDCIPDHSSGLVNCNCRSHNLEKLMESPERRLPLNIKNYQLRNTGRKVIALTGFSPVQLNLQIEGLQMALELHQSLCTILPLNISGCY

SEQ ID NO: 140280 - protein, 214 aa, Heterodera glycines
  Coding regions on vcDNA: vcDNA=SeqID_66703; Strand=-; Position=25-669
MPIPIREGPYFSARRVVIPENAEVFNDRLYGLGDPRFEEEERVPRWQEPPIPRQIESLSSWIERSYGPHWYETARERRAVEARLRGELREGATLLGEHFGRIAEIHFDGFTCYGPEGLFISPGITLFDHFVRLGLQVDPVKPCIQEYVGFSPREQGMLVDIYPIELVNIRTRIGVAWRAPAVLEEPHPPLRDHQLPDGRLENRPPRVARRLPNR

SEQ ID NO: 140281 - protein, 34 aa, Heterodera glycines
  Coding regions on vcDNA: vcDNA=SeqID_66704; Strand=+; Position=1-106
CPFGVLKQLWGAKIQRRIKVQAIGKLLPKDSVSP

SEQ ID NO: 140282 - protein, 39 aa, Heterodera glycines
  Coding regions on vcDNA: vcDNA=SeqID_66705; Strand=+; Position=1-119
KIDFFVFGAVPLNRCAQIYGETESFGNSFPIACTLILRW

SEQ ID NO: 140283 - protein, 125 aa, Heterodera glycines
  Coding regions on vcDNA: vcDNA=SeqID_66706; Strand=-; Position=1 -228,271-417
DTLNALGLLLTGLPSSFQAFFLDRIEESFEWSQIASADADPSQLFESLSHEVYLHSDSRILSMLALIHSFCQHGGNNSLSIIPDFVINRLAHKVDNEAQLVYFLRIVVPYLQRIHEKERNKHMPE

SEQ ID NO: 140284 - protein, 62 aa, Heterodera glycines
  Coding regions on vcDNA: vcDNA=SeqID_66707; Strand=+; Position=1-209
TEGTANPSLEASRPTYSNKRVNAVQIRQLCPFPPHRFHVLFNSLFKVLCNFPSRYLFAIGLV

SEQ ID NO: 140285 - protein, 51 aa, Heterodera glycines
  Coding regions on vcDNA: vcDNA=SeqID_66708; Strand=+; Position=1-153
MGRDRPEFDTPGKLGRMTDRWGKGNVGKSEGQKDDVSLAILTKQLIHSAEY

SEQ ID NO: 140286 - protein, 100 aa, Heterodera glycines
  Coding regions on vcDNA: vcDNA=SeqID_66709; Strand=-; Position=1 -100,155-335
  Homolog annotation: Hit_ID=AAK94490.1; Match level="QueryCoverage =100%, HitCoverage=9%, E-value=3e-41, Identity=86%"; Hit description =PAZ/Piwi domain protein [Heterodera glycines]
DTLQTMVHYLCSSQIVRKPTSLPSPVYIADEYAKRGRNIYAKRGRNIYSHYAKNGIDNSKNLQLFAKNKGVEWPLRTYADMTKVLSFLNTTYLRELRINA

SEQ ID NO: 140287 - protein, 31 aa, Heterodera glycines
  Coding regions on vcDNA: vcDNA=SeqID_66710; Strand=+; Position=1-94
RETEKQSDRCAAHCRSGPLGKQRQNKAANKT

SEQ ID NO: 140288 - protein, 44 aa, Heterodera glycines
  Coding regions on vcDNA: vcDNA=SeqID_66711; Strand=-; Position=1 -52,459-541
MVENFKTLPILSVFRGDLIILCDVTDQKVINRSDQIFYEWMMLN

SEQ ID NO: 140289 - protein, 25 aa, Heterodera glycines
  Coding regions on vcDNA: vcDNA=SeqID_66712; Strand=+; Position=1-76
IRRGTTVIRRGTTVIRRGTTVIRRG

SEQ ID NO: 140290 - protein, 302 aa, Heterodera glycines
  Coding regions on vcDNA: vcDNA=SeqID_66713; Strand=+; Position=1-909
  Homolog annotation: Hit_ID=CAA82797.1; Match level="QueryCoverage =45%, HitCoverage=21%, E-value=6e-15, Identity=38%"; Hit description =gag protein [Ascaris lumbricoides]
MSSARCRMALGPALFRLRQHVTTAENLLDEPMINAETTENLEQERGHITRILSRMEVELDAWGAIMNGLQGPAREAEEAFFTAFIRDDRHLTEWLEDAREMLAHIAAELADEPNQPIAAGGQQPAVAVNPPVPAVPFVNNAAFLGGANVQQPAAVANHANQPPLVPINAQIVPNLPAVAAPAPLATARLPQLSLPVFSGEPMEWPAFWQSFESAVDRAALEPVDKLNYLHGCLRGKAARAVTAYRGGDNYAHAVAALRRLFGDPRKIAEALQSELINLRPVDDSVGSLQHLLETLERVCRQL

SEQ ID NO: 140291 - protein, 58 aa, Heterodera glycines
  Coding regions on vcDNA: vcDNA=SeqID_66714; Strand=+; Position=1 -93,479-560
  Homolog annotation: Hit_ID=NP_871713.1; Match level="QueryCoverage =100%, HitCoverage=12%, E-value=2e-17, Identity=68%"; Hit description= na+-coupled DiCarboxylate transporter, high-affinity plasma membrane transporter INDY2 (nad-2) [Caenorha
MPIGITALLPTVLFPALGILSARAVAHEFLNDTNFLFIGGLVVAAAVEKCGLHERVAL

SEQ ID NO: 140292 - protein, 53 aa, Heterodera glycines
  Coding regions on vcDNA: vcDNA=SeqID_66715; Strand=-; Position=1-212
FEYPKRTLEKIDFFVFGAVPPNRCAQIYGETESFRNSFPIACTLILRWIFAPP

SEQ ID NO: 140293 - protein, 102 aa, Heterodera glycines
  Coding regions on vcDNA: vcDNA=SeqID_66716; Strand=-; Position=1 -273,745-780
MKIGKRFIYKLKFKEEIVRVLIENGTTLVIKPNGAEGTDSAGAVRAELGQQLASGWHHVALHRDAQTLRAMVDDTHEETLAAPIEDASDLLLFTFSSSRQLN

SEQ ID NO: 140294 - protein, 93 aa, Heterodera glycines
  Coding regions on vcDNA: vcDNA=SeqID_66717; Strand=-; Position=1 -140,244-382
MDSPKCQTLNFARPFFPNNFVLLEVEKSVADAFSSSNMITDQFNHESLSLTIRGHCSDPLVVCTSSRTFGAKDVEVSNTLLLLDGTPNSAGAN

SEQ ID NO: 140295 - protein, 74 aa, Heterodera glycines
  Coding regions on vcDNA: vcDNA=SeqID_66718; Strand=-; Position=1-224
MTFYASHHILRVPTTLYASHHILRVPTTLYASHHILRVPTTLYASHDILCPWRGWHSEAPKIFGNRNSVPSLVS

SEQ ID NO: 140296 - protein, 100 aa, Heterodera glycines
  Coding regions on vcDNA: vcDNA=SeqID_66719; Strand=+; Position=1-305
  Homolog annotation: Hit_ID=NP_217150.1; Match level="QueryCoverage =57%, HitCoverage=7%, E-value=3e-11, Identity=53%"; Hit description =PE_PGRS [Mycobacterium tuberculosis H37Rv] ref|NP_856313.1| PE-PGRS FAMILY PROTEIN [Mycobacterium bovis AF
GIRGGRGRVGGFGVSGGGFRWRGAAGGRGVGGVGGRGGVGGRGGGGGHGGGAGQGWHGIPSSDFRHFWGRNSDFRLPKIFGASEFRLPTSEIFDEKSEFF

SEQ ID NO: 140297 - protein, 937 aa, Heterodera glycines
  Coding regions on vcDNA: vcDNA=SeqID_66720; Strand=-; Position=1 -237,553-1047,1093-3174
  Homolog annotation: Hit_ID=CAE59944.1; Match level="QueryCoverage =29%, HitCoverage=25%, E-value=1e-12, Identity=27%"; Hit description =Hypothetical protein CBG03431 [Caenorhabditis briggsae]
MDTDVNANQEVPPIQTEEEFENVEEMDESQNSVLKYLVCQTDAKSVVGGKLSGQGPFFMGIPDEIVSAKRRLQMGDVVMLASITSPQEWWMGENYLLPHPTPYMKGDEIKAHANHVVIGAKDCNDSFCFPLDTFSERLMGAAAAVQRTHEMVKLAKQAVTVQLVWDRPQVRDEEVQRNLKKAQLLSFDWTLTNKSSVADFLEAWEEDTPVNAKIANDTKAHWCAHGHVISASASEINPGIFTIKAWEDWENILDEMESYLVLVPNYGGLTFREMCFEKTILSDIAQGNAPVSHILRVLMGKGTDETRTAVRLTEKVGKLNEEQRIAHSLFLDQETRVIFMQAPAGTGKSVSVAECIASVLKKDPDAAILAVSPLNVAVCELVKDTMEALTEKVPMLALFSGQGKGRYMDRIRPLGDNLLVEAVQRYGNIPPTEGAPGKRWNEEKLFQKYVDDFNRAPRRARERTTTAALLNMTKYRVYFMTLALAEELALDLGNINYVLVDECGQATLSAILSTLTQFRKVRKILLTGDKQQLRVHLPSQMLPIRGKYGFESVLEVLERAKGIDRTVLSRCYRSHSAIVKCLDAGVYAPAGDRLVPGKPDTEMSFFLNFMGPRIVTENCPVILIHQKTPAQQESVSFSSHNPEQRETALEFLGIIQRTFSGLIQIVCFYQAERKQVTLEIERRNWQNVKAGTVDSIQSQEADLVIVLTTRTGAGRTEDVNIGKEFWADAARTTVAVSRPRFGLIVIGDLTLLWHKGEVWRRFLDQALKMTVAVTPDYIGLISNPWPNRVGNTITRPNGSVPMAYEFYAERDSTLRHESLGQRINTTNFSSPSFLGNSFSVFAHPVLPCANTSSLAPSSAHSFGMMVIDTSVPPPAVYARTGRAGPNVRMTPYPPQREPRTSYAEAVEHGRPAPKERRTDVVCRRCGRFGHIEKRCRT

SEQ ID NO: 140298 - protein, 70 aa, Heterodera glycines
  Coding regions on vcDNA: vcDNA=SeqID_66721; Strand=+; Position=1 -124,349-437
MAKRTVIKKLQSKKSVQKTWNNCEERKAQTQRATEARLAKKNFKLSNDTKNVCIDQVIKKGMTYKSEDSH

SEQ ID NO: 140299 - protein, 524 aa, Heterodera glycines
  Coding regions on vcDNA: vcDNA=SeqID_66722; Strand=-; Position=1 -225,613-1620,2335-2391,2449-2733
  Homolog annotation: Hit_ID=NP_500013.1; Match level="QueryCoverage =48%, HitCoverage=20%, E-value=4e-49, Identity=38%"; Hit description =predicted CDS, polyprotein family member (4B673) [Caenorhabditis elegans] gb|AAC02594.1| Hypothetical pro
MDAIMERVANCHYYSSLDLSSGYLQIKLSEEASRKCGVITEDGVYQMTHMPFGLKNATAAFSRAMARVLTGLNDNKIKDLLSHEPLLTFPDYSKPFHVFTDASLVGQAGVLMQKNNNGVFSAISYCSRTLSASERKWPTVQIELGAIIYALREFKPFIFLSDVELHTDHKPLAYLLKKAEAHPNLARWLIELQAYQIKIVHISGKQNSLADALSRAQENISIKEVQNLDELDDIAEFPICLSLTIDQRVIFDPFINNLILRGKDGHSYDIDLKKEQREDPQCSKLINFLQRGKFPDEMDPQSMENLTENAKNLVMDSGILYFKYSEQSPRIYLPISLRSLIFDSFHSSPLGGGHMDLKKTLKKCRKYYWPLQYSDILSWYKQCITCQLRHSPSPAFRAEMQMVPANTLFARLPWKGVFRIIKIDGIYATIKCVEILGPACTSPWLSPEENNALVEAESEEIADLPGHSHPIIIKEQIELPAQNHANDLVSDTQNIENDTCEPTQLPHYALRNRTKLNKPARYLD

SEQ ID NO: 140300 - protein, 601 aa, Heterodera glycines
  Coding regions on vcDNA: vcDNA=SeqID_66723; Strand=-; Position=1 -54,148-966,1088-2018
MFNVTDINFHAFIHNLVKKEIFGDWSYIWKVIITIISLISLIDVLLRFGIFALQIYLGNGRLGSLLLGNQTIRTAQNIIQSLPQSSNSQPSQSPIESFDIKFVQVNKIPSPSKQMNSPQRDSKSETICESIFMLRSYAEFKEFGFIPANLDLPIFLIKINGVEFRALVDSASETSVGSDRILYLASVPKSAQREVNIRFRSLGMNPLEVSGDSLVGKIVAWAHLAKGEDILGEAPLLFTDHSVFENECFDLIIGANLIDRFGGVTILPKERKIIFGCTLTNNVRAISPISQKVDQSPRFEKISVNFLGSISPNCSIITSRINNVKNPSLVDTGASISVAPKLMAPIWQCIPYPTFVNVISASGHTLELTEKVSVVFSIGNFEIKETIYLVDDNKFKTSAYNLLIGCNILGKLPPFTFDYPNSKFSVGNFITPLGSLPNNSLLNNLRIQAINSLILPPNKGTIIQAQFDPSIVSDKPIYIHSLDKKLLNEHFGLIPLIVEPFRGTVKILIINPTAMPFQIYKGKHLAYADEVRQINNYTMSNSSEDLMAMSISEGVVVDPNFKIDLSKSSVVGKDLEKLKSLCDEFYDVFSQSQYDLGSFTE

SEQ ID NO: 140301 - protein, 300 aa, Heterodera glycines
  Coding regions on vcDNA: vcDNA=SeqID_66724; Strand=-; Position=1 -191,1564-2274
DTKSHQAKMEAETEENKWEMLNARSREERKKAMDCVKGSELIKAFQHKMFSDETTSEQLGKSIRNIAELKVDVNKTKKLHKQNSRTRRSRRHKDDDGDPINLLKRNLSRRGEFSYGPPPPSHSSSSSLSSSSSFSASHRLRPPLPHRRKSSPPAEVKNVDLSSSPVAGTSSGPFDVAENVHGLPILDESYKFLRSNSVKEAEEKRRQQRQHYEAVVRRNGSTKSPNCMGGNGLDDEDSDDVEEKVENDEPNFDMDSPRNVQQQSYHDGGHRRLDKSESKKMLADKKQQLAEAEAELEMQL

SEQ ID NO: 140302 - protein, 250 aa, Heterodera glycines
  Coding regions on vcDNA: vcDNA=SeqID_66725; Strand=-; Position=1 -223,825-1354
MEEINPKLSDIFDKTEKGAEFSFGNHIFNAVERKNGIVGKLLYDWEKKKLYEWDRNQMSIWVAKQYKNPDPPEHRHKLYEHGLTNSDNHERIHLIIHVLLVDAVFDRLARDLCSKTAFEVQFRNWAAVAKQMEGEEIRNYVCTPLNNVNCLLSACWAGGGHVWPKGLWPNFIANYRTQLRDRPWAGKIRQNVFRHKKIVIISGISWMKRNPAYDPKIREQQLGIHSKKSKKLFVREIFSKFKFRFYKLSF

SEQ ID NO: 140303 - protein, 135 aa, Heterodera glycines
  Coding regions on vcDNA: vcDNA=SeqID_66726; Strand=+; Position=1 -195,547-669,716-804
MVKNLLVEYRTECFVNPHKYSSWAFTALWLSITVKNLLVEYRTECFVNPHKYSSWAFTALWLSITIILCLGLTIYHLLVLDLSFALTNIFVGLYIGAMIASLIEIFIFSLVRKSNQKLFDLRPGNYKNQPLRFGT

SEQ ID NO: 140304 - protein, 296 aa, Heterodera glycines
  misc_feature (36)..(36): Xaa can be any naturally occurring amino acid
  misc_feature (171)..(171): Xaa can be any naturally occurring amino acid
  misc_feature (179)..(179): Xaa can be any naturally occurring amino acid
  misc_feature (183)..(183): Xaa can be any naturally occurring amino acid
  Coding regions on vcDNA: vcDNA=SeqID_66727; Strand=-; Position=1-922
  Homolog annotation: Hit_ID=NP_502797.1; Match level="QueryCoverage =99%, HitCoverage=84%, E-value=5e-41, Identity=35%"; Hit description =HASI (4P602) [Caenorhabditis elegans] emb|CAB16520.1| Hypothetical protein Y57G11C.19 [Caenorhabditis ele
KITAAGKVQSNMNLPIENSNYRDVLLYLAGKNSNHXYGQDYRENSNLRQEFKKFKKKFARLNTVPSGFHTDWQCDLCIFDQLKKHNDGYRYLLVCIDVLSRMIFSAPAKSKKSEDMIEVFDRVFKKSKIIPMKIYSDSGIEFQAGKMKKYLGKFIIKNVMYSPDLHTGVAXRANRTIKXRLYXYFTKMETLRWVDVIDKIVSNINNSVNRTLGVKPSSINFGAFWEKLYKDSKKNKFKIGDIVCISKEKGKFAKGYLPNFFTEVKIVVVNPTTPGSFKIEHFKGNLIKSIFYNQEL

SEQ ID NO: 140305 - protein, 147 aa, Heterodera glycines
  Coding regions on vcDNA: vcDNA=SeqID_66728; Strand=+; Position=1 -55,116-271,331-450,501-545
  Homolog annotation: Hit_ID=NP_499603.1; Match level="QueryCoverage =96%, HitCoverage=35%, E-value=3e-41, Identity=60%"; Hit description =Ser/Thr protein phosphatase, protein phosphatase (37.4 kD) (pph-4.1) [Caenorhabditis elegans] emb|CAA2209
KFLTPGAMCDMLWSDPEKECVGFAISPRGAGKECVGFAISPRGAGYLFGSDVVKLFCEKNGVEMIARAHQLVMEGYKWHFDNTVLTVLTIWSAPNYCYRCGNVAAILEMDDVLKKEFLIFEAAPQVGRNTPMGRNTPMKGPMPEYFL

SEQ ID NO: 140306 - protein, 20 aa, Heterodera glycines
  Coding regions on vcDNA: vcDNA=SeqID_66729; Strand=+; Position=1-60
MAGIGTKLWGDSGGGGGGRT

SEQ ID NO: 140307 - protein, 274 aa, Heterodera glycines
  Coding regions on vcDNA: vcDNA=SeqID_66730; Strand=-; Position=1 -109,217-439,490-544,783-920,979-1084,1143-1336
  Homolog annotation: Hit_ID=AAH53603.1; Match level="QueryCoverage =90%, HitCoverage=53%, E-value=2e-94, Identity=63%"; Hit description =CDC-like kinase 2, isoform 1 [Homo sapiens] sp|P49760|CLK2_HUMAN Dual specificity protein kinase CLK2 (CDC
GECGVVVSASPAHRLPIQDDKDGHLIYSNGDRIDNKFEIVKTLGEGTFGKVVQVKDLNNPKGPQRALKIIKNVSKYREAARLEINVLRKLKDKDPDGRNLVIQLLDSFDYHGHMCLVFELLGLSVFDFMLIHAVKFLHDNKLTHTDLKPENILFVNSESDVVNGGEEAKRKKQFRDASVRLIDLGSATFDHEHHSTIVSTRHYRAPEVILELGWAQPCDVWSIGCIMFELYSGMTLFQTHDNREHLAMMQRILDGIPYRMGRKSKSVLRAGLIC

SEQ ID NO: 140308 - protein, 43 aa, Heterodera glycines
  Coding regions on vcDNA: vcDNA=SeqID_66731; Strand=-; Position=1-131
MLSISIDFDLIDFDLILLIYFDFIFGHPYIYHLLYDILSEQSS

SEQ ID NO: 140309 - protein, 17 aa, Heterodera glycines
  Coding regions on vcDNA: vcDNA=SeqID_66732; Strand=+; Position=1-55
HKHLFDLFYHIHNLIKI

SEQ ID NO: 140310 - protein, 372 aa, Heterodera glycines
  Coding regions on vcDNA: vcDNA=SeqID_66733; Strand=-; Position=1 -570,613-1160
CPSKFSIDYILSIPAKKPRHGIQAGAGTSSAKSAKDFVKKLESSIEHVPRFQYVKAKSKFSIEDVPANPEGLLAGIFQFCIDEAVVESEQRGVKPTHLGCLISSPLLTGGDIPIPIRQITDNTVDTILNQFNKVAQSKQQQNVTLWGEPFTVTVTTVDRTGLPDKRSLKGGARRSLASVHHRINDRCLIKIRNQDGYCLFYALQATMVAKTRGWPKWQFYNYMHSRYGQQGCLQRDVLDLMQQTGARPGLNAYEAEVFVPRVVDYWNNNNDQQQQQQQQRFAVFIFGSSGQYKPLYKYINDRYDTPIVLYFNNDHFDGVQKEYGLFGQNYCFECEKPYDRPSRHLSSCKAHCLLCSRVGPRFPCSPLRGFFR

SEQ ID NO: 140311 - protein, 147 aa, Heterodera glycines
  Coding regions on vcDNA: vcDNA=SeqID_66734; Strand=-; Position=1 -17,87-236,681-878,1094-1172
MSVQKMPRQSSRRLALVGCVISVLLLYTFLFGWPGPNIYSNKQPAIEHCVADHMIRKGISHPLVNGQAEDGTYWRGWHCAKQAMKMAFWCPSPSIFHIFNPENRVAFAGNGFLGIDMALDRRVLWRRIQIHTIIDACSESIELTRGL

SEQ ID NO: 140312 - protein, 95 aa, Heterodera glycines
  Coding regions on vcDNA: vcDNA=SeqID_66735; Strand=+; Position=1-363
RRVRSLNFSTKFMCSDNNELLKDPSAAHKLTLLLANRHRCHKSRKTLADFLRKKFHFHNRRVKNCATNLTTTTKFFTDIRKGCYTKSIERGGGIS

SEQ ID NO: 140313 - protein, 119 aa, Heterodera glycines
  Coding regions on vcDNA: vcDNA=SeqID_66736; Strand=+; Position=1 -106,486-619,1153-1272
MALCHCGNCGEKFETDVGGDDSRLFIGRTDQCPIGCVDLENELCAIVEAMCQMCADGTAAEAVRAACAQAVGICVYLSIEGWSGPGPKHGQLSMEVPGFSTRKVPVPVLPKIPGPDLLY

SEQ ID NO: 140314 - protein, 44 aa, Heterodera glycines
  Coding regions on vcDNA: vcDNA=SeqID_66737; Strand=-; Position=1-134
GGGGGSVCGRERLELLSEMDELESVHSSMTGGGADIGGCGDSGA

SEQ ID NO: 140315 - protein, 180 aa, Heterodera glycines
  Coding regions on vcDNA: vcDNA=SeqID_66738; Strand=+; Position=1 -57,133-417,637-767,843-867
  Homolog annotation: Hit_ID=NP_499039.1; Match level="QueryCoverage =100%, HitCoverage=21%, E-value=3e-62, Identity=63%"; Hit description= ribonucleotide reductase (89.0 kD) (rnr-1) [Caenorhabditis elegans] emb|CAA79574.1| Hypothetical protein
IEPYTSNVYSRRVLSGDFQIVNPHLMKDLIELNIVNPHLMKDLIELNLWDDQMKNRLIAENGSVQNIKQLPQEIKDLYKTVWEIPQKDILKMAADRAAFIDQSQSLNIHIAQPNYAKLSSMHFYAWSLGLKTGMYYLRTRPAVDAVQFTVDKMALRGTIAKDESVEIDVLKDDGCLMCSG

SEQ ID NO: 140316 - protein, 18 aa, Heterodera glycines
  Coding regions on vcDNA: vcDNA=SeqID_66739; Strand=+; Position=1-56
YREAIPEGFGLPINLGAS

SEQ ID NO: 140317 - protein, 68 aa, Heterodera glycines
  Coding regions on vcDNA: vcDNA=SeqID_66740; Strand=+; Position=1 -81,215-340
MTLLTSSSSSLEDLAALDGCSNTSDILLADSLLSDIEHFATHCLALRNLLATTAAATAHKNGATAGKM

SEQ ID NO: 140318 - protein, 87 aa, Heterodera glycines
  Coding regions on vcDNA: vcDNA=SeqID_66741; Strand=-; Position=1 -138,216-318
  Homolog annotation: Hit_ID=NP_502753.2; Match level="QueryCoverage =95%, HitCoverage=15%, E-value=4e-31, Identity=78%"; Hit description =dihydrolipoamide dehydrogenase (52.6 kD) (4P233) [Caenorhabditis elegans] emb|CAB05249.2| Hypothetical pr
GVNYKVGKFPFVANSRAKTNNDVEGFVKVIGDKDTDRLLGVHIMGPNAGEMIANAGEMIAEATLALEYGASCEDIARVCHPHPVSWF

SEQ ID NO: 140319 - protein, 202 aa, Heterodera glycines
  Coding regions on vcDNA: vcDNA=SeqID_66742; Strand=+; Position=1 -445,495-658
MIKFEQNDQNEQNENTSGVDQMGEEMGNGPNDQQKRETVKKFDAIKEKLKEKGKFEWKNQSKTERKIAKLLGTNRNSIQKWKNELNLKKNNKKKKQFYEQKKRKFIEQFGEFKELYAQGKQKEFVKELGISKDTFRKWKKELAPKYHKTQHNNVDKLKKMKQYYEIKESNPQISDRKITEKLGITCRTLLTWKKKFASFSTI

SEQ ID NO: 140320 - protein, 718 aa, Heterodera glycines
  Coding regions on vcDNA: vcDNA=SeqID_66743; Strand=-; Position=1 -659,795-1550,1626-2365
  Homolog annotation: Hit_ID=NP_510849.1; Match level="QueryCoverage =88%, HitCoverage=50%, E-value=1e-111, Identity=35%"; Hit description= predicted CDS, zn-finger, CCHC type and RNA-directed DNA polymerase and Integrase, catalytic domain cont
MDELVTGIHGVFVYLDDFIVATNSMDQHQQTLYKFFSRLQEWGLRVKFEKCKFLCTELKFLGHIISAEGIRPDPDRSRMINEMPAPTDEQTLRSFLGAINYYSRFVSQMREIRAPLDELLKKDVQWRWGPDQQQAFEGAKKIITSDLLLTSYDPAKPIVVAADASNKGLGATISHTFADGSEKVVEHASRSLTPAERNYSQIEKEALSIIFAVQKFHRMFIRYISTKNFGQADVLSRLIKQHRDTLQEEDKVIASAQMAQNLDNSEDDNIEFCAAAVDYMFQTTIDQLPVTADEIAEHIKRDEEMKKVIEHCRNGWPKTANESTMAAFYTHRLRISEVNGCLLMGDRVIIPSALRFRILKALHFTHPGMVRMKSLAKQFVYWPKIDMDIERWVINCEECRSAAKAPSKVLLHPWPSSTEVYERLHMDFAGPCADGNKYLVVVDSYSKWPEVIKMTTTTASMLIEKFVWLFSRNHCIKQTFSPPFHPQSNGRAERFVDTLKRQMKKCARDDVNWVQNSLLAYRSTPNASLNGRTPAELFLGRPVRTILSLVKPQVDKQEKGNDKYKQRMIKQFNQHHGTHERKFGIGDQVQFINYQHGTKTWLKGMIESGNGVVWKVQAPKLNAVVTRYSNQMRKIYPIPYKEHHEQLPDEHPQQQPPNDQPEEVQPRSPRRVRFADELNEPLERAQSPPTLRRSTRERKAPKILNPDASKARYDYVYR

SEQ ID NO: 140321 - protein, 37 aa, Heterodera glycines
  Coding regions on vcDNA: vcDNA=SeqID_66744; Strand=-; Position=1 -10,78-128,192-244
MLSETVKIGFIGAGKMAQALARGLINSGRNWAKRKVG

SEQ ID NO: 140322 - protein, 249 aa, Heterodera glycines
  Coding regions on vcDNA: vcDNA=SeqID_66745; Strand=+; Position=1-749
MSDHTRAKRNVQPEQLASQLSAAQLATTMALSQLYLKECQRNVRVSNPTLQARKLLKRENLQARWISETTIEVFPCVPISLSNISYRTTKDCYKFIPVTIHLLNTTQDAFLDPEMRILSLISKIASCSQFRYHHLQVQQKPNLWVRIDSKNGNVQRLAQTAIHELYETILNKTDNDLDLHPLIFHQWQLDNDTNFANFPHIDEFEDSEDFKNKLEQHTTQRAEALGALPGGIEGWTIRWLQERLQEAIQ

SEQ ID NO: 140323 - protein, 27 aa, Heterodera glycines
  Coding regions on vcDNA: vcDNA=SeqID_66746; Strand=-; Position=1-83
MRFSTLGSDCSSSYYGLPGGVEEPITT

SEQ ID NO: 140324 - protein, 44 aa, Heterodera glycines
  Coding regions on vcDNA: vcDNA=SeqID_66747; Strand=-; Position=1 -66,359-427
MLKGCLYVILALIAVSLIRWANNCYVQLKFQIDWFMGSGQTPKK

SEQ ID NO: 140325 - protein, 279 aa, Heterodera glycines
  Coding regions on vcDNA: vcDNA=SeqID_66748; Strand=-; Position=1 -208,253-392,451-558,615-755,847-948,1567-1585
  Homolog annotation: Hit_ID=CAE68853.1; Match level="QueryCoverage =98%, HitCoverage=59%, E-value=3e-45, Identity=37%"; Hit description =Hypothetical protein CBG14815 [Caenorhabditis briggsae]
MLSLLSLLLASGTVLKADTERWTSQIYPNPRRNHTGCNTWENSTLCDPDHILTDQWRAQINENIRSQMTKLTNANVTLAEKAPAECLTNANVTLAEKAPAECQNQSERITIYVLLAKQIWTPNNKSIPGNDLTNFGDELAHTNFGDELAHRYGLNDLSCKTFLLLIGIEAAKLAYVRTGKDFRMPADLMQRVTGKDFRMPADLMQRVFHEYKLFSAKSFMAGLNKIIDEIGTQLDDPFKDTAATSLSEIVNALMEKNGDGEGGPNGSATAAPSWMCPIC

SEQ ID NO: 140326 - protein, 68 aa, Heterodera glycines; identical to SEQ ID NO: 127362
  Coding regions on vcDNA: vcDNA=SeqID_66749; Strand=-; Position=1-400

SEQ ID NO: 140327 - protein, 69 aa, Heterodera glycines
  Coding regions on vcDNA: vcDNA=SeqID_66750; Strand=-; Position=1 -67,146-288
MFCCSIFFFFLFIESFCALKATTHLNFSPIVSELALKIVEECLDEYGQLVETRPFIKRISSPETVFKNY

SEQ ID NO: 140328 - protein, 183 aa, Heterodera glycines
  Coding regions on vcDNA: vcDNA=SeqID_66751; Strand=+; Position=1 -195,228-323,396-653
  Homolog annotation: Hit_ID=CAE61809.1; Match level="QueryCoverage =34%, HitCoverage=58%, E-value=3e-12, Identity=60%"; Hit description =Hypothetical protein CBG05776 [Caenorhabditis briggsae]
LAEFKDRRANASEKVIKMETIRESIGDKAEQVKQLEQLIAATGCELSETERQLRTMERSKQAKIDELETTVQQNLRKMALDVDSINGTLDKITEIGEVFLLLLTAIVICECGAGRKNGQAGCERHTVGRGGGGATGRNGAGSKRGGGRGGGRGGGKGNGRGGGRGGGGKGGGRAQQPEAEEDE

SEQ ID NO: 140329 - protein, 122 aa, Heterodera glycines
  Coding regions on vcDNA: vcDNA=SeqID_66752; Strand=+; Position=1 -276,333-425
MRIEVGRGKAQTRDTIRAETNRDKSAVWDGITEHSNPWDGNDEKLQLNVHGVDICVSDEVVSQLAPFIENPAENAHPPALELSVQKCRIEIKDPKKKFPIRIGFDELKFEDGPVSSKQTSAS

SEQ ID NO: 140330 - protein, 42 aa, Heterodera glycines
  Coding regions on vcDNA: vcDNA=SeqID_66753; Strand=-; Position=1 -113,399-414
MARFFLCSAIFSPLLLLMLFDKIGEKGMVEAGCCCCCKGQFA

SEQ ID NO: 140331 - protein, 47 aa, Heterodera glycines
  Coding regions on vcDNA: vcDNA=SeqID_66754; Strand=-; Position=1 -15,83-211
MDYVKSLPLHDGVEKQQKKMVGDALNQNVEDENLRVYLLMEIQAKGF

SEQ ID NO: 140332 - protein, 32 aa, Heterodera glycines
  Coding regions on vcDNA: vcDNA=SeqID_66755; Strand=-; Position=1-96
SPIRPFEFCSKGFQTIIVAFPSPPKCTPSSQR

SEQ ID NO: 140333 - protein, 18 aa, Heterodera glycines
  Coding regions on vcDNA: vcDNA=SeqID_66756; Strand=-; Position=1-56
VGFFVLVVCELVKKWGVT

SEQ ID NO: 140334 - protein, 168 aa, Heterodera glycines
  Coding regions on vcDNA: vcDNA=SeqID_66757; Strand=+; Position=1-507
  Homolog annotation: Hit_ID=EAK89514.1; Match level="QueryCoverage =38%, HitCoverage=9%, E-value=1e-10, Identity=56%"; Hit description =secreted protein with cysteine rich repeats and a mucin like threonine rich repeat, signal peptide, transcr
MPEPMELDQEPGTSTSTSSARPGPSTNQQVISSLMLISILCLLFTGTAQGQSSRQKRFAEIKTWHGGHVSNFFNIFTERDRRASTKYSPYVQRYINKVLALNRSLSQSTNPLTPTTPTWTTTQPTTTTSQPRTTTTTATTTTTRTTNWPTKSNTRPTARITTTTPMPW

SEQ ID NO: 140335 - protein, 87 aa, Heterodera glycines
  Coding regions on vcDNA: vcDNA=SeqID_66758; Strand=-; Position=1 -114,490-636
MKRLMVLAVAGKVAEVKAVGHSSGWEEDEKDWCRVARKLAMTSTRWAEIEGEEEKRAFVKREVRRLEGWAMRTARKELDAEWPDVLR

SEQ ID NO: 140336 - protein, 47 aa, Heterodera glycines
  Coding regions on vcDNA: vcDNA=SeqID_66759; Strand=-; Position=1 -23,399-519
MENISRINFLILLEWSPLSIFRDLCPYFHIFYFGIYQKNLYSRFPIS

SEQ ID NO: 140337 - protein, 188 aa, Heterodera glycines
  Coding regions on vcDNA: vcDNA=SeqID_66760; Strand=+; Position=1-566
  Homolog annotation: Hit_ID=EAA60764.1; Match level="QueryCoverage =100%, HitCoverage=84%, E-value=3e-46, Identity=53%"; Hit description= hypothetical protein AN4722.2 [Aspergillus nidulans FGSC A4] ref|XP _408859.1| hypothetical protein AN4722
TPAETETTPAETESSPAETETTPAETETTPAETETTPAETETTPAETETSPAETETTPAETETTPAETETTAAKTETTSAETDTTPAETETTPAETETTPAETDTTPAETETTPAETETTPAETDTTPAETETTPAETETTPAETETTPAETETTPAETETTPAETETTKAETETTPAETETTPAETE

SEQ ID NO: 140338 - protein, 43 aa, Heterodera glycines
  Coding regions on vcDNA: vcDNA=SeqID_66761; Strand=+; Position=1-129
AAPADGIRGPHDRRKAKYIRQDNNLQALVADLTSVIRLNTFAH

SEQ ID NO: 140339 - protein, 15 aa, Heterodera glycines
  Coding regions on vcDNA: vcDNA=SeqID_66762; Strand=+; Position=1-49
LKAIHCLPVLGTAKH

SEQ ID NO: 140340 - protein, 53 aa, Heterodera glycines
  Coding regions on vcDNA: vcDNA=SeqID_66763; Strand=-; Position=1-227
KKTLRIIRIGQMLGLGWESNPLVHPFHGQALPLSYRGTSALSFMDYQARFPRF

SEQ ID NO: 140341 - protein, 143 aa, Heterodera glycines
  Coding regions on vcDNA: vcDNA=SeqID_66764; Strand=+; Position=1 -5,605-1031
MRCAVTAITSVLERTSAANAQSRAMQLLRALFAAEDYEGFSAKVTCCNCWLNDDDDDVVMDKKANFAGINEATNNDQDDDAFEQFANSQIIGEDNDKIDASASSSTHKRRGYIIEEKIRILDCAKMSSIHVASRRFSMDRNTI

SEQ ID NO: 140342 - protein, 121 aa, Heterodera glycines
  Coding regions on vcDNA: vcDNA=SeqID_66765; Strand=+; Position=1 -45,84-250,291-444
MCLFHLSQSVLRYVQRHGLIREYEANENLEQYIRSLAALAFLQPNLVEGSLDILYARAPMVARPVFEYFRKTYIIRDNGEQPLFPVDSWNHHQAVIDDLCRTNNAQVSNLRGQTDLLLKII

SEQ ID NO: 140343 - protein, 61 aa, Heterodera glycines
  Coding regions on vcDNA: vcDNA=SeqID_66766; Strand=+; Position=1 -19,269-435
METYLRRVLEIPNLIELVKPTTLSSNIALDLISEFSLNLYSSNFMHGIEAVQAQVAKIGQI

SEQ ID NO: 140344 - protein, 163 aa, Heterodera glycines
  misc_feature (76)..(76): Xaa can be any naturally occurring amino acid
  misc_feature (92)..(92): Xaa can be any naturally occurring amino acid
  misc_feature (159)..(159): Xaa can be any naturally occurring amino acid
  Coding regions on vcDNA: vcDNA=SeqID_66767; Strand=-; Position=1-495
  Homolog annotation: Hit_ID=BAB33421.1; Match level="QueryCoverage =82%, HitCoverage=48%, E-value=1e-54, Identity=78%"; Hit description =putative senescence-associated protein [Pisum sativum]
GKTNLSHDGLNPAHVPYWWVNNPTLGEFCFAMIGRADIEGSKSDVAMDAWPPQASYPCGNFSDTSCWKLYTLKDRXATLSRSVFVLKIRIKXAFAFLLYERFPSSLSSLGHLRYALTDVPPQSNSPPDTVIGAGRRATGWPDLTPKWTPLRAHSRFTDXVRNR

SEQ ID NO: 140345 - protein, 194 aa, Heterodera glycines
  Coding regions on vcDNA: vcDNA=SeqID_66768; Strand=-; Position=1 -253,469-629,668-838
MPKQNEIVLKYSFLDLTWFLDIEAVFYAISKTVVPNPQIFESGFQKKCLVVKTIFHISLHNFVSSARIETGIRPLERAARALQEVKKLFEFLQFCFHNFRKLFGIIMPKQNEIVLKYSFLDLTWFLDIEAVFYAISKTKKCLVVKTIFHISLHNFVSSARIETGIRPLERAARALQEGMERKNSYFWDFFRNQN

SEQ ID NO: 140346 - protein, 236 aa, Heterodera glycines
  Coding regions on vcDNA: vcDNA=SeqID_66769; Strand=+; Position=1 -285,333-756
  Homolog annotation: Hit_ID=AAL78214.1; Match level="QueryCoverage =73%, HitCoverage=89%, E-value=1e-56, Identity=61%"; Hit description =putative esophageal gland cell protein Hgg-20 [Heterodera glycines]
RLSDFAWMETLAWLGRAEVGMKLALVNTRFNMLVDKQFMLRQWRFGEFHICEREGAQRGGAEIMTSEDGTNFITLPLPTTPMPSSVVGFQSLSIWFINADVIKFLRRIRRLFAEDIALEFSTRHTEFRSWQVIARHVWPLLRDGISTLVCLRKCDLAMLRKHVSPTVLFDCPDLHQIRTDMVPECPSDAAENTDPTCRELYTWIHSPRDYRQAPISVKLIKWRQTKWDEFMNNLCR

SEQ ID NO: 140347 - protein, 75 aa, Heterodera glycines; identical to SEQ ID NO: 124542
  Coding regions on vcDNA: vcDNA=SeqID_66770; Strand=+; Position=1-225

SEQ ID NO: 140348 - protein, 43 aa, Heterodera glycines
  Coding regions on vcDNA: vcDNA=SeqID_66771; Strand=+; Position=1-159
GREAALIAQQIYKRARSARLRSRSCVNSPTIEKRARSARISPT

SEQ ID NO: 140349 - protein, 63 aa, Heterodera glycines
  Coding regions on vcDNA: vcDNA=SeqID_66772; Strand=-; Position=1-191
MPLHISNFNGICQLRPAQFGIVLEWMNLGSVWAFLSEQKTNSANSVKQLDSKDLLRIAIQVWV

SEQ ID NO: 140350 - protein, 45 aa, Heterodera glycines
  Coding regions on vcDNA: vcDNA=SeqID_66773; Strand=-; Position=1 -19,113-231
MAKRFVANQKKKASFATTSAADDNKFATTLATETWAVKTLIKLVK

SEQ ID NO: 140351 - protein, 25 aa, Heterodera glycines
  Coding regions on vcDNA: vcDNA=SeqID_66774; Strand=-; Position=1 -12,566-631
MNVPTWYCEWKEMDLFEELCPMPSM

SEQ ID NO: 140352 - protein, 143 aa, Heterodera glycines
  Coding regions on vcDNA: vcDNA=SeqID_66775; Strand=+; Position=1 -151,202-314,567-734
  Homolog annotation: Hit_ID=NP_520242.1; Match level="QueryCoverage =83%, HitCoverage=69%, E-value=1e-25, Identity=46%"; Hit description =hypothetical protein RS01483 [Ralstonia solanacearum GMI1000] emb|CAD15828.1| CONSERVED HYPOTHETICAL PROT
MKFEELNGLDAENFVSKLGKIFEKSAWVVQEAYGEKPFESVDQLFNAMERVLMNAGREKQLKLIQAHPDLAGNEMFSGNLTQHSTSEQANAGLSALTAQQLAEFNSLNSAYKSRFNFPFIIALRDQKEGSNIISYVSYFNLFI

SEQ ID NO: 140353 - protein, 80 aa, Heterodera glycines
  Coding regions on vcDNA: vcDNA=SeqID_66776; Strand=+; Position=1 -105,225-324,598-635
  Homolog annotation: Hit_ID=NP_496785.1; Match level="QueryCoverage =51%, HitCoverage=6%, E-value=3e-09, Identity=65%"; Hit description =prion-like Q/N-rich domain protein PQN-32, Prion-like Q/N-rich domain protein (66.0 kD) (pqn-32) [Caenorha
MVITKASFSKRFRNCCARLGDGCQQLCSYDQNLGTIQLAVLTGSKKNKAYTVSTDTNPTPLPPTVRVSGRHRLLPSICRF

SEQ ID NO: 140354 - protein, 92 aa, Heterodera glycines; identical to SEQ ID NO: 125147
  Coding regions on vcDNA: vcDNA=SeqID_66777; Strand=+; Position=1-304

SEQ ID NO: 140355 - protein, 215 aa, Heterodera glycines
  Coding regions on vcDNA: vcDNA=SeqID_66778; Strand=+; Position=1 -69,192-267,323-437,537-635,732-789,896-1070
GRLVSMDHFRDPHKGNQLHYYAIMHRFSGSVFLKPEPMSFSELLKTAQENEEVDMALTQLCGHDEYENEEVDMALTQLCGHDEYGDGRVQFSTYWERVPGADSRIWFAGSPESDVQKSLFEKDGFRLISLCGYSIRKTATARFVGVWQKPALRTVPYEAHYGVTLSECIELNDRLAARRENKESVRQLTNASEISCGAIASFAKGRSKRRIGATG

SEQ ID NO: 140356 - protein, 558 aa, Heterodera glycines
  Coding regions on vcDNA: vcDNA=SeqID_66779; Strand=-; Position=1 -86,131-531,579-1768
  Homolog annotation: Hit_ID=NP_507780.1; Match level="QueryCoverage =41%, HitCoverage=14%, E-value=2e-15, Identity=29%"; Hit description =predicted CDS, DNA polymerase type B, organellar and viral family member (5T899) [Caenorhabditis elegans]
MMPEKRRQFDHWYEQHREEPFQLDEALASYCTNDVEILMAALVAFRREFFDVSKRNEYVDGIDDRENHDGIDVLRECMTVAGACMKHFRLNHLPAEHLAIVPEKGYDNTQNQSKLALRFLFWYAEENNVQVQTAYSPDGEKKIANYTVDGWIEAEGCVIEVNGCVWHGCRKCFPSDNMMLPNGKTAGEQRERDAKRLQFLRTQVTRVDVFWECEIQRMLDRSREMRKKFAEYHPTDWTSKTNPFSRIWPRFLVYHRSPPRLTSPPRLKTKIEPRPPPPRPTAKREKQQAKLDWKKNQHPTPAPRAKREPELKLDPRPSTSRQAGYFPPPTTKIEPKHAPTKRPVPYRIPEREPKIREKPLQQQQPPPPTAVVEEMPYVPPPRRGTKRPHPVNDENGEVHIRKRVRQPRRVRVQYSPEPGPSTSAQAYEQQQQQQQRELFAIQSNQLTMTQRIERLYIKCNHYADRMGVRGNTINTANGKPLAHSNLRMAIKYIIDRRAGRPTIKPPGANLLEERLRKDPILYSWTAPPKRPSQSKTTRTERTIKKEFRPKNGADQHHS

SEQ ID NO: 140357 - protein, 265 aa, Heterodera glycines
  Coding regions on vcDNA: vcDNA=SeqID_66780; Strand=+; Position=1 -191,609-1217
LSKIGGDELADSVQMRLLRDENARLLSALGSVKADKAVLKKQLDQLQQNDALAEHQQTNVLKQSKLSPTRTEKSQQRHVFTLHDNNNGFTGCTSAHNQQHKSPQNISNRNSRRCSPRCPHNRHCPPPPPRVHHQHHHHPPHCHHRPQFLHRLRRCPMYRLRLPHFPQFRHVRPPSARPPAFRSISALPPPRLLFHCPSINTTIRPPLHRPVVLLLLLAVVLTTRNGPPPRRRAAAATEGRWWQTTGDEQRCSGQKALAAVTANGT

SEQ ID NO: 140358 - protein, 105 aa, Heterodera glycines
  Coding regions on vcDNA: vcDNA=SeqID_66781; Strand=-; Position=1 -98,314-531
MCVQSAPETRANTELRQAVQDKLDVAQIQLRTKALLESDAGIDVEMTPRGREVLDTLSFQLCSLTDLYRVANAYGLEEVKLSVLHCAGRYDAEVVEGVWRDFLQK

SEQ ID NO: 140359 - protein, 79 aa, Heterodera glycines
  Coding regions on vcDNA: vcDNA=SeqID_66782; Strand=-; Position=1 -37,267-379,446-535
  Homolog annotation: Hit_ID=CAE63642.1; Match level="QueryCoverage =98%, HitCoverage=19%, E-value=5e-14, Identity=50%"; Hit description =Hypothetical protein CBG08140 [Caenorhabditis briggsae]
MNRYTKMVDDVTARLLKTSILPEHMKTFTRKEFREAPKITDELAADDELMPYMPRPYYSRPNRLDKDYFDFDLQHSVDM

SEQ ID NO: 140360 - protein, 192 aa, Heterodera glycines
  misc_feature (191)..(191): Xaa can be any naturally occurring amino acid
  Coding regions on vcDNA: vcDNA=SeqID_66783; Strand=-; Position=1 -410,475-612
  Homolog annotation: Hit_ID=NP_508451.2; Match level="QueryCoverage =75%, HitCoverage=73%, E-value=2e-30, Identity=44%"; Hit description =putative secreted or extracellular protein precursor (24.0 kD) (XD98) [Caenorhabditis elegans] gb|AAC4707
SVFCAFCVIGTTRECKAFLFFYLRKTLPIKCSLDNRSLTGSYATKGSNETVATVLKLMKVGLLEGYAVRRIKMFNDRVFLSRYRRSYWFGTRYYALDNNFFLDTRETCAYRMREEERDGLEYEENADEPVLDIVYQCQKYAQFCCGLDCCKCQKYAQFCCGLDCCKWEPIAMDPKPIRPRPPPSIWCLPFXV

SEQ ID NO: 140361 - protein, 242 aa, Heterodera glycines
  Coding regions on vcDNA: vcDNA=SeqID_66784; Strand=+; Position=1 -96,141-244,293-335,383-475,524-601,736-845
  Homolog annotation: Hit_ID=NP_509196.1; Match level="QueryCoverage =95%, HitCoverage=24%, E-value=6e-64, Identity=55%"; Hit description =putative endoplasmic reticulum protein family member, with at least 5 transmembrane domains, of eukaryoti
IIRSEPIFGFIPRIRFSDKGSYVESATKDYDHMAFKYLSWALFPLLGSYAVYSDYDHMAFKYLSWALFPLLGSYAVYSLVYDEQKGWYSWVLGMLYGFLLTFGMLYGFLLTFGFIMMTPQLFINYKLKSVAHLPWRMTPQLFINYKLKSVAHLPWRMLTYKFINTFIDDLFAFVIRMPTLDDLFAFVIRMPTLYRLGCFRDDIIFLIYIYQRWIYRVDPKRVNEFGTTGDDQTGTEISGIEA

SEQ ID NO: 140362 - protein, 109 aa, Heterodera glycines
  Coding regions on vcDNA: vcDNA=SeqID_66785; Strand=-; Position=1 -4,358-550,727-859
MKPCEHSDWDQSAVEKLKSEANATIWESDQMGRTVVILYRGGRVKARVFVMAKHLPPKPMAKLSDFIMWQNDKETEVEDAMLTTRISIQKDNLMLGEGDTAAEKGDKIV

SEQ ID NO: 140363 - protein, 77 aa, Heterodera glycines
  Coding regions on vcDNA: vcDNA=SeqID_66786; Strand=+; Position=1-339
LITVVYLFLRDHSNHISYTDKFHIIARHYRLITLSIDRSFPNVLSPITLFALIRLPSFPLPFLLIHILCKNSPAPPP

SEQ ID NO: 140364 - protein, 258 aa, Heterodera glycines
  misc_feature (8)..(8): Xaa can be any naturally occurring amino acid
  Coding regions on vcDNA: vcDNA=SeqID_66787; Strand=+; Position=1 -94,563-719,935-1037,1099-1150,1197-1291,1361-1515,1893-1922
  Homolog annotation: Hit_ID=CAE68521.1; Match level="QueryCoverage =95%, HitCoverage=69%, E-value=5e-45, Identity=38%"; Hit description =Hypothetical protein CBG14343 [Caenorhabditis briggsae]
YLHDEKQXLFLLINFSYIFYFIYRYWPKQPSRAELALFGWTVGLRTAYCQQVPAQELVDPFKDAVVRMLNRHCRNASACRLKKSVSFSKHQIVLLDGYPRREHRILHFRFFVVLPHDASMDKKPDKPLLSMDKKPDKPLLSNQILSEMLDSQIGELSHGLGWQVMLDSQIGELSHGLGWQVLGHDKYPRFDPATTFFNFFNRTLIPIAVLAGLCMFFLAYWTTAFTSGSSSGGWLVRGSSGGKNAALRRTMEIIEEQK

SEQ ID NO: 140365 - protein, 136 aa, Heterodera glycines
  Coding regions on vcDNA: vcDNA=SeqID_66788; Strand=+; Position=1 -154,367-623
MPIIAPNVEEKAAVDQQQQQKVAKKGATNIQPQQHEALPTSGAKGPQAAQNGIQQKYLGPAKGSLSSVSGSSSTKRREMEEMDDMVPEIVVMHAHTSSQESRETAASGGRRVSTAAEKGYRESRQKSYVFFKNYPG

SEQ ID NO: 140366 - protein, 117 aa, Heterodera glycines
  Coding regions on vcDNA: vcDNA=SeqID_66789; Strand=-; Position=1 -301,431-483
MLLAIVFFVCSIAFPQPIFSVIKSKPKNLVLIDRQIYEQKLAENDGTGELREFIQKLEDQNETMAKVIEKCEAIEEREDAKLAKIYFSLKTKLGEIKGGEGILFLCKYIFFPGFSIA

SEQ ID NO: 140367 - protein, 74 aa, Heterodera glycines
  Coding regions on vcDNA: vcDNA=SeqID_66790; Strand=+; Position=1 -24,83-283
MAHPAGDVTDAQVLEMSSDQIDERVRQLDEEIRVMRDEMRKIAYNIKTMGTKTKENNKQMQKVSKQTKGGTTNL

SEQ ID NO: 140368 - protein, 146 aa, Heterodera glycines
  Coding regions on vcDNA: vcDNA=SeqID_66791; Strand=+; Position=1 -145,203-498
MNNENGTLPSVSTIKKKANATGGGYGVVIHSFDSQNKNSAQSIVYVDHNRPLYVVPRYLFDVTYLTNQGFSKSQVNKRSIELGFGANIQFESRGNQIVYFDRCSKGQDWIKIGEQLLLQDKDRRFFFEDKAKNYVNIKSKAHSWSS

SEQ ID NO: 140369 - protein, 50 aa, Heterodera glycines
  Coding regions on vcDNA: vcDNA=SeqID_66792; Strand=-; Position=1 -57,168-263
MPIKRRKRWIDFVLFVDQKKIIALIFIGFKNVMEFSEFFCRYLSKFKKVM

SEQ ID NO: 140370 - protein, 110 aa, Heterodera glycines
  Coding regions on vcDNA: vcDNA=SeqID_66793; Strand=+; Position=1 -105,392-508,1049-1157
FCAQPSGEWSLDGLFGGTRIVRARVAQCQHSVGCAIYEGGYIRLHCATDARPNDVKLRWSWDGEPRRLEVVDAQNVLINGLRFNDNGRRVTCTAENTIDVGTGVFELDVP

SEQ ID NO: 140371 - protein, 224 aa, Heterodera glycines
  Coding regions on vcDNA: vcDNA=SeqID_66794; Strand=+; Position=1 -169,217-306,390-545,606-664,807-944
  Homolog annotation: Hit_ID=XP_342302.1; Match level="QueryCoverage =89%, HitCoverage=39%, E-value=3e-63, Identity=61%"; Hit description =similar to RIKEN cDNA 4933412D19 [Rattus norvegicus]
RNMRVRPFFTAHFSQKNFQDRVEYSRTWQGIYFNIAGHFFSVYCIWKLIICTVNIVFDRVGKVDPITKGIVNIVFDRVGKVDPITKGIEIIVKHFGYQIDVPFWSQQCSFLVIGLIAVTSIRGLLLTIAKFFNAISNRQSSNLIVLVLAHVMGMYFVSSVGMYFVSSVLLIRMNMPPEYRTIITEVLELQFNFYHRWFDVFLLSALSSILFLYLAHKRHQINRQ

SEQ ID NO: 140372 - protein, 196 aa, Heterodera glycines
  misc_feature (97)..(97): Xaa can be any naturally occurring amino acid
  misc_feature (115)..(115): Xaa can be any naturally occurring amino acid
  misc_feature (129)..(129): Xaa can be any naturally occurring amino acid
  misc_feature (147)..(147): Xaa can be any naturally occurring amino acid
  Coding regions on vcDNA: vcDNA=SeqID_66795; Strand=-; Position=1-1582
  Homolog annotation: Hit_ID=AAL31950.1; Match level="QueryCoverage =76%, HitCoverage=33%, E-value=2e-32, Identity=56%"; Hit description =CDH1-D [Gallus gallus]
IGSSLHTDRSRNTNRPRISRNGSVPGSDGRCVQRAGTYSERVDDSPLQGIPRSRTIIAMSDPNHGKFSPVYQPLSGKDKHADFASVARVQPRTSKGXHRPVIAQFRAAEHRKSLXEVVPTEAMSQLFSXARVSLVIGINQTNRSTNXERPCTTIHRIMKKLSICQSLRCPGRVSFPVLSQIKPQAPLLVVPFRQFL

SEQ ID NO: 140373 - protein, 472 aa, Heterodera glycines
  misc_feature (15)..(15): Xaa can be any naturally occurring amino acid
  misc_feature (60)..(60): Xaa can be any naturally occurring amino acid
  misc_feature (191)..(191): Xaa can be any naturally occurring amino acid
  misc_feature (304)..(304): Xaa can be any naturally occurring amino acid
  misc_feature (308)..(308): Xaa can be any naturally occurring amino acid
  misc_feature (314)..(314): Xaa can be any naturally occurring amino acid
  misc_feature (340)..(340): Xaa can be any naturally occurring amino acid
  misc_feature (397)..(397): Xaa can be any naturally occurring amino acid
  misc_feature (410)..(410): Xaa can be any naturally occurring amino acid
  misc_feature (414)..(414): Xaa can be any naturally occurring amino acid
  Coding regions on vcDNA: vcDNA=SeqID_66796; Strand=+; Position=1 -256,292-357,384-634,666-708,766-1071,1250-1431,1470-1558
  Homolog annotation: Hit_ID=EAA17111.1; Match level="QueryCoverage =95%, HitCoverage=93%, E-value=7e-52, Identity=39%"; Hit description =hypothetical protein [Plasmodium yoelii yoelii]
RTGHWWCQRAHRSRXVVNRNHLGNDPAAGSPTATLLRLLPGKPLRLNRFQSAYRPKPEHXPSPNFSKWLSPGSDGRCVQRAGTNSSFTDNNCNVRSQSNSSFTDNNCNVRSQSRQIFTGFTLILPVARVQPRTSKGITDLLRQIFTGFTLILPVARVQPRTSKGITDLLLLNFVRLNTENPSKKLCPQKQXANYLVGRVSLVIGINQTNRHELRTAMHHHPPNHEKAINLFPVLSQIKPQAPLLEKAINLFPVLSQIKPQAPLLNRKTFVSGKLNRKTFVSGKLPTRANKSAGALVGIVYGQNXGGIXSPSNLXLSLKTFAKCFRCSPSCYGPRISPLTXQYEWPRLSLLTIISVSKTNNRTEILFYYSIFLTAAIILCILRAGITAAAGTRLALSXILVKGFKLYPFRXPASXEIGLVISRHYLLALRVAISQAPSPESNPYISQAPSPESNPYPPLPVITMVVRYTTIES

SEQ ID NO: 140374 - protein, 81 aa, Heterodera glycines
  Coding regions on vcDNA: vcDNA=SeqID_66797; Strand=-; Position=1 -105,170-286,473-495
LLLASAMVSMLCLISGLFLLPPDIHSFSSTPSEQDANRQIPLTTVGRLSCVTEAGCVLSDTSQLNFLVVGDIGGLPVFPYY

SEQ ID NO: 140375 - protein, 161 aa, Heterodera glycines
  Coding regions on vcDNA: vcDNA=SeqID_66798; Strand=+; Position=1 -168,487-804
MFKTAMQLSIIENGICYTIIIICGFKIAKFVNKNAYRNATCGQQVHKQLTINLIIKALLPLAMNILNFSVAIQLLFFQTEMSPNFLFLQMCASVPAYWLPVLNPLVTICTVSDYRSAVTILIRSTTRSRSRDSGVFAAADLPQIRVIRPTNYANPIINNYV

SEQ ID NO: 140376 - protein, 50 aa, Heterodera glycines
  Coding regions on vcDNA: vcDNA=SeqID_66799; Strand=-; Position=1-152
SLFTFELPYAYSADDRLDLNRYDPYELLARCRHFVQQRDLLNAVRVANLI

SEQ ID NO: 140377 - protein, 90 aa, Heterodera glycines
  Coding regions on vcDNA: vcDNA=SeqID_66800; Strand=-; Position=1-429
NRNYAQKAPQTILALPIPSTIAFIHPIMSAKIIRVPKIACDLSLAKNGVSKNSNYAQKAPQTILALPIPSTIAFIHPIMSAKIIRVPKIA

SEQ ID NO: 140378 - protein, 75 aa, Heterodera glycines
  Coding regions on vcDNA: vcDNA=SeqID_66801; Strand=-; Position=1-230
KQIKQLIANMTSLNTTAPNNYELFLLFCGDAVELLTTFVGIPLSIANLIFGGSHIGHPPEHRKPFSSSRVSLFSW

SEQ ID NO: 140379 - protein, 160 aa, Heterodera glycines
  Coding regions on vcDNA: vcDNA=SeqID_66802; Strand=+; Position=1-483
MGKKHSTREWNKIERKIAKKLGTNRNKIYEWKREFGMIKKHYYTDEEKRKILKRFDQLYDKINEKLNKKLKGKRKICQKIIAKHLGTNISSIYYWKKQFQKGNSSVNNQKTGDEKREIVEKYFKTKIKFMQNGKHSLKEWKEFRAKIKQMFGVNYWTIER

SEQ ID NO: 140380 - protein, 188 aa, Heterodera glycines
  Coding regions on vcDNA: vcDNA=SeqID_66803; Strand=-; Position=1 -202,690-870,931-1070
  Homolog annotation: Hit_ID=NP_506859.2; Match level="QueryCoverage =93%, HitCoverage=5%, E-value=1e-69, Identity=65%"; Hit description =speract/scavenger receptor (5P989) [Caenorhabditis elegans] emb|CAB03852.2| Hypothetical protein C06B8.7 [
VRGKFLIGIFVPDLGVHQFILGPLQAVGNEFAHIQMLPYQEQLVYDSKLPNYGLIDGPTVRQGRLQIRFRDRWRSVCTQMTNWTSIDTGTACRTMGYDDGAFWRFFQRNNDTYPFVMPAPKCTQRQNSLWNCPGFEDKEHIPSLWNCPGFEDKEHIPLSENLCQGEDDIGIYCWGRPTFTGWARHWKG

SEQ ID NO: 140381 - protein, 169 aa, Heterodera glycines
  Coding regions on vcDNA: vcDNA=SeqID_66804; Strand=-; Position=1-510
MIILGRDSLVKDETVDQIMEQCQRIQQLCSRFPSVSFIWLPPPYVRQYDLAYHEMIGRLSELLGDWFVFVTPFGRSLIEIWHYGDSFDRSSVNADGWMTENGIKALSAWISTQIPKWPNNRQLGRIRTVRSSVSVTRRVYGLGLCDRRPNSRSRSPFRRRDNRQSQPFV

SEQ ID NO: 140382 - protein, 372 aa, Heterodera glycines
  Coding regions on vcDNA: vcDNA=SeqID_66805; Strand=+; Position=1 -940,994-1172
MKILLIFLLLCALIFKKAINQIEAGKIIQEKSFAEIFGQRWDDGAEEENICQNDQIIHGEIADQNNQFGQNVRQFDQNFDENVEVKEEESEEMSTDYDELGDQLPMPTNNGQSCDKFSNETNKNKRETVEQFHKIKEKVKQMGKKYSKKEWTKIERKIAKKLGVSQEKIYKWKREFGMMKNKNYSVEEKRIMLKQFDQIYAKLKMKLNEKLEGKRKKCKKIIAKYLDIDISSIYKWKKEIKVGKMVKNQKNDDEKTEIVEKYFKIKNEFMKNGKHSRKEWKEFYIKIKQKFGVIFQTIEKWAKNLGIEQNNSKERNMLSIAEKMEVIKQYYQIKKQNPKFKEYEIAAKLGIPMSSLDKYKTKYGNESKNKLL

SEQ ID NO: 140383 - protein, 104 aa, Heterodera glycines
  Coding regions on vcDNA: vcDNA=SeqID_66806; Strand=-; Position=1 -179,604-713,829-854
  Homolog annotation: Hit_ID=CAE71617.1; Match level="QueryCoverage =69%, HitCoverage=2%, E-value=5e-12, Identity=52%"; Hit description =Hypothetical protein CBG18580 [Caenorhabditis briggsae]
MLRNIGILSLLAFFFLCGTINGQQPPLANGLEPTRQRIRNTLGGFYSGNVTLYFRNSPYRKFFLSRVERELIVESGATITIETGVQMYFDTGVGMKGPGLSWPG

SEQ ID NO: 140384 - protein, 89 aa, Heterodera glycines
  Coding regions on vcDNA: vcDNA=SeqID_66807; Strand=-; Position=1 -15,61-315
MNYVLTFFAEKILNFPMENPSQIDLSPFLLFFNSSPFLPAGVVSQQWTNKCIFPIHILSIVILRPTSDDCAGPNSAKANIPKNKMPTIK

SEQ ID NO: 140385 - protein, 103 aa, Heterodera glycines
  Coding regions on vcDNA: vcDNA=SeqID_66808; Strand=-; Position=1 -75,2607-2714,2762-2890
  Homolog annotation: Hit_ID=CAE71617.1; Match level="QueryCoverage =47%, HitCoverage=1%, E-value=2e-12, Identity=61%"; Hit description =Hypothetical protein CBG18580 [Caenorhabditis briggsae]
MAFLEFCNNSAAVAGAAPAVVQPQHGPVLIANSTISHNRGHGIVIESTLDGRAFVNQSRIEANYGDGIFYRQKHDGLSSTQNRLGLEIGIPLSILDKKSALSE

SEQ ID NO: 140386 - protein, 302 aa, Heterodera glycines
  Coding regions on vcDNA: vcDNA=SeqID_66809; Strand=+; Position=1 -875,945-978
MKIKIILFSLLIFKNADNIYAGKINDEKNFDEIFGQRWDEKSEENGEKETDQNGRIEQMDGQNEAKNDQINAQLLHETQFDQLFDENLQVKQESATNCDQLEQLPINFGQISDHFSNGIDKKKREIVEKFDKIKEKVKQMGKKFTRKEWEKIERKIAKKLGENQRKIYKWKREFGMIKKHYYTDDEKYKKVKQFDQIYGKLKTKLNGKLEGKRTKCQKIIAKHLGTNIRSIYQWKKKLKNGKTMKNQRIFEQKIEIVEKYFKIKNEFMQNGKHSRKEKMGQENWLKSNSFKGAEALYICGKN

SEQ ID NO: 140387 - protein, 162 aa, Heterodera glycines
  Coding regions on vcDNA: vcDNA=SeqID_66810; Strand=+; Position=1 -187,689-990
MLIEFMNQKQLKQHVKEPTRENTILDLVMTSESELINELIVLEHFSTSDHKMVGFKIKEKFRKNSVVNGSLTQSAQNKTKLSDIELNVGIIWNILRKLPRRNSTSPDNISYILLKNCAEPITKILADIFRLALYSGQIPEIWRTSLVVPIFKKGEKTDLLGV

SEQ ID NO: 140388 - protein, 60 aa, Heterodera glycines
  Coding regions on vcDNA: vcDNA=SeqID_66811; Strand=+; Position=1 -8,167-341
MQSNKKKIKFDLSNISFLFRLRADIKQPLTIRSTCGAHPHVQPGQCKNLEFVMSHDVGGD

SEQ ID NO: 140389 - protein, 21 aa, Heterodera glycines
  Coding regions on vcDNA: vcDNA=SeqID_66812; Strand=-; Position=1 -33,575-607
MSSAICCRTKLNYVTLTYAYA

SEQ ID NO: 140390 - protein, 78 aa, Heterodera glycines
  Coding regions on vcDNA: vcDNA=SeqID_66813; Strand=+; Position=1 -83,1073-1088,2331-2467
MSDYHHQQKGGGGSGYPQHQSSYGYPAIIINHDQHDDIEGYKQQQQQAAKGGGVGGMDQLRKEEPVQIGWMTEAKDWA

SEQ ID NO: 140391 - protein, 110 aa, Heterodera glycines
  Coding regions on vcDNA: vcDNA=SeqID_66814; Strand=-; Position=1-333
MLPGRDPGIPDLGVLSKRNGTGSWLKAPAWAPAGPVRSLIIMAWHTRPNPWPRSSNQFGPAPPCATDPYRRPHRPWLLVAVVVCTLRCRHVAAQVAQHRRPVRAVENTHG

SEQ ID NO: 140392 - protein, 243 aa, Heterodera glycines
  Coding regions on vcDNA: vcDNA=SeqID_66815; Strand=+; Position=1 -159,233-302,544-650,710-765,1269-1327,1390-1422,1799-2018
  Homolog annotation: Hit_ID=NP_741649.1; Match level="QueryCoverage =86%, HitCoverage=17%, E-value=1e-91, Identity=80%"; Hit description =SLOwpoke potassium channel subunit, large-conductance calcium -activated potassium channel, controls quant
QFHEQEGVFNHAPYSGLRFLRALRLMTVPDILQYLNILKTSSYIRLAQLLSIFISTSFISTSLAGAGVIHLLENSGDPWKDFVNSHRISYPDCVYFLLVTISTVGYGDIYCTTVLGRVFMVFRVFMVFFILGGLAMFASYVPEIADLIGNRQKYGGEYKGEHGKRHIVVCGHINYESVSHFLQDFLHEDREDVDVEVVFLHRVVPDLELEGLFKRHFTKVEFFTGQWRRRLYMKIKNAILSLI

SEQ ID NO: 140393 - protein, 109 aa, Heterodera glycines
  Coding regions on vcDNA: vcDNA=SeqID_66816; Strand=+; Position=1 -258,343-387,807-833
  Homolog annotation: Hit_ID=CAE67433.1; Match level="QueryCoverage =68%, HitCoverage=4%, E-value=1e-19, Identity=69%"; Hit description =Hypothetical protein CBG12923 [Caenorhabditis briggsae]
MGGWGRRGSGVSREPSPGANAMKSFLANIMRVISIKNYSSDIRVIVQLMQYHNKVLFIHFSCHYMQFYSINLLLFFKAYLLNIPSWDWRRGDDVICLAELKTNRASEGL

SEQ ID NO: 140394 - protein, 128 aa, Heterodera glycines
  Coding regions on vcDNA: vcDNA=SeqID_66817; Strand=+; Position=1 -53,1782-1841,2593-2751,3100-3210
  Homolog annotation: Hit_ID=NP_741647.1; Match level="QueryCoverage =97%, HitCoverage=11%, E-value=1e-52, Identity=79%"; Hit description =SLOwpoke potassium channel subunit, large-conductance calcium -activated potassium channel, controls quant
SPHMAEWLNEYLRGAGMEMYTETLSHSFVGMRFPDAAQLLFTRLGLLLLAIELKDDEKKECNIAINPGPSTVIQSQTQGFFIAQSADEVKRAFYWCKICHADVYDVSLIKKCKCKNLSLFRKGGKAMM

SEQ ID NO: 140395 - protein, 288 aa, Heterodera glycines
  Coding regions on vcDNA: vcDNA=SeqID_66818; Strand=-; Position=1 -215,289-434,508-784,1240-1468
  Homolog annotation: Hit_ID=AAH75367.1; Match level="QueryCoverage =53%, HitCoverage=33%, E-value=1e-12, Identity=31%"; Hit description =UBX domain containing 1 [Xenopus tropicalis] ref|NP_001005818.1| UBX domain containing 1 [Xenopus tropical
MDQTDHSAVGPSSSSPSLPVSSTVPRNALLFDPAAPAEVQQQQNAAEEEDDQFYELTAEDLRKMLKALQDESKRQNSLLPTKLMKERDQQLKHKAYKHSIVRFRLNNGQILQAQFLSTEPVSALFIFLRQIISPTIRFELRQIPTTSGKLKSDDSTTSLLDAGITPKSVLILKIVAADNSPESPEQMNADQIFVVDSFQSCTQTEAKAEAQKWLSSNTEFRPYLDTILHMLPSTDNSTATAAAMPSPVMPSSSAPHDSGGGGTNSQSRNNSQRTTKPSSELPKWLKRK

SEQ ID NO: 140396 - protein, 33 aa, Heterodera glycines
  Coding regions on vcDNA: vcDNA=SeqID_66819; Strand=-; Position=1-100
MPEQFTLGVQQPSDPICHAWECARDAIQQQQHD

SEQ ID NO: 140397 - protein, 253 aa, Heterodera glycines
  Coding regions on vcDNA: vcDNA=SeqID_66820; Strand=-; Position=1 -34,87-126,180-249,329-431,482-539,730-894,960-1101
  Homolog annotation: Hit_ID=XP_395431.1; Match level="QueryCoverage =100%, HitCoverage=28%, E-value=1e-41, Identity=40%"; Hit description= similar to ENSANGP00000018264 [Apis mellifera]
YKNDGKRVYLPFDPKPIDPKPILEGTRINSPHYLCQLIVREPGIPHYLCQLIVREPGIQRFTLVIAQYEKMKYEKMKTIYYSLRVYSSADFRCGNMPMPYKFHRKVAAEWRGPTAGGCGNAEWRGPTAGGCGNGASRETNNPLFHLCTEDGSDDNALLVELRGPKEFSVGFELAPVSLTRNDRTFETKDSGPFRPGFTVLQLDELPPGFTVLQLDELPAGTYSIRPMTFVAGQEGPFILRVDCSCKFELKRVQ

SEQ ID NO: 140398 - protein, 18 aa, Heterodera glycines
  Coding regions on vcDNA: vcDNA=SeqID_66821; Strand=-; Position=1-56
YREAIPEGFGLLINLGAS

SEQ ID NO: 140399 - protein, 36 aa, Heterodera glycines
  Coding regions on vcDNA: vcDNA=SeqID_66822; Strand=-; Position=1-191
RMGLRGRELLRQTGKIAAQMGGSFGVFMTVAQGIRC

SEQ ID NO: 140400 - protein, 135 aa, Heterodera glycines
  Coding regions on vcDNA: vcDNA=SeqID_66823; Strand=-; Position=1-408
MALITLREREDYYDAVRAEEEEAEKATLTSSTAANRGNEKQQEEEEEQEEARQLQQMMALLVANIDPVPMVYRQQRKAKNDSTNDGTDKGSNRVDNGLKWTGKRTTNGQKRAKTTKRQTMMMTKSMKPAKWLTRN

SEQ ID NO: 140401 - protein, 132 aa, Heterodera glycines
  Coding regions on vcDNA: vcDNA=SeqID_66824; Strand=-; Position=1 -134,181-282,1051-1210
  Homolog annotation: Hit_ID=CAE70126.1; Match level="QueryCoverage =40%, HitCoverage=8%, E-value=1e-11, Identity=69%"; Hit description =Hypothetical protein CBG16586 [Caenorhabditis briggsae]
MSMIAYSEDADDLSDSEVVATFLLSNTSNIWLRGLQFSLAESMEQCFDALKNSGLPISAEPSEDGMPWCNATWDTVLCWRLRVFRNLIHLHLMVALLAVVLIRLVLYIDLIFTDRMGHQQLVNPHGKTINTM

SEQ ID NO: 140402 - protein, 35 aa, Heterodera glycines; identical to SEQ ID NO: 124958
  Coding regions on vcDNA: vcDNA=SeqID_66825; Strand=+; Position=1-214

SEQ ID NO: 140403 - protein, 315 aa, Heterodera glycines
  Coding regions on vcDNA: vcDNA=SeqID_66826; Strand=-; Position=1-947
MRHAMRMFLVPEDVFQSVFVQPQAAAAAAADGADGTPIGLLRSRIQQIERSRELNEEQKAAQYHQEFKRLNKLVREQEEQPINVRLQHEKEREKNAATPPPPPPPPPPPPPPPPQTIDHSTPKRLEKNIVPSAFGLRRQRHHYTQKAGALSNRRPAQKQQRKAAAAAETPNSSGNGETEKEEGDEDDGEQWDDAQSSSSTASTGGAAAKRVLRARDGEAGKGGGGGGETADRLQPKHNYQMTKNALITHIRKKGHSLGVSDQGKVLRADGSEFKTSNVEAIVSHLLNRDKRSEFKGPPVGYKEFAEKAREDPLLK

SEQ ID NO: 140404 - protein, 59 aa, Heterodera glycines
  Coding regions on vcDNA: vcDNA=SeqID_66827; Strand=+; Position=1 -7,122-294
MSYPAAGLELKIFCGTGSRGINPANPAFKICGIPCGIAGFWKIEKISIKFKEFPKIKKC

SEQ ID NO: 140405 - protein, 58 aa, Heterodera glycines
  Coding regions on vcDNA: vcDNA=SeqID_66828; Strand=+; Position=1 -86,328-418
MLSFRMIPTMLDLDDKKKVIVENHAGAHPLINDTGLSNDAKNVSKKSYKLSKYAALNG

SEQ ID NO: 140406 - protein, 56 aa, Heterodera glycines
  Coding regions on vcDNA: vcDNA=SeqID_66829; Strand=-; Position=1-169
MPLSANFTKLAAFSIGILALLPILSAEAQAMETADDEGIDAQKLLFLACIQGKLES

SEQ ID NO: 140407 - protein, 92 aa, Heterodera glycines; identical to SEQ ID NO: 125147
  Coding regions on vcDNA: vcDNA=SeqID_66830; Strand=-; Position=1-304

SEQ ID NO: 140408 - protein, 42 aa, Heterodera glycines
  Coding regions on vcDNA: vcDNA=SeqID_66831; Strand=-; Position=1-141
MIGRAVRNRPFIFEGIFKFILYPRKMAISFFEKFYTHKSACV

SEQ ID NO: 140409 - protein, 95 aa, Heterodera glycines
  Coding regions on vcDNA: vcDNA=SeqID_66832; Strand=-; Position=1 -54,283-407,583-691
MLRTDKDELKEEKQRLKEVFLCANQQGWASPNAVAHVNRCNVSLGMDIWLHCWLGQMLNHSFPCRTRIATVDEGELAAELCLGTASLTQWRACAK

SEQ ID NO: 140410 - protein, 69 aa, Heterodera glycines
  Coding regions on vcDNA: vcDNA=SeqID_66833; Strand=+; Position=1 -93,356-472
MKEEEEEEEVVQLYFEAKQSKKRRIQWPKNTDSNLRGSNPLRLKRNALTTRPHMQWTTDPNYHFLCERA

SEQ ID NO: 140411 - protein, 50 aa, Heterodera glycines
  Coding regions on vcDNA: vcDNA=SeqID_66834; Strand=-; Position=1 -25,265-392
MTAKRMGDEIVDVESSGRSEEAADDEGARTARSTQQANCAIARIGLTWRR

SEQ ID NO: 140412 - protein, 428 aa, Heterodera glycines
  Coding regions on vcDNA: vcDNA=SeqID_66835; Strand=+; Position=1-1287
MVITRSPILTRQRALNLEIAVDRNGHQINVGGNQQNSPQRQNHSAGESFPQNQQIENSPISPTELAGFNGENGDDSSLVLEPNMTEEELRRRLLVVSIERSQPPANGNAGNGENAEGLRNAIRENDGRPNFGVNGQTFAHQRRPHDTFLSNLMNNGIGNFPQNLVHVPRTSTPTRNVEFEQQIGPFPFVVDRNNRAPTPPLNIRQQIFHPIPLNAHRINQVSVNAQRNIDVQYVPNNCVNVPPNVQRHCDIQYTAPNPVAAPSNAQQIQAGSRLIQNIPMQAQLWQGPDGKMTLVYPQDQQQQVQIEQPNLAQNHQKFTRQVFQIPETNQEPRHFPTYPQPNVAPSNLEFNLILERIPDLNGNEGTDSVRRFFKKFDAYTDGWPNAKRISALESKVYNKAERAFEAAKSKRLTESKNLEIYLICNFNQ

SEQ ID NO: 140413 - protein, 267 aa, Heterodera glycines
  Coding regions on vcDNA: vcDNA=SeqID_66836; Strand=+; Position=1 -252,299-731,950-1067
GGTTKQSAHSKGQYRTKSGAKSGEKRRKASMPLEMATQTAKNNANFQNSPPLMPQHRPTPGTFSPPPNRSLFPPQSLGIVQIGTSLPPQNEQPLLRFAPFLPPPPPQHGILRPPVPLFVPPAADAFIPSQFAPSFDSSATASTINAMNMNMVIPPLMMLHQQQQSNNNAERTTATAAATWTLFEMLAKGTTPNGQQQKNEMGQQSQQNNNTNRGQQNGTTENEGPINVTSPSHSLVVCSPNLLRNSESDAQIDQLMDQMIAQRHADD

SEQ ID NO: 140414 - protein, 140 aa, Heterodera glycines
  Coding regions on vcDNA: vcDNA=SeqID_66837; Strand=-; Position=1 -316,365-598
  Homolog annotation: Hit_ID=NP_501645.1; Match level="QueryCoverage =56%, HitCoverage=28%, E-value=3e-19, Identity=56%"; Hit description =phosphatidylinositol glycan class C like (4K106) [Caenorhabditis elegans] emb|CAA92490.2| Hypothetical pr
MAHFDLVVLFLCCFELVHSDVFGPFALFCFCSFASSATLLAHFALLRSSDLFQISSSDFVEYCRTFVTILAFGYAFTPVIRTLTTSISTDTIYACAILLFFASLFVHDYGINVPVVSLPLSANLCLAASVFLISRLQSDF

SEQ ID NO: 140415 - protein, 60 aa, Heterodera glycines
  Coding regions on vcDNA: vcDNA=SeqID_66838; Strand=+; Position=1-180
MVDRFQKGQCAAVEQQQKQNELNNTNNDEDADEHDELVQQRQQRTPIAPIMRQNSLHTLP

SEQ ID NO: 140416 - protein, 42 aa, Heterodera glycines
  Coding regions on vcDNA: vcDNA=SeqID_66839; Strand=+; Position=1-127
QLSSGSSSSASGAAAGRDVHVRTPLNDPRSPFKPLAYTSFEP

SEQ ID NO: 140417 - protein, 67 aa, Heterodera glycines
  Coding regions on vcDNA: vcDNA=SeqID_66840; Strand=-; Position=1 -108,271-363
  Homolog annotation: Hit_ID=NP_741578.1; Match level="QueryCoverage =97%, HitCoverage=6%, E-value=3e-12, Identity=44%"; Hit description =C2H2 type zinc finger containing protein (103.5 kD) (5J271) [Caenorhabditis elegans] gb|AAA96114.2| Hypoth
MSRKARDVMIKLREVSMRLGGAQYFKKRSNEAISCEKCGKLVINRLSDHAYSHLEGCDLFKCQQCNL

SEQ ID NO: 140418 - protein, 85 aa, Heterodera glycines
  Coding regions on vcDNA: vcDNA=SeqID_66841; Strand=+; Position=1-257
MAHFMQIENSAELYSNSANIRNASKLCPMRLFVGAMFSRLRDDFAKIEGSEKWHFDVVRGLAYLDLEFSDVALKKRRISEEQCTK

SEQ ID NO: 140419 - protein, 138 aa, Heterodera glycines
  Coding regions on vcDNA: vcDNA=SeqID_66842; Strand=-; Position=1 -129,185-295,568-744
  Homolog annotation: Hit_ID=NP_510116.2; Match level="QueryCoverage =91%, HitCoverage=50%, E-value=2e-19, Identity=32%"; Hit description =ADAMTS family member (162.6 kD) (adt-1) [Caenorhabditis elegans] emb|CAA90302.2| Hypothetical protein C02
MTHLLEGAGDAELGCGGQSVQRERCNDTKCELSPVNDGGQWGEWQPCSVSCGIGFQFRERLCADGPCANSGKQARTCNVQWSNWSQWTNCASCSVFETRKRHRQCVVKVATANGQQEETELGQEACNSAGGQSESTEI

SEQ ID NO: 140420 - protein, 20 aa, Heterodera glycines
  Coding regions on vcDNA: vcDNA=SeqID_66843; Strand=-; Position=1-60
MTVFFRIRLMSDGPQQEAHL

SEQ ID NO: 140421 - protein, 133 aa, Heterodera glycines
  Coding regions on vcDNA: vcDNA=SeqID_66844; Strand=+; Position=1 -159,364-606
MFHNSTYFLIVFLLHEILIFTSVHCTMAKKKLHQQQREENFDSTTSAFSPKFELHRRHHKHRLRRAVIKICVDFNRQPIACKWETEAQLRKKLMACHLSIITMPFCHRTVPKITRKMHKIQRDRRRGGIFSAL

SEQ ID NO: 140422 - protein, 52 aa, Heterodera glycines
  Coding regions on vcDNA: vcDNA=SeqID_66845; Strand=-; Position=1 -147,204-215
MVLGFEFFATLSLLANWMVSVSVCCSTVTVFLAFPFFTWVLFEFAFFTTDNK

SEQ ID NO: 140423 - protein, 222 aa, Heterodera glycines
  Coding regions on vcDNA: vcDNA=SeqID_66846; Strand=+; Position=1 -92,653-1229
MSTVQLSGFVQMSTSKYPLSKCPDVHFPNVRITEIVVEIILDNCELLKKIDKSITNFIDAELEQKIIQQNCDALKNDKKIDDAKLSGEQLPILIQKHGQKMLEKLKEIETEKNVDKMSQILAPTNEQQQQHQPNWHNDQKMQKAVIIFNFLREIFAVLQSDSNANDDDDPMAKNAKSVIQQFLTTQSQKPTVVPMPSELMGLVIKLWPIIYNNAPQNQRKNQ

SEQ ID NO: 140424 - protein, 110 aa, Heterodera glycines
  Coding regions on vcDNA: vcDNA=SeqID_66847; Strand=-; Position=1 -128,409-555,641-698
  Homolog annotation: Hit_ID=CAE72788.1; Match level="QueryCoverage =99%, HitCoverage=21%, E-value=4e-30, Identity=59%"; Hit description =Hypothetical protein CBG20050 [Caenorhabditis briggsae]
YRDSFVDAFTVPESVGTGQIAIAFYSGLWAYNGWNYLNFITEEMVNPVRDLPRAIFISCTLCTLFYVLANVAFYAGTSPDELLESKAIAVTFANKFYGAFAFAMPILVAG

SEQ ID NO: 140425 - protein, 111 aa, Heterodera glycines
  Coding regions on vcDNA: vcDNA=SeqID_66848; Strand=+; Position=1 -40,373-451,774-905,996-1081
EERASPSPKRWTKRKFVICIPKFTNLKSENGATRRRPSSLSDSLEAADQKIARLSDSLKGADQKIAQLSDSLKGADQKIVELTAEVKDLRAAAELQVQNGAVPPVPNLVAE

SEQ ID NO: 140426 - protein, 44 aa, Heterodera glycines; identical to SEQ ID NO: 126591
  Coding regions on vcDNA: vcDNA=SeqID_66849; Strand=+; Position=1 -45,128-217

SEQ ID NO: 140427 - protein, 92 aa, Heterodera glycines; identical to SEQ ID NO: 131128
  misc_feature (45)..(45): Xaa can be any naturally occurring amino acid
  Coding regions on vcDNA: vcDNA=SeqID_66850; Strand=-; Position=1-998
  Homolog annotation: Hit_ID=XP_523367.1; Match level="QueryCoverage =91%, HitCoverage=58%, E-value=2e-21, Identity=66%"; Hit description =PREDICTED: similar to rRNA intron-encoded homing endonuclease [Pan troglodytes]

SEQ ID NO: 140428 - protein, 120 aa, Heterodera glycines
  Coding regions on vcDNA: vcDNA=SeqID_66851; Strand=+; Position=1 -79,194-283,473-804
  Homolog annotation: Hit_ID=NP_005623.1; Match level="QueryCoverage =95%, HitCoverage=10%, E-value=4e-16, Identity=40%"; Hit description =small optic lobes [Homo sapiens] gb|AAK61233.1| small optic lobes homolog [Homo sapiens] emb|CAC14067.1|
ATRYLTNEFAGLVLMVDNYSSDNCLKVHSDCQNSTNVLSTRSSLLAFDSIPPLHRQVVTLLTHFEPSQSFMVTHRWVYHQTKFPQLRDFVPCTEFASAQNFPPLQTETIGYLHGPFPVYK

SEQ ID NO: 140429 - protein, 83 aa, Heterodera glycines
  Coding regions on vcDNA: vcDNA=SeqID_66852; Strand=-; Position=1-252
MPMPANDKVFNMSPDAQELEQRPLPEPQQAELLKQTGEQQEELLIQIGDVEDTLLLTEHEGEERKDEANQELGRTIMLSKLNN

SEQ ID NO: 140430 - protein, 27 aa, Heterodera glycines
  Coding regions on vcDNA: vcDNA=SeqID_66853; Strand=+; Position=1 -68,466-481
MKKGTGTKKFKLEASNQVKNWFSFFIF

SEQ ID NO: 140431 - protein, 54 aa, Heterodera glycines
  Coding regions on vcDNA: vcDNA=SeqID_66854; Strand=-; Position=1-403
LVTNHHTNFLVPFLLPPFALQIYTFIKLLYFKFTNFVKDKIRLMTQRPPQSFKL

SEQ ID NO: 140432 - protein, 89 aa, Heterodera glycines
  Coding regions on vcDNA: vcDNA=SeqID_66855; Strand=+; Position=1 -15,53-143,199-362
MGGRIKAQRDLAQAKDLLGNVAQHLAPIPRGQLRNLIASFFEVGYTFGMTPPHEANHAPTQENFKVQFDRITELLQNADATRINKASQC

SEQ ID NO: 140433 - protein, 92 aa, Heterodera glycines; identical to SEQ ID NO: 125147
  Coding regions on vcDNA: vcDNA=SeqID_66856; Strand=-; Position=1-304

SEQ ID NO: 140434 - protein, 63 aa, Heterodera glycines
  Coding regions on vcDNA: vcDNA=SeqID_66857; Strand=-; Position=1-235
MIGRAVRNRPFIFEGIFKFILYPRKMAISFFEKFYTSQKRLRMRRRAVHNRHFISQRIFIFRG

SEQ ID NO: 140435 - protein, 36 aa, Heterodera glycines
  Coding regions on vcDNA: vcDNA=SeqID_66858; Strand=-; Position=1 -7,155-258
MTFIQNNFGLCRQMVSHRTLSGSYSMAFAYRSATSP

SEQ ID NO: 140436 - protein, 18 aa, Heterodera glycines
  Coding regions on vcDNA: vcDNA=SeqID_66859; Strand=+; Position=1-56
YREATPEGFGLPINLDAS

SEQ ID NO: 140437 - protein, 304 aa, Heterodera glycines
  Coding regions on vcDNA: vcDNA=SeqID_66860; Strand=-; Position=1 -370,466-639,851-1223
  Homolog annotation: Hit_ID=NP_507880.1; Match level="QueryCoverage =82%, HitCoverage=57%, E-value=4e-76, Identity=56%"; Hit description =sulfotransferase ST1B2 (5U596) [Caenorhabditis elegans] emb|CAB60475.1| Hypothetical protein Y113G7A.11 [
LCFTSPMIERLGAEFCDSLKYPRLLKTHFSWANLPKRHLQQSATTTNGTAQPKYIFAVRNPKDCCVSYFHHNRNFKIYEWAHGKFDDFFELFLEGRLMAFGDYFEHLLSWLPHLSDANVLFLKYEDMLNDLEGSVRKIGHFLGGHAEKLVNDQQTLSRIVAESRLEAMQRDQQRWFPGTALNGESFVRKGTSRDWKNYMSKEQSDRMGRAFRQKLAGTVAENWWRTEMRWNEAEEEEEEEKKEEKEEEEKENEQEQREAKKKEEDDSGMESGDDLLERSAKVSDDSLRLNGSPAPQGPTTTDSK

SEQ ID NO: 140438 - protein, 66 aa, Heterodera glycines
  Coding regions on vcDNA: vcDNA=SeqID_66861; Strand=+; Position=1 -93,268-375
MRQPTQQMLKIVAECHQPAFKEQLEKVVEFAQSRVLQTVAKLGAQTLDHMRYDIPLVQFNARTMAD

SEQ ID NO: 140439 - protein, 159 aa, Heterodera glycines
  Coding regions on vcDNA: vcDNA=SeqID_66862; Strand=-; Position=1 -25,1008-1101,1138-1419
  Homolog annotation: Hit_ID=NP_507880.1; Match level="QueryCoverage =88%, HitCoverage=26%, E-value=7e-37, Identity=55%"; Hit description =sulfotransferase ST1B2 (5U596) [Caenorhabditis elegans] emb|CAB60475.1| Hypothetical protein Y113G7A.11 [
AKLAFLSPMIERLGAEFCDSLKYPRLLKTHFSWANLPKRPQPKYIFAVRNPKDCCVSYFHHANLPKRPQPKYIFAVRNPKDCCVSYFHHNRNFKIYEWAHGKFDDFFELFLEGRLMAFGDYFEHLLSWLPHLSDANVLFLKSVWRSKFIQNFLFLLKFF

SEQ ID NO: 140440 - protein, 104 aa, Heterodera glycines
  Coding regions on vcDNA: vcDNA=SeqID_66863; Strand=+; Position=1-438
NGLSKNRNYAQKASQTILTLPIPSTIAFIHPIMSAKIIRVPKIACDLSLAKNGLSKNRNYAQKASQTILALPIPSTIAFIHPIMSAKIIRVPKIACDLSLEKMV

SEQ ID NO: 140441 - protein, 89 aa, Heterodera glycines
  Coding regions on vcDNA: vcDNA=SeqID_66864; Strand=+; Position=1 -388,559-841
FLFKKIFFWVFGAVPLNRCAQIYGETESFGNSFPIGCTLILRWIFAPHNCLSTPNGHLKKSIFLFSGQSPRTDAPRFMGRPNPSGIAYL

SEQ ID NO: 140442 - protein, 62 aa, Heterodera glycines; identical to SEQ ID NO: 126119
  Coding regions on vcDNA: vcDNA=SeqID_66865; Strand=-; Position=1-286

SEQ ID NO: 140443 - protein, 129 aa, Heterodera glycines
  Coding regions on vcDNA: vcDNA=SeqID_66866; Strand=-; Position=1-390
MTHTLWVPPPIDSSTQQFVYSTIRLLYDSSTQPKCDDSSTRSNVNDSSIIRFVYSTIRLLSQNVTIRLLGQMSTIRLLYDSSTRRFVYSAKMRRFVYSSKKVRKPGFELEQTLKPFFRGFLLKKAVTIV

SEQ ID NO: 140444 - protein, 49 aa, Heterodera glycines
  Coding regions on vcDNA: vcDNA=SeqID_66867; Strand=+; Position=1-152
MKYSNEEKLRKTKEYFEIKAKNPKISDSIIATNLGIGWATLKKWKKKLA

SEQ ID NO: 140445 - protein, 304 aa, Heterodera glycines
  Coding regions on vcDNA: vcDNA=SeqID_66868; Strand=+; Position=1 -55,193-405,1093-1232,1380-1465,1589-1664,1934-2105,2763-2788,3219 -3365
MKAFILTFINICLIASMPSTPCPLFGTLQLELNNFLEYANEPVGSLRRGNSVNIRGMSWQLSAELTESAAEDGTKYLGLNLYCNNNCKIDANWNCFSMLEFRITVGQVDVMSKKLPATNFTAQNSSLGITNFIKIQNLVDVCRHLKDYTVQIVANVKPDQPCGTSLPRTDAILVKTSNDQIGVEVNINRNLLAAHSSSFNDFFANFQPPAESTSSTGGLSIMLDAPSTAEHFEQLMDLLHYGDCVLEDIYGLDALKEFILYNLLQESDFVAQYFLQNLEIIEQLSDGAKIALKQRIKELLEAAQ

SEQ ID NO: 140446 - protein, 157 aa, Heterodera glycines
  Coding regions on vcDNA: vcDNA=SeqID_66869; Strand=+; Position=1 -152,244-413,463-611
  Homolog annotation: Hit_ID=CAE56536.1; Match level="QueryCoverage =96%, HitCoverage=16%, E-value=2e-35, Identity=47%"; Hit description =Hypothetical protein CBG24263 [Caenorhabditis briggsae]
MDDEQFVAFARHRHANAERISTWMHDEKQRPRELGQNQLGFFLMWLRYELREKEKAGWLSTVEIRTEGLSTDQDDLPVSISVSYFALALQGPFQPLSNYYALPFEFKGESYRSVEHYAYQRLFEALKFPPEEVMRLRTTVKPADVAKCAQKVFDKQQ

SEQ ID NO: 140447 - protein, 153 aa, Heterodera glycines
  Coding regions on vcDNA: vcDNA=SeqID_66870; Strand=+; Position=1 -201,251-511
  Homolog annotation: Hit_ID=NP_498037.2; Match level="QueryCoverage =79%, HitCoverage=22%, E-value=7e-20, Identity=39%"; Hit description =yeast ULA (ubiquitin activating) homolog (60.8 kD) (ula-1) [Caenorhabditis elegans] gb|AAA21162.2| Yeast
SIFDQIEPADVRAVPPRVHPLCWYAIWRATDRFRALNGRFPGSIASSQKGDAKELKEIVGKLFSETQNAELISSQDELVPPETIAEVCRYGGSEPHVVAAILGGCVAQEAIKLCTHQYMPVDNSLLFDAHSQQAASFRVVASQREEQRTRKTR

SEQ ID NO: 140448 - protein, 167 aa, Heterodera glycines
  Coding regions on vcDNA: vcDNA=SeqID_66871; Strand=-; Position=1 -136,186-553
KKNEENREKKVANFLSEKWAIIKQEKPQLANIFTLLQTSFNTLKGDFGNVNALKMLKKQIVDAAFLLTDHIQISHDQILPLNRQNGLNMIKELAKLWVNSREFNGKCIVDENYGNKNENHGQTGEDDDGDNYDRSRQWQRKILQLILSAVDDEPLKMATNGIFRIKK

SEQ ID NO: 140449 - protein, 24 aa, Heterodera glycines
  Coding regions on vcDNA: vcDNA=SeqID_66872; Strand=-; Position=1-80
RTLSTAVRQRSSKIYSMPQILWAG

SEQ ID NO: 140450 - protein, 97 aa, Heterodera glycines
  Coding regions on vcDNA: vcDNA=SeqID_66873; Strand=+; Position=1 -133,177-337
MVDQFVQPETAEEQQVKAKKPRVDERFLWKITRGQFVLAIRLCSEDWNNLFHNKDKTRRLEDGRVAIGLEMCEECARINCCVSDMIADQKKKPKTTE

SEQ ID NO: 140451 - protein, 48 aa, Heterodera glycines
  Coding regions on vcDNA: vcDNA=SeqID_66874; Strand=+; Position=1-148
DQFKWDDAASRVRTLDEAFTKLVDMNNLIKQQPPVPSVKSNNTNPFVV

SEQ ID NO: 140452 - protein, 463 aa, Heterodera glycines
  Coding regions on vcDNA: vcDNA=SeqID_66875; Strand=-; Position=1 -275,519-1140,1796-2290
MPSNGFSHVAVPYSSSSSSHHYPIPPPASCITVPSPSTEFSRLDISLANPCFGLLPAVATAATKTATTAATTVPIQPQQSPATYSASGQQTNKLERQSVPFHHRTSEESPPLAQNCENPIFDLIMMAANNKSAAGGKQRQLPQTANGGGTKKEDAEDDEQQKHLKRTAPPPPPPRSSLARFSTRACLPMPSEQDEHDELASTEELFRIGGNNGIGRGANNAASRLIGMRNAIDDDEDNDDFDGIGVGRGGWGGGRAEKRTKKMVVPNEDNNDDHDDDGTFAENVGVSLAGDGSDCLHHFQQQIARHHRHNRLHHHQAAPPIVVGPTSSSFSSSTLAASSSSSSAPIVLPPPKRKYHHHQQVHRLLMASLGMRRNGANVNNGTAPTTATVGGQHRRRRGTHFRHQQQSMLPTVPDIDDKEEETEQDELHHGNHDGSNTTTNCAATACEGGTAAEDKSHEIMAVQ

SEQ ID NO: 140453 - protein, 43 aa, Heterodera glycines
  Coding regions on vcDNA: vcDNA=SeqID_66876; Strand=+; Position=1-171
KCSISYCIFVDNNFPKNPKISTKIGRDSRIGIPSKSPIPINPQ

SEQ ID NO: 140454 - protein, 92 aa, Heterodera glycines; identical to SEQ ID NO: 129555
  Coding regions on vcDNA: vcDNA=SeqID_66877; Strand=+; Position=1-304

SEQ ID NO: 140455 - protein, 97 aa, Heterodera glycines
  Coding regions on vcDNA: vcDNA=SeqID_66878; Strand=-; Position=1-294
MLIRHKKSTGGGFSKIVMLPDGTEFNVNTNKCEGLWAQLKQKTKRIHGTSTNLTNSYMCEQIFRLNAKTKGKSIFNAFCDLLRHNYNFIRHNCLVNV

SEQ ID NO: 140456 - protein, 67 aa, Heterodera glycines
  Coding regions on vcDNA: vcDNA=SeqID_66879; Strand=+; Position=1-204
MVGGVEIDIKTVPWTVLFQGLVKRNEQNKMIIFQNCASIFISPEFVLLAAHCFDKIKEGKYFHLGKK

SEQ ID NO: 140457 - protein, 18 aa, Heterodera glycines
  Coding regions on vcDNA: vcDNA=SeqID_66880; Strand=+; Position=1-56
YREAIPEGFGLPINLGAS

SEQ ID NO: 140458 - protein, 19 aa, Heterodera glycines
  Coding regions on vcDNA: vcDNA=SeqID_66881; Strand=+; Position=1-59
AREQLASDASAAVAVRLTV

SEQ ID NO: 140459 - protein, 90 aa, Heterodera glycines
  Coding regions on vcDNA: vcDNA=SeqID_66882; Strand=+; Position=1 -136,329-465
MARHQAQCVGQLFRVRCRVHLLPVHQIRAPVHLRPVHNHPAGPGRRVVEGRLITNPGSDRALPIHYDELYEGQRIDRLPVPIIPSLARCP

SEQ ID NO: 140460 - protein, 149 aa, Heterodera glycines
  Coding regions on vcDNA: vcDNA=SeqID_66883; Strand=-; Position=1 -98,148-238,382-528,586-699
  Homolog annotation: Hit_ID=XP_222275.2; Match level="QueryCoverage =99%, HitCoverage=9%, E-value=2e-49, Identity=61%"; Hit description =similar to slingshot 1 [Rattus norvegicus]
TSQDIRRRLSEQISVDQRRYKEFIDHQMLVILGQLDRPSKIFDYLYLGTEWNASNWEELKANGVQYILNVTKEVDNFFPTQFTYLKIWVSDEATTELLMHWQRTYDFIKEAKEKGAKVLVHCKKGISRSASTVIAYAMKAYGWGLDEAL

SEQ ID NO: 140461 - protein, 149 aa, Heterodera glycines
  Coding regions on vcDNA: vcDNA=SeqID_66884; Strand=+; Position=1-447
MPMAHGNRCVAIKVVDMNKIEPEKVNQLNNEAAILHELKARGVKLIPQLYTMYGRKTKGELIPQLYTMYGRKTKGELIPQLYTMYGRKTKGELIPQLYTMYGRKTKGELIPQLYTMYGRKTKGELIPQLYTMYGRKRKGNSSPNCTQCT

SEQ ID NO: 140462 - protein, 37 aa, Heterodera glycines
  Coding regions on vcDNA: vcDNA=SeqID_66885; Strand=+; Position=1-155
SEKNIYETKKSIFSSVRLGYSNIYGERKSNAELKYRL

SEQ ID NO: 140463 - protein, 932 aa, Heterodera glycines
  Coding regions on vcDNA: vcDNA=SeqID_66886; Strand=-; Position=1 -270,356-480,531-641,926-1161,1217-1289,1346-1463,1507-1627,1692 -1783,1892-1996,2053-2178,2249-2383,2445-2531,2617-2760,2811 -3031,3105-3273,3330-3542,...
  Coding regions on vcDNA: Position=...3682-3838,3984-4179,4509-4605
  Homolog annotation: Hit_ID=NP_609181.2; Match level="QueryCoverage =94%, HitCoverage=56%, E-value=1e-105, Identity=28%"; Hit description= CG31756-PA [Drosophila melanogaster] gb|AAF52603.3| CG31756-PA [Drosophila melanogaster]
MIGGERELSLSASSSSIGAPNGTVPPASSANGASSQNRSLPISAALLTQQQYPHGQQQHGQIVTKARDFPITIRSMRISLALLTNYHPILASQNELILTILLDLLWMPTNSWEAAVAVEVFRKIIGQPTLLKWLCAREEGAKFVELLFSRLYSFLRKCLEEGEPFAVFVLDWLDKHSAERIPEAYCLSVGFATLVDATGAVCSAVESGELLPAQNGATTAKEEMPKSEEKCQKANLDSSASLPQAYSDIAKELFQVAHSFLCSAISTLLDFSVDDSITEHLLTCLSSLVTLACKFGNADAKHSLLRAFCRAALPCQYFSRFVDSHSSASLALQSGAMANGSVGANSDLSLKDSSVEPTQVVAMGTVCPSPHHPSQFFNTTVMMTAKNLQVARLLIGCVHQNGHLLGDCWEMVLTTIQHFVWIVGLRPTSTGTFRAGGETKSASEGGGVMSTTSASAASTPLTLIFALCQNHQLNVLFESTSTLDEVSIHHIIAALCKLSNESMTVAQTSSRETSFFSIAKLLQTALVNLPRLHLCAHSSAATREWGAVSLTQLVRSAMKQTIAEQRELETNKKTAKNEETIKREQLILNPLAAICEIEFLDVRAKQLGQYQIHLTNWIIFNCSSPQIVLCAFSSPTVAPLSRLCGLPSCKLSLPCTDPQLIDQSFRVLSLVIKEFLAVVPFECVQMLVETNALYGQQQIHLNVALASVGQLWDISDFVRRAQQNVGKEEAETAWLCIYAALGRLCVDARPPVRKSACDTLLQTVAAHGQALGTQKWAEMLTDVLFPMLDRVRHLTQTASTHRSNTSTLGAPNLMIHHSRDTYQPNGLIFSFNVQKAFPDFWSQLLTHIELAAKADSAEMSLAALKNMQDLLFGRQQQTEGQQQQQTIGIRGKQQMSTNGRKHYVPGLYHLTTLLEMFQQLFHRVRRQIPIED

SEQ ID NO: 140464 - protein, 104 aa, Heterodera glycines
  Coding regions on vcDNA: vcDNA=SeqID_66887; Strand=+; Position=1-643
TFCGFRVFWTNSHSITLIFGPHLAANDSPSIRDEKIGQQGFIFKGTCLIHSSLAFNFSALGVFLPLDETQLSQKRSILCVFLPFLFMFLAFIFCPPLSPFSLDW

SEQ ID NO: 140465 - protein, 95 aa, Heterodera glycines
  Coding regions on vcDNA: vcDNA=SeqID_66888; Strand=+; Position=1 -18,661-791,933-1071
MPLNYAQMKSICKKQKTKKNEKKTKKGEQFIHHSSSKDEKKKRNEKRRKSKWRKNNDLTEREGEKDKAKKERILKTNSQMADFISIFFFFVLAMS

SEQ ID NO: 140466 - protein, 281 aa, Heterodera glycines
  Coding regions on vcDNA: vcDNA=SeqID_66889; Strand=-; Position=1 -118,184-301,766-845,894-1103,1148-1226,1291-1341,1398-1474,1540-1652
  Homolog annotation: Hit_ID=CAE62180.1; Match level="QueryCoverage =96%, HitCoverage=49%, E-value=5e-76, Identity=53%"; Hit description =Hypothetical protein CBG06227 [Caenorhabditis briggsae]
MLRLPTFFKGYLWLLYLGVIVLFIYYFRVPLKAYEKFESLLSMSMYFNNLTPKFYVALTGTSSLVSGIILIFEWWYFKNNAIENALESEDGSDIDENYDGTKPLPELTEYDENGHEGNDCKVWRNPMALFRGAEYQRFTRETGQEPLTFYDLNLSAQDHQTFFCCEADAGKEDLEIMSMVWRERDSQVRISEAKRALKVNSELAEEFCQSVAEVEETLRKALRIVEGMYKRSQAAMYPDPESQQKSRDINMLVFIRRRLAMCARRQGRVREAIKMMRDVSD

SEQ ID NO: 140467 - protein, 275 aa, Heterodera glycines
  Coding regions on vcDNA: vcDNA=SeqID_66890; Strand=+; Position=1 -36,905-1074,1159-1438,1800-2139
  Homolog annotation: Hit_ID=NP_701342.1; Match level="QueryCoverage =95%, HitCoverage=27%, E-value=2e-12, Identity=26%"; Hit description =MAEBL, putative [Plasmodium falciparum 3D7] gb|AAL10509.1| erythrocyte binding protein 1 [Plasmodium falc
MDDANIAAILAFVISSPRGEEVVRIHALQREVKALRQIRDVFGREKDKAEELCQQKERENNNLLKKIERMQAQIACITPCAERTPVLEDQLLMMETQAATNARQLQDAEKRAQNAEKFAADLKFELKKMDIKHDNLEKIVEEQSAKIRMSRDDSDAVEQLRKDQEKDTYWKMIDQCKARSEENTQKAYDELKKTQEEKRNLERELAEGKRTMNELLELAEQQKEVITACDSDRTELEKAQKELDTVQKQSAERERFWKSEMERMQREIVAQEKTK

SEQ ID NO: 140468 - protein, 103 aa, Heterodera glycines
  Coding regions on vcDNA: vcDNA=SeqID_66891; Strand=+; Position=1 -191,599-634,930-1014
MNELSARSTQANVQQQNDMERSFRSGMNRTQSMSVTFVSRLGSAMSHQETLSNLDSAGMNDDESGMKKEKYRMSNGETGWCAEELADRVQRLMEGCFVASTWT

SEQ ID NO: 140469 - protein, 87 aa, Heterodera glycines
  Coding regions on vcDNA: vcDNA=SeqID_66892; Strand=+; Position=1 -132,179-310
MAPSVYSNFASDASVQLALNVPLPRNVCCTQIDNVHTQIDNVHEMLYLLLRHRRFREKFLNDDDNRELKKRLLRALMREEIIPSEEN

SEQ ID NO: 140470 - protein, 58 aa, Heterodera glycines
  Coding regions on vcDNA: vcDNA=SeqID_66893; Strand=-; Position=1-321
FRPRGRLGPNPKIEKCAFLKIKILKTKPEGSLATWHKLGLINIRSFFTILLIPNPIIF

SEQ ID NO: 140471 - protein, 207 aa, Heterodera glycines
  Coding regions on vcDNA: vcDNA=SeqID_66894; Strand=+; Position=1 -162,361-819
MAGFIACHMSALSKNRSFWAMASSNHSIMEEIVANHTMTPRLTATVRSLINNRPDEVMSDRRDYQVILGCDLMAKLPPITFDFVQGLISISGKSVTMGERGDLLYSNVKVVARHHVDIQPGSYSMLTGKLDSQIQLDQVITHSLDGRLSKMHLGMISTVAKPVEGCIKMILTNPTDAPISICAGMHVALVNELKQSVDGPWLEEQSQ

SEQ ID NO: 140472 - protein, 33 aa, Heterodera glycines
  Coding regions on vcDNA: vcDNA=SeqID_66895; Strand=-; Position=1-100
HLEQSISTNAFTPPSRRFQVQNCRFCEFGVIND

SEQ ID NO: 140473 - protein, 32 aa, Heterodera glycines
  Coding regions on vcDNA: vcDNA=SeqID_66896; Strand=-; Position=1-96
MADLQKLSGADRLLLCRRYFHVGFVCLPLLWA

SEQ ID NO: 140474 - protein, 79 aa, Heterodera glycines
  Coding regions on vcDNA: vcDNA=SeqID_66897; Strand=-; Position=1 -30,274-483
MEKERSTSTEKFFRSLGVKKADLPHGGRSNRGFLEICQYMDIKYGHKSRNMEKYGNMDINREIWKNMDIESYPRSFKPS

SEQ ID NO: 140475 - protein, 29 aa, Heterodera glycines
  Coding regions on vcDNA: vcDNA=SeqID_66898; Strand=-; Position=1-88
DYFSKHLVDWGIIGDYGINRDWAIIRAYT

SEQ ID NO: 140476 - protein, 196 aa, Heterodera glycines
  Coding regions on vcDNA: vcDNA=SeqID_66899; Strand=-; Position=1-591
  Homolog annotation: Hit_ID=CAH99519.1; Match level="QueryCoverage =85%, HitCoverage=20%, E-value=1e-21, Identity=28%"; Hit description =hypothetical protein PB000319.03.0 [Plasmodium berghei]
MAKMSKYGHKMAKMSKYGHKMAKMSKYGHKMAKMSKYGHKMAKMSKYGHKMAKMSKYGHKMAKMSKYGHKMAKMSKYGHKMAKMSKYGHKMAKMSKYGHKMAKMSKYGHKMAKMSKYGHKMAKMSKYGHKMAKMSKYGHKMAKMSKYGHKMAKMSKYGHKMAKMSKYGHKFFKIECKISSNLLVEIAYEIHFQILG

SEQ ID NO: 140477 - protein, 393 aa, Heterodera glycines
  misc_feature (379)..(379): Xaa can be any naturally occurring amino acid
  misc_feature (391)..(391): Xaa can be any naturally occurring amino acid
  Coding regions on vcDNA: vcDNA=SeqID_66900; Strand=-; Position=1 -152,793-940,1039-1093,1176-1208,1263-1285,1374-1460,1577-1683,1889 -1968,2274-2405,2739-2768,3133-3278,3332-3453
  Homolog annotation: Hit_ID=NP_499400.1; Match level="QueryCoverage =89%, HitCoverage=62%, E-value=1e-126, Identity=63%"; Hit description= cuticlin protein family member (3M5) [Caenorhabditis elegans] pir||T23760 hypothetical protein M142.2 -
YAIGVTNLVNIRPLFSSSVYALRVHTPPPFDQLDKSLADSITWHMCSTEFHGTPEIICEPDKIGVRASTKKQFDGIVFVQDNFDRAECRAGPEHFPDPKIIGITVPFRNCNVRRYRSLNPRGIFVEMAVVFMFVVFMFHPVFMTKVDQFMTKVDQMVKIQCFYMEAEKEVKVPMEVSQITTQFYQQVYQMPRCEYTLRKDHANGPVVQYAVLGQSVFHRWECVEELNGDQFGMLVHSCFVDNGFGDRVDILDSRGCGLDAVLLRTPDYDSTLRLATKEYHVFKYADRPVLQFQCQITLCLKLDNGCAGITPPKCRNCATAHRHRAVHHSKTRRKGSERCADGGTKVDVFTRPIGGTKVDVFTRPIMVGFMEILGNIIYXLRDNIANNETFXNS

SEQ ID NO: 140478 - protein, 37 aa, Heterodera glycines
  Coding regions on vcDNA: vcDNA=SeqID_66901; Strand=+; Position=1 -80,660-693
MILDYLEHMVFLGGQPQCAVVVGSAQHARSPCKLTDT

SEQ ID NO: 140479 - protein, 15 aa, Heterodera glycines
  Coding regions on vcDNA: vcDNA=SeqID_66902; Strand=-; Position=1-46
MNWRGYGGSMGSTWG

SEQ ID NO: 140480 - protein, 141 aa, Heterodera glycines
  Coding regions on vcDNA: vcDNA=SeqID_66903; Strand=-; Position=1-438
NCNYAQKAPQTILALPIPSTIAFIHPIMSAKIIRVPKIACDLSLEKNGVSKNRNYAQKAPQTILALPIPSTIAFIHPIMSAKIIRVPKIACDLSLAKNGVSKNRNYAQKAPQTILALPIPSTIAFIHPIMSAKIIRVPKIA

SEQ ID NO: 140481 - protein, 57 aa, Heterodera glycines
  Coding regions on vcDNA: vcDNA=SeqID_66904; Strand=+; Position=1 -3,257-427
MKNGLKKFWYYLVELYKGFKPVTTLELAEFKKFVKLCDQQNIKDVGNNILKFYNVYY

SEQ ID NO: 140482 - protein, 163 aa, Heterodera glycines
  misc_feature (33)..(33): Xaa can be any naturally occurring amino acid
  Coding regions on vcDNA: vcDNA=SeqID_66905; Strand=+; Position=1-910
EIVSLFSSLPPRVRVGICAPAAILRRSGHFSGXFSGVEPLSSVTRHHHGSQIHYHRKLIRQTLERHVAGTRPCDQLSCSESTLDARRALGFVANKCAPLWGDWSFGACISSRITTVIQVRSQGQVNYSWCNEPYAVSLSGRLNLHMHGLIFEMNTSVQAGSTR

SEQ ID NO: 140483 - protein, 50 aa, Heterodera glycines
  Coding regions on vcDNA: vcDNA=SeqID_66906; Strand=+; Position=1-155
IARCVAGEVPPQKTRKYRAVDARILDSYRVTIPSTTSTLLTKMIKITIQC

SEQ ID NO: 140484 - protein, 25 aa, Heterodera glycines
  misc_feature (5)..(5): Xaa can be any naturally occurring amino acid
  Coding regions on vcDNA: vcDNA=SeqID_66907; Strand=+; Position=1-78
FVTSXQALAIYSIFFDVIQPFECVR

SEQ ID NO: 140485 - protein, 29 aa, Heterodera glycines
  Coding regions on vcDNA: vcDNA=SeqID_66908; Strand=-; Position=1 -66,123-146
MAISFFEKFSMQQTLSNMKRSAKNGYLFF

SEQ ID NO: 140486 - protein, 29 aa, Heterodera glycines
  Coding regions on vcDNA: vcDNA=SeqID_66909; Strand=-; Position=1 -66,123-146
MAIYFFEKFSMQQTLSNMKRSAKNGYLFF

SEQ ID NO: 140487 - protein, 29 aa, Heterodera glycines
  Coding regions on vcDNA: vcDNA=SeqID_66910; Strand=-; Position=1 -66,123-146
MAISFFEKFSMQQTLSNMKRSAKNGYLFF

SEQ ID NO: 140488 - protein, 39 aa, Heterodera glycines
  Coding regions on vcDNA: vcDNA=SeqID_66911; Strand=+; Position=1-118
VRLGYSNNYGEQKSKAEIKYRYREAIPEGFGLLINLGAS

SEQ ID NO: 140489 - protein, 83 aa, Heterodera glycines
  Coding regions on vcDNA: vcDNA=SeqID_66912; Strand=-; Position=1 -9,1241-1371,1429-1486,1589-1642
  Homolog annotation: Hit_ID=CAE60568.1; Match level="QueryCoverage =74%, HitCoverage=8%, E-value=3e-14, Identity=56%"; Hit description =Hypothetical protein CBG04197 [Caenorhabditis briggsae]
MVEWEVPWQRCNNTWNTQQCRESLNATMGTEDDNGQQLRTPSQEFYLYSVLESNKSKGMDDLGGIKIIKYNYIILFVNFTFVN

SEQ ID NO: 140490 - protein, 50 aa, Heterodera glycines
  Coding regions on vcDNA: vcDNA=SeqID_66913; Strand=-; Position=1-151
MANSWSAGGGYGNLLAIDDDENTTTEEEKSGTGIAGGGGGEGFTVGHGTE

SEQ ID NO: 140491 - protein, 172 aa, Heterodera glycines
  Coding regions on vcDNA: vcDNA=SeqID_66914; Strand=-; Position=1-521
PHGYLDHHHQLHHQQQRRSCFHLRTMAIMHGGAGDNGGGSSTVASVPQGSSAGAAAAAQPMFGDMAARHRRRSYWLATTTAQPQQQQQQPRSWHRNARGRCGSEGQQVGAVKQQQQPREVGAVQLQLQQKQQQQRHQLIVGQGRCMALYFPLRDKMGIFKSFSAEFRDFEIA

SEQ ID NO: 140492 - protein, 177 aa, Heterodera glycines
  Coding regions on vcDNA: vcDNA=SeqID_66915; Strand=+; Position=1 -73,221-368,411-471,511-641,788-908
  Homolog annotation: Hit_ID=NP_506486.1; Match level="QueryCoverage =63%, HitCoverage=14%, E-value=2e-09, Identity=25%"; Hit description =citron-like (105.0 kD) (5O516) [Caenorhabditis elegans] emb|CAB04720.1| Hypothetical protein T08G5.5 [Cae
MYEAYTNEEIVSKLPIEASSIGSYDTSKLHYEYQVCRTFERRPIIELQVVESHDLIICLTDVHLSIHDAVEPFKLLDVCSKYKSISAFSHFVTESQTIHIAISARKHLHIFKYLLGELCEINDCAPITLPENAQAVVWCGVNNLILAFKCEFQFWDMDHFLHRDDLIGEKVTTNLFL

SEQ ID NO: 140493 - protein, 275 aa, Heterodera glycines
  Coding regions on vcDNA: vcDNA=SeqID_66916; Strand=+; Position=1 -97,141-271,340-480,1108-1289,1381-1657
MLAKGSAPSTGWYGWITNWFTEEGNNDSEAQNELKNCGNDVNEALYLSMKPPKLKKHKLDPELKAVESRMEAEILQMLNESWDESTILRRDNLLAEIVLNVAKVFFRLSEDEEENEAKMEQGKKTAEKSPLDTDELGFFGSDEFDESLFYGFQQKNVQSTHLLLAIGRTYGENYAKEANGKQKRSKRSNLRQKGQQIGRRSAHSPSSSTAAAAKPTDYGHQAEDNNAILRLFYKRLAPKLEVYHELNISCAPLSILCDECALSGIFEPFTQKVGN

SEQ ID NO: 140494 - protein, 308 aa, Heterodera glycines
  Coding regions on vcDNA: vcDNA=SeqID_66917; Strand=-; Position=1 -396,912-1171,1331-1601
  Homolog annotation: Hit_ID=AAH86810.1; Match level="QueryCoverage =97%, HitCoverage=74%, E-value=1e-40, Identity=45%"; Hit description =Zgc:103412 [Danio rerio] ref|NP_001008617.1| zgc:103412 [Danio rerio]
MKSLQHLVLSHHSQLKDTIEDQLCLASIHYLRAHFQQAIDIYKKILSKNKNFMALNVYLALCYYKLDYYDLSLEMLQSYLDKYPDSPNAVNLKACNQYRLYNSKAAENELKVLKDLSSSELRFAKDVILHNKPFFTNDDTFNFNYGQNQLLCEHFAEAEEAFRMVTGHSIISNLTHCLCIARAYIANKKGKAAWSLYQKERHIQNSQQLLKLVAMDSYRAEDYVTAAKAFDELDKRGAIGSDDGNEEENYAVAKQAACVGVVKMFAARQCDTGELRDAMKMLGKDRDTNAKNIVTTVKKWAAENGVYI

SEQ ID NO: 140495 - protein, 170 aa, Heterodera glycines
  Coding regions on vcDNA: vcDNA=SeqID_66918; Strand=-; Position=1-513
  Homolog annotation: Hit_ID=NP_507780.1; Match level="QueryCoverage =94%, HitCoverage=10%, E-value=5e-14, Identity=28%"; Hit description =predicted CDS, DNA polymerase type B, organellar and viral family member (5T899) [Caenorhabditis elegans]
MTIASACVKNFALNHLKPNSLAIVSEKGYTPQQNQSALAIKYLDWYSHINNVNIQTAHSRYGEYVFKREGQVYQVDGYIKGTNGKRDKIIEVNGCLWHGCEECFEDLDDETKMPNGKTLGQLREREVRKHEILSRYVDLEVIWEHEINEQLKKDKQMREFFDNWKDHSPI

SEQ ID NO: 140496 - protein, 20 aa, Heterodera glycines
  Coding regions on vcDNA: vcDNA=SeqID_66919; Strand=-; Position=1-60
ARIYTQLELDKLRQHIQSRQ

SEQ ID NO: 140497 - protein, 43 aa, Heterodera glycines
  Coding regions on vcDNA: vcDNA=SeqID_66920; Strand=+; Position=1-130
MAFYITLIALVLAVIRFLVKSRSNTTYRTVTVTPPMLEECAQK

SEQ ID NO: 140498 - protein, 75 aa, Heterodera glycines
  Coding regions on vcDNA: vcDNA=SeqID_66921; Strand=-; Position=1-228
  Homolog annotation: Hit_ID=NP_608540.1; Match level="QueryCoverage =98%, HitCoverage=53%, E-value=8e-10, Identity=40%"; Hit description =CG2839-PA [Drosophila melanogaster] gb|AAF51469.2| CG2839-PA [Drosophila melanogaster]
MRKRAEEKEEEEEKKEWKRSETEEEKRRKRKRKRRRNGREVRRRKRRGERGREEKKKTKLENRKKKKKKGRERGR

SEQ ID NO: 140499 - protein, 17 aa, Heterodera glycines
  Coding regions on vcDNA: vcDNA=SeqID_66922; Strand=-; Position=1 -7,295-329,482-493
MPERVLKRTKFYLHKML

SEQ ID NO: 140500 - protein, 222 aa, Heterodera glycines
  Coding regions on vcDNA: vcDNA=SeqID_66923; Strand=+; Position=1 -524,845-989
MPLTKQHEKDEEEANSPMKTAKKRQRSEAKDDNENNDDGTKSIGTTSTRPSSPPAADEVRGRRFSERLHRKTVRGQAEQLQYWQCHVGEEAGGEGQRRNANASATTNTTERTTRKRVAAAESAPTAKAVPTPSSNINKITPPLATAVPPPSEKRLRLQTYQQIADDFGLRLTALCEQYFFSLLTNASVCLVLTIDPRQQMAKISYERALGWWVIFCKKKQKF

SEQ ID NO: 140501 - protein, 188 aa, Heterodera glycines
  Coding regions on vcDNA: vcDNA=SeqID_66924; Strand=+; Position=1 -143,413-472,589-757,1083-1154,1199-1321
MANETSSIPIVEEPPEEDENDHEQQQNKHTEGEEEKANGTFSVTVSHPDLRLERIAGDLLLRLAIVPGKRIQLSPLEQQYTKKNRTKQKGDECLTFEDFNVANDDRGWIRVIEGGGVRKNGQRKATRTEHWLKISRELFTYAIIGEQFEKVQQFFKKFFHVQQTAVDDKTSADRSNEEDRKRRMELKK

SEQ ID NO: 140502 - protein, 126 aa, Heterodera glycines
  Coding regions on vcDNA: vcDNA=SeqID_66925; Strand=+; Position=1 -44,746-1082
MICCDYCLIWYHVEGAKFWQGKEGRKGDEKWWDRKTTKGTGTKRRIVVQNSSNNNNKRWWWCQEKQQDQDGRRGKRRDEEEEGNARGKCRAAGGAATAAAAVDGTAEAPAGTAGGQPEFAVQKLHR

SEQ ID NO: 140503 - protein, 142 aa, Heterodera glycines
  Coding regions on vcDNA: vcDNA=SeqID_66926; Strand=+; Position=1 -312,504-617
MADINIRLDELDQWKNNVHQFMVVLKSNTFDNGTTIAMDNDGTIAMGQQQQQSTTTTKRSPNGGADANGDDRDGGNDCHAAENGSEEKKPTMTTAAVKNEDENMLVGCPVCHGEFQMREICKHVHTCFVRSERQTTYGTDYQ

SEQ ID NO: 140504 - protein, 30 aa, Heterodera glycines
  Coding regions on vcDNA: vcDNA=SeqID_66927; Strand=+; Position=1-92
VVYLTASFPYLMLFFLLLRGLSLPGASLGL

SEQ ID NO: 140505 - protein, 131 aa, Heterodera glycines
  Coding regions on vcDNA: vcDNA=SeqID_66928; Strand=-; Position=1-396
MDSAQIRNALLELAQPNRQNEGQENGAENNGNEEQRGGLRMRFRNVGTNDGRENWLVGDENRNDGHRNLNQNLLPRTSTPISGPIIPELLIQNVHQSVHQNLPNRQNMGDKNQQHGIPKTAMPQPQVVQQQ

SEQ ID NO: 140506 - protein, 22 aa, Heterodera glycines
  Coding regions on vcDNA: vcDNA=SeqID_66929; Strand=+; Position=1 -3,451-516
MELTLITHQAEVTLIGIQCNGN

SEQ ID NO: 140507 - protein, 87 aa, Heterodera glycines
  Coding regions on vcDNA: vcDNA=SeqID_66930; Strand=-; Position=1-263
DQFLTDPNEVEIVREMIEKSAEKGKDKKTSERVEKIDLEKFVGRIYQTIEKFVDNSNKMWAKIKGQIAAAQMGELTEKRKALETEGY

SEQ ID NO: 140508 - protein, 910 aa, Heterodera glycines
  Coding regions on vcDNA: vcDNA=SeqID_66931; Strand=-; Position=1 -1482,1563-2812
  Homolog annotation: Hit_ID=AAA93301.1; Match level="QueryCoverage =36%, HitCoverage=89%, E-value=4e-49, Identity=32%"; Hit description =HASI
ELARYLHLRDEQQNRPTKVEITKGLKALIKRGDQSDEEEQFFDLGSDGAQRPASQSRRRLRRHRHYNDDEEMPLMPPSPPLQVENRGQKRKANEFYSSWEEGAKRQLRHEDAPVPSSSKIANRQRRRKLPPVSWRREEEQIPADIQQEEPFQPAPQPSIPIHPQLNRKRKAQHALNDVRESKKSLIGLEELRPPSLQQEASLRFKQKRTSKSRVTLPQHSNSLALAKLRNPPRDLLAEAASAPLPDDDGHDFELLQSPGVAAQVEPLPPGPPLPSKAKKRKSNKVDEDTERKRSRIDSRKRDLLEEAASAPLPDDFELSQQPGTSAQVEPLPPGPPLLSRTKKRKTNKAEEEYTERKRSRIGSRKRLSSPSVTKNLPKRQKNSGSDALSEEQRRQFAEDQHLFSIPNSQLTNEQKRRRLQFVFNRNPAKYGVQGDTILNSAGNPITDSSVAQALDYIIERREGRIPQFRQPPGTKFIRDRINRDLILRTWTAPPRNETGEIQGARRIDASFPNEGSQAEVDGPANSRNGNPNQKPTSQATKMEKSIENVLEGLYNDPKSPAAFAGVDRLWLEAKKELGNKIRKNDVKHYLEGHRTYTLMRPRRVNFLRARTTAAGFMTDCQVDLADFQALSRHNSGNRYLMVVIDVLSKRIFVTPLRTKKSDDMVEGFKRVFSTMPMKPHRIFSDKGTEFRNQQLKKLFDEEEVEKYESTYSEKKAALAERAIRQIKNRVYRYFAQTKTLNWVDVIDQIVDGINKSPSRVHGMRPIDVNFKNSQQIWEKMFGEDQHRALFGKHRKRAKFLPGQTVRMSIAKGQFEKGYIPNYGDEILEIDEVKRHKKPMQYKLRDAKGEKFKGFFYPEELAPVRRDAETTYRIERVFRKRKMPDGTMEVLVKFVGYLRENGFMRLNLYKY

SEQ ID NO: 140509 - protein, 387 aa, Heterodera glycines
  Coding regions on vcDNA: vcDNA=SeqID_66932; Strand=-; Position=1 -291,345-1217
MSINLHDKKSLMDNILPVVEINQTNNGITVSSERIAIPRTVQFDILGKCRECKATECETEWCVSKEGVTIWCTRFKISPRFVPFDVIYDLPGYTFFKIRNKGRVFNVDHGFRSNACTQTPTPVYHLPPPPPPPQLPKRKQESHQDAEQRVANQFFDSVSAATTGLDIARHQTRQGDGKEFFGAVSAATMGMDIEQKNEKPKLRKQQRTDASDFFSPISAATMGMTPEHLKPKPKSRQQPVDASNFFSSISAATMGMDVGQDKPPKPSQKEQLNSDAAEFAVSLSAATKGFDFAEATVKKPKEPNQADASELFSAVSAATMGMSSEQQQTRTKKEKEQTDQEILDEFLESVSAATTNMDVPEKRKPKKKVKKEMEDEEMTAIASITRK

SEQ ID NO: 140510 - protein, 58 aa, Heterodera glycines
  Coding regions on vcDNA: vcDNA=SeqID_66933; Strand=+; Position=1 -78,123-221
MARQSTILPIYKRQSRRQQQHYHFENVLVFEGARHRQFQLSWFCIALIVILFVAWFLW

SEQ ID NO: 140511 - protein, 163 aa, Heterodera glycines
  Coding regions on vcDNA: vcDNA=SeqID_66934; Strand=+; Position=1-492
  Homolog annotation: Hit_ID=CAG83749.1; Match level="QueryCoverage =78%, HitCoverage=34%, E-value=6e-23, Identity=42%"; Hit description =unnamed protein product [Yarrowia lipolytica CLIB99] ref|XP _499823.1| hypothetical protein [Yarrowia lipol
MRKRKWKRIRKWKRNIKWKRKWKRNRKWKRRRGTESGRESGRGTESGRESVRGTESGRESGRGTESGRGTESGRESGRGTEKESGRGTESGRESGRGTESGRESGRGTESGRGTESGRGTEKESGKGTESGRESGRGIESGRGSGRGTESGTQFSCITSLEIV

SEQ ID NO: 140512 - protein, 228 aa, Heterodera glycines
  Coding regions on vcDNA: vcDNA=SeqID_66935; Strand=-; Position=1 -502,707-890
MILDKFFGQIDQSIVPILSEDFPNEQKVMVEKAMQSLNKIKMGQITSEDEVIEVKSQFDELLSKKADNLDWQNVPIYDIVQISNWQLAIRSFGALSELFKNGTGGHNAKSEANRKKEEKKAKHQQRNGKKNENNGQGEEHGRSIFEQWLNDNAQLVKSVYDRLFPEDVLKQLQKKRRRRRKIDCEAWLQCISLILLFIIIIWVIIAFFLLAGSKSGGGRSRYRSRSSS

SEQ ID NO: 140513 - protein, 188 aa, Heterodera glycines
  Coding regions on vcDNA: vcDNA=SeqID_66936; Strand=-; Position=1 -375,678-770,816-911
VDLGPEAEFAVYVQLNILWTSIELGRKLKTVSRVVKLKIFKPDYGKIYQLNLGQAGYSKISFSGQLSFDQPIRENEAIVAFVDVPLMSESANETSQKIDKFSSWFSLGSETFIKNGSKLNKNRNGDVNLSYNIPVDLSKFYGKQMFGLTVNIYKLKTYIENEKTKLGNCPICLNSFCSKEKISKFQLT

SEQ ID NO: 140514 - protein, 95 aa, Heterodera glycines; identical to SEQ ID NO: 124528
  Coding regions on vcDNA: vcDNA=SeqID_66937; Strand=+; Position=1-661

SEQ ID NO: 140515 - protein, 86 aa, Heterodera glycines
  Coding regions on vcDNA: vcDNA=SeqID_66938; Strand=-; Position=1-647
IIFIQKIFVWVFGAVPLNRCAQIYGETEFFGNSFPIACTLILRWIFAPHNCLSTPNGHLKKSIFCFRGSPPEPMRPDLWGDRILRE

SEQ ID NO: 140516 - protein, 105 aa, Heterodera glycines
  Coding regions on vcDNA: vcDNA=SeqID_66939; Strand=+; Position=1 -205,254-364
  Homolog annotation: Hit_ID=NP_504245.2; Match level="QueryCoverage =100%, HitCoverage=10%, E-value=1e-23, Identity=50%"; Hit description= ribosome biogenesis protein bms1 homolog (5F86) [Caenorhabditis elegans] gb|AAF60833.3| Hypothetical pro
LPGVGDFRVRRITILSDPCPLPANRTAKRTLNEREQIVYAPMSGLGGLVYDKDAVYIDIGGSKSFSRARNRDEFIEALEGIKEPLDSKMGKATLKLLKENPDLEL

SEQ ID NO: 140517 - protein, 55 aa, Heterodera glycines
  Coding regions on vcDNA: vcDNA=SeqID_66940; Strand=-; Position=1 -69,390-488
MAGHFKNSTKRIEELKGFCEELEKRKAILPELLLEMDKFRAKLNNENMNGFMVPI

SEQ ID NO: 140518 - protein, 206 aa, Heterodera glycines
  Coding regions on vcDNA: vcDNA=SeqID_66941; Strand=-; Position=1 -449,758-926
SYILDQMLHNKRKSYTNFDTLLADEEEEEQEQKRQQHLNTKQDKEQNQSVRSYVPEDPETGATTTICGGTCGDDVGIIDANNVQQQHQAVPAGVGNQQPQIVAVPSTSSLNSSSTEFKFGATTSSAATREDDELSELEDTGTALVEGEVLLEGHEKIALGLQVCVDDVETVQRMFQVFVGHATGHPMVRYLLLTNKFLYLLAVDGK

SEQ ID NO: 140519 - protein, 255 aa, Heterodera glycines
  Coding regions on vcDNA: vcDNA=SeqID_66942; Strand=-; Position=1 -143,911-1051,1270-1462,1655-1943
  Homolog annotation: Hit_ID=CAE63246.1; Match level="QueryCoverage =50%, HitCoverage=20%, E-value=5e-11, Identity=30%"; Hit description =Hypothetical protein CBG07612 [Caenorhabditis briggsae]
MFHHFAPIGLPQNAAAFKPTKGQHEQIERSINGAVDEILNTNGGGGGTLLKTDKCYWAFAREFIPSAERAEMRVRWVCRNRRALSLAWLKDSLNRANLHFQLLSFIACADALKRAHYERNACMRNTALLKRICVRVDQLTELQFNIEASKTNFWAIFIGPPYVFHPEDTPIALPRTMTATTAVLMSTAQFFDGTMSPIGGSSSCNSSLINGTAGGQQQHQRKQQVRVVQQQTPNVPMNIRRRMTPAQNAALPKSF

SEQ ID NO: 140520 - protein, 95 aa, Heterodera glycines; identical to SEQ ID NO: 124528
  Coding regions on vcDNA: vcDNA=SeqID_66943; Strand=-; Position=1-778

SEQ ID NO: 140521 - protein, 104 aa, Heterodera glycines
  Coding regions on vcDNA: vcDNA=SeqID_66944; Strand=-; Position=1-438
NGVSKNRNYAQKASQTILTLPIPSTIAFIHPIMSAKIIRVPKIACDLSLAKNGVSKNRNYAKKASQTILALPIPSTIAFIHPIMSAKIIRVPKIACDLSLEKMV

SEQ ID NO: 140522 - protein, 20 aa, Heterodera glycines
  Coding regions on vcDNA: vcDNA=SeqID_66945; Strand=+; Position=1-65
TDQKRTKLCRDTERKRNNLF

SEQ ID NO: 140523 - protein, 66 aa, Heterodera glycines
  Coding regions on vcDNA: vcDNA=SeqID_66946; Strand=+; Position=1-202
KLLKGIDSVLHAKADQHVQKNEKVLSFVEQARNAMLDRAKLMTNQVGKQVKDGLMLAFGRVVFTFV

SEQ ID NO: 140524 - protein, 75 aa, Heterodera glycines
  Coding regions on vcDNA: vcDNA=SeqID_66947; Strand=-; Position=1 -90,188-325
MECSTTTEQRPGTSEHIDNDDHCSSPPVKPLTYAQAAANRPRRILRAIWIQNPSLIQPSMIEFPYKFLIFSITDC

SEQ ID NO: 140525 - protein, 155 aa, Heterodera glycines
  Coding regions on vcDNA: vcDNA=SeqID_66948; Strand=-; Position=1-468
LVLMAEDRRQVEKLEATTKIREMFDLILKCNVDEQLINKSIPRNVFGFLVDCLSEDNASHPQLVANATAALANIAPQKATDIYDTKHSKVLIYLENWIKSSTDEELLKNAISILKPIIAKDIVREMDYRKFSTLFNSRNKEIFEEALCAAYHLIS

SEQ ID NO: 140526 - protein, 64 aa, Heterodera glycines
  Coding regions on vcDNA: vcDNA=SeqID_66949; Strand=-; Position=1-193
MPCTNCMAEYTRRRKEVGELDYGSKWEKMPSKSDRLCRMSFRLLRAMRWPKVRCAIGVPEQTGA

SEQ ID NO: 140527 - protein, 24 aa, Heterodera glycines
  Coding regions on vcDNA: vcDNA=SeqID_66950; Strand=+; Position=1-76
ITGVSIIAVLFLVFLMPSQNLVRF

SEQ ID NO: 140528 - protein, 45 aa, Heterodera glycines; identical to SEQ ID NO: 130861
  Coding regions on vcDNA: vcDNA=SeqID_66951; Strand=+; Position=1-536

SEQ ID NO: 140529 - protein, 64 aa, Heterodera glycines
  Coding regions on vcDNA: vcDNA=SeqID_66952; Strand=+; Position=1-194
MEALMMTLSLIYHERIGRNTEGGRAVQIFSAYFSNLAQPWRKFKNITIGLRIYMKGQKLMHRIC

SEQ ID NO: 140530 - protein, 128 aa, Heterodera glycines
  Coding regions on vcDNA: vcDNA=SeqID_66953; Strand=-; Position=1-384
  Homolog annotation: Hit_ID=YP_149579.1; Match level="QueryCoverage =100%, HitCoverage=11%, E-value=7e-68, Identity=97%"; Hit description= DNA polymerase III, alpha chain [Salmonella enterica subsp. enterica serovar Paratypi A str. ATCC 9150]
MGFPGYFLIVMEFIQWSKDNNVPVGPGRGSGAGSLVAYALKITDLDPLEFDLLFERFLNPERVSMPDFDVDFCMEKRDQVIEHVAEMYGREAVSQIITFGTMAAKAVIRDVGRVLGHPYGFVDRISKL

SEQ ID NO: 140531 - protein, 16 aa, Heterodera glycines
  Coding regions on vcDNA: vcDNA=SeqID_66954; Strand=-; Position=1-49
EAIPEGFGLPINLGAS

SEQ ID NO: 140532 - protein, 125 aa, Heterodera glycines
  Coding regions on vcDNA: vcDNA=SeqID_66955; Strand=+; Position=1-660
LFEYPKRTLEKIDFFVFGAVPPNRCAQIYGETESFGNSFPIACTLILRWIFAPHKCLSTPNGHLKKSIFFVFGAVPPNRCAQIYGETESFGSSFPIACTLILRWIFAPHNCLSTPNGHLKKSIFL

SEQ ID NO: 140533 - protein, 1040 aa, Heterodera glycines
  Coding regions on vcDNA: vcDNA=SeqID_66956; Strand=-; Position=1-3120
  Homolog annotation: Hit_ID=NP_510849.1; Match level="QueryCoverage =78%, HitCoverage=60%, E-value=1e-152, Identity=36%"; Hit description= predicted CDS, zn-finger, CCHC type and RNA-directed DNA polymerase and Integrase, catalytic domain cont
MAAVIKAGKGPGPFLPEMCWATWWERFEFFIQLKGVTDVATKRLLLFTEMGQVYEELRRMAQPEDVRTMDLAEIEQLMVERFGEAKSIAACRHELFSAKQQTGQSIRDYSVRLRSLIAKAEWSRDSIDMCLCALFINGISNDAIRVELIKKGDKDLKFKDAVESAVLLEQSNLDAQAIGSNAMPEVAKVGNQQRGPRTPTKSTRSCFRCGKPGHFANVCPNQNSTCRKCGEIGHWAVGCKSKNRDGNANFGQQFGQKPKTNGRQIKNIECSSVSVIHEIKGISADPGFIQLNIHNGRLEFELDSGADVTVIDEIDWKRIGRPKLEPSQGLVAYGGKSIGGILGKAKVKVTHEGRTIESNIHVISGKHKNLCGRDLIMGLKIDLNRAFGISTIRAVEIKQELDACLGQYPEVFQDGVGRCKKMASLKFKEGCQPKRCKPRPVPFSLRNEVEKVLDQWQAEKIIEPVATSEWATPLVIVPKTNGKLRLCFDYKVTVNPWLDVHQYPLPRPEELFSILNGGEKFTKIDLKDAYLQLLLDEKAKSCLTICTHKGLFHFARLPFGVASAPAIFQQVMEEVLQGIDGVAVYLDDILITTATDQHHIKRIDQLLKRLSENGLRVKREKCEFLKPEIEYLGHIVDKKGLHASPGKIEAILKMPEPKNLKELQSFLGMVNYYGKFVPSLATLSEPLNELRRNDAKWTWTKSQQKAFDVIKKVLTSTEVLVHYDPQKPLFLAADASDYGVGAVIFHKDEKGRVGVIAYASRTLNSSERNYSQIEKEARAIIFGVDKFKQYLYGRKFVLQTDHEPLKKIFGPKGELPIVAAKRLHRWSLTLMNFDFEVVYCSTKEFGNADGLSRLPCPEETTIDCVGLEVQQVQAENISCLPVTVSAIAKEVKKDEILRKVKEFIEKGWPQKVEGLKSFHVIRNELALMEGCIMFGNRTIIPSKFRTKMLEILHATHPGMVRMKALARQKMWWPGIDKEIEIIRKRCKICQEEAPDERKVPLHPWESPERPWQRIHIDFCGPFWGSMWLIIMDAKSKWPEV

SEQ ID NO: 140534 - protein, 70 aa, Heterodera glycines
  Coding regions on vcDNA: vcDNA=SeqID_66957; Strand=-; Position=1-212
MAKAISESNRSAARKSANGHSEHAKREKGGERIEIHGGHSVECNGTENFGRRIARQSRKPFRVTEAKSAD

SEQ ID NO: 140535 - protein, 45 aa, Heterodera glycines
  Coding regions on vcDNA: vcDNA=SeqID_66958; Strand=-; Position=1-136
MNEDDDYCTKCKIPTVDEIINGKESKLKDRVEDGLQKITSKAKKI

SEQ ID NO: 140536 - protein, 352 aa, Heterodera glycines
  Coding regions on vcDNA: vcDNA=SeqID_66959; Strand=-; Position=1 -511,594-1141
  Homolog annotation: Hit_ID=CAG84110.1; Match level="QueryCoverage =55%, HitCoverage=14%, E-value=8e-12, Identity=24%"; Hit description =unnamed protein product [Yarrowia lipolytica CLIB99] ref|XP _500178.1| hypothetical protein [Yarrowia lipol
MQMELLMLFCLLKMFFLCPTFLAFDNEIKAYEKGEMNELQRWSTEEEEEMWQSGEEKGEMPKTKSRSVAPIQSLWEDGPISPIDQRTINELPRDDGRGTMVDVDIVKGRKGLWMRPNVVNLVDEIRDDGEGMASPLAMLSPALSLVPKRRRRIGTTDGRQTKKNVIRKEEKMAKQSEPKEMPKNDGIGLNVQSDFVEKSGGEEAKMTNTETEGEGERTTEKKEKKKEEEKEKEEKEKEKNETGGKSKEEREREKEGKKKEKEEGKDWTMKQSNSKSQSQNSTQTETVKRDFWANALRTLLIEFRKMHPELIRGGKAKRRTTEQSSNRTKSKTNEEMARKRPGGRGEPSPISD

SEQ ID NO: 140537 - protein, 50 aa, Heterodera glycines
  Coding regions on vcDNA: vcDNA=SeqID_66960; Strand=-; Position=1-504
AYFQKISHEFSFKKFFNCFLNVCIFFGLPKLHRTWFFLFSFKSPQIFFTA

SEQ ID NO: 140538 - protein, 128 aa, Heterodera glycines
  Coding regions on vcDNA: vcDNA=SeqID_66961; Strand=+; Position=1 -213,664-837
MDTTTINRILAGNTKTRELYLGCFPCDKLPNIINKYPSTLVANNDPSNKEGTHWIAMFIVDDRTVYYLIVLYGGITRESARKQMAYNGFKNVTVDQNFYVRHRICRRYANNPCVIEKHKNGHERFYPT

SEQ ID NO: 140539 - protein, 238 aa, Heterodera glycines
  Coding regions on vcDNA: vcDNA=SeqID_66962; Strand=+; Position=1 -382,427-761
  Homolog annotation: Hit_ID=NP_507780.1; Match level="QueryCoverage =94%, HitCoverage=16%, E-value=1e-13, Identity=24%"; Hit description =predicted CDS, DNA polymerase type B, organellar and viral family member (5T899) [Caenorhabditis elegans]
MPKIKPYRIIAYDFEATQDKKMENKFEHVVNFAAATVICTDCINNGYWNNSLLGKKCNICGPHRTITFSPFDYTKTTVDQKIITQNPLHKFVQWLFFERNKKYPTVAFAHFGGRYDMTMIIKEVIEQSIHNPEIIKQGNRLYELKINANDHRPLTILHDSYNLMPIKLSGLIKSFGLQIEDKQFFPHMFNKATNYDNVLTHLPSRVDYCPNQMKKADLQKFNDWYSNNLKILQLRFII

SEQ ID NO: 140540 - protein, 35 aa, Heterodera glycines
  Coding regions on vcDNA: vcDNA=SeqID_66963; Strand=+; Position=1 -89,159-177
MLYLDVKEKSYRGKRAGAETRAPKRERRNAKFFMF

SEQ ID NO: 140541 - protein, 67 aa, Heterodera glycines
  Coding regions on vcDNA: vcDNA=SeqID_66964; Strand=+; Position=1 -128,200-275
MKRTLIFVEKFVAQKRINESKGPAITWSISKKKPKKGENKKRPITEKNRQNTIGLYLLKAAYKIHLL

SEQ ID NO: 140542 - protein, 37 aa, Heterodera glycines
  Coding regions on vcDNA: vcDNA=SeqID_66965; Strand=+; Position=1-115
RLEPDKRTTKSKTMTVFEGYEMRTDRIIAAGQTQAIF

SEQ ID NO: 140543 - protein, 21 aa, Heterodera glycines
  Coding regions on vcDNA: vcDNA=SeqID_66966; Strand=-; Position=1 -36,123-152
MYFSFFEIPNYGSDLKKEMIK

SEQ ID NO: 140544 - protein, 46 aa, Heterodera glycines
  Coding regions on vcDNA: vcDNA=SeqID_66967; Strand=+; Position=1 -89,804-855
MATLSSSTVMLLFLLLFVLALIYVAFFFTRHFALARNASMAKYEVQ

SEQ ID NO: 140545 - protein, 184 aa, Heterodera glycines
  Coding regions on vcDNA: vcDNA=SeqID_66968; Strand=+; Position=1 -72,122-223,267-356,680-835,926-1057
  Homolog annotation: Hit_ID=CAE67453.1; Match level="QueryCoverage =96%, HitCoverage=18%, E-value=4e-32, Identity=38%"; Hit description =Hypothetical protein CBG12954 [Caenorhabditis briggsae]
MPSPVERYGPFLKHIRERLRHTNILLYTDDLGIVHSLLVHASKMNMSQTRYSYLVSNMDLHLLEDFLGPEFHCNITGFQLVRQQPQIKTDLALAMDATALVGAAVHALRQRNLEPKPHQLLCDAGDQWTDGMLMQEQIRRVDLTDAATGGHSATSAIRFNETTGERMDTSLLAITRMPNGTFTD

SEQ ID NO: 140546 - protein, 121 aa, Heterodera glycines
  Coding regions on vcDNA: vcDNA=SeqID_66969; Strand=+; Position=1 -62,109-141,186-313,614-701,786-837
  Homolog annotation: Hit_ID=NP_495639.2; Match level="QueryCoverage =100%, HitCoverage=16%, E-value=6e-45, Identity=61%"; Hit description= AMPA GLutamate Receptor subunit (glr-4) [Caenorhabditis elegans] gb|AAA81054.3| Glutamate receptor famil
LNSLWFAVGSLMQQGSDVIPRAAATRTVAVIWWLFTLILISSYTAQLAAFLTVERMSTAVESSADLAAQQRIKFVFVNSSREGIARVKGGNYAYMMESTMLEYWIGEDCQLQTIGGLLDSK

SEQ ID NO: 140547 - protein, 95 aa, Heterodera glycines; identical to SEQ ID NO: 129573
  Coding regions on vcDNA: vcDNA=SeqID_66970; Strand=+; Position=1-678

SEQ ID NO: 140548 - protein, 173 aa, Heterodera glycines
  Coding regions on vcDNA: vcDNA=SeqID_66971; Strand=+; Position=1 -226,626-738,1273-1456
  Homolog annotation: Hit_ID=CAE68337.1; Match level="QueryCoverage =96%, HitCoverage=37%, E-value=1e-21, Identity=34%"; Hit description =Hypothetical protein CBG14058 [Caenorhabditis briggsae]
ANNAKIKRFMEKNNLHNITELENYYIQRLQVIVKELFEERQEMAEGQKKAKQKKMIFWQEVFDNNKPVNAEDRRADPSNTVVHNWYSRTTQERFLDTKRAVEKGFQVLVSSCWPRASAVAERLWSPPELTRLADAAWPRLQEHRCRMVARGYRAEPVNGPDFCQTELDEQMLK

SEQ ID NO: 140549 - protein, 68 aa, Heterodera glycines
  Coding regions on vcDNA: vcDNA=SeqID_66972; Strand=+; Position=1 -34,68-240
MLAEIASVELPGAKNAKLGSGFKNLAKTFYFMESIIFVTCRKQVFYVNGLPQTVVGSEIFIKNPKMIT

SEQ ID NO: 140550 - protein, 40 aa, Heterodera glycines; identical to SEQ ID NO: 126546
  Coding regions on vcDNA: vcDNA=SeqID_66973; Strand=-; Position=1-181

SEQ ID NO: 140551 - protein, 21 aa, Heterodera glycines
  Coding regions on vcDNA: vcDNA=SeqID_66974; Strand=+; Position=1-65
MAISFFSWGFDRKLGTNICLL

SEQ ID NO: 140552 - protein, 19 aa, Heterodera glycines
  Coding regions on vcDNA: vcDNA=SeqID_66975; Strand=+; Position=1-59
TFSFSSLALPNTHTIFEML

SEQ ID NO: 140553 - protein, 19 aa, Heterodera glycines
  Coding regions on vcDNA: vcDNA=SeqID_66976; Strand=+; Position=1-59
TFSFSSLALPNTHTIFEML

SEQ ID NO: 140554 - protein, 19 aa, Heterodera glycines
  Coding regions on vcDNA: vcDNA=SeqID_66977; Strand=+; Position=1-59
TFAFSSLALPNTHTIFEML

SEQ ID NO: 140555 - protein, 19 aa, Heterodera glycines
  Coding regions on vcDNA: vcDNA=SeqID_66978; Strand=+; Position=1-59
TFAFSSLALPNTHTIFEML

SEQ ID NO: 140556 - protein, 226 aa, Heterodera glycines
  Coding regions on vcDNA: vcDNA=SeqID_66979; Strand=+; Position=1-681
MHINIFVPFLFLFVIFNGCQAKELKICVKYEKTVAMRETQINLTAIRVNSKNEYRNIKENIKIGECFGISIPQQENNKTQKITFEFTIYVKPLENEYQPPADDHDENPSDEGPYENRILDIKMDDIRTMVRRNNFVIHEPNPSMVYTFNLGTIDPPGFLWKRKIFVLPENDLGNYHAFLYAVAYKNQRTQDNLNSKSCMKLLRYAPFVKIDKEIAPTLKRMTKGWK

SEQ ID NO: 140557 - protein, 90 aa, Heterodera glycines
  Coding regions on vcDNA: vcDNA=SeqID_66980; Strand=+; Position=1-270
MCENLRFAQTFSLLGGIPLLTSLFGCFPVEPFTASESEMAALGDASNADKDDAGDNNNLNNLCASHQRKASTERGTQTDAGHLAILHDQL

SEQ ID NO: 140558 - protein, 50 aa, Heterodera glycines; identical to SEQ ID NO: 125301
  Coding regions on vcDNA: vcDNA=SeqID_66981; Strand=-; Position=1-607

SEQ ID NO: 140559 - protein, 95 aa, Heterodera glycines
  misc_feature (85)..(85): Xaa can be any naturally occurring amino acid
  misc_feature (91)..(91): Xaa can be any naturally occurring amino acid
  misc_feature (94)..(94): Xaa can be any naturally occurring amino acid
  Coding regions on vcDNA: vcDNA=SeqID_66982; Strand=+; Position=1-652
LFEYPKRTLEKIDFFVFGAVPPSRCAQIYGETESFRNSFPIACTLILRWIFAPHNCLSTPNGHLKKSIFLFSGQSPRTDAPRFMXRPNPSXIAXL

SEQ ID NO: 140560 - protein, 130 aa, Heterodera glycines
  Coding regions on vcDNA: vcDNA=SeqID_66983; Strand=-; Position=1 -20,56-428
MERQISRCAQSPNPISPITNSPFFSTTTTTTLTASKLFQNFSTNVTIASPVNLPTATNLNTLQNALHYVTGAVRWASTIPAKPNKATSKNVCTATTISITTTAMVNKRSSLKMGIKIKIKAECRYFYFST

SEQ ID NO: 140561 - protein, 95 aa, Heterodera glycines
  Coding regions on vcDNA: vcDNA=SeqID_66984; Strand=-; Position=1 -164,451-575
  Homolog annotation: Hit_ID=NP_499777.1; Match level="QueryCoverage =83%, HitCoverage=49%, E-value=7e-25, Identity=70%"; Hit description =protein conserved (3O528) [Caenorhabditis elegans] emb|CAB07619.1| Hypothetical protein F45G2.10 [Caenorh
IYATKARRALAAEAATALDDGTKEPIDATEIFEHIRDINDPEHPYTLEQLNVVQEELIQVSADPTDPFVDVRFTPTIPHCSMAALIGLAIYAKLR

SEQ ID NO: 140562 - protein, 122 aa, Heterodera glycines
  Coding regions on vcDNA: vcDNA=SeqID_66985; Strand=-; Position=1 -296,740-812
MTDVKLIWDVFTREIWPIFATNIHRLGFDDGDHLDNLRRRTSPTILTDLDELHSINSGHLCPEGIADMDPMQLLAKLWPNGYTLRQKMDNQSNYVSVLMPLAPPAEEKEGEEEADQSNKNVV

SEQ ID NO: 140563 - protein, 43 aa, Heterodera glycines
  Coding regions on vcDNA: vcDNA=SeqID_66986; Strand=+; Position=1 -65,123-186
  Homolog annotation: Hit_ID=AAH71548.1; Match level="QueryCoverage =100%, HitCoverage=22%, E-value=3e-18, Identity=100%"; Hit description=Rac1 protein [Danio rerio] gb|AAH44538.1| RAS-related C3 botulinum substrate 1 [Danio rerio] gb|AAH44501
MQAIKCVVVGDGAVGKTCLLISYTTNAFPGEYIPTVFDNYSAN

SEQ ID NO: 140564 - protein, 181 aa, Heterodera glycines
  misc_feature (7)..(7): Xaa can be any naturally occurring amino acid
  Coding regions on vcDNA: vcDNA=SeqID_66987; Strand=+; Position=1 -53,99-185,271-362,759-920,986-1056
  Homolog annotation: Hit_ID=NP_500362.2; Match level="QueryCoverage =82%, HitCoverage=72%, E-value=6e-60, Identity=76%"; Hit description =CEll Death abnormality CED-10, RAC related (21.5 kD) (ced-10) [Caenorhabditis elegans] gb|AAC25821.1| Cel
RFYYCFXVMVDGRPINLGLWDTAGQEDYDLWDTAGQEDYDRLRPLSYPQTDCFLLCFSIVNPASFENIRAKWYPEVSHHCPQTPIILVGTKLDLREDSKTLDKLRERRLAPISVAQGHQMAREIKATKYLECSALTQIGLKQVFDEAIRAVLCPVQVKFDEAIRAVLCPVQVKPKKSCAIL

SEQ ID NO: 140565 - protein, 93 aa, Heterodera glycines
  Coding regions on vcDNA: vcDNA=SeqID_66988; Strand=-; Position=1 -254,633-658
MESCQCTWTNLYASFILYGSYFLLFCNFFYQTYLRRGNRYANKSKAKGGKAAAESVVHANGTANCSINDESAKTNGSVVHHQQQNPTAVDEPM

SEQ ID NO: 140566 - protein, 91 aa, Heterodera glycines
  Coding regions on vcDNA: vcDNA=SeqID_66989; Strand=-; Position=1-637
LFEYPKRTLEKTDFFVFGAVPPNRCAQIYGETESFGSSFPIACTLILRWIFAPHKCLSTPNGHLKIRFFCFRGSPPEPMRPDLWGDRILRE

SEQ ID NO: 140567 - protein, 24 aa, Heterodera glycines
  Coding regions on vcDNA: vcDNA=SeqID_66990; Strand=+; Position=1 -52,295-317
MEKACKIWRDYIDFSALELLELAS

SEQ ID NO: 140568 - protein, 105 aa, Heterodera glycines
  Coding regions on vcDNA: vcDNA=SeqID_66991; Strand=-; Position=1-315
MSREILPIFVTNIRHLDIPDGGHLDHLRRLISPTILFDLINLNSMCSADLFPDVIADDGPNATAGQALSKWLHTPRKDGQPKRLCCKLHHVPVNEAKEWVNNFKK

SEQ ID NO: 140569 - protein, 78 aa, Heterodera glycines
  Coding regions on vcDNA: vcDNA=SeqID_66992; Strand=+; Position=1 -87,534-683
MEQKSLGPIVIPFGEQQKEKNEQSNIEENAICLRPQVKTTKKTSIHEPMAIGKCIYYLRNGSRQDQSAGDKSADRQLS

SEQ ID NO: 140570 - protein, 58 aa, Heterodera glycines
  Coding regions on vcDNA: vcDNA=SeqID_66993; Strand=-; Position=1 -76,1277-1377
MIRRGATVIGRGATVIRRVTTVIRRAIFKFTKIKTKLQNKKVTALHEAAHAIIIKELN

SEQ ID NO: 140571 - protein, 114 aa, Heterodera glycines
  Coding regions on vcDNA: vcDNA=SeqID_66994; Strand=+; Position=1 -91,433-609,688-764
MRVQPVREVMVKGSEANVIDVWIIEGKNKARDVRVQIARKQTVLNLANRQDGTLCVDKEHKAQLIFPNSIQFDQKEEITLQSVNIDCNDAGVLTLTIYDNGAYKTHTEKPFKLI

SEQ ID NO: 140572 - protein, 165 aa, Heterodera glycines
  Coding regions on vcDNA: vcDNA=SeqID_66995; Strand=+; Position=1 -93,189-591
MVRHKQNFSVGNDFPTSSKNDQQMNEGFIAPKKSLKRKIDENDETIDLDKVPMSFFDAGGNESIQQNEYVIETEQFSSQFSHMGMISNKKDTGKNSRNQMTEEQRQIIRAKNAIAAKTYRKKVKNVDFLLLQASEQNTYNVELYELSRFKVKCKHCPVIHFSEEE

SEQ ID NO: 140573 - protein, 40 aa, Heterodera glycines
  Coding regions on vcDNA: vcDNA=SeqID_66996; Strand=-; Position=1 -60,1115-1177
MFRWGIEPKKKIMKVRAMNEPIAGRDRPKHTERSHLQEND

SEQ ID NO: 140574 - protein, 89 aa, Heterodera glycines
  Coding regions on vcDNA: vcDNA=SeqID_66997; Strand=+; Position=1-383
LFEYPKRTLEKIDFFVFGAVPPNRCAQIYGETESFGNSFPIVCTLILRWIFAPHNCLSTPNGHLKKSIFLFHKYFFRKCSETHQILFTC

SEQ ID NO: 140575 - protein, 33 aa, Heterodera glycines
  Coding regions on vcDNA: vcDNA=SeqID_66998; Strand=+; Position=1 -31,873-943
MYLKIKMFEKVLILFLIYFFYFGLNGLSLYYLY

SEQ ID NO: 140576 - protein, 80 aa, Heterodera glycines
  Coding regions on vcDNA: vcDNA=SeqID_66999; Strand=+; Position=1-243
PLVQKNFAGFIFMKHLLEVEQKVQRIRNSITIIPKQFYDRCVSFESILESSSKLNSSLIACADRFSVIKSITKNDDEFRI

SEQ ID NO: 140577 - protein, 69 aa, Heterodera glycines
  Coding regions on vcDNA: vcDNA=SeqID_67000; Strand=-; Position=1-210
DRCRRRESQKSLLRQKTRHPHATIAPAALRFARLQLPPAPFAAALAQGIGLPGEPNNARTGGSAAETAR

SEQ ID NO: 140578 - protein, 75 aa, Heterodera glycines
  Coding regions on vcDNA: vcDNA=SeqID_67001; Strand=-; Position=1 -108,1045-1164
MFVFLFSKAISPSKSNAELAEQFIDIESEDRCQLIKKNCLQLRVTETTGVLGCRDHGSRVTDFFGSPVITAHGFP

SEQ ID NO: 140579 - protein, 103 aa, Heterodera glycines
  Coding regions on vcDNA: vcDNA=SeqID_67002; Strand=-; Position=1 -177,265-400
MPTVREILECLQKPIKRPINPTNEDSVLNAERTAAEQQMEGVSTSNDLNVGESDDEENFKTESDERLVKENPKQHPSQALDASVRHRLLRETIDGRRSASLNA

SEQ ID NO: 140580 - protein, 195 aa, Heterodera glycines
  Coding regions on vcDNA: vcDNA=SeqID_67003; Strand=-; Position=1 -15,75-296,352-505,556-752
MAIERPISAQSSDQQQIVLDNPTANPLKVREAMGTDTAGNATADVGSVGNGTADEAMSTTSTYTARQRQNFNKKQRKQNGQMFVDAPAEKFGPRVRKNPKQGKYEVQAILATTTYKKDGQLRRIFYVQWLGYSQKDYSWVLSEWMDTQELVTEFTVNSVISWVFKAIRGEEVPEEIAEKLRTNPEYISRKFLWGN

SEQ ID NO: 140581 - protein, 77 aa, Heterodera glycines
  Coding regions on vcDNA: vcDNA=SeqID_67004; Strand=+; Position=1 -82,140-291
  Homolog annotation: Hit_ID=AAF60061.1; Match level="QueryCoverage =76%, HitCoverage=27%, E-value=3e-15, Identity=52%"; Hit description =ORFRU4-R [Macaca mulatta rhadinovirus 26-95]
MLHKSVLLITLLLLIGAFMQIPTTDAWGGWGGGPGWGGGRGWGGGRGWGGGPGWGGGRGWGGGPGWGGGRGWGWGKK

SEQ ID NO: 140582 - protein, 118 aa, Heterodera glycines
  misc_feature (104)..(104): Xaa can be any naturally occurring amino acid
  misc_feature (117)..(117): Xaa can be any naturally occurring amino acid
  Coding regions on vcDNA: vcDNA=SeqID_67005; Strand=+; Position=1 -277,322-362
  Homolog annotation: Hit_ID=EAL26365.1; Match level="QueryCoverage =86%, HitCoverage=66%, E-value=1e-36, Identity=66%"; Hit description =GA19129-PA [Drosophila pseudoobscura]
AFRVNVDFPTESPLKPPSVTFATKIYHPNIDDKGQVCLGIILAENWKPATRAEQVMNALLSLIAEPEIAHPLRSDLAEEFQRDKKKFFKNAEDYTKKYAERRDXVDYTKKYAERRDXV

SEQ ID NO: 140583 - protein, 66 aa, Heterodera glycines
  Coding regions on vcDNA: vcDNA=SeqID_67006; Strand=-; Position=1-226
AISFFEKFYTSQKRLRMRRRAVHNRHFISQRIFIFRGYPRKMDISFFDKFYTHTNALEHDREGGAQ

SEQ ID NO: 140584 - protein, 72 aa, Heterodera glycines
  Coding regions on vcDNA: vcDNA=SeqID_67007; Strand=-; Position=1 -66,1001-1153
MENIDTVVVPIIETEISEFVLCQFWHDSKALDKLSLIIGDEVEPAADHARISSGARSLAPPIGRRSRECAGF

SEQ ID NO: 140585 - protein, 50 aa, Heterodera glycines
  Coding regions on vcDNA: vcDNA=SeqID_67008; Strand=+; Position=1 -15,117-251
MCKKKSATGPGPGREFPVIRGPGSRSRILKRSGPGPGPGRATGNREKQSL

SEQ ID NO: 140586 - protein, 1243 aa, Heterodera glycines
  Coding regions on vcDNA: vcDNA=SeqID_67009; Strand=-; Position=1 -452,759-966,1008-1568,1615-1876,1916-2234,2277-2832,2876-3376,3426 -3701,3750-3949,3991-4387
  Homolog annotation: Hit_ID=NP_001004509.1; Match level="QueryCoverage= 78%, HitCoverage=66%, E-value=1e-108, Identity=30%"; Hit description =si:busm1-180o5.3 [Danio rerio] emb|CAD60788.1| novel protein similar to DNA polymerases [Danio rerio]
MENYKLMDYQSTTCEKFGFTKNITEFRVNPDVERPDEAMKDAIDNMIKVALKTTEEKMKRKVRMFGVAITGAGLAFPVWVPYRAYPQNNADVIMEEINKLEQSGDGDENKKMLLLSEPITMKITCVTMPSGEGPRNVHKFDFGFKEHQRIGIVNTDKFCLFYALASSMNYLIMDKYSFIRFMKNLARQKEAAVELLRNCGIDGNEISYGVEQLPNVQKYWDEIYPGKYRVVAFEKSADPRKSICVLWKAPMGREKVVPIFLENGHWDGLKNYVCFFNRGRKFCIDCECFFDKDVKHTFECRARCYYCNRVGGMPCEKESGVKIECPKCHRYFYNWECYNYHQGHQTCKLWRRCVICDKTYLFNPKKEHECGETYCQLCSVSHDPKRGCYIMPIEEKEEKDVYRIVVWDSETSQDSIYKGDQKEHVINYISVRVTCTECCDDKNRTNCKICGEERIKDWSEAEGHEPTKDFVEWILTAFTNYDMYIFAHNAGRFDGHFVFNYLCRTGKNPLPLINGLKIYEFKVQNSKKHSKLIWRDSCLLMPVKLESLKATFNLDSEDKPFFPYYYNKKENYGIRLEHLPPMEDYSPGSMNKDKFIKFEKWYNENKETPFYLDDELKNYCRNDTEILLLSIIEFRRILINDITKGFDPLPRSCTNAGVAMNIFKGMFLLTEQLSIVPEKGNERCDRASVMAIKYLEWRSQRDGIEIRHAGNGREVKVGKYKLDGFIANNGARDKCIEVMGCYIHGCLNCYDPAAELIGGRTAQELNDETQERLVELRKTLDVEEVWGCQIEKELKKDEEMRGFFDDRGNEKGPIDPRMAYAGGRTGPMKLFAKSDEKKKISVYDIVSLYPSVNYGTAYPIGLPEIIIPKTDEINVNWMRPEDLKYKGLYKVRVNPPKGLRIPVLQLKCDERLLFPLCWRCASKFKKETTRCNYKCPHDAAQRRYVATYTSVELAKALECGYTVDRFYRAWHYEEEVDDLFKGYVRLFLKLKEEASGFPKGVETDEQKNIWREEYKEKYGIEIELTKVKKNPGLRYISKLMLNSLWGKFSMRNCLNKNAVIDRASEYYKMACDHKIEMCDIVEYSEEAIRVIYRDKDEFVMEHKSSNIIISLWTTSMARLKLLEFMREAEGNGGEILYTDTDSIFVLHYRDVEPITTGKYLGEMTEEYGGYEIEEYCCGGAKHYALKMKNKQTGETEYVMKIRGITFDVDNRKTLHYDTFRQMVLNYGKGEVDPAFFVYKNDFG

SEQ ID NO: 140587 - protein, 84 aa, Heterodera glycines
  Coding regions on vcDNA: vcDNA=SeqID_67010; Strand=-; Position=1 -57,290-487
MSVCWGKFRSNQNLSMKKVVIGWAFVLETTNECQMKESALIELKSVKQYLLLLSDGKYPQLQITKPPKKPMRKGNGKRSASHRY

SEQ ID NO: 140588 - protein, 61 aa, Heterodera glycines
  Coding regions on vcDNA: vcDNA=SeqID_67011; Strand=-; Position=1 -19,275-441
METYLRRVLEIPNLIELVKPTTLSSNIALDLISEFSLNLYSSNFMHGIEALQAQVAKIGQI

SEQ ID NO: 140589 - protein, 115 aa, Heterodera glycines
  Coding regions on vcDNA: vcDNA=SeqID_67012; Strand=+; Position=1 -129,191-305,764-864
MCSLMLFVGRGNQCQWIGTARRRRRRRKSGAIDGGGGEEGTTHFNLMASDRMSLRRSLPDVRRRQCRQKKYPPADKLPNTSEFLRTELEQFLKRLSIRTKLIRAKKRVGLIRARL

SEQ ID NO: 140590 - protein, 109 aa, Heterodera glycines
  Coding regions on vcDNA: vcDNA=SeqID_67013; Strand=+; Position=1-330
MYADPAGSRTKIKFADPVAGLEFKIFCRTGSGRIYPANPAILQILHFPKNAGLRTGILQNPAQDPVLLRALLSTERLPPFLAFSKPGFFVIGYIEFYSYLTCYENNMEI

SEQ ID NO: 140591 - protein, 157 aa, Heterodera glycines
  Coding regions on vcDNA: vcDNA=SeqID_67014; Strand=+; Position=1 -101,992-1091,3472-3566,3852-4027
  Homolog annotation: Hit_ID=NP_501890.1; Match level="QueryCoverage =96%, HitCoverage=11%, E-value=8e-33, Identity=38%"; Hit description =predicted CDS, AMOP domain containing protein family member (4L60) [Caenorhabditis elegans] emb|CAA94300.
LDSPLFQTTSFSAQETNTRAAFVAQKAKEMCHDWDITCSEMIGAKNCYMSAQNVYGSYTGKADWQWQYNQGWGGAAYTTGAGGTLNREGLRAGEEGGQNRFATHYGQVCCYDQEGYLQQTTYQPTLKVIDQMFYNPGFPLRAYEFGSYPYLGQFEVP

SEQ ID NO: 140592 - protein, 242 aa, Heterodera glycines
  Coding regions on vcDNA: vcDNA=SeqID_67015; Strand=+; Position=1-729
  Homolog annotation: Hit_ID=XP_320889.1; Match level="QueryCoverage =71%, HitCoverage=22%, E-value=4e-20, Identity=31%"; Hit description =ENSANGP00000012033 [Anopheles gambiae] ref|XP_313651.1| ENSANGP00000013044 [Anopheles gambiae] ref|XP_314
MAEAAIHQLSDVFQQFLTAQQANAAAPAQPTPMPNLANFDCFGLGDHGESDIEGWLERFALALDCSTPNLQDELKVKLLLTKLSESAYSEYTKHCLPKKPTEFDFGKTSEMLKSLFAKHKSVWINRYECLKAEKQDEEEFRGFINRHKRLLSDFEFKKLNEEQFNCLMLLVALKSPKDAELRKRILSKLAADGDRATYESVVNDLQMFLSTISEAKVMERPSNSNILAVKRSQQPMMPSSSP

SEQ ID NO: 140593 - protein, 47 aa, Heterodera glycines
  Coding regions on vcDNA: vcDNA=SeqID_67016; Strand=+; Position=1 -62,647-728
MASFCTVFEFHWYSHVQCIFRSSLPSFQLTNVSTTSCTSKTNTGTYS

SEQ ID NO: 140594 - protein, 22 aa, Heterodera glycines
  Coding regions on vcDNA: vcDNA=SeqID_67017; Strand=+; Position=1-70
VRLGYSINYGEQKSNAELKYRL

SEQ ID NO: 140595 - protein, 296 aa, Heterodera glycines
  Coding regions on vcDNA: vcDNA=SeqID_67018; Strand=-; Position=1 -641,672-877
  Homolog annotation: Hit_ID=NP_500013.1; Match level="QueryCoverage =72%, HitCoverage=15%, E-value=8e-38, Identity=39%"; Hit description =predicted CDS, polyprotein family member (4B673) [Caenorhabditis elegans] gb|AAC02594.1| Hypothetical pro
REFVQCTLIKHATPYWQGNAITERTFRTYHNILSKYITKENPDFDEYIEFASFCYNTSCHSSTKETPFFLMFGRDPIFCIDQILDVRVHNQVDFKTDGEFTQKLVTTLRKAWKCAAEAIEEAQKKMKIQYDKTMRQPKISVGDRVLLRNYTGKIGTSKKFHLPWKGIFRVVELNGVHATIISCISPNQPPKKVHINQIKKCFELIGPPCTLPEKLSVHADVEALSNEPPEKLSVHADVEALSNEPSEAGNLNQENSESTITNRQNVINQGIADINGDRRYSLRNRLAITKPKRFTE

SEQ ID NO: 140596 - protein, 200 aa, Heterodera glycines
  Coding regions on vcDNA: vcDNA=SeqID_67019; Strand=+; Position=1-603
  Homolog annotation: Hit_ID=XP_345024.1; Match level="QueryCoverage =94%, HitCoverage=87%, E-value=8e-20, Identity=27%"; Hit description =similar to SPAC23A1.17 [Rattus norvegicus]
HFNHWDSIHFQSLGLNPPAFQSLALNPPAFQSLALNPPAFQSLGLNPPAFQSLGLNSAFQSLALNPPAFQSLGLNPPAFQSLGLNPPAFQSLGLNSFQSLALNPPAFQSLGLNPPTFQSLGLNPTAFQSLGLNPPAFQSLGLNPPTFQSLGLNPPAFQSLGLNPPAFQSLGLNPPAFQSLGLNPPAFQSLGLNPPAYQSL

SEQ ID NO: 140597 - protein, 76 aa, Heterodera glycines
  Coding regions on vcDNA: vcDNA=SeqID_67020; Strand=-; Position=1-388
GGTVPKFCTTFYCGKSKYLIGQRRVNEHSRLWPVVERKNGNIRWGALFSKNSSFRLTIPPFCALFRFKIESFFFVF

SEQ ID NO: 140598 - protein, 110 aa, Heterodera glycines
  Coding regions on vcDNA: vcDNA=SeqID_67021; Strand=+; Position=1 -121,612-823
MAGALRYTIMHPGAGVKSAEARLKGVATFRQGAIGMQLKSGDKSDTIPLANKPFLAEQQGDRIWGLNREPIAEKLRVENVGEADKTTLVIFFNDKTENEQLDHDLDDAQV

SEQ ID NO: 140599 - protein, 82 aa, Heterodera glycines
  Coding regions on vcDNA: vcDNA=SeqID_67022; Strand=+; Position=1-249
MSKSGLGEARFGTRSRSSKRSPKIFRGSQNRKEPSLFTTADQSITCQLTPIYVAGNIHKYKILEKCILTMLYRYIMHVSIGD

SEQ ID NO: 140600 - protein, 87 aa, Heterodera glycines
  Coding regions on vcDNA: vcDNA=SeqID_67023; Strand=-; Position=1 -43,101-319
MKVAFFLNGTPVQSSDRVQVLYQNGFALLSIAEVTEQDAGYYVCQAENEIGSAETSATVVVVPRKGDGKFLAESEGTWERGRHARVA

SEQ ID NO: 140601 - protein, 71 aa, Heterodera glycines
  Coding regions on vcDNA: vcDNA=SeqID_67024; Strand=+; Position=1 -69,271-417
MGENFIFIKDFCRYCKENAKIMLLTNKLHIRRKSFPFLLSSSTLTIKSSFSLEELFKERRRKMRISNSTES

SEQ ID NO: 140602 - protein, 17 aa, Heterodera glycines
  Coding regions on vcDNA: vcDNA=SeqID_67025; Strand=-; Position=1-54
PVNSCIGCKCRRCCTPN

SEQ ID NO: 140603 - protein, 197 aa, Heterodera glycines
  Coding regions on vcDNA: vcDNA=SeqID_67026; Strand=+; Position=1 -108,153-638
MYDIISVFNNESRLYSLYLEFLTIADSMNWLNVKLKLDLFIFVQWTDAKIANSAASIARQKCANVWNRHKFLFYKLYDRWHDEPLDEMPNFQIYQSIFLNEMNLLFEKFLMKSEKAMDEEIRKIIEKAQKKYDEKKGTRKVKGKAKESDKNGENYAKFEVKLGEKNVETLSKLVEENAIFKKILKNSKKKKSGKRLL

SEQ ID NO: 140604 - protein, 121 aa, Heterodera glycines
  Coding regions on vcDNA: vcDNA=SeqID_67027; Strand=+; Position=1 -45,94-225,299-485
MMMYNDNNSQAPPQQPPLPYATNDHQRQHHHFQQPAQQQDPRIYPQQMFYNPPQPMPASHQYHHQTLLNRLPNVPQPSVADAQVMVPPPAMTDIALAGAEQAIQMFYNNAGIHNQQTHQQN

SEQ ID NO: 140605 - protein, 130 aa, Heterodera glycines
  Coding regions on vcDNA: vcDNA=SeqID_67028; Strand=+; Position=1 -51,667-778,830-1059
MELEDVDMDEDEIVKTLCRVPLIERLADEFAGRYAVAAWVCFFVESRFGVLMRRYFLHIEHSEWVILSIPNENARRRRANWLPDPSEEDDTTLANSIREFRARLARFRADYPQLFLPDSNKLSPVRILCH

SEQ ID NO: 140606 - protein, 26 aa, Heterodera glycines
  Coding regions on vcDNA: vcDNA=SeqID_67029; Strand=+; Position=1 -44,175-208
LDNDGKVARFASFQLVQLRFAQTLLQ

SEQ ID NO: 140607 - protein, 220 aa, Heterodera glycines
  misc_feature (13)..(13): Xaa can be any naturally occurring amino acid
  Coding regions on vcDNA: vcDNA=SeqID_67030; Strand=-; Position=1 -98,588-644,692-765,809-945,1116-1240,1498-1520
  Homolog annotation: Hit_ID=CAE74248.1; Match level="QueryCoverage =88%, HitCoverage=35%, E-value=2e-40, Identity=46%"; Hit description =Hypothetical protein CBG21934 [Caenorhabditis briggsae]
LLQIVLNKYYRRXGGIARRLSFSKFGIPRPKNVCLILVPGDGGSRLKANLTGKPSVVHYFCQRQTNDFFALWLDLTGKPSVVHYFCQRQTNDFFALWLDLQQFGPFVIDCWADNMRLNFNRTSGLQQFGPFVIDCWADNMRLNFNRTSGRAQDLEGVKVRVPGFGHTRTVEWDSSKRSPSRYFAPIVASLAKLGYQRGIDVIGAPYDWRRAPGEFNFFCF

SEQ ID NO: 140608 - protein, 293 aa, Heterodera glycines
  misc_feature (19)..(19): Xaa can be any naturally occurring amino acid
  misc_feature (250)..(250): Xaa can be any naturally occurring amino acid
  misc_feature (258)..(258): Xaa can be any naturally occurring amino acid
  Coding regions on vcDNA: vcDNA=SeqID_67031; Strand=-; Position=1 -156,206-319,396-496,569-639,984-1055,1122-1175,1238-1280,1329 -1388,1454-1503
  Homolog annotation: Hit_ID=CAA09602.1; Match level="QueryCoverage =93%, HitCoverage=51%, E-value=6e-62, Identity=51%"; Hit description =nicotinic acetylcholine receptor alpha subunit [Ascaris suum]
RNVPKHSADNWLIISFSLXLKVFWEPPAVFKSLCQIDVQWFPFDEQLCQLKFGSWSFGSWSYPADLLRLTFWEDANGTETEREELASTLSIHSSSDLSDYYPSVEWDIMSVKAVRHSHFYSARSSADSLSLSLSFQYNLALRRKPLFYTINLVFPCVGISFLTILVFYLPSDSGEKIALCISILVALTVFFLLLIALCISILVALTVFFLLLTEIIPATGTVIPLIGTEIIPATGTVIPLIGRYLLFTMXRYLLFTMXMVTLSVMGTVYALNFHFHKLNFHFHKPTTHSFSPW

SEQ ID NO: 140609 - protein, 547 aa, Heterodera glycines
  Coding regions on vcDNA: vcDNA=SeqID_67032; Strand=-; Position=1 -146,201-322,698-920,964-1120,1325-1501,1551-1655,1912-2052,3009 -3104,3153-3264,3357-3674,3907-3953
  Homolog annotation: Hit_ID=NP_788510.1; Match level="QueryCoverage =97%, HitCoverage=89%, E-value=3e-47, Identity=35%"; Hit description =CG5215-PB, isoform B [Drosophila melanogaster] gb|AAO41247.1| CG5215- PB, isoform B [Drosophila melanogast
MFGYQQTQFNYGAYASANGQQQSFINYAQQQNNSATAPVAGNATTNAYAASQYSLAASAYAQYSQAATQQQSVAATYGVQPPPPPPDYSEFRKKRYGLGHQNRDVQQHFCEVCKISCAGQAAYKDHLEGKPHKKKEMAAKNKSTVPTYKGVGFRCEVCELTCSSKDTYDAHIKGQKHQRTVALLRRMGKPVPEQLDVSPAVLTSANAQALGKPIPTKALLADVDIKPIGQEYIEEETDTNGKFINYNCKLCDCKFSDKNAKDIHLKGRRHRLQYKQKVDPSLKVEMKQWGGKKQQQKHKFGGPGAYAMSYKTLKAVSDSMLSEADCPPETQEEHRVLKGVMRVGLLAKHLMLKTDTQAKCVPLHSVNSTVKIVRDIGNRVQTWSALNCWAIELLVEKTLASISMPLSPGDAVRRLFEVISSGQFLSKRSKLTDPCEKDQVDILAHITDQEREDITSSAQHAIRLIAYNQLYKILGIERLPDLRPAPAPPVGNGGAASLKRPLSRDESSANGGGGPAGAASAAADSSSEGNIAEKKMRMDDTKEETED

SEQ ID NO: 140610 - protein, 96 aa, Heterodera glycines
  Coding regions on vcDNA: vcDNA=SeqID_67033; Strand=+; Position=1 -226,277-339
TVPSMSSGTVSPLRDVPLRLSDKPSLPFPSPRRLTNDCPSSPSPAPITLYLRLVSWVCSMSGLLFGYASSSINDLLPFIVREMRLWPAEVGVVISC

SEQ ID NO: 140611 - protein, 220 aa, Heterodera glycines
  Coding regions on vcDNA: vcDNA=SeqID_67034; Strand=+; Position=1 -82,178-398,439-544,598-786
  Homolog annotation: Hit_ID=NP_388504.1; Match level="QueryCoverage =98%, HitCoverage=40%, E-value=5e-27, Identity=36%"; Hit description =hypothetical protein BSU06230 [Bacillus subtilis subsp. subtilis str. 168] emb|CAB12442.1| ydjK [Bacillus
TTTTLRRSENSLKAELMGKLANQVVSFVVSFFASWAGLFLVSRFGRRPLLMTGQIGVIGMNILMAICFGFFPFGPIRGWLTLALLLVFLTFGQGFISTVTWLLTAEIFPLHLRGICSGLLTAEIFPLHLRGICSGIGMSVAWGTAFAVTMLIPIGIHIGIHSIGMAANFACLALLGLISLLFVWNFLPETRNKTLEELEKQFQKRDWTALKREGQNERDR

SEQ ID NO: 140612 - protein, 80 aa, Heterodera glycines
  Coding regions on vcDNA: vcDNA=SeqID_67035; Strand=-; Position=1 -114,177-305
MSRFYKTSLCTFYQQRGFCNNGDQCRWAHGEAELRKGADGSSNGLANYYAATMQAMATGQQNANGSSAEAAAAAAAAGWN

SEQ ID NO: 140613 - protein, 49 aa, Heterodera glycines
  Coding regions on vcDNA: vcDNA=SeqID_67036; Strand=+; Position=1 -24,81-206
MGRARRKKGKTARRARQGLLGFTRIAREGKKPKQFVSNFMLVLILRKCF

SEQ ID NO: 140614 - protein, 26 aa, Heterodera glycines
  Coding regions on vcDNA: vcDNA=SeqID_67037; Strand=+; Position=1 -30,450-500
MVAGIWGGGRGLTLRTVIILSNISSK

SEQ ID NO: 140615 - protein, 33 aa, Heterodera glycines
  Coding regions on vcDNA: vcDNA=SeqID_67038; Strand=+; Position=1 -99,508-510
MDVKLIVNVMEGMDRTKMLQICYQYQQQKMKEE

SEQ ID NO: 140616 - protein, 78 aa, Heterodera glycines
  Coding regions on vcDNA: vcDNA=SeqID_67039; Strand=+; Position=1-279
STYGAGCVSNILFGKIFFFDLSEGANINNFFLKTHTYEKVTSIFLIRSEIVRGGNIVHPYQKIVFAFLYISFVLNLLI

SEQ ID NO: 140617 - protein, 20 aa, Heterodera glycines
  Coding regions on vcDNA: vcDNA=SeqID_67040; Strand=+; Position=1-63
VNLVLYNGEGLQNLERLYRF

SEQ ID NO: 140618 - protein, 70 aa, Heterodera glycines
  Coding regions on vcDNA: vcDNA=SeqID_67041; Strand=-; Position=1 -212,264-349
KCPAILSAAHKNGDTSIHNQKERKNVWQKQTFVEAKHCFGWINHNHHKFWENLVKFDGMRERQTVEMCNK

SEQ ID NO: 140619 - protein, 130 aa, Heterodera glycines
  Coding regions on vcDNA: vcDNA=SeqID_67042; Strand=+; Position=1-395
LTVFPFRQKKFFFDSYFERDSDEEEEARKVEKGEESGRRHAKSSDRNGGRQRQDGKKIRREEEKQTAEEEEEEEEDPLDAFMNEINEVADQAKEESLRKESHALNTGEYAGGQMGRDDIEQEDMHGQLTD

SEQ ID NO: 140620 - protein, 43 aa, Heterodera glycines
  Coding regions on vcDNA: vcDNA=SeqID_67043; Strand=+; Position=1-505
CFAVPRTGRQWIALNLQEIILAISGCKKLLGNELFFEVSQTPY

SEQ ID NO: 140621 - protein, 18 aa, Heterodera glycines
  Coding regions on vcDNA: vcDNA=SeqID_67044; Strand=+; Position=1-56
YREAIPEGFGLPINLGAS

SEQ ID NO: 140622 - protein, 27 aa, Heterodera glycines
  Coding regions on vcDNA: vcDNA=SeqID_67045; Strand=-; Position=1 -48,118-151
MTSHFLVGAAAFGAGMCFTKTYMEKPK

SEQ ID NO: 140623 - protein, 71 aa, Heterodera glycines
  Coding regions on vcDNA: vcDNA=SeqID_67046; Strand=-; Position=1 -161,390-444
MISVQFSPIVLLLLLLTLLHLSSPANARPQWYYADPISMANNRGTLFDNLWGRNEFAGREWCLSTQFFKGY

SEQ ID NO: 140624 - protein, 86 aa, Heterodera glycines
  Coding regions on vcDNA: vcDNA=SeqID_67047; Strand=+; Position=1-348
FPSNFPPSFCCCFCSLCCTFLHRPMLVPNGITPTQFRWPTIAALFSTICGDGSDLALRKTNKTIVNLCIILCKVLFNFVLINAINS

SEQ ID NO: 140625 - protein, 53 aa, Heterodera glycines
  Coding regions on vcDNA: vcDNA=SeqID_67048; Strand=-; Position=1-161
MISVQFSPIVLLLLLLTLLHLSSPANARPQWYYADPISMANNRGTLFDNLWGR

SEQ ID NO: 140626 - protein, 320 aa, Heterodera glycines
  Coding regions on vcDNA: vcDNA=SeqID_67049; Strand=+; Position=1 -179,242-508,569-1085
  Homolog annotation: Hit_ID=AAL78214.1; Match level="QueryCoverage =58%, HitCoverage=96%, E-value=3e-09, Identity=28%"; Hit description =putative esophageal gland cell protein Hgg-20 [Heterodera glycines]
MAPPAEKKKKHSSADHRLIISASIGGKKQQQTLGSVITSFGKRRSLRVAMKENCRILRKIWVCNDIWMDIFPHFDRPQLGLKMALLSPRFNALVDKHFDGISQLTIWNAITIHRIGTKAKLVVEENNAKFPLPDHPLRNKIRFNYLRIEYIDYSVITFLRANQQIFDKGTDLNLFMPYYDHDDKNVQPIWDDFARAIWPIFAPNIRHLSFSDAHAFGNLRRHISPTILTDLNQLNSIDSDYLLPDVIGDDGPNATAGQALSKWLQILGKDGKPKQLSCSNYYHAAMPTINEWIVNFKEVKKGLITFNWPLFFGFQLKYLH

SEQ ID NO: 140627 - protein, 30 aa, Heterodera glycines
  Coding regions on vcDNA: vcDNA=SeqID_67050; Strand=+; Position=1-90
TVYALIIDQSLLSRSLQLSPSLRGVLKNNP

SEQ ID NO: 140628 - protein, 271 aa, Heterodera glycines
  Coding regions on vcDNA: vcDNA=SeqID_67051; Strand=+; Position=1-815
LQQAFLLLGRARKKRRGGRALSTGEADREKGQQRQTGPHAARRERGKARTEARRTTAKATGKKGTTNQERKTEGRRRPDTAQAQTANDANQRPAGGPRRPGGEQPGNESPPAPGEACTQSRNPKEQTEGHHQERSRRHKPTQHGETHPARTPQGKTEREHTQDAAEGGARPPPERGAKRQANTENERDTSPPKRRHNAPEGTTTEREHRRAAARNRATTGQRSPKTTGAARALHWQNQRACPSPKGVGKPVKICRDWDRTLQLLSVNEEFL

SEQ ID NO: 140629 - protein, 82 aa, Heterodera glycines
  Coding regions on vcDNA: vcDNA=SeqID_67052; Strand=+; Position=1 -18,84-314
VARKVETQFPPVKTVRRECTKIAASCPCGYGSCVFVTRKQIVDVCCAGPYEFKCCHNVRNANFGVFITFEMCRVTPPRDYDG

SEQ ID NO: 140630 - protein, 156 aa, Heterodera glycines
  Coding regions on vcDNA: vcDNA=SeqID_67053; Strand=-; Position=1-471
  Homolog annotation: Hit_ID=AAQ61376.1; Match level="QueryCoverage =65%, HitCoverage=75%, E-value=1e-21, Identity=49%"; Hit description =conserved hypothetical protein [Chromobacterium violaceum ATCC 12472] ref|NP_903384.1| hypothetical protei
MWLLSFRLTGIGSSFTLFLRNVMTQLTPLDLVLDTLQQVVASPEHRPTQLAARFSADYRQQVDGKALNFEQFEQHMALLKRQTRRMTLSVIAAAEQGEAVLTHHLVELEKCDGSCSRVRVLAHFTVREGRICACDELTELLAGSPGDRDLGSRVSE

SEQ ID NO: 140631 - protein, 117 aa, Heterodera glycines
  Coding regions on vcDNA: vcDNA=SeqID_67054; Strand=-; Position=1 -79,1064-1134,1518-1721
  Homolog annotation: Hit_ID=NP_001005360.1; Match level="QueryCoverage= 49%, HitCoverage=6%, E-value=3e-19, Identity=75%"; Hit description =dynamin 2 isoform 1 [Homo sapiens] sp|P50570|DYN2_HUMAN Dynamin 2
MRLLDLFALATVFAHFFYRSVQIVNRNVFATTGYKESEVQLPQIVVVGSQQVREEIEKETERVTGSNKGISPAPITLTIYSSRAVNLSLIDLPGITKVPVGDQPPDIEVLNSLYDLI

SEQ ID NO: 140632 - protein, 133 aa, Heterodera glycines
  Coding regions on vcDNA: vcDNA=SeqID_67055; Strand=+; Position=1 -54,102-336,417-529
  Homolog annotation: Hit_ID=NP_498147.1; Match level="QueryCoverage =96%, HitCoverage=63%, E-value=3e-24, Identity=49%"; Hit description =protein phosphatase (21.1 kD) (3G460) [Caenorhabditis elegans] gb|AAF60485.2| Hypothetical protein Y32H12
MNILATHHPPDKDYGHMKIDEPKTPFNNYSDSEGEELTSGGGTSRPRRVSLVGAVDADELRKTISGGTRSQMKVLDPPGSGEDDEDSESGMTEEQIVKKREFEKKRKTHYNEGAFLKKMRERAAKEEEEEDEQ

SEQ ID NO: 140633 - protein, 175 aa, Heterodera glycines
  Coding regions on vcDNA: vcDNA=SeqID_67056; Strand=-; Position=1 -45,99-323,375-576,773-828
MHSAGLSPFVNHWSKVHNFTPETGKCHLSPHGVVFQSAAIHNFPLAERLNDFVAHSPLVDRWKLCIGNANNSPLFVEEKDENCQTTDNEKDNNVLVLLQPVDGFNPGLRFYAESVQMAIDLRGLGRLVAMQDIDLRAGEWEVLLCQNKQQKKKHMTNMWENDLLPRNNKGNEIVN

SEQ ID NO: 140634 - protein, 32 aa, Heterodera glycines
  Coding regions on vcDNA: vcDNA=SeqID_67057; Strand=-; Position=1-96
RYNERVKQCVKESNVALESDYRDISNDGEGRR

SEQ ID NO: 140635 - protein, 227 aa, Heterodera glycines
  Coding regions on vcDNA: vcDNA=SeqID_67058; Strand=+; Position=1 -394,580-868
MVIRPSSVQMHPPLHNNRFHSNQFSFAVAAEQCQQPPMNGGGGTQPPPAGGALFQQPFPPAPPRGTEAAAQIEQHQMMLIRQHQQQQQQQMLLHQLMLRGEVSLPPQGRPSAQPPHSFPPNPHNNYQHIVGELTPPPSQPSLGGLSSPQANGNTSSAALLLNGFNPSSTTASVSSGYNFHSVGDLHHPTTTATTAVSASELLQRQCQQMLLARQAAAVLQQQQQHKS

SEQ ID NO: 140636 - protein, 68 aa, Heterodera glycines; identical to SEQ ID NO: 139700
  Coding regions on vcDNA: vcDNA=SeqID_67059; Strand=-; Position=1 -18,288-476

SEQ ID NO: 140637 - protein, 79 aa, Heterodera glycines
  Coding regions on vcDNA: vcDNA=SeqID_67060; Strand=+; Position=1 -237,379-441
FFLSFEINCEKYTKLFSVLIMLYNAFKPRREAGQFQNFVLHFTVESPSTLLDNYVSMSTVAFGLLWNGKWKYQMGCALF

SEQ ID NO: 140638 - protein, 34 aa, Heterodera glycines
  Coding regions on vcDNA: vcDNA=SeqID_67061; Strand=+; Position=1 -6,376-474
MNLGISHGISKRICTFVEIILREFFLFCGCPQQQ

SEQ ID NO: 140639 - protein, 30 aa, Heterodera glycines
  Coding regions on vcDNA: vcDNA=SeqID_67062; Strand=-; Position=1 -27,895-960
MKKNIYKRLFNPEIVVRKCRSANVALRQKD

SEQ ID NO: 140640 - protein, 223 aa, Heterodera glycines
  Coding regions on vcDNA: vcDNA=SeqID_67063; Strand=-; Position=1-672
MKLCLLFFSIVFLIAQIEIGAEKKKLEQKTFEEIFGEKWEEKENEQKKREIVQKFNKIKEKIKQKERKYSTKEWHKIELKIGKKLGTNRNKIYKWIKELGIYKGHNKSKTDVQKIEIVQKFNAMKNEYKQNGRKYSTKEWDKNYAEICKKIGVGHDLIKRWKKQFGMGERINEKEKMEKMKMYWQMKGENPKMSDSKISKILKISQWTIFNWKKQFEEELNED

SEQ ID NO: 140641 - protein, 449 aa, Heterodera glycines
  Coding regions on vcDNA: vcDNA=SeqID_67064; Strand=+; Position=1 -61,159-395,887-1002,1103-1285,1335-1535,1576-1806,1996-2316
  Homolog annotation: Hit_ID=XP_415979.1; Match level="QueryCoverage =65%, HitCoverage=36%, E-value=3e-25, Identity=26%"; Hit description =PREDICTED: similar to Zinc finger BED domain containing protein 4 [Gallus gallus]
MFISLNSYFFSNLKMSNLNPVQQCLLLISKITTHNFTNSVKIVQAEKQKTEKKGQSGINPLKRAFANAFYGSSQQITDDEEKEAPISSKSPILIGLNAKRRHTAESIVSFIREALNDFQIQEQKISALTRDTENTMKKCIKEGLRSIEEEERLKNLFENVKRFVRKVRKSRVLTEQLAELQQKEEIEEVPPTVLIKNVEVRWNSSYKMIERFINLLSIEHYQLPKFNADDWLLLSSIKSILSPIYEATVLLQNRNSSCSIIIPLFKAISFGLRENKDNRYSNIKKTIANAIELRLKQAEEQKNLVLATILDPRFKTIYLDSSRLNQYKDWLISEVESYHAKTDATSPSPSALETRQKAEVEVNEYLRDPKIKSRADPSLYWEVNSQKWPMIGDVVRKFLSPPATSSEIERLFSTAGLISDDLRKSLLPENIAKLLFLHHNLLVTGFSIE

SEQ ID NO: 140642 - protein, 49 aa, Heterodera glycines
  Coding regions on vcDNA: vcDNA=SeqID_67065; Strand=-; Position=1-533
LNLKKCQRLLFLKFFEILTFSLIIYYFAKLIHKYFFRKCSETHQMLIKS

SEQ ID NO: 140643 - protein, 130 aa, Heterodera glycines
  Coding regions on vcDNA: vcDNA=SeqID_67066; Strand=+; Position=1 -148,190-434
MPSHEFQNIKVKNRPNFVEQFNKCNVFCQQSEAEEKASRPIERVTENAFGTVPKRTAHLAHRIGQRGYKGRRNGPKKWRQLTKAMAKTLLGVNNNHWRGLFIRCDFANGANDLGTVRMSVAGGEAVVLGP

SEQ ID NO: 140644 - protein, 86 aa, Heterodera glycines
  Coding regions on vcDNA: vcDNA=SeqID_67067; Strand=-; Position=1 -137,185-309
EPNATRERLGRFIATDAPTLRATNEWRKERDEENRRNDKRRGKRRALPFSVFAAKWRRFRPVPFACASAASASNAEAKCGTMFNRK

SEQ ID NO: 140645 - protein, 17 aa, Heterodera glycines
  Coding regions on vcDNA: vcDNA=SeqID_67068; Strand=+; Position=1-52
ALEVKKANLADGGRSNR

SEQ ID NO: 140646 - protein, 193 aa, Heterodera glycines
  Coding regions on vcDNA: vcDNA=SeqID_67069; Strand=+; Position=1 -278,754-841,1291-1411,1630-1724
  Homolog annotation: Hit_ID=CAE59853.1; Match level="QueryCoverage =65%, HitCoverage=21%, E-value=7e-24, Identity=43%"; Hit description =Hypothetical protein CBG03326 [Caenorhabditis briggsae]
MGISQLLLQLRQRCLPYYSYSKSDQKNHHHHFALGGGLLLLLLLAIGTFESPVPLVAVPSATTLIIGTMVTLFLASQADFIYRSWLTLERDLTGLFLLIKIRLDMRRRMRENKGIQQIFVDVYTFREFNALANRFANTFLQNGYRSGDVVALFMENSAEFVAAVFAFLNVKQFYVLTYLSQVIVYKIVDIIQI

SEQ ID NO: 140647 - protein, 150 aa, Heterodera glycines
  Coding regions on vcDNA: vcDNA=SeqID_67070; Strand=+; Position=1 -70,231-284,334-416,528-656,788-904
  Homolog annotation: Hit_ID=CAE59853.1; Match level="QueryCoverage =96%, HitCoverage=23%, E-value=2e-42, Identity=56%"; Hit description =Hypothetical protein CBG03326 [Caenorhabditis briggsae]
MLSTIRPNNPLLVFDGYLNQEETKKKVVQNVFRHGDSAFLTGDILHWDRLGYLYFRIRTGDTFRFKGENVEAVLLPLKCIIDAVVYGVRVLELDGSVGMAALVKNDEAGTDDKFLRELSARLHANLPAYAIPRFIRICNAVDRTGHCFQI

SEQ ID NO: 140648 - protein, 57 aa, Heterodera glycines
  Coding regions on vcDNA: vcDNA=SeqID_67071; Strand=+; Position=1-173
MLLLLRVLLAVVLRVLLRVGCCCCGGAIRTNGVQPAKQFAHQRRQQLEAALVAKLCQ

SEQ ID NO: 140649 - protein, 30 aa, Heterodera glycines
  Coding regions on vcDNA: vcDNA=SeqID_67072; Strand=+; Position=1-90
MCRELNGGVRHNTRERSGIAAKKGYKSLFP

SEQ ID NO: 140650 - protein, 38 aa, Heterodera glycines; identical to SEQ ID NO: 130624
  Coding regions on vcDNA: vcDNA=SeqID_67073; Strand=-; Position=1-348

SEQ ID NO: 140651 - protein, 43 aa, Heterodera glycines
  Coding regions on vcDNA: vcDNA=SeqID_67074; Strand=-; Position=1 -86,336-381
MCPKELVEQRKKEIERGFNKMIEYLEGSSEETETPKKYSNFLI

SEQ ID NO: 140652 - protein, 161 aa, Heterodera glycines
  Coding regions on vcDNA: vcDNA=SeqID_67075; Strand=+; Position=1-486
MFNAISIAHRRVKPMLRHFAAQGSISLIVLLSGSIDEDECVVRVVIEVVAPDWHFVQYSFLLLPRPVFGCPSTLLLFLRCPPSSSFSSRGVKLVGYRIGQGRQCLTGGSFQTRCYCLFGAGCEAGGVPYRPGSTVPHRWTSQTRSLMFGSAGLRQADPSAL

SEQ ID NO: 140653 - protein, 157 aa, Heterodera glycines
  Coding regions on vcDNA: vcDNA=SeqID_67076; Strand=-; Position=1 -204,254-523
MGQNGIQEQQLLRDERTQKRKVEDQFYFCNLSADMKRVYSPGFCGLLCNHPRHSDVLDVRMSIFAFVESMKGTSGEYWHILTPKSKRNFEADIGTTPTFLQPGGKTVTTIALGKYGQGNPEPVALRPNYWLETSRERKPGLGYFQESRWKVYTANDL

SEQ ID NO: 140654 - protein, 92 aa, Heterodera glycines
  Coding regions on vcDNA: vcDNA=SeqID_67077; Strand=-; Position=1 -151,208-335
  Homolog annotation: Hit_ID=NP_499054.1; Match level="QueryCoverage =93%, HitCoverage=61%, E-value=1e-14, Identity=49%"; Hit description =esophageal gland cell secretory protein 11 like precursor family member (3K419) [Caenorhabditis elegans]
MCSKFLVLTMLLQMALANPFGTKQSVTVSGHLKCQGKPSVGTKVKLYDNDHFTIDDLMAQSKTDNNGHFKMSGTSKEIANIDPKLNLYHVRN

SEQ ID NO: 140655 - protein, 52 aa, Heterodera glycines; identical to SEQ ID NO: 128760
  Coding regions on vcDNA: vcDNA=SeqID_67078; Strand=-; Position=1-267

SEQ ID NO: 140656 - protein, 26 aa, Heterodera glycines
  Coding regions on vcDNA: vcDNA=SeqID_67079; Strand=+; Position=1 -6,134-208
MKISNLFGLVGNQANYGWSKETAKWQ

SEQ ID NO: 140657 - protein, 42 aa, Heterodera glycines
  Coding regions on vcDNA: vcDNA=SeqID_67080; Strand=+; Position=1-126
RDGRSSARHSKPKAKPNFFRSTKFEVRSPKTAKFRSSKHEVF

SEQ ID NO: 140658 - protein, 26 aa, Heterodera glycines
  Coding regions on vcDNA: vcDNA=SeqID_67081; Strand=+; Position=1 -52,206-234
MEKDLQIWRDYIDFSALEHVLKIFMN

SEQ ID NO: 140659 - protein, 24 aa, Heterodera glycines
  Coding regions on vcDNA: vcDNA=SeqID_67082; Strand=+; Position=1-76
ITGVSIIAVLFLVFLMPSQNLVRF

SEQ ID NO: 140660 - protein, 45 aa, Heterodera glycines
  Coding regions on vcDNA: vcDNA=SeqID_67083; Strand=-; Position=1-136
MMGSPNAAQTLDGLNKVGHDELKKMATAQRGGDWIGTVTIGGQQF

SEQ ID NO: 140661 - protein, 79 aa, Heterodera glycines
  Coding regions on vcDNA: vcDNA=SeqID_67084; Strand=-; Position=1-590
TLITIASYQKFNLVYNEKSHYQLRRTGRFPSIHRSFYSSVFLLSSPTSSFFPHFPLIFPSKIDPPPINCFLMPIDHNGK

SEQ ID NO: 140662 - protein, 85 aa, Heterodera glycines
  Coding regions on vcDNA: vcDNA=SeqID_67085; Strand=-; Position=1 -155,262-295,491-559
MILHTERRSICSKRHGVPSPQQRRRRKTTNEQTAKEVKKNVENELEEKGREASPEGNEDERRCAYDDDRNAELFDGVGSYMVYAP

SEQ ID NO: 140663 - protein, 478 aa, Heterodera glycines
  Coding regions on vcDNA: vcDNA=SeqID_67086; Strand=+; Position=1 -1125,1377-1688
MSGRDAETERTAVKEEGGRGKKDSSWLDESESRERVEWKRKVSRGKKRTKISPQKRQMRKKVEEQRNAALSDQEESRESDQNRETKKKWVKTSAGKVPKGQPQYSTHAEKEAHQRDGTQADTGERNLSLQQQANDALSQQQLTETETDRPIDGQQYGRFAVRTVKGLPKWRRDGILTEASKSTESEFETAPSKSDRHHYDTDGTQQLRQEQSFLSGASTELSEFLVERVRPKNEYRRYGNSKESSAEAMEKSPRHGIGMTNHLNLSSDEIETDQSLESHRFHSTETASHFLSRSEQKETDDKNSAGWRIRTVKKGGEVVPTEEDEQKQAQFLMRKTESGTEGNFGIMAKSDGQKWGDSQNANDGADNERRKEQQELFHLANAQPALWLNEFGEVSHSTDQRGGQMGLPHSDGSRAMAECRGWEDVHRAIKRFVKFQLAKEAKVEQKDDSFLAKVAIRPRIFTQKRQWTVKMPKFHWFH

SEQ ID NO: 140664 - protein, 41 aa, Heterodera glycines
  Coding regions on vcDNA: vcDNA=SeqID_67087; Strand=-; Position=1-123
MQRPIIVNIIALANLGTGIKLNSLTITECEFKYNPRKFNAA

SEQ ID NO: 140665 - protein, 107 aa, Heterodera glycines
  Coding regions on vcDNA: vcDNA=SeqID_67088; Strand=-; Position=1 -40,138-272,332-478
  Homolog annotation: Hit_ID=NP_491896.1; Match level="QueryCoverage =99%, HitCoverage=20%, E-value=7e-28, Identity=56%"; Hit description =metalloenzyme (59.2 kD) (1H147) [Caenorhabditis elegans] gb|AAB96720.1| Hypothetical protein F57B10.3a [C
MCNFASPDMVGHTDVAIGRILEACRNHGYVLLVTADHGNAEQMKADDGGPHTAHTRNKVPFTCSSAAHSFKSAPPTTAEGVPRARALCDVAPTVLYLMGLPKPEEMD

SEQ ID NO: 140666 - protein, 117 aa, Heterodera glycines
  misc_feature (7)..(7): Xaa can be any naturally occurring amino acid
  Coding regions on vcDNA: vcDNA=SeqID_67089; Strand=-; Position=1-794
SRRIRSXHKSGRIGSGGLPRKQKNRFFQVSVWGTQTIMGSKNPTQNQSTGYREAIPEGFGLHINLGASVRGDCPENKKIDFFKCPFGVLKHLWGAKLQRRIKVQTIGKLFPKDSVSP

SEQ ID NO: 140667 - protein, 213 aa, Heterodera glycines
  Coding regions on vcDNA: vcDNA=SeqID_67090; Strand=+; Position=1-639
  Homolog annotation: Hit_ID=XP_345024.1; Match level="QueryCoverage =98%, HitCoverage=87%, E-value=5e-27, Identity=28%"; Hit description =similar to SPAC23A1.17 [Rattus norvegicus]
VRLNPPAFQSLGLNPTAFQSLGLKPPAFQSLGLKPPAFQSLGLNPPAFQSLGLNPPAFQSLGLNPTAFQSLGLNPPAFQSLGLNPPAFQSLGLNPPAFQSLGLNPPAFQSLGLNPPAFQSLGLNPPAFQSLGLNPPAFQSLGLNPPAFQSLGLNPPAFQSLGLNPPAFQSLGLNPPAFQSLGLNPPAFQSLGLNPPAFQSLGLNPPAFQSLGL

SEQ ID NO: 140668 - protein, 74 aa, Heterodera glycines
  Coding regions on vcDNA: vcDNA=SeqID_67091; Strand=-; Position=1 -126,507-605
MADENWKGSIGDGNVGIKCTGRGGGGTDLGIDGAEEVVFGRGLDQSLGLTKNVAFDQAQALVQFNLLSAPITID

SEQ ID NO: 140669 - protein, 63 aa, Heterodera glycines
  Coding regions on vcDNA: vcDNA=SeqID_67092; Strand=-; Position=1 -64,114-241
MPVSQANSWIPLVLSLVLRFRETRHTESKNFSGRDSRAANFKEIYRSEQFKISALLKDTAHNQ

SEQ ID NO: 140670 - protein, 168 aa, Heterodera glycines
  Coding regions on vcDNA: vcDNA=SeqID_67093; Strand=+; Position=1 -81,313-409,689-1017
MDTISLQVLLAFAMFATTALAGLLPIKLLHAITRRQDENDEQRSRKSDYILTLLSCFAGARITPIFGQVPVEHRLPIPAILCLLRLFLGLFSGGDLPKSVRVRKTAPATRALSQRWPWRPFSWQQRRVGKNWQKILNSKREKHLMDLALPPELVSFSHWRSYFPNLWS

SEQ ID NO: 140671 - protein, 34 aa, Heterodera glycines
  Coding regions on vcDNA: vcDNA=SeqID_67094; Strand=-; Position=1 -86,203-221
MVGGLSSTKVAKSRKNLNKLLALGRRRCRVQRCR

SEQ ID NO: 140672 - protein, 77 aa, Heterodera glycines
  Coding regions on vcDNA: vcDNA=SeqID_67095; Strand=+; Position=1 -72,394-552
DEDPRTRPAGQEPVQDFLGSDPYATEEDSLQFFEEQERQIALQIAQENGENEQQKEAEDDAEDGQAEEQQLEEDEEE

SEQ ID NO: 140673 - protein, 34 aa, Heterodera glycines
  Coding regions on vcDNA: vcDNA=SeqID_67096; Strand=+; Position=1-103
MNTKKKANIQEKNGTKIITKLARKLELADRTITK

SEQ ID NO: 140674 - protein, 80 aa, Heterodera glycines
  misc_feature (80)..(80): Xaa can be any naturally occurring amino acid
  Coding regions on vcDNA: vcDNA=SeqID_67097; Strand=+; Position=1 -77,761-928
  Homolog annotation: Hit_ID=CAE62038.1; Match level="QueryCoverage =92%, HitCoverage=5%, E-value=4e-28, Identity=69%"; Hit description =Hypothetical protein CBG06054 [Caenorhabditis briggsae]
PPTLDPMRLDIGNIYDWFTNPLPYQVMPISWYPRNFTNPDLNYLDQYVRISDDTLYAVQLGLYVVGYKEFQDDQVSLITX

SEQ ID NO: 140675 - protein, 46 aa, Heterodera glycines
  Coding regions on vcDNA: vcDNA=SeqID_67098; Strand=-; Position=1 -93,552-599
MRSMTIDGSFFCSIVYDLSSAIFASFTMKSTQNIFKLIGQLMLLVI

SEQ ID NO: 140676 - protein, 106 aa, Heterodera glycines
  Coding regions on vcDNA: vcDNA=SeqID_67099; Strand=+; Position=1 -72,195-288,382-536
  Homolog annotation: Hit_ID=CAE62132.1; Match level="QueryCoverage =91%, HitCoverage=16%, E-value=8e-10, Identity=34%"; Hit description =Hypothetical protein CBG06176 [Caenorhabditis briggsae]
MSKPLAERMKHLLSAGEDADVYFLLVPAHRIILKLASDVFEAMFRFDAKKERPENVSGNCPDVVEIPDIEAEAFKVMLSFIYTDDLSDLNGENAMAVLYAGGFNFM

SEQ ID NO: 140677 - protein, 70 aa, Heterodera glycines
  Coding regions on vcDNA: vcDNA=SeqID_67100; Strand=+; Position=1 -66,126-272
MKALTKMRNGWAFLFGAMLLKKQKIGVANVLQLFELFRKSAALRISEENSMTMFLTIKTEAGDTISFHLL

SEQ ID NO: 140678 - protein, 191 aa, Heterodera glycines
  Coding regions on vcDNA: vcDNA=SeqID_67101; Strand=-; Position=1-573
IEWQTGNMVRIELPSSNVTNPHELSKNLYRLLGEGSDPLAKKVRSTQNSFMLATNKARRWAREEYIRRKTKEKLGVRDEELLLQALMTDTGPLVGLNTVTQGLLAREKHAETSNIALRTPTDDNDSYQKKLDDYFSKLSEKNLSIVDELGMIKLKAEIKNLTEEERVILEATKEMGTEGWIQSYREIRLAW

SEQ ID NO: 140679 - protein, 25 aa, Heterodera glycines
  Coding regions on vcDNA: vcDNA=SeqID_67102; Strand=+; Position=1 -57,129-149
MFFLLFYLFLFSVPKTNAENIETLV

SEQ ID NO: 140680 - protein, 69 aa, Heterodera glycines
  Coding regions on vcDNA: vcDNA=SeqID_67103; Strand=+; Position=1 -10,167-366
MPQEKFRRRRKKRRDELLGTIISILIMLGLMIALRWVILFILSRSQQLNAANARWALRLPAQIGEAREF

SEQ ID NO: 140681 - protein, 339 aa, Heterodera glycines
  Coding regions on vcDNA: vcDNA=SeqID_67104; Strand=+; Position=1-1020
  Homolog annotation: Hit_ID=XP_526077.1; Match level="QueryCoverage =85%, HitCoverage=67%, E-value=6e-27, Identity=27%"; Hit description =PREDICTED: similar to flagelliform silk protein [Pan troglodytes]
SPGLNPPAFQSPGLNPPAFQSPGLNPPAFQSLGLYPPAFQSLGLNSPAFQSPALNSPAFQSPGLNSPAFQSPGLNPPAFQSPGLNPPAFQSPGLNPPAFQSLGLNPPALQSLGLNPPAFRTLGLNPLAFQSLGLNPPAVQSLGLNSPAFQSPGLNPPAFQSLGLNSPAFQSLGLNSPAFQSPGLNPPAFQSLGLNSPAFQSPGLNPPAFQSLGLNPPAFQSLGLNSPAFQSPGLNPPAFQSLGLNSPAFQSLGLNSPAFQSPGLNPPAFQSLGLNPPAFQSLGLNPPAFQVFCLHFGTTFGIFLVFTCFWHFLMAHVSFLYLFFPFFHFLMARHFFSIF

SEQ ID NO: 140682 - protein, 75 aa, Heterodera glycines
  Coding regions on vcDNA: vcDNA=SeqID_67105; Strand=-; Position=1-225
MAAKAVKEAALFGDEMGNKRVRNVAATILYTMPLKREEEEANDEGEEGGKEGHGTAEETEEDEQNKQMLKEEEEE

SEQ ID NO: 140683 - protein, 80 aa, Heterodera glycines
  Coding regions on vcDNA: vcDNA=SeqID_67106; Strand=+; Position=1 -153,523-719
FVVSPSHIKNCAIAVSLGQEEAVHMLKSHFKTVQNFFILRRRLFPSLSRQRKFGHVKEATPQRRCQQSVQVDIRLRQQLV

SEQ ID NO: 140684 - protein, 119 aa, Heterodera glycines
  Coding regions on vcDNA: vcDNA=SeqID_67107; Strand=-; Position=1-360
MKKVFDAYENTYKTPKQKLDKVKQLQAEISDELRNSLKMTTDPEVLKEASFAFGDVPTFTGITKRVSVLPPKYLSIKGHEQCVDKYVVYGWHQGWHSEASKRSEIEIPCHPWLAPVVWD

SEQ ID NO: 140685 - protein, 45 aa, Heterodera glycines
  Coding regions on vcDNA: vcDNA=SeqID_67108; Strand=+; Position=1-136
FFILRRRLFPSLSRQRKFGHVKEATPQRRCQQSVQVDIRLRQQLV

SEQ ID NO: 140686 - protein, 69 aa, Heterodera glycines
  Coding regions on vcDNA: vcDNA=SeqID_67109; Strand=-; Position=1 -85,283-407
MLCCCFLFQLSLFLFPFTSATIAGYESKAEMPAAAPPAPNCANLDETSEANANGPNPFCVYPALIGVTH

SEQ ID NO: 140687 - protein, 343 aa, Heterodera glycines
  Coding regions on vcDNA: vcDNA=SeqID_67110; Strand=+; Position=1-1032
MNSSLELFGEESVHAFDDWADRFKDYLSLTGKNWTEEEKVTRLKLALKDTPRELFKELKSNQITTFTSALEALRAKLDSPQRREVAKRTLSVCRQREDETVAQFLRRLTPLIDSTNPSLTGDLRKEKICEEFLDRLRPNMSFLIRLVGLTQPKNLEMVKAQAEELEALLLSTGGGVTQITQLINSMTEQRGNEEPNEQNERKFEQQWSDNGGEFRNATSHDAQCSYLENERSEGNHQNWPRRRHGNMNRRNWSNYPTCQLCNRAGHSSYNCHERRAQFEDQANGEWHQHRRLPWNNWRDQANEMNEMPQSTSSLAPEFMEDLVKSLITLNLQKLNNTRPNNRD

SEQ ID NO: 140688 - protein, 44 aa, Heterodera glycines
  misc_feature (14)..(14): Xaa can be any naturally occurring amino acid
  Coding regions on vcDNA: vcDNA=SeqID_67111; Strand=-; Position=1-133
FIGDSINYTSCEHXADIIAHSFDRDDINGILLWTFYVRISNLFR

SEQ ID NO: 140689 - protein, 53 aa, Heterodera glycines
  Coding regions on vcDNA: vcDNA=SeqID_67112; Strand=+; Position=1 -115,710-756
MDPNLTKITFKLPRCPVVTELFDKADRCPNIYATVEAHRTKKKTVQFQPPIHQ

SEQ ID NO: 140690 - protein, 106 aa, Heterodera glycines
  Coding regions on vcDNA: vcDNA=SeqID_67113; Strand=-; Position=1 -176,1184-1280,1543-1590
MPSFALSDDGNELERLKAQRKAIDAKIAAELVRWQMVNWGTELTPKAKDNLKHWETIESFSSLVPWSLKASCPFRFVSDVPDFCFLVAQFQVISVEWFGDDYDGSN

SEQ ID NO: 140691 - protein, 69 aa, Heterodera glycines
  Coding regions on vcDNA: vcDNA=SeqID_67114; Strand=+; Position=1 -83,148-271
MALSSLIELGKNRQQTQRDEAENGIDNDDCRFDGSVAVSSPSVISSTFAATPANCSAETFQSHANGTHN

SEQ ID NO: 140692 - protein, 50 aa, Heterodera glycines
  Coding regions on vcDNA: vcDNA=SeqID_67115; Strand=-; Position=1-153
HNVAELRRVHVDLGEHRVGQFSGQTGKYEYNAEKQTMEFENLEVEKDDGF

SEQ ID NO: 140693 - protein, 205 aa, Heterodera glycines
  Coding regions on vcDNA: vcDNA=SeqID_67116; Strand=-; Position=1 -118,175-323,1075-1304,1452-1569
  Homolog annotation: Hit_ID=CAE56442.1; Match level="QueryCoverage =96%, HitCoverage=59%, E-value=1e-26, Identity=37%"; Hit description =Hypothetical protein CBG24145 [Caenorhabditis briggsae]
MMGRRGTNGRQTQPKEEEKRVETEQKKQPPGDEGTYGGTAKNAKDANSTAKQRKDSAVSEFLLTVEQQQKKRIRSTSICTAQMKAAECQEEKADELANDIFSLITECVANIELPSKVAATSFAFGEMHAQLCHFGFRPEFFSTIADATIAECLRLDAGTQKRCETLLAWSQLMQFMFSNVRDGYYAEVRQQRRSSLPQQRLLLKQ

SEQ ID NO: 140694 - protein, 70 aa, Heterodera glycines
  Coding regions on vcDNA: vcDNA=SeqID_67117; Strand=+; Position=1-283
GREAAEYPPKKIKKRARSARHEAAKRPNVLKKLKDGREAPVLRPRSGRMSPKKLKNGREAPVLRPRSGRI

SEQ ID NO: 140695 - protein, 58 aa, Heterodera glycines; identical to SEQ ID NO: 138265
  Coding regions on vcDNA: vcDNA=SeqID_67118; Strand=-; Position=1-437

SEQ ID NO: 140696 - protein, 32 aa, Heterodera glycines
  Coding regions on vcDNA: vcDNA=SeqID_67119; Strand=+; Position=1-100
CCNDGCQIRKKSTACQPISWSRNGMIGSAWWA

SEQ ID NO: 140697 - protein, 40 aa, Heterodera glycines
  Coding regions on vcDNA: vcDNA=SeqID_67120; Strand=-; Position=1-122
  Homolog annotation: Hit_ID=NP_494570.1; Match level="QueryCoverage =100%, HitCoverage=3%, E-value=4e-12, Identity=77%"; Hit description =AdaPTin or adaptin-related protein (140.0 kD) (apt-5) [Caenorhabditis elegans] gb|AAB66112.2| Adaptin or
LGYDISWTTFNIIEVMSSTRYSEKRIGYLAAVQAFNDETD

SEQ ID NO: 140698 - protein, 18 aa, Heterodera glycines
  Coding regions on vcDNA: vcDNA=SeqID_67121; Strand=+; Position=1-57
YSEAIPEGFGLPINLGAS

SEQ ID NO: 140699 - protein, 184 aa, Heterodera glycines
  misc_feature (143)..(143): Xaa can be any naturally occurring amino acid
  Coding regions on vcDNA: vcDNA=SeqID_67122; Strand=-; Position=1 -27,1010-1555
  Homolog annotation: Hit_ID=XP_308192.1; Match level="QueryCoverage =100%, HitCoverage=47%, E-value=1e-44, Identity=50%"; Hit description= ENSANGP00000021557 [Anopheles gambiae]
IILVFLDESSVLPVAADDSQSGIGATISHVFPNGVERVIEHASRTLTPAERNYAQIEREALSLIFAVQKFHRMIYGRNFTLLTDHKPLLAIFGNKNGIPIYTASRLQRWALILSNYDFTIKFKSANFGHADVLSRLSEHRTDXEVIVAHTYSTEEVEYALLVNLEQLPVDAKEVSELTISDDLL

SEQ ID NO: 140700 - protein, 40 aa, Heterodera glycines
  Coding regions on vcDNA: vcDNA=SeqID_67123; Strand=+; Position=1 -31,122-213
MVNNQALSTCSVKVNENWLKTSCMSCILYAFSCRMLINSC

SEQ ID NO: 140701 - protein, 114 aa, Heterodera glycines
  Coding regions on vcDNA: vcDNA=SeqID_67124; Strand=-; Position=1 -24,453-572,829-1026
  Homolog annotation: Hit_ID=NP_506619.1; Match level="QueryCoverage =42%, HitCoverage=5%, E-value=3e-09, Identity=50%"; Hit description =DNA Replication Factor C (rfc-1) [Caenorhabditis elegans] emb|CAA99812.1| Hypothetical protein C54G10.2 [C
MQKKDVTVNVFEAARQILSAETSVMQKNELYFTDYSLIPLFVQENYVNRPKTFIILYFINFFHLLGNVFFCASLRSDGRLFDCSDSIPRLVWQTFDRTEKAKINATTFAPYPSK

SEQ ID NO: 140702 - protein, 250 aa, Heterodera glycines
  Coding regions on vcDNA: vcDNA=SeqID_67125; Strand=-; Position=1 -80,240-387,447-489,594-619,722-855,907-1002,1244-1285
  Homolog annotation: Hit_ID=CAE71946.1; Match level="QueryCoverage =98%, HitCoverage=42%, E-value=1e-43, Identity=40%"; Hit description =Hypothetical protein CBG19013 [Caenorhabditis briggsae]
CLFRINKIEEAHRECARVLEKNPLDQAAWSLKLACFAEEVFVDELENDEAGLADAYMDLGTAVATAARPGTSLSRPGTSAGGPSPAVRPRGTSAGGPSPAVRPRTASGRPLSGMQRPMQRPESRLKTGTQNSMERMLRTSRTSRTSRPISAVTARQARLGTASMVAQKDGPFVNMARLNLEKYAASMVAQKDGPFVNMARLNLEKYAREGNVNTHLFNYVFLHEADARSALRWSPHAARTANDAIWFWPA

SEQ ID NO: 140703 - protein, 38 aa, Heterodera glycines
  Coding regions on vcDNA: vcDNA=SeqID_67126; Strand=-; Position=1 -59,121-178
MLFCGAVAGKSDDSAVALGAKCPISWTLMTTNTFLEGL

SEQ ID NO: 140704 - protein, 201 aa, Heterodera glycines
  misc_feature (3)..(3): Xaa can be any naturally occurring amino acid
  Coding regions on vcDNA: vcDNA=SeqID_67127; Strand=-; Position=1 -82,131-337,420-602,659-732
  Homolog annotation: Hit_ID=AAP30768.1; Match level="QueryCoverage =98%, HitCoverage=98%, E-value=7e-93, Identity=89%"; Hit description =putative gland protein G22C12 [Heterodera glycines]
MDXSFCSSIISIVAIVCLLCKCCFSAPHPCCPGSQHVVSMMKDHTPCCPGSQHVVSMMKDHTGTFSASMPKSSLCMSAERVAAAVENQLKTIWCPGNGSQTLINEINATQSSSDEECARSLGFVRAMFEIAASAASHAGANADLAVQFREQVGTIDSNCAALGIHVGQISLDAPKGDDHPQVHDSESVLSNPGTSGSHKRF

SEQ ID NO: 140705 - protein, 117 aa, Heterodera glycines
  Coding regions on vcDNA: vcDNA=SeqID_67128; Strand=-; Position=1 -56,102-399
MTFKMDTTTDSQKNRVLSRLMIRWTTFSTWSTELDILPLLDKKGQSEEEFFDFLYLNHPQISSNNSKRKISLLSYVFFKIFPNSNIFTMIRLIFIQSFCFSIYSICFFLFFFLATSF

SEQ ID NO: 140706 - protein, 52 aa, Heterodera glycines
  Coding regions on vcDNA: vcDNA=SeqID_67129; Strand=-; Position=1 -93,166-231
  Homolog annotation: Hit_ID=CAE62558.1; Match level="QueryCoverage =80%, HitCoverage=7%, E-value=1e-10, Identity=71%"; Hit description =Hypothetical protein CBG06668 [Caenorhabditis briggsae]
MRQYPTCMEFNERFLIFLFEHAYASEFGSFLGNNELEKKRLGVKVGFFEKIF

SEQ ID NO: 140707 - protein, 154 aa, Heterodera glycines
  Coding regions on vcDNA: vcDNA=SeqID_67130; Strand=-; Position=1 -78,137-180,235-406,604-740
  Homolog annotation: Hit_ID=NP_510539.1; Match level="QueryCoverage =99%, HitCoverage=30%, E-value=3e-30, Identity=44%"; Hit description =general substrate transporter family member (52.2 kD) (XP951) [Caenorhabditis elegans] emb|CAB60332.1| Hy
NMLALKFTLICMGSVRTNGTDLSGAEQHQHSVAYTPQQKNQLMWAVAVGSMLWAVAVGSMLGTFPFSWLYTRFGARFVLFGAGLASAIATALIPIATSFSFNLFLALRFFQGISFAADFAAMGMICSRWASLKQNALFISVLRCYSPLSTTITN

SEQ ID NO: 140708 - protein, 86 aa, Heterodera glycines
  Coding regions on vcDNA: vcDNA=SeqID_67131; Strand=+; Position=1 -103,148-305
MSKKRKQKQFAEELGIGEKTFYRWKKEFGIEMDKSGNAYSNVEKMSKMNIYYKMKKDNSSLSDTEIARSLKISLPTLSKWKKQKLS

SEQ ID NO: 140709 - protein, 143 aa, Heterodera glycines
  Coding regions on vcDNA: vcDNA=SeqID_67132; Strand=-; Position=1 -381,663-713
MGDSALADEDGNLHKGGKASATMLASVPLLSSDDELRNGPTLSAPPLPEGKENGGGGGMCILDTMKPKIHMMKQQQKQHRKMNINSNNNNNCYNNAVNGTLPQLAKGGIRYRMHSRSQSPSLFGSSKHENSFILNQKNVFSPL

SEQ ID NO: 140710 - protein, 222 aa, Heterodera glycines
  misc_feature (192)..(192): Xaa can be any naturally occurring amino acid
  Coding regions on vcDNA: vcDNA=SeqID_67133; Strand=-; Position=1 -127,197-318,767-874,1190-1504
  Homolog annotation: Hit_ID=CAE69224.1; Match level="QueryCoverage =97%, HitCoverage=96%, E-value=2e-58, Identity=48%"; Hit description =Hypothetical protein CBG15264 [Caenorhabditis briggsae]
LSTDALILTITLISPFDAQLVSMLGNATRAENCAEWTDWGPCVWVWLRGDDPRWQRSYFDQLLPGRSGCRNHMFFKLLRERWGQAVSNVMDYFRQLTTSTKQCGFCSFQHSCGRRCHRRSSSNPMNPLFVAERHCDGVDQSASCVSRTNGAVAADECQLWPNRQIALPNVSDWMASILRTVPFLNCVPQTAXVCIYTVCYCNAHIPHKGTLKCRIRSINTGH

SEQ ID NO: 140711 - protein, 395 aa, Heterodera glycines
  Coding regions on vcDNA: vcDNA=SeqID_67134; Strand=+; Position=1 -189,284-355,414-515,593-673,724-786,881-1006,1119-1200,1262 -1366,1430-1519,1588-1704
  Homolog annotation: Hit_ID=P23731; Match level="QueryCoverage=91%, HitCoverage=51%, E-value=1e-143, Identity=76%"; Hit description =Intermediate filament protein B (IF-B) pir||S06954 intermediate filament protein B - common roundworm
NQIADHRKGKTDKLTNIKILFNLSELEMLRARWKQLTDEEKRLLGDNARLWDDLTKARNDLDEETLGRIDFQNQVQTLMEELEFLRRVHEQEVKELQAFLRRVHEQEVKELQALLAQAPADTREFFKNELALAIRDIKDEYDYIAKQGRQDMESWYKLKVSEVQGNANRAVSEVQGNANRAQMESNYQREEVKRMRDNIGDLRGKLQDLEGRNSHLEKEVQNLNYQLNDDQRQYEQALNERDATLRRMKDECQSLVAELQALLDTKQMLDAEALLDTKQMLDAEIAIYRKMLEGEESRVGLRQMVEQVVKTHSLQQQEETDSTVVKTHSLQQQEETDSTRNVRGEVQTKTTFQRSARSAKGNITIAECEPSGKFVTLENTHRSKVSEKIRRGECR

SEQ ID NO: 140712 - protein, 96 aa, Heterodera glycines
  Coding regions on vcDNA: vcDNA=SeqID_67135; Strand=+; Position=1 -124,354-520
MDDAPIDPHRRVIRRNAAHLLHKKEAKYVLEKHGLLMHLGTPVCEWHLDLIKKGMAEQAESSRKGESHSINEGMAEQAESSRKDESHSIDNLFKLE

SEQ ID NO: 140713 - protein, 25 aa, Heterodera glycines
  Coding regions on vcDNA: vcDNA=SeqID_67136; Strand=-; Position=1 -61,536-552
MVTRIPIYFMMLIILIHQNSAHWDI

SEQ ID NO: 140714 - protein, 28 aa, Heterodera glycines
  Coding regions on vcDNA: vcDNA=SeqID_67137; Strand=+; Position=1 -64,270-292
MTNFGLAIFVVSMLTMPFSDEDYKSKIN

SEQ ID NO: 140715 - protein, 146 aa, Heterodera glycines
  misc_feature (21)..(21): Xaa can be any naturally occurring amino acid
  misc_feature (54)..(54): Xaa can be any naturally occurring amino acid
  Coding regions on vcDNA: vcDNA=SeqID_67138; Strand=-; Position=1-447
  Homolog annotation: Hit_ID=NP_671477.1; Match level="QueryCoverage =91%, HitCoverage=46%, E-value=2e-26, Identity=56%"; Hit description =rRNA promoter binding protein [Rattus norvegicus] gb|AAK21974.1| rRNA promoter binding protein [Rattus no
HATARLTRPLEPILFPKLRIXFADFPYLHYSRLEAVHLGDLLRISVRSGRRFKXLPSHFQGPCGAHETPQEPWCFTGATSLSQAEPLPGTHTLNEKRTLARTPHDVCEFICVTAQNSSCEPSFLAWRGNEPTSLSATGWTNCASTE

SEQ ID NO: 140716 - protein, 57 aa, Heterodera glycines
  Coding regions on vcDNA: vcDNA=SeqID_67139; Strand=+; Position=1 -161,383-395
MTQHLLKCEIESETHPLLIPIEQYAKKSFFSWGPDNPSVKDNPSVMDSPSVDNPDLN

SEQ ID NO: 140717 - protein, 177 aa, Heterodera glycines
  Coding regions on vcDNA: vcDNA=SeqID_67140; Strand=+; Position=1 -88,264-709
  Homolog annotation: Hit_ID=XP_346518.1; Match level="QueryCoverage =78%, HitCoverage=11%, E-value=9e-13, Identity=34%"; Hit description =hypothetical protein XP_346517 [Rattus norvegicus]
MHFEVIRDLCENIHKTDEMVQQKFAKIIKGLTESKECRQNLNSFLKKEQIKKIFEVIGIPFEEKDFENPEQKMEFSSDQSEEKGKETQKKGRKNRRDKNGQKTQNKNEEKWESEKESGEKWTKNEEEKMPKEEKESQKVPKEEKESQKVPIGEEKSEPVPEEEEEELPNTKGEFKGL

SEQ ID NO: 140718 - protein, 135 aa, Heterodera glycines
  Coding regions on vcDNA: vcDNA=SeqID_67141; Strand=+; Position=1 -22,92-222,508-726,1314-1349
MTKQIEIEQILFDRMMAKEAGKELANCLSPSFAKATQQLISDELDQQNSQKSNHQAKLLISGSFLLGLNTTDSDIDLICVVPGKAIEKEHFFGEPNEICVERECEKGGRQKDTLAQSFYCQLCGPISFTPTNLAF

SEQ ID NO: 140719 - protein, 28 aa, Heterodera glycines
  Coding regions on vcDNA: vcDNA=SeqID_67142; Strand=+; Position=1-84
SWHNCVHPGPISGPISPPTVAVEVAGTE

SEQ ID NO: 140720 - protein, 91 aa, Heterodera glycines; identical to SEQ ID NO: 135535
  Coding regions on vcDNA: vcDNA=SeqID_67143; Strand=+; Position=1 -63,109-321

SEQ ID NO: 140721 - protein, 286 aa, Heterodera glycines
  Coding regions on vcDNA: vcDNA=SeqID_67144; Strand=-; Position=1 -96,139-312,360-717,781-869,1115-1255
  Homolog annotation: Hit_ID=NP_506393.1; Match level="QueryCoverage =97%, HitCoverage=84%, E-value=1e-37, Identity=36%"; Hit description =zinc transporter ZIP (40.5 kD) (5O194) [Caenorhabditis elegans] emb|CAB03256.1| Hypothetical protein T01D
MMDEPILAVISLTMFIGSYLAGFIPLFFSLNERKVRIASIFGAGLLVGTAFCVIIPEGISSLAAASFVQTNDREIGKMSPEKTEDAASNLEKERKTNEKMHRRNIRQNWDENEQRKGAIGQGKTARDRRKKDAKAEKVPTADEPHNGGEEGGQWHEEGTRRTDFERLNGPIGVSLLVGFLFMHVIDQLSKLSHSRQKGMPTLGLVIHAFADGIAMGSASSAGSQLELQILVFVAIMLHKIQSSSSDDSLSGVHEETTPSQFTGIVLLFSAGTFLYIATVHVLPELV

SEQ ID NO: 140722 - protein, 79 aa, Heterodera glycines
  Coding regions on vcDNA: vcDNA=SeqID_67145; Strand=+; Position=1 -138,1238-1339
MYNTDSESPSDFAASTRRIEQFLFDDATAKHFQPIVIEKDFQFVGWTHASQSIHKASLAKKKFNSLEMDAATHSNSWPQ

SEQ ID NO: 140723 - protein, 55 aa, Heterodera glycines
  Coding regions on vcDNA: vcDNA=SeqID_67146; Strand=+; Position=1 -57,200-308
MRVISQNHKMIRRKFWKTVVLLNFRQNYWDAEACHEDLEISGDNSLTVYRKRTNL

SEQ ID NO: 140724 - protein, 254 aa, Heterodera glycines
  Coding regions on vcDNA: vcDNA=SeqID_67147; Strand=-; Position=1 -172,222-812
MKLITLLLFINVLQFSVGTDNQKGPRIIYLQEPTVHQISPSQFRNFVIENTTDPEWKATKNANEASSSSINIPINIDSDSDDDDYDGLDRRDALRTGGPLLLDFFTGKAYQQNLSRQNLGEYSKSNLLDLSNQPNNSNQMILPAVRNQPSNSDQTKQRSINDDSNMLMRVNPANNLPEVIASVTNSQQLTDQNNHPLTENPTDQSVRSNQNNQHEIQEILHLPMKNQQNNKRAAAPNSRQEYGFDLEKVPKAKK

SEQ ID NO: 140725 - protein, 149 aa, Heterodera glycines
  Coding regions on vcDNA: vcDNA=SeqID_67148; Strand=-; Position=1 -89,250-426,473-634
  Homolog annotation: Hit_ID=NP_496336.1; Match level="QueryCoverage =99%, HitCoverage=50%, E-value=9e-36, Identity=50%"; Hit description =CAP-z protein, F-actin capping protein, beta subunit (30.8 kD) (cap -2) [Caenorhabditis elegans] emb|CAA87
LKKETDNSLSGQGVKCWDSIHVLEVNEAAKFAKYKLTSTVMLWLQTQKTTTGTIDLGGSLTRQSEQDCAVNEQNPHLANIGKMIEDQESKMRATLDQESKMRATLNEVYFGKARQIVGDLRSVESTAELKSRGELGGRILIIRINHGHC

SEQ ID NO: 140726 - protein, 157 aa, Heterodera glycines
  Coding regions on vcDNA: vcDNA=SeqID_67149; Strand=-; Position=1 -396,745-822
MKPFMSKKSTLVLIIVVLLLIIGVALAIALLVTASAEKETSKSPLDVLDPTPFGTVRCKGCTSTTSTASSTSTTPAPTTTTTAKPNEEHRSEAIPDSTSLFKLALALAAAIFYALLSRQPSKDYWLQPTAKETLIRFGVQSTTFPIPHCVEKDKFYQ

SEQ ID NO: 140727 - protein, 96 aa, Heterodera glycines
  Coding regions on vcDNA: vcDNA=SeqID_67150; Strand=-; Position=1 -75,438-569,853-934
MTKNSAPTPVPPMGQQQLQNYTDPKQKQPRKRSSPGSLSTSSSSSIIAITSTSPTAVPDSVSPPFRPLETTGPTNSKATKLHNAEEMLCKADNEQR

SEQ ID NO: 140728 - protein, 38 aa, Heterodera glycines
  Coding regions on vcDNA: vcDNA=SeqID_67151; Strand=+; Position=1 -88,443-471
MPGNLLLQFGCFAFVRQLHWFAVLVGSCAVSIILAYCY

SEQ ID NO: 140729 - protein, 94 aa, Heterodera glycines
  Coding regions on vcDNA: vcDNA=SeqID_67152; Strand=-; Position=1 -6,290-428,475-614
  Homolog annotation: Hit_ID=NP_500734.1; Match level="QueryCoverage =97%, HitCoverage=4%, E-value=9e-09, Identity=31%"; Hit description =LAMinin related (lam-1) [Caenorhabditis elegans] pir||T15099 hypothetical protein W03F8.5 - Caenorhabditis
MKSTYDKVLALLEEKEGGNEERKQRAEELRKRTTELLAKIKRSREEKISLIERADSLDVELNNFHTSIEELSDQIDQVTSEIDRRVEFHATCDA

SEQ ID NO: 140730 - protein, 188 aa, Heterodera glycines
  Coding regions on vcDNA: vcDNA=SeqID_67153; Strand=-; Position=1 -86,307-420,510-662,743-811,1189-1331
  Homolog annotation: Hit_ID=NP_500734.1; Match level="QueryCoverage =99%, HitCoverage=49%, E-value=1e-80, Identity=34%"; Hit description =LAMinin related (lam-1) [Caenorhabditis elegans] pir||T15099 hypothetical protein W03F8.5 - Caenorhabditi
ACDKQSGQCECRERGITGRQCNQCQPGFWNFPECRTCQCNGHASICDQRTGACIDCRNLTDGTHCERCVDGYYGDPRLGINLPCKPCPCPGGPGSGFQHADSCYLTPPPSPTVTCNCRSGYAGERCDQCAVNYWGNPREIGCVCNNLGTNSSAGSCDRVSGQCPCFANVVGPQCDQCAPLHYDLASGK

SEQ ID NO: 140731 - protein, 52 aa, Heterodera glycines
  Coding regions on vcDNA: vcDNA=SeqID_67154; Strand=-; Position=1 -106,723-775
MVALIGDNVPFFTRKRHVLVKESAIVRPACIPSMAHGVCSSDSSCAGYPLAL

SEQ ID NO: 140732 - protein, 264 aa, Heterodera glycines
  misc_feature (65)..(65): Xaa can be any naturally occurring amino acid
  Coding regions on vcDNA: vcDNA=SeqID_67155; Strand=+; Position=1 -32,332-505,573-743,784-905,950-1014,1069-1124
  Homolog annotation: Hit_ID=NP_496415.1; Match level="QueryCoverage =90%, HitCoverage=67%, E-value=5e-68, Identity=57%"; Hit description =adenovirus interacting protein 1 (35.8 kD) (2L593) [Caenorhabditis elegans] emb|CAA90136.1| Hypothetical
PNSNKNRNFEVLIYVFDVESREVQKDYRNYQSCLEALMQNSPMAKVFCLVHKMDLIQEEMRDKVXKAAATALRQATALRQHANPIIQCFRSSIWDETLYNAWSAIVYQLVPNVSSMEHKLKKFADIMDADEILLFEKATFLVIAQAILLFEKATFLVIAQAQRAKHEDIHRFEKVSNIIKQFKLSCSRMGSQFESIEIRNSTFAAFRMGSQFESIEIRNSTFAAFIESFTYNTYVMLVLSDGNISSFTYNTYVMLVLSDGNISS

SEQ ID NO: 140733 - protein, 18 aa, Heterodera glycines
  Coding regions on vcDNA: vcDNA=SeqID_67156; Strand=+; Position=1-56
YREAIPEGFGLPINLGAS

SEQ ID NO: 140734 - protein, 61 aa, Heterodera glycines
  Coding regions on vcDNA: vcDNA=SeqID_67157; Strand=+; Position=1 -146,552-591
MAFQQMGHALNDADIKAIYKRVDKNQDGKINFKGMFLKKKSNQIISELNGNGKSQRHPFNN

SEQ ID NO: 140735 - protein, 93 aa, Heterodera glycines
  Coding regions on vcDNA: vcDNA=SeqID_67158; Strand=-; Position=1-722
MFEYPKRTLEKIDFFVFGAVPPNRCAQIYGETESFGNSFPIVCTLILRWIFAPHKCLSTPNGHLKKSIFLFSGQSPRTDATRFMGRPNPSGIA

SEQ ID NO: 140736 - protein, 58 aa, Heterodera glycines
  Coding regions on vcDNA: vcDNA=SeqID_67159; Strand=-; Position=1 -85,446-534
CFWPSLLCSSTPSAGGSLSPRLTTFMATLRLDWSASVMSGILIAVFNAAYMTSDPICG

SEQ ID NO: 140737 - protein, 118 aa, Heterodera glycines; identical to SEQ ID NO: 127138
  Coding regions on vcDNA: vcDNA=SeqID_67160; Strand=-; Position=1 -144,210-308,505-618
  Homolog annotation: Hit_ID=CAE62877.1; Match level="QueryCoverage =97%, HitCoverage=17%, E-value=5e-13, Identity=37%"; Hit description =Hypothetical protein CBG07063 [Caenorhabditis briggsae]

SEQ ID NO: 140738 - protein, 82 aa, Heterodera glycines
  Coding regions on vcDNA: vcDNA=SeqID_67161; Strand=+; Position=1 -111,234-368
MRAALAFYDRTVRHRFADGSSGGEAQREELKLCLNVLSLVSTLESADAEREAKWERLKQFLRVCGTAAIFAVLAFLFTLYWP

SEQ ID NO: 140739 - protein, 27 aa, Heterodera glycines
  Coding regions on vcDNA: vcDNA=SeqID_67162; Strand=+; Position=1-83
MAQFVLKLQIRERVDDTEAVFMDIEEA

SEQ ID NO: 140740 - protein, 229 aa, Heterodera glycines
  Coding regions on vcDNA: vcDNA=SeqID_67163; Strand=+; Position=1 -375,631-942
MGYAYRFRNIYSNLMVHNFPYYIIFSTISPVSNELLFEVFYEEEAKLDSQSANCVRERKFCGTAIQSLAELRQAVQQQRRTIELQLQGRPYMEEKQQQQRNRKPSQQQLQQQQHQQEMYGVLVIKASLSNCHGTNRALVKQHSTEFVGTLENGHHYHQPTQPTKSCSPFAYPGDNQQHHPPPLSPSIKKYSTTGSESSSTIKRSLTRQKQHYIYNVTDDEGHSPSYDRQ

SEQ ID NO: 140741 - protein, 225 aa, Heterodera glycines
  Coding regions on vcDNA: vcDNA=SeqID_67164; Strand=+; Position=1 -324,456-537,582-853
ELIENKRYLTSKSYTEDYVEKRQNTNSMALKRNFNEKMPNGRGGRMKDKMPMEMNSPRPRRRNGTGSHRGETSQNLGEKFRHESRADQTNGGQNAKMERSASQNRQRQRTEMGRQKSLRKKDEMDKLWQELQDDEERSKRPPSLNEKQFDKLWEDFNDKDKEEALAVEKNAKSGKKHRKSAEKKRQNAEASRSSNEGKMGAMKVNGESAKKGKSGGAKTKQSHSS

SEQ ID NO: 140742 - protein, 369 aa, Heterodera glycines
  Coding regions on vcDNA: vcDNA=SeqID_67165; Strand=-; Position=1 -95,147-197,588-666,1486-1621,1843-2013,2311-2422,2488-2521,2841 -3008,3485-3745
  Homolog annotation: Hit_ID=CAA33463.1; Match level="QueryCoverage =75%, HitCoverage=65%, E-value=2e-27, Identity=53%"; Hit description =twitchin [Caenorhabditis elegans]
LYKCKECTDAFARPLYLASHSRNHGYNGRYKCQHCNYGCDLKDTFDKHRACHVNVTPIRIDFDDEVFAGSPDPDEPKAAEPPTEVPQERWVDPLPEKLQFQQQENKFAELKCKYSRANAKVRWYKGRKELFSDGLKYKILIDKQSITLIINNPDPDDSGKYKCEANGVPTNSFVTVEDSPDQQPLSSTARRSESRRPKSARKEAAALTLLDAMQCSHLTPPRPKNMERTASSSGRRRVGSTAADRSAKAAAAACAAGEEATDEVEVADSEEEQQLLDMTTVEVRCADERLLAKASLNVPVRPGPPKPLYTTDKSIMLQWTRPLRDRGTPITDYELEIRERGTKLWGKATTNAELWEKDAFGNVPDTRIK

SEQ ID NO: 140743 - protein, 63 aa, Heterodera glycines
  Coding regions on vcDNA: vcDNA=SeqID_67166; Strand=-; Position=1 -32,425-584
MSLMIVFYVKKAPLQRQDHSSVEMWLDKFERTQGDLLIMKSDEFRDKTLKEISDVRFLKNIIS

SEQ ID NO: 140744 - protein, 42 aa, Heterodera glycines
  Coding regions on vcDNA: vcDNA=SeqID_67167; Strand=-; Position=1 -76,585-637
MTMLFLFLITLSPFLLISQWLLLAKLIFISKYAILLKTFSIF

SEQ ID NO: 140745 - protein, 33 aa, Heterodera glycines
  Coding regions on vcDNA: vcDNA=SeqID_67168; Strand=+; Position=1-103
VRLGYSNHYGSKNPTQIKVQAIGKLLPKDSVSP

SEQ ID NO: 140746 - protein, 27 aa, Heterodera glycines
  Coding regions on vcDNA: vcDNA=SeqID_67169; Strand=-; Position=1 -47,106-142
MSDNGKEAKKEMAKAICQPNQMDFDFT

SEQ ID NO: 140747 - protein, 466 aa, Heterodera glycines
  Coding regions on vcDNA: vcDNA=SeqID_67170; Strand=-; Position=1 -81,154-272,327-419,467-564,614-767,859-927,975-1022,1076-1297,1348 -1425,1526-1642,1703-1727
  Homolog annotation: Hit_ID=CAE73140.1; Match level="QueryCoverage =97%, HitCoverage=71%, E-value=1e-128, Identity=54%"; Hit description= Hypothetical protein CBG20528 [Caenorhabditis briggsae]
ELAFEKAIASDPYCRSVAETLNLEDFAIESDYIESDYSGPHLDGEISVEFMEEMIATFKDQRKLHTQYAYKILLAIRKYILLAIRKYLIELPSLVDISVPDKQKFTICGDVHGQFYDLCNIFELNGFPSESNCGDVHGQFYDLCNIFELNGFPSESNPYLFNGDFVDRGSFSVETIFTLFGSFSVETIFTLFGFKLLFPNHFFMSRGNHESDVMNKMYGFEGEVKSKYTAKMAELFTEIFNFLPLCHVINSKIFVCHGGLFKEDGVVCHGGLFKEDGVTLEKIRKTNRNRQPPEDGIMCDLIRKTNRNRQPPEDGIMCDLLVNALFPTFYAVIFRSDPQELSGYSPSKRGVGIQFGPDVTERFLKDNDLLYVVRSHEVKPEGYESHSHEVKPEGYESHHEGKCWTIFSAPNYCDTIGNKGAFITFTGDQLSPKVHSFEAVPHPTVRAMQYASSMFSFLASSMFSFL

SEQ ID NO: 140748 - protein, 386 aa, Heterodera glycines
  Coding regions on vcDNA: vcDNA=SeqID_67171; Strand=-; Position=1 -48,96-221,680-913,1468-1592,2228-2260,2308-2367,2411-2447,2744 -2976,3030-3291
MAEECVASQQFSKALQILHRLCIEDTSVLFYPFLREALVSFANAAFCSLSLNEWTWALLNSFQSQWRQLVAQSSSPLQFQLEMSNLNYSPIKFNARFLVINSSANNKRQTNEKFAFDEEIADGFQIATADDSLLIEVRHFSLRTSSGSLSWDIDHRSTSNRHHQNSIEEMDKNNYAVKSSLHCLRLNNRLTSPFGFNPNLTIAFPFAFKFVVPFLQNQKMKNDAFEHFDAIPLDSLIKQHFEKLKISSVDSSEFLNTHSVWVKVTNGDGQSPMRETGQSNGGDDEHQTQLGDVVVEWSSTLSFEHVRSVLALPTMPPILVIPMTLNVELANENDGEETNEAISGCCFRILKPFRIRYYLRNTSGGPLAVHLNFEQSAGTSIDGILE

SEQ ID NO: 140749 - protein, 1131 aa, Heterodera glycines
  misc_feature (252)..(252): Xaa can be any naturally occurring amino acid
  Coding regions on vcDNA: vcDNA=SeqID_67172; Strand=+; Position=1 -308,351-696,1062-3784,4522-4543
  Homolog annotation: Hit_ID=NP_491240.1; Match level="QueryCoverage =99%, HitCoverage=87%, E-value=0.0, Identity=36%"; Hit description=zn- finger, CCHC type and RNA-directed DNA polymerase  and Integrase, catalytic domain containing protein fa
LKEEHKVMLLTALKSPKDLETKNFVKLGEGDNVKYDEIVQDCVNFMTTISEVKLISSAANRSINAVKPKWHKTEKGGRPNNKQGQSSSAPAQQCWRCAKCQKCSQNGHYATRCKCQKCSQNGHYATRCRNGDGETNCQFQKGKLEIYIGTAMKVNSASLFKTDVAADGKDIKFVLDSGAEIIVIDELSHEVIGSPRLRKCTESGCMFDGTQVKFVGKGVANFKLAGTIFSALTWVIERRTNKIVFSNFRLCXMKRKNLAKTLEIFSICLRRASRVHSRQQNIFENNAESENNDFVGYLSENSEMRKSQKRSIGTADSFAKKFRRQALSPRDIGLTILFIFKFNSRLCIDYSTGLNNALQDHQHPLPLPEDIFATLKGKYFSQIDLRDAYLQIELDDESRKICSISTHRGNYEVKRLPFGVKSAPAIFQSVMDQILAEFEFATAYLDDVIIVSKSVKEHADHLKNVLEKFQEWGFRIKLEKCSFFREEIKYLGQIIDRNGRRPDPEKISAISEMPAPTDVPSLRSYLGMVNHYQQFVKNMRFVRKPLDDLLKQDSEWKWSEKCKQAFDKIKEILSSDLLLTHYDPTKEIVVAADASELGIGAVISHKFPDGTIKAIAHASSALTPAEKNYSQIEKEGLALIFAVQKFHKMIYGRKFTLQTDHKPLLAIFGSKKGVRQCSANRLLRWSLIILAYDFSIEYISTNDFGQADVLSRLIAKGKSDEDRLIASLRSDSKIDYILIGSIEAVPIKFKEIVAAAEADKTIQKVKKFLTNGWPRNVGDESAEIKLFHRIKEQLCITRNCLMYADRVVIPEKLRQKTLHSFHKGHPGIKRMKQLARNYAYWPNMDADIQQMVENCQPCQMEAKAPVKSNLQPWPKPSLPWQRVHIDYAGPFFGKEYLIIVDAFSKYPEVFEMATKSTAATIEKLRYLFSRHGIPEILVSDNGTQFTSNEFAKFMAVNGVNHLFSAPYNPMSNGQAERFVDTFKRTFRKLKGEGAPSKEIIETFLVSYRTTPNDSLPNSKTPAEMFLGRKPRTTLDLLRPPPSPIDRDVEMARRFNKRFGTKLREFPIGNKVFARHRISQNWQQGQVSKRTGVIYDVAFADGRSGRYHANQLRPRKTSDSDDQISMNEFGSF

SEQ ID NO: 140750 - protein, 74 aa, Heterodera glycines
  Coding regions on vcDNA: vcDNA=SeqID_67173; Strand=-; Position=1 -206,242-260
MDGPIAFTDNYPNNEQTVIEPNDKLKFHCPECHYEMCRKYNAKWVEEHKILTCEQFAKQQNEQIQRNLKFWLCR

SEQ ID NO: 140751 - protein, 231 aa, Heterodera glycines
  Coding regions on vcDNA: vcDNA=SeqID_67174; Strand=+; Position=1 -151,247-349,502-677,723-911
  Homolog annotation: Hit_ID=AAD27589.1; Match level="QueryCoverage =96%, HitCoverage=32%, E-value=7e-88, Identity=76%"; Hit description =chaperonine protein HSP60 [Onchocerca volvulus]
MAIFNLFILGKTLVIEQSWGSPKITIDGVTVAKAIDFKDKFQNMGAKLVQDVANKTNEEAGDGTTCATVLARAIAKEGFENISKGANPVEVRKGLMNAVDELVKELKAMSKTVTTPEEIAQVATIAANGDKTIGKLISDAMKKVGNKGVITVKDGKTLLDELELAMKKVGNKGVITVKDGKTLLDELELIEGMKFDRGYISPYFINSAKGAKVEFEKCLILFSEKKISQIQ

SEQ ID NO: 140752 - protein, 180 aa, Heterodera glycines
  Coding regions on vcDNA: vcDNA=SeqID_67175; Strand=+; Position=1 -201,432-670,1121-1223
DSLYQQVADQKYKGLTFPGFGEIFKRTRFFLINSQPDLDFNQFDIVNDVEKVKFIGGFNLKPIPNAEFKYPYNLDSKKGVVLVSFGTVVNTTMVQSSTIIEAIAETIKKFPNFLFIWKLSQGHPNKTFVGLKNVITELWVDQKNIFGKSKNGGICVLLWDEQCVGGHLQWCADGLCAILW

SEQ ID NO: 140753 - protein, 344 aa, Heterodera glycines
  Coding regions on vcDNA: vcDNA=SeqID_67176; Strand=-; Position=1-1033
MKESVGQMIMKEMKNEGEKCEEETNTDLGPSVMDVVESDQRSQGVNYVLEVDQDGIEVFTEKNPLGKRHRNLSEDENGKDIENEGDDEGSGRKMVICQITDKMVIAIRFGGKMKGPDIIGIPESFELGAQLRLGDIVFVTSYAPIERFSVWLSNAFRINADAEAMTVSSVLQNSLEKCIGIVMSMVKEQKDVPKAVDVAFPESQVLQRLYQHQLDSTIDLAKIKPGVLINVTFVRIHRPSDIAIGPKGIYITPADFEGVSERELVVHQPCIGTGISGLVIGYEFPFSTSTDLKLCEHGIAAAVSGALLKAKAEMEEFTIHTALFVLESGKDNIVVTFEHFVQEK

SEQ ID NO: 140754 - protein, 93 aa, Heterodera glycines
  Coding regions on vcDNA: vcDNA=SeqID_67177; Strand=-; Position=1 -135,192-336
  Homolog annotation: Hit_ID=CAB88204.1; Match level="QueryCoverage =93%, HitCoverage=28%, E-value=2e-21, Identity=57%"; Hit description =putative cuticular collagen [Globodera pallida]
MGEAKFLIGFASLCSIGAIIATVVMMQTLNIQINEVKMRVFDGVQAFRLNTDTAWTELMEVQISVTPPSRARENPTKNDIFLRQKRQDYNAMP

SEQ ID NO: 140755 - protein, 217 aa, Heterodera glycines
  Coding regions on vcDNA: vcDNA=SeqID_67178; Strand=-; Position=1 -231,434-511,859-1141,1222-1282
MDEPRVIGRTDDEEEVMIIRDEDLQGRMDQFHEKTGESDESDEEKPTGTMAPVPAPRRSLLGPIPPITTTGGKQLKKPAKCPQALQMTSLLAVNGHQLHQKPTIRPAVPESDWNSESGLEGSSVDLVQPKSANVRIRIGRLQFLDHSASLHFSHFEEGGRVFVEWNFLDFSREQCVTRNDAEMPQLLTESFDLDHQSDYELNQNQIALLTQWTQLNI

SEQ ID NO: 140756 - protein, 80 aa, Heterodera glycines
  Coding regions on vcDNA: vcDNA=SeqID_67179; Strand=-; Position=1 -16,153-250,291-419
MSPKAHESVISEASIDVSIYWKFAYAFDGFENLKVEEKVPLRTFAQLTEQNGPKENGQRKTQRIAGENAKKEEAINKIMK

SEQ ID NO: 140757 - protein, 151 aa, Heterodera glycines
  Coding regions on vcDNA: vcDNA=SeqID_67180; Strand=-; Position=1 -228,1342-1569
MPTKIKRLNGRMSGRNSQRNTVPNGPKKDELDELHRANQLMAQKALTDDIGTLLFLGPFLTLTILNNKNMFPDVSRRLSALRTEFDRVARELSQAQRELRSQSDSLNSEREDAQRRADGSARSAEIVDRELAIAREECRALRNAHERLVEK

SEQ ID NO: 140758 - protein, 136 aa, Heterodera glycines
  Coding regions on vcDNA: vcDNA=SeqID_67181; Strand=+; Position=1-500
ALPQAKGLRALMSRVFSNASTLVPRQGVPIHELIGLVNHGNTPLTRIPTPPPTLGSASPVLSSPQHLCLRPHLHKSINSPNFFNTQTSCMFYSFRQLPIAGETEATTKVAPQQQPSPFNAEHKRKQALEPRRPRSP

SEQ ID NO: 140759 - protein, 35 aa, Heterodera glycines
  Coding regions on vcDNA: vcDNA=SeqID_67182; Strand=-; Position=1 -97,156-166
MGAPTIRQPSQNVTIRQLSQIRISRDANSYSAIFM

SEQ ID NO: 140760 - protein, 75 aa, Heterodera glycines
  Coding regions on vcDNA: vcDNA=SeqID_67183; Strand=-; Position=1-225
MSREFSLLQPELFDSREEYELFMAIRGGQRTADLGRRIQRMRDGLPPPSLFEKDRDLWTVLDEEEIMYKERMTLE

SEQ ID NO: 140761 - protein, 45 aa, Heterodera glycines
  Coding regions on vcDNA: vcDNA=SeqID_67184; Strand=-; Position=1 -105,180-212
  Homolog annotation: Hit_ID=NP_722629.1; Match level="QueryCoverage =93%, HitCoverage=10%, E-value=3e-09, Identity=61%"; Hit description =CG3935-PA [Drosophila melanogaster] gb|AAF51505.1| CG3935-PA [Drosophila melanogaster] gb|AAM52023.1| RE6
MSGQMEMVFSCSHYPDMLQRDELALKTGLDEDRILIWFQNRRAKW

SEQ ID NO: 140762 - protein, 86 aa, Heterodera glycines
  Coding regions on vcDNA: vcDNA=SeqID_67185; Strand=-; Position=1 -86,342-516
MYYHIYIIFYIFRRLGTFSYIIRNFGVILDRYFEKSLDLDLDSILDLDLDKNPGKSRSRKNPGSSRPGSRPGPGFFEICFKRQTNA

SEQ ID NO: 140763 - protein, 123 aa, Heterodera glycines
  Coding regions on vcDNA: vcDNA=SeqID_67186; Strand=+; Position=1-369
MAKPMELRQLQHHTTPMAEDQEELDMTSTNPMPTTTMTKTTTIEMEEVEDEEGGGEAQEEEEEVKEQGEREGDGEEGTENITPGTETETERETETDGEREREDGKGKGDTGGAAAEQSAEWAE

SEQ ID NO: 140764 - protein, 482 aa, Heterodera glycines
  Coding regions on vcDNA: vcDNA=SeqID_67187; Strand=+; Position=1-1449
  Homolog annotation: Hit_ID=NP_498959.1; Match level="QueryCoverage =67%, HitCoverage=14%, E-value=1e-42, Identity=32%"; Hit description =zn-finger, CCHC type and RNA-directed DNA polymerase  and Integrase, catalytic domain containing protein
MYGECIRAALRCRVCAHARKPRSNEPPLNIVETKEPLELVCIDILSIGPAASSNRYILVAVDHFSKYLVACAIPNKNAETIAKNVVKNFICVLGTPKKLHSDKGTEFVNETLEEISKTLKIERTTTSGYDPQANGVTERVNQTILGMLRKSTYSAWEWDERLPFVVFAYNSTPSEVTGISPHHLMFGKPANFPLEHELKFAVNPLYTIDQNTYIQLFRESLMQLVDEARKNSQISRAKMKEHFDAQAKVTENKFQIGDRVMVIFPGSHIRSPHKKILWNHFGPFRITELNKSTATVIPSDNPYGNPMTVPLERLVRVPKELPNICTMPKGKNPYKNVLNGLISVAGLICQENLKFDGEEKLNSKPDGIIGQLRSIAFLGGEEEQMETEQMDDKEAKTNESENEENVEEKTDDNEVDANRSEKEANLEEEDQISVRKKRSRKRFLGHWHVQETGTNAVPMWSWPTWMPSLTDQALGSRRSRIR

SEQ ID NO: 140765 - protein, 265 aa, Heterodera glycines
  Coding regions on vcDNA: vcDNA=SeqID_67188; Strand=+; Position=1-795
  Homolog annotation: Hit_ID=NP_836672.1; Match level="QueryCoverage =99%, HitCoverage=38%, E-value=1e-141, Identity=96%"; Hit description= DNA helicase IV [Shigella flexneri 2a str. 2457T] ref|NP_706885.2| DNA helicase IV [Shigella flexneri 2a
MSEIASGVLRQQLDLIATRTGENKWLTREQTSGVQQQIRQALSALPLPVNRLEEFDNCREAWRKCQAWLKDIESARLQHNQAYTEAMLTEYADFFRQVESSPLNPAQARAVVNGEHSLLVLAGAGSGKTSVLVARAGWLLARGEASPEQILLLAFGRKAAEEMDERIRERLHTEDITARTFHALALHIIQQGSKKVPIVSKLENDTAARHELFIAEWRKQCSEKKAQAKGWRQWLTEEIAVVSARRYFWDDEKLQRRLASRLDAC

SEQ ID NO: 140766 - protein, 56 aa, Heterodera glycines
  Coding regions on vcDNA: vcDNA=SeqID_67189; Strand=-; Position=1 -9,380-541
MWTCRPERQAEVVPAHQSERPRRRIQGLLVPVFAARPMQQDGGARQIQVFYSERQT

SEQ ID NO: 140767 - protein, 88 aa, Heterodera glycines
  Coding regions on vcDNA: vcDNA=SeqID_67190; Strand=+; Position=1-267
MPRPMSSGITEEEDDEEEEDVLLVPEAEEAAAMPRPLSGDMDRYCWWEEPTALFPPAPFPPPLLLLVLLPPPLLLLCWAMLPVGQLAM

SEQ ID NO: 140768 - protein, 40 aa, Heterodera glycines
  Coding regions on vcDNA: vcDNA=SeqID_67191; Strand=+; Position=1 -15,96-203
MLNGISSSTRVSHEIVLDDDGVDCPSVVRDELPAKKQKRI

SEQ ID NO: 140769 - protein, 122 aa, Heterodera glycines
  Coding regions on vcDNA: vcDNA=SeqID_67192; Strand=+; Position=1 -160,265-473
MASTHEKRTDSRLVFVPFVTFADPLFWNEINRLKVDHWKLDESLKPIYATTTFQGAQPSDGLLSFDQFSIAAESGQTLPLQSVQPFVSPFHGTFLLLNTKKAFSDGFDRKKFLEQSADSVIY

SEQ ID NO: 140770 - protein, 324 aa, Heterodera glycines
  Coding regions on vcDNA: vcDNA=SeqID_67193; Strand=+; Position=1 -97,150-206,265-1082
  Homolog annotation: Hit_ID=AAF73774.1; Match level="QueryCoverage =64%, HitCoverage=71%, E-value=2e-23, Identity=23%"; Hit description =surface protein PspC [Streptococcus pneumoniae]
MPVSPVLNQQKGAPNANEIAGRGNAKGENSVRVNRSVQSNGDEGMEMVGMAEIRYEQKQQVAGGGLCCCCIPCCFFNESSHEEPPKIFKFFMTKKKTPQQPPAEVVQPQNSVPSPKTSTNQQPPAEVVQPQNSVPSPKTSTKQQPPAEVVQPQNSVPSPKTSTKQQPPAEVVQPQNSVPSPKTSTKQQPPAEVVQPQNSVPSPKTSTNQQPPAEVVQPQNSVPSPKTSTKQQPPAEVVQPQNSVPSPKTSTKQQPPAEVVQPQNSVPSPKTSTNQQPPAEVVQPQNSVPSPKTSTKQLPPVSVHQLRSVHRQRPFLSKLHTPRD

SEQ ID NO: 140771 - protein, 80 aa, Heterodera glycines
  Coding regions on vcDNA: vcDNA=SeqID_67194; Strand=+; Position=1 -175,552-619
MDLILATDWINNAYPEMDLQDANKENKEPTKKQEEEAEDPSWISLIDEEMKREPLAPIGPDALLHKAWHPLAPPQLAVRR

SEQ ID NO: 140772 - protein, 322 aa, Heterodera glycines
  Coding regions on vcDNA: vcDNA=SeqID_67195; Strand=-; Position=1 -56,375-989,1037-1334
MPNSTRPCSSAMWSLTFLRGKLAQRVGRTEIRYTRTPAEFHELLEDPSLDKLDFVHVSEHMDRCVVRKRPEFAKAPLTNCLPVASFVTSYARLHLYDYIEQVLAIDGAELLYCGMLFFHKTFGVHAYALDTDSIYYVNKMGGPCVAEGEALGQMKREHTDRRIVEFVAGGPKNYGIRHTARDGTDERANLKIRSFRLSYAAQQLLNFEAMKELTLATYNIDGPIDDVLDNDDLYVFGGGEHRAIRVNFPHIDRNAYADLYTHEAHKDYRPFYAKGRVRPGMQTRPFGYVEDDGPPNDGQRTERRKRNFVDHDPAQPGHSGWF

SEQ ID NO: 140773 - protein, 86 aa, Heterodera glycines
  Coding regions on vcDNA: vcDNA=SeqID_67196; Strand=-; Position=1 -211,684-733
MASAFLFGWWWRGNVARLDDVHPTSVVVSIDLHPLGTVLDLAAQIIIINLMVLGHFLNYGTNGRFLNRPRAKKSPCIRLLSSPTHQ

SEQ ID NO: 140774 - protein, 188 aa, Heterodera glycines
  Coding regions on vcDNA: vcDNA=SeqID_67197; Strand=+; Position=1 -10,203-756
MGAARLNMMDLNASVEFGNEIELSPVKLIEPAQTQAYKIAGKRKRPVKRTRFSFRAPKVLIVLLVIFLPNAFANPDVNNQISIQFTPPSIVYLLIIPFLIFVTITVLLWSKRNSDLPMLPNLNAISPHHAVVQTLINSTPVRCLMDTGASLTVAPRSVADELNCRTFSSDLEAMSASGHVIRLKEYAQ

SEQ ID NO: 140775 - protein, 80 aa, Heterodera glycines
  Coding regions on vcDNA: vcDNA=SeqID_67198; Strand=+; Position=1-243
  Homolog annotation: Hit_ID=NP_701231.1; Match level="QueryCoverage =93%, HitCoverage=2%, E-value=3e-10, Identity=44%"; Hit description =hypothetical protein PF11_0371 [Plasmodium falciparum 3D7] gb|AAN35955.1| hypothetical protein [Plasmodium
MIELMKQLKKHLQIDEEIGENKEKEKVEEMGEKKGKKEKEKGKKREKEDKQEKGEGKKRKMEGKEDKKEEGKEKEGKKGK

SEQ ID NO: 140776 - protein, 47 aa, Heterodera glycines
  Coding regions on vcDNA: vcDNA=SeqID_67199; Strand=-; Position=1-141
MPLLGKKIEKNDADPRRHLVGGAAAKANVNSDNGNHCGQSDKNLKKT

SEQ ID NO: 140777 - protein, 328 aa, Heterodera glycines
  misc_feature (325)..(325): Xaa can be any naturally occurring amino acid
  Coding regions on vcDNA: vcDNA=SeqID_67200; Strand=+; Position=1-991
  Homolog annotation: Hit_ID=NP_502797.1; Match level="QueryCoverage =92%, HitCoverage=86%, E-value=6e-53, Identity=37%"; Hit description =HASI (4P602) [Caenorhabditis elegans] emb|CAB16520.1| Hypothetical protein Y57G11C.19 [Caenorhabditis ele
NFKWRPKRYPEITTDDVNKFLEKQRTYTIHKPIRKKFPRLKTVPSGFHTDWQCDLCIFDQLKKHNDGYKYLLVCIDVLSRMIFSAPAKSKKSEDMIEVFDRVFEKSKIIPMKIYSDSGLEFQAGKIKNILRKNFIKNVMYSPDLHAGVVERANRTIKERLYRYFTKMDTLRWVDVIDKIIININNSVNRTLGAKPVSVTFENARALWEKLYKAKKFKISKKKKFKIGDIVRIIKEKGKFAKGYLPNFTEELFKIVIVNSTTPDSYRIEDLEGNLIKGIFYNQELVKRWMIFTLYYRRTHRGRRTLRQNSQYASPRLWNWAQIGQXLSH

SEQ ID NO: 140778 - protein, 20 aa, Heterodera glycines
  Coding regions on vcDNA: vcDNA=SeqID_67201; Strand=-; Position=1-62
MINNHVNGANDVDMERTENE

SEQ ID NO: 140779 - protein, 402 aa, Heterodera glycines
  Coding regions on vcDNA: vcDNA=SeqID_67202; Strand=-; Position=1 -122,169-269,427-510,713-934,1015-1176,1228-1268,1411-1549,1855 -1955,2001-2237
  Homolog annotation: Hit_ID=NP_501024.1; Match level="QueryCoverage =82%, HitCoverage=60%, E-value=9e-34, Identity=29%"; Hit description =spermine synthase (4H401) [Caenorhabditis elegans] gb|AAC47920.1| Hypothetical protein C01B10.8 [Caenorha
MEFVGTFSDGQSPELVHSLDKLMERICAAQQMNWFRHFISRGPVDQTSIKISALDGAERYELFVVDDQQLKTMCRKMIGFSQLKMAAQFSERIANFIDSSSYESPTNGFPWLCLPLQINLLSLGSADVTDQIGHGFSKISGKWSVEQVEVEGGATRRRLVFLDSANLIQSEVEVVRKSKNGNRWHIVWSDLSCQHHKMMLSAFALLPSLSSAGLADALEAPLRIALLGLGGGILAKFMHDKFKQSQIVAVEIDPEVLAIARKLFDFPTESDRLEVVICDAMDFLRENSAQGGVLSLNLVTRDEEASQSVKRVLSTIFPCVYSIKGDEDINEVLLCCGTANEEIVPDISALGLKGEKPVKRKKVQKRSSNQMPKTKSDSAKRSEEPWMKECAEYLANKKQFVT

SEQ ID NO: 140780 - protein, 131 aa, Heterodera glycines
  Coding regions on vcDNA: vcDNA=SeqID_67203; Strand=-; Position=1 -46,396-584,645-805
MGFSRNKIQEWKKELVGTKNFSNQQRHEIIEKFEKVKDEFAKKFNLKPSYEIERKIVGKIGVGLSTVYQWMRKFGLIGIRHKTYTDAERSELFEKIDKRKKRNPWESERKIAKELGVSRVSIMRWRKKSQN

SEQ ID NO: 140781 - protein, 280 aa, Heterodera glycines
  Coding regions on vcDNA: vcDNA=SeqID_67204; Strand=-; Position=1-840
  Homolog annotation: Hit_ID=XP_318162.1; Match level="QueryCoverage =99%, HitCoverage=34%, E-value=2e-73, Identity=50%"; Hit description =ENSANGP00000020700 [Anopheles gambiae]
MLSDLLLTHFDPSLPIIIAADASKDRIRATISHIFPDKTEKVIEHASSVLSEEQRNYSQVEKEALALVFAVQKFHRMIFGRKFTLLTDHKPLISIFGSKKGIPIYAASRLQRWALILSNYEFDIRYINTTAFGQVDMLSRLIANYPRPEEDILIAKICTETECFIGTILQARIDQLPVTATEIAEMTQKDEILQKVAKFSKEGWSQKCNDPDLAPFFPKRNEILQIENCLLYQNRVIIPTVLRDRTLKALHMAHPGIVRMKALARQHVYWPGMDSAIEKL

SEQ ID NO: 140782 - protein, 106 aa, Heterodera glycines
  Coding regions on vcDNA: vcDNA=SeqID_67205; Strand=-; Position=1 -196,446-570
MVGSLKVETLVGSKLEIELTILMNYSSMNIFKNRDLGDRSWKFEKNICKSRDLGDKVENMNIFHNEQTEVKERGRENLCDDLSLIITHILSVKPSKNQPSQSIIIC

SEQ ID NO: 140783 - protein, 56 aa, Heterodera glycines
  Coding regions on vcDNA: vcDNA=SeqID_67206; Strand=+; Position=1 -87,189-272
MKIQPNHMADFKSDCIERGHFWAETPVVNGCIKKKFFIFSQEKYVRKSPKYVPIYV

SEQ ID NO: 140784 - protein, 88 aa, Heterodera glycines; identical to SEQ ID NO: 124691
  Coding regions on vcDNA: vcDNA=SeqID_67207; Strand=-; Position=1 -96,135-305

SEQ ID NO: 140785 - protein, 60 aa, Heterodera glycines
  Coding regions on vcDNA: vcDNA=SeqID_67208; Strand=+; Position=1 -114,155-222
  Homolog annotation: Hit_ID=AAH68420.1; Match level="QueryCoverage =93%, HitCoverage=6%, E-value=1e-11, Identity=56%"; Hit description =Unknown (protein for IMAGE:6970634) [Danio rerio]
MTEDQIEQRESFLCNLEDANLRTKAQSELLLSDMQAFKAANPGCELVDFLRWHSPRGSDG

SEQ ID NO: 140786 - protein, 232 aa, Heterodera glycines
  Coding regions on vcDNA: vcDNA=SeqID_67209; Strand=-; Position=1-698
  Homolog annotation: Hit_ID=XP_311783.1; Match level="QueryCoverage =91%, HitCoverage=40%, E-value=9e-33, Identity=38%"; Hit description =ENSANGP00000025124 [Anopheles gambiae]
YFLNFLAKSNFPTTRRGVLSTIASLFDPLGLCSPCLVKAKMFFQSLWDSAKGWDESIGPKLEKDWVAIISEWDCPPVTFARYTPCGQASLQLHVFSDAGPNSFASAVYLRSELNGSVRVSLLFAKSRLRPKKFKNDGFTIPRLELLGLITAIRAKNFVVSNLDFSFENIYFWADSQIILSWLASTASQPIFIANRLAEIRKERGAFKFVRSTDNPADLGTRGLSQKGNGQTI

SEQ ID NO: 140787 - protein, 257 aa, Heterodera glycines
  Coding regions on vcDNA: vcDNA=SeqID_67210; Strand=+; Position=1 -69,997-1163,1319-1440,1492-1633,1689-1845,2024-2140
  Homolog annotation: Hit_ID=NP_492109.1; Match level="QueryCoverage =96%, HitCoverage=38%, E-value=7e-35, Identity=36%"; Hit description =metalloprotease III family member (1I107) [Caenorhabditis elegans] emb|CAA96596.1| Hypothetical protein C
MAWVADGIEEEDEPTKSYEHAEQEKLANAKEYVHRMEFGDRTFTHDVSEISRGRNAKLVLHRMRRTKGGPFRSVRHSQTKPSPQRTMCQHSSSSKRSINADPDTFWHQMPIKFHLHDSLDLTAIQQIASAIAFWENNTCVTFEHLDREPSAAEEKEEDFVDFFKGHGCYSMIGRSGGRQGVSIGSGCERVPLAVPTFIFRESIPNFSLALWSMKLATCGEFVLPSYLSDFQLRDDDEIMTLGLPYDYGSVMWVNAII

SEQ ID NO: 140788 - protein, 28 aa, Heterodera glycines
  Coding regions on vcDNA: vcDNA=SeqID_67211; Strand=-; Position=1-84
MSLLPSDHSIVTVSDQSPISVSDHSLVS

SEQ ID NO: 140789 - protein, 88 aa, Heterodera glycines
  Coding regions on vcDNA: vcDNA=SeqID_67212; Strand=-; Position=1 -115,167-320
  Homolog annotation: Hit_ID=CAE73113.1; Match level="QueryCoverage =90%, HitCoverage=49%, E-value=5e-18, Identity=47%"; Hit description =Hypothetical protein CBG20494 [Caenorhabditis briggsae]
RSVLRANFRVVLGSAALALLGSVLLVFGSCVMLFPNDMDVHGWIFLVVGVLFAIPGFYHVWYIGCTLCGRPGYSFENLPTFTKPNFPY

SEQ ID NO: 140790 - protein, 127 aa, Heterodera glycines
  Coding regions on vcDNA: vcDNA=SeqID_67213; Strand=+; Position=1 -123,180-316,372-495
HSSIFTKYKFSYLLSHLLICVIYGAFTLNYVLAFAFENAGNPTTGVVAETLLGPVGYKFFAGTFIISLGSTCCYVSIFVIIRCKNAVTQQTNTRVLRSLIIILSINIGGYLTNLAIYQLLYAFGSIL

SEQ ID NO: 140791 - protein, 39 aa, Heterodera glycines
  Coding regions on vcDNA: vcDNA=SeqID_67214; Strand=-; Position=1-199
LHFLFLHPIFLNFNPPPFENLFFVHQFAIVCFFFLCQCF

SEQ ID NO: 140792 - protein, 146 aa, Heterodera glycines
  Coding regions on vcDNA: vcDNA=SeqID_67215; Strand=+; Position=1 -195,284-422,480-577,649-657
MKMPNVSQLFCVLIVFSTFIEKSIGAPKKGTASPLEKAEQKDDEPKLGKEDKKLVNNKKELLKKELNTILEEKIPTFILEVNEIAQMIDNEQKPLERKFIQQLIDKMRPLYVDAKKDHLHLWSKVRILKHDKQIKDDVPTMEVLFK

SEQ ID NO: 140793 - protein, 24 aa, Heterodera glycines
  Coding regions on vcDNA: vcDNA=SeqID_67216; Strand=-; Position=1 -3,144-215
MIKQKFITVNCLLISGQLSEMKNP

SEQ ID NO: 140794 - protein, 133 aa, Heterodera glycines
  Coding regions on vcDNA: vcDNA=SeqID_67217; Strand=+; Position=1 -151,194-443
MEQPNQEIKTKRNKEKLEHEGSLYVLHKLSDDGLRKYWRCEFFGANDKCKGRLHTDINGNVLKIIGSHTCDMSAAHVECQRRITQLKRRAVETCGAPATIRAQVLRNTTTPVLAAFPTKAATKKVNVCKFLCQ

SEQ ID NO: 140795 - protein, 239 aa, Heterodera glycines
  Coding regions on vcDNA: vcDNA=SeqID_67218; Strand=+; Position=1 -41,1125-1185,1317-1721,2026-2238
MGAKLLAPLSTGMKSFGKQTFEFIDQSKSSICSQPSSSAAAPRENRGRAILLSEEEEEPQGEETEWLGKKSAASAGPSNTERKREKKVTDRKAGVILKLKTNKLKKPEAHGMLKSLKLKAKKLREKQKKRRRKDRMRSDEEEGEAMDSDGSNDGDVDMRADSYDSEDSDKSKLTVAPGRKAGAGAFVRLLDNYLEWLENRGILDKVLDDCRKHSKVIEKALNESEGSAPVERPAGLNPK

SEQ ID NO: 140796 - protein, 102 aa, Heterodera glycines
  Coding regions on vcDNA: vcDNA=SeqID_67219; Strand=+; Position=1 -94,151-222,305-447
MLSKESLQGSIGFSEQSVDEDRSNILNTTIAGGFKLVGMNVQRFYAYGEFFTVNERLHFSRASPTPFCVMKYAYSEKSAEFTPPQCPFPSFASQRKKQTNES

SEQ ID NO: 140797 - protein, 41 aa, Heterodera glycines
  Coding regions on vcDNA: vcDNA=SeqID_67220; Strand=-; Position=1-128
GEVPGSERLHVRRCNNDRRMDGRNLKSERPVRRCKAKEDVP

SEQ ID NO: 140798 - protein, 88 aa, Heterodera glycines
  Coding regions on vcDNA: vcDNA=SeqID_67221; Strand=+; Position=1-531
KPAVSAVPFGPFPPPHKSAQSIHQFFRSFVHFHSLLLSFSIISQCCACSTFRLHSIKSNERIMNFSFLYSPADQMGPEIVTRAQHNNN

SEQ ID NO: 140799 - protein, 81 aa, Heterodera glycines
  Coding regions on vcDNA: vcDNA=SeqID_67222; Strand=-; Position=1-246
NVHLTFQWINSKMDRHFVIPLNSTLDDSCGFELLRSGTTSIRATFDSPIPKGGVEMIVLGEFDQMIMIDYNRHIVSDSKLG

SEQ ID NO: 140800 - protein, 91 aa, Heterodera glycines
  Coding regions on vcDNA: vcDNA=SeqID_67223; Strand=-; Position=1 -153,219-341
  Homolog annotation: Hit_ID=NP_505500.2; Match level="QueryCoverage =100%, HitCoverage=30%, E-value=4e-19, Identity=41%"; Hit description= lifeguard (33.2 kD) (5K187) [Caenorhabditis elegans] emb|CAD44126.1| Hypothetical protein F40F9.1b [Caen
MGIMTIATLCLALFGLGVAIAAFFTNVHILQVIFAAIGTILIMIWFAIHIQLVMGGRTYEISSEEYVYASIILFLDVIQILWFLLSLFGEK

SEQ ID NO: 140801 - protein, 274 aa, Heterodera glycines
  Coding regions on vcDNA: vcDNA=SeqID_67224; Strand=-; Position=1 -235,329-456,678-1138
  Homolog annotation: Hit_ID=NP_502797.1; Match level="QueryCoverage =55%, HitCoverage=42%, E-value=4e-26, Identity=39%"; Hit description =HASI (4P602) [Caenorhabditis elegans] emb|CAB16520.1| Hypothetical protein Y57G11C.19 [Caenorhabditis ele
PNVAPYLGLNNQSKPQETEEPRKIIIPRKRLKEQTPDPESDNDTLEELSPEPQTTSTLKTPVPIKTIIHPTLLNGLFRDVLLYLAGKKDETPRGAKFLKDRLLKDPTVKDMVDKSKVMWGQKQKTYTIHKPIRKRFPRLKTIPSGFHTDWQCDLCIFDQLKKHNDGYKYLLVCIDVLSRMIFSAPAKSKKSEDMIEAFDRVFEKSKIIPMKMYSDSGLEFQAGKMKKYFEEKFIIKNVMYSPDLHAGVVERANRTIKERLYRYFTKKDTLRGVD

SEQ ID NO: 140802 - protein, 167 aa, Heterodera glycines
  Coding regions on vcDNA: vcDNA=SeqID_67225; Strand=+; Position=1 -45,355-528,931-1215
MTNFVKVFAKISTKECADAIIQFAKLVLGNEKMEPICILSEQFDRNLIVGELNCEMYERQKCTDSSLYCIICKHSAVKSLTNANSSALPKLKFFFMDVSIEMKFIFVPNYKLSIPKEQNNLRNYEKFANYFAENIEKLAFNDNFDDKINKYEIDLLEDFLEKPTFRS

SEQ ID NO: 140803 - protein, 111 aa, Heterodera glycines
  Coding regions on vcDNA: vcDNA=SeqID_67226; Strand=-; Position=1 -205,804-934
MHILIMFWTLELYVGHFVGHRIAVPLDLDAIMYQICAMAVAVAYNLLALNRIIAIMAPIFYCHLFTIRLFGRTTATVSVNGHQHDTPHQQNQQENDQLRVVPPSFSPSLDN

SEQ ID NO: 140804 - protein, 41 aa, Heterodera glycines
  Coding regions on vcDNA: vcDNA=SeqID_67227; Strand=+; Position=1 -72,865-918
MQSAFLRVLPWPAEQANAATIQANITLSSTSNGDEQLFGVF

SEQ ID NO: 140805 - protein, 24 aa, Heterodera glycines
  Coding regions on vcDNA: vcDNA=SeqID_67228; Strand=-; Position=1-80
RTLSTAVRQRSSKIYSMPQILWAG

SEQ ID NO: 140806 - protein, 24 aa, Heterodera glycines
  Coding regions on vcDNA: vcDNA=SeqID_67229; Strand=-; Position=1-80
RTLSTAVRQRSSKIYSMPQILWAG

SEQ ID NO: 140807 - protein, 101 aa, Heterodera glycines
  Coding regions on vcDNA: vcDNA=SeqID_67230; Strand=-; Position=1 -92,147-195,270-434
MSFFTLLSLVLFAWIFVLFSDFYLRYLNSQRYLNFLERHRISVTPFQVRFYLSNFESHPRPTLALLKAVDRCILGLRRSRFLVRIGNSIIFLPFLYGCGIF

SEQ ID NO: 140808 - protein, 15 aa, Heterodera glycines
  Coding regions on vcDNA: vcDNA=SeqID_67231; Strand=+; Position=1-45
MTTCIVAGLCSVGRA

SEQ ID NO: 140809 - protein, 46 aa, Heterodera glycines
  Coding regions on vcDNA: vcDNA=SeqID_67232; Strand=-; Position=1 -31,104-213
MSSANEENQHYGKNVSMLQQNGSVKFKRRAEKPKMASTFPEMVIIV

SEQ ID NO: 140810 - protein, 109 aa, Heterodera glycines
  Coding regions on vcDNA: vcDNA=SeqID_67233; Strand=-; Position=1 -196,580-713
ILINEPLGTDRPEIVHCCDELLARHPPCNSSHLFQFLIDKIADKMRENAVANEQQLTEMAQKSGEYLDVLEGIDPIRHNFWKYRRAQLQTLADSVKGDSTNSANEEQDA

SEQ ID NO: 140811 - protein, 33 aa, Heterodera glycines
  Coding regions on vcDNA: vcDNA=SeqID_67234; Strand=+; Position=1-101
CLSLFLINFIHIQMLSSMIGRAVRNRPFIFEGI

SEQ ID NO: 140812 - protein, 92 aa, Heterodera glycines
  Coding regions on vcDNA: vcDNA=SeqID_67235; Strand=+; Position=1-304
MIGRAVRNRPFIFEGIFKFILYPRKMSISFFEKFYTSQKRLRLRRRAVHNRHFISQRIFIFRGYPRKMAISFFDKFYTHTNALEHDREGGAQ

SEQ ID NO: 140813 - protein, 137 aa, Heterodera glycines
  misc_feature (7)..(7): Xaa can be any naturally occurring amino acid
  Coding regions on vcDNA: vcDNA=SeqID_67236; Strand=+; Position=1 -127,399-553,619-746
  Homolog annotation: Hit_ID=CAE71212.1; Match level="QueryCoverage =89%, HitCoverage=32%, E-value=2e-45, Identity=69%"; Hit description =Hypothetical protein CBG18075 [Caenorhabditis briggsae]
IQKSNYXKINCFPDTVKLRDCFCYNKNDKLITPEMVAEVLCEDLDLPLNTFLPAIAQNIQQQIEAHSEPMPDDVQATDQRALLKLNIHVGNQSLVDQFEWDMSNPNNSPEQFAQKLCAELGLGGEFVGAIAYSIRGG

SEQ ID NO: 140814 - protein, 45 aa, Heterodera glycines
  misc_feature (20)..(20): Xaa can be any naturally occurring amino acid
  misc_feature (22)..(22): Xaa can be any naturally occurring amino acid
  Coding regions on vcDNA: vcDNA=SeqID_67237; Strand=-; Position=1-282
  Homolog annotation: Hit_ID=CAE65237.1; Match level="QueryCoverage =100%, HitCoverage=32%, E-value=1e-09, Identity=60%"; Hit description= Hypothetical protein CBG10120 [Caenorhabditis briggsae]
PCDRKFTIKIKDGYVSSGKXRXKLYDIGRIELEGGFSGESRDCLN

SEQ ID NO: 140815 - protein, 111 aa, Heterodera glycines
  Coding regions on vcDNA: vcDNA=SeqID_67238; Strand=-; Position=1 -86,490-739
  Homolog annotation: Hit_ID=AAH09048.1; Match level="QueryCoverage =53%, HitCoverage=27%, E-value=2e-10, Identity=44%"; Hit description =LCN7 protein [Homo sapiens]
MKLIGWGEETTGNGELIKFWLGVNSWGNSWELNGLFKLRRGTDECRIESYDIEIYERAGKPLREKLWGGPALNRRLWLSGPVFYQLNYRPCPLQLPTLLDHIGSMLPQLIH

SEQ ID NO: 140816 - protein, 760 aa, Heterodera glycines
  Coding regions on vcDNA: vcDNA=SeqID_67239; Strand=-; Position=1 -60,550-1329,1465-1732,2230-2606,3104-3410,3585-4075
MLFPLIFLISFPTITDAKQLFDDDNVLLAFVRGQSNFEQFLVEEELNDLEIKYPPPQTMKEYLMLQYESQLGIVCLMRRHWHCAKIGSEFADNEQRKCQKFRNYLDILYEYLFTEFMGLPAVKPQFYFAEIFTFCTLSNVMLSLSWLFKFFFDSKFSKMKGHKLDRYFLEYYEPKLANEDKLDYKVELDNPNETFEDIIVQTALETGNESLRKLMRHIFGKNLEKIFRKMEQTTMESLIGQQITVGTQFSEWNLWPNDGENLNKILFYLYEIGIRRERMKIEKSLFIQFLTPPKFYQYCQETQRGEQTTKELEKRFEYFLVDLYLMRQNWQCAKMVEEIMGDEEMVKECEKIQKYLHILYEYLFMVYAKNEEPLLAQQIPIIEPKFQRQNDQVSQTFIMNELFDYSRIFFDSEYRKSDEYKAYMSANKLPWLTLLNESKLGNYTANFGNSTETLRNKFDQKLKSILKKWRDHEKGNKLEGYNPFLKKPFYDIISRTEDKAFNAFVKGLSNFEHFCLQYADELANICNGMAAEANAEQRKIHLQEKYAAYLGILSLMMDNWHCAKIGNEFAENERRECQKYRNYLDIFYEYLLHVFREDEDPVIAINSQIIIRRIELFGTLIEVIKVLNMVTKFYFDTKFSKSKEYKFENVFENSSISIGKLEQIFKGAFNEAGEAAIKGKSQSDKKEQFDKTLKEMLKVAQQIATRERGKLKVMEDKMEEHSAEENSEAEKELISAKSAAFDDKFGTLFDSPFCGTTIHN

SEQ ID NO: 140817 - protein, 100 aa, Heterodera glycines
  Coding regions on vcDNA: vcDNA=SeqID_67240; Strand=-; Position=1 -196,241-347
MDESKRENFSPQNDDDVITIGDNNNTQTLLDLQPGPSKRGRKPRLDKIHEEIASAMKKAKAMEAEVDESPKKQPTNVFEYPTIFWKLARPKVLANINLKK

SEQ ID NO: 140818 - protein, 355 aa, Heterodera glycines
  Coding regions on vcDNA: vcDNA=SeqID_67241; Strand=+; Position=1 -217,260-835,883-1157
  Homolog annotation: Hit_ID=AAA93301.1; Match level="QueryCoverage =92%, HitCoverage=90%, E-value=5e-51, Identity=35%"; Hit description =HASI
MDKKINKIYTDPANPGGYAGASALYAAVKKKHPKLKRTEFEDFLQRNTTYTLFKPKREKFRRLRTVPAGFMTDVQADLADFQALSRKNSGYRYLLLAVDVLSRRMFGAPVKSKRPVDMKKAFEELFEQMPRVPDTLYTDRGLEFVAKPLKEFYTEKGIQKFETSSKKKAAVAERAIRTLKTRLYKYFSANNTSVWVDVLPKFLSAINNSVCRATGLRPNEISDTNAREVWKRVYGEGLAQLDKTPKIRAGETVRIPKPKHIFEKGYIPNYSDHVYTVDEARSTNPQHYLLKDYYGTKLKRKFYLPELTKVQVDENTMYRIEKKYKERVRDGKREMLVKFIGFPEKYWVTNEEINE

SEQ ID NO: 140819 - protein, 200 aa, Heterodera glycines
  Coding regions on vcDNA: vcDNA=SeqID_67242; Strand=-; Position=1 -51,154-274,322-752
MDHLCCANPSAGIVEKGDTDSIFYDYLTRLGDPLPGGEQLGELADEYPNHTIMEFICAGPKAYGLWLHNNATGEDEYKLKVRGITLDSDACERITFEKMKDMVQNKLGQPDNNVRLNYPTKNFRITKKGEIFTVPLVKQFNPTVNKGVVRDHGLKVVPFGYSDEEWCKWNCPGACTCLFNPDLNVNMFTEEELNDPDIMP

SEQ ID NO: 140820 - protein, 188 aa, Heterodera glycines
  Coding regions on vcDNA: vcDNA=SeqID_67243; Strand=+; Position=1 -372,461-652
MVNGIQRGNFDQELTTKFDNESSFGILFCTANFAFEMNDNFGKFLSNFCHEFKTGKNLEEAIETVKNSLIILTRSITIEQIIIKENIFQKIAKNEFFGAKNAENIAKFFEHANSSFRLSLSAQLHHFNNLMSASENVPSTKKRIRRMIRRGFSRAMDQFQNSLDNSRYRLRNDRKKCAFFLALSVVVL

SEQ ID NO: 140821 - protein, 72 aa, Heterodera glycines
  Coding regions on vcDNA: vcDNA=SeqID_67244; Strand=+; Position=1 -78,162-302
MTKDGHKFFKIEGVISPNFFKFAKCKKILQKMIFREFFRSLGVKKANLADRAVLIDVFGKMPKYGQNTKIWT

SEQ ID NO: 140822 - protein, 208 aa, Heterodera glycines
  misc_feature (22)..(22): Xaa can be any naturally occurring amino acid
  misc_feature (202)..(202): Xaa can be any naturally occurring amino acid
  Coding regions on vcDNA: vcDNA=SeqID_67245; Strand=+; Position=1 -244,295-328,377-453,499-700
  Homolog annotation: Hit_ID=NP_497570.1; Match level="QueryCoverage =94%, HitCoverage=25%, E-value=9e-39, Identity=40%"; Hit description =laminin A precursor family member (67.2 kD) (3D594) [Caenorhabditis elegans] gb|AAK29943.1| Hypothetical
DDFTLTSAGLVALLGEVPLSNXFPPPLLLQQLSIETTISVFDKSLYSHVHPQGQLHCWLRSYISNQLTSTAHDWVKIFARFNSGTYNNQWTFNSGTYNNQWTVVDYKMFKPVVDYKMFKPGQQLPQSNLIWVLEQIPGTTVSRDVGTTVSRDVTWFLRKYSYWPSYNIPFLRRISELSGFDRKGEENDWWKWSAEPQIDAKXMPKGIL

SEQ ID NO: 140823 - protein, 133 aa, Heterodera glycines
  Coding regions on vcDNA: vcDNA=SeqID_67246; Strand=+; Position=1 -185,232-448
MGLFAFACQRDNSGYQGVTTYDNTNYNSQYGGYGIGNYGNGNNQLQQQQQQQQYPQQQQQGIYTTGYPAFGQQSANNGFGQAGYNGLMGQQQMAQNGQYGASGTGATMNTATGTRYVDMCMDWWNVRRADGEA

SEQ ID NO: 140824 - protein, 38 aa, Heterodera glycines
  Coding regions on vcDNA: vcDNA=SeqID_67247; Strand=-; Position=1 -40,88-162
PPFADAPLSLSHSFGSSSSLLPCFCIFPVPFLFSSFCS

SEQ ID NO: 140825 - protein, 104 aa, Heterodera glycines
  Coding regions on vcDNA: vcDNA=SeqID_67248; Strand=-; Position=1 -88,328-554
MNTDFPTASTIFALLATLIVMLIMPDKCRAFDCVHGDYRPIQLDDQMKREKLSDGALSIRGYKPCDLSNCFNTKCISSPGHQINYQYCSCLFHLVSKKVSFFFC

SEQ ID NO: 140826 - protein, 102 aa, Heterodera glycines
  Coding regions on vcDNA: vcDNA=SeqID_67249; Strand=-; Position=1 -183,565-690
MEKASEDSNSQNNEIADQSRENRISARSRDKQKREPKENAEGDDNVRGQRNNEDQRTKQRQHRGGPRQNYGQWSTRQMSEGGQMGGTYKRIAKVSQHRVFMG

SEQ ID NO: 140827 - protein, 182 aa, Heterodera glycines
  Coding regions on vcDNA: vcDNA=SeqID_67250; Strand=-; Position=1 -74,188-658,947-950
MSFKRVNSFQPAVPMAKKWDFRSIGNNFAEEMENYKLMDYQSTTCEKFGFTKNITEFRVNPDVERPDEAMKDSIDNMIKVALKTTEEKMKRKVRMFGVAITGAGLASPVWVPYRAYPQNNADVIMQEINKLGQSGDGDENKKMLLLSEPVTMKITCVTMPSGEGPRNVHKFDFGFKEHQRIG

SEQ ID NO: 140828 - protein, 43 aa, Heterodera glycines; identical to SEQ ID NO: 136181
  Coding regions on vcDNA: vcDNA=SeqID_67251; Strand=-; Position=1-388

SEQ ID NO: 140829 - protein, 169 aa, Heterodera glycines
  Coding regions on vcDNA: vcDNA=SeqID_67252; Strand=-; Position=1 -67,137-257,324-405,458-642
  Homolog annotation: Hit_ID=NP_506041.1; Match level="QueryCoverage =93%, HitCoverage=26%, E-value=5e-47, Identity=58%"; Hit description =SPINL protein family member (58.1 kD) (5M597) [Caenorhabditis elegans] emb|CAB07311.1| Hypothetical prote
LICVFVLFAINLLNYMDRFTIAGVLVLNDVQKFYHIDDKSAGFLQTVFIIFFMTIAPICGFLGDRFNRKRILLVGLSVWVGAVFASSFISENHFWAFLLLRGVVGIGEHFWAFLLLRGVVGIGEASYAVIAPTIIADLFVGQMRSRILMFFYFGIPVGKVKAITIQSLI

SEQ ID NO: 140830 - protein, 188 aa, Heterodera glycines
  Coding regions on vcDNA: vcDNA=SeqID_67253; Strand=-; Position=1 -155,620-813,925-1099,1171-1213
MEQCTVEHIRYQLRTGRAREQDKVNYGGSGGGGTHRNDQSAAVWMRDRRCNRTIGLLPFARSHLFLLLIDGICHESAAEKKESAKTQQQRNGAEDKHGTSTAAPSLLFPKFMSQKQVPNCELTRSSMDLERTLRPDLDYTLSHPKAGFHWCCSKVLNRKKEIIRINFGFLENIVGNSIRSGKGIRHNN

SEQ ID NO: 140831 - protein, 211 aa, Heterodera glycines
  Coding regions on vcDNA: vcDNA=SeqID_67254; Strand=-; Position=1 -159,1366-1432,1514-1731,2510-2700
  Homolog annotation: Hit_ID=EAA49399.1; Match level="QueryCoverage =38%, HitCoverage=11%, E-value=1e-15, Identity=53%"; Hit description =hypothetical protein MG01057.4 [Magnaporthe grisea 70-15] ref|XP _368187.1| hypothetical protein MG01057.4
MPHKSWWKSFGEVFFGRPSQIGRAGEENAMASAADDIDDKQLYRAPSMTEMMRELSLLQEQIENGIWEFNAYANEREYSAYNSALCPWSSLDKLLRSKFDELLPGKRSTTTANGQQQQQQQQQQQQQQQQQQQQQQQQQQQQQQQQQQPGPRGNPGHVGPAGPQGPTGEPATEGRPGLPGPVGPMGESGTPGNRGQPGIPGPPGLNGKDGE

SEQ ID NO: 140832 - protein, 136 aa, Heterodera glycines
  Coding regions on vcDNA: vcDNA=SeqID_67255; Strand=-; Position=1 -115,583-671,719-820,878-982
  Homolog annotation: Hit_ID=CAE67780.1; Match level="QueryCoverage =92%, HitCoverage=20%, E-value=1e-35, Identity=54%"; Hit description =Hypothetical protein CBG13355 [Caenorhabditis briggsae]
MRKIREIENEKEERMNEARDPKHWKMSHNDFKRVIGESLSLIVQTLQNDLIVPAWAHFGSIIKEIYTECIPITDGNVANYIPQLARMSPNYWGVSICTVDGQRISFGDSKVPFCVQSVSKALNYSIGTIKLFTLIR

SEQ ID NO: 140833 - protein, 38 aa, Heterodera glycines
  Coding regions on vcDNA: vcDNA=SeqID_67256; Strand=+; Position=1 -33,459-542
MVHAVDEDGQKSATGPGPGSGQLSTTEYQGPGFDRDRD

SEQ ID NO: 140834 - protein, 21 aa, Heterodera glycines
  Coding regions on vcDNA: vcDNA=SeqID_67257; Strand=+; Position=1-65
MAISFFSWGFDRKLGTNICLL

SEQ ID NO: 140835 - protein, 19 aa, Heterodera glycines
  Coding regions on vcDNA: vcDNA=SeqID_67258; Strand=+; Position=1-59
TFAFSSLALPNTHTIFEML

SEQ ID NO: 140836 - protein, 135 aa, Heterodera glycines
  Coding regions on vcDNA: vcDNA=SeqID_67259; Strand=+; Position=1 -134,557-830
MSPLRFFVALFLITLAILAGTHGTVENSVDGGPNMASPIIRERRKQKLLNQKEISSLMSVSIILIITDRCLKGNDSLKIMRHSVSRIPILISRWMITSRSNVMSLERCYDVSQKPSNAELLVRIKIHSNYPIQID

SEQ ID NO: 140837 - protein, 138 aa, Heterodera glycines
  Coding regions on vcDNA: vcDNA=SeqID_67260; Strand=-; Position=1 -143,361-634
MAAEAIGAEENGGRDNGKWRTEEAINDEKQEKIICGRRKNAELLGRIKQKLLNQKEISSLMSVSIILIITDRCLKGNDSLKIMRHSVSRIPILISRWMITSRSNVMSLERCYDVSQKPSNAELLVRIKIHSNYPIQID

SEQ ID NO: 140838 - protein, 232 aa, Heterodera glycines
  Coding regions on vcDNA: vcDNA=SeqID_67261; Strand=+; Position=1 -150,202-278,325-432,481-670,934-977
  Homolog annotation: Hit_ID=NP_509517.1; Match level="QueryCoverage =96%, HitCoverage=37%, E-value=2e-31, Identity=35%"; Hit description =l-carnitine dehydratase/bile acid-inducible protein F (XJ613) [Caenorhabditis elegans] gb|AAA81458.2| Hyp
KSFGGRGFASDCAMTEGLAYLGSFLFLSRHEPWLWHEEFALFSGKCPIYRTYETADRKWMAVGAVEPKFQTYETADRKWMAVGAVEPKFQQKLFEILGISTEKIDGMAKLTREMLGISTEKIDGMAKLTREMENAFRGKTQGEWAIIFEGEDACVTEDACVTPVLNMDEVGKYEQHKRRNAFLRGGSGGSVWVPRAVPKRMETEKSQTKAKSERTERIISPSNFLQNGKKKV

SEQ ID NO: 140839 - protein, 35 aa, Heterodera glycines
  Coding regions on vcDNA: vcDNA=SeqID_67262; Strand=-; Position=1-104
RSDVCSVAPHDALSAHRAKSQTRAVASSEAVANLT

SEQ ID NO: 140840 - protein, 43 aa, Heterodera glycines; identical to SEQ ID NO: 131356
  Coding regions on vcDNA: vcDNA=SeqID_67263; Strand=-; Position=1-505

SEQ ID NO: 140841 - protein, 722 aa, Heterodera glycines
  Coding regions on vcDNA: vcDNA=SeqID_67264; Strand=-; Position=1 -301,350-468,518-1161,1204-1398,1459-1636,1746-1850,1895-2032,2092 -2189,2255-2453,2499-2576,2626-2737
  Homolog annotation: Hit_ID=CAE64155.1; Match level="QueryCoverage =80%, HitCoverage=52%, E-value=3e-28, Identity=24%"; Hit description =Hypothetical protein CBG08774 [Caenorhabditis briggsae]
MEFFLGDFESDEDEVDEISQVLLREQISQMQTEDFFLPAHIKFTTDAFEEENNDFLSAADFPDDYHYFDNFSDEQEEIKLMESPMLVEIPDEMDTPSHSFDYSIKLSGNEIEILDRIPVISKPGQTKSVPASHRPVAEVFNENLLPGAHQQKQRQQIEKTQRPSLAIDSADIKRRRRPTMNADDFVYTPLKKVRLTVRKMEENVVVKREEETLVAKKKKKPKERSEKPKEVKEKQRERSEKPKEMREKPKEMKEKEFQGVEMTKKTAETVVAKKETKPKELNEMQLQRLNLIKKIKEKKAVAKEKRERERNEKQMQRLEFIRRMTELRHLNPLASPSRGPFLYEGDYFYREILVGRSDSNANNGEAEVDCVSVSAPGGFDELFVTNPAENSAISISKMICGRKKALNNKEEDGGTYSEESFKNLGVEAREFLGSFLKFIDDQRLVDLATQGVTGGASMFHSLTMKNANCLRESLRLYCKSGQALLVQVHFWLLKHLSQTRLTSYLNLLRFLKNAGSNLSDYIASSPTAEAELEKANKTISEFIAQKLYEPPLSSSSKFIECDPIKNVSLVLVYPQINAKMSQHTIRAHETLFRNLLPLAVCCVEKVELNLNVDRPISVEECAWMCIRMIRQRVKEIAKRRQNDHIFLAGWGTTCWLNHKAVSKVSNVSGILDFAFPTESPCGSRGSVDDQICLTYPSTLFVVGEDAHNVRMQALRQLRKNMI

SEQ ID NO: 140842 - protein, 70 aa, Heterodera glycines
  Coding regions on vcDNA: vcDNA=SeqID_67265; Strand=-; Position=1 -111,247-348
MTLLFCLALCPPISELSGALNKSVMKKVFVLLCPSLVGPAFPDSFESNLKNDIYSSILIDKNNDCALFSC

SEQ ID NO: 140843 - protein, 54 aa, Heterodera glycines
  Coding regions on vcDNA: vcDNA=SeqID_67266; Strand=+; Position=1 -87,436-513
MYFLQLDSFPIIKIVLVSFLEKHFSTQVQDRPSTHSHPLRIKTFCLRDKKRSLQ

SEQ ID NO: 140844 - protein, 21 aa, Heterodera glycines
  Coding regions on vcDNA: vcDNA=SeqID_67267; Strand=-; Position=1-62
LYICYIGFEFRFKKQNLPAEG

SEQ ID NO: 140845 - protein, 179 aa, Heterodera glycines
  Coding regions on vcDNA: vcDNA=SeqID_67268; Strand=-; Position=1 -25,121-204,374-492,741-863,1204-1392
MNAEYVETLIICPFVWLFIANSAVCLLLLFVNGWPKIEKFGTTNNWGNIFCQLDSAMAILIGFGWAFAPLWLLRNQFNYGCREGFKLAAETRALMIVCINLAQFWSQFIYHAHWSNKHMAGISVFITWASISIIYRIYLLFADENENVPNMEMPAARVAQNGTTVLTNGNATHYYKKRT

SEQ ID NO: 140846 - protein, 76 aa, Heterodera glycines
  Coding regions on vcDNA: vcDNA=SeqID_67269; Strand=-; Position=1 -60,380-550
MSRADEIKENAERFAVFVLWLCPCGFVSKMGGPGRLANFLVIRQLLETIQFVYVQPEESKRIHSFMPRASVFNFKP

SEQ ID NO: 140847 - protein, 83 aa, Heterodera glycines
  Coding regions on vcDNA: vcDNA=SeqID_67270; Strand=+; Position=1-252
MRRGTKVIRRGTKVIRRGTMVIRRGTKVIKSGTTVIRRGTMVIRRGTTMIRRGTTMIRRGTTVIRRGTTVIRRGTNLIKEVQK

SEQ ID NO: 140848 - protein, 99 aa, Heterodera glycines
  Coding regions on vcDNA: vcDNA=SeqID_67271; Strand=-; Position=1 -150,609-758
MPDVICSCSFGQMNVEFGNKNLRPEPKKVIPTSTSTTATTNTVASKPKTMTSSIHPSITAEVVKIGSTLQCFAWQICNLLVFFIQFSWQNVWAKFEFAF

SEQ ID NO: 140849 - protein, 120 aa, Heterodera glycines
  Coding regions on vcDNA: vcDNA=SeqID_67272; Strand=+; Position=1-603
KHHLILMKMNLFLRFNGRSDEFRQKQLTICVVYIVHVFGVAAFFVQMVPFFVHFVTFFAEFKASRNFRLPFRIPLESKFKFCPNILPRKLNKKNQQIANLPGKTLQCASNFDNFSSNTGM

SEQ ID NO: 140850 - protein, 126 aa, Heterodera glycines
  Coding regions on vcDNA: vcDNA=SeqID_67273; Strand=-; Position=1 -64,549-680,1024-1208
MKANTVFVFFFFLFGLLQFCFGDQPGNVFLYWGCAQSVWSDECILRANVMQTVVGSANVSCECFRGLKCVGGSLDEKRNGKTSVQYCFDGYEFCYKAVCVKVKFCVYVIKRLMIFCIRNQFFRGPK

SEQ ID NO: 140851 - protein, 96 aa, Heterodera glycines
  Coding regions on vcDNA: vcDNA=SeqID_67274; Strand=+; Position=1 -84,137-343
  Homolog annotation: Hit_ID=CAE58589.1; Match level="QueryCoverage =100%, HitCoverage=12%, E-value=8e-21, Identity=51%"; Hit description= Hypothetical protein CBG01756 [Caenorhabditis briggsae]
MLDPTLNYVLLVQGYYASKNSWGFPKGKINEDEVPLNCALREAFEEVGFDATEHIKNPEKCRPLQHFFGETLVRLFLATDVPMDFPFKPHLRKEIR

SEQ ID NO: 140852 - protein, 55 aa, Heterodera glycines
  Coding regions on vcDNA: vcDNA=SeqID_67275; Strand=-; Position=1 -158,210-219
MCQLVKIDGTENGVTILHKWFHRCHIVAPVPIRTNACVHGWANLWAKFNNSINVS

SEQ ID NO: 140853 - protein, 104 aa, Heterodera glycines
  Coding regions on vcDNA: vcDNA=SeqID_67276; Strand=-; Position=1-312
  Homolog annotation: Hit_ID=AAP93583.1; Match level="QueryCoverage =100%, HitCoverage=21%, E-value=8e-35, Identity=65%"; Hit description= thioredoxin reductase [Apis mellifera ligustica]
MDYENVAPTVFSPLEYGCVGLSEETALERFGEDNIEVFPGYFKPPEFFIPQKSIANCYLKVVAHREGNQKVVGLPFLGPNAGEIIQGFAPAIKLNLPVKDLMET

SEQ ID NO: 140854 - protein, 104 aa, Heterodera glycines
  Coding regions on vcDNA: vcDNA=SeqID_67277; Strand=+; Position=1 -88,420-638,749-756
MPRHGQQMNGQQNEAHLVATEQLADLAKKTLILFRDANESFSDQNAVSDWLRRSFDLPANSICELSSPSLVTNSQVFFIVFDEIGTAERILEMSKSEERAQKIF

SEQ ID NO: 140855 - protein, 29 aa, Heterodera glycines
  Coding regions on vcDNA: vcDNA=SeqID_67278; Strand=-; Position=1 -11,646-724
MSVGPSTFYPIRSQCAAATIEFIGMPRTV

SEQ ID NO: 140856 - protein, 81 aa, Heterodera glycines
  Coding regions on vcDNA: vcDNA=SeqID_67279; Strand=+; Position=1-483
FFAYQIFAINAHLFKKYSILLKCSVFCYILRIAVHLKESVIEQISQISRKVQAVAVKIVYIKTMALRISALGPFSKLMCFY

SEQ ID NO: 140857 - protein, 49 aa, Heterodera glycines
  Coding regions on vcDNA: vcDNA=SeqID_67280; Strand=+; Position=1-150
VQAWIQVPMTLDFSWTWIFLDFCPGNQGPGPTWNPGPGPGPGFFQNVDL

SEQ ID NO: 140858 - protein, 50 aa, Heterodera glycines
  Coding regions on vcDNA: vcDNA=SeqID_67281; Strand=-; Position=1 -57,143-237
MIASELADQIPSKISDEMEDIIPKGHLSDFQIAPKDMQLIRANELANAMM

SEQ ID NO: 140859 - protein, 146 aa, Heterodera glycines
  Coding regions on vcDNA: vcDNA=SeqID_67282; Strand=+; Position=1 -97,160-362,468-605
MVSAKVVNIHCNKSVMLSEINSIGFDMDYTLAGYLSPNTEELIFKLCIDYLLKHKGFWIEAIFLCNFFLGIRKKLILWCTIASLLFAAFGTTKKERMVLKEKNCSIVSQKHCQIEPRSESDEHFLRLARNRSVVPTCSSLRQRLWS

SEQ ID NO: 140860 - protein, 271 aa, Heterodera glycines
  Coding regions on vcDNA: vcDNA=SeqID_67283; Strand=+; Position=1 -180,719-829,876-930,1640-1767,2489-2575,2716-2890,3559-3638
  Homolog annotation: Hit_ID=NP_728163.1; Match level="QueryCoverage =84%, HitCoverage=58%, E-value=2e-28, Identity=33%"; Hit description =CG32549-PC, isoform C [Drosophila melanogaster] gb|AAF48832.2| CG32549-PC, isoform C [Drosophila melanoga
DVQAAMKHVHCGDGAMKAQILLNPNQYVEKETRIGTLLERIRRSGKKCFLLTNSAYAYTKGIMRFLLGNDWSSFFDLVIVDAEKPLWFTGDADFRTVVNTQTGETETVPDNIYSGENKRVAYIFGGSGAQPRRGCVDSKQKTALGKETIGERLGEFVQDVSKAMDQAYGNYGSLFRTGTRKTFFSYQLENYADLYGSSCFHLLDYHPSYHFRAKFKLMPHESPVDQSEADNQQGQVEDQHGQAADGPPFEVPNVSPNQSSSEDEEEQNTDN

SEQ ID NO: 140861 - protein, 96 aa, Heterodera glycines
  Coding regions on vcDNA: vcDNA=SeqID_67284; Strand=+; Position=1 -165,455-580
MPSAAVADALHGICPADPRRHGPLATVRKCQCPEVQRQLHLCTKRMAFCQKHTEIQKLATVESVMAELPFGVLDRLFFVGVPIVDAEVRERFRRLW

SEQ ID NO: 140862 - protein, 64 aa, Heterodera glycines
  Coding regions on vcDNA: vcDNA=SeqID_67285; Strand=+; Position=1 -97,204-301
MRPRSKSLSNINFEITQTPICRFYLRFMDALYEAKHDRIFLKRKKNNHWVKIRRVYPVFILALI

SEQ ID NO: 140863 - protein, 55 aa, Heterodera glycines
  Coding regions on vcDNA: vcDNA=SeqID_67286; Strand=+; Position=1-166
MARFVNHSCQPNCCALLTTTTTSTDDANSDQKEVPSVLVYALRRIFAGEELTMDY

SEQ ID NO: 140864 - protein, 47 aa, Heterodera glycines
  Coding regions on vcDNA: vcDNA=SeqID_67287; Strand=-; Position=1-141
MAKLATTEQLNEQFGLCDEEKDEVGQRFAVAIRRTKIIRHGRQKVQT

SEQ ID NO: 140865 - protein, 259 aa, Heterodera glycines
  Coding regions on vcDNA: vcDNA=SeqID_67288; Strand=-; Position=1-777
  Homolog annotation: Hit_ID=NP_502797.1; Match level="QueryCoverage =90%, HitCoverage=63%, E-value=1e-22, Identity=29%"; Hit description =HASI (4P602) [Caenorhabditis elegans] emb|CAB16520.1| Hypothetical protein Y57G11C.19 [Caenorhabditis ele
MDKKINKIYTDPANPGGYAGASALYAAVKEKHPKLKRAEFEDFLQRNTTYTLFKPKRDKFRRLRTVPTGFMTGTLYRGLLRTIQGSDVQADLADFQALSRKNSGYRYLLLAVDVLSRRMFGAPVKSKRPVDMKRAFEELFEQMPRVPDTMYTDRGLEFVAKPLKEFYAEKGIQKFETSSKKKAALGGAGHPHPKDSAVQIFFRHTLRFGFECAGQVFECINNSVCRATGLRPNEIIDAMRKEGCGKEGVYGEGLAQLGQ

SEQ ID NO: 140866 - protein, 142 aa, Heterodera glycines
  Coding regions on vcDNA: vcDNA=SeqID_67289; Strand=+; Position=1 -213,305-390,449-576
MGNVVSKVGNFMVKAAFVAVDGFLAVGEAFGQGMRALLSPEEHANPPITQVLLVRRRGDLIPCFRNVLKSKNETALGSIHDELSDLGLDHISYAFVKGVDLKLGFFLRSEWTWSATNVPPKWSNSTTCVIVWMPKRDAITAN

SEQ ID NO: 140867 - protein, 120 aa, Heterodera glycines
  Coding regions on vcDNA: vcDNA=SeqID_67290; Strand=-; Position=1 -172,268-458
  Homolog annotation: Hit_ID=NP_492112.1; Match level="QueryCoverage =99%, HitCoverage=54%, E-value=1e-17, Identity=43%"; Hit description =putative nuclear protein, with a coiled coil-4 domain (1I131) [Caenorhabditis elegans] pir||T25283 hypoth
FAKSDDEEEEEGADNPTDDIRKMREEERPQVVVLDPRTDLSAEELQKEIEKGNEEEDKRKIMEGKIMFRKPEKRKTENGSGKEGSKEEEEKEKRAKREEKPGQQQKEQNRRLLSFGEEDE

SEQ ID NO: 140868 - protein, 62 aa, Heterodera glycines
  Coding regions on vcDNA: vcDNA=SeqID_67291; Strand=-; Position=1-186
MASSDSEASSFAFPQNSKCGATASGQKTTANASSSLAMRVQRKVLSKLSKRGMVRLLGDNRL

SEQ ID NO: 140869 - protein, 34 aa, Heterodera glycines; identical to SEQ ID NO: 138629
  Coding regions on vcDNA: vcDNA=SeqID_67292; Strand=-; Position=1 -42,133-195

SEQ ID NO: 140870 - protein, 159 aa, Heterodera glycines
  Coding regions on vcDNA: vcDNA=SeqID_67293; Strand=-; Position=1 -200,668-947
  Homolog annotation: Hit_ID=CAE67000.1; Match level="QueryCoverage =86%, HitCoverage=33%, E-value=4e-26, Identity=35%"; Hit description =Hypothetical protein CBG12399 [Caenorhabditis briggsae]
MAFLPFATANLAPFSPIIQLNPRGVSYSFTLVISFHPVFLTGIDRAFNIRCFFTEAVRAIDASMDVSCVTDQSLLADIQYDEKAFAAHSHAHVVLFRPFSFRPSSISAPSLQFRYADRVQLFFTCTVQLCFREDGGCEGISPPQCDRHNTSPAQRSSDG

SEQ ID NO: 140871 - protein, 35 aa, Heterodera glycines
  Coding regions on vcDNA: vcDNA=SeqID_67294; Strand=+; Position=1-108
VRFRPLTVQEKNMDFHVNDSPNYYTNAFFNCSPNA

SEQ ID NO: 140872 - protein, 114 aa, Heterodera glycines
  Coding regions on vcDNA: vcDNA=SeqID_67295; Strand=+; Position=1-345
MVDKPYEFVDRNSLPGDQCACIRKNTRHKRPKAFGLRKCPNREIRSARVSACALALGAVSSGEMVLPKSGKLGCLASAVSLPLALSPSLPMRTLALKRDVVSAETIRLYKTAVI

SEQ ID NO: 140873 - protein, 154 aa, Heterodera glycines
  Coding regions on vcDNA: vcDNA=SeqID_67296; Strand=+; Position=1 -151,691-1004
MAKTAEFYDDNDNSKSSKGNAQLKSDHPTQQANGTMAATKGTESKGADEKAPLHPNSSDDSNASPSVGGSSISDFVAQLPPAPPLLVHIAVPFLLIAATFVGLFNCAVAFGLYFVFRAVASDFGRSALYTLPRDFKWVLLLGKESRMKQISSRG

SEQ ID NO: 140874 - protein, 155 aa, Heterodera glycines
  Coding regions on vcDNA: vcDNA=SeqID_67297; Strand=-; Position=1 -206,694-955
MRVRVGMRVELGKCQRSTALHLDHALFVRVTAHCAQKVGMDWCTAAECAPQQPFELEEQKGAPVGEKKCNSTHLKSLGNVYNALRPKSEATARKTKYRPNATAQLNRPTNVAAISKKGTAMCTRSGGAGGSCATKSEMDDPPTEGEALESSDELG

SEQ ID NO: 140875 - protein, 181 aa, Heterodera glycines
  Coding regions on vcDNA: vcDNA=SeqID_67298; Strand=+; Position=1 -37,95-185,233-302,1288-1481,1649-1678,1859-1981
  Homolog annotation: Hit_ID=CAE57319.1; Match level="QueryCoverage =100%, HitCoverage=38%, E-value=1e-29, Identity=55%"; Hit description= Hypothetical protein CBG00242 [Caenorhabditis briggsae]
ILCYIYTSGTTGAPKAAIIRHYRYYLMSIGCGNAFGIVPSDRLYLTLPMYHTAGGILGTSQVVFKGSTEGNSNLLNLDNRPGSCGFIPIYNSLHGFFPLLLLKVDPKTGQLMRDKRGFCIKSVPGETGELWEMMRGEMIRVGAIRNDPLLRFEGYVNEGDTQKKLIRNCQSAGDQVFSTGD

SEQ ID NO: 140876 - protein, 118 aa, Heterodera glycines
  Coding regions on vcDNA: vcDNA=SeqID_67299; Strand=+; Position=1 -68,204-305,540-726
  Homolog annotation: Hit_ID=CAE66728.1; Match level="QueryCoverage =80%, HitCoverage=6%, E-value=1e-13, Identity=41%"; Hit description =Hypothetical protein CBG12077 [Caenorhabditis briggsae]
MRAVRPRQSLTAFGECSSTANRRDSTIDEKLSDPNGIILEPMKELLKTEKDYIEDMSVFLNELMAYALNPEDVGYCFIEWMEKLKELYADYCLNKEENNYLICLPETIKIFNVKINLH

SEQ ID NO: 140877 - protein, 108 aa, Heterodera glycines
  Coding regions on vcDNA: vcDNA=SeqID_67300; Strand=-; Position=1-327
MKKPLESPAVAASSDNKTIGQQIAQNVKVADNANKQMMLDGEKPEESEEKLKENLIDKDKEHGANEAEIELARKAFENWMKSMTETTKNMKTDEGFGKMKVYLQWLFR

SEQ ID NO: 140878 - protein, 337 aa, Heterodera glycines
  Coding regions on vcDNA: vcDNA=SeqID_67301; Strand=+; Position=1 -244,318-918,1073-1241
  Homolog annotation: Hit_ID=CAE60612.1; Match level="QueryCoverage =96%, HitCoverage=63%, E-value=1e-103, Identity=44%"; Hit description= Hypothetical protein CBG04253 [Caenorhabditis briggsae]
ENCCNSLLSTNRIVEVSGDNTPEPHELNRASILITTPEKWDGITRCADTRHYVKQVELLVIDEIHLLGVERGAVLEAIITRIKSMARRRELAKLPVRVVCLSTALANAGDVAEWIGVRDHGLFNFRPSVRPVPVQVHIQGFPGQHYCPRMALMNKPAYQASAIATDGKLWVPWSLMAPCGCHGHWWLSVDARSFPHPSLFQYIKQFSSTKPALIFVASRRQTRLTAMALLGLLQREGEQSHQQWLGMNQTELERTLASVRDDNLRLTLTYGVGIHHAGLHVAERALVERLFVERKIQVLVATATLAWGINVPAHLVIVKGTEYYDGKTHKYIDFPVT

SEQ ID NO: 140879 - protein, 25 aa, Heterodera glycines
  Coding regions on vcDNA: vcDNA=SeqID_67302; Strand=-; Position=1 -52,367-392
MCEEIRLRFPKLNGIVSSAQLTGTI

SEQ ID NO: 140880 - protein, 100 aa, Heterodera glycines
  Coding regions on vcDNA: vcDNA=SeqID_67303; Strand=+; Position=1 -69,141-374
MRLFKDKDEDEQGDRLICISLAQRFTDESHYIMGASDASQLPMDVPLISINHCLADFIKPEDIEGSRCAQCSNATPPPSAPPTLVKQLMFTRLPDILVIH

SEQ ID NO: 140881 - protein, 24 aa, Heterodera glycines
  Coding regions on vcDNA: vcDNA=SeqID_67304; Strand=-; Position=1-74
IPFIYSLKSSKYINSMHWESNLRP

SEQ ID NO: 140882 - protein, 1105 aa, Heterodera glycines
  Coding regions on vcDNA: vcDNA=SeqID_67305; Strand=-; Position=1-3320
  Homolog annotation: Hit_ID=XP_318550.1; Match level="QueryCoverage =91%, HitCoverage=99%, E-value=0.0, Identity=41%"; Hit description =ENSANGP00000020240 [Anopheles gambiae]
VKIVAVHTVKVTSHCLNVGLNRGHWWKLQVKINDNDCEMNGDTGAQATIITIQTWIKLGRPKLELSDIEMHNCNEEPFPTEGMFQCVVSCFDKPPKRLTAYVSSAVNYNLFGLPWIMAFDLIPREVMFPKVQQKEMCEPISIHATLAPMRKANIKDEASLIEALKTDFSEVFEPGLGQCSKIKAHLILKQDAKPIFCKARPIPHGATEAVNAELDRLLEIGAIKPIDFSHWAAPILAVKKKNGKTRVCIDFSTGLNNALELNRHPLPRPDDIYAALNGASYFSNLDLRDAYLQMELDEESKDLCVINTHRGLFQCQRLPFGVKSAPSIFQHLMDQICAGIPGVFAYLDDGLIASKTLEGHISALYQLFTKIKEFGLRIQLEKCKFFQKELLFLGHIVSSKGIRPDPARSEAISKMPAPHDKTSLRSFLGALNYYGRFVKEMREIRTPLDQLLRKDENWNWSEEQQKAFEKAKKIMTSDLLLTHYNPALPIIVAADASKNGIGATIGHIFPDKSEKVIEHASCVLSDSQQNYSQIEKEALAFVFAVQKFHRMLFGRKFTLFTDHKPLLAIFGSKKGIPIYSASRLQRWALIMANYDFDIKYTNTASFGQADVLSRLIANYPKPEEDVLIANICVETDCYINTILQSQTDHLPVTAQEIAESTTKDETLQKIVNFVISGWPTKCREPEIAPFHPKRNEILEIGGCLLYKSRVIVPSQLRGRILKALHFAHPGIVRMKALARQYVYWPGIDSEIERVVRQCDECQGAQKCPIKAPLAPWTVTDKAFQRVHIDFAGPCQDGYVYFILVDAFSKWPEVYQMSSITAKSTVFTLRSIIHRLGIPEEIVSDNGTQFKSAEFAAFCKEFGIKHTFSPPFHPQSNGQVERFVDTFKRAMKKCSKDDKNWTEKVLLAYRTTPNNAIDGYSPDQLFFGRKLRTKLALVLPKGHRNDSENIDKIQLDKRRKDYSNKMAKQFDERHGAKEKVFFPAEPVLLLNYRNQKTYWLHGTIVERVRNSPTYRVHVPVLGRIVHRHSNQLRRNCVFEENSKHNPGPDQQPIPPVNGQAQNLAHQIADPVDQRTDQQAANDPPTMALRRSQRKPKPVIRFSPSGR

SEQ ID NO: 140883 - protein, 72 aa, Heterodera glycines
  Coding regions on vcDNA: vcDNA=SeqID_67306; Strand=+; Position=1 -52,185-351
MADNNWLSSSLSLNLFETKCVLLWVLEKTLYHIKGWIRTDTDEKREEEAKGKGILDKCHWETIKREQLTTAN

SEQ ID NO: 140884 - protein, 228 aa, Heterodera glycines
  Coding regions on vcDNA: vcDNA=SeqID_67307; Strand=-; Position=1 -87,128-249,510-627,674-807,1199-1257,1306-1375
  Homolog annotation: Hit_ID=CAE71619.1; Match level="QueryCoverage =97%, HitCoverage=60%, E-value=2e-48, Identity=43%"; Hit description =Hypothetical protein CBG18583 [Caenorhabditis briggsae]
RLAFLFSLLLSFVSATQFLRSKTRALFHFAMPTKAASCGPAGKCVAMPTKAASCGPAGKCVPFPHGARCQCASGRMGTECQSECRDIYNSCDRWLQEGRCVWTRPFSAFFLDNCPFTCGICQRAGQGLPVPLPPMLEPLQGLPVPLPPMLEPLAWFVGRWQTQTIGPDRFPAPLSRGPYIEILDVQLAEVPSFDRPPLNISVTARVTARTLDGWEEHNEVGFLTVKPA

SEQ ID NO: 140885 - protein, 75 aa, Heterodera glycines
  misc_feature (62)..(62): Xaa can be any naturally occurring amino acid
  Coding regions on vcDNA: vcDNA=SeqID_67308; Strand=+; Position=1 -97,176-285
  Homolog annotation: Hit_ID=NP_506861.1; Match level="QueryCoverage =97%, HitCoverage=16%, E-value=6e-22, Identity=65%"; Hit description =receptor nicotinic family member (5P990) [Caenorhabditis elegans] pir||T18997 nicotinic acetylcholine rec
ALVTKFCHFQYWQDEFLQWDPDTYDGATEIFLASTDIWISTDIWIPEFSLYYSVNFNDAVKXQSNNDVRVNYTGE

SEQ ID NO: 140886 - protein, 32 aa, Heterodera glycines
  Coding regions on vcDNA: vcDNA=SeqID_67309; Strand=-; Position=1-98
MGPGAKQKSAALAEKDGKLAKGKGGEGAISDQ

SEQ ID NO: 140887 - protein, 227 aa, Heterodera glycines
  Coding regions on vcDNA: vcDNA=SeqID_67310; Strand=+; Position=1 -166,468-501,576-627,672-710,760-860,1181-1232,1331-1405,2634-2669
  Homolog annotation: Hit_ID=CAE71620.1; Match level="QueryCoverage =97%, HitCoverage=46%, E-value=2e-62, Identity=60%"; Hit description =Hypothetical protein CBG18584 [Caenorhabditis briggsae]
FPFFSQRCTLLLGSWAHSNDSIKYSLFSKNLSLIDFYDNQEWQLDLVRPTQFGIVFNLVIPSAIITLVAVIGFHTPSTSGLVAVIGFHTPSTSGKMRDAKFRLGIMTLMSKMRDAKFRLGIMTLMSMSMILLAIVEDMPMSMILLAIVEDMPKFSISSSRKGRGSFSGIPLIGLYYFMLLAIVGMSTVTTQMQMFVYVERNVRIHHHVPFYLRWMIADFVPSCHSSF

SEQ ID NO: 140888 - protein, 67 aa, Heterodera glycines
  Coding regions on vcDNA: vcDNA=SeqID_67311; Strand=+; Position=1-202
ESVLRRDGCIVVKDNVAKGTEKEFDEVDNSWARPREMLHKLFERADCRIVLERKQPNIPKALYEAWE

SEQ ID NO: 140889 - protein, 194 aa, Heterodera glycines
  Coding regions on vcDNA: vcDNA=SeqID_67312; Strand=-; Position=1-583
  Homolog annotation: Hit_ID=XP_319741.1; Match level="QueryCoverage =65%, HitCoverage=29%, E-value=1e-16, Identity=35%"; Hit description =ENSANGP00000006515 [Anopheles gambiae]
MTQPAAVQPNLQQLIDVIAQQQTQINQLINVQRNNQPNPAIIQTIPSMPDVAIFEHCDEKHRITEWLERFTFAIDSCAPNAADDIKVKALMNKLSETAFSEYSKFVLPAKVTDFDFDETISKLEKLFAKPQSIFVDRFACLMATKDDGEEFQQFVNRHKRLLKDFQYDKLNEEQFKGLMLLTALKSSKDAVLRQ

SEQ ID NO: 140890 - protein, 157 aa, Heterodera glycines
  Coding regions on vcDNA: vcDNA=SeqID_67313; Strand=+; Position=1 -264,412-552,612-680
MSSSPSTAVFIFAYTLFSVELITCVAVLAITFLNLAVIVPTKLLHLNLKSILIVQSIAVMLYVLPRVVMLFQKFTSDDPFAPANVVLQNIMTFDALFRRLLGHALIIERFIATLRTNSYEKFSKVFFTLTWFCITFAIAFVNTNNTMNQSVDYLPKF

SEQ ID NO: 140891 - protein, 84 aa, Heterodera glycines
  Coding regions on vcDNA: vcDNA=SeqID_67314; Strand=+; Position=1-253
MANPADMALLFQQLTDTLKNIANQNANPNKQNSDLFATINSQLSEFIYNPEADLVFEIWHERYGPFLETDGQSLPDEMKTRLLV

SEQ ID NO: 140892 - protein, 100 aa, Heterodera glycines
  Coding regions on vcDNA: vcDNA=SeqID_67315; Strand=+; Position=1-303
MSAAQVSFWLVGASVCGATAAQVSVAQMAAAQMSAAQVSFWLVGASVCGATVAAQVSVAQMAAAQMSAAQVSFWLGGASVCGATVAAQMSAAQMSANPKN

SEQ ID NO: 140893 - protein, 253 aa, Heterodera glycines
  Coding regions on vcDNA: vcDNA=SeqID_67316; Strand=+; Position=1 -74,131-198,1394-1444,1494-1667,1740-1753,1807-1930,2082-2339
CLPKRKVNSKANVKNILCFKLDGIGGGKKCHFPPFARHSRRTHRMARCSVGFERREELAKLAVQHATNSSDQMEDGDLSLVSFGSSALPGALADYSPRDEAKSNYLSEYVSKTISAVEWLIKLDRLRQEEAIRRAMAKLSAERAPKAEIEGCRASDGRMTRTISLPTSQGDGQKSIGAIRPLAYGISPTAKPIATPGDGPLTNGQKQSKSYGWVLPVAPPSVTSPVRFVQQFGFIFGLRVHGFVRKNANAKTF

SEQ ID NO: 140894 - protein, 88 aa, Heterodera glycines; identical to SEQ ID NO: 124691
  Coding regions on vcDNA: vcDNA=SeqID_67317; Strand=-; Position=1 -96,135-305

SEQ ID NO: 140895 - protein, 119 aa, Heterodera glycines
  Coding regions on vcDNA: vcDNA=SeqID_67318; Strand=+; Position=1 -133,175-401
  Homolog annotation: Hit_ID=NP_503721.1; Match level="QueryCoverage =88%, HitCoverage=20%, E-value=3e-14, Identity=38%"; Hit description =transposase family member (5D107) [Caenorhabditis elegans] ref|NP _503720.1| transposase family member (5D
MSNEAEKEFTSTGNPKAPALHVVLDWIHRSWQEISKEVIIKSFEVCGLTTPLDGTGDEKIACFKPNGAIGPIGIKFLREFRATETVKDGRNDQEEAGLSEDDGDVELDGVGDDDEFLIC

SEQ ID NO: 140896 - protein, 23 aa, Heterodera glycines
  Coding regions on vcDNA: vcDNA=SeqID_67319; Strand=-; Position=1-71
GGLFFNLVRKGDIIGDRAFKGDG

SEQ ID NO: 140897 - protein, 32 aa, Heterodera glycines
  Coding regions on vcDNA: vcDNA=SeqID_67320; Strand=-; Position=1 -57,154-195
MSYSESATQKMIARKVYKKEKPETVGQLNKSN

SEQ ID NO: 140898 - protein, 177 aa, Heterodera glycines
  misc_feature (176)..(176): Xaa can be any naturally occurring amino acid
  Coding regions on vcDNA: vcDNA=SeqID_67321; Strand=-; Position=1 -79,123-286,330-446,540-642
  Homolog annotation: Hit_ID=XP_395835.1; Match level="QueryCoverage =96%, HitCoverage=28%, E-value=3e-30, Identity=42%"; Hit description =similar to ENSANGP00000013881 [Apis mellifera]
VPIMIILGGQVRSSQIYNAQEFCRFIRYVSTEEKKQFSSKRENYVSTEEKKQFSSKRENELLLQIPKNGVTVPYRVVDNPTRLKDEEWDRVVAVFVQGPAWQFKGPAWQFKNWKWNGNPVEIFANIGAFHLQFEERTRDTECDSFSVSCVVIGRSQRHQGWSEVKEFWAMLDGRIXK

SEQ ID NO: 140899 - protein, 55 aa, Heterodera glycines
  Coding regions on vcDNA: vcDNA=SeqID_67322; Strand=-; Position=1 -87,244-321
DDESSILPFYRLQHSKSLPVDRTPTPTNEQEENVTSNIKIAKKINVTADGNCLFR

SEQ ID NO: 140900 - protein, 104 aa, Heterodera glycines
  Coding regions on vcDNA: vcDNA=SeqID_67323; Strand=+; Position=1 -72,128-223,272-418
MTQNASAGIASELVLNRNASRFISSLLKIPTVKIRDTKSVEHKVAEISRTGYDKLIVISDFDYTLSRYHRNGEHCKTTHGIFSGVCVNEKNLEFYEKAHVLETK

SEQ ID NO: 140901 - protein, 127 aa, Heterodera glycines
  Coding regions on vcDNA: vcDNA=SeqID_67324; Strand=+; Position=1 -184,463-518,956-1096
  Homolog annotation: Hit_ID=CAE64348.1; Match level="QueryCoverage =61%, HitCoverage=21%, E-value=1e-20, Identity=58%"; Hit description =Hypothetical protein CBG09035 [Caenorhabditis briggsae]
MANVHLISNMMQFDENEVCIGFREPLIHTFNKNQTVIKQEAPFFHKLADRNAVLLLGDSLGDVRMDVGVENESVVLKIGFAFAMKVINEFGYRQDARTPSQIRNIDYQMGVYSHADGSAYIEQGETK

SEQ ID NO: 140902 - protein, 38 aa, Heterodera glycines
  Coding regions on vcDNA: vcDNA=SeqID_67325; Strand=+; Position=1 -98,510-528
MSAIQLSQLLKATSNRKIEHPVLINHICTALKDFFSSD

SEQ ID NO: 140903 - protein, 162 aa, Heterodera glycines
  Coding regions on vcDNA: vcDNA=SeqID_67326; Strand=+; Position=1 -122,170-364,420-591
SFSLVRDIKRGEQKHHPLLERFELMLRLVVPLNSHSTPQEWHKTGAFLEGRCFVDTAQRQLIPLRDVNGNANVREVAVILLMDRHFTQRIGPSEKGPDRPTGINQMNIRHLKLAGIHPIVFTERHFRKLGDDERSQIKFIREKILSLSEEFHTNEWTEENNS

SEQ ID NO: 140904 - protein, 101 aa, Heterodera glycines
  Coding regions on vcDNA: vcDNA=SeqID_67327; Strand=-; Position=1 -112,614-804
MSIYNFFLLFSSLLVVVLQQCSAANATDKNNEDNVTKAISSDKIVPKSDAIVHSGPVVESAFAVDNLSEPVKKWTNWRNGKKLEVNEAMEVPLVINPGWAN

SEQ ID NO: 140905 - protein, 158 aa, Heterodera glycines
  Coding regions on vcDNA: vcDNA=SeqID_67328; Strand=+; Position=1-477
  Homolog annotation: Hit_ID=AAL78215.1; Match level="QueryCoverage =94%, HitCoverage=55%, E-value=1e-64, Identity=76%"; Hit description =probable polyprotein allergen Hgg-14 [Heterodera glycines]
MRTFYDNLEGEAKKGATKKIVEECYGWVDEVATEDERNALKQMHHQSHDECKAKVRELMGRLSEERSEQVENRMGFCEHVYYGKMDGEGDGGAGTAGDEHHHHHHHHTKRRASDGKSGQCPNKIGKKRIKEKANKQKYRKSGLKGKSGQNAPTPNIAQ

SEQ ID NO: 140906 - protein, 18 aa, Heterodera glycines
  Coding regions on vcDNA: vcDNA=SeqID_67329; Strand=+; Position=1-54
MAVRKRPGPQHSLWVPKR

SEQ ID NO: 140907 - protein, 86 aa, Heterodera glycines
  Coding regions on vcDNA: vcDNA=SeqID_67330; Strand=+; Position=1 -4,311-567
MGTRTDAAADGARAQRQTMLLPWPSVRRHVQGDADGQYQSVRAVLPKWVRDAHRERGLPRAAGHGQCRTNAATDEDSDLWATGRGQ

SEQ ID NO: 140908 - protein, 77 aa, Heterodera glycines
  Coding regions on vcDNA: vcDNA=SeqID_67331; Strand=-; Position=1-234
MGHIFGRKFECFEKGLISLSPPGLYLTDKSVKIRLFVESVPPPVTASLEVPIPHFFFACREAQMINLLYRSLFSIAK

SEQ ID NO: 140909 - protein, 116 aa, Heterodera glycines
  Coding regions on vcDNA: vcDNA=SeqID_67332; Strand=+; Position=1 -178,378-550
MKHNYHDGTSNAYASSPVPTISTCSAPPPPPPPAVPMSYMNPKQHKHYQCYQQQQEPLMDGYGYAVPVVPMPNNDHNNMRSFCAALCRCHLKNVSMFCIAFVEFCISGQFQKAFIH

SEQ ID NO: 140910 - protein, 31 aa, Heterodera glycines
  Coding regions on vcDNA: vcDNA=SeqID_67333; Strand=-; Position=1 -80,199-214
MAHFFEIMGWEKSKTSVFGVQAVKMLDVKIF

SEQ ID NO: 140911 - protein, 208 aa, Heterodera glycines
  Coding regions on vcDNA: vcDNA=SeqID_67334; Strand=+; Position=1 -106,150-278,406-508,574-682,740-811
  Homolog annotation: Hit_ID=CAE64534.1; Match level="QueryCoverage =100%, HitCoverage=15%, E-value=6e-66, Identity=64%"; Hit description= Hypothetical protein CBG09276 [Caenorhabditis briggsae]
YLTDKVSKQIFATSSAADFSAHNKNQKLFHELHVQAHENVSILFADIVNFTQLAAQLNAKQAHENVSILFADIVNFTQLAAQLNAKDLVKTLNELYSKFDEDAQKLSCMRIKFLGDCYYCVSGMPVNRPSHADMCVLMGLEMLEMIKTIRQVRIATGVNVDMRIGVHTGSVLCGILGLKKWQFDIWKKWQFDIWSDDVSFANQMESTG

SEQ ID NO: 140912 - protein, 96 aa, Heterodera glycines
  Coding regions on vcDNA: vcDNA=SeqID_67335; Strand=-; Position=1-549
KLTLPFSPSLKHSFVRLRFRHDIPSIPFSSTPFCFACVNFCLLFGHFFFPFPFFLLLSLSNEWQINALKLLFLHGFSPLCTVYQSFCLCILLTHHL

SEQ ID NO: 140913 - protein, 97 aa, Heterodera glycines
  Coding regions on vcDNA: vcDNA=SeqID_67336; Strand=-; Position=1-293
  Homolog annotation: Hit_ID=YP_071881.1; Match level="QueryCoverage =100%, HitCoverage=12%, E-value=1e-46, Identity=91%"; Hit description= DNA topoisomerase IV subunit A [Yersinia pseudotuberculosis IP 32953] ref|NP_994289.1| DNA topoisomerase
MSDLTHDGVERLPLHTFTENAYLNYSMYVIMDRALPYIGDGLKPVQRRIIYAMSELGLNNSAKFKKSARKRGDVLGKYHPHGVGGCYEAMVLMAQPF

SEQ ID NO: 140914 - protein, 96 aa, Heterodera glycines
  Coding regions on vcDNA: vcDNA=SeqID_67337; Strand=-; Position=1 -100,482-674
PWNNTTSTTTAEGTKEPNGKEEGLSAEKAKTNRAENATENVPNVSSTFAVPSRHSVPDLPPACADHPPGLIGPIPVWMDGPGFETVGNDERRYSNN

SEQ ID NO: 140915 - protein, 86 aa, Heterodera glycines
  Coding regions on vcDNA: vcDNA=SeqID_67338; Strand=+; Position=1 -45,336-551
MTASLQQIRAQPGWTADKCKEQIEVAKSENRTFQRQTLQAHLVHLLNKEHKFNEAIQLGTDGRTKNRNGCKIIFLGIKQFFIEIPI

SEQ ID NO: 140916 - protein, 22 aa, Heterodera glycines
  Coding regions on vcDNA: vcDNA=SeqID_67339; Strand=+; Position=1-67
LRWRALPPSPFGIFLCRFARHD

SEQ ID NO: 140917 - protein, 89 aa, Heterodera glycines
  Coding regions on vcDNA: vcDNA=SeqID_67340; Strand=+; Position=1 -127,320-462
  Homolog annotation: Hit_ID=NP_506105.2; Match level="QueryCoverage =95%, HitCoverage=17%, E-value=2e-16, Identity=47%"; Hit description =putative protein of bilaterial origin (56.9 kD) (5M880) [Caenorhabditis elegans] emb|CAA99873.3| Hypothet
MIAFLLDDKNFSIICEELKLRKIDTTNLWDVLFDMIILDAFEDVQKPPSAIAALLRNGFISTSMKQSTLNSLIWSMIKTKRQRLQVTEI

SEQ ID NO: 140918 - protein, 129 aa, Heterodera glycines
  Coding regions on vcDNA: vcDNA=SeqID_67341; Strand=+; Position=1-387
  Homolog annotation: Hit_ID=NP_416571.1; Match level="QueryCoverage =100%, HitCoverage=11%, E-value=4e-70, Identity=100%"; Hit description=putative sensor-type protein [Escherichia coli K12] gb|AAC75128.1| putative sensor-type protein; putati
MPWLPFLLILLPANIMTMVMYAFRAERKHISESETHFRNAMEYSAIGMALVGTEGQWLQTNKALCQFLGYSQEELRGLTFQQLTWPEDLNKDLQQVEKLISGEINTYSMEKRYYNRNGDVVWALLAVSL

SEQ ID NO: 140919 - protein, 127 aa, Heterodera glycines
  Coding regions on vcDNA: vcDNA=SeqID_67342; Strand=-; Position=1-384
MSGKRLFTNVLKSAVGTVNDRPCIPPEGLNREMLKRRPTPAPVPQFTTRSAERSPVRKTYAPFRKGMPLERAEEAIYKIRKSLLQAADALSELADELFPHGEAREKDEGKEDEEAQWGGPGPSHSFM

SEQ ID NO: 140920 - protein, 22 aa, Heterodera glycines
  Coding regions on vcDNA: vcDNA=SeqID_67343; Strand=-; Position=1-67
CNWVNLAKSGTASTRIWLSSML

SEQ ID NO: 140921 - protein, 21 aa, Heterodera glycines
  Coding regions on vcDNA: vcDNA=SeqID_67344; Strand=+; Position=1-66
CPFGDSTLWGAKIHAELKYRV

SEQ ID NO: 140922 - protein, 204 aa, Heterodera glycines
  Coding regions on vcDNA: vcDNA=SeqID_67345; Strand=-; Position=1 -84,127-192,451-541,589-699,748-884
  Homolog annotation: Hit_ID=NP_493632.1; Match level="QueryCoverage =99%, HitCoverage=26%, E-value=5e-49, Identity=50%"; Hit description =putative membrane protein, family 8 (71.0 kD) (2A305) [Caenorhabditis elegans] gb|AAB70976.1| Hypothetica
IQWAFLLARRARDQGMIESDIIYVDLLEKIRQYRVNVLTLTLKIRQYRVNVLTLTLYDWVPIPLVYTQVVNLAVRLYFVIALFARQFLKDFGGRICLISQKVDIIVPLMTILQFFCLISQKVDIIVPLMTILQFFFYMGWIKVAEVLLNPMGEDDDDFEEDDDDFETNWIIDRNLQCGLMIVDECYGREPPMERDQFGSEAMRR

SEQ ID NO: 140923 - protein, 214 aa, Heterodera glycines
  Coding regions on vcDNA: vcDNA=SeqID_67346; Strand=-; Position=1 -84,559-1119
MLIAFMKRNHETIIIEYSMEKYEAYLCIKMEFYKLNFMLLFIINSLNKTLSVNNFCEKNGKLLPIFAEIFGQGWETEQNANCHPNDQNDLNLAHSNRNVQIDKYNDQQKLEIIHKFHAIKEGIIKRRKLERKVRNKIEQKIAEKLGICRPKIYKWNKEFEFVYENKFYKQKKQEFIERIDDFWKNVQKWKTETICGRVGHCWIYINKMEKGIWH

SEQ ID NO: 140924 - protein, 53 aa, Heterodera glycines
  Coding regions on vcDNA: vcDNA=SeqID_67347; Strand=+; Position=1 -130,499-530
MAFSLAKCASILCCAVLLAVIICFSNKNLYNICINAMILPYKHINYFCVHLLV

SEQ ID NO: 140925 - protein, 55 aa, Heterodera glycines
  Coding regions on vcDNA: vcDNA=SeqID_67348; Strand=+; Position=1 -130,226-263
MAFILAKCASILCCAVLLAVIICFSNKNLYNICINAMILPYKHRLKHSLAMCPIK

SEQ ID NO: 140926 - protein, 121 aa, Heterodera glycines
  Coding regions on vcDNA: vcDNA=SeqID_67349; Strand=-; Position=1 -42,239-334,545-772
MDGILTGAGFLRIPRELVRGHFTQERTARIEQYFGCGFVFYQLPQVIEQETEPPNITSPTPNSSPNSNGQKTPENAESPSGAVASPNAADPSSNATNSSSVTGSPNAGESCSNAANSVILF

SEQ ID NO: 140927 - protein, 129 aa, Heterodera glycines
  Coding regions on vcDNA: vcDNA=SeqID_67350; Strand=-; Position=1-390
  Homolog annotation: Hit_ID=NP_851896.1; Match level="QueryCoverage =93%, HitCoverage=3%, E-value=3e-11, Identity=34%"; Hit description =very large tegument protein [Cercopithecine herpesvirus 1] gb|AAP41454.1| very large tegument protein [Cer
MSDKKKQKKSSKKRDKSGDRKKSSKEQPRTDAEVQQPRTDAEVQQPRTEAPEVVNGATPSTGVLTVYEEPPSTAGQTTVYEEPPSTAGQTTVYEEPPSTAGQTTVYEEPPSTAGGDASKTTKPTTGSQN

SEQ ID NO: 140928 - protein, 18 aa, Heterodera glycines
  Coding regions on vcDNA: vcDNA=SeqID_67351; Strand=+; Position=1-56
YREATPEGFGLPINLGTS

SEQ ID NO: 140929 - protein, 147 aa, Heterodera glycines
  Coding regions on vcDNA: vcDNA=SeqID_67352; Strand=-; Position=1-444
MLSEFSTLITAFLAQLSTEEKDKWAPNALRQTVEALSNGKNQHQLLLVPSDFVAFLLNKIITSFTNKNGGTVEKFSGNSGKKISENFAPPPTSSSSSRHVRRRFRRDMSPSLWLALACAMTGFVHNSMLYTMMAYILIVHHILFYDH

SEQ ID NO: 140930 - protein, 219 aa, Heterodera glycines
  Coding regions on vcDNA: vcDNA=SeqID_67353; Strand=-; Position=1 -135,189-557,607-764
  Homolog annotation: Hit_ID=NP_492537.1; Match level="QueryCoverage =91%, HitCoverage=50%, E-value=2e-10, Identity=30%"; Hit description =putative protein family member (1K150) [Caenorhabditis elegans] emb|CAB02815.1| Hypothetical protein C36F
TDSNYGTLKNLDADIFTKNAPAKPAAAPKAGQAPHGGGGPAQTPTTDSNYVTLKNLDADIFTKNAPAKPAAGGAASQKSAAGGAMSQKSAAPAGGTSALGTASQKTAAAPAGGTSALGTASQNLTYDFPLDYLNMSSQWGGGRLVKPAAAPKAGQAPHGGGGPAQTPTTDSNYGTLKNLDADIFTKNAPAKPAAAPKAGQAPHGGGGPAQTPSEKMAKF

SEQ ID NO: 140931 - protein, 63 aa, Heterodera glycines
  Coding regions on vcDNA: vcDNA=SeqID_67354; Strand=+; Position=1-192
QKGGEAKGQRERSVLKKRKGKTDEQRKKGRKCGEQRTNFAHLGEEESVNRSNKAKNGRNELIC

SEQ ID NO: 140932 - protein, 193 aa, Heterodera glycines
  Coding regions on vcDNA: vcDNA=SeqID_67355; Strand=+; Position=1 -170,390-453,1611-1695,1773-1864,2006-2176
  Homolog annotation: Hit_ID=NP_491290.2; Match level="QueryCoverage =66%, HitCoverage=77%, E-value=8e-48, Identity=42%"; Hit description =UNCoordinated locomotion UNC-89, PHarynx Muscle abnormal PHM-1, UNC -89 (unc-89) [Caenorhabditis elegans]
MVLRVMYVIELLETEEGGIELVDPSWCKRLAQIMAGLSVAALAGDDERTLSLSQAPPGGSSSIEWTTTGTSLEMQGTRTEDTGRYSCVATNEYGQASTSAFFRVLKVEKESAGPSFVKSLAERRNCKEGEVISFECEVDGWPEPELVWLVDDQPLRPSHDFRIQYDGQIAKLEIRDAQPDDSGTYTVNIDFIN

SEQ ID NO: 140933 - protein, 131 aa, Heterodera glycines
  Coding regions on vcDNA: vcDNA=SeqID_67356; Strand=-; Position=1 -144,530-743,817-854
MLANNRSALLNLLIGVLIGFVLSLALFPSTDFPSVKLPTYSRPVVLIKEDQQKQRNANVQQQQRDELLNNHDHVDEHRNEHRRRFDPHTEEEVDDNDDEHGAAPGIPLFFHTNGSHVNEAKIYLFFLKQLI

SEQ ID NO: 140934 - protein, 112 aa, Heterodera glycines
  Coding regions on vcDNA: vcDNA=SeqID_67357; Strand=+; Position=1-353
  Homolog annotation: Hit_ID=EAK91016.1; Match level="QueryCoverage =91%, HitCoverage=90%, E-value=5e-29, Identity=66%"; Hit description =hypothetical protein CaO19.6835 [Candida albicans SC5314]
MVRLVFRPYTQVRRSICTSESLRTSTRVSSGFILLRNSSPSFGSQRILSVSAPSHAIETGLSCSLQGSHISSVRSLLSLRLWVLHPMTCAYAKLLGPCFKTGRTDDRLYTEK

SEQ ID NO: 140935 - protein, 90 aa, Heterodera glycines
  Coding regions on vcDNA: vcDNA=SeqID_67358; Strand=+; Position=1 -39,464-697
MNPKRSQMGTNQSELSYFWTVASKQKLLKIVQQMCKLHMNVSAARFSTVIATLKRKRYLRAGEQSDETFTIIDLLFANSQMRKLPFLFST

SEQ ID NO: 140936 - protein, 17 aa, Heterodera glycines
  Coding regions on vcDNA: vcDNA=SeqID_67359; Strand=+; Position=1 -7,483-529
MVDQFPFIMIDLSFISQ

SEQ ID NO: 140937 - protein, 131 aa, Heterodera glycines
  Coding regions on vcDNA: vcDNA=SeqID_67360; Strand=-; Position=1 -123,445-564,614-767
  Homolog annotation: Hit_ID=AAO33712.1; Match level="QueryCoverage =93%, HitCoverage=29%, E-value=1e-12, Identity=38%"; Hit description =beta-1,4-galactosyltransferase 6 [Cricetulus griseus]
PLPDNNFGEVSGFTPEQYQRVNGYSNLFWGWGDEDVDMFNRILSVGYPDERKRELSAPELGFYTSLELAKGVNDTTNTIGNEECRQRLLDSAVKRMPLDGLNTIKGTYKVVSVQENKLFTNIAVMNNKRDR

SEQ ID NO: 140938 - protein, 144 aa, Heterodera glycines
  Coding regions on vcDNA: vcDNA=SeqID_67361; Strand=-; Position=1 -44,94-333,639-787
  Homolog annotation: Hit_ID=AAH68719.1; Match level="QueryCoverage =81%, HitCoverage=23%, E-value=2e-18, Identity=43%"; Hit description =MGC81163 protein [Xenopus laevis]
MRCLRMIYFLRFIYLMFVDHFVIILALLICPFSVAEPLPLCPEVPPTLIGRQLPDKKMQMLADTEREHPEMAKGGEWKPRTCIAQQKVAIMIPYRNRAEHLRGLLANLIPFLQRQQAHFRIFVVEQAFPVGKRVDKFNKAKLIN

SEQ ID NO: 140939 - protein, 178 aa, Heterodera glycines
  Coding regions on vcDNA: vcDNA=SeqID_67362; Strand=-; Position=1 -35,196-697
  Homolog annotation: Hit_ID=CAE71161.1; Match level="QueryCoverage =87%, HitCoverage=41%, E-value=2e-42, Identity=52%"; Hit description =Hypothetical protein CBG18017 [Caenorhabditis briggsae]
MTLTVKLPAAFLDLCQVWAERQQAEERLSGQGLVVEIDESKFFRAKYNRGRMINRAYDWVFGLLERGTNKVRFFNVQRRDADTLLPIIADNIEANSIIISDGWAAYGGINNMQQQYDHRWVNHRMYFVDPNDPRVHTQGIEATWRALKNGLRRLHGTNSDMFVTNLSLSVYVPSVPWK

SEQ ID NO: 140940 - protein, 40 aa, Heterodera glycines
  Coding regions on vcDNA: vcDNA=SeqID_67363; Strand=+; Position=1 -16,67-173
MAKSAGMPTADQRNRRVFRSLFWIIAVNIGGIVFIQYVPH

SEQ ID NO: 140941 - protein, 75 aa, Heterodera glycines; identical to SEQ ID NO: 139835
  Coding regions on vcDNA: vcDNA=SeqID_67364; Strand=+; Position=1-228

SEQ ID NO: 140942 - protein, 85 aa, Heterodera glycines
  Coding regions on vcDNA: vcDNA=SeqID_67365; Strand=-; Position=1-258
EPIVPVPEFVVDLCDFEDLYLAEFEDQHLALIRLSETNWRLISRTTATADQNDDPNRDEHHQNSGEGPAENGSEKTLIEIGRFFS

SEQ ID NO: 140943 - protein, 121 aa, Heterodera glycines
  misc_feature (8)..(8): Xaa can be any naturally occurring amino acid
  Coding regions on vcDNA: vcDNA=SeqID_67366; Strand=-; Position=1 -163,264-464
PKNPWRRXIGFIQQIRIELLFPFLFHKMDAASAIKRRGMAKDWLDNSAGGAKLGEIGGTIQQRHLGKLFHRLHFPFQYFHSLVQLFHSPRAFFHPKRSFFENLVGLILKSTQRMGQLNDDF

SEQ ID NO: 140944 - protein, 99 aa, Heterodera glycines
  Coding regions on vcDNA: vcDNA=SeqID_67367; Strand=-; Position=1 -7,300-589
MPGAPVTVASVNIDTDTLLRTRHTDAKHSKDDENRENDGKFDDANDDGEDGEDQQKGGEETVAKEGEEEEDNGMGIERRGRHNAKAETIGGAQLAPMVS

SEQ ID NO: 140945 - protein, 78 aa, Heterodera glycines
  Coding regions on vcDNA: vcDNA=SeqID_67368; Strand=-; Position=1 -73,537-700
MCISLTTNMRAKTTNCSTLQITFASVDECPDYGMNSASEDERRHFLRRYFVHFGQPIGEECEMDKMLCKIRHFEAVHS

SEQ ID NO: 140946 - protein, 51 aa, Heterodera glycines
  Coding regions on vcDNA: vcDNA=SeqID_67369; Strand=+; Position=1-156
GVDECPDYGMNSASEDERRHFLRRYFVHFGQPIGEECEMDKMLCKIRHFEA

SEQ ID NO: 140947 - protein, 194 aa, Heterodera glycines
  Coding regions on vcDNA: vcDNA=SeqID_67370; Strand=+; Position=1 -78,142-306,878-964,1085-1206,1264-1396
  Homolog annotation: Hit_ID=CAG11123.1; Match level="QueryCoverage =57%, HitCoverage=35%, E-value=2e-14, Identity=37%"; Hit description =unnamed protein product [Tetraodon nigroviridis]
MATVLRSSAELSVESIVALFNCYVHSIFTFFCSDFDAQQQQQMFGTNFVTFRLRQFVQSIEKKMNGPGATEGGQDSVENAESILKQISATDWTTGEIHSQHSPYVDTIVQECSQFKQKFVRLFPYVHISDELYAAIWSMLLLCIFRILVQGYADVKKCSIEGRALQLLDVEQLCGELEEITGLRQFHNHPFILV

SEQ ID NO: 140948 - protein, 560 aa, Heterodera glycines
  Coding regions on vcDNA: vcDNA=SeqID_67371; Strand=-; Position=1 -69,425-658,756-860,934-1044,1091-1183,1369-1507,1573-1700,1746 -1802,1914-1985,2144-2302,2386-2485,2638-2819,4036-4055
  Homolog annotation: Hit_ID=NP_500253.1; Match level="QueryCoverage =99%, HitCoverage=86%, E-value=1e-140, Identity=48%"; Hit description= spastic paraplegia 3A homolog, atlastin, putative guanylate-binding protein, similar to ARL-6 interactin
NEFVINSEAIKRILDDPRYADKKVCVVSVAGAYRTGKSFILNFFLRYLRWHSAPVADRTVDWLEMESTLGGFSWRGGDDRDTNGILIWPEPFLLEDRNGEQVVVLLMDTQGIFDMDTTVKKCSTVFALSTMVSSVQIFNINKNIQENDLQHIFNINKNIQENDLQHLQLFTEYARLALDEDNNSKPFQSLLFLVRDWSVPDDAEYGSIGGQFQSLLFLVRDWSVPDDAEYGSIGGQRILDKRLKVTRRQHPEHQQLRLHIRSSFDNIRCFLLPHPGREVATNLHYRGKLDKIDIDPDFKAQLRSLANYVFYPNNLVVKQIGGQPITCRELAGYINAYFEVFSKAEMPNPQTIYDAYFEVFSKAEMPNPQTIYDVTAKTNHYEAVESAKAVYMREMEESCGGDSPFMSGAELRAEHERCKEQAMRIFKTAKKMGGPELAKQFAQKLKQDITEAFESFEHANNEAFESFEHANNSKTVHLRTPAVLVASMIALYCCQLFFQLLGLDTIASIFSLFLTLIFVALGIWTYSRYSGHFRHAQVFIDGRVHALLHNVLAPNCVHIR

SEQ ID NO: 140949 - protein, 113 aa, Heterodera glycines
  Coding regions on vcDNA: vcDNA=SeqID_67372; Strand=+; Position=1 -81,133-234,303-387
  Homolog annotation: Hit_ID=CAE60152.1; Match level="QueryCoverage =100%, HitCoverage=55%, E-value=3e-31, Identity=60%"; Hit description= Hypothetical protein CBG03702 [Caenorhabditis briggsae]
MRLEKCWFCSSTIYPGHGIQFVRNDATVFKFCRSKCNKLFKKKKNPRVFKFCRSKCNKLFKKKKNPRKLKWTKASRRIRGKELVELVNDVTQAMEIRRNEPTKYDRNLWETAV

SEQ ID NO: 140950 - protein, 72 aa, Heterodera glycines
  Coding regions on vcDNA: vcDNA=SeqID_67373; Strand=-; Position=1 -168,221-268
MSLLYFRISRDLDFMKMVYKDVIASNSSIEQFMGFCEEMHAQGFHKQPLAIYLQRSDYFVHINKDGEFQLKQ

SEQ ID NO: 140951 - protein, 69 aa, Heterodera glycines
  Coding regions on vcDNA: vcDNA=SeqID_67374; Strand=+; Position=1 -39,426-595
MRKSSMNLLLLNLALSDLCLLSINSLYLMPKLFERPILKFSLIYCHFHIFMTGVCGLVSILTYMAICVE

SEQ ID NO: 140952 - protein, 49 aa, Heterodera glycines
  Coding regions on vcDNA: vcDNA=SeqID_67375; Strand=-; Position=1 -80,174-243
MSRVARKDEVPIKILKRVQWPRELYLRITANEVPKMGTNWMKKQDRSVM

SEQ ID NO: 140953 - protein, 75 aa, Heterodera glycines
  Coding regions on vcDNA: vcDNA=SeqID_67376; Strand=+; Position=1 -136,242-333
MCTLSDPTNQPEIFLLLSTASLVLYCGEFECYALIWLLTWWRNSQISENGRRLMVSLSVIMSMGFVCDIGVSTFE

SEQ ID NO: 140954 - protein, 19 aa, Heterodera glycines
  Coding regions on vcDNA: vcDNA=SeqID_67377; Strand=+; Position=1-57
AIYEAIPEGFGLPINLGAS

SEQ ID NO: 140955 - protein, 65 aa, Heterodera glycines
  Coding regions on vcDNA: vcDNA=SeqID_67378; Strand=-; Position=1 -64,425-558
MDDQRMPVSAAFSVPQIATALADLTNPDHVGNEALKDFDHPMHGERIRQINRECQRQFKLHGLLA

SEQ ID NO: 140956 - protein, 294 aa, Heterodera glycines
  Coding regions on vcDNA: vcDNA=SeqID_67379; Strand=-; Position=1 -122,207-582,708-917,972-1148
  Homolog annotation: Hit_ID=S65469; Match level="QueryCoverage=87%, HitCoverage=36%, E-value=2e-50, Identity=37%"; Hit description=DNA topoisomerase (EC 5.99.1.2) - Caenorhabditis elegans
MSTSKMVGTMFLHQKEGQSEGTDLGQCSMGRTDTRHPRGKRKEETSNEKKKGKKAEEVMPKKSKESTSKSRKKNESSGEEEDFDDDSDGEEEEYQPKVRRREGKRMKKDDILQKKKQKSDPSPAKKSDSKKSTKTTKVTKVEVKEESGAGVEHKKRKTTKVEVKEEPSSSQGSPSKKRVKKQEEEEEVWRWWEEDESNAGASDGSIKWQTLVHKGPVFAPAYVPLPKHIKFKYDGKEMDLSLPAEEVASFYAKMLDHDYTSKPVFNQNFFKDWVKVMTKAERAEIKDLAKCDFR

SEQ ID NO: 140957 - protein, 145 aa, Heterodera glycines
  Coding regions on vcDNA: vcDNA=SeqID_67380; Strand=+; Position=1 -58,142-351,581-748
MSNQGGKKQPTDSLIRAKYPDPIVVALLANSSSSPPTESPSSADIRPTSLGQLLLPSSSPPPSSSVAPITDQSPTVPGKGTPPTIRVDNGRVHKCAVPSRVAQLRVELRRQTLLLQCADHKQIRPLGQSERRESLVDSLRQLSAR

SEQ ID NO: 140958 - protein, 18 aa, Heterodera glycines
  Coding regions on vcDNA: vcDNA=SeqID_67381; Strand=+; Position=1-55
MENAPEVKSQTTETEKGT

SEQ ID NO: 140959 - protein, 205 aa, Heterodera glycines
  Coding regions on vcDNA: vcDNA=SeqID_67382; Strand=-; Position=1 -204,596-708,752-852,914-1114
LEHNPYLTAAEREAIGNRKEELRQLSLSVKRNILVDLDISTGAMHQQKAMPLSVLVERHLFSKNPSKRAIPWLQSVQHKGPLLIAALEDDAPIEYFNGEDTQKSEATGEGDGVSCQRRNVILAKATLVDCITWTEFSREYSAERTLFRPLQNAFVLLVADAEALSPPIPHKCPSEFFEVGRSLVNAVNLALVNGGGIYEETLTTF

SEQ ID NO: 140960 - protein, 210 aa, Heterodera glycines
  Coding regions on vcDNA: vcDNA=SeqID_67383; Strand=-; Position=1-631
MVEMGTEIQTSRNELKAFQEEVDKAKNITLEHVEKNDLKKAKKSADVAKGIARQAKTKYTSTLEGYNDKSEKGFSGIVNRLNEALGEHIKRKDIENIQVSEAEKGPQKRERLANEDVQFQYDSIDQKFIVYLSAAVSHIDLSKHLAYVLGFKNTRLFHAEEANYMPDLTGGVRQLYIYAPDLIENTIIGNQMAPLLRIVNVVDDPGSISE

SEQ ID NO: 140961 - protein, 219 aa, Heterodera glycines
  Coding regions on vcDNA: vcDNA=SeqID_67384; Strand=-; Position=1 -141,378-566,614-943
MPFHQQTQHTAKCKWKCHNCLRVGSAFRGNCVQGNDNFFETCLGCNKHHQQKEHVCGQKFCKICLGFHAPRDCYIPYRPKVKKEKRFVFFDFECTTDFKPDPQLMRFKHQVNFCFAHVTCTRCIEKGIWDQELERACALCGRFRTYAWSPFEFWHTDVECRKVVEDPLATFTKWLLNFETEVLGMEPGAKKRRKRKNISHSIVILKSIKIIFLYCNSIT

SEQ ID NO: 140962 - protein, 233 aa, Heterodera glycines
  Coding regions on vcDNA: vcDNA=SeqID_67385; Strand=+; Position=1-704
  Homolog annotation: Hit_ID=AAG00552.1; Match level="QueryCoverage =100%, HitCoverage=81%, E-value=2e-30, Identity=34%"; Hit description= retinitis pigmentosa GTPase regulator [Mus musculus]
EEDQSVEEKVEEDHQSVSDTASGRETGRGSESGRRSGSGRESGRGIESGRESGCGRESGREIESGRESGRESGRGTESGSGRESERGRESGRESGRGTESGRESGRESGRGTESGRESGRGTESGRGIESGTESGRESGRGTESGRESGRGTESGRESGRGTESGRGIEEEQKVEEKVKEEQKVEEKVEEEQKVEEKVEEDQKVEEKQKVEEKLEEEQKVEEEVEEEQKVEEE

SEQ ID NO: 140963 - protein, 96 aa, Heterodera glycines; identical to SEQ ID NO: 138093
  Coding regions on vcDNA: vcDNA=SeqID_67386; Strand=-; Position=1-291

SEQ ID NO: 140964 - protein, 63 aa, Heterodera glycines
  Coding regions on vcDNA: vcDNA=SeqID_67387; Strand=-; Position=1-510
LTSKNNSLPKSFLQPLIANLISCRLKAIHCLPVSAQQSTNRVFDFLQKIIHYPKVFYNHLLPI

SEQ ID NO: 140965 - protein, 104 aa, Heterodera glycines
  Coding regions on vcDNA: vcDNA=SeqID_67388; Strand=-; Position=1 -136,181-308
  Homolog annotation: Hit_ID=AAQ83118.1; Match level="QueryCoverage =100%, HitCoverage=11%, E-value=6e-29, Identity=57%"; Hit description= N-ethylmaleimide-sensitive factor [Aedes aegypti]
GPPNTGKSYLAAQIAKDSEFPFIKVCTPEEMVGYSETAKCAKIRKVFEDAYKSPLSCVIIDNVFEDAYKSPLSCVIIDNIERMMDYSPIGPRYSNFVLQTLLVL

SEQ ID NO: 140966 - protein, 179 aa, Heterodera glycines
  Coding regions on vcDNA: vcDNA=SeqID_67389; Strand=-; Position=1 -165,291-439,490-592,639-703
  Homolog annotation: Hit_ID=CAE71970.1; Match level="QueryCoverage =84%, HitCoverage=2%, E-value=2e-56, Identity=75%"; Hit description =Hypothetical protein CBG19042 [Caenorhabditis briggsae]
NDAGGGGESCSFESLKVLPLMFAYFNAHKQYFMASSSIVQTGTASNKEKEMVASLFCRLAALLRIKNHAFGSVAKITVRCLQGLTQALDIRTLVKTNSDIVRTGLLIFFLLIFFSNCADDLFLAVNELKEGGQYSLLRGENLKSGVSMEFAFQMIIPVSGVSMEFAFQMIIPVLSTVFS

SEQ ID NO: 140967 - protein, 144 aa, Heterodera glycines
  Coding regions on vcDNA: vcDNA=SeqID_67390; Strand=-; Position=1 -235,475-674
MASAQNSGHAVDPSTVSADLNDICGDTDGMANEEEADDAIVKEIVTALLSGGPFPAAEENDEQSQAMEQQQTNGTAMDGPNLVEKSWSAVAICIDGVGTGATAFIGAVTKTGATAVPVRRGQWAKRRAPRLAQIRKATTWHSPP

SEQ ID NO: 140968 - protein, 160 aa, Heterodera glycines
  Coding regions on vcDNA: vcDNA=SeqID_67391; Strand=-; Position=1 -384,625-723
  Homolog annotation: Hit_ID=NP_113997.1; Match level="QueryCoverage =98%, HitCoverage=15%, E-value=2e-11, Identity=29%"; Hit description =cyclic nucleotide-gated channel beta subunit 1 [Rattus norvegicus] emb|CAA04133.1| cyclic nucleotide-gate
MQKKRRKKQKKKHHSEKELEKRVANGQKGENEGRKEENEGRKEEEFKMAKGTEEEEEEEERRSGTYSSSGGEVYLNEREEEELLMVMEQGLDRRLGKERGQVGEGKDKQQQQNGDKEHKEEEEEQKQQITTQNDQTAEIISSNHSQTPKSPNYHSQQTQE

SEQ ID NO: 140969 - protein, 50 aa, Heterodera glycines
  Coding regions on vcDNA: vcDNA=SeqID_67392; Strand=+; Position=1 -53,351-450
MNGITAGDYGAIGGTYFCRASKNMDIKSRNMAIKYGQRIAKYGHKIAIWT

SEQ ID NO: 140970 - protein, 375 aa, Heterodera glycines
  Coding regions on vcDNA: vcDNA=SeqID_67393; Strand=+; Position=1 -715,1637-2049
MQQPNLLKIHGSLQQKLSAKRTAAHLTTSPLSTIPSKRQQFLDGAAQLDITALLTSTEVSEPVRAVILQLDALLKLAVDMVHETSIQDTRAVLEEDRREHSVVLMGVPESDSGLSSTRRAIADQQQVLDILDVCEIEAMPTKVYRMGQRKEGGPRLLKVEMPTRKITQTFLRNKTRLKNSKFQAVSVRPSLSPEQLKERHNLINCCKTARAQFPNLNFIVYAGHVIPQNDVSVFRDDPVEDKYAIFFSSVRRNLEINIPETILSVKSAKNFYPPHLLASIREKARLYKLMKENRGKYEPLYKSISLHIKTQIRNIQSRKENKILSGDKNRLFSYLRKYFKPVEDPPVIQYNTLFVSDSTSKAEIFAKIFSENYCK

SEQ ID NO: 140971 - protein, 36 aa, Heterodera glycines
  Coding regions on vcDNA: vcDNA=SeqID_67394; Strand=-; Position=1 -22,699-787
MTYFEYLETKEAQEQNPGERQSSFYTQKREYYQPEP

SEQ ID NO: 140972 - protein, 196 aa, Heterodera glycines; identical to SEQ ID NO: 140372
  misc_feature (97)..(97): Xaa can be any naturally occurring amino acid
  misc_feature (115)..(115): Xaa can be any naturally occurring amino acid
  misc_feature (129)..(129): Xaa can be any naturally occurring amino acid
  misc_feature (147)..(147): Xaa can be any naturally occurring amino acid
  Coding regions on vcDNA: vcDNA=SeqID_67395; Strand=-; Position=1-1673
  Homolog annotation: Hit_ID=AAL31950.1; Match level="QueryCoverage =76%, HitCoverage=33%, E-value=2e-32, Identity=56%"; Hit description =CDH1-D [Gallus gallus]

SEQ ID NO: 140973 - protein, 469 aa, Heterodera glycines
  misc_feature (63)..(63): Xaa can be any naturally occurring amino acid
  misc_feature (194)..(194): Xaa can be any naturally occurring amino acid
  misc_feature (341)..(341): Xaa can be any naturally occurring amino acid
  misc_feature (398)..(398): Xaa can be any naturally occurring amino acid
  misc_feature (411)..(411): Xaa can be any naturally occurring amino acid
  misc_feature (415)..(415): Xaa can be any naturally occurring amino acid
  Coding regions on vcDNA: vcDNA=SeqID_67396; Strand=+; Position=1 -264,300-365,392-642,674-716,774-1078,1257-1438,1477-1565
  Homolog annotation: Hit_ID=EAA17111.1; Match level="QueryCoverage =94%, HitCoverage=93%, E-value=2e-55, Identity=39%"; Hit description =hypothetical protein [Plasmodium yoelii yoelii]
HQRTGAFGGANASPQQQVGGNRNHWSNDPAAGSPTATLLRLLPGKPLRLNRFQSAYRPKPEHXPSPNFSKWLSPGSDGRCVQRAGTNSSFTDNNCNVRSQNSSFTDNNCNVRSQSRQIFTGFTLILPVARVQPRTSKGITDLLSRQIFTGFTLILPVARVQPRTSKGITDLLLLNFVRLNTENPSKKLCPQKQXANYLVGRVSLVIGINQTNRHELRTAMHHHPPNHEKAINLFPVLSQIKPQAPLLHEKAINLFPVLSQIKPQAPLLNRKTFVSGKLNRKTFVSGKLPTRANKSRRIASWHRLRSELGRYLIAFELKTFLPKCFRCSPSCYGPRISPLTXQYEWPRLSLLTIISVSKTNNRTEILFYYSIFLTAAIILCILRAGITAAAGTRLALSXILVKGFKLYPFRXPASXEIGLVISRHYLLALRVAISQAPSPEISQAPSPESNPYPPLPVITMVVRYTTIES

SEQ ID NO: 140974 - protein, 93 aa, Heterodera glycines
  Coding regions on vcDNA: vcDNA=SeqID_67397; Strand=-; Position=1 -93,699-887
MDTEQIPQRPRTVDTEEYVRTRIEQIAELLELWRYVLVPILFITFVLPLAFTFQILNLDMLIHVQKDNVTFTLDNNERTANDVRNKIKMRNFI

SEQ ID NO: 140975 - protein, 71 aa, Heterodera glycines
  Coding regions on vcDNA: vcDNA=SeqID_67398; Strand=-; Position=1 -207,907-915
MPHPLTIFLNNQGQRVVENGVLEKTRIGRTTNATGPTLLCRRERDNAKGKVPKGKVPKGHATKANWQQMKI

SEQ ID NO: 140976 - protein, 127 aa, Heterodera glycines; identical to SEQ ID NO: 133730
  Coding regions on vcDNA: vcDNA=SeqID_67399; Strand=-; Position=1-384

SEQ ID NO: 140977 - protein, 30 aa, Heterodera glycines
  Coding regions on vcDNA: vcDNA=SeqID_67400; Strand=+; Position=1-157
NFHISSGRINQIAASERCQAPLLQPSCKDG

SEQ ID NO: 140978 - protein, 120 aa, Heterodera glycines
  Coding regions on vcDNA: vcDNA=SeqID_67401; Strand=-; Position=1 -74,181-245,307-367,772-886,1392-1436
  Homolog annotation: Hit_ID=CAE72726.1; Match level="QueryCoverage =100%, HitCoverage=23%, E-value=6e-26, Identity=45%"; Hit description= Hypothetical protein CBG19964 [Caenorhabditis briggsae]
MVGWGWMKGPVNGPYYATYAQYFRRFFEEYAKQNLTFWALTIENEPGAGLLPFWSWQAMYLSATTQRQFAATLLGPELKKSVASKNVKIMAHDDQRSNVYEQAETFYGTPGGEQTIDGVA

SEQ ID NO: 140979 - protein, 53 aa, Heterodera glycines
  Coding regions on vcDNA: vcDNA=SeqID_67402; Strand=+; Position=1-161
MIGTPHYYMGRPIEMAKSSHRETCRLETENLSPETSQLENQDSTLTDQDQFAD

SEQ ID NO: 140980 - protein, 76 aa, Heterodera glycines
  Coding regions on vcDNA: vcDNA=SeqID_67403; Strand=+; Position=1-231
MGSDSHILPGTRVSKMDPGKDYYRTKSPVLTGFQGSARLFKTRTLVSDCKFFAERLSEMGPGQDPGLKVLYFDIAP

SEQ ID NO: 140981 - protein, 24 aa, Heterodera glycines
  Coding regions on vcDNA: vcDNA=SeqID_67404; Strand=-; Position=1 -52,295-317
MEKACNIWRDYIDFSALELLELAS

SEQ ID NO: 140982 - protein, 338 aa, Heterodera glycines; identical to SEQ ID NO: 130842
  Coding regions on vcDNA: vcDNA=SeqID_67405; Strand=+; Position=1-1017
  Homolog annotation: Hit_ID=NP_917837.1; Match level="QueryCoverage =96%, HitCoverage=15%, E-value=1e-39, Identity=35%"; Hit description =B1158C05.18 [Oryza sativa (japonica cultivar-group)]

SEQ ID NO: 140983 - protein, 62 aa, Heterodera glycines
  Coding regions on vcDNA: vcDNA=SeqID_67406; Strand=+; Position=1 -28,131-207,271-354
MAILHQQTGEVNCESISLDNDGQSDGKATDPQQQKEFVEKCAKMEMDFKISTLELEKVGFHR

SEQ ID NO: 140984 - protein, 131 aa, Heterodera glycines
  Coding regions on vcDNA: vcDNA=SeqID_67407; Strand=-; Position=1 -120,265-540
MSKRTTPKQNGSVMNMDLSNSLANKTDLTDLDLRMVDDPQHCLPSSSGASSSVPVNVQPPNHSEHSLISRARFDARAPAIDLRMRYKLNGLRYFQDIAVPFRAQSGKIQKFRAKTFAGAVPIRRSNMKKSH

SEQ ID NO: 140985 - protein, 110 aa, Heterodera glycines
  Coding regions on vcDNA: vcDNA=SeqID_67408; Strand=+; Position=1 -211,386-505
MPCSFGLLALSTTPIARPVPREMPALPDRPAPPASRANAMAAGPKSPKKRSTNPASAALTTSSMACASPGATSKKSDPLAPRDRPALPDRTDRPENVNANTEDDAEDGPR

SEQ ID NO: 140986 - protein, 183 aa, Heterodera glycines
  Coding regions on vcDNA: vcDNA=SeqID_67409; Strand=-; Position=1 -135,200-284,336-386,425-534
  Homolog annotation: Hit_ID=AAH64436.1; Match level="QueryCoverage =97%, HitCoverage=27%, E-value=5e-39, Identity=50%"; Hit description =Unknown (protein for IMAGE:4030575) [Xenopus laevis]
VPLFDFLALSHKQKETLLKLVVLSLSAIVSFLVRLFAVIRFESVIHEFDPYFNYRTTKYLTEHEFDPYFNYRTTKYLTEEGYYNFHNWFDAFAWYPLGRIIGFAWYPLGRIIGGTIYPGLMLTSMFIHRFLNLLNVTVDIRGTIYPGLMLTSMFIHRFLNLLNVTVDIREVCVFLAPLFSSFT

SEQ ID NO: 140987 - protein, 127 aa, Heterodera glycines
  Coding regions on vcDNA: vcDNA=SeqID_67410; Strand=+; Position=1 -70,436-749
MRFGEAGELWGSFWGCQTFTCKDEHGKDIFRINGCAERKDRKCSKVYYTHCMKIGGLSYCSHCDDLVDGKVCNSFDQLINLDQSDDQLNSILKSNTNSTSKAEKLGPASAFTWISSNLLLIFGNGEK

SEQ ID NO: 140988 - protein, 121 aa, Heterodera glycines
  Coding regions on vcDNA: vcDNA=SeqID_67411; Strand=-; Position=1 -56,358-503,863-1026
MGRPKDGPTKLRISQIEIRSHPEESDLYELPAFLRFDWANYERWTVTDQQQNPFGGDYRFVYFGTKGRRKHFDQPQRDQRVQSPPFGPTAGASPDGSPCGDFGCARTDDGGRIREAMRSEK

SEQ ID NO: 140989 - protein, 19 aa, Heterodera glycines
  Coding regions on vcDNA: vcDNA=SeqID_67412; Strand=-; Position=1 -33,334-360
MALKFALRQQKLPLALPSA

SEQ ID NO: 140990 - protein, 88 aa, Heterodera glycines
  Coding regions on vcDNA: vcDNA=SeqID_67413; Strand=-; Position=1 -138,179-305
PHSSVLDCTDLLLTVDDCPGDFPFVASAHATIRYVCRGTATTLDKAICPPGGAILFWPFSSIGALRDDYFASIIELRLRSPGALLIPS

SEQ ID NO: 140991 - protein, 137 aa, Heterodera glycines
  Coding regions on vcDNA: vcDNA=SeqID_67414; Strand=+; Position=1 -210,252-366,447-535
  Homolog annotation: Hit_ID=NP_497826.1; Match level="QueryCoverage =78%, HitCoverage=76%, E-value=8e-15, Identity=47%"; Hit description =ethanol induced 6 like (15.4 kD) (3F241) [Caenorhabditis elegans] emb|CAA86749.1| Hypothetical protein C1
MVRRGGRSSSPKASAPVRSVKSTSPARSAVPSRPAGTQPTSGATAPQQKGPGLLGQMAATAGGVAIGSAMGHAIGNMFSGGNAQEVAAQQDVPANSDNFETTKQYSQPFLRTRAKVASPRDSTTSSIVEKLALAVRP

SEQ ID NO: 140992 - protein, 37 aa, Heterodera glycines
  Coding regions on vcDNA: vcDNA=SeqID_67415; Strand=+; Position=1 -49,173-237
MGIEETIKMDRIEIVKDLAAYELTIGYSRILTSDDEL

SEQ ID NO: 140993 - protein, 72 aa, Heterodera glycines
  Coding regions on vcDNA: vcDNA=SeqID_67416; Strand=-; Position=1-216
  Homolog annotation: Hit_ID=NP_495003.2; Match level="QueryCoverage =93%, HitCoverage=36%, E-value=3e-14, Identity=54%"; Hit description =putative protein of bilaterial origin (2F649) [Caenorhabditis elegans] gb|AAN63414.1| Hypothetical protei
MLKPFVFLFLILSSTKYICPNKHKDIRDYTDADIEKLYDQWEENDEDELPEDEKPPCQRKRPQIDLESLQQR

SEQ ID NO: 140994 - protein, 47 aa, Heterodera glycines
  Coding regions on vcDNA: vcDNA=SeqID_67417; Strand=+; Position=1-143
MTKSFLERDNFESELGATQQDDPFGEDFCDISSNEIIDVFADGDLAG

SEQ ID NO: 140995 - protein, 28 aa, Heterodera glycines
  Coding regions on vcDNA: vcDNA=SeqID_67418; Strand=-; Position=1-86
NSCGNIKARKYYARLCSLCTALGPTLYV

SEQ ID NO: 140996 - protein, 353 aa, Heterodera glycines
  misc_feature (27)..(27): Xaa can be any naturally occurring amino acid
  Coding regions on vcDNA: vcDNA=SeqID_67419; Strand=-; Position=1 -701,740-1081
  Homolog annotation: Hit_ID=NP_502797.1; Match level="QueryCoverage =92%, HitCoverage=92%, E-value=8e-57, Identity=37%"; Hit description =HASI (4P602) [Caenorhabditis elegans] emb|CAB16520.1| Hypothetical protein Y57G11C.19 [Caenorhabditis ele
RENFFQKIFFNLKSPAKFSGIQKIFKXGQKRYPEITTDEVNKFLEKQKTYTIHKPIRKRFLRLKTVPSGFHTDWQCDLCIFDQLKKHNDGYKYLLVCIDVLSRMIFSAPAKSKKSEDMIEAFDHVFEKSKIIPMKIYSDSGLEFQAGKIKNILRKNFIKNVMYSPDLHAGVVERANRTIKERLYRYFTKKDTLRWVDVIDKIITNINNSVNRTLGAKPSSINLKMPVRSGKNKFKIGDIVNKFKIGDIVRITKEKGKFSKGYLPNFTEELFKIVVANSTTPDSYRIEDLEGNLIKGIFYNQELVKTWMIFTLYYLRTHQGRRTLRQNSQFTPRDFGIGHKLVSSSLINYLPLL

SEQ ID NO: 140997 - protein, 28 aa, Heterodera glycines
  Coding regions on vcDNA: vcDNA=SeqID_67420; Strand=-; Position=1 -49,454-491
MDKYSITNCTIFVLSYKFYTVFVSVTVE

SEQ ID NO: 140998 - protein, 127 aa, Heterodera glycines
  Coding regions on vcDNA: vcDNA=SeqID_67421; Strand=+; Position=1 -129,183-236,617-721,784-875
LQYLTRLLLIQSHLSSNSYKSSCTTCVSSSHQQHYSTVTETKTVYPVKTYSWCTGTACGAQAQPVQPVAPAASGGGTSISTGSSCSSGTCGQQKQQVQPVAPVQPAAPASTSSCSGGSSCGATAQEV

SEQ ID NO: 140999 - protein, 68 aa, Heterodera glycines
  Coding regions on vcDNA: vcDNA=SeqID_67422; Strand=-; Position=1 -94,185-297
MHAFCARAIYHRACQSKAKQQRCCFERIKGIESVYRLLEKFICNLSTILRSELEMINFTIQTSFRCSN

SEQ ID NO: 141000 - protein, 35 aa, Heterodera glycines
  Coding regions on vcDNA: vcDNA=SeqID_67423; Strand=-; Position=1-106
AFRAKKRNAKCETPKNANNAKGEMRKAKPRPIPAA

SEQ ID NO: 141001 - protein, 111 aa, Heterodera glycines
  Coding regions on vcDNA: vcDNA=SeqID_67424; Strand=-; Position=1 -6,312-419,474-571,1045-1168
MMVYAVTLSEKYSVEELREYTGSENNLYTNARIDQFIQEVGNSISRCPGGQRVGFVHVTPVPDVEASVTPTPFELNATISISSAKAKDGNPKKQNKEDEVAKARDQVILSR

SEQ ID NO: 141002 - protein, 24 aa, Heterodera glycines
  Coding regions on vcDNA: vcDNA=SeqID_67425; Strand=+; Position=1-80
RTLSTAVRQRSSKIYSMPQILWAG

SEQ ID NO: 141003 - protein, 164 aa, Heterodera glycines
  Coding regions on vcDNA: vcDNA=SeqID_67426; Strand=+; Position=1 -70,257-654,1108-1134
  Homolog annotation: Hit_ID=NP_509377.1; Match level="QueryCoverage =59%, HitCoverage=19%, E-value=9e-09, Identity=37%"; Hit description =predicted CDS, reverse transcriptase like family member (XI784) [Caenorhabditis elegans] gb|AAB37984.1| H
MTQSELKILYSLRQQAYQANIAAEHIAQKYDPSIFIINETWLNPRNTIENELSINGRYRVMLANRNEKKGGGSAILTKTNIPYQTLFSGTKFQSEILHIKLLFKKPIQIINIYRPPNCTVQNTKKLLKFISDQSDSENIIYCGDFNIPNILWDENKRNYGYISL

SEQ ID NO: 141004 - protein, 494 aa, Heterodera glycines
  misc_feature (486)..(486): Xaa can be any naturally occurring amino acid
  Coding regions on vcDNA: vcDNA=SeqID_67427; Strand=+; Position=1-1506
  Homolog annotation: Hit_ID=NP_510671.1; Match level="QueryCoverage =99%, HitCoverage=50%, E-value=1e-80, Identity=35%"; Hit description =predicted CDS, endonuclease/exonuclease/phosphatase family and RNA -directed DNA polymerase (XR69) [Caenor
NILRKLPRRNSTSPDNVPYIIKNCAEPITKFLADIFRLILDSGQIPEIWRTSLVVPIYKGEKTDPLNYRPVSLTSTVCRVFERILSSKILEFLNSIVDKEQFGFLKNRSTTTQILKTMDDIYNSLQKNQQIDIIYIDFVKAFDSVPIDLLLQKIKKIGIEGKIQNFLTNFLKNRSFKVKIGEELPESFKIFSGVLQGSVLGPLLFLIFINDLPSFIANEASSVGIKMYTDDVKLYYAHENDDKTNHLDKAIEALEKWSKINGLEISTGKCFVLYLGKNNMKKDYLINSKKISESDNVRDLGIIIDSKLHFSGHINKIVRNAYLRVFQILRVLKTREIKTLTTAYKTFVRPQLEYATEVWNPNLKKDIDKIERVQKFFTRKAFRKCGFLYKKYKERLKITDLHKLEERRKINDLTTAFKIIKGFTSLEAEKSFFFSERPRRPLLLRDTAKTQNNFFNRIVKNWNNLPVVAVQINKAKEFSTKSNEFXVGFSILPY

SEQ ID NO: 141005 - protein, 67 aa, Heterodera glycines
  Coding regions on vcDNA: vcDNA=SeqID_67428; Strand=+; Position=1 -94,185-241,593-645
MHAFCARAIYHRACQSKAKQQRCCFKRIKGIESVNRLLEKYICNLSTILRKSVNRLLENIFAIYQQF

SEQ ID NO: 141006 - protein, 77 aa, Heterodera glycines
  Coding regions on vcDNA: vcDNA=SeqID_67429; Strand=-; Position=1 -130,414-517
MPIYDMTPQHVGRGKTVAELIAEDQANSGQDLLAEIQHRPKQREEINQLLESQRSGPSNFGQQMDELWDASSDEDKS

SEQ ID NO: 141007 - protein, 22 aa, Heterodera glycines
  Coding regions on vcDNA: vcDNA=SeqID_67430; Strand=+; Position=1-69
PLYGTGANTLCVVNFMLILALF

SEQ ID NO: 141008 - protein, 95 aa, Heterodera glycines; identical to SEQ ID NO: 125597
  Coding regions on vcDNA: vcDNA=SeqID_67431; Strand=+; Position=1-816

SEQ ID NO: 141009 - protein, 137 aa, Heterodera glycines
  Coding regions on vcDNA: vcDNA=SeqID_67432; Strand=+; Position=1 -78,390-524,574-774
MLRDDVGEAPKRRKNDKKRRGRKKNKKNDGTQNHQPLTTDDIFGTGAVNLPKTEHSQPAKELSEETILDEELPPAPADLPPFDAFPSPPPSSSKRRNTTIGTQLPQLPDYGKRNLIIIRDFLDAQSPNPRFWCRWRD

SEQ ID NO: 141010 - protein, 195 aa, Heterodera glycines
  Coding regions on vcDNA: vcDNA=SeqID_67433; Strand=+; Position=1 -290,630-782,898-1041
  Homolog annotation: Hit_ID=CAE69821.1; Match level="QueryCoverage =82%, HitCoverage=50%, E-value=4e-30, Identity=42%"; Hit description =Hypothetical protein CBG16139 [Caenorhabditis briggsae]
LVEDISDQYDDSEQPTIIHHEPATPTTMFDNYGPIEKIVVVGTGLMGSGIAQIAVESGVKVCLVGRSQEKCDQTRLKINTGVQKSIKKRMANETAEAQQQLVEATMESLELVTNLDEAGLSDADIVIEAVVENLKVKQKLFIELEAKVSEKCLLVTNTSSFLLEDVSCKMGAAKREQFGGLHFFNPVPAMKLVEV

SEQ ID NO: 141011 - protein, 201 aa, Heterodera glycines
  Coding regions on vcDNA: vcDNA=SeqID_67434; Strand=+; Position=1-606
MYFGFICAILAFSLYMGEGMPINPPPDENDCDFTTDLEVLAACKQRYINRRRGLNPDQNEPRIGSKLDKYKEQLKCVKTNDHKRKRKITDEDRQEKIELYKRLKSNPKQKNRRMLGHLSKLLNVEPSKQNAQTDQSFENESAGQSSSQPSTSDAHRSVSEEQSLSDDDQLVPDYSTAAAENSSKNLPKESTSEKRNGSESN

SEQ ID NO: 141012 - protein, 126 aa, Heterodera glycines
  Coding regions on vcDNA: vcDNA=SeqID_67435; Strand=-; Position=1-381
MKRRFAVVALVAYLLIGALTTTCEAAPYAKLSKPVAKDDQKEPGAIVKPSPENQASLNRIHSFSASSLPSQSPASPPHVQPKASFQRVDSISSASSSTANPTADNQIDTLPPKKRFSKLRITKTKE

SEQ ID NO: 141013 - protein, 62 aa, Heterodera glycines
  Coding regions on vcDNA: vcDNA=SeqID_67436; Strand=+; Position=1 -171,307-324
MLSNSHCLSLLSLALFDNFSGGKPKKIFNENYILLFIGFIEFFCDEVNLLEGREKLNIVNKN

SEQ ID NO: 141014 - protein, 85 aa, Heterodera glycines
  Coding regions on vcDNA: vcDNA=SeqID_67437; Strand=-; Position=1-258
MGKKGPSFFRKIRQNQAKMGESGKTGASQWQRTHELTTAAADAVEALAEHLRDYNVAVSILLVTIAAGLAEMNNHYKGNFKGNRK

SEQ ID NO: 141015 - protein, 33 aa, Heterodera glycines
  Coding regions on vcDNA: vcDNA=SeqID_67438; Strand=+; Position=1-100
MGVNGSVTEFANKIRELVEQASPDPHYTDEARE

SEQ ID NO: 141016 - protein, 155 aa, Heterodera glycines
  Coding regions on vcDNA: vcDNA=SeqID_67439; Strand=+; Position=1 -138,663-949,994-1036
MGAETYSNWKQCHQGNGNCQFPWKIIANFAKTVAKENHRIQTDQHLAFASASSPANFIIYISFASSFAASVVPFELTNEKTREQLALKRANDSDHFLLIRCPIAREASKWTKWEEEAIGWEIHDQWNRISIQVYHKEEIGDGLLDEIPGPSDQQK

SEQ ID NO: 141017 - protein, 51 aa, Heterodera glycines
  Coding regions on vcDNA: vcDNA=SeqID_67440; Strand=-; Position=1-411
  Homolog annotation: Hit_ID=EAA16545.1; Match level="QueryCoverage =76%, HitCoverage=22%, E-value=5e-09, Identity=79%"; Hit description =hypothetical protein [Plasmodium yoelii yoelii]
LADEAFGYLKRVIVTPAVYPRLIKFPWLNIQSTGQKSDTVNVHKDHPSPLF

SEQ ID NO: 141018 - protein, 475 aa, Heterodera glycines
  misc_feature (452)..(452): Xaa can be any naturally occurring amino acid
  Coding regions on vcDNA: vcDNA=SeqID_67441; Strand=+; Position=1 -35,2111-3535
  Homolog annotation: Hit_ID=S60004; Match level="QueryCoverage=89%, HitCoverage=31%, E-value=2e-59, Identity=33%"; Hit description =hypothetical protein - common roundworm retrotransposon R4 (fragment) gb|AAA97394.1| reverse transcriptase cod
YRSRKSLGAARCVLRHLNVAVYAAGYVLAEGNKERRQVIRRQSAEWLLRQKSEINNIRRHIGWITDELTRRRTGKNPTSRQLSNFAWLQRRYQVLGKPGETRDLEVQRERLVSRLRLAQDRVNSSMDREERARKRMLPLRRKLEEPLGDSKLDPKQARTFWASLIGERKEFGKIPELENWAEEVRSKVTDGQGFASDHVDQTVWKKIRKARPLKAPGPDGIPNLLWKRLPSANQALFKWLMGIKRKQLSVPSWLTKGRVVLLPKGGDPVDPANYRPIACLNTQYTGMVTAWVSEHLTTYSILPIEQRAMVSGTWGCTHAMVIDRAITSYAEATGLLYVGFVDFAKAFDSVSQPWIRYALKVAGVHKRIRCLIGILMKCWSVRYEVFKSGRVLRSALLAVKNGVLQGDTLSPLLFCLSVAVVSSAVGSLFDFEVTIPGRGVMQQQNHVYMDDXGFASEASLTDVVTLERTASALEN

SEQ ID NO: 141019 - protein, 91 aa, Heterodera glycines
  Coding regions on vcDNA: vcDNA=SeqID_67442; Strand=-; Position=1-763
FIATTGKRDQYDQLLRSSRSIPVCWTNGAAPSSQTEGLPPPFARQTAHQRPAQWFRPLWQCHRFRPLFAFCRRPPYLEVKVLLRRQSCYYL

SEQ ID NO: 141020 - protein, 136 aa, Heterodera glycines
  Coding regions on vcDNA: vcDNA=SeqID_67443; Strand=+; Position=1-412
SFSRTKRFNLYVPDGYAYYWRDLQEEQRFSGTRWWMISDSVCRTYGFGKTPLVFIDGGTTPKATKKFWKMSCCRTWARFPAIHFTFQQNNASIHVSRNTTSGSSPLNPVILQFIRSKMYQLLYFSPPIMDLNYFVE

SEQ ID NO: 141021 - protein, 60 aa, Heterodera glycines
  Coding regions on vcDNA: vcDNA=SeqID_67444; Strand=-; Position=1-183
  Homolog annotation: Hit_ID=CAE66848.1; Match level="QueryCoverage =96%, HitCoverage=30%, E-value=1e-12, Identity=56%"; Hit description =Hypothetical protein CBG12220 [Caenorhabditis briggsae]
FCKQSETSVGMRNYIEHSLTKFATENPYCAIYVVPGRNATPVLRAEYSNGRLVHVNAKAF

SEQ ID NO: 141022 - protein, 82 aa, Heterodera glycines
  Coding regions on vcDNA: vcDNA=SeqID_67445; Strand=+; Position=1 -230,976-994
MSEQKPSQNVGKTESIGQKDTMDGKQQKAQQKNTLEDIGTTALESEPTSEELKNFAKMFKQRRVQLGFTQAEVGQQLIFVPI

SEQ ID NO: 141023 - protein, 1548 aa, Heterodera glycines
  Coding regions on vcDNA: vcDNA=SeqID_67446; Strand=-; Position=1 -54,117-193,244-526,578-715,788-874,1183-1599,1686-2008,2051 -2255,2306-3884,3926-4260,4306-4647,4768-4922,4970-5253,5303 -5585,5639-5723
  Homolog annotation: Hit_ID=NP_001004509.1; Match level="QueryCoverage= 47%, HitCoverage=51%, E-value=2e-75, Identity=29%"; Hit description =si:busm1-180o5.3 [Danio rerio] emb|CAD60788.1| novel protein similar to DNA polymerases [Danio rerio]
VAQLVQPILVNASHQQLAEPFCADGTHNIQFLIGCVAALGQPLPPLCLIVVSVDHRPAQQTPAGPLAVTNCVLRTGDGHRVEASGWQAHAGSLAALCVGSAYWFTNCVSRAKYQRLDCWFRIGVGGPNALVVPHVAPEFPANIAPVVPVQVGAGRDAVRALPNVTNAGDEQREDADLDNNNNNNDNHGLEPRPSRCASRTAGARPTQRRAAEPAERSIDECFVIERSTAMRNVPRNTRGEICELRFLPLEEAQRPDLLMETIIQQLLDRVLAGHPRPSMVGLQLHPPGFDRPYVIGLRPPEQHNAAALAAAIERLNEQSAAGIDLLAGTTVTKVLAVWPLDSIRADPQRGGESLVRIHNPNDRLCLARAVVMGMHDRETRMAGGGGKAAFNLFASRQDQHGPAAAQMLTRAGIAANSDMYTLDDVQRLQQWINNEHGVGQIRLVVLEKEQEYRIVFKGEGLAAKFNLCLVLERGHFNYIGRVEQLFDVPNYCIDCERRADARYHAFGCKVVCRLCLRYGPGYPCQTEQLPNGGSSARKCADCQFVFPNDGCYNFHLANNPPAPMDGRGQRQRQPICQWRRVCRACGRIAYVATHQCPRDQPADDGICRRCNGPHTVDEPCYIQPIDDGSVRQRASIAVDNDDSDDDDDDDEELPLRLCFFDAETSQDTPLQLNNRTVQKHVPLLIVAEVICERCLQAGISVSDGLGRRAPGCVCMTGMVRGQLFRQWSSPPFANAPGDNSASPVGAPAFNQRRFFFHSFDNDGNDPVDQFLDFLLHHGPKKAHTVCIAHNGGKYDFHLVLEALHRRNRPPKHLCTTGLKIYSMRLSGRHQRRVTFKDSINYFFCALDALVKSFQVPDHLATLKPFFPYLYIRRQHLSQRLINLPSQEFYAPDTMKAEKRAQFLRWRWHADNNGNGFQLREQLIMYCVNDVAILRESVIRFRQLIADNTQGLDPFLHASTAAGLALATFRRCFLPANRLVHSPEGGYLRGRRASAESQRYIRFFELEHPEAQVQCASWSVGEAHIEDSGYRVDGLWRREAPLRPLAIEWLGCYYHGCPACFPDRQQQLAAGRTAEDLYERTERRLFELENDHGCEIHKVWACQWTERLRHDPNLKRRYDAVFVPCPLDPRNDALRGGRTEPFKLHHVCSDDEEIMCIDIVSLYPYVMKANRFPVGNPRVLTREVLLRPPTVPLPWNAPENNIFRGLLLARVLAPRNIRVPLLGYRTKDGRFTFPLCAWCADRRQQRPCRHEDDKRSWVTAYTHVELNKALQLGYVVTDLFEATGWPEGCVTDEQQKAFVDDFERTEGIRLDSTKMEFNPGLRLIAKTLANSLWGKLAQRVGQTEICYTRTPAEFHALLDDPTVDKLDFVHVSDHMDRCVVRKRPEFAKAPLTNCLPVAAFVTSYGRLHLYDYMEQVSAIVGAELLYCDTDSIYYVNKMGGPCVAEGEALGQMKREHTDRRIVEFVAGGPKNYGIRHTARDGTDERANLKIRSFRLSYTAQQLLTFEAMKNLTLATYNIDGPIDDALDNDDLYVYGGGEHRAIRVNFPQN

SEQ ID NO: 141024 - protein, 231 aa, Heterodera glycines
  Coding regions on vcDNA: vcDNA=SeqID_67447; Strand=+; Position=1-696
  Homolog annotation: Hit_ID=NP_701480.1; Match level="QueryCoverage =89%, HitCoverage=6%, E-value=1e-11, Identity=28%"; Hit description =hypothetical protein PFL0575w [Plasmodium falciparum 3D7] gb|AAN36204.1| hypothetical protein PFL0575w [Pl
MKFRLLYLPILFFVIEINQIKIENKKLPQKSFDEIFGEKWEEKEGKQRNEKNKREIIEKYYKIKEKIKEKGRKYSEKEWRKIEVKIAKKLGTNRTYIQKWNKEFGLQKKKSYKSKTDEEKRQIIQKFIKMKNEFKQKRKYSRKEWQQNYEEICKKIGVNRGTIKKWKKQFGISCKITEKEKMEKMKKYWKIKRENPKMSDKETAKILQIDRTTISKWKKQFGGEILEDLNG

SEQ ID NO: 141025 - protein, 134 aa, Heterodera glycines
  Coding regions on vcDNA: vcDNA=SeqID_67448; Strand=-; Position=1 -115,196-416,463-531
MDQQQKIKTKRNKFKLEHDGALYVFDQLSADGLKKFWRWRLHTDLNNVVQKLVGVHSCDMNAAHVECQRLVTGLKRRAAETCEASATIRAQVLQNTCTPVLAAFPSKYATKKVIKRLRRDENAPRVEPLNLEQL

SEQ ID NO: 141026 - protein, 44 aa, Heterodera glycines
  Coding regions on vcDNA: vcDNA=SeqID_67449; Strand=+; Position=1-197
  Homolog annotation: Hit_ID=NP_503146.1; Match level="QueryCoverage =100%, HitCoverage=14%, E-value=1e-12, Identity=77%"; Hit description= TFII(Two)B general transcription factor (33.1 kD) (ttb-1) [Caenorhabditis elegans] gb|AAG24202.2| Tfii(t
EIGEIAGATEVTVRQTYRLLLPKALELFPPDFRFETPIDQLPTS

SEQ ID NO: 141027 - protein, 65 aa, Heterodera glycines
  Coding regions on vcDNA: vcDNA=SeqID_67450; Strand=+; Position=1 -103,1547-1738
TKLRLFKLYNMDQQQKIKTKRNKFKLEHDGALYVFDQLSADGLKKFWRCEFHGPSDKKILIIFSV

SEQ ID NO: 141028 - protein, 109 aa, Heterodera glycines
  Coding regions on vcDNA: vcDNA=SeqID_67451; Strand=+; Position=1 -135,211-405
MSQNRDENSQPPVPDGPYPLAQERNEFVEDEAPVLLEMLDRLSQGGICQAMGLFSFALADCLATFHTFAILFDCETPVPFDEQHKRYVFEHRDKPRLIYVSEDGSVIQA

SEQ ID NO: 141029 - protein, 96 aa, Heterodera glycines
  Coding regions on vcDNA: vcDNA=SeqID_67452; Strand=+; Position=1 -66,120-197,787-930
  Homolog annotation: Hit_ID=CAE73276.1; Match level="QueryCoverage =51%, HitCoverage=13%, E-value=9e-09, Identity=55%"; Hit description =Hypothetical protein CBG20694 [Caenorhabditis briggsae]
MWAMEHQGDMEMEIGGNVENQRGWLSQDELVMRSSSDELDKLSTCLSEASSETQERRRPSLISDIVQAQLALWTLVLTVFYSYAWQQHRKKFLLSL

SEQ ID NO: 141030 - protein, 81 aa, Heterodera glycines
  Coding regions on vcDNA: vcDNA=SeqID_67453; Strand=-; Position=1 -87,381-539
MSNTKAAGQSAAGASEIADQVEQKHNAMKSTYDKVLALLEEKEGGNEERKQRAEELRKRTTELLAKIKRSREEKICELFFY

SEQ ID NO: 141031 - protein, 60 aa, Heterodera glycines
  Coding regions on vcDNA: vcDNA=SeqID_67454; Strand=-; Position=1-508
QLLDLNFLTLTYINKGGGGVDKKFFGLIILLIDGCAFAKNIGQMARNLKKSIRLRIYLQA

SEQ ID NO: 141032 - protein, 261 aa, Heterodera glycines
  Coding regions on vcDNA: vcDNA=SeqID_67455; Strand=+; Position=1-784
MEENFGQPSVRSRMLAQGRALRERVGREGNQNQILAEKAFRFEFERQSAHSSSDEKSLGRSGYEGRAEQEQTLVEGLKAELLRVKDERDVAEAKVEILLQKLSDKEQIFNFLKTNNVKLLVEREQIRCEFLSMEDELKTVKEKLEMAEQENGHFSILSVQQNLMAQEQSRKIMALMEEVEEMKAKNSGEQEEFLKNSENRIAEPKKSVSKLPLKLNIVKKRNPKIAKPKKISQKPEAGKCNFLPLNSIIFRKPPPQFKPNY

SEQ ID NO: 141033 - protein, 195 aa, Heterodera glycines
  Coding regions on vcDNA: vcDNA=SeqID_67456; Strand=-; Position=1-585
MDNNSADPVTKQLLQICVALLQQVQNQQAVISEQDHQLQHFRQQKMMEEAIQDHERRRSVVVQGLPEPAGDKPSERVAADRSELSHVLDELGVECPISSYRMGPPYQAGSGHRPRLIKIILPASKFQRQLLAEWNKKRAHIKQSGKWQHLNIRPSLSPAELEERRAMQKECTERRKAEPNADWIIYAGNIVKRSE

SEQ ID NO: 141034 - protein, 119 aa, Heterodera glycines
  Coding regions on vcDNA: vcDNA=SeqID_67457; Strand=+; Position=1-358
MGRRTLSKHDKFERNVTFFLAVLGLSIALFIYVSAKIDTVASDMSDEIITLHALQSKFNEHYNEMLKYYNSRILAAQSDFNSRYDRLQSEFIQIQSEFWKKSNKFTERIVNLELEFKRY

SEQ ID NO: 141035 - protein, 214 aa, Heterodera glycines
  Coding regions on vcDNA: vcDNA=SeqID_67458; Strand=+; Position=1 -150,390-561,632-802,854-951,1371-1424
MEDGLPLPMPPSKAKVAARQKAKTSSTTTAAKVVATQNACCSSSSSTAANPPPPSIRIPKGKTPKKVRPRRPEPDQPDDQYELRAVLATAEVVSGGTTHLCLYVDFLDYQGQEDWCLSTKSDALELTHFHDIDSTMDSTLHAIVGRPVAPFLQQRLNARPLFHQLRQQQQNGPQVVEQQLPFVFSSSVDVTPAQRAKANALFEAFKVREGLNEE

SEQ ID NO: 141036 - protein, 82 aa, Heterodera glycines
  Coding regions on vcDNA: vcDNA=SeqID_67459; Strand=-; Position=1-633
AFPRVGPPFNAYFGAVKSGRQAFLRVGPPIVFCISFLYLSLSLSLTHISSFLCFDKPDQKYLKIQANALFEAFKVREGLNEE

SEQ ID NO: 141037 - protein, 86 aa, Heterodera glycines
  Coding regions on vcDNA: vcDNA=SeqID_67460; Strand=-; Position=1 -96,135-252,665-711
MPKQNEIVLKYSFLDLTWFLDIEAVFYAISKTKKCLVVKTIFHISLHNFVSSARIETGIRPLERAARALQEEKMPCGENNISHFTP

SEQ ID NO: 141038 - protein, 102 aa, Heterodera glycines
  Coding regions on vcDNA: vcDNA=SeqID_67461; Strand=-; Position=1-309
MSRVTQMDCIRVYAPFSQSGSGTHIENVVYLELLDLETQQPRTPNRGLMDVDNDPDAAIPDVGPRVPDVDNDPDVERDNGNAAGANDQEPNDFDSSFDDFFD

SEQ ID NO: 141039 - protein, 58 aa, Heterodera glycines
  Coding regions on vcDNA: vcDNA=SeqID_67462; Strand=-; Position=1-438
SKPRKNGVSKNRNYAQKAFQTILALPIPYTIAFIHPIMSAKIIRVPKIACDLSLEKMV

SEQ ID NO: 141040 - protein, 30 aa, Heterodera glycines
  Coding regions on vcDNA: vcDNA=SeqID_67463; Strand=-; Position=1 -75,143-160
MLYLDVKEKSYRGKRAGAETRAPKRKIFVF

SEQ ID NO: 141041 - protein, 41 aa, Heterodera glycines
  Coding regions on vcDNA: vcDNA=SeqID_67464; Strand=+; Position=1 -3,114-236
MCRNRTWQQKRDSKQRKEERLNAARAQIDADVYNGKFFFRR

SEQ ID NO: 141042 - protein, 45 aa, Heterodera glycines; identical to SEQ ID NO: 124527
  Coding regions on vcDNA: vcDNA=SeqID_67465; Strand=-; Position=1-138

SEQ ID NO: 141043 - protein, 117 aa, Heterodera glycines
  Coding regions on vcDNA: vcDNA=SeqID_67466; Strand=-; Position=1 -164,590-778
WEKKDEANGSKKRQSKTQRDEKTTGKRPMEEKGTKKDGERERADEGQRRTERRRDNTLNNPEYRNGECFKIESHSLPSSNVSKPNQPPHFASSSLLKPVPMSKSSSNSLHVGIASTQ

SEQ ID NO: 141044 - protein, 56 aa, Heterodera glycines
  Coding regions on vcDNA: vcDNA=SeqID_67467; Strand=-; Position=1 -215,371-733
FINIFSQTALKRTKFYLQVILGTQMLSLSKREMNKNLKIFNCFLNMRKILGLTFFL

SEQ ID NO: 141045 - protein, 207 aa, Heterodera glycines
  Coding regions on vcDNA: vcDNA=SeqID_67468; Strand=-; Position=1 -42,561-845,977-1273
  Homolog annotation: Hit_ID=AAH25437.1; Match level="QueryCoverage =97%, HitCoverage=51%, E-value=1e-28, Identity=38%"; Hit description =Sdccag10 protein [Mus musculus]
MSSFYINEPVTNGKVVGNTIFNLLKLNEYEVDKNERPIYPHKITSAKVLVNPFDDINPRKATKDDERKRSKREKNATNVAMAATKRNTSLLSFGDEIEEEDEQSEHLTKKFKGKSAHDVLEDELLSRERAVKAEELTTSGDQREAEEADERSREERLDRVKRKLQDQREGKRAKRAAGGKGTTRGDEEEDLEQLVDDEKEAQRREEM

SEQ ID NO: 141046 - protein, 281 aa, Heterodera glycines
  Coding regions on vcDNA: vcDNA=SeqID_67469; Strand=+; Position=1 -90,766-912,1053-1186,1236-1304,1346-1520,1620-1697
  Homolog annotation: Hit_ID=NP_494839.1; Match level="QueryCoverage =97%, HitCoverage=24%, E-value=1e-60, Identity=46%"; Hit description =domain protein (100.8 kD) (2E999) [Caenorhabditis elegans] gb|AAA81130.1| Tudor staphylococcal nuclease h
FSRRRLSAPPDPPPLARSPNKKFVKNLIFDVLSGDSVVLQLPPSVQGAAPTELTVYLANVSAPRLAKRPTENTEATPDEPYAWEAREFLRKKIVGQAVLFMREFQATSGREHGKILLGSSGTSDAENVSESGVSAGWLEVRPGKQSDAENVSESGVSAGWLEVRPGKQIDDYGKKLLDLQEQAKSAKKGRWSEEEIDDYGKKLLDLQEQAKSAKKGRWSEEESAKHIRNIQWTIEEPRELVALYSGKQLDAVVEQVRDGTTFRLFLLPSFEYITVALSGIK

SEQ ID NO: 141047 - protein, 48 aa, Heterodera glycines
  Coding regions on vcDNA: vcDNA=SeqID_67470; Strand=+; Position=1-250
VFEAVPLNRCAQIYGETESFRNSFPIACTLILRWIFAPHNCLSTPNGH

SEQ ID NO: 141048 - protein, 36 aa, Heterodera glycines
  Coding regions on vcDNA: vcDNA=SeqID_67471; Strand=-; Position=1-130
FFEKKNLKNFRLFIKNFGSRNSYPKNVGNRKSFRAI

SEQ ID NO: 141049 - protein, 190 aa, Heterodera glycines
  Coding regions on vcDNA: vcDNA=SeqID_67472; Strand=-; Position=1 -35,84-186,250-314,537-595,638-751,822-897
  Homolog annotation: Hit_ID=CAE69823.1; Match level="QueryCoverage =86%, HitCoverage=6%, E-value=4e-45, Identity=57%"; Hit description =Hypothetical protein CBG16142 [Caenorhabditis briggsae]
TFKSNFVVDTKGAGAGQLTVRVRGPKGAAGAGQLTVRVRGPKGAFNVEMQRDSAQERTIHCKYYEPREPGDYQVEVKWHGHHVPGSPFFVLIVDTEQELQRFLAGGVPSPTPPSPFGGVPSPTPPSPFVPPGWMAPPPPPPGVLPLPPIMPSPPSHEANANVAAPSHEANANVAAPVAGTPTAIYGGRHH

SEQ ID NO: 141050 - protein, 15 aa, Heterodera glycines
  Coding regions on vcDNA: vcDNA=SeqID_67473; Strand=+; Position=1-49
LKAIHCLPVLGTAKH

SEQ ID NO: 141051 - protein, 148 aa, Heterodera glycines
  misc_feature (137)..(137): Xaa can be any naturally occurring amino acid
  Coding regions on vcDNA: vcDNA=SeqID_67474; Strand=+; Position=1-449
  Homolog annotation: Hit_ID=AAP92584.1; Match level="QueryCoverage =81%, HitCoverage=24%, E-value=5e-34, Identity=63%"; Hit description =Ab2-057 [Rattus norvegicus] gb|AAP85373.1| Aa1262 [Rattus norvegicus] gb|AAP85367.1| Aa1011 [Rattus norveg
AWPFLVRGAICLVYSDNERDSSLLNSWLIASGHNFLEGFSVFSRTKLSNNRSVMPLDVRGCTRATLAKSACLPSPKGVGKPVKICRDWDRTLQLLSVNEEFLVGASHQLALNTSLPFVHTARRCPGLSHFEKFGDGXCSGRSVCRLEP

SEQ ID NO: 141052 - protein, 46 aa, Heterodera glycines
  Coding regions on vcDNA: vcDNA=SeqID_67475; Strand=-; Position=1 -101,605-644
MPSMLMDDEHLLSAWTARASHWTSFAITMKKLGRKSGLYSSSTLTS

SEQ ID NO: 141053 - protein, 98 aa, Heterodera glycines
  Coding regions on vcDNA: vcDNA=SeqID_67476; Strand=+; Position=1 -139,231-320,639-704
  Homolog annotation: Hit_ID=CAE73952.1; Match level="QueryCoverage =100%, HitCoverage=21%, E-value=7e-46, Identity=88%"; Hit description= Hypothetical protein CBG21577 [Caenorhabditis briggsae]
GVNYKVGKFPFVANSRAKTNNDVEGFVKVIGDKDTDRLLGVHIMGPNAGEMIAEATLALEYGASCEDIARVCHPHPTLSEAFREANLAAYCGKAINSI

SEQ ID NO: 141054 - protein, 45 aa, Heterodera glycines
  Coding regions on vcDNA: vcDNA=SeqID_67477; Strand=-; Position=1-236
AVLVRFITAPNLLASQQSSLTCQIGRVRMIPQCQAPHQKQNDITK

SEQ ID NO: 141055 - protein, 44 aa, Heterodera glycines
  Coding regions on vcDNA: vcDNA=SeqID_67478; Strand=-; Position=1-132
MASDGQAMAKWLFTPRMDDVPKVLRCWLNKDDGDLASKIEAFKA

SEQ ID NO: 141056 - protein, 57 aa, Heterodera glycines
  Coding regions on vcDNA: vcDNA=SeqID_67479; Strand=+; Position=1 -153,520-540
MAQSPAAPAAAAAASTASAILSAKAAAAAAVDDELGSSGGSGSQTLVEAIQPSPQRE

SEQ ID NO: 141057 - protein, 179 aa, Heterodera glycines
  Coding regions on vcDNA: vcDNA=SeqID_67480; Strand=-; Position=1 -75,127-364,500-726
  Homolog annotation: Hit_ID=CAE70845.1; Match level="QueryCoverage =91%, HitCoverage=30%, E-value=3e-31, Identity=40%"; Hit description =Hypothetical protein CBG17629 [Caenorhabditis briggsae]
MPRPISNKIINIGGLVEMKAKELEPEIKAVVDNSQAGAVIISFGTMVDIKTMKSEMKLAFFEAFARFPDYEFIWKIELSEEEAKMFAKYKNVHPVKWMDQKSLLMHPKMRAFVSHCGLNSVSEAARFGVPILAIPLFADQLYNAILARVKGIAIQLDVGQLNGEGAEQLIIEGLDRAIT

SEQ ID NO: 141058 - protein, 16 aa, Heterodera glycines
  Coding regions on vcDNA: vcDNA=SeqID_67481; Strand=-; Position=1 -4,197-243
MISIGQIDKAYWNLRK

SEQ ID NO: 141059 - protein, 156 aa, Heterodera glycines
  Coding regions on vcDNA: vcDNA=SeqID_67482; Strand=-; Position=1 -58,507-542,759-848,924-1031,1087-1265
MDNVDLLNPSFMPLSKMSHSFLTKFLLRALNAYQKNIKQKMNFVLPLSVICCFFALPWICYGTHCKVGIYETSGYAAIVASECAADQQFCSAIGCALGTEHIVILWACEQQNDTQVIVSRLSFGTYNHTCLAQIGQKGANMSNEEFAFPELNDYIK

SEQ ID NO: 141060 - protein, 64 aa, Heterodera glycines
  Coding regions on vcDNA: vcDNA=SeqID_67483; Strand=-; Position=1 -82,252-364
MANEHVKLPEAQEPDKIPTLPAVALNKSIQCRTGFFRGNGYGKTEVKECVGGEYCYAVSCQIGD

SEQ ID NO: 141061 - protein, 65 aa, Heterodera glycines
  Coding regions on vcDNA: vcDNA=SeqID_67484; Strand=-; Position=1 -79,127-243
MAMIAPFDLLPPIALLVLIAMINQCSPLTCKIGHANHKMGEKSANGKCEDKVPNAQHCFSVLCME

SEQ ID NO: 141062 - protein, 115 aa, Heterodera glycines
  Coding regions on vcDNA: vcDNA=SeqID_67485; Strand=+; Position=1 -70,734-1011
MPGKFNFHLPTEKKLLKMEIYYQISPKQMKLRSEFFAESKLGPFLEEFAGLWLLAADIWPKFGQMPTKFVFMVANGCQLIRVDGPPQKCATFYHLAFEKPRAIRQQIIKPLVGIN

SEQ ID NO: 141063 - protein, 101 aa, Heterodera glycines
  Coding regions on vcDNA: vcDNA=SeqID_67486; Strand=+; Position=1 -148,209-366
MPWTVYFMASLTEYSEYGRRCTASLISPKFVLLAAHCFDKMKEFQPFLLGFGSNSRVFKSPNYDGFVVKMTRVTNLNVFIHPKYTKNGLGLNDLALIKALN

SEQ ID NO: 141064 - protein, 15 aa, Heterodera glycines
  Coding regions on vcDNA: vcDNA=SeqID_67487; Strand=+; Position=1 -31,430-446
MNFEIQLQMLDTLQH

SEQ ID NO: 141065 - protein, 98 aa, Heterodera glycines
  Coding regions on vcDNA: vcDNA=SeqID_67488; Strand=+; Position=1 -145,216-299,612-679
AQQCLRSVNWVRRLVNMIDADRLVHAEAHEFGGIQLPARKLEAFRLVRELLAVVTAHPNLPQNIQQTVGLPISANNRSSVPVCIKIGSSDHDPYYKGK

SEQ ID NO: 141066 - protein, 183 aa, Heterodera glycines
  misc_feature (16)..(16): Xaa can be any naturally occurring amino acid
  Coding regions on vcDNA: vcDNA=SeqID_67489; Strand=+; Position=1 -99,153-293,337-421,475-562
  Homolog annotation: Hit_ID=NP_500372.1; Match level="QueryCoverage =93%, HitCoverage=13%, E-value=9e-36, Identity=49%"; Hit description =OSMotic avoidance abnormal OSM-9, Neuron Specific Serotonin deficient NSS-2, olfactory channel involved i
QKNQIIPPPPLPSANXSLPSSQLHMCVIFNKSTMYRYTMYRYAVRHWSKPAHSYLVNNAGQTPLTLATKLGRREIFDEMLELMKVEFWRFSDMTCSAYPLEALDTIRMKVEFWRFSDMTCSAYPLEALDTIRLDGTTNFDSALTTVVNGDSSDHLFDSALTTVVNGDSSDHLEMIGNEVIQRA

SEQ ID NO: 141067 - protein, 44 aa, Heterodera glycines
  Coding regions on vcDNA: vcDNA=SeqID_67490; Strand=-; Position=1-133
MSSEQNGNDKQIENGEQQNRRRRRDGEGMRKGQMKQKTSTKLYL

SEQ ID NO: 141068 - protein, 37 aa, Heterodera glycines
  Coding regions on vcDNA: vcDNA=SeqID_67491; Strand=-; Position=1 -91,144-205
MGRPFLEHMGGRKYYSCRRCKTYLTNRRELISHTFRG

SEQ ID NO: 141069 - protein, 28 aa, Heterodera glycines
  Coding regions on vcDNA: vcDNA=SeqID_67492; Strand=-; Position=1-179
DKLMGLRSSSGEEQFSTIPARFYEVLIY

SEQ ID NO: 141070 - protein, 95 aa, Heterodera glycines; identical to SEQ ID NO: 124528
  Coding regions on vcDNA: vcDNA=SeqID_67493; Strand=-; Position=1-662

SEQ ID NO: 141071 - protein, 98 aa, Heterodera glycines
  Coding regions on vcDNA: vcDNA=SeqID_67494; Strand=+; Position=1-297
MPIQCLSEHLFWKETNEKHTQFPSVQAATLDTSAKGPVESERPRPPNWEENPVPGRTPRFSWMAPRIFEKAYQISYRGLLPRQPNMQMFRPFKAVDTV

SEQ ID NO: 141072 - protein, 78 aa, Heterodera glycines
  Coding regions on vcDNA: vcDNA=SeqID_67495; Strand=+; Position=1 -139,799-896
MNCAAELVIKPDQIGQLQRLPTVAISKTTKIPKSNLTERHRRRLDEEGFNTGVCTFPPSPSSQLVPDTIPITTVGTKN

SEQ ID NO: 141073 - protein, 98 aa, Heterodera glycines
  Coding regions on vcDNA: vcDNA=SeqID_67496; Strand=-; Position=1-470
RPLPSPLSFLHHFPFALIFSSFHPSITPRSLLRSILTVFPICLLDGHSRLTFSRDKRIIHNFTLNEPNFQILKSFVALNFSIILQNFKNSLSFKKVII

SEQ ID NO: 141074 - protein, 69 aa, Heterodera glycines
  Coding regions on vcDNA: vcDNA=SeqID_67497; Strand=+; Position=1 -24,92-276
MIPGFSNWDAECEGSFAIEPIDGAELRGQCLAKIAKYQTKRKALDKAVGQNFFVGIQTKLWHSDGPSRN

SEQ ID NO: 141075 - protein, 76 aa, Heterodera glycines
  Coding regions on vcDNA: vcDNA=SeqID_67498; Strand=-; Position=1-230
  Homolog annotation: Hit_ID=NP_740998.1; Match level="QueryCoverage =100%, HitCoverage=22%, E-value=5e-09, Identity=40%"; Hit description= failed axon connections family member (31.6 kD) (2F956) [Caenorhabditis elegans] gb|AAM81113.1| Hypothet
VIGSWNLRNAPQKRFPFIELNGERISDSQIILWRLSDYFKIEVIARIIVVTSISYSKDGLDNEQRAKARAIERLIE

SEQ ID NO: 141076 - protein, 41 aa, Heterodera glycines
  Coding regions on vcDNA: vcDNA=SeqID_67499; Strand=+; Position=1-128
GEVPGSERLHVRRCNNDRRMDGRNLKSERPVRRCKDKEDVS

SEQ ID NO: 141077 - protein, 237 aa, Heterodera glycines
  Coding regions on vcDNA: vcDNA=SeqID_67500; Strand=+; Position=1 -16,164-283,457-500,1053-1209,1286-1662
  Homolog annotation: Hit_ID=AAL33791.1; Match level="QueryCoverage =49%, HitCoverage=92%, E-value=5e-12, Identity=30%"; Hit description =fatty acid retinoid binding protein precursor [Onchocerca ochengi]
MGRVKEVVPEEAADFFDQLTGRDKQVLREVLAKADTYQSTGEVLQDLRNGSSTLYDKAVQSVKQLRNALGGGFSLSNLKAQAQQLVARYRQLDASTKEELRNAFPTIAFVLDNPVVQTMASGLFDIKTKDEGPMGERGRERNGEGERGEEGDRDNGGMTRGGGRGEDGGGRGGEVEDEVGERAERRNVVHRRKNRSAVSVASMAALAATSAALVTTNGAMSTMINQQRRSNLGRRDG

SEQ ID NO: 141078 - protein, 18 aa, Heterodera glycines
  Coding regions on vcDNA: vcDNA=SeqID_67501; Strand=+; Position=1 -11,811-856
MGGSKNMPEDYKLEPIDE

SEQ ID NO: 141079 - protein, 85 aa, Heterodera glycines
  Coding regions on vcDNA: vcDNA=SeqID_67502; Strand=-; Position=1 -57,166-366
MHAIRHVIFPTACLLPLRQKQKEHEVIRLVVTLSENGQMPAIGTEFQKKHGLPLASFIVTEAKMATKNTLAKLANAFVEGKNYSK

SEQ ID NO: 141080 - protein, 79 aa, Heterodera glycines
  Coding regions on vcDNA: vcDNA=SeqID_67503; Strand=+; Position=1-238
MPWITAISRKIFEAEMEKKDEGKKEDEMAKEKSNKLKKNMSKLEEILGKQRAEKGKKEQRKERRKVMREIAKPRPKRDE

SEQ ID NO: 141081 - protein, 43 aa, Heterodera glycines
  Coding regions on vcDNA: vcDNA=SeqID_67504; Strand=-; Position=1-306
MNIVFNVTPTPIPHTHKDVLNLFRKYLSIPSFLPTLCCVQLYK

SEQ ID NO: 141082 - protein, 39 aa, Heterodera glycines
  Coding regions on vcDNA: vcDNA=SeqID_67505; Strand=+; Position=1-118
MVPKQGIRASPDKVEAIQKMPTPENLKELHSFLGMVGYY

SEQ ID NO: 141083 - protein, 232 aa, Heterodera glycines
  Coding regions on vcDNA: vcDNA=SeqID_67506; Strand=-; Position=1 -153,199-744
  Homolog annotation: Hit_ID=NP_499260.1; Match level="QueryCoverage =97%, HitCoverage=13%, E-value=3e-96, Identity=76%"; Hit description =clathrin heavy (3L297) [Caenorhabditis elegans] emb|CAA83003.1| Hypothetical protein T20G5.1 [Caenorhabdi
MKADSSRVMEYIQKLDNYDAPDIANIAITDKLYEEAFAIFRKFGVNASAIKVLIENVKNLDRAYEFAEKVNEPAVWSALAKAQLNESLVKEAVDSFVKADDPSAFIEVAKKCNETDHWEDLVRYLQMARKKSRESFIETELCFAYAKTGRLTELEEFITEPNHAQIQLVGDRCAEDGMNDAARILFSSISNFAKLAKTLVELGDFPGAVDAGRKANSTKTWKQVTYELCLLS

SEQ ID NO: 141084 - protein, 237 aa, Heterodera glycines
  Coding regions on vcDNA: vcDNA=SeqID_67507; Strand=-; Position=1 -571,619-761
MLFLLFIFVFLIINNSTDKTLSVNLCKKCRPTFAEIFGEEWQNEIIIGGDENENETDQNANFHQNESTYQNDQLDFQQKKEIIHKFHAIREGIKKRGKYSAKVWVKTEQKIAKKLGISRQKIYKWKKEFGQYLKNNKNYYEKKKKEFIERIDEIKRMSKKGTQKQFAKELGIDEKTLRKWKKEFGIEIGKRYSNEEKMSKMNDYLKMKKANPSLSDKEIAEFLKITQRTLLTWKQKF

SEQ ID NO: 141085 - protein, 954 aa, Heterodera glycines
  Coding regions on vcDNA: vcDNA=SeqID_67508; Strand=-; Position=1 -1936,2002-2929
  Homolog annotation: Hit_ID=NP_491240.1; Match level="QueryCoverage =100%, HitCoverage=71%, E-value=0.0, Identity=37%"; Hit description =zn-finger, CCHC type and RNA-directed DNA polymerase  and Integrase, catalytic domain containing protein f
KPKWHKTQKGGRPNNKQGQSSSAPAQQCWRCGWTNHSHWECKHKSAKCQKCSQNGHLEGQCDKVQEWRRRNKLPIPKRKIGNLRIGTAMKVNSASLFKTDVAVDGKDIKFVLDSGAEIIVIDELSHEVIGSPRLRKCTESGCMFDGTQVKFVGKGVANFKFRNICIKSEYYVAKRGSLNLLSVQMMDAFGLLNELKAKIDAPVNLCRVGDETRGFTKAPKPSQNSTVKAHIDHLKATFPDIFKNELGRCMKFKAHLTLKADAAPVYRKARPVPYNAQEAIDGELERWEKMGVIGKVEYTEWAAPILAVKKADGSARLCIDYSTGLNNALQDHQHPLPLPEDIFATLNGGKYFSQIDLRDAYLQIELDDESRKICSISTHRGNYEVKRLPFGVKSAPAIFQSVMDQILAEFEFATAYLDDVIIVSQSVKEHADHLKKVLEKFQEWGFRIKLEKCSFFREEIKYLGQIIDRNGRRPDPEKISAISKMPAPTDVPSLRSYLGMVGHWQQFVKNMRFVRKPLDDLLKQDSEWKWSEKCKQAFDKIKEILSSELLLTHYDPTKEIVVAADASELGIGAVISHKFPDGTIKAIAHASSALTPAEKNYSQIEKEGLALIFAVQKFHKMIYGRKFTLLTDHSHFLPFSEAKRDIEYISTNDFGQADVLSRLIAKGKSDEDRVIASLRSDSEIDDILIGSIEALPIKFKEIVAAAEADKTIQKVKEFLTNGWPRNVRDESAEIKLFHRIKEQLCITRNCLMYADRVVIPEKLRQKTLHSFHKGHPGIKRMKQLARNYAYWPNMDADIQQMVENCQPCQMEAKAPVKSNLQPWPKPSAPWQRVHIDYAGPFFGKEYLIIVDAFSKYPEVFEMATKSTAATIEKLRYLFSRHGIPEILVSDNGTQFTSNEFAKFMAVNGVNHLFSAPYNPMSNGQAERFVDTCKRTFKKLKGEGAPSKEIIETFL

SEQ ID NO: 141086 - protein, 181 aa, Heterodera glycines
  Coding regions on vcDNA: vcDNA=SeqID_67509; Strand=-; Position=1-543
  Homolog annotation: Hit_ID=NP_491240.1; Match level="QueryCoverage =40%, HitCoverage=5%, E-value=5e-15, Identity=49%"; Hit description =zn-finger, CCHC type and RNA-directed DNA polymerase  and Integrase, catalytic domain containing protein f
MQLSQSGTKPKREEGQTTSKANYHPLRHNNVGDVVGQITATGSVSTSQRSAKNVPKWTFGRPMRQSAGMETEKQFANSKKENWKLKFTFENRCKCTESGCMFDGTQHLKTTFPDIFKNELGRCMKFKAHLTLKADAAPVYRKARPVPYNAQEAIDGELERWEKMGVIGKVEYTEWAAPILA

SEQ ID NO: 141087 - protein, 107 aa, Heterodera glycines
  Coding regions on vcDNA: vcDNA=SeqID_67510; Strand=-; Position=1-324
MAQANIQQLLDAISQLVTAQQQQQNNQPNPNNNVPVPVLPDISDFEPTDEKGRISEWIERFSFAMDCSAPNATDAVKVKALMNKLSETAFSEYSKSCLPSKVTDFDE

SEQ ID NO: 141088 - protein, 71 aa, Heterodera glycines
  Coding regions on vcDNA: vcDNA=SeqID_67511; Strand=-; Position=1 -42,567-678,768-829
MGEISAQSPAKGEESELEINDTTQQELDIEDAARFIATFAELSDGFCVRLGLGAGENMPSGGFCAIAETWY

SEQ ID NO: 141089 - protein, 26 aa, Heterodera glycines
  Coding regions on vcDNA: vcDNA=SeqID_67512; Strand=-; Position=1 -21,269-328
MFEFVRSSWVKDKVKQKKLIEDKKKL

SEQ ID NO: 141090 - protein, 50 aa, Heterodera glycines
  Coding regions on vcDNA: vcDNA=SeqID_67513; Strand=+; Position=1-150
MSKPNKCCLTVVVVVVVGVVVVVGVVVVVGVVVVVVVEVVVVVVVVGVVV

SEQ ID NO: 141091 - protein, 68 aa, Heterodera glycines; identical to SEQ ID NO: 134199
  Coding regions on vcDNA: vcDNA=SeqID_67514; Strand=+; Position=1-316

SEQ ID NO: 141092 - protein, 117 aa, Heterodera glycines
  Coding regions on vcDNA: vcDNA=SeqID_67515; Strand=+; Position=1 -138,188-403
KRSSNNPNLCPTSNSMSDIYGFINNISDRISRRVRRKRPTESGVSGVSGAPPETRKDDKAKGGGCSKKCACIIVCSILTLIVLVIGGLVLAAVLTPETFKNAPLLSLIAGKKNGGAD

SEQ ID NO: 141093 - protein, 247 aa, Heterodera glycines
  Coding regions on vcDNA: vcDNA=SeqID_67516; Strand=+; Position=1 -60,175-292,755-905,1003-1152,1208-1346,1436-1464,1684-1745
  Homolog annotation: Hit_ID=CAE61940.1; Match level="QueryCoverage =96%, HitCoverage=7%, E-value=2e-45, Identity=42%"; Hit description =Hypothetical protein CBG05938 [Caenorhabditis briggsae]
CFDGQRAAENICGGEGVRAKLIQHCKLLLQAKQEELCGRVLMTLCKMASTARTRQYGEGSSIRRDLLLRYFGAGSVQGNGNEREKPRKVIILQPVRISDQLIWPFEISEISLYEIQCKLCDAKAVDLVVDLIVLDPSYDIFLKTVQLAKAMLHGGNEKVQMSFYKRLQERKLVQMSFYKRLQERKLSARFFKVLVQKMQTAQNRVKTDILCGLARTRPALSAVVSRRCTTMSVPLIQQGATGGGGED

SEQ ID NO: 141094 - protein, 341 aa, Heterodera glycines
  Coding regions on vcDNA: vcDNA=SeqID_67517; Strand=+; Position=1 -201,229-384,431-574,681-873,927-1071,1712-1729
  Homolog annotation: Hit_ID=AAK68366.1; Match level="QueryCoverage =99%, HitCoverage=10%, E-value=6e-60, Identity=41%"; Hit description =Inositol triphosphate receptor protein 1, isoform f [Caenorhabditis elegans] ref|NP_501252.1| inositol 1 4
LLLAIMESRHDSENADRVLRNMAHINGGGKQLLKAIAQAYCMPNTQNFELFRMRQKLLCNEQSGREKKSGTFWRTIATKVPFVGPKFAEKPEQSGREKKSGTFWRTIATKVPFVGPKFAEKPQQQNQQQIASPLSKPTNLAFGTLADPREVGHNIYILAHQLARHSAVGHNIYILAHQLARHSAELDVMLPENAKDENTREALAYYRTHTGQIEIVRADRKMERVIFPIHNICAYLTSETKESVFINTEKDAQGSKVTDFFERWPSLYEEMKWQRKLQDRLWLSACTKRRLWLSACTKRLPLWGRMGFFMAVLINLILAVAYPDHEDSSAARPRMFSRYAP

SEQ ID NO: 141095 - protein, 195 aa, Heterodera glycines
  Coding regions on vcDNA: vcDNA=SeqID_67518; Strand=+; Position=1 -75,343-855
  Homolog annotation: Hit_ID=XP_414438.1; Match level="QueryCoverage =95%, HitCoverage=4%, E-value=2e-20, Identity=39%"; Hit description =PREDICTED: similar to inositol 1,4,5-trisphosphate receptor type 1 [Gallus gallus]
MVSSTLLLIALLGLLPSLYLLGIFQLFDVVASEDTLRNVIRSVTRNWQSIILTGLLALILVYHFSIVGYLFFQRGALQNLPIEFLQFIPSDFRLEVHKLSAQRAEEGQKPCPNDLPCEFRFHCDKKSDGEKCDGREKWRRTAEKEKEEEEEEEELKIPSCDTLLMCILTTLNWGDHLGGGKTHSLNGRKFIQMSI

SEQ ID NO: 141096 - protein, 24 aa, Heterodera glycines
  Coding regions on vcDNA: vcDNA=SeqID_67519; Strand=+; Position=1-76
ITGVSIIAVLFLVFLMLSQNLVRF

SEQ ID NO: 141097 - protein, 104 aa, Heterodera glycines
  Coding regions on vcDNA: vcDNA=SeqID_67520; Strand=+; Position=1 -103,148-356
MMSHFEMIGTDNQMFPQNVRLNPGLALCSSAPFGGHIGTSLPSAVTVSPAAVASVGGGELQQFAIPRISQQSQAQPVQGLQFALGQSAIFGGESARDGGGQQTQ

SEQ ID NO: 141098 - protein, 206 aa, Heterodera glycines
  Coding regions on vcDNA: vcDNA=SeqID_67521; Strand=-; Position=1 -114,425-556,636-857,1650-1747,2962-3016
  Homolog annotation: Hit_ID=CAE63869.1; Match level="QueryCoverage =76%, HitCoverage=60%, E-value=3e-27, Identity=37%"; Hit description =Hypothetical protein CBG08434 [Caenorhabditis briggsae]
MSSLLSEVFLNELIIVMVGICILVLSALCLVVNLAVIRPLGAIATPSYVFYTIVTIILAINRLVVLTSDRLDNLLFSPICIKLWFLLPALVSLSFALALSSPWAAIAYWPDQFSWAYDDSRPLSHWVQIVEEIIELGGIPTAGLIYAAIFFTILYKWLLPNTKMAKCALNFMWIANGAVNPIIYFAVNASKMPWFRHSARQGRRRQ

SEQ ID NO: 141099 - protein, 63 aa, Heterodera glycines
  Coding regions on vcDNA: vcDNA=SeqID_67522; Strand=-; Position=1 -69,133-255
MSSFVSLLLLIGLIPLHLTHGNNRIRRDATEEEAENKSAANNSTEEETSKMQHLINLIIHLIF

SEQ ID NO: 141100 - protein, 110 aa, Heterodera glycines
  Coding regions on vcDNA: vcDNA=SeqID_67523; Strand=+; Position=1 -102,217-447
MCSTERYTTAPTYGSTPKAWLVRQLPRNVGQRPQQQVHLQLPCYDFCPVQATAIKSVPVCIPTEAGTLTVPEFLEMAQSRAATGGVYKGQGRIQSELMTRPYKEFLVHGQ

SEQ ID NO: 141101 - protein, 154 aa, Heterodera glycines
  misc_feature (143)..(143): Xaa can be any naturally occurring amino acid
  Coding regions on vcDNA: vcDNA=SeqID_67524; Strand=-; Position=1 -27,141-580
  Homolog annotation: Hit_ID=AAP92584.1; Match level="QueryCoverage =81%, HitCoverage=25%, E-value=2e-35, Identity=63%"; Hit description =Ab2-057 [Rattus norvegicus] gb|AAP85373.1| Aa1262 [Rattus norvegicus] gb|AAP85367.1| Aa1011 [Rattus norveg
IDGRAPPGVFLVRGAICLVYSDNERDSSLLNSWLIASGHNFLEGFSVFSRTKLSNNRSVMPLDVRGCTRATLAKSACLPSPKGVGKPVKICRDWDRTLQLLSVNEEFLVGASHQLALNTSLPFVHTARRCPGLSHFEKFGDGXCSGRSVCRLEP

SEQ ID NO: 141102 - protein, 130 aa, Heterodera glycines
  Coding regions on vcDNA: vcDNA=SeqID_67525; Strand=+; Position=1 -87,134-381
  Homolog annotation: Hit_ID=CAE71845.1; Match level="QueryCoverage =90%, HitCoverage=16%, E-value=4e-34, Identity=59%"; Hit description =Hypothetical protein CBG18887 [Caenorhabditis briggsae]
ESEWVVTRERYKYDEQFNLLQPIDGKISGRVAKEHMLKSKLPNSVLGKRVAKEHMLKSKLPNSVLGKIWKLSDVDKDGHLDSDEFALSNYLINLKLEGHELPTELPKHLVPPSKKAMAGDASSSDNQIYP

SEQ ID NO: 141103 - protein, 34 aa, Heterodera glycines
  Coding regions on vcDNA: vcDNA=SeqID_67526; Strand=-; Position=1 -93,200-211
MPSNFIKYQSFLSGNKNEVLTIKELIDCRLKACW

SEQ ID NO: 141104 - protein, 113 aa, Heterodera glycines
  Coding regions on vcDNA: vcDNA=SeqID_67527; Strand=-; Position=1 -121,165-385
MSHENAGNSVLEFVSAGSKQYSIKYRNDKNGQIWYKTKIRGITFNKKNQIDHDEFKNMIINYENNKKLIFDYDKFGPTRESYILSRNLRKEYKPIQKKGIIGNNFEIIPFGLW

SEQ ID NO: 141105 - protein, 48 aa, Heterodera glycines
  Coding regions on vcDNA: vcDNA=SeqID_67528; Strand=-; Position=1 -56,282-372
MCRLRWWPNFLSIPALQLWPLKAAMWTREMPTLCSTNAQIQSLPNEMK

SEQ ID NO: 141106 - protein, 130 aa, Heterodera glycines
  Coding regions on vcDNA: vcDNA=SeqID_67529; Strand=+; Position=1-393
MDEKPALIDSKLFSYESFVVVAENPIVSEAVTHKRAVMARVQVAVMSLRKRKRGRMINDVIQIATDQNHSTHHNCNAGIERKLGHQRSRHIGRKVFAQAEVVQRERNGHVLFDVLALKWFIDEALEANDL

SEQ ID NO: 141107 - protein, 87 aa, Heterodera glycines
  Coding regions on vcDNA: vcDNA=SeqID_67530; Strand=+; Position=1 -51,842-1054
  Homolog annotation: Hit_ID=NP_508550.1; Match level="QueryCoverage =75%, HitCoverage=8%, E-value=9e-09, Identity=46%"; Hit description =ral guanine nucleotide (96.1 kD) (XD830) [Caenorhabditis elegans] gb|AAA83583.2| Hypothetical protein F28B
MLKKVRYMPPTDYEWVPPNGQQQLALTDGSAVAMDHLQWETIRERVIKAGTVPRLVDSLIDEDGHMDLKQVFWKCGGMLRVYTKHWP

SEQ ID NO: 141108 - protein, 277 aa, Heterodera glycines
  misc_feature (191)..(191): Xaa can be any naturally occurring amino acid
  Coding regions on vcDNA: vcDNA=SeqID_67531; Strand=-; Position=1 -80,341-658,729-871,1173-1309,1695-1862
  Homolog annotation: Hit_ID=XP_326598.1; Match level="QueryCoverage =100%, HitCoverage=23%, E-value=2e-52, Identity=39%"; Hit description= predicted protein [Neurospora crassa] emb|CAD21337.1| conserved hypothetical protein [Neurospora crassa]
EKEREKERDFRIWENYEKEREKERDFRREKERDFRIWENYEKEQKERDFRFWEIEKEREKERDFRIWENYEKEREKERDFRIWENYEKEREKERDFGFWENYEKEREKERDFRFWEIIREREKEREKERDLEWEKEREKERDFRIWENYEKEREKERDFRFWEIIREREKEREKERDLEREKEREKERDFXIWESYEKEREKERDFRFWEKREREKEREKEREKEKEKKNEKEKEKKKERKRQRKKEREREMERERERENEKEKEKKERERERERES

SEQ ID NO: 141109 - protein, 45 aa, Heterodera glycines
  Coding regions on vcDNA: vcDNA=SeqID_67532; Strand=-; Position=1 -67,182-252
MLASPGAQTQILLWGERHFFCTYATGGSDGQHVAKANADKKWGNF

SEQ ID NO: 141110 - protein, 74 aa, Heterodera glycines
  Coding regions on vcDNA: vcDNA=SeqID_67533; Strand=+; Position=1 -102,497-619
MVSAKLPSIGRYSFAITGYDLNQPTKTTKATTTGTVTKVISKTNIQFSPTTLKATNKCEFLCTKYCFLQTNSLS

SEQ ID NO: 141111 - protein, 111 aa, Heterodera glycines
  Coding regions on vcDNA: vcDNA=SeqID_67534; Strand=-; Position=1-336
MDSDVLGLVGPCLLMESAQGVADFVGDYADQITAGRSDGNALGKCHNSLRKSFPSCSARSLTCVPPALPTKLEHPPPSKNSIRSVSGPPSMKRRHVAFCQMANASRIFCRV

SEQ ID NO: 141112 - protein, 770 aa, Heterodera glycines
  misc_feature (11)..(11): Xaa can be any naturally occurring amino acid
  Coding regions on vcDNA: vcDNA=SeqID_67535; Strand=+; Position=1 -144,234-442,687-755,808-954,1017-1227,1406-1484,1658-1709,1830 -2064,2190-2401,2460-2607,2970-3581,3749-3870
  Homolog annotation: Hit_ID=NP_508120.2; Match level="QueryCoverage =97%, HitCoverage=97%, E-value=1e-179, Identity=43%"; Hit description= metalloprotease family member (83.3 kD) (XB181) [Caenorhabditis elegans] gb|AAA83298.2| Nematode astacin
FSFPCPPLHFXLSSAFCYSIVQSKRTRKASKSAVEQIKKIFNEKATQHDAALMADEPRRGFVPRRDPTARRHHDELAVNGEDGDYFEGDLELAEWQAERLWHKLGEAKANAKLKRRRPFYKRWDRRRPINYEMAENVPEKTRQKTRQKIRLALAIWQNATCLRFIEGGPDTDRIEFFDGGGCSSFVGRAGGTQGISIATPGCDLVGIGISIATPGCDLVGIIAHEIGHALGTFHEQARPDQSQHIAVHYSNIPAIRWNNFQPIGDDQAQTLGLPYDAGSVMHYGPFGFAADQFRPTISTLDKHWQFTIGQREAPSFLDIEAINRAYGCTGQCPTDLWCLHGGYTDPNDCSRCVCPIGFGGTFCGEVQPSPCRSDQSMGRLIKDKGSPNHSLKSFSSWSASPMVQTVASPDFPRNFPSDLFCVWLFRSPPQGHLFIEFVEESFGYPCEDTCDKAFVELKMGPDFRVTGYRFCCSSPPLMTFQSFCCSSPPLMTFQSVGEEAVIIQRNPNGATRGFQARKTNRLGLYRRISEKPMPTSQPPPEVPMTSSSSSFPSVMNAILFLLPLRYAKAFSSSSPSVMPMPFSSSSPSVMPMPFSSSSPSVMPMPFSSSSPSVMPMPFSSSSPSVMPMPFSLLPLRYANAISSSPPPPPSSNECSLCLQWSEWNDCSQMCGGCGRKTRRRHCPSAACQREEKRICNRMACPEGTNFLFNNGEFHLLWKGCCVGLFLNNSKCGPLENSENPFLRIISSLLSSHDGQKEKTKRNGGKSKSGE

SEQ ID NO: 141113 - protein, 240 aa, Heterodera glycines
  Coding regions on vcDNA: vcDNA=SeqID_67536; Strand=+; Position=1 -33,401-606,650-849,911-1194
MERKKSTKLANSLPLTEFSCSVEGDEFAHLADQFANGKMEEEKGREKVRVERKRIVVRRKKLKNNGRRRRDREEEKGELKGKRRKPSVDEEKRHEERDNEDNATLTDWEQQRTTNWTTPEGVGTEGRGGRWTPGAVPDERQQQILEVLGIVPKSMASSENGSKEMLILQKLQNQPMKDDNELEEGPNGSQMSKNVNERTKDGEIDSEPLADLKVHNANGYSFPPANRGQFVEDEVGSSYS

SEQ ID NO: 141114 - protein, 100 aa, Heterodera glycines
  Coding regions on vcDNA: vcDNA=SeqID_67537; Strand=+; Position=1 -139,192-355
MSSSPSMPSPHELIRQLMPMSNDLQNRLQQQNGTAIAQMPPNGLNVYFLRPSKALSDAAASSADWPNAKFGTPPISRPFGQGPTFGTMPNGGTAKRAGHK

SEQ ID NO: 141115 - protein, 53 aa, Heterodera glycines
  Coding regions on vcDNA: vcDNA=SeqID_67538; Strand=-; Position=1 -102,285-344
METGILFFNLLRRGYIIGGWQINGDWHIKRVYTVQISISIIKIILIFFSNILI

SEQ ID NO: 141116 - protein, 92 aa, Heterodera glycines
  Coding regions on vcDNA: vcDNA=SeqID_67539; Strand=+; Position=1 -67,440-651
  Homolog annotation: Hit_ID=NP_492060.1; Match level="QueryCoverage =43%, HitCoverage=11%, E-value=1e-14, Identity=87%"; Hit description =C2H2 type zinc finger containing protein (40.0 kD) (1H871) [Caenorhabditis elegans] emb|CAA95789.1| Hypot
PFKCKYCNRTSKWKADLIRHVAKTHGIRVVSKYSRSKALELDKQQQKQLLMVEEAVEEEEEDGGRAFDSSSSCCDSETPTKDENNNQNKAKF

SEQ ID NO: 141117 - protein, 220 aa, Heterodera glycines
  Coding regions on vcDNA: vcDNA=SeqID_67540; Strand=+; Position=1-663
MARNKQLVQRQQQKRRIDAIVESGDELAGDQRPVIDNSQHSAELADLLSLKRETELADHLSLGLQHNAELADQLSLNREAEVADKLSLGSHYSPALADQLSLGPQHTAELANQMSLKREAKVADQLPLGPQHTAELADQPLSFPNSHASAFAAGSVAEASKLAHSLHQQQQQRLQLDASLALLQQLLNILPPVAPPPPPPNGTEQSRDGTAGSIFRPKMA

SEQ ID NO: 141118 - protein, 267 aa, Heterodera glycines
  Coding regions on vcDNA: vcDNA=SeqID_67541; Strand=+; Position=1 -406,457-731,792-915
YIDHSVIAFLRSNHQIFDKRGIDLHLCIPYSNTTDGQRIWDIFGREIWPIFSTNIHHLRYTGGDHLDNLLRRISPTILIDLDQLTSIHSFDLLPAAIGDGFNVPNETISAGQALSKWLHTPRKDGQPKRLHNFKEHFLRANAISSVTYEIHFPIHAPSIQMVPFEFLNEWTKEKLTMTKANENELGNRWIMKRCKIIGETAAVQQQKKDDNCNKVAIWLYICNDCIGPLSPPPFAEESGQSITKGPSSADKMSDGQNNKNSDQMQKK

SEQ ID NO: 141119 - protein, 92 aa, Heterodera glycines
  Coding regions on vcDNA: vcDNA=SeqID_67542; Strand=+; Position=1-304
MIGRAVRNRPFIFEGIFKFILYPRKMAISFFDKFYTSQKRLRMRRRAVHNRHFISQRIFIFRGYPRKMAISFFDKFYTHTNALEHDREGGAQ

SEQ ID NO: 141120 - protein, 60 aa, Heterodera glycines
  Coding regions on vcDNA: vcDNA=SeqID_67543; Strand=-; Position=1-355
KELEALKLFEKLFERNYDFYLDHFFARLRSHAIFGTLIILALIMGCIKAIVEGIGSAKIV

SEQ ID NO: 141121 - protein, 71 aa, Heterodera glycines
  Coding regions on vcDNA: vcDNA=SeqID_67544; Strand=-; Position=1 -39,145-195,590-715
  Homolog annotation: Hit_ID=CAE72754.1; Match level="QueryCoverage =97%, HitCoverage=5%, E-value=8e-24, Identity=73%"; Hit description =Hypothetical protein CBG20003 [Caenorhabditis briggsae]
MHSHRIENIVLENSFENRTSSWWQSENGVQNVSIQLDLEAEFHFTHLIMIFRSFRPAAMFIERSKDFGKTW

SEQ ID NO: 141122 - protein, 125 aa, Heterodera glycines
  Coding regions on vcDNA: vcDNA=SeqID_67545; Strand=+; Position=1 -31,379-725
MAKSQIASLVEAEFSGIFTAPSYPSAVLKKQNNISINLPVLRAVQQHFCTAVPTGTVAAPTVPCACVVGAVTGRTATGTEMDKCDAHNRWRAKGWPILNLAPFRWHLCGILVSFLWHCVWPTWTC

SEQ ID NO: 141123 - protein, 25 aa, Heterodera glycines
  Coding regions on vcDNA: vcDNA=SeqID_67546; Strand=+; Position=1-78
ARPWQQIFPDISFPPDFVKERVKLD

SEQ ID NO: 141124 - protein, 219 aa, Heterodera glycines
  Coding regions on vcDNA: vcDNA=SeqID_67547; Strand=+; Position=1 -111,279-379,476-590,770-882,1133-1351
  Homolog annotation: Hit_ID=XP_393145.1; Match level="QueryCoverage =94%, HitCoverage=33%, E-value=2e-40, Identity=42%"; Hit description =similar to ENSANGP00000004072 [Apis mellifera]
TEFPQNGGDVHVKMEIDSEEQAGEQLQFFAKYLTSQKLFPLQLADSQFRRYFLLQYLIIANYLLLKVKLKDTFTLTTLQEEEVRELTDKCFALLRETHPNGSLFADAVKKVLSRERLWSTWKNEGCPDLITPLLNAQTIEKYAAFKRKAVAQCVAGQLDLGNKEMTRLWNIQPNNLLACRSQKRNCTPDLVQFLSDALDELDPEQQVDEQYQSVNDEKY

SEQ ID NO: 141125 - protein, 146 aa, Heterodera glycines
  Coding regions on vcDNA: vcDNA=SeqID_67548; Strand=+; Position=1 -141,449-748
  Homolog annotation: Hit_ID=CAG84110.1; Match level="QueryCoverage =61%, HitCoverage=6%, E-value=3e-10, Identity=43%"; Hit description =unnamed protein product [Yarrowia lipolytica CLIB99] ref|XP _500178.1| hypothetical protein [Yarrowia lipoly
MFYDLKFKSSNVQESNRVPTVANASAVSTSTASFLKKTIKLTAENLPLLKERAEQIQLATKKIEEAAKKSEETTKKIEETMKKIEDSEAERKREHSANGEKSEKRESETKSKKREREKESENEKPKKGENARKRESRKREFKKIQS

SEQ ID NO: 141126 - protein, 188 aa, Heterodera glycines
  Coding regions on vcDNA: vcDNA=SeqID_67549; Strand=+; Position=1 -231,1327-1662
MPSLLADENDTHLYYVRAYCMNRGKRFHANYGTFVVNRSAAANEDKVTISFEQKEPCDYYAAEVLLMRSGSLYGMGWPDERPMVHFVCSSYGNGEKREIVFKRNFHLQITPALGEGEEENVYYAEVECNGNKYQTFRTFTKSKTDVVLHVSDCKSYDFSVRKVPKALFKPQDNMRKVRFQLILSEIAV

SEQ ID NO: 141127 - protein, 171 aa, Heterodera glycines
  Coding regions on vcDNA: vcDNA=SeqID_67550; Strand=+; Position=1-514
MRALWRLARAFPGTLIRCICFYAAQALEIERLVAQQEIPDILVTTADATQGHESSLAVVVTTCSVFDSGADSQPFWADAARVDVAISRASHGMIIIGDLLLLNRTETWRRYLDQATTETTVVGPEYFDFEQFNNPDNYYDKDGQLISANGGAVRSEHFYSKYGKNVWYNNS

SEQ ID NO: 141128 - protein, 199 aa, Heterodera glycines
  Coding regions on vcDNA: vcDNA=SeqID_67551; Strand=+; Position=1 -222,689-1066
MFIVCATIKTRIVFSLLLLLLINYPQCFVMGRHRIIAAEDMETVLNRLRPSVDRFDANFQRTFNEYGRVDSVREFLEDSVVPRFTVEEHGRVDFVDAFQQLQLRIQQFFDTKIRALHRLVGAAEKEAQKVDMDKVMGPTLGSEGRCRDQMRALNASSVHNPSIWKKSNGKTNSGIHVGILGMKVLGDDKQLGHGIFKTF

SEQ ID NO: 141129 - protein, 150 aa, Heterodera glycines
  Coding regions on vcDNA: vcDNA=SeqID_67552; Strand=-; Position=1-453
MYIETAQHNLGKELTDQSVRADLIAERQTLCKTISLLEKYNGKWEAIFLRVKGQALQDEEQNYRDFKPEGKAFMHWVDQARGLVDTIGGALGLSELGDAIPQPNQPAQVVQQAPVVHQRHDVTLPPITLPKFSGEPREWPLFWKLFETSV

SEQ ID NO: 141130 - protein, 177 aa, Heterodera glycines
  Coding regions on vcDNA: vcDNA=SeqID_67553; Strand=+; Position=1 -475,859-917
  Homolog annotation: Hit_ID=E86336; Match level="QueryCoverage=86%, HitCoverage=34%, E-value=2e-36, Identity=50%"; Hit description =hypothetical protein F14O10.11 - Arabidopsis thaliana gb|AAF88160.1| Contains weak similarity to an unknown pr
EEEEKEREKEDREKEKEEEKEEEEKEREKEDREKEKEEEKEEEEKGREKEDREKEKEEEKEEEEKEREKEDREKEKEEEKEEEEKEREKEDREKEKEEEKEEEEKEREKEDTQNEHEEQREQHQQQVGHGHGQAAESVETRHGQFEMSAEERECLSFFDFANHPRISDRIFAAICFR

SEQ ID NO: 141131 - protein, 20 aa, Heterodera glycines
  Coding regions on vcDNA: vcDNA=SeqID_67554; Strand=-; Position=1-60
YRICSNYSPVSINPAVSNYP

SEQ ID NO: 141132 - protein, 24 aa, Heterodera glycines
  Coding regions on vcDNA: vcDNA=SeqID_67555; Strand=+; Position=1-77
ECLAQKWAKFDIQKHPKLRGISVM

SEQ ID NO: 141133 - protein, 83 aa, Heterodera glycines
  Coding regions on vcDNA: vcDNA=SeqID_67556; Strand=-; Position=1 -152,207-305
MAFRCDGANYYNYFIVDEKAINNVTCKGIKKDVLPKLPEYFFYDSSQFASLKVSICQKNGFFNLFKEYYLEVTDMGNPTDSKA

SEQ ID NO: 141134 - protein, 93 aa, Heterodera glycines
  Coding regions on vcDNA: vcDNA=SeqID_67557; Strand=+; Position=1 -188,393-486
MNGVTRTLKWANVWRKLASRLAIRVMPKTTIAFSHLCRKLICPQTIWTNHFGSGNTFTIRWKKYSLEYLVYHLHLFGNEIELKDNFEKNRLIY

SEQ ID NO: 141135 - protein, 76 aa, Heterodera glycines
  Coding regions on vcDNA: vcDNA=SeqID_67558; Strand=-; Position=1 -120,309-419
MEPAAVVVVPSSSETVPSNTTNQIADKRDDTATTSSIDKIMLSPEEWEVRMRGGILSKALRRYAADGHLKGDDVPK

SEQ ID NO: 141136 - protein, 182 aa, Heterodera glycines
  Coding regions on vcDNA: vcDNA=SeqID_67559; Strand=+; Position=1-546
MAELRCQLRLSPPSSALVALPPFPSPRPCYDFAPISSSSPTSAVANGREGLLIELVRQREQQQQLFRPTAVLPSEVQLLTSAINSLSNGSPQGLALQMQQQQQQQDNNGTMTVPTNGIGQDAQQQQMGQQLTTAFDMREPLAVVQQRTMGSSEEANAMPTAEGAAVDSDCATPATISQQNLQ

SEQ ID NO: 141137 - protein, 33 aa, Heterodera glycines
  Coding regions on vcDNA: vcDNA=SeqID_67560; Strand=-; Position=1-98
SFSRLSSPLLFHPFVKFRSLRLFSVVRSVFVLL

SEQ ID NO: 141138 - protein, 191 aa, Heterodera glycines
  Coding regions on vcDNA: vcDNA=SeqID_67561; Strand=-; Position=1 -75,143-253,304-334,379-475,533-676
  Homolog annotation: Hit_ID=NP_741899.1; Match level="QueryCoverage =85%, HitCoverage=72%, E-value=5e-43, Identity=58%"; Hit description =leftover like (XL616) [Caenorhabditis elegans] emb|CAD36494.1| Hypothetical protein F59F3.6 [Caenorhabdit
VRRTDLLADPRSKLADWFRPGTNRPIPTDKGGNLFLDIPTDKGGNLFLDRDPKMFRHIIGYLRLKKERCAASLALPAKPDDLAKLPAKPDDLAKLIGECEALNLVEFRLIGECEALNLVEFRELALEMLQKYVRTEEQHYVTSVTSYVQMALRDYEAWQFEQEQARQAENGQGRGGGVKRGTNPQGNFNTV

SEQ ID NO: 141139 - protein, 25 aa, Heterodera glycines
  Coding regions on vcDNA: vcDNA=SeqID_67562; Strand=+; Position=1 -52,151-176
MEKACKIWRDYIDFNALEKASECLD

SEQ ID NO: 141140 - protein, 36 aa, Heterodera glycines
  Coding regions on vcDNA: vcDNA=SeqID_67563; Strand=+; Position=1-153
KPKLFGLFKKGLKIFKNFIHLPLDKKSIREPYLTFN

SEQ ID NO: 141141 - protein, 207 aa, Heterodera glycines
  misc_feature (203)..(203): Xaa can be any naturally occurring amino acid
  Coding regions on vcDNA: vcDNA=SeqID_67564; Strand=-; Position=1 -136,201-323,395-563,716-881
  Homolog annotation: Hit_ID=NP_740963.1; Match level="QueryCoverage =87%, HitCoverage=47%, E-value=3e-67, Identity=70%"; Hit description =cyclic AMP-dependent catalytic subunit (42.2 kD) (kin-1) [Caenorhabditis elegans] emb|CAD45614.1| Hypothe
FLVNYLIDFTFWQITGFGFAKRVKGRTWTCGTPEYLAPEIILSKGYGKAVDWGYGKAVDWWALGVLIYEMVAGYPPFFAEQPIQIYEKIVSGKVKYVKYPPHFSSDLRDLLKNLLQVDLTKRYGNLRGGPTDIKNHKWFSLVDWVAVLQKRVTPPPLPQPAIRRMFEALYPKVKGPDDTSHFQAEPIGVGDELRIQCLQIGIXVCED

SEQ ID NO: 141142 - protein, 95 aa, Heterodera glycines; identical to SEQ ID NO: 124528
  Coding regions on vcDNA: vcDNA=SeqID_67565; Strand=-; Position=1-706

SEQ ID NO: 141143 - protein, 80 aa, Heterodera glycines
  Coding regions on vcDNA: vcDNA=SeqID_67566; Strand=-; Position=1 -147,417-509
MANTFGYLRGYDALHGVGIVLKENDNRADASFNYCINGLLSNLHKNVAQNIVFLITHSSGSGKTIALLRRLLKPIEEKAG

SEQ ID NO: 141144 - protein, 101 aa, Heterodera glycines
  Coding regions on vcDNA: vcDNA=SeqID_67567; Strand=+; Position=1 -191,253-358,419-427
  Homolog annotation: Hit_ID=CAE69823.1; Match level="QueryCoverage =97%, HitCoverage=4%, E-value=1e-17, Identity=48%"; Hit description =Hypothetical protein CBG16142 [Caenorhabditis briggsae]
MGGTYQLIVQIDSKNVPGSPSRVILTFYLKLFLLFQVHSHQLPAELISVDAKPLKFGVINEDIRTIIDARKATAGHLSAQCSGPTRPEYCELMDNRDGTIF

SEQ ID NO: 141145 - protein, 22 aa, Heterodera glycines
  Coding regions on vcDNA: vcDNA=SeqID_67568; Strand=+; Position=1-69
ILGSKYNYAGFFVLVVCELVTK

SEQ ID NO: 141146 - protein, 46 aa, Heterodera glycines
  misc_feature (46)..(46): Xaa can be any naturally occurring amino acid
  Coding regions on vcDNA: vcDNA=SeqID_67569; Strand=-; Position=1-265
ADLKLSIACRFSAQQSTNRVFDSLQKIIPYPKVFTTTYCQSNLLQX

SEQ ID NO: 141147 - protein, 160 aa, Heterodera glycines
  Coding regions on vcDNA: vcDNA=SeqID_67570; Strand=-; Position=1 -131,225-272,327-411,606-771
  Homolog annotation: Hit_ID=NP_500734.1; Match level="QueryCoverage =98%, HitCoverage=7%, E-value=7e-59, Identity=70%"; Hit description =LAMinin related (lam-1) [Caenorhabditis elegans] pir||T15099 hypothetical protein W03F8.5 - Caenorhabditis
ILQNVSIQLALEAEFHFTHLIMIFRSFRPAAMFIERSKDFGKTWTIYRYTIYRYFAYDCSASFPNIPEGPPRKHNDIPEGPPRKHNDVICTKKYSSFEPATGGELVYKVISPHIPTEDPYAPEIAELLKITNLRINFTKLHTLGDDLLDSRPDIDEKYWY

SEQ ID NO: 141148 - protein, 55 aa, Heterodera glycines
  Coding regions on vcDNA: vcDNA=SeqID_67571; Strand=-; Position=1 -51,341-457
MQKCNCPCWSVMAIKLSPIFYLKIFLKVLLAIVETVPAAMMTTVLTAALTMCGHW

SEQ ID NO: 141149 - protein, 67 aa, Heterodera glycines
  Coding regions on vcDNA: vcDNA=SeqID_67572; Strand=+; Position=1-204
VSDNINTAKQLSATFLCFFLSNLLFTILYIVITLNLVTEAYQISLVYACGNWSIAILCVATEFTIMT

SEQ ID NO: 141150 - protein, 68 aa, Heterodera glycines
  Coding regions on vcDNA: vcDNA=SeqID_67573; Strand=-; Position=1-204
  Homolog annotation: Hit_ID=NP_504227.1; Match level="QueryCoverage =100%, HitCoverage=11%, E-value=4e-09, Identity=41%"; Hit description= putative protein, with at least 9 transmembrane domains, of bilaterial origin (5E922) [Caenorhabditis el
LACVGPLLYSVLHKGVGLRIEKPPLILVLLAMSTVSMLLLALFWEWTMPIFGAQHSVAILLLTFLMAL

SEQ ID NO: 141151 - protein, 73 aa, Heterodera glycines
  Coding regions on vcDNA: vcDNA=SeqID_67574; Strand=+; Position=1 -196,447-472
NRSGRGNFRLRYNPMAAVELTLLGNRLEDRARKHRVAIGASTSASTVNEANAGENGEGGSGQNQNVAFFWANN

SEQ ID NO: 141152 - protein, 18 aa, Heterodera glycines
  Coding regions on vcDNA: vcDNA=SeqID_67575; Strand=+; Position=1-56
YREAIPEGFGLPINLGAS

SEQ ID NO: 141153 - protein, 169 aa, Heterodera glycines
  Coding regions on vcDNA: vcDNA=SeqID_67576; Strand=-; Position=1 -54,230-298,421-450,510-653,699-740,787-955
MANMKYLPPELLDEMAFYRRSEVIKKHKLAKDDLPWTNFATEGFYDSIDGSMLNLLLSNLRELYLRVKQTRAWLALVVQAELFPATMLLIEELCEFIESPGLYFGAVPESTSEEDPYQTVACVGPTVIIWVMFLGDKSCLRKMRLVSSRLRHLWLPFRHRSKTDCAIAT

SEQ ID NO: 141154 - protein, 314 aa, Heterodera glycines
  Coding regions on vcDNA: vcDNA=SeqID_67577; Strand=+; Position=1 -751,856-1046
  Homolog annotation: Hit_ID=XP_320889.1; Match level="QueryCoverage =88%, HitCoverage=34%, E-value=1e-15, Identity=25%"; Hit description =ENSANGP00000012033 [Anopheles gambiae] ref|XP_313651.1| ENSANGP00000013044 [Anopheles gambiae] ref|XP_314
MSCAPDQDVLEFGASVNAKCERADMTLSKDEIKCLIFITGLSDAHRDLRQECLRQLERAKSATPPRTVKLENLLEECRSILSLQHSAAALTSSGQAHAIQCKPQVLKEDKPKNKGFKPKTQLNSGKNFRNEGNNSGNVNSNPKRQEFRAQTCGRCGKGHSYRVCRYPADVQCFGCGKRGHVKQMCPNRAQSNSVAVASTFSVAQTNRDWIWIELQINDKPIKLAADSCSNLTIIQLPIWESLGKPKLKNAVANTTAPSIMGLDWITLFEQKTQLPIATTLPVLFDSTLHQSVNAIQSPKDPTDLANQIKAQFPQ

SEQ ID NO: 141155 - protein, 123 aa, Heterodera glycines
  Coding regions on vcDNA: vcDNA=SeqID_67578; Strand=-; Position=1 -89,166-274,353-384,438-536,578-704
  Homolog annotation: Hit_ID=CAE65008.1; Match level="QueryCoverage =75%, HitCoverage=47%, E-value=4e-29, Identity=58%"; Hit description =Hypothetical protein CBG09846 [Caenorhabditis briggsae]
MGRLIPTQNLCKVCGDKTFGRHYGAWVCDGCSCFFKRSIRRSAEYKCVAGTGKCLVDKCRRNWCQACRFNKCIAEANMAKERVQKERGPRKAKRSKSGKRNEVPKEAEKSQRESGETDGRGQR

SEQ ID NO: 141156 - protein, 55 aa, Heterodera glycines
  Coding regions on vcDNA: vcDNA=SeqID_67579; Strand=+; Position=1 -105,451-513
MLNNWSNAIGNIGVAKMGNANWTVPLAHCIANATVKVGQAINVIKQRTVVQGRNV

SEQ ID NO: 141157 - protein, 280 aa, Heterodera glycines
  Coding regions on vcDNA: vcDNA=SeqID_67580; Strand=+; Position=1 -240,2392-2652,2764-2841,2909-2974,3164-3360
MDNAKPKAKGTPPNSNVCAETDGQVKKHKGSRMMEKRKNNWHFSGPNCNVPTDECQKWKKCLNNGKCITLIDGDELPRKRFDVVVSPTKCSDLFVPGSFNKLTVHKFRVEEAKQAEKSVKSTKRLLIITYQMDPLLLQFIQINLKCLNTELVSNVVAKPPFYICDRLGQWDRLATFGRTFALPSCTPTENAMQEVIGDLHFEGPCDRAAKCARKVIQTIENASKSFGSFCTRPFCDGQLGIKTECLGERSAISGANPSTTAAQNPPSAGATPLVDTYERK

SEQ ID NO: 141158 - protein, 102 aa, Heterodera glycines
  Coding regions on vcDNA: vcDNA=SeqID_67581; Strand=+; Position=1 -22,179-255,546-755
MANLCPTGHHQRGPMFGALCGGRGNGRGGTMRNLGFTTPANGSNSASDCSLIFCPPGHFRNTTIGPADDSFNQLNSAFEAVCVPCPIGYYQAKKTNGKEAFK

SEQ ID NO: 141159 - protein, 42 aa, Heterodera glycines
  Coding regions on vcDNA: vcDNA=SeqID_67582; Strand=+; Position=1 -38,302-392
MEHRNSEEAKKREGTFVGVLVNNARGLFQSTSSQRLDDLIIK

SEQ ID NO: 141160 - protein, 102 aa, Heterodera glycines
  Coding regions on vcDNA: vcDNA=SeqID_67583; Strand=+; Position=1-309
MIMAKVQFFNCRTEAQNVFTDSLKKAKNGEKIREKGKANQKAISAEGKAPQAKQSKGLPFDANDAIGVQANFFGIRKGNETVPGNTLREKSDRSLNIQSYRN

SEQ ID NO: 141161 - protein, 92 aa, Heterodera glycines; identical to SEQ ID NO: 125147
  Coding regions on vcDNA: vcDNA=SeqID_67584; Strand=-; Position=1-304

SEQ ID NO: 141162 - protein, 92 aa, Heterodera glycines
  Coding regions on vcDNA: vcDNA=SeqID_67585; Strand=-; Position=1-304
MIGRAVRNRPFIFEGIFKFILYPRKMAISFFEKFYTSQKRLRMRRRAVHNRHFISQRIFIFRGYPTKMAISFFDKFYTHTNALEHDREGGAQ

SEQ ID NO: 141163 - protein, 35 aa, Heterodera glycines
  Coding regions on vcDNA: vcDNA=SeqID_67586; Strand=-; Position=1 -69,121-159
MTSFSAPFQHFALSVANVRADLSQIRVCPVNATNG

SEQ ID NO: 141164 - protein, 28 aa, Heterodera glycines
  Coding regions on vcDNA: vcDNA=SeqID_67587; Strand=-; Position=1 -75,390-401
MGRMVVAFLTTNSRQMTMNYVLIDRFWV

SEQ ID NO: 141165 - protein, 63 aa, Heterodera glycines
  Coding regions on vcDNA: vcDNA=SeqID_67588; Strand=+; Position=1-192
NSNRNSYNLGLFLHQRRVKAAKKMRNDRLFWRILNGQIGLLITFDAHFCLLILMCLSDEKIHF

SEQ ID NO: 141166 - protein, 120 aa, Heterodera glycines
  Coding regions on vcDNA: vcDNA=SeqID_67589; Strand=-; Position=1 -122,163-403
MVAFRDPKTVAEKRFNTALCKGRSVIEHALGIFKRRFSIAKTSCRLRLRRIATAILAAAVLHNIAIEMRLPEPPLATEESNENDDLNEINEDENRNAILNYRQARQAGIEKRHELVARFT

SEQ ID NO: 141167 - protein, 26 aa, Heterodera glycines
  Coding regions on vcDNA: vcDNA=SeqID_67590; Strand=+; Position=1-80
SKSSLTTAQKNMFFVRFRPRGAQEKN

SEQ ID NO: 141168 - protein, 76 aa, Heterodera glycines
  Coding regions on vcDNA: vcDNA=SeqID_67591; Strand=-; Position=1 -140,197-287
MLKLEKEGNDDGYFVWVLKRCPIGGTTAVQWEHKNLNNVNFIIFEFGRLSPPKTGQMNAKYRLKMNAGPNGQRKKK

SEQ ID NO: 141169 - protein, 56 aa, Heterodera glycines
  Coding regions on vcDNA: vcDNA=SeqID_67592; Strand=+; Position=1 -20,450-600
MSGTITRHELPPKRFFSVFDPFDDEYKHWNKYGSKRMDERLNRQCYYHNKRHYFVG

SEQ ID NO: 141170 - protein, 24 aa, Heterodera glycines
  Coding regions on vcDNA: vcDNA=SeqID_67593; Strand=+; Position=1 -52,295-317
MEKACKIWRDYIDFSALELLELAS

SEQ ID NO: 141171 - protein, 174 aa, Heterodera glycines
  Coding regions on vcDNA: vcDNA=SeqID_67594; Strand=+; Position=1 -48,97-224,568-916
MDFNNLSSNSTILGDLFYTTYKNAGLSAGLVTMAVLIALCAVPGNCMNLFLVYLTIKRKSLRGSSNYLLALNSFYEFLHQTGHYIFLFTILSGRNFIPFFGSAIFQLQSIFGYNAAIFTMIETAVDRFLAVVTPKLYASENERIYIISIGTFPLCGHTPKLYKKKGKGPRFYAS

SEQ ID NO: 141172 - protein, 104 aa, Heterodera glycines
  Coding regions on vcDNA: vcDNA=SeqID_67595; Strand=-; Position=1 -11,59-359
MNRRWICADVWMDILPSFDRPQLGLKMALISDRFDILVDKHFDGKGELTIWNDHRNSQGHGGRANWTKSETIYANQGQQGQIFVEFPMQDHPLPTNPDYGPYDY

SEQ ID NO: 141173 - protein, 51 aa, Heterodera glycines; identical to SEQ ID NO: 124998
  Coding regions on vcDNA: vcDNA=SeqID_67596; Strand=+; Position=1-155

SEQ ID NO: 141174 - protein, 106 aa, Heterodera glycines
  Coding regions on vcDNA: vcDNA=SeqID_67597; Strand=-; Position=1 -186,887-1021
MAIKYGPKIAKYGHKMAKIAKYGHKWQKCQNMDINFSKLSAKFLQIYWLKLHMRYISKFFDSDFFPFFRDFLAIFMTFLVDFLKIFSALNSQPYASLIDLYFAFSF

SEQ ID NO: 141175 - protein, 118 aa, Heterodera glycines
  Coding regions on vcDNA: vcDNA=SeqID_67598; Strand=-; Position=1 -18,150-409,695-773
MDTGFVTFLRATTSVAYNVRLELLVANEMNIVEPFELVNEMTQEKLTLTKDEEICLLKRCPIVGETAAVQWEKDENLDNLNGVIFHLYHDCIGPLSPPDQSDEKVFSTPGPSDQRKKE

SEQ ID NO: 141176 - protein, 33 aa, Heterodera glycines
  Coding regions on vcDNA: vcDNA=SeqID_67599; Strand=+; Position=1-100
MIKVFILVLFCTFSVSAEYDDYIDDEIEGQSSA

SEQ ID NO: 141177 - protein, 91 aa, Heterodera glycines
  Coding regions on vcDNA: vcDNA=SeqID_67600; Strand=+; Position=1-276
AYGDKNSKRKWNLSKINAIEYCGSSRVHHHTHIGSGGVINHLFNNIIQLDGPTLLDLQSDQSLIAWRSGEGDKSRIKGTTFSSTLGYVICD

SEQ ID NO: 141178 - protein, 71 aa, Heterodera glycines
  Coding regions on vcDNA: vcDNA=SeqID_67601; Strand=+; Position=1 -13,182-384
MNTEKPGGNGIPRENTGIPFPFFLPDGILTGTGKWLEYRSGIPARHFRFPIPVPVSFLSKTGKKYTVRMGV

SEQ ID NO: 141179 - protein, 210 aa, Heterodera glycines
  Coding regions on vcDNA: vcDNA=SeqID_67602; Strand=+; Position=1-632
  Homolog annotation: Hit_ID=NP_920205.1; Match level="QueryCoverage =95%, HitCoverage=13%, E-value=1e-20, Identity=31%"; Hit description =putative DNA helicase homolog [Oryza sativa (japonica cultivar -group)] gb|AAP52492.1| putative DNA helica
MNFRGATEAYAIVHSMPFARLSHHVVKLAIHLPNQQPIVYRAFQLVSKAQQIQQGELPETHCSAYWKQWQNEWKNDPKFKDILFEKVPEQFRWAKDKWVLYKRQQIKRPPIGRIVPVPPSDPERFALYSLMRHFPGDPDHLKMVNGLLCTSFTEAAIMHGLLEDGKIWDKTLAEAALSRWPDQMRWLFVSIMVYGQPSNAIELWNKYKDQ

SEQ ID NO: 141180 - protein, 119 aa, Heterodera glycines
  Coding regions on vcDNA: vcDNA=SeqID_67603; Strand=-; Position=1-357
MTTNLPQGNEAQNSGSDFDPVYFSPEENQRWANLLVRMRAFEQAVCRQFRQIETQFAQISNQIQISNTADRVRELESSLKELENTMEMDTFQAQEKMIDIEQEVGKVNMRIDYQERLTK

SEQ ID NO: 141181 - protein, 83 aa, Heterodera glycines
  Coding regions on vcDNA: vcDNA=SeqID_67604; Strand=+; Position=1-303
TFIFEGIFKFILYPRKMAISFFEKFYTSQKRLRMRRRAVHNRHFISQRIFIFRGYPRKMAISFFDKFYTHTNALEHDREGGAQ

SEQ ID NO: 141182 - protein, 210 aa, Heterodera glycines
  Coding regions on vcDNA: vcDNA=SeqID_67605; Strand=-; Position=1 -255,381-756
QVQQLKEIAPKAKLKKLGLADIGPELSSESEGDEEEEDAAHNTEQQQQDDANDVPDDLTMDERADAARRREVLDFETPVYARELREQQQQAPLLSPPRVRAAATPPRRSPRASATPLPPRGSGPLPRRLVDLRGPLPRLFHLRWPLPRLVVLRRLPLKPPTTSRKSRAENATIWASSVGVVRAGSTRSKRGAAATTAASIRSNANHGFAW

SEQ ID NO: 141183 - protein, 68 aa, Heterodera glycines
  Coding regions on vcDNA: vcDNA=SeqID_67606; Strand=+; Position=1 -176,530-560
MSSVFFLIPANIRGLIVKTATNCKQFGWVSMRLHIVAVAANRAHAVLFPFHYAQKVTKNIEELVSDIT

SEQ ID NO: 141184 - protein, 77 aa, Heterodera glycines
  Coding regions on vcDNA: vcDNA=SeqID_67607; Strand=-; Position=1 -198,302-337
MNKISLIPSSSMALLLVVVVLLIIPFVPFTLSEQCLYDSVTESCLKVNCPFDCYVASPGTCGCNARMKFDSIWKRLV

SEQ ID NO: 141185 - protein, 97 aa, Heterodera glycines
  Coding regions on vcDNA: vcDNA=SeqID_67608; Strand=-; Position=1-402
LFEYPNRTLEKIDFFVFGAVPPNRCAQIYGETESFRNSFPIACTLILRWIFAPHNCLSTPNGHLKKSIFFVFGAVPPNRCAQIYGETESFGNSFPIA

SEQ ID NO: 141186 - protein, 17 aa, Heterodera glycines
  Coding regions on vcDNA: vcDNA=SeqID_67609; Strand=+; Position=1-53
FAYTENNSVTISPEECC

SEQ ID NO: 141187 - protein, 115 aa, Heterodera glycines
  Coding regions on vcDNA: vcDNA=SeqID_67610; Strand=+; Position=1 -148,194-393
MPKNFVFSRHMAIYNTFRSQRLISFIYFSAFYNKMDAIKKYAIKKFHDLVKTAKSPQLPTTLPMEKLVWPIGKNFLKKLGQPIMANSDRLALYTILGAQTMTNSVSWAITFFLLY

SEQ ID NO: 141188 - protein, 234 aa, Heterodera glycines
  Coding regions on vcDNA: vcDNA=SeqID_67611; Strand=-; Position=1 -176,316-346,392-476,561-689,748-824,1080-1199
  Homolog annotation: Hit_ID=CAE60310.1; Match level="QueryCoverage =99%, HitCoverage=10%, E-value=1e-63, Identity=57%"; Hit description =Hypothetical protein CBG03901 [Caenorhabditis briggsae]
LDSTEYPVIVQTMWPRGSADVDANADPSVPRNRLVLKSKAPLGGPIHGCMATASAIDTFLAKFLAQPQDREYADLCVLPELTDREYADLCVLPELTEQTLLENLRDRFNNGKIYTYIGPILVAVNPFSFFPIYNPKYSRLYCQSRRLGILPPHVFAIADITYHNLIKQKFAIADITYHNLIKQKENQVVVISGESGSGKTESANFLLHHLTTLSQKGNQATIEQQILSAGPVWR

SEQ ID NO: 141189 - protein, 1347 aa, Heterodera glycines
  Coding regions on vcDNA: vcDNA=SeqID_67612; Strand=+; Position=1 -131,1876-2257,2755-2856,2907-3035,3140-3466,3529-4197,4461-4839,4957- 5203,5492-5690,5756-5828,5877-6015,6063-6126,6208-6333,6381-6494,6546- 6681,6727-6878,...
  Coding regions on vcDNA: Position=...6982-7090,7248-7449,7739 -7901,8219-8417
  Homolog annotation: Hit_ID=NP_500205.1; Match level="QueryCoverage =39%, HitCoverage=39%, E-value=1e-21, Identity=22%"; Hit description =protocadherin 15 (4D224) [Caenorhabditis elegans] gb|AAC19184.1| Hypothetical protein C45G7.6 [Caenorhabd
MDFHLPCVIVHLILCVFVLPFSYSHQQQSIGDNQAEKTLENALGNTAANQPRKRPTPPSSPPRAFVDEFEKRTDNGPRAENAENQPNLLNLNRHEFNQLDEVGATTFEPLISRLINSARFDLPQQLHQNSSAATANNISMVLPIAQEMMFEFVPHFERDFYELMVPQGYNEELNYTLSEVQILLKPGSIVQWEQNENGDYNFELQASHGHIKFTSKLRAKVLKGMREITSMWTEEAELTKPTVTTLVTEPTTVSSDSQPFTVSFDDFTDEKSDSSSSYNETTASSSDDEPAQIILDLDHNLYNINTGSSTEPTKTIESKDSKDEALFMLDPIEIELNNSLNSILSASREIKWTRRRENEMGEDEAENVGMEGKKAEEENKKKEERQKDKGKEEEEEVENVGREQEKEEEGKAEKKDEEVGKEEKNGQEKKEETKREEEKEEKAEAKKEENENKEEKETGENKEEKKHHLLDVNDYIKAIQIELDAQLMGQDNDTIWQIAVPFASLPSLAHNPVPNLAISIPESKSQPISHDEMDYLVRLELHSSNDTVLDMRPHHIGPGDSAQLWLNDQEKVANEPLDFTLFASVVDWNGHQISQPMSIFKGKFVVEDPPKGPPPQIHHPEALTGYEFVIDENATDGTEIGRIKLENSDTNNADEHAEFELFGHGSHLYGQKTKFKKSRKFPRFKIDSGGIMRLYCGAENGWKSGNGFRSLPEAVTVRVRDVNDNPPELKLFSDEIVVVNGQLRGDAPFMIGISDKDRQEMVKNRIFKALISWASPSSISYPKSKIMICAPENRFNALSLAGNLSIFFKLEQFDEINGLFGVILKDGVKLTEEGTHELLLVVVDGSGQSDTKIVPNNLKLYHFKNQLYNKSMPAYRIHTGVPIVQLQLKHPPPSTVTVNYLISDGNPGWLSVEPFIGNVFGANVPKEGVPPGNYSIQVVAVDQEKRQVLAECQLLLELTGEPVIDEQLQFPSPYVSLSIARLDNDDENDKIVDLVPFPEGEYLRHAEFNYGDLRAWDEAEKPAQLSKGALTVFMPGNGTIRLDMAKLRNVRSLHLNFTIKPNPNFIATNGSEKINNVTLVAITLQSDETKTLALQRQREKPCFAAPWTNESVPIRLRITEELPIDHPIIKLPAYNPMNSTDRLKIFMDGPYSKLFTINDDGVIAVKARLDFEQLLLDDHLIEILLLATSMKSPPQSTTALVQIELLDVDDMAPVIQLVNGMLKEPNRVLEDDQNALIIVDIEENSGHGKLELMLLNVSDVDSKKHQCELIGGEGKFAIEKKIQLNVLDKNDNRPVITWDRQDTQIRLLDNMPAGSAVGRFFARDKDAGDNGRVEFSLGQRQQPAATK

SEQ ID NO: 141190 - protein, 138 aa, Heterodera glycines
  Coding regions on vcDNA: vcDNA=SeqID_67613; Strand=+; Position=1 -97,417-548,961-1149
  Homolog annotation: Hit_ID=CAE73993.1; Match level="QueryCoverage =90%, HitCoverage=34%, E-value=1e-12, Identity=32%"; Hit description =Hypothetical protein CBG21626 [Caenorhabditis briggsae]
LNKHIQSHYRPLNLPWTLCMRSIFQWNNETVNVWSHLLGFVWFVYLQWWALNESLPSVNAPIADYWVMGTAMLCSQELQKFYGTLIGAMVVLIAIYVPFRRFSIQSKCRFGVPDVLYLSMALIALYPTWHWTQANANY

SEQ ID NO: 141191 - protein, 104 aa, Heterodera glycines
  Coding regions on vcDNA: vcDNA=SeqID_67614; Strand=+; Position=1 -8,322-628
MARQIRCDRLLPPVVAFANPRRVDLFPLDGHPTADHLPSHGTDQTAASPYGPNASSICRFAFCASAFVVGPTGNESLKSHRDINQRRMTTQIITEGKMEKQFRI

SEQ ID NO: 141192 - protein, 137 aa, Heterodera glycines
  Coding regions on vcDNA: vcDNA=SeqID_67615; Strand=+; Position=1 -269,329-396,438-514
MHTKVAKHSPTLKFEFNPNEKPTVGQAINALLPTNFGMPLAQAMAQFDFKVEIRERAIECALVFVDFDQWENSFLEHHGVYKVLLYPKSGNNVRTNDQSMTQPWATNTDQKKADCEFPIIYRQFQEIRIIRAKSANN

SEQ ID NO: 141193 - protein, 97 aa, Heterodera glycines
  Coding regions on vcDNA: vcDNA=SeqID_67616; Strand=+; Position=1 -73,316-536
MPLDYIFFTRKYIRPGFPGPKFMKSANATRHRPILVPSLLQHLANQFGITDLHLSIAQGFWRPRIWGAQMPCTEVPSGNELIAKFDTCQVANCRQYL

SEQ ID NO: 141194 - protein, 16 aa, Heterodera glycines
  Coding regions on vcDNA: vcDNA=SeqID_67617; Strand=-; Position=1-55
SGVLKVANHESDMYFD

SEQ ID NO: 141195 - protein, 69 aa, Heterodera glycines
  Coding regions on vcDNA: vcDNA=SeqID_67618; Strand=-; Position=1 -45,238-402
MAIQFDKCRLTSEPKLNLGFRRGFVEPKMDLKKVALFFCSGFGIVQIKPNIHDNVLWYSGERVFVTYYV

SEQ ID NO: 141196 - protein, 47 aa, Heterodera glycines
  Coding regions on vcDNA: vcDNA=SeqID_67619; Strand=-; Position=1-271
FLKLHYFIFLAKLIHKYFFTNCSETHQILFTSYFRHSDAFTIKKGDE

SEQ ID NO: 141197 - protein, 41 aa, Heterodera glycines
  Coding regions on vcDNA: vcDNA=SeqID_67620; Strand=+; Position=1-436
LIHKYFLERAVKRTKFYLHASLGTLMLFLSKREMNKIFKNF

SEQ ID NO: 141198 - protein, 240 aa, Heterodera glycines
  Coding regions on vcDNA: vcDNA=SeqID_67621; Strand=-; Position=1-723
MSSARCRMALGPALFRLRQHVTTAENLLDEPVINAETTENLEQERGHITRILSRMEVELDAWGAIMNGLQGPAREAEEALFTAFIRDDRHLTEWLEDAREMLAHIAAELADEPNQPIAAGGQQPAVVVNPPVPAVPFVNNAAFLGGANVQQPAAVANHANQPPLVPNNAQIVPNLPAVAAPAPLATARLPQLSLPVFSGEPMEWPAFWQSFESAVDRAALEPVDKLTISTVAYAERLLVP

SEQ ID NO: 141199 - protein, 123 aa, Heterodera glycines
  Coding regions on vcDNA: vcDNA=SeqID_67622; Strand=-; Position=1 -91,386-666
MPGDIQIGALFPMHRQIAGSEGCGAIWEQYDHRLSARGGHPMFVLPNGRLSEEVEPRSGHRRAGEVVHNNCGAESAPGVPHSADWLLGNDHGFERQGAVRILSEVQNARIFMTNPKKMGFGKH

SEQ ID NO: 141200 - protein, 390 aa, Heterodera glycines
  Coding regions on vcDNA: vcDNA=SeqID_67623; Strand=+; Position=1 -125,174-1219
  Homolog annotation: Hit_ID=NP_573311.1; Match level="QueryCoverage =98%, HitCoverage=23%, E-value=9e-09, Identity=19%"; Hit description =CG15040-PA [Drosophila melanogaster] gb|AAF48863.1| CG15040-PA [Drosophila melanogaster]
VGTDNQKGPRIIYLQEPTVHQISPSQFRNFVIENTTDPEWKATKNANEASSSSINIPINIDSDSDDDDYDGLDRRDALRTGGPLLLDFFTGKAYQQNLSRQNLGEYSKSNLLDMSNQPNNSNQMILPVVRNQPSNSDQTKQRSVNDDSNMLMRVNPANNLPEVIASVTNSQQLTDQNNQPLTENPTDQSVRSNQNNQHEIQEILHLPMKNQQNNKRAAAPNSRQEFGFDLEKVPKAKKGKGLAEWLGHSIDQKQKIAVENTSEQPTITDHINLSSQTTQLNNLNNPTTNQNVVDLSDKTLSTKQTNEVGPLNSMDNSDHQMMGNAVVQQVASDQSCQSTQTDKLSDQITFTNQFDPNNLENKFNQSNFINFSLSGQNQTNNDNHSEQSEP

SEQ ID NO: 141201 - protein, 67 aa, Heterodera glycines
  Coding regions on vcDNA: vcDNA=SeqID_67624; Strand=-; Position=1 -120,847-930
MATDLIHWHNAGRNVPTLSRRHKAVQQAMKDNIIQWFCQSRYFYKKDIDNCLLFTYYGALGNGNNFE

SEQ ID NO: 141202 - protein, 18 aa, Heterodera glycines
  Coding regions on vcDNA: vcDNA=SeqID_67625; Strand=+; Position=1-56
YREAIPEGFGLPINLGAS

SEQ ID NO: 141203 - protein, 63 aa, Heterodera glycines
  Coding regions on vcDNA: vcDNA=SeqID_67626; Strand=-; Position=1-192
PRFITPLCSSSSEPVKRRSLLVEPMAPLEDHHELPVVVLQEERLNSQPPVSKEYLQELFVQLD

SEQ ID NO: 141204 - protein, 159 aa, Heterodera glycines
  Coding regions on vcDNA: vcDNA=SeqID_67627; Strand=+; Position=1 -194,254-451,556-601
  Homolog annotation: Hit_ID=CAE62810.1; Match level="QueryCoverage =98%, HitCoverage=62%, E-value=4e-47, Identity=47%"; Hit description =Hypothetical protein CBG06986 [Caenorhabditis briggsae]
ECPQAQPGPQGAPLPQGVPGSPGVPGIDADGGVRGQPGLPGPPGAPGEPGQPGQPGEPGPAGIMHEVDGKPGPPGPAGEVDGKPGPPGPAGPPGLPGTEGAPGQPGAPGQPGGQGAAGEPGEPGPPGKTGAAGQQGPQGNQGTGGTCDHCPPPRTAPGY

SEQ ID NO: 141205 - protein, 98 aa, Heterodera glycines
  Coding regions on vcDNA: vcDNA=SeqID_67628; Strand=+; Position=1 -16,802-1008,1397-1470
MQKGYGNEWLTHYGCAKSPEKGACSDNVEKEMKDLYGLAVSCSFCTIGRKMDDMSNKNFPLYNTTNVVMPPSGRESHNQKAIYALACDTKIKKGRKKL

SEQ ID NO: 141206 - protein, 49 aa, Heterodera glycines
  Coding regions on vcDNA: vcDNA=SeqID_67629; Strand=-; Position=1 -70,330-409
MNQGKEEGKSRRLAIRPFAHLGRGSLLTNQASISTNSEPGAEIRTKNRK

SEQ ID NO: 141207 - protein, 101 aa, Heterodera glycines
  Coding regions on vcDNA: vcDNA=SeqID_67630; Strand=+; Position=1 -87,204-290,442-498,787-862
VDSVRVHMEEINLSFSHRFAVMPDNCLSILGTELLGAVGFILSLPDGLGIRADICAAKLKAVLGEGAGDSGKKNEMVIEGKVKWAKFLTEDEIQREMADTM

SEQ ID NO: 141208 - protein, 43 aa, Heterodera glycines
  Coding regions on vcDNA: vcDNA=SeqID_67631; Strand=+; Position=1 -34,91-188
MGVWVRKEKGIAFVHIISGQVDKRFYFHYLSLRFNSLMEQKIF

SEQ ID NO: 141209 - protein, 18 aa, Heterodera glycines
  Coding regions on vcDNA: vcDNA=SeqID_67632; Strand=-; Position=1-54
SSSNSRRFSNSVSSYWRR

SEQ ID NO: 141210 - protein, 47 aa, Heterodera glycines
  Coding regions on vcDNA: vcDNA=SeqID_67633; Strand=-; Position=1-141
MTLKCLPPELLFELMPFVPAENAVPDAISSCRLFHCLLFKRVLNWKK

SEQ ID NO: 141211 - protein, 357 aa, Heterodera glycines
  Coding regions on vcDNA: vcDNA=SeqID_67634; Strand=-; Position=1-1074
MERNNEPLDEEAANGNGNQGDLPSDRQDGERANAAQQTKTKKGMDAQGLGTSQTGVTPAASKNLRSGAITVRSARDRIERAADTLSSRIAEARELMDSDFTRGEAPEHAARLMAMERGLGQVTRIFEGHFDKGIAEAGAAPEERQDFLYDFVAAPLPASTKYLQLREHPTPAELLQIAAEHLGDLQAMRQTFEDEEREQSISRSSRSVDTEDSHPSKELPRTMARRSMPEWETSFRDVLARFQAGQVGQAPQRFEQANRVAPPVMPNMAALIQRRSNAPSVASVRVNNPVREWMARNRGGENEPPAQQRPQAQQPLQAEQQRFERLTLNDQGQAFPRASHHARIRREEHPSRERLRT

SEQ ID NO: 141212 - protein, 216 aa, Heterodera glycines
  Coding regions on vcDNA: vcDNA=SeqID_67635; Strand=+; Position=1-648
DRQDGERANAAQQTKTKKGMDAQGLGTSQTGVTPAASKNLRSGAITVRSARDRIERAADTLSSRIAEARELMDSDFTRGEAPEHAARLMAMERGLGQVTRIFEGHFDKGIAEAGAAPEERQDFLYDFVAAPLPASTKYLQLREHPTPAELLQIAAEHLGDLQAMRQTFEDEEREQSISRSSRSVDTEDSHPSKELPRTMARRSMPEWETSFRDVLA

SEQ ID NO: 141213 - protein, 141 aa, Heterodera glycines
  Coding regions on vcDNA: vcDNA=SeqID_67636; Strand=-; Position=1 -175,312-385,442-617
  Homolog annotation: Hit_ID=CAA92962.1; Match level="QueryCoverage =96%, HitCoverage=15%, E-value=3e-09, Identity=30%"; Hit description =Hypothetical protein F56H11.1c [Caenorhabditis elegans] emb|CAA92483.1| Hypothetical protein F56H11.1c [Ca
GSTPTCVRSASICCLRALIDASCQAGVLYAQRHKMCATVIISELAGGAKKVVESLIKRFSPDCLNSFNKCCGNSSAEGPQLNAPILLAQPYQSVAVAIGPENGGKVKGQSNNSRAEQLDVNLADANCESAKCQHLCSVKDD

SEQ ID NO: 141214 - protein, 16 aa, Heterodera glycines
  Coding regions on vcDNA: vcDNA=SeqID_67637; Strand=-; Position=1-49
EAIPEGFGLPINLGAS

SEQ ID NO: 141215 - protein, 281 aa, Heterodera glycines
  Coding regions on vcDNA: vcDNA=SeqID_67638; Strand=+; Position=1-847
  Homolog annotation: Hit_ID=YP_053971.1; Match level="QueryCoverage =44%, HitCoverage=10%, E-value=3e-11, Identity=33%"; Hit description =TRNA-splicing endonuclease positive effector, putative [Paramecium tetraurelia] emb|CAH03240.1| TRNA-spli
QDPLSHSLTNDSQTAAAIQIVTAFKDTILSPNVSLVVICLYSYQKESLQTEFEKQRIEVLVVTVDGYQAQESDLVILVTTRTSLRDGALSENSEFLKDSRRATVALSRAKSGLFLIGDFKTLSEGEVWNKFLETASEDSQIVGEEYLQILRNGRYMRDRYWQLIDGIGRVVQDLQWLQKNDENWRTMQQQSTSSSMSTFESRKRRADEPDQGPSARRNETWRPQQRLGQFSGAVFVRSREPTGPRGACFVCKRVGHLAKNCWYADGQSAGRGQPRGKGQWK

SEQ ID NO: 141216 - protein, 146 aa, Heterodera glycines
  Coding regions on vcDNA: vcDNA=SeqID_67639; Strand=+; Position=1-439
NGVSKNRNYAQKAPQTILALPIPSTIAFIHPIMSAKIIRVPKIACDLSLAKNGVSKNRNYAQKASQTILALPIPSTIAFIHPIMSAKIIRVPKIACDLSLEKNGVSKNRNYAQKASQTILALPIPSTIAFIHPIMSAKIIRGPKIA

SEQ ID NO: 141217 - protein, 96 aa, Heterodera glycines
  Coding regions on vcDNA: vcDNA=SeqID_67640; Strand=+; Position=1 -30,85-345
  Homolog annotation: Hit_ID=CAE59796.1; Match level="QueryCoverage =65%, HitCoverage=7%, E-value=2e-09, Identity=50%"; Hit description =Hypothetical protein CBG03256 [Caenorhabditis briggsae]
MAFVGHPILADIRKGFRLRPTQTVDKSKPIIQAEGEQLTELLQNRSPSPAELPQAKANGVPKATKAPPPAPPMTQQKNEAKRQQQTMTAKVLYRKD

SEQ ID NO: 141218 - protein, 54 aa, Heterodera glycines
  Coding regions on vcDNA: vcDNA=SeqID_67641; Strand=-; Position=1 -14,146-296
MAIKCSVLPHCMALETLWTKPIYKAYHKCTTEDEREKQMLFPVFGSQEKYFVKL

SEQ ID NO: 141219 - protein, 52 aa, Heterodera glycines
  Coding regions on vcDNA: vcDNA=SeqID_67642; Strand=-; Position=1-157
MRIYTNLEKIEIIEKFYRIKEENPRITGNQMSDILGISKYTLGRWKKQFSEK

SEQ ID NO: 141220 - protein, 74 aa, Heterodera glycines
  Coding regions on vcDNA: vcDNA=SeqID_67643; Strand=-; Position=1 -217,263-270
MRISQNLSVKCYNDAEKKELLKLYEKIKKKHPELDKEKIGKILNVTGRTLTNWKNQFYGNDSKNKCENVQKKSK

SEQ ID NO: 141221 - protein, 95 aa, Heterodera glycines; identical to SEQ ID NO: 136768
  Coding regions on vcDNA: vcDNA=SeqID_67644; Strand=+; Position=1-660

SEQ ID NO: 141222 - protein, 83 aa, Heterodera glycines
  Coding regions on vcDNA: vcDNA=SeqID_67645; Strand=-; Position=1-254
LLENLALKPSFLSSSNDNISEIKIILLKAYKHFNIIPEEENLSEFEKITQNFANKENYEKVQKLVKAFKMSRALERNLILKIF

SEQ ID NO: 141223 - protein, 43 aa, Heterodera glycines
  Coding regions on vcDNA: vcDNA=SeqID_67646; Strand=-; Position=1-129
FVPKRNWCCQDFVNGRNCTILTVIRILYHLSFDFFQRLTVLLS

SEQ ID NO: 141224 - protein, 75 aa, Heterodera glycines
  Coding regions on vcDNA: vcDNA=SeqID_67647; Strand=-; Position=1 -183,267-311
MGKDGISAGGRHWRGIKVQTKPKSGPNGEQMRNFELETSFTSQMFIHENNKKLILSFIIKLHQCRVESTSIFDQI

SEQ ID NO: 141225 - protein, 95 aa, Heterodera glycines
  Coding regions on vcDNA: vcDNA=SeqID_67648; Strand=+; Position=1-657
LFEYPKRTLEKIDFFVFGAVPPNRCAQIYGETESFRNSFPIACTLILRWIFAPHNCLSTPNGHLKKSIFLFSGQSPRTDASRFMGRPNPSVIASL

SEQ ID NO: 141226 - protein, 60 aa, Heterodera glycines
  Coding regions on vcDNA: vcDNA=SeqID_67649; Strand=-; Position=1 -169,333-346
MRMAFMFGWMTDVRATKIKLAMDNGMPTKFINSSTAPPRNKRNCSVSVGVVVFMFLCMLM

SEQ ID NO: 141227 - protein, 236 aa, Heterodera glycines
  Coding regions on vcDNA: vcDNA=SeqID_67650; Strand=+; Position=1 -45,199-408,454-641,691-958
MPKKLKIISFFISQKLIIPIYIATTTPSPHDHKQPITNLITTAVQLLLVGSIELGIFYKLSRYNSKIYQKMFQNIGSNNLSIRYQLSENIRIGKQLIPPLFLNLGNIFAGTMILLWDFLDLPFYIYIFNLAAIINSIFGLLIEFFIITCHPFLKRDLCHFLNRIGKMFGFNLLAYNHRIADATVKVGTNNTAPSLSAVNGIAQRNLISGKALIDNQTKPEDHFAMLKEAWEKGPMK

SEQ ID NO: 141228 - protein, 178 aa, Heterodera glycines
  Coding regions on vcDNA: vcDNA=SeqID_67651; Strand=-; Position=1 -42,112-345,469-578,958-1105
MKAILIFQSLFIILRGSCRFVICLFKFFLWDPIGAESMQFFPALLKIYFIGIYARNFVPHVLIVERILSTLFVRTYEKKRGHLFTILWTPFALIIPIYIATTTPSPHDHKQPIMNLITTAVQLLVGSIECHPFLNRDLCQFLNRIGKMFGFNHLAYNHRIGDATVTFGTNNTAPLLAA

SEQ ID NO: 141229 - protein, 175 aa, Heterodera glycines
  misc_feature (1)..(1): Xaa can be any naturally occurring amino acid
  Coding regions on vcDNA: vcDNA=SeqID_67652; Strand=-; Position=1 -192,241-330,381-506,558-605
  Homolog annotation: Hit_ID=AAL78220.1; Match level="QueryCoverage =95%, HitCoverage=94%, E-value=8e-73, Identity=86%"; Hit description =putative cysteine proteinase [Heterodera glycines]
XLNCLPQLFLRNETIAEQFNSVKRLTDQSHVKWFGNVRIMTERLSEFQGKTKSKNGQKTDGKNKNSPANFKMYPSRNSPANFKMYPSRDIGILTEQSQRDKMAMAEKRAYVKRAYVDTQMERIGKALDEIMPKNGQNESFGGDRITQTECHNEVMHTFNVMHTFNKICFNFSKVK

SEQ ID NO: 141230 - protein, 119 aa, Heterodera glycines
  Coding regions on vcDNA: vcDNA=SeqID_67653; Strand=+; Position=1-360
MLSPRAIAQNQTVAAAAASGANVGTNAAPVRRFWPSYIDQHVAQLDFDASVMMMTSAGDECQNDDDEEDDDEEDEDGGDEDDVVQQGGGRPQQRLQIGSGMARGGGGAEETARDGNIFE

SEQ ID NO: 141231 - protein, 47 aa, Heterodera glycines
  Coding regions on vcDNA: vcDNA=SeqID_67654; Strand=+; Position=1 -48,108-201
MATFNVAHLITLIGVVSIASSVVADEQQNQNKTQNGGGGLKHLLGSD

SEQ ID NO: 141232 - protein, 127 aa, Heterodera glycines
  Coding regions on vcDNA: vcDNA=SeqID_67655; Strand=+; Position=1 -84,239-493,579-623
MIRNWANLTISWEDKLDSLLKGQIFEEKYAHYIRIICKSASLADFYDFCGYAETRIRLQLLIDIERFDHIRLAHGKQIIANEQSTEEIENENGTKNEQKRQVTIKKIFVIFAMFITFTIAGISYERL

SEQ ID NO: 141233 - protein, 156 aa, Heterodera glycines
  Coding regions on vcDNA: vcDNA=SeqID_67656; Strand=-; Position=1 -110,153-264,310-557
ISSVVAKRLGNPLRYGNPSRRCFLSLKTVALAKLTQTIHKVNVKEIRKLSVKEVESLSFIPPKMLCHIREEFLSIPQNQKGRVFYELSAEKRSRILAELLCLLLLFDGYFKYFTATNHPLPIIVRSRIHFANFSDCTGFLYVGKCVEKSARCDGMR

SEQ ID NO: 141234 - protein, 256 aa, Heterodera glycines
  Coding regions on vcDNA: vcDNA=SeqID_67657; Strand=+; Position=1 -148,372-568,610-1035
MAVRKCPTFAHRRAREQQVRGMASPFQRVQQHGQPTDGAVQKCHSLAEQKSATWGLEDVDYDSEPWALGGGLLPDMQRLVISSAKVGEIFTVKYAIPLSLTCYTIQPVDLLSLDKSLLFDLFALSDEQLLANSAISLPGNSSLRPEEFFFDLNFAPFLKYGAPSHHFAAECADGGEADDGEANSKGLCSLALGILNASGLVESFNSECIVKFRQKYYPSLSSEQQMEDDSSQSPGDVPMELMPFYFNLSIHSEHVA

SEQ ID NO: 141235 - protein, 341 aa, Heterodera glycines
  Coding regions on vcDNA: vcDNA=SeqID_67658; Strand=-; Position=1 -221,279-437,483-691,733-876,924-1024,1420-1612
  Homolog annotation: Hit_ID=NP_508590.1; Match level="QueryCoverage =99%, HitCoverage=54%, E-value=3e-80, Identity=42%"; Hit description =UNCoordinated locomotion UNC-78, WD repeat actin-binding protein family member (65.3 kD) (unc-78) [Caenor
TVSFGSAIEDQQLAVVWLRNWIVSVSLSGFINYICPETLKVCRVLRGHNKSITALTLSEDRRMAFTADFEGHITRWNVSDGSSERVTPQVHKSQVSGLSLTSGGLLISIGWDDSVAFIENALSPSIENVQSLSHRLSSQPRGVASIGQNGERVAVACHRSIFIFTDKKQSSVIDIKYEGTSVAIHPNGILLAVGGNDSRVHLYDLPTNGGAFVEKKVLQHAGAITSVNFSPNGKYLVATDIARKVVPYSVDDGFKVASEKEWSFHTARINCCAWSSNSRYIATGSLDTNVMVWDLQQSGEHPLVIRGAHSMSAINGVAWLSDNRLLTVGQDSNVKQWTLKL

SEQ ID NO: 141236 - protein, 138 aa, Heterodera glycines
  Coding regions on vcDNA: vcDNA=SeqID_67659; Strand=+; Position=1 -29,81-448,571-590
  Homolog annotation: Hit_ID=CAD21136.1; Match level="QueryCoverage =76%, HitCoverage=21%, E-value=5e-20, Identity=55%"; Hit description =conserved hypothetical protein [Neurospora crassa]
MLDISRARQITIVLNNTRQGFKIVDTGNAATPPPQQQQQHHQQRQTQTPQQQHHQQRQTQTPPQQQHQQRQTQTPPPQQQRQHHQQTQQQQQQQQQERQQTQSPQAQQQQQILRPVPLNMFQFQPVNDDLLPGKMVCF

SEQ ID NO: 141237 - protein, 108 aa, Heterodera glycines
  Coding regions on vcDNA: vcDNA=SeqID_67660; Strand=+; Position=1 -43,117-263,369-463,632-673
MLKDIMEPLVKFHKVGIHLDFKLKNLIVVEKMMKSKHKKKTLFGTKECLEKVKVKTFKLIDFDGSVLYLNREKKGKIAWDLMGYTEAFSAPELLQNLSLFTEGDIEVI

SEQ ID NO: 141238 - protein, 95 aa, Heterodera glycines; identical to SEQ ID NO: 136988
  Coding regions on vcDNA: vcDNA=SeqID_67661; Strand=-; Position=1-643

SEQ ID NO: 141239 - protein, 47 aa, Heterodera glycines
  Coding regions on vcDNA: vcDNA=SeqID_67662; Strand=-; Position=1-192
FLKLHYFIFLAKLIHKYFFRNCSETHQILFASYFRHSDAFTIKKGDE

SEQ ID NO: 141240 - protein, 53 aa, Heterodera glycines
  Coding regions on vcDNA: vcDNA=SeqID_67663; Strand=-; Position=1 -30,211-342
MNNDKYGIFLLYMRYMDEHPCWTFIAFALAFCIIGTIGIASNGAVIYVTIKTK

SEQ ID NO: 141241 - protein, 74 aa, Heterodera glycines
  Coding regions on vcDNA: vcDNA=SeqID_67664; Strand=+; Position=1-225
MPINPTNVIHLMEEYYHGNAPNPSPITVEEKQLAEDFLKTLIFCANKSGEIEISEELVLDDFANFHQKEDQAVL

SEQ ID NO: 141242 - protein, 147 aa, Heterodera glycines
  Coding regions on vcDNA: vcDNA=SeqID_67665; Strand=-; Position=1 -228,1357-1464,1513-1606,1669-1682
MNFDQRAEPNGIQQNPSAMIGRTARANNQWPNYPMPWPISANDEEDTTTHSITFSFSDIQQVIAQYSQDPNRDMFQLFLGPDANKIEKSNGQFDGLVTNGVLILSPNDNDDEGASVYLSASSSNNDDDENESDSEISPNCWKEELLK

SEQ ID NO: 141243 - protein, 167 aa, Heterodera glycines
  misc_feature (2)..(2): Xaa can be any naturally occurring amino acid
  misc_feature (4)..(4): Xaa can be any naturally occurring amino acid
  misc_feature (20)..(20): Xaa can be any naturally occurring amino acid
  Coding regions on vcDNA: vcDNA=SeqID_67666; Strand=-; Position=1 -181,423-557,864-977,1275-1352
  Homolog annotation: Hit_ID=CAE68877.1; Match level="QueryCoverage =92%, HitCoverage=91%, E-value=8e-55, Identity=62%"; Hit description =Hypothetical protein CBG14840 [Caenorhabditis briggsae]
MXYXNSYVRTLFRIFSKKYXHCCVHVKNIYFFSLDGPVFWSRRVLYVFCCSCHFDRHERDLLRLMEQWKHRIERVCLVDRPLDYPFLPDSLFGFLANHLPQLEFVYLRELDLEKINRVTVERLSQHKRLKKMIVHGCRNYEVLQDFRNLPQLLVVKGDIQGLKVWRT

SEQ ID NO: 141244 - protein, 86 aa, Heterodera glycines
  Coding regions on vcDNA: vcDNA=SeqID_67667; Strand=+; Position=1-322
FAWRNTVLHTYHTSIIFFNYFFHFITQRSRLIRSSPNFAGKLLRTLQMLINFLRIFCLEEHSSSHLPHQHYFFLIIFFILSPNVLD

SEQ ID NO: 141245 - protein, 428 aa, Heterodera glycines
  Coding regions on vcDNA: vcDNA=SeqID_67668; Strand=-; Position=1 -286,326-1326
  Homolog annotation: Hit_ID=NP_508324.1; Match level="QueryCoverage =92%, HitCoverage=16%, E-value=7e-21, Identity=22%"; Hit description =predicted CDS, peptidase family A16 and RNA-directed DNA polymerase and Integrase, catalytic domain and Z
MPDLVHSGAEVISIQSTSEDCERQSNGSVCRVSGTTELTISLALKDDKGKIMGSLELILQFLRLHCNQQTLKWLRSYKINVISKRRCPTMGSCTKKMEDYENFPGNNFCKKGDAIWGHKCALPSSECFFYRTYAEPTSNTIWELIRCTGWDYELKMSLTLTIGNETKSKDLTMFPGLTVKWSKFSFTPEGLTPPISPILNDYFIVSKNDIIYGGKEFLTDLTCDDPNEAKNFSCKLNKEVCRECWINREKGEVECACSEKTIEKMTPKLPFTTAKLNIRKEGKKILSETEYSPVKLAIRVNGIKIVTVTDGTKCNIKPTNFSGCYNCGTGGTLNYVCQTEFGQAEAEIKCQNGPIFLAKCSENGHEQKDILPFEMADINMNCIVECPGGQTNFRLKGTLRYVPVDEKKFRRINTEEIMKTNPDGIVKH

SEQ ID NO: 141246 - protein, 28 aa, Heterodera glycines
  Coding regions on vcDNA: vcDNA=SeqID_67669; Strand=+; Position=1 -50,280-316
MKKLEKSYIYSLMGVINFYRNLHIYHWI

SEQ ID NO: 141247 - protein, 44 aa, Heterodera glycines
  Coding regions on vcDNA: vcDNA=SeqID_67670; Strand=+; Position=1-132
MILWVALRKNSYEIMLNDTALDNRQFWPNDWCEGSGRENVTHIV

SEQ ID NO: 141248 - protein, 315 aa, Heterodera glycines
  Coding regions on vcDNA: vcDNA=SeqID_67671; Strand=+; Position=1 -39,86-233,303-367,504-674,1412-1627,1899-2160,2260-2306
MLLLEEPITNQIEIKEPVKLTYTKFYRKICNGVQFTFRLQLQNETDQFKISLLHDRPEHHDRIGSTVFEIEVALPSNFTFVVHYYGIRTSNNGSLTLNVDDQREYEFKLIISDTYKFIVNRTLFYEQNTSITPAWAINFVREKKYVDGKNTFLTDILLYESQPFILQILMADDGFYGSISRSDYTKFCDYYVAQINHEKAIMPFPPFAIDHIQIDGDLKPVKGIKLIQVILPNNSTHFLDDKNKTINCTPLPYKQINRTDGLLKVNESIIVMMELRGFNPGEKQEVGVFFYNQAIGYHDLMRIRRWHFNGTVFFA

SEQ ID NO: 141249 - protein, 112 aa, Heterodera glycines
  Coding regions on vcDNA: vcDNA=SeqID_67672; Strand=-; Position=1-337
  Homolog annotation: Hit_ID=YP_051285.1; Match level="QueryCoverage =100%, HitCoverage=42%, E-value=2e-44, Identity=78%"; Hit description= phosphomethylpyrimidine kinase [Erwinia carotovora subsp. atroseptica SCRI1043] emb|CAG76094.1| phosphom
AVASIRRELLPLVSIITPNLPEAAALLACAPAEDEAQMREQGRALLAMGCRAVLMKGGHLSESESPDWLFTAEGEQRFTAPRVATRHTHGTGCTLSAALAALRPRHADWAAT

SEQ ID NO: 141250 - protein, 92 aa, Heterodera glycines; identical to SEQ ID NO: 131128
  misc_feature (45)..(45): Xaa can be any naturally occurring amino acid
  Coding regions on vcDNA: vcDNA=SeqID_67673; Strand=-; Position=1-1325
  Homolog annotation: Hit_ID=XP_523367.1; Match level="QueryCoverage =91%, HitCoverage=58%, E-value=2e-21, Identity=66%"; Hit description =PREDICTED: similar to rRNA intron-encoded homing endonuclease [Pan troglodytes]

SEQ ID NO: 141251 - protein, 330 aa, Heterodera glycines
  misc_feature (192)..(192): Xaa can be any naturally occurring amino acid
  misc_feature (249)..(249): Xaa can be any naturally occurring amino acid
  misc_feature (262)..(262): Xaa can be any naturally occurring amino acid
  misc_feature (266)..(266): Xaa can be any naturally occurring amino acid
  Coding regions on vcDNA: vcDNA=SeqID_67674; Strand=+; Position=1 -113,172-267,299-341,399-702,881-1062,1101-1189
  Homolog annotation: Hit_ID=EAA17111.1; Match level="QueryCoverage =93%, HitCoverage=67%, E-value=2e-39, Identity=39%"; Hit description =hypothetical protein [Plasmodium yoelii yoelii]
SGKTSTLILPVCVQRTSKGITDLLLLNFVRLNTEISLVIGINQTNRHESLVIGINQTNRHELRTAMHHHPPNHEKAINLFPVLSQIKPQAPFPVLSQIKPQAPLLNRKTFVSGKLPTRANKSNRKTFVSGKLPTRANKSRRIASWHRLRSELGRYLIAFEPLTFFLINEDILAKCFRCSPSCYGPRISPLTXQYEWPRLSLLTIISVSKTNNRTEILFYYSIFLTAAIILCILRAGITAAAGTRLALSXILVKGFKLYPFRXPASXEIGLVISRHYLLALRVAISQAPSPESNPYPPLPVIISQAPSPESNPYPPLPVITMVVRYTTIES

SEQ ID NO: 141252 - protein, 72 aa, Heterodera glycines
  Coding regions on vcDNA: vcDNA=SeqID_67675; Strand=+; Position=1-217
MAYHNNSQQHLNPPRLCFQNRSLSARESGAAEDEGHRFDATGVDAFWQRTATPTTATRGRRQLSASTDQLLT

SEQ ID NO: 141253 - protein, 72 aa, Heterodera glycines
  Coding regions on vcDNA: vcDNA=SeqID_67676; Strand=-; Position=1-219
INCEKRNVALQSDPIALSGSVFDRFPLLCIDQSRVHADQSLLAKEQSDVDRGRGGGAASVHVGQKNGGENSA

SEQ ID NO: 141254 - protein, 236 aa, Heterodera glycines
  Coding regions on vcDNA: vcDNA=SeqID_67677; Strand=+; Position=1 -95,390-516,621-813,973-1268
  Homolog annotation: Hit_ID=CAE73796.1; Match level="QueryCoverage =99%, HitCoverage=17%, E-value=3e-70, Identity=57%"; Hit description =Hypothetical protein CBG21346 [Caenorhabditis briggsae]
MAKQTRDEGKFVELDGAEMGKVVVRFPPEASGYLHIGHAKAALLNQFYRHQFEGRLILRFDDTNPAKEDAHFEKVIEEDLRLLQVEWDKMSRTSDHFDALLDFCQQLLVAGKAYVDDTEAEQMRKEREERVESRNRGNDLILCRKIFGFSFMMVSLPRLFYPNFSKNQNKLPGTVPDSAVEQNLALWKEMQEGSERGQQCCVRIKMDMKHNNGALRDPTIYRCKGESHVRHGDKYK

SEQ ID NO: 141255 - protein, 51 aa, Heterodera glycines
  Coding regions on vcDNA: vcDNA=SeqID_67678; Strand=+; Position=1-155
LQIYWLKLHMRYISKFFDSVRRFDKDGFRSAISRSTFGNWSRIFSAITCNH

SEQ ID NO: 141256 - protein, 396 aa, Heterodera glycines
  Coding regions on vcDNA: vcDNA=SeqID_67679; Strand=+; Position=1 -92,327-873,1286-1432,1490-1894
  Homolog annotation: Hit_ID=CAA30354.1; Match level="QueryCoverage =77%, HitCoverage=45%, E-value=7e-83, Identity=45%"; Hit description =glutaminyl-tRNA synthetase [Homo sapiens]
MDMKHNNGALRDPTIYRCKSESHVRHGDKYKVYPTYDFACPIVDSLEGVTHALRTTEYMDRDEQYNTICDSLGLRKPCIWAFARLNMTHTVMSKRKVGKSMAPSISNVCFVQLTWLVEQGFVSGWDDPRMPTVRGIIRRGLTVEGLKQFILAQGGSRSVVTMEWDKVWAFNRKVIDPVAPRYTALENASATLVPVTVRQFVAEECGQVPLHPKDYKKTLKVTWLAKRAENFAVKTVRFDHLISTPIIGKEEDWKEFVNRDSEHFGTLLAEPALQKVNCGDILQIQRKSFYICDAKTANSMTLIEIPDGKETNNADVDDGEMPTFCARLLPSCDDSEMATFCARLLPSGDDSEMATFCARLLPSGDDSEMATFCARLLPSGDDSEMATFCARLLPSW

SEQ ID NO: 141257 - protein, 53 aa, Heterodera glycines
  Coding regions on vcDNA: vcDNA=SeqID_67680; Strand=+; Position=1-159
MAKEQRKREKANIGDRRETRGRTTEGEEADKDGKGGGDNEGGESIGKRWRKWQ

SEQ ID NO: 141258 - protein, 51 aa, Heterodera glycines
  misc_feature (30)..(30): Xaa can be any naturally occurring amino acid
  misc_feature (39)..(39): Xaa can be any naturally occurring amino acid
  Coding regions on vcDNA: vcDNA=SeqID_67681; Strand=-; Position=1-155
TVSFFLINTRNHQIKTTKQLRILPHEYTVXINNLCLLRXLSFLFRLFFPLA

SEQ ID NO: 141259 - protein, 33 aa, Heterodera glycines; identical to SEQ ID NO: 129788
  Coding regions on vcDNA: vcDNA=SeqID_67682; Strand=-; Position=1-101

SEQ ID NO: 141260 - protein, 217 aa, Heterodera glycines
  Coding regions on vcDNA: vcDNA=SeqID_67683; Strand=+; Position=1 -73,118-525,772-941
MAFMGSDMTKISPFLPFRTSEEMIVSSLGRSNSRKQYTSQHNNHCSSGGGSVGRHALPPNNSLPKRQQPHHHSHHHMNNSSRGTPCNSGTGSGKSARVRHDAAAATATGRTAKRTVATTNGTQPQRNDNANSTHTNATSTTASATTAGNNIANHAMDTMAAMSSSTIDMDLLPAEVSSGYDSDLVSRIQDDIMQQTPPVQWNDISGLEEAKRLLTEA

SEQ ID NO: 141261 - protein, 129 aa, Heterodera glycines
  Coding regions on vcDNA: vcDNA=SeqID_67684; Strand=-; Position=1 -165,265-489
MHAPLYGYNQSSVVAEPTIATTDSIPIRTSFVTPEGIYRQMTVNEFFRANRIQNQVAGSVCNTPVRFSFLRIPVTRLSFAEEALPSTSDVHHHELLRENYKWHSNEMNGYIDRICHNIGREIYVFDYTR

SEQ ID NO: 141262 - protein, 104 aa, Heterodera glycines
  Coding regions on vcDNA: vcDNA=SeqID_67685; Strand=+; Position=1 -92,178-400
MCSVFAKHPILLFNNSSDIFYYEISIGNKKNFMLFGFAVKQQTTLYGYEKGTYAYDNYGNIFINGEQKESNVKYFYGVGDTVGIGVNSATRQIIFTKNGQRLGW

SEQ ID NO: 141263 - protein, 167 aa, Heterodera glycines
  Coding regions on vcDNA: vcDNA=SeqID_67686; Strand=+; Position=1 -211,253-377,421-585
MLCKCGECFECEDEKRRLKRNRELNTRKEQIKNCTGNHLAPAMMELKRRNMKLFKKAYRPVKGVINKITGGPWNVECEVCHETFTYFMVEWENSRTDFSWGPGRTMVEADNINQKEILAHYVGQNDLLQNEVDYYQNLGNNPPLNVPPMGEDAIILTRDDGMPIGAE

SEQ ID NO: 141264 - protein, 269 aa, Heterodera glycines
  Coding regions on vcDNA: vcDNA=SeqID_67687; Strand=-; Position=1 -219,274-490,1341-1423,1492-1782
MDPAFLAEFAPPEGAELHRHKIKKIDPDLLPTSAEADTSFDERTVPLLDKESISTLLVLFLLDQEKFDTVRLQKLLKLICIDPGTCDFTIWALLSMFDGLDKFKSVDGYEAPADGGKFQFGWINELRLQNVLNRPERVLLVTSNSGQQSLLHVLKEVSGRESVPGKFLKSLETFQYLCNQLKKVEEQRKKAQLTKKKDDTEKEGAEEQQQATTSKPQADTHAKEESDEATLVRNMVDELAPLWEELSNCLSLLEKAEDSNMAVFVSSKW

SEQ ID NO: 141265 - protein, 20 aa, Heterodera glycines
  Coding regions on vcDNA: vcDNA=SeqID_67688; Strand=+; Position=1-70
FVFTDLQSKWLMPFCRYFID

SEQ ID NO: 141266 - protein, 610 aa, Heterodera glycines
  Coding regions on vcDNA: vcDNA=SeqID_67689; Strand=-; Position=1 -294,341-604,876-1337,1545-2213,2260-2403
MTKRLLPDQQQQGFHPLHSSVPIYAKANLRGDFNMEKLVKLESELRKGTERHRLLVKGILKLVKSSSTQPLDNELAHNALTLLLRLVSLDGMSHEFLNGDGVKTLLEMKRNPISAQMVTNGTTTPPTLNTLATLILRQCIDSDVALLQSAFEQMITATCNGQPISMQEITSRRHAMRTKRYQKDVKLLSQIVTELTQFDTFADADKNTRLMQPPNLLKLIAEVLRSYPKVAVPIFIEQSLGEKSVLRWIIERFLLSAPVNDLSDTAHLAKTVVSELVSNSSSQRITDHVVGNIKSLLIECGDFDCTVVTSDESNNGAYVKFADKVTILAKLTMHLRECLQLHEKPGIDTVNTLLKLLEGMMTKNGAEFGAMGARSYLLPSFSYDPRSFQYYDDDDLTLSRATFEEMGRPAANIDPPIASTPREDQNAHQENHVAIPNEHGDVEQLDESMGEPGHLRGDIIDSMLDTTQEENEEGGESEDESPHDSEEEDMDTGEELTQQRPAVHEGAMEDDHISEAADANEQVLQSHLVADDDFEEMDDDDDGEEDEEDETEVEGGGELADFDDTLLDYVTDFNALAQQMHDIRRRINLNIDTNALTIRPQQVQKRNDEY

SEQ ID NO: 141267 - protein, 253 aa, Heterodera glycines
  Coding regions on vcDNA: vcDNA=SeqID_67690; Strand=+; Position=1 -148,223-323,358-519,877-1227
  Homolog annotation: Hit_ID=NP_498867.1; Match level="QueryCoverage =67%, HitCoverage=46%, E-value=1e-28, Identity=42%"; Hit description =putative protein, with a coiled coil domain, of eukaryotic origin (37.4 kD) (3J530) [Caenorhabditis elega
MQNEVMDSDEDEQLTGNGAAEEAMLDQGEWGHQSTEEKCIYYSTINILRKGTTFSEKRIGKKKLAKLQAKAEAKALREQVKALEQTEREERKQREEEIRKEEEKKRQLEEEEKRKRAEKRRLEKEEKDRREMEEYLKIKGAFEVHEQGFDYDENEDNADNLLESFVNFVRKKKVIRCLIGLFYCHSPQVVHVDELASNFKSKPTDIVDRLKTLLQQKRLTGLFDDRGVLGFRLSHQLSLPLRTFCFYNRGGIA

SEQ ID NO: 141268 - protein, 45 aa, Heterodera glycines
  Coding regions on vcDNA: vcDNA=SeqID_67691; Strand=-; Position=1-137
MGEQVKRHGRTVKQFLLCYRNKKSLREGTADGINGIRGHLCRQKA

SEQ ID NO: 141269 - protein, 88 aa, Heterodera glycines
  Coding regions on vcDNA: vcDNA=SeqID_67692; Strand=+; Position=1 -107,242-401
MDIHSVQQAKKVAEQLEREKRIRRLPMSETINDLIRYTQEMQKDDCKCFEGILITDLDGLNFDLFIPPNHAKSLRFNFCKQSKKFLIL

SEQ ID NO: 141270 - protein, 143 aa, Heterodera glycines
  Coding regions on vcDNA: vcDNA=SeqID_67693; Strand=-; Position=1 -248,299-482
MGKYKAMAKTLKTFKVKASRKQLEKAKRARRRKTNGELGTEEGGTNNGDGWEGGKGGNDQEKRRTIEEKRNAICWDRKRTKKRLAKDSKTKAPGEAQQGVTTNRQITKKKAEESDEKSEKGGTEEGKGRRMQWKKTKNSRLSL

SEQ ID NO: 141271 - protein, 145 aa, Heterodera glycines
  Coding regions on vcDNA: vcDNA=SeqID_67694; Strand=-; Position=1 -111,155-292,705-893
  Homolog annotation: Hit_ID=NP_506192.1; Match level="QueryCoverage =94%, HitCoverage=22%, E-value=1e-50, Identity=70%"; Hit description =ATP-binding cassette sub-family F member like (69.2 kD) (5N242) [Caenorhabditis elegans] emb|CAA99835.1|
MHRQLRIGWFDQHSNEALNQEQSAMDYLMVKYQIDQQSARKNLGMVGLASHAHTVHIKNLSGGQKSRVALAELSLKQPDILILDEPTNNLDIESIQALAEGIEDFSGGVVMVTHDERLIRATDCRLWVVEDQVDGEEETPSHCEI

SEQ ID NO: 141272 - protein, 231 aa, Heterodera glycines
  Coding regions on vcDNA: vcDNA=SeqID_67695; Strand=-; Position=1 -113,161-312,446-813,961-1023
MSGRKSLERNHHERSSKTSHHRSAVIKFSGEECDSKDRKSSHIRRTDSDKIMRSVNSVKNRLKASLNAAIEAESTKQNTGKREMSSSNDVADSFARQAEINRIEEPGFRPSSFKSDADTSRKVINSVLFLIVFFKNNSLEKMNDKGKTNATKHDRAMFGPIWAGKELEKGRKTAQSEAKRDTRQHHRETNEKFEGEAQCQPGTRFTLAHELIQSNSKIIFRHLQMWKKSFV

SEQ ID NO: 141273 - protein, 45 aa, Heterodera glycines; identical to SEQ ID NO: 137718
  Coding regions on vcDNA: vcDNA=SeqID_67696; Strand=-; Position=1 -127,341-351

SEQ ID NO: 141274 - protein, 317 aa, Heterodera glycines
  Coding regions on vcDNA: vcDNA=SeqID_67697; Strand=-; Position=1 -208,251-433,476-567,611-697,923-1303
TMTKIKEDIGEAFVWISVDETTDKMGRMIANLLLGKLDGKKWHPPHLISVKALEKVDSGAMARFVNEGLDSFSANIKKERVLFLVTGRMIANLLLGKLDGKKWHPPHLISVKALEKVDSGAMARFVNEGLDSFSANIKKERVLFLVTDGAAYMKKAGRQLKVFYTNLLHVTCLCHALHRVAEKVRDEFAQVVNSFNANDAVCVKECQLSFNNSVWQDLAYIHSNFGQLSAAITKLETQGMTIFDAMDVFAGVHNQMDSVYGEKATEIRKKFSDIVAKNNGIEKISQFCQILSGKNTESDVPPNLIPFYKFAPLTSCD

SEQ ID NO: 141275 - protein, 67 aa, Heterodera glycines
  Coding regions on vcDNA: vcDNA=SeqID_67698; Strand=+; Position=1-206
VGHTVDAERNLINLYPQCHLITADPSAEINDALTHQIGGKFVHAAIGGKTAMGQPVNVRREGIFSKN

SEQ ID NO: 141276 - protein, 67 aa, Heterodera glycines
  Coding regions on vcDNA: vcDNA=SeqID_67699; Strand=+; Position=1 -156,255-302
MDEEIKGGKISKELENYHELLLRLFKIKFKQLINQNDKFVEEMLTKEWVIELLCRQFKKRSIKKNDC

SEQ ID NO: 141277 - protein, 345 aa, Heterodera glycines
  Coding regions on vcDNA: vcDNA=SeqID_67700; Strand=+; Position=1-1038
  Homolog annotation: Hit_ID=NP_504187.1; Match level="QueryCoverage =96%, HitCoverage=25%, E-value=1e-50, Identity=40%"; Hit description =predicted CDS, integrase, catalytic domain containing protein family member (5E782) [Caenorhabditis elega
MDDSSTPIDRDEVMVNFKRNLAFINNRYQIALPWNDRVGTLPTNYHQAKARLISLINKLRALNLVNEYQAILDEQLQKSVIELVDSPEQSIGPVHYLPHRAVVRTDKTTTKIRIVMDASAKPKHSPSAPSLNECLHTGPLLLKDLTGILLRFRRMEHVLLADIEKAFLQLGVREQDRDATRFLWLRNPTNNDLNSLKREDILVFRFCRVSFGLTVSPFLLNATVREHLALFDSTLAKRIDENLYVDNILIEMWPNEQLQPVVEEVKSIFKAAGMNIREFYGSNIDGIKQLPSEDQAKELENTKVLGITWKPKFNRIVFKMPTFDGKITKRTILSHIAQVYDPARF

SEQ ID NO: 141278 - protein, 75 aa, Heterodera glycines; identical to SEQ ID NO: 138893
  Coding regions on vcDNA: vcDNA=SeqID_67701; Strand=+; Position=1-228

SEQ ID NO: 141279 - protein, 31 aa, Heterodera glycines
  Coding regions on vcDNA: vcDNA=SeqID_67702; Strand=+; Position=1 -80,199-214
MAHFFEIMGWEKSKTSVFRVQAVKMLDVKIF

SEQ ID NO: 141280 - protein, 65 aa, Heterodera glycines
  Coding regions on vcDNA: vcDNA=SeqID_67703; Strand=-; Position=1 -48,245-394
MDSLRSLCFDFFLAANEYAIEKGLLPKNEQNAEDYSDWLCSAIGLEHRPFLPYTNAVVNVIKKII

SEQ ID NO: 141281 - protein, 76 aa, Heterodera glycines
  Coding regions on vcDNA: vcDNA=SeqID_67704; Strand=-; Position=1-231
MKIGVLLTRSEWYRHNGLGDGDRASLHGQFRGCRPANGGAPYACRNAIQSGQISSVKLNNHYTDTRKWKEELGAKH

SEQ ID NO: 141282 - protein, 279 aa, Heterodera glycines
  misc_feature (38)..(38): Xaa can be any naturally occurring amino acid
  Coding regions on vcDNA: vcDNA=SeqID_67705; Strand=+; Position=1 -127,235-328,486-557,608-650,710-765,822-871,1029-1157,1215-1368
  Homolog annotation: Hit_ID=AAG23825.1; Match level="QueryCoverage =99%, HitCoverage=20%, E-value=3e-82, Identity=58%"; Hit description =guanylyl cyclase [Heterodera glycines]
LISLMQYFNWTRFGFVLQSDSNGVSGGCTQKAKEISMXIILSSVSSSVSITYKVRIFNTQTSDLNTIVTGLRNRARIILLCFDDVTQLRTFLFDGGLKTKDYLYIIPDNDLILSFDYLYIIPDNDLILSFNLNLSRMPFWKQGAVNCTNYDGRDADGRDADAEVIGRLTFRWHYDITQSALSNRNYLGYFGRVINRTRDWPFYCPESDCSNVANGSVYSLLLYDAIYNGSVYSLLLYDAIYNYGMALNETFRQFGIRPEVYRNGTLLAQNNRKTFMGKK

SEQ ID NO: 141283 - protein, 163 aa, Heterodera glycines
  misc_feature (158)..(158): Xaa can be any naturally occurring amino acid
  Coding regions on vcDNA: vcDNA=SeqID_67706; Strand=-; Position=1 -162,480-811
  Homolog annotation: Hit_ID=CAE69480.1; Match level="QueryCoverage =93%, HitCoverage=43%, E-value=5e-35, Identity=47%"; Hit description =Hypothetical protein CBG15682 [Caenorhabditis briggsae]
EGFDNLYDLEFLRMLSLRDCRWIDDWVLSRIGGMFANTLEMLDLSNCHRISAKGLLGLRSLSKLRFLRLDGLGKTEGIAKSALLLEETLPNLVVIGIDYEHAMAEMEAEKKLLSNDRVLIDAKGTKFSNGTNGEKSVKLGRILEIECINAEEDGYQSXLLIPA

SEQ ID NO: 141284 - protein, 124 aa, Heterodera glycines
  Coding regions on vcDNA: vcDNA=SeqID_67707; Strand=-; Position=1 -43,996-1327
MGCQVTTVAKFATIRFNSTSNKVDDKNYDGFLARFPRSNSNVFIHPKYLTNEFLGESYYDLALIKVAFLAQLKKLNFISRKFVQIPDEHVEFTSKLPPVCLHCGSIERFKNGTSFVAGWGKTDG

SEQ ID NO: 141285 - protein, 234 aa, Heterodera glycines
  Coding regions on vcDNA: vcDNA=SeqID_67708; Strand=+; Position=1 -33,88-206,272-502,554-803,1325-1396
MNATPNDQIFKLCSGKDQCWTVIIYAFIVTFLTIGGVLFNFSVIFITIRTKSFRGTVNILFAFYSLCEIVHLGGNFLSIFSAFSGQYFMPYKTLITFAFAPIICGTCAVILLLFIGIERLSAVLFPFKKINQNSFLAIVLVFNIIQIIMLTIIYSHCEDTQLDSVEVFANYYEVAVLFYTVRFLNIFPIFFKIITLIKSQCSTSGLFEATMTKAITTRPNSTIEYSVHFSQLSQ

SEQ ID NO: 141286 - protein, 77 aa, Heterodera glycines
  Coding regions on vcDNA: vcDNA=SeqID_67709; Strand=+; Position=1-232
MGGQRRAIRWTSDGTSKIHGDQKHSVPMYMFSFSMIRLIIDEPTELCATLFQQHARTMLDQVDIMLLLHRQDGEATP

SEQ ID NO: 141287 - protein, 106 aa, Heterodera glycines
  Coding regions on vcDNA: vcDNA=SeqID_67710; Strand=-; Position=1 -96,229-343,400-509
MPRGGEKGPKTIEEVHEEAEKEQQVNEMERIEHERKKENEKMQQQTTRKGSRPNYGGRSSADRRSAAAANVSSLLPSSRAESRIAGLSKLREVDSFVLGGGEIPTE

SEQ ID NO: 141288 - protein, 210 aa, Heterodera glycines
  Coding regions on vcDNA: vcDNA=SeqID_67711; Strand=+; Position=1-852
FQQKQTSGLAQACAWAAKETEQVVMTQRWPGIRASRTWEEPSRRWTQLRGQCTGTHTSTPDFPVRTLPQAKGLRALMSRVFSNASTLVPRQGVPIHELIGLVNHGNTPLTRIPTPPPTLGSASPVLSSPQHLCLRPHLHKSINSPNFFNTQTSCMFIHFDSCQSLEKLRPRQRWHPSSSHHRSMPSTSASKHLNPDGRAPHSEIASFFQP

SEQ ID NO: 141289 - protein, 89 aa, Heterodera glycines
  Coding regions on vcDNA: vcDNA=SeqID_67712; Strand=-; Position=1 -96,149-322
  Homolog annotation: Hit_ID=P53023; Match level="QueryCoverage=41%, HitCoverage=29%, E-value=2e-10, Identity=83%"; Hit description=Major sperm protein 3 gb|AAA29148.1| major sperm protein
MAQLPLEDIATLPTQKGVFNAPFDNKATYYVRVINLGRSASATPSRPPNRSARSNSSSSTTSDGRTLRQLNMDMIGSHPTVPKLSFCPP

SEQ ID NO: 141290 - protein, 42 aa, Heterodera glycines
  Coding regions on vcDNA: vcDNA=SeqID_67713; Strand=+; Position=1 -84,498-542
MGNIVFCVQTKECVLFVSIYGRLCADYRKTRERVFVQFNHFI

SEQ ID NO: 141291 - protein, 70 aa, Heterodera glycines
  Coding regions on vcDNA: vcDNA=SeqID_67714; Strand=+; Position=1 -108,998-1102
MQRNAKRPPMNGTGGPSRVLIGIYIESMGNFQAADMSNTERCMQLGASEEQKIINKWPIKSNISGELSDG

SEQ ID NO: 141292 - protein, 304 aa, Heterodera glycines
  Coding regions on vcDNA: vcDNA=SeqID_67715; Strand=+; Position=1 -162,211-314,682-704,749-806,901-967,1222-1303,1598-2018
  Homolog annotation: Hit_ID=NP_509753.1; Match level="QueryCoverage =53%, HitCoverage=37%, E-value=1e-61, Identity=67%"; Hit description =neurotransmitter-gated ion-channel subunit family member (XL75) [Caenorhabditis elegans] pir||T19840 hypo
AYVASQVNVSWFKIGATRYNPEIGLPEFKIVQLTPESCDGSYMYAIMSGTFKYDKFSCLEAVIHLNRQIGYHVVQSFIPTGLIVMISWVSFWIDRRAVPARVTLSFTTLLSLSTLGNGLRFNLPQVAYAKAIDFWFGSCMFFVFLSLVEFAAVNSYMREAEKYERDDDFSSTSRSPVLPFPSSHQKNSKKKSGNKSPILSANNKNDYNNNNKKDEQENETKAIGAKLHNWTSNAIAIPSRFGRCADGGAAGDTKRSITTHNQQQQNGTMRMIRRGISPRLFSKFPANSPSFANEKRENNHRFFE

SEQ ID NO: 141293 - protein, 36 aa, Heterodera glycines
  Coding regions on vcDNA: vcDNA=SeqID_67716; Strand=+; Position=1 -48,113-175
MHSFKLFASLFLVLCVISLVICQDKPAAVKRGHLLN

SEQ ID NO: 141294 - protein, 43 aa, Heterodera glycines
  Coding regions on vcDNA: vcDNA=SeqID_67717; Strand=-; Position=1 -36,101-195
PHKITQFSLTNLRKKCILSSFLHRSFLYFVWFHLSSARTSQQQ

SEQ ID NO: 141295 - protein, 25 aa, Heterodera glycines
  Coding regions on vcDNA: vcDNA=SeqID_67718; Strand=+; Position=1-75
TCTCGVVVKLSTFHNFSPGFNSPLG

SEQ ID NO: 141296 - protein, 63 aa, Heterodera glycines
  Coding regions on vcDNA: vcDNA=SeqID_67719; Strand=-; Position=1-189
MEEMVVKWASVVFPEFGIRYNGADIMVANFLSVVRRITVTPPIKLTRFFLNTFMYSMRQSSRM

SEQ ID NO: 141297 - protein, 29 aa, Heterodera glycines
  Coding regions on vcDNA: vcDNA=SeqID_67720; Strand=-; Position=1 -147,564-632
WLTKTSSTWVLSILFQIAPNFFYSLTRPN

SEQ ID NO: 141298 - protein, 87 aa, Heterodera glycines
  Coding regions on vcDNA: vcDNA=SeqID_67721; Strand=+; Position=1-264
MSLNSRLSNHTGDEVVDNESHSPAVATPPVPKSKKRTAASLKQNDSGNNKSLSTLIEAAKMMEGGSSSEEHHQDGVSMPNSPAGSSG

SEQ ID NO: 141299 - protein, 70 aa, Heterodera glycines
  Coding regions on vcDNA: vcDNA=SeqID_67722; Strand=-; Position=1-210
GISVLYSMVDKTTRCGAPMKVWQPTRRKRLRAFWMRRIGMWRPFDRICPPLPLRGALFISSMPVCPTIHR

SEQ ID NO: 141300 - protein, 294 aa, Heterodera glycines
  misc_feature (16)..(16): Xaa can be any naturally occurring amino acid
  Coding regions on vcDNA: vcDNA=SeqID_67723; Strand=-; Position=1 -254,338-428,477-530,582-789,836-892,943-1010
  Homolog annotation: Hit_ID=NP_493361.1; Match level="QueryCoverage =80%, HitCoverage=43%, E-value=3e-64, Identity=49%"; Hit description =putative protein, with a transmembrane domain, a coiled coil domain (51.7 kD) (1O13) [Caenorhabditis eleg
FRKTKLQKNKNILYAXNQPKSIYICEALNLVTMTTCSCDWCSIQSYYAPRWGTSVWGEPTLVKGCLSGTMLRRGVKSHCETADDCQEPFTCFCDGKDYCNKRSRKTEMEPIQLFTCICEGTHCRFTCICEGTHCREKKTCTGELCTFVTNHRSKERERELCTFVTNHRSKERERGCVNSSVPLVERRSAGACMMPPITGAMHHTVAKRAEDLLRTESCVCQGDFCNAERPKPVPENSRERPKPVPENSRCTAFAQFELLGQKMKSKKTSCTGLLGQKMKSKKTSCTGEFCFRAD

SEQ ID NO: 141301 - protein, 36 aa, Heterodera glycines
  Coding regions on vcDNA: vcDNA=SeqID_67724; Strand=-; Position=1-109
MAHANVLAFVVLPSVVALPRVGQKRLGQIVFARRKN

SEQ ID NO: 141302 - protein, 111 aa, Heterodera glycines
  Coding regions on vcDNA: vcDNA=SeqID_67725; Strand=-; Position=1 -268,325-389
MIRKRKINRSNKNGLKIRRRADDSEGAEEAKEDATGPQHSPSSSADEADDGQQILANSAEGEQQKEQKDEEDEERTEPHSVALSFDEKGEVAATIVTGRIQEVVHVLANFK

SEQ ID NO: 141303 - protein, 89 aa, Heterodera glycines
  Coding regions on vcDNA: vcDNA=SeqID_67726; Strand=-; Position=1-268
MIRKRKINRSNKNGLKIRRRADDSEGAEEAKEDATGPQHSPSSSADEADDGQQILANSAEGEQQNEQKDEEDEERTEPHSVALSFDEKG

SEQ ID NO: 141304 - protein, 235 aa, Heterodera glycines
  Coding regions on vcDNA: vcDNA=SeqID_67727; Strand=+; Position=1 -261,749-899,1293-1447,1783-1923
MLLTFPFCLLLIFAKSSNCQMQNFNCFAQNGPNRRLSPAQLADTAFWHEQFQKIELINSSDFKLKEFICELSQKQRIFEAVFGTLPRPKKCISCENCANDQTKSGGKNYSRRKRLLQFISKAIQIDWDGNGLLNRSKSLNAFKGISPVVVDRQKGDEHDEGEENEQLDCAICLGPIDYGTEVRPLPVCKNNDGTNEATLIEITNGRTEENEEGRREEEEGRRTTAEEGGAEIDQV

SEQ ID NO: 141305 - protein, 102 aa, Heterodera glycines
  Coding regions on vcDNA: vcDNA=SeqID_67728; Strand=-; Position=1 -147,822-981
MANITAGDTIFLHFNWNENKNGWWWGELWKFLAKKSFKFSNEKKWPNFKHKKALKMLRFFAILFILSASAAPRALNFGTNLEKTSPIVAVSSIKLNQKEPPV

SEQ ID NO: 141306 - protein, 19 aa, Heterodera glycines
  Coding regions on vcDNA: vcDNA=SeqID_67729; Strand=+; Position=1-60
EPMNSCIGCKYRRCCTPNS

SEQ ID NO: 141307 - protein, 164 aa, Heterodera glycines
  Coding regions on vcDNA: vcDNA=SeqID_67730; Strand=+; Position=1-495
  Homolog annotation: Hit_ID=E86336; Match level="QueryCoverage=87%, HitCoverage=37%, E-value=4e-28, Identity=49%"; Hit description =hypothetical protein F14O10.11 - Arabidopsis thaliana gb|AAF88160.1| Contains weak similarity to an unknown pr
MPQVVPAAVARRKRSIFGNFFAGLFHRNNETSTEGRRPSNGTESAEEAEKVKEKEEEKEEEEKEEEKKEKEEEEKEEKKEEEEKEEEEKEEKKKEKEEEEKEEKKEEEEKEEEKEEDEEKEEEKEKDNATDQSAVGREKRSPFGIFMKYKKNGKQLSIGQHATN

SEQ ID NO: 141308 - protein, 189 aa, Heterodera glycines
  Coding regions on vcDNA: vcDNA=SeqID_67731; Strand=+; Position=1 -149,197-570,665-711
MEIGQNANCHTIEENGTKQMQIVNSDGNPLPIPQNPLPNKVTGFRGIQIKYIDQNVVTFLRRFHRFFAVCSTDLYLTTGNGHILDFVLLNIWPMFRHSMHVMFLSSIAFRRLRQLAPSLLNDCPSLHTILFDGDILPEFPPDESANASDGQAQMVVYASSEWYAQVAQMLCEFSGIPMLLLLLLFTLTF

SEQ ID NO: 141309 - protein, 121 aa, Heterodera glycines
  Coding regions on vcDNA: vcDNA=SeqID_67732; Strand=+; Position=1-367
AKPKKQQQHNDYQELIDSLTVASTLLPSQPEQHPPIIAQTMDTQPMDFVDTMSAMTTFLPSQSTTNSAPVPKSQQSETLVDVLSAAVSFLPSEGEKTKEQQHQTDDDVSTVKANLDVKEED

SEQ ID NO: 141310 - protein, 303 aa, Heterodera glycines
  Coding regions on vcDNA: vcDNA=SeqID_67733; Strand=-; Position=1-912
MENRSPKRPSNYRIDHIPSKKPRQGLVINQILGVVQQGGGETSSSKEAPKDYVQKLGSSVEHVAKFHYTKMKSRFSISDVPSNPERLLAGIFQHCIDSATKDSREHEIEPTHLGCLISSPLLSEGAITIPTRKISDNTIDTILNLFLKVAQSKQQKNVSLWGDPFTVTITTVDRSGLQFKRRVKGGTRRKIASVHHRINDQCLIKINNHTGDNYCLFYALLATMIAKTRGWPRWQFGRYLNNQHGQQGQLHHDAVELMKQVKAPMDLDGYDADTFVPLIVDHWNNMQQQHRFAVFIFWLVGTV

SEQ ID NO: 141311 - protein, 54 aa, Heterodera glycines
  Coding regions on vcDNA: vcDNA=SeqID_67734; Strand=+; Position=1 -39,188-313
MPKEREKKWQKKKEIEKILTAIENERKRTDFQKIMKPFEQFLKQQIQGEEIRDG

SEQ ID NO: 141312 - protein, 80 aa, Heterodera glycines
  Coding regions on vcDNA: vcDNA=SeqID_67735; Strand=+; Position=1 -61,136-317
MKEDLLQVELIPLAEEKAEKSEAIETGEMDEEMPIELSVYELGMYRRFKHMALLIGDIGRQMFTVECTVNLRKELFICPF

SEQ ID NO: 141313 - protein, 103 aa, Heterodera glycines
  Coding regions on vcDNA: vcDNA=SeqID_67736; Strand=+; Position=1 -150,313-474
MGPYIKYDFVEGNCADFTKSLLKLISWTKSPEMKSDGTEGKENGKYPPEKPIVHKQIELAKVDFLQNPRLVQLVKDGPEIIKGFMRAVTQTVTAIGGMARRRN

SEQ ID NO: 141314 - protein, 18 aa, Heterodera glycines
  Coding regions on vcDNA: vcDNA=SeqID_67737; Strand=+; Position=1-56
YREAIPEGFGLPINLGAS

SEQ ID NO: 141315 - protein, 33 aa, Heterodera glycines
  Coding regions on vcDNA: vcDNA=SeqID_67738; Strand=+; Position=1 -83,628-646
MYREGRRKIAIAREIGVTHSCVSKVIRRILSDH

SEQ ID NO: 141316 - protein, 17 aa, Heterodera glycines
  Coding regions on vcDNA: vcDNA=SeqID_67739; Strand=+; Position=1 -15,65-103
MFGQKDIKFGCLTVELV

SEQ ID NO: 141317 - protein, 162 aa, Heterodera glycines
  Coding regions on vcDNA: vcDNA=SeqID_67740; Strand=-; Position=1 -166,493-815
MSSDESTTSSASVVSVQLREVPIKDFKDVLPVLQKTLNELEHPFIKKAEEISGMEPEYTQWLVYWCVFAEFCQFDYLFGSINGPSAAVRASEDRLSALLGPSANLWRSQLVREAYPQSACRDERIGQDEEDVLIEQIMYHCVMSRMILCCDSYIMCYVLYVE

SEQ ID NO: 141318 - protein, 147 aa, Heterodera glycines
  Coding regions on vcDNA: vcDNA=SeqID_67741; Strand=-; Position=1 -54,282-668
  Homolog annotation: Hit_ID=CAG04363.1; Match level="QueryCoverage =91%, HitCoverage=66%, E-value=6e-18, Identity=48%"; Hit description =unnamed protein product [Tetraodon nigroviridis]
MQLKQALKRGVSSGDLKQVRGIGASGSFKLGDGTQPTLAKASPAKKKSPVKKAKKAAPPAPAAVPKKTSPKVPAPAAVKKVAVKKPTPKKAPKAIARKVAAPPPPAPAAKKAPVPSSTATKGKKTTAKKAVTTAKLPASPPPAAPPA

SEQ ID NO: 141319 - protein, 230 aa, Heterodera glycines
  Coding regions on vcDNA: vcDNA=SeqID_67742; Strand=+; Position=1-693
MLSHLNSNLELFGEESVHAFDDWADRFKDYLSLTGKNWTEDEKVTRLKLALKDTPRELFKELKSNQITTFTSALEALRAKLDSPQRREVAKRTLSVCRQREDETVAQFLRRLMPLIDSTNPSLTGDLRKEKICEEFLGRLRPNMSFLIRLVGLTQPKNLEMVKAQAEELEALLLSTGGGVTQITQLINSMTEQRGNEEPNEQNEENSNNNGATMVGNSEMPLHMTRSART

SEQ ID NO: 141320 - protein, 44 aa, Heterodera glycines
  Coding regions on vcDNA: vcDNA=SeqID_67743; Strand=+; Position=1 -71,152-215
MNVNKMRQFVVSSQNVKTQLGHISVCAMLVSLRDLTAKAASVKK

SEQ ID NO: 141321 - protein, 146 aa, Heterodera glycines
  misc_feature (96)..(96): Xaa can be any naturally occurring amino acid
  Coding regions on vcDNA: vcDNA=SeqID_67744; Strand=-; Position=1 -147,215-319,449-612
  Homolog annotation: Hit_ID=NP_500741.2; Match level="QueryCoverage =67%, HitCoverage=45%, E-value=4e-22, Identity=61%"; Hit description =troponin I (23.1 kD) (tni-4) [Caenorhabditis elegans] gb|AAB94188.2| Troponin i protein 4 [Caenorhabditis
MAIKQSLKRVLKADRERKKAEVRKRLEEAGRAKKAKKGFLTPERKKKLRKLLMLKATEKLLMLKATEDLKLQQQQRAEERQKVLHERIPQVPDLNXSDSKVMNKGEKREREMGRRERGRKKGVIRQSNCQMAMSTTAQLLVLGEVS

SEQ ID NO: 141322 - protein, 84 aa, Heterodera glycines
  Coding regions on vcDNA: vcDNA=SeqID_67745; Strand=+; Position=1 -120,667-801
MDAILATDWLHNAFPERKTTTTTTTTISSVGEELDDAVKAVRIYYYVKHGVKLVYPQLPCVLQFGGGDHCSLFPLECLSVIKDA

SEQ ID NO: 141323 - protein, 28 aa, Heterodera glycines
  Coding regions on vcDNA: vcDNA=SeqID_67746; Strand=-; Position=1 -37,354-403
MLRKRQTQKLAGGKLVSICDEGILVSCW

SEQ ID NO: 141324 - protein, 52 aa, Heterodera glycines
  Coding regions on vcDNA: vcDNA=SeqID_67747; Strand=-; Position=1-216
KIFYRTGSGRINPANPAILQILHLKSAGSCAGLRILGNFKKFCINKKKSFKV

SEQ ID NO: 141325 - protein, 32 aa, Heterodera glycines
  Coding regions on vcDNA: vcDNA=SeqID_67748; Strand=+; Position=1-96
MCYVSAVFLRLCFGVHRGGGGSSPNFMKGISH

SEQ ID NO: 141326 - protein, 43 aa, Heterodera glycines
  Coding regions on vcDNA: vcDNA=SeqID_67749; Strand=-; Position=1 -12,93-212
MGVWHLFICISGQVAKPSDFIISRLGTIPHWDRIFFIFSLPLF

SEQ ID NO: 141327 - protein, 195 aa, Heterodera glycines
  Coding regions on vcDNA: vcDNA=SeqID_67750; Strand=-; Position=1 -86,145-269,333-372,416-542,593-624
  Homolog annotation: Hit_ID=NP_508850.1; Match level="QueryCoverage =93%, HitCoverage=25%, E-value=3e-28, Identity=38%"; Hit description =MYND type zinc finger containing protein family member (XF621) [Caenorhabditis elegans]
RQWRRNIMDIWAHTKNIEKDSFAMGKFEEIFGRLIRFYEPIFGRLIRFYEPKALLPKDVVFELHCRDFINRHAISDKHYLREIGKGLYLDEIGKGLYLDLCAYDHSCRPNTVYSCRSFVATLRPLLCAYDHSCRPNTVYSCRSFVATLRPLHANVKMLDRSTTSYSYIDLLCAKRDRRKLLKECAKRDRRKLLKE

SEQ ID NO: 141328 - protein, 103 aa, Heterodera glycines
  Coding regions on vcDNA: vcDNA=SeqID_67751; Strand=+; Position=1 -189,473-595
MAFMAIIMDFWCNISRIFWYNEKKIRQRIEQLLSKIKGKKLDDIAKAMVNINVDEDENQKGKNLKELLLWENGPENMSIYRALTICIKNAISEFNKRLIKQKV

SEQ ID NO: 141329 - protein, 116 aa, Heterodera glycines
  Coding regions on vcDNA: vcDNA=SeqID_67752; Strand=+; Position=1-354
  Homolog annotation: Hit_ID=AAP92584.1; Match level="QueryCoverage =99%, HitCoverage=23%, E-value=4e-25, Identity=56%"; Hit description =Ab2-057 [Rattus norvegicus] gb|AAP85373.1| Aa1262 [Rattus norvegicus] gb|AAP85367.1| Aa1011 [Rattus norveg
PFLDRGAICLVYSDNERDSSLLNSWLIASGHNFLEGFSALSRTKLSNNRSVMPLDARGCTRATLAKSACLPSPKGVVKPVKICLDWDRTLLLLSVNEEFLAGASPQLALNTSLPFV

SEQ ID NO: 141330 - protein, 183 aa, Heterodera glycines
  Coding regions on vcDNA: vcDNA=SeqID_67753; Strand=+; Position=1 -179,396-766
MEKQCLEYLGTITLFARAIQAKMNFIEQMSKHWANKSVNGIAKKWEHFIFNQNIVFEFEQQSINFVENFIQIIDENETDKIKNYGNYSPQSPNDHQTTQFGTYNSDEFNAIFATLEMHECSMLIAKGVINFEMIKQIKLAHYLNGETFSNAGNPPPKKCLCVDAKIEQQYVNKLQKMLNQKKL

SEQ ID NO: 141331 - protein, 257 aa, Heterodera glycines
  Coding regions on vcDNA: vcDNA=SeqID_67754; Strand=+; Position=1 -194,516-1092
RGAGASTAQFGFHSVGRQPMQTDRDGRLRNAVQVRDRGHLRKVEERFPGTEITRPFWHSLRLSKIARPGRPLKRTISDNLRNFDSNTRQRHSDDAPVPCSFSSHCKDELSKRHSEDDFYAPSKASADRLLSSFIPIQHQHMLHQYLNDHQTTFDQNRNQQRQRHETSTSSNNSNTTITDNNNKPQPAQQQQQNHHHMLLSIQQAIVAAAAMAATVQHQQQQQQQLRQQQQNGTNKSNAIVGDEQQRHMPLQQNVQME

SEQ ID NO: 141332 - protein, 144 aa, Heterodera glycines
  Coding regions on vcDNA: vcDNA=SeqID_67755; Strand=+; Position=1 -75,468-693,942-1075
MTRWKRRVTARATGEWCGEQIDSLGRPTATPPHAEPFEYGGGPRRESVDGPMPTLSRLVRQRKTHKKQIHNLAIVNELKLARQSQERTMTRGRAEKRRSAELLHQRHIRLNRRQQMKTNSVTTTTAKSKPTEEKEREATETDSK

SEQ ID NO: 141333 - protein, 47 aa, Heterodera glycines
  Coding regions on vcDNA: vcDNA=SeqID_67756; Strand=-; Position=1-146
FCGIKYHFESVSVASLSFSSVGLLLAVVVVTEFVFICCLLFSLMCLW

SEQ ID NO: 141334 - protein, 88 aa, Heterodera glycines
  Coding regions on vcDNA: vcDNA=SeqID_67757; Strand=-; Position=1 -99,227-392
MSKFPSNLSQGRFVALIVHPLSVRRRLAVESSAVKLNANEVPTDRNIVVNDEQSLNVCEAIAEQPMAILVTDNGTQLLRTNAVRLQYL

SEQ ID NO: 141335 - protein, 56 aa, Heterodera glycines
  Coding regions on vcDNA: vcDNA=SeqID_67758; Strand=-; Position=1-168
THCQRLRQQLPQDRPKSQSVDYGKSPSPLDPNPRLKSPPGTAPLAQSARNFWNSVH

SEQ ID NO: 141336 - protein, 73 aa, Heterodera glycines
  Coding regions on vcDNA: vcDNA=SeqID_67759; Strand=+; Position=1 -163,270-328
MQTGHKPLSDEGSCPFTENLDTVLEEICKQKNKTSVCQTGDDWKARAKSIITKVAWSYANVATALAIVKNRYA

SEQ ID NO: 141337 - protein, 95 aa, Heterodera glycines; identical to SEQ ID NO: 136988
  Coding regions on vcDNA: vcDNA=SeqID_67760; Strand=-; Position=1-663

SEQ ID NO: 141338 - protein, 105 aa, Heterodera glycines
  Coding regions on vcDNA: vcDNA=SeqID_67761; Strand=-; Position=1-318
MPTNCRRHRLPLLMKLKLIRRFLHMCGQYLPLLYCLLSYSAAVVVCCVPCQHPLRRKVPKTMPNGGHCRQQQQRGTMAATMVALPYQQDFVACAAADYVDDDAEI

SEQ ID NO: 141339 - protein, 60 aa, Heterodera glycines
  Coding regions on vcDNA: vcDNA=SeqID_67762; Strand=+; Position=1-180
MRRDHEEEAGAAAHPPVPKRALFVHGLPSGVRQKQLPRAHQMHHGGPKVRRRETCAKRDK

SEQ ID NO: 141340 - protein, 138 aa, Heterodera glycines
  Coding regions on vcDNA: vcDNA=SeqID_67763; Strand=+; Position=1-416
  Homolog annotation: Hit_ID=NP_497829.1; Match level="QueryCoverage =86%, HitCoverage=47%, E-value=9e-17, Identity=42%"; Hit description =protein likely ortholog of mouse Ly1 antibody reactive clone (28.5 kD) (3F252) [Caenorhabditis elegans] e
GEQKQDAWVSQVRAAIRQVDEPRLKNLLRSVQCHTNIPRKEAKFVNFLQNSLRIRDRALCVDAWNAIKRAADAEAAKAKRTTAEDAVVTTATEEKETAEHNGDDADKIATGRTDNASATTENMEGQAEEENMEDETAK

SEQ ID NO: 141341 - protein, 53 aa, Heterodera glycines
  Coding regions on vcDNA: vcDNA=SeqID_67764; Strand=-; Position=1 -45,284-400
MTNSTHFVVKISKIKLQGTGNFDKNRDRDLPGPEKSGPGPRFSSGTGTNREFS

SEQ ID NO: 141342 - protein, 102 aa, Heterodera glycines
  Coding regions on vcDNA: vcDNA=SeqID_67765; Strand=-; Position=1-309
MFLTNVIALGEFSSPFPGQKGAPSEAPRLANETLNSVDWPTSAPNVDRFAVADWWQFGIDAGCLGGHCEQCGDTECDPCGHRSAIQPKGHPKENEMHQQIVF

SEQ ID NO: 141343 - protein, 107 aa, Heterodera glycines
  Coding regions on vcDNA: vcDNA=SeqID_67766; Strand=+; Position=1 -97,337-484,1269-1347
  Homolog annotation: Hit_ID=NP_504441.1; Match level="QueryCoverage =89%, HitCoverage=19%, E-value=1e-43, Identity=90%"; Hit description =glutamate-gated chloride channel (55.6 kD) (glc-3) [Caenorhabditis elegans] gb|AAB04959.2| Glutamate-gate
KMDLKLILLNIFSYYLLQLYIPSTMLVIVSWVSFWLDRTAVPARVTLGVTTLLTMTTQTSGINAKLPPVSYSKAIDIWCGACLAFIFSALLEFACVTYISSRMFYKR

SEQ ID NO: 141344 - protein, 30 aa, Heterodera glycines
  Coding regions on vcDNA: vcDNA=SeqID_67767; Strand=-; Position=1 -12,102-182
MTFLRATFGENTDQDQDYGLGIHTDYRLTD

SEQ ID NO: 141345 - protein, 118 aa, Heterodera glycines
  Coding regions on vcDNA: vcDNA=SeqID_67768; Strand=+; Position=1 -250,486-592
MKSIHCNQLKIEYKIISRELNRQIKLFYNEKETKVVPKGNSCIHRHIRNKLGQNASLPPLVSSNGVIVHEKADKCNYTSLWYSAILPSATQCIAVKMCRGPMIDAVQNGSYAVSLLAL

SEQ ID NO: 141346 - protein, 82 aa, Heterodera glycines
  Coding regions on vcDNA: vcDNA=SeqID_67769; Strand=-; Position=1 -168,258-338
MFAKLLLLLFVCIIGKKISLCEQILSPPTQDYSECGISDFDPFNEQRSAEDTEISHVVKGYTVDDDRALPWMATLQRLEGLF

SEQ ID NO: 141347 - protein, 26 aa, Heterodera glycines
  Coding regions on vcDNA: vcDNA=SeqID_67770; Strand=+; Position=1-79
GAGELMPNYNGCREYVWSYSTDRLKM

SEQ ID NO: 141348 - protein, 19 aa, Heterodera glycines
  Coding regions on vcDNA: vcDNA=SeqID_67771; Strand=+; Position=1-59
TFSFSSLALPNTHTIFEML

SEQ ID NO: 141349 - protein, 123 aa, Heterodera glycines
  Coding regions on vcDNA: vcDNA=SeqID_67772; Strand=+; Position=1 -115,164-285,551-671,721-734
  Homolog annotation: Hit_ID=CAA74206.1; Match level="QueryCoverage =97%, HitCoverage=32%, E-value=2e-17, Identity=44%"; Hit description =serine proteinase [Heterodera glycines]
MCQKYPTPKLSDQLMVGKMRMISMEKCIEYTSKDSNKEFTNLSNVLPFVNNTRALLTEFNSAHLKDKLCVIAEPSLAEKGDSGGPLMFKTGKNNNWAQVGVASTSTCNPEKPKSTDGLTIQKV

SEQ ID NO: 141350 - protein, 92 aa, Heterodera glycines; identical to SEQ ID NO: 131693
  Coding regions on vcDNA: vcDNA=SeqID_67773; Strand=-; Position=1-357

SEQ ID NO: 141351 - protein, 204 aa, Heterodera glycines
  Coding regions on vcDNA: vcDNA=SeqID_67774; Strand=+; Position=1 -32,241-399,575-746,940-1023,1087-1203,3133-3154
  Homolog annotation: Hit_ID=NP_999487.1; Match level="QueryCoverage =97%, HitCoverage=14%, E-value=2e-44, Identity=46%"; Hit description =Niemann-Pick C disease protein [Sus scrofa] gb|AAD47090.1| Niemann -Pick C disease protein [Sus scrofa] sp
RINGLCIDRSRNAWALAWEQAFISLLKSYKSDQFSVSFMAERSLEDEISRQSNADAFTVFLSYTFMFIYVAIALGHMRRCRASLVHSKFTLGICGIIGCVLSVSSSIGLFALFNMSATLIILEVEPFLVLAIGVDNIFILVHSYQRLANDVDRPLPDRRLANDVDRPLPDRIAQICEDVIPSMMLSSLSECLCFSLGGLNGAKK

SEQ ID NO: 141352 - protein, 126 aa, Heterodera glycines
  Coding regions on vcDNA: vcDNA=SeqID_67775; Strand=+; Position=1 -114,422-559,801-929
  Homolog annotation: Hit_ID=NP_609357.2; Match level="QueryCoverage =90%, HitCoverage=8%, E-value=1e-18, Identity=37%"; Hit description =CG5722-PA [Drosophila melanogaster] gb|AAF52874.2| CG5722-PA [Drosophila melanogaster]
MPAVQMFSLYASVAILLNFILQLTCFLAVFIWDIQRQESGHLELCGFCVSPVPFQPTDTESRIERWMRDYYAPALLYKFSRCAVIFLFAIWFSLSSAIMNRISAGLDPKIAVPEVQKKMRKGKAFN

SEQ ID NO: 141353 - protein, 19 aa, Heterodera glycines
  Coding regions on vcDNA: vcDNA=SeqID_67776; Strand=-; Position=1-60
EPVNSCIGCKCRRCCTPNS

SEQ ID NO: 141354 - protein, 50 aa, Heterodera glycines; identical to SEQ ID NO: 135818
  Coding regions on vcDNA: vcDNA=SeqID_67777; Strand=-; Position=1-154

SEQ ID NO: 141355 - protein, 127 aa, Heterodera glycines; identical to SEQ ID NO: 133730
  Coding regions on vcDNA: vcDNA=SeqID_67778; Strand=-; Position=1-384

SEQ ID NO: 141356 - protein, 150 aa, Heterodera glycines
  misc_feature (37)..(37): Xaa can be any naturally occurring amino acid
  Coding regions on vcDNA: vcDNA=SeqID_67779; Strand=+; Position=1-1152
  Homolog annotation: Hit_ID=NP_690845.1; Match level="QueryCoverage =86%, HitCoverage=95%, E-value=4e-10, Identity=35%"; Hit description =Mitochondrial protein of unknown function, overexpression suppresses an rpo41 mutation affecting mitochon
TERRTANPSLEASSPTYSNKRVNADQIRQLCPFPPHXFTSSLTLSSKCFATFPHGTCSLSDSWPYLVLDEVYHLIWAAIPNNPTPRHVKMGRHRQLDRSCTFSGAPVKGNLNKRANPCSRSIRYTSQPQRSCDSALDSSQFTRRYYGNPR

SEQ ID NO: 141357 - protein, 56 aa, Heterodera glycines
  Coding regions on vcDNA: vcDNA=SeqID_67780; Strand=-; Position=1 -133,851-888
MFFIGITDLLMIPISSIITGYLAITGAVFCTAPTFIYVCGACAIGFRPSVFDQYHQ

SEQ ID NO: 141358 - protein, 29 aa, Heterodera glycines
  Coding regions on vcDNA: vcDNA=SeqID_67781; Strand=+; Position=1 -7,140-222
MSYIFLDFIAYYFYNFGDYDQYFPKWVHY

SEQ ID NO: 141359 - protein, 18 aa, Heterodera glycines
  Coding regions on vcDNA: vcDNA=SeqID_67782; Strand=+; Position=1-56
ILFDRARQEKATVGTKFA

SEQ ID NO: 141360 - protein, 90 aa, Heterodera glycines
  Coding regions on vcDNA: vcDNA=SeqID_67783; Strand=+; Position=1-273
VQRNEVERHGLPLTDKEHEQWETMAIGGGGADQQQQQQPLQDHLDRLARSREAMVIDGEPQQMISHDEHGQPIGMTTVQVGVINKFIITN

SEQ ID NO: 141361 - protein, 63 aa, Heterodera glycines
  Coding regions on vcDNA: vcDNA=SeqID_67784; Strand=-; Position=1 -144,282-329
MCAGKIGRKDGSAKSMWWHLEGLHMKSSYAEKEMESKKRKRSVLKGTKDKDLKALYAKAYPNL

SEQ ID NO: 141362 - protein, 36 aa, Heterodera glycines
  Coding regions on vcDNA: vcDNA=SeqID_67785; Strand=-; Position=1-108
MPTALPNAGPKLRDMMKYAPPPSTTPLVATADTLMQ

SEQ ID NO: 141363 - protein, 128 aa, Heterodera glycines
  Coding regions on vcDNA: vcDNA=SeqID_67786; Strand=+; Position=1 -144,188-373,422-476
  Homolog annotation: Hit_ID=CAE61836.1; Match level="QueryCoverage =100%, HitCoverage=12%, E-value=4e-56, Identity=78%"; Hit description= Hypothetical protein CBG05808 [Caenorhabditis briggsae]
AKLGLMLGVYLPTIQHILGVTMFIRLAWIVGVAGVSHTFMMLFICCLCTFLTCISVSAVATNGVVEGGGAYFIISRNLGPAFGSAVGILFYLANTVATSMYLVGGIEILLLYLYPGMTIGGKNAHTDT

SEQ ID NO: 141364 - protein, 80 aa, Heterodera glycines
  Coding regions on vcDNA: vcDNA=SeqID_67787; Strand=-; Position=1 -96,155-298
  Homolog annotation: Hit_ID=CAC80545.1; Match level="QueryCoverage =63%, HitCoverage=4%, E-value=4e-17, Identity=76%"; Hit description =putative Na-K-Cl cotransporter [Meloidogyne incognita]
MASNYQGFGFTPLYEKEEPASFYVDKKKIEERAKLGVMLGVYLPTIQHILGVTMFIRLAWIVGVAGVSHTFLMLFICCLC

SEQ ID NO: 141365 - protein, 422 aa, Heterodera glycines
  Coding regions on vcDNA: vcDNA=SeqID_67788; Strand=+; Position=1 -132,192-287,332-472,523-811,902-1230,1410-1688
  Homolog annotation: Hit_ID=NP_494384.1; Match level="QueryCoverage =68%, HitCoverage=20%, E-value=2e-85, Identity=54%"; Hit description =patched family member (ptc-3) [Caenorhabditis elegans]
MNCPEDLIVGGIRRDAQGVQIRHAEAFQTVFLVASAGDVYQRLIRSKNHRMEKFGVSFTQAHAGAIIAAWQRNFTKSIYDHTLNKPAQGIRVVHPLASTSIQDMLEQFSEFQFFVIFIGYVLMIIYAGWSQVHWQGWWFSVKSSCLLAIIGVLVITLASVAGLGLSTAMNIHFNAATTQIVPFLTLGLGIDDMFLLLHNYNDVLEAVRQKEVAVLLKETGMSVLITSINNILAFLTGCILPIPALRSFCGQVAILLTSNVLCIILLFPAFIALDLRRRKAGHRDMSFAALFCCCCNSSCFIGGKKGGGIENGGQKHAKMMEGGAFKKRKECSSRNQLVKTDSTVTTHSSEIDLQQMSAAVFGPPSSGPLMANVNFGPSSSPPSASNNKPVTSSATKSLHKWYTLVGFLHGYYIPLLRRPIAK

SEQ ID NO: 141366 - protein, 16 aa, Heterodera glycines
  Coding regions on vcDNA: vcDNA=SeqID_67789; Strand=-; Position=1-80
FRNKIQNFNGHLAQRN

SEQ ID NO: 141367 - protein, 465 aa, Heterodera glycines
  Coding regions on vcDNA: vcDNA=SeqID_67790; Strand=+; Position=1 -258,397-491,542-698,907-1035,1085-1126,1171-1386,1440-1631,1681-1881
  Homolog annotation: Hit_ID=CAE72420.1; Match level="QueryCoverage =80%, HitCoverage=24%, E-value=1e-102, Identity=51%"; Hit description= Hypothetical protein CBG19582 [Caenorhabditis briggsae]
ANCTGWWKFHVQMNIIHFISRFMRTWLHSLQSSLDRAAKIGIFPDDDLKKMAADALARTDDFLLARKLLCSAGQRFNCTEMIQRGAKLIEDGRINPRGFYNYLTAWFYQDNMMYYVSQAYYVSQAAFFPTPLPWHFSAADESVVPPADPLLYSQIPFYMNGLTDTQSIVQMIKEIRAICDRYSADGLPVYPSGIPFTFWEQYLKLTFYLVSAILIIGVAIIGVAVLLVISIIIFNPWAAAMVAIIVVTMFNPWAAAMVAIIVVTMTVELAGFMGVFGVKMNPISAVTLITAVGIGVEFTAHVVLAFLTSLGSRDERMVACLEHMFIPVEHMFIPVIHGGLSTLLGIVMLAFSEFDFVVKYFFVVMTALVIIGLINGLALLPVLLSLIGPPCEITPVNGITPVNGSNLLPCPASERYRPEDSPNCFTTPSSTHHQQSDEQKRRRGCKRMLAVDDSSSASSTEDGAG

SEQ ID NO: 141368 - protein, 77 aa, Heterodera glycines
  Coding regions on vcDNA: vcDNA=SeqID_67791; Strand=-; Position=1 -135,244-339
  Homolog annotation: Hit_ID=NP_055278.1; Match level="QueryCoverage =97%, HitCoverage=73%, E-value=2e-26, Identity=76%"; Hit description =Lsm3 protein [Homo sapiens] ref|XP_216220.1| similar to U6 snRNA -associated Sm-like protein LSm3 (MDS017)
MATLDAVEEPLDLIRLSLNERVYVKLRQERELRGRLHAFDQHLNMILADVEETVTITETDEETFEEIHKPSKRTIPM

SEQ ID NO: 141369 - protein, 328 aa, Heterodera glycines
  Coding regions on vcDNA: vcDNA=SeqID_67792; Strand=-; Position=1 -202,251-377,425-509,582-772,820-946,1131-1385
  Homolog annotation: Hit_ID=NP_497655.1; Match level="QueryCoverage =89%, HitCoverage=32%, E-value=3e-59, Identity=45%"; Hit description =FtsJ homolog 3 (94.3 kD) (3E173) [Caenorhabditis elegans] gb|AAF39868.1| Hypothetical protein H06I04.3a [
LFSLKTVKRLAERAAKAVKGIKEEEEEKESNDEDDDEEEKDEEKATTKMTKMEKEFDDGLNEAIEEEDEHKLGTKSAKKPKLTPEQLAMGEEMIYSKKRAQDLEDWAWNRYTSNDEALPEWFVSDEKRHCQLEPPVDKERVDFYAKREQRELNTRPIKKVAEAKARKRQRRIRRMEKAKKKAEGIVDNEQMEHGEKVRELRRLYKKAGSNEKRKVTYQVVTKGKRGSMSRPDGHYRLVDKRMKKDMRKQSKTGTKRTNKAKANTFGRKGKMREKSQNPKERMNSERKDGPKQKRKNGKNGGTRRMGGEKRKSGKPNGTRMGGERKRKR

SEQ ID NO: 141370 - protein, 34 aa, Heterodera glycines
  Coding regions on vcDNA: vcDNA=SeqID_67793; Strand=+; Position=1-105
LFSLKTVKRLAERAAKAVKGIKEEEEEKESNDED

SEQ ID NO: 141371 - protein, 24 aa, Heterodera glycines
  Coding regions on vcDNA: vcDNA=SeqID_67794; Strand=-; Position=1 -52,295-317
MEKACKIWRDYIDFSALELLELAS

SEQ ID NO: 141372 - protein, 78 aa, Heterodera glycines
  Coding regions on vcDNA: vcDNA=SeqID_67795; Strand=+; Position=1-234
  Homolog annotation: Hit_ID=AAG45420.1; Match level="QueryCoverage =78%, HitCoverage=11%, E-value=7e-12, Identity=51%"; Hit description =vegetative cell wall protein gp1 [Chlamydomonas reinhardtii] sp|Q9FPQ6|GP1_CHLRE Vegetative cell wall prot
ICAPPAPPPPRKKRPLPRPSPNPPPPPPINANAPLPPAAPPPPPLFALPKPPLPFPLLPLSIPRLLSVDELSITLTIL

SEQ ID NO: 141373 - protein, 106 aa, Heterodera glycines
  Coding regions on vcDNA: vcDNA=SeqID_67796; Strand=-; Position=1 -146,202-341
  Homolog annotation: Hit_ID=NP_499254.1; Match level="QueryCoverage =81%, HitCoverage=10%, E-value=4e-30, Identity=59%"; Hit description =transmembrane cell adhesion receptor precursor; matrix receptor, muscle attachment protein, MUscle Attach
ECAERSLNTCDENADCIDTPQGYSCQCFAGYVDVSSNAHLPPGRVCTVQTSCPKQRTDLIFQTSCPKQRTDLIFLIDGSGSIGSQVSAEKRRIIICDWFRSIKWTC

SEQ ID NO: 141374 - protein, 43 aa, Heterodera glycines
  Coding regions on vcDNA: vcDNA=SeqID_67797; Strand=+; Position=1-505
VKHPISALLCREPAGNGWLLICKKLDWQYVVVKNFCVRNYFLK

SEQ ID NO: 141375 - protein, 69 aa, Heterodera glycines
  Coding regions on vcDNA: vcDNA=SeqID_67798; Strand=-; Position=1 -174,316-351
  Homolog annotation: Hit_ID=EAL35225.1; Match level="QueryCoverage =98%, HitCoverage=10%, E-value=7e-12, Identity=45%"; Hit description =hypothetical protein Chro.30409 [Cryptosporidium hominis]
MRKKKRKAKKENGRKRREEKEKKEEKEEEDEAKEEDEEEEEDEEKDEEKEEEERDGDEAHYERFVYAIV

SEQ ID NO: 141376 - protein, 238 aa, Heterodera glycines
  Coding regions on vcDNA: vcDNA=SeqID_67799; Strand=+; Position=1 -246,613-994,1042-1127
MAKQKRNEFRIERQNSYGQQNCGGDEAKRGGRGSGREGGGAGKWGQRKNNREGSEYNDGEHDNAVDEPNDAGASRMGGNQTMLKKWTLELEDATEVREKGKRKKREKQWPKERQRGIRVRSVQLRRTDRPPLPRGGAGPNPFPAHFGAECAAEPNGGRQRHRRLCVPSDLRFGSSHCVDKTDQKRRHFYSMGHQTAPVHLQLHGHEHTQKNEDIPRKTVEQIHNGNCQCDHGGPGHLL

SEQ ID NO: 141377 - protein, 342 aa, Heterodera glycines
  Coding regions on vcDNA: vcDNA=SeqID_67800; Strand=+; Position=1 -104,218-422,467-1183
  Homolog annotation: Hit_ID=AAO51424.1; Match level="QueryCoverage =18%, HitCoverage=4%, E-value=1e-14, Identity=50%"; Hit description =similar to Plasmodium falciparum. Hypothetical protein [Dictyostelium discoideum]
MVRSVHENVPNVVSFSQMTTVMMRNSNNISIMRMGTAAQFNLCILLERGHFNYIGRIAQLFKVPGYCIDCERRADARYHAIGCKAACRLCFRFGGGYPCQRERLSDGQISSRKCTECGFIFPNDNCYEYHLANDAPAPIDGRGHRQRRSLCQWRRFCPTCGRVAYFGIHQCPSIRRAIGPVDCFRCKGPHMLDEPCYIQPIGVAPPLPMLGPVHNNDDNNNNNNNNNNNNNNNNEDENDIDFIINNLGGEGDEDEDDVENGDDINDDDDDDERDELLPLRLCFFDAETSQERPLQLNNQVAHKHVPLLIVAEFICEPCIRAGININDGQGQRAPGCVCLCGR

SEQ ID NO: 141378 - protein, 24 aa, Heterodera glycines
  Coding regions on vcDNA: vcDNA=SeqID_67801; Strand=+; Position=1-75
SFSIYNLSGTLLDDDAKRQKVLCM

SEQ ID NO: 141379 - protein, 36 aa, Heterodera glycines
  misc_feature (5)..(5): Xaa can be any naturally occurring amino acid
  Coding regions on vcDNA: vcDNA=SeqID_67802; Strand=-; Position=1-108
IMNAXIIRVPKIACDLSLAKKGVSKNRNYAQKASQP

SEQ ID NO: 141380 - protein, 46 aa, Heterodera glycines
  Coding regions on vcDNA: vcDNA=SeqID_67803; Strand=-; Position=1 -67,619-692
MGRKSRGNGENETDQNLQVKQENKMSEIWSFYKKSQTSETALCPLS

SEQ ID NO: 141381 - protein, 304 aa, Heterodera glycines
  Coding regions on vcDNA: vcDNA=SeqID_67804; Strand=+; Position=1 -87,271-390,443-618,668-867,912-974,1028-1296
  Homolog annotation: Hit_ID=CAE65983.1; Match level="QueryCoverage =82%, HitCoverage=50%, E-value=3e-32, Identity=33%"; Hit description =Hypothetical protein CBG11172 [Caenorhabditis briggsae]
VFDKEKADNEPKGKDPTWFLVILLPIVALMLSQIVFTERAHSIPFALPSAEGFFKACGTIIVSCLAQSLVLPMENKIKKPSQMLGPFGVLSGGIAISTIVYAIVGFLGYSAYGESLRDSVLDHLECVSNAKELTVLTYIIRIALCLSIFASFMLQMFVIVGVLWPLLEKRIEKLSRIWKIGIQFIFRAILVSVCLAISYSINNLAAIIRLIGVTTGTLLAFVLPAIFDLLTFVPLFRSQNRLREANVRLGINIGIIGFGFVILVGGLVVNVITMANKEEDWKCAANATTSGNVTATTQSYTTPI

SEQ ID NO: 141382 - protein, 62 aa, Heterodera glycines
  Coding regions on vcDNA: vcDNA=SeqID_67805; Strand=+; Position=1-292
HCAQMGICLLLLNGILGIENSESEEDKSMLWLCRCFNSKFVGPSERKRRRLLNFLLINLAFF

SEQ ID NO: 141383 - protein, 87 aa, Heterodera glycines
  Coding regions on vcDNA: vcDNA=SeqID_67806; Strand=-; Position=1-1137
IIFIQKIFFWVFGAVPLNRCAQIYGETESFRNSFTIACTLILRWIFAPNNCLSTPNGHLKKSIYFCFRGSPPEPMRPDLWGDRILRE

SEQ ID NO: 141384 - protein, 75 aa, Heterodera glycines
  Coding regions on vcDNA: vcDNA=SeqID_67807; Strand=+; Position=1-272
VPPPFGFAVVVDVPPPPCVVVVVVSLSLLPMPKMPKVPSTIRRKVKRAQKVLKFASWVILILCSLYGGLFLSFCE

SEQ ID NO: 141385 - protein, 34 aa, Heterodera glycines
  Coding regions on vcDNA: vcDNA=SeqID_67808; Strand=-; Position=1-432
GFVFDFAFFPFIPIDHVNSFSIHLVSYFMKLYII

SEQ ID NO: 141386 - protein, 193 aa, Heterodera glycines
  Coding regions on vcDNA: vcDNA=SeqID_67809; Strand=+; Position=1 -177,217-301,519-692,734-879
MFRRILSNAKRQRIYVDDLIRNAKIEPNKKNYGIDELRQIQEYLNQEFPGKFLIAAFTKEWGIKPIYKGDGPKKYIVCVFHENDHWDGLNFPCEKEGREPIECLKCNRLFFSDFCFQNHLKLACKLYRRCTLCDSEYNTRNKHICGIKFCNFCKVKHAKSESCYIKKINIPKNLPRYRIVSYDIECSVSIEKS

SEQ ID NO: 141387 - protein, 34 aa, Heterodera glycines
  Coding regions on vcDNA: vcDNA=SeqID_67810; Strand=+; Position=1-106
VRLGYSNIYWGAKIQRRIKVQTIGKLFPKDSVSP

SEQ ID NO: 141388 - protein, 34 aa, Heterodera glycines
  Coding regions on vcDNA: vcDNA=SeqID_67811; Strand=+; Position=1 -19,418-503
MTNSNLGNDKFQPGRAHISDKLPIIISLEQLIIC

SEQ ID NO: 141389 - protein, 56 aa, Heterodera glycines
  Coding regions on vcDNA: vcDNA=SeqID_67812; Strand=-; Position=1-595
RQNAHLKLRKYKLIFAIRTDYLVNRKQINHKIRTKNDFILECTLKMHNKLIYSNLF

SEQ ID NO: 141390 - protein, 133 aa, Heterodera glycines
  Coding regions on vcDNA: vcDNA=SeqID_67813; Strand=+; Position=1-402
  Homolog annotation: Hit_ID=ZP_00237190.1; Match level="QueryCoverage =83%, HitCoverage=32%, E-value=5e-09, Identity=31%"; Hit description =erpL protein [Bacillus cereus G9241] gb|EAL15046.1| erpL protein [Bacillus cereus G9241]
MAIFFLSPQRRDAPYRRPDPATKKADPKKVPAPGVKKLLTEVLSEINTLSDALNKHAAEFSRFFHFIVKQAQIGEQEDEKERQARKAEDEKERQARKAEDGKEKQAKKVEDGKEKQAEKAEEGEKQPEPAKED

SEQ ID NO: 141391 - protein, 64 aa, Heterodera glycines; identical to SEQ ID NO: 129150
  Coding regions on vcDNA: vcDNA=SeqID_67814; Strand=+; Position=1 -208,471-1138

SEQ ID NO: 141392 - protein, 65 aa, Heterodera glycines
  Coding regions on vcDNA: vcDNA=SeqID_67815; Strand=-; Position=1 -52,166-311
MFIVLPFVRVVIESSAKDDNPINFIQPELAFSQQKMDILFICLAFIRSSNEKRAVIFELLSFMQS

SEQ ID NO: 141393 - protein, 95 aa, Heterodera glycines
  Coding regions on vcDNA: vcDNA=SeqID_67816; Strand=+; Position=1-660
LFEYPKRTLEKIDFFVFGAVPPNRCAQIYGETESFGNSFPIACTLILRWIFAPHNCLSTPNGHLKKSIFLFSGQSPRADAPRFMGRPNPSGVASL

SEQ ID NO: 141394 - protein, 166 aa, Heterodera glycines
  Coding regions on vcDNA: vcDNA=SeqID_67817; Strand=-; Position=1 -402,479-577
MAFQSLGLKPPAAIQSLRLKPPAFQSLGLNPPAFQSLGLKSPAFQTLGLNPPAFQCHSNLWDSPQPAFQAMRLNSQAFQSLGLNPPTFQSLGLKSPAFQTLGLNPPTFIGIPISGTQPTSISISGTQPTSISISAFQSLELKSLAFQTLGLKSPAFQTLGLKSAAF

SEQ ID NO: 141395 - protein, 181 aa, Heterodera glycines
  Coding regions on vcDNA: vcDNA=SeqID_67818; Strand=-; Position=1 -303,577-819
MALLRFNAAKSSRGKILLTNAGFEYAFEVQQTNVKNLISDFKALSKVKDGWEYWRCPCRSPYCPGRACVQIEWHQEADGVQYKLGRVTKEHNHPATFGAELEGDAGLDAVPTHDIVIPDQLVDRVIYNQNLKGSRMIIFCSQFGINTLRAYRDEVAVDGTFEVVRKVGCQINVDLDESTWF

SEQ ID NO: 141396 - protein, 88 aa, Heterodera glycines; identical to SEQ ID NO: 124691
  Coding regions on vcDNA: vcDNA=SeqID_67819; Strand=+; Position=1 -96,135-305

SEQ ID NO: 141397 - protein, 124 aa, Heterodera glycines
  Coding regions on vcDNA: vcDNA=SeqID_67820; Strand=+; Position=1-375
MSGYVPTVAMFAVALLLHCFALSRVFMIVHFKLNTHKDMSPLLMALILNWTLFCLLVIPYEVYSIANWRPTQGMYCSAAFTLYCRPLLGEVREARVPSRSPNQAPSRDFLISGISSRVRKTHYF

SEQ ID NO: 141398 - protein, 53 aa, Heterodera glycines
  Coding regions on vcDNA: vcDNA=SeqID_67821; Strand=+; Position=1-168
MMQIRSKVRKNTETGIMARKRWHGKAMTNSTKPGWYNSKGGRNNGQNPKRIDW

SEQ ID NO: 141399 - protein, 44 aa, Heterodera glycines
  Coding regions on vcDNA: vcDNA=SeqID_67822; Strand=+; Position=1 -67,417-484
MDANKCPTANMPIIRGTYYGTRIRVYSRPWSSVAYQNQMRVPIK

SEQ ID NO: 141400 - protein, 20 aa, Heterodera glycines
  Coding regions on vcDNA: vcDNA=SeqID_67823; Strand=+; Position=1-65
TDQKRTKLCRDTERKRNNLF

SEQ ID NO: 141401 - protein, 69 aa, Heterodera glycines
  Coding regions on vcDNA: vcDNA=SeqID_67824; Strand=+; Position=1-210
MGNEKQQSQEVKTDSKMDSENGGRTDGGKADGGKADGGKADGGRTDGGRTDQVVSEPHRLTRVFEKKRP

SEQ ID NO: 141402 - protein, 118 aa, Heterodera glycines
  Coding regions on vcDNA: vcDNA=SeqID_67825; Strand=-; Position=1 -159,848-916,1694-1822
MPIKRNFCLISQKPNGDWTFKSECRRSDASAPDGGTSKSGTVEHRGLQEGPDNDNRHSLRGGPHSWQCPQTHHLPNYPFLFLFNVFVFHASPAEAVVPPTSGRRHFGGHSLDGTDGRD

SEQ ID NO: 141403 - protein, 18 aa, Heterodera glycines
  Coding regions on vcDNA: vcDNA=SeqID_67826; Strand=+; Position=1-56
YREAIPEGFGLPINLGAS

SEQ ID NO: 141404 - protein, 56 aa, Heterodera glycines
  Coding regions on vcDNA: vcDNA=SeqID_67827; Strand=+; Position=1-168
MQQIFVDNLPGFPDNIRISRSADSFYVALPFHRSEQKPHIFDRLGPWPLARKFIGE

SEQ ID NO: 141405 - protein, 86 aa, Heterodera glycines
  Coding regions on vcDNA: vcDNA=SeqID_67828; Strand=-; Position=1 -171,335-424
MSKRMDMPPLGSQTLAKARFSSQHPTGKMYTNYDRKMGSENASLNQDFFKTRYGSSIGAVLICINRGGILLGFNSKDVLGWIRSHE

SEQ ID NO: 141406 - protein, 35 aa, Heterodera glycines
  Coding regions on vcDNA: vcDNA=SeqID_67829; Strand=+; Position=1 -51,102-158
MPGCGNKYYDHVKHCAMVNFYDNEPDKNPKEDPPQ

SEQ ID NO: 141407 - protein, 21 aa, Heterodera glycines
  Coding regions on vcDNA: vcDNA=SeqID_67830; Strand=+; Position=1-63
TVHIPWGRGKSRTTGRTSYGT

SEQ ID NO: 141408 - protein, 21 aa, Heterodera glycines
  Coding regions on vcDNA: vcDNA=SeqID_67831; Strand=+; Position=1-63
MRKKMFDRARQEKATVGSKFA

SEQ ID NO: 141409 - protein, 21 aa, Heterodera glycines
  Coding regions on vcDNA: vcDNA=SeqID_67832; Strand=+; Position=1-63
MNGGSIKDDDDDELTTKATKT

SEQ ID NO: 141410 - protein, 240 aa, Heterodera glycines
  Coding regions on vcDNA: vcDNA=SeqID_67833; Strand=+; Position=1-723
MEQQDGLWPLSSTDRCQSRANCNAIGENGGLVALSGEETDESQCTTPTETLSPIVRRKTTDSKEGTKIREEKRAVEGTHGNVKVTDGIMLEKRGTQRATERQNDDERETDNRAPLDSPRSQNQHCTDVLIPTSNPIFAPCARPFFHNKMPILRPNKRNGPSLDELHLADGIGAECFADGTHGERRRTSRHQIPSVSMEKSNLPSNKNTWRTPSRLICNFEESILNGRIPANSVVSGSLKN

SEQ ID NO: 141411 - protein, 98 aa, Heterodera glycines
  Coding regions on vcDNA: vcDNA=SeqID_67834; Strand=-; Position=1-296
  Homolog annotation: Hit_ID=CAH17895.1; Match level="QueryCoverage =100%, HitCoverage=18%, E-value=2e-23, Identity=51%"; Hit description= Protease-1 (PRT1) protein, putative [Pneumocystis carinii]
SSTPPPPTPTPPLAPTPPPPTPPAAAPLPPAPPAAAPLPPAPPAPAPPPATPHAPSASPAPPTPAAPSTPPPTPAPPPTPAAEGEEALENATDEGAST

SEQ ID NO: 141412 - protein, 18 aa, Heterodera glycines
  Coding regions on vcDNA: vcDNA=SeqID_67835; Strand=-; Position=1 -53,544-547
MPNSQFHYYYFTWMPPHG

SEQ ID NO: 141413 - protein, 19 aa, Heterodera glycines
  Coding regions on vcDNA: vcDNA=SeqID_67836; Strand=-; Position=1-71
NRTLTDDLMEKNPRRREFN

SEQ ID NO: 141414 - protein, 30 aa, Heterodera glycines
  Coding regions on vcDNA: vcDNA=SeqID_67837; Strand=+; Position=1-89
HILAHSVEVLSIPPPGQQFFRSVQICCFVR

SEQ ID NO: 141415 - protein, 748 aa, Heterodera glycines
  Coding regions on vcDNA: vcDNA=SeqID_67838; Strand=+; Position=1-2246
  Homolog annotation: Hit_ID=NP_494149.1; Match level="QueryCoverage =95%, HitCoverage=48%, E-value=1e-141, Identity=40%"; Hit description= predicted CDS, putative protein of ancient origin (2C297) [Caenorhabditis elegans] gb|AAF39854.1| Hypoth
MMMKEEEDEEVERARNENREPAEIKLLFETGRQLDRRLGYNVPRANEVAAVYVPGADGEVPNAKIVVRERGKELKILKSTDSMVTPMTYPLFYPRGTLGWHPEMKHRNSNRRVTRLQYVSYTVAIREREFNPILYGGKLFQQYCVDEYVKIEGDRMNWIKCNQKKILADAYKNVDNMLMRRAEERGLPLGRKVILPPSMTNSPRYVEKHFQDAMAVVRRFGKPDMFLTMTCNPQWEEISENLFHEQKSSDRPDLVVRVFNLKVKAIMNEIVKKKVFGEVIAWMYPVENQGRGLPHIHLLLTLAEQDKLINGEDVEKKGISARIPDKELEAELFDLVKRFMIHGPCGNLNPNCPCMEEFVDKNGMKGRKCSKGYPKAFQEETVVLENGLALYARPNDGRTVQIFANGRRHELDNRWVVPHNLYLLKMFKCHINLEKVNSVSSVKYLHKYVHKPPDRARLELEERNDHDEVKEFIDARYVCPQEAVWRIFELPMYDRSHCIMSLPVHLQGEHICYFDENMEEEEIRERIANGSELMAYFELNKTNVLAKTMFYHQIPEKFCFKKGKWTERKTYFNTIGRMVKVSPAEPERYHLRLLLLNVKGACSYDDLKSVFDTNGNAKVCETFSAACLERGLIRNDEEWKRALEEAESFEMPWKLRAFFALILVHCNPAKPEELWNMFKDSLSEDFRRNFRKEVAYAKAYREIALSIIKAGKTLADFPTMEQINVDDDVEQMFDLAEELDLGQRNLCL

SEQ ID NO: 141416 - protein, 550 aa, Heterodera glycines
  Coding regions on vcDNA: vcDNA=SeqID_67839; Strand=+; Position=1-1653
  Homolog annotation: Hit_ID=NP_494302.1; Match level="QueryCoverage =99%, HitCoverage=39%, E-value=2e-91, Identity=36%"; Hit description =predicted CDS, putative protein of ancient origin (2C878) [Caenorhabditis elegans] gb|AAB95006.1| Hypothe
MPWKLREFFALILVHCNPAKPEELWNMFKDSLSEDFCRSFRKELAYAKAYKEIALSIMKAGKTLADFPTMEQINVDDDVEQVFDLAEELDLGQRNYALMYDEQRKISDEILHRIWNSVNEPAFYFLSGPGGTGKTHVNKTIVHMLRGQKKKVCTMAFTGIAATLLPAGRTLHNRFGLTLDMSNSSISPRSRVWQELKETDLFICDEAPMINKRAMRTLDEKLKEIMNNGIAFGGKVLLWTGDFRQTLPIQKHATRAEMVSSTIKRSEYWRLAKRYKLTKNMRALATEQEFTRDLLEIGSGKWNNENDEIILPDNCISNGDLAEEIFGQCIVLENWNEMAKSAILAPKNVDVSEMNNKVLEMLSGEEVVYTSIDLAQDENRQRADDYLDEYLNALNPSGFPRHKLRLKKNAIVLLMRNLNIEMGLCNGARMKVEQMQPNLIVCKILTGDKAGQTVYIPRITLCCSEDYPFDLHRHQFPLVLAFAMTINKAQGQTLEQVGIDLRKDVFSHGQLYVALSRARAWNKLRIRLDDGNLERKVKNVVYRELLDNSD

SEQ ID NO: 141417 - protein, 100 aa, Heterodera glycines
  Coding regions on vcDNA: vcDNA=SeqID_67840; Strand=+; Position=1 -84,138-356
MQQELINQATAAIALCHKKFRFSGTLQELSAQRLLLVSQERLALLNRQMDQLNEQRILTNLSVQQLDDIPESVDFDNEDELESVTPLARCTLYIDKIVIF

SEQ ID NO: 141418 - protein, 580 aa, Heterodera glycines
  misc_feature (14)..(14): Xaa can be any naturally occurring amino acid
  misc_feature (125)..(125): Xaa can be any naturally occurring amino acid
  misc_feature (150)..(150): Xaa can be any naturally occurring amino acid
  misc_feature (443)..(443): Xaa can be any naturally occurring amino acid
  Coding regions on vcDNA: vcDNA=SeqID_67841; Strand=+; Position=1 -211,264-381,427-634,731-1008,1109-1346,1392-1492,1678-1860,1906 -2065,2707-2757
  Homolog annotation: Hit_ID=NP_497319.1; Match level="QueryCoverage =94%, HitCoverage=36%, E-value=4e-53, Identity=28%"; Hit description =putative protein of fungal and metazoan origin (147.6 kD) (2P527) [Caenorhabditis elegans] gb|AAK68489.1|
LDPSPFYVQINCPXAFNYYGIIPPFCLIADLLAALSRKAVPRDLECIFDFVEPWLCGRSSGRAQKKAYRILAEIYRRIGEPELETILAEIYRRIGEPELETLFEAKRTFLRAHWKRNEGIEWDAXTHFVYHILQVLSSFTEFDQLEWDAXTHFVYHILQVLSSFTEFDQLAEFSASISAEIVAFLSRLNNRSTRHQSALCLSEMSSALIRLDSPGTNTASSALHPLLSNLFSSKPAKMVPSRPFNVLIALNILAQKHCRLMDASLLAQFVAYSSSALRISPAAVRPLPIRILRILSAKMEQFMFDQFKDLIIESVFSQDTRTSTSRMRKANALLLAQLLERLELETLLKFAGDRLVWQKQLKNIEKRRRRHRRDKAEKGEEEDDDSGKSAISWTTAGGRTSAISWTTAGGRTAKADSIFDILRDSSDEEEEGEDENEMVKKKXKSINTKPPLSGKLDLLDQQSMLQKVTLVGNEKSANKSERKKPGKRQKGKRGFKTNKEGKLLIALGQEAAFKTNKEGKLLIALGQEAAKKREHQKGRHLRKGRNGERGEEAKHDEDGGGRNKKRIKTNKTNKIKIYPW

SEQ ID NO: 141419 - protein, 70 aa, Heterodera glycines
  Coding regions on vcDNA: vcDNA=SeqID_67842; Strand=-; Position=1-234
  Homolog annotation: Hit_ID=NP_493718.1; Match level="QueryCoverage =80%, HitCoverage=4%, E-value=3e-09, Identity=55%"; Hit description =PaTched Related (ptr-3) [Caenorhabditis elegans] gb|AAC48225.2| Patched related family protein 3 [Caenorha
MFWLGFRFGNFNFVVFFKFSQLKGSLLCVTPFLVLALGVDDAYLMLNAWQRLRIRRALAFLAQFTQILVH

SEQ ID NO: 141420 - protein, 79 aa, Heterodera glycines
  Coding regions on vcDNA: vcDNA=SeqID_67843; Strand=-; Position=1-387
LISSQKSCQFKTAKKAEFSKFFISIFFYSSKFSVLFSRLIEPVKSFRMISRLFDSVNNFKSYINSKLAQTELARRSWPV

SEQ ID NO: 141421 - protein, 90 aa, Heterodera glycines
  Coding regions on vcDNA: vcDNA=SeqID_67844; Strand=+; Position=1-273
MIAQSVPNIGHYYDEEEVMEDEEEYSYEEIDEEEEEEEEEVEKEEKRTVAARALPAAQLAEGGGQNRTAQGNDQLCHLADECRRQFLNIF

SEQ ID NO: 141422 - protein, 261 aa, Heterodera glycines
  Coding regions on vcDNA: vcDNA=SeqID_67845; Strand=+; Position=1-786
MLMIPEAEYCALRSAMNSGDYLQNEKASLDAKISQNLQDPDISEDLKAKRHDWLYKERRTVKGILENRPQKVVIENHVPGPNVAPYLGLNNQSKPQETEEPRKIIIPRKRLKEQTPDPESDNDTLEELTPEPQTTSTLKTPVPIKTIIHPTLLNGLFRYVKENKDLFKITAAGKVQSNMNLPIENSNYRDVLLYLAGKKDETPRGAKFLKDRLLKDPTVKDMVDKSKVMWGRGRKKAIKSIKTPGIVREKKPFKPLIWARL

SEQ ID NO: 141423 - protein, 86 aa, Heterodera glycines
  Coding regions on vcDNA: vcDNA=SeqID_67846; Strand=-; Position=1 -99,149-287,685-707
  Homolog annotation: Hit_ID=CAE70223.1; Match level="QueryCoverage =83%, HitCoverage=4%, E-value=3e-11, Identity=41%"; Hit description =Hypothetical protein CBG16703 [Caenorhabditis briggsae]
MGEDVERLDMVQLFNTMRQEQRLAQAFAQMGLRRDYQPILHLMDLSEEKPGAYALDYREANPEWLNNLDKDKVDEGIGTEILPFFA

SEQ ID NO: 141424 - protein, 331 aa, Heterodera glycines
  Coding regions on vcDNA: vcDNA=SeqID_67847; Strand=+; Position=1-996
  Homolog annotation: Hit_ID=EAL48886.1; Match level="QueryCoverage =99%, HitCoverage=41%, E-value=5e-15, Identity=23%"; Hit description =hypothetical protein 58.t00022 [Entamoeba histolytica HM-1:IMSS]
MENENEKSKMVATNKEFIAVIEKIKSKKTITAKDKKALQNLCIFNKLYIKHNGTIEGIATNLEQKISEQKKKQPKLMEKIEKKLHLKTKEEKQLEQVKNIQQKLKGIVDKIHGIEKSSGTDLWDIAKEFCAEEESGKEKKVDEQNKEIIETNASSSSSLSEPKQKKSKTKKEGTADGGKKRTHLLGKIDQILHHEETDEEKLLNEINQIVTDNFMNEFEKAKKAYQNEADIKEAEEKLEQIKKILKILNNELFTLNKKESQISTELESIETEMEKVGKKIADLDNEITTNTEKAKRQAKIIWEELKKMKEHFAKKLEANNSNVGEGAKETA

SEQ ID NO: 141425 - protein, 58 aa, Heterodera glycines
  Coding regions on vcDNA: vcDNA=SeqID_67848; Strand=-; Position=1 -82,305-399
MKAQSELRRITSSASLHWPIGCLNNSEMQCFSHCDFAVRIVNNPKSNSENETTDEFIR

SEQ ID NO: 141426 - protein, 53 aa, Heterodera glycines
  Coding regions on vcDNA: vcDNA=SeqID_67849; Strand=+; Position=1 -97,329-392
  Homolog annotation: Hit_ID=AAM74953.1; Match level="QueryCoverage =100%, HitCoverage=19%, E-value=8e-24, Identity=100%"; Hit description=chorismate mutase [Heterodera glycines]
MNSSVVSFSLLLFGLFTIRTAKSQCEKHCTKSKPMGQCNEAEEVILRNSDCAF

SEQ ID NO: 141427 - protein, 32 aa, Heterodera glycines
  Coding regions on vcDNA: vcDNA=SeqID_67850; Strand=+; Position=1 -84,337-351
MATMGRMVVAFLTTNSRQMTMNYVLIDRAKID

SEQ ID NO: 141428 - protein, 112 aa, Heterodera glycines
  Coding regions on vcDNA: vcDNA=SeqID_67851; Strand=-; Position=1 -182,350-506
MHLIWFCIFANCFLHRNGHETFAMATLIDNWTNCSDKKPNLECAFPRHQPNWPVVQSIDDESPSLKKVSRSEITLKITKKFGVGISNIAENNPYIILVVMLTDSTFETLMKR

SEQ ID NO: 141429 - protein, 42 aa, Heterodera glycines; identical to SEQ ID NO: 125794
  Coding regions on vcDNA: vcDNA=SeqID_67852; Strand=+; Position=1 -71,113-170

SEQ ID NO: 141430 - protein, 70 aa, Heterodera glycines
  Coding regions on vcDNA: vcDNA=SeqID_67853; Strand=+; Position=1-213
MAQPSEEEPSTSEAPARDNDGQPSSTPTPVTPLEMDVPSVEMVDTDVQIPFTPADEDQQIHQCRHIHGTL

SEQ ID NO: 141431 - protein, 104 aa, Heterodera glycines
  Coding regions on vcDNA: vcDNA=SeqID_67854; Strand=+; Position=1-437
KWSSKNRNYAQKASQTILTLPIPSTIAFIHPIMSAKIIRVPKIACDLSLEKNGLSKNRNYAQKASQTILALPIPSTIAFIHPIMSAKIIRVPKIACDLSLEKMV

SEQ ID NO: 141432 - protein, 232 aa, Heterodera glycines
  Coding regions on vcDNA: vcDNA=SeqID_67855; Strand=-; Position=1-699
MKRTNASNITPPRAKRAMPPALDLDQNTATLEEQERQRTLVFIGLPESNAIRPSERVQEDREAITKILDHLEVEAQPTAVFRLGRYDPQRTTPRPLKVVMPTPTHQHVVLGGWKRERARLRSQQNLNRLFVRPALSKEQLKEEYEARLRKRQQNPAPPAPPTQLPKTTNDQTPDVAKGPNQNEASEDVSKPPDVFDQKILACYAALISLPPTDKIVHQIQSLKKQYPHLFNK

SEQ ID NO: 141433 - protein, 193 aa, Heterodera glycines
  Coding regions on vcDNA: vcDNA=SeqID_67856; Strand=-; Position=1-579
MKRTNASNITPPRAKRAMPPALDLDQNTATLEEQERQRTLVFIGLPESNAIRPSERVQEDREAITKILDHLEVEAQPTAVFRLGRYDPQRTTPRPLKVVMPTPTHQHVVLGGWKRERARLRSQQNLNRLFVRPALSKEQLKEEYEARLRKRQQNPAPPAPPTQLPKTTNDQTPDVAKGPNQNEASEDVSKPPD

SEQ ID NO: 141434 - protein, 52 aa, Heterodera glycines
  Coding regions on vcDNA: vcDNA=SeqID_67857; Strand=+; Position=1 -72,220-306
MSKSVIDGIKLILSTAEHSDVHFLSFPGAPIGPPDACFVNWFLTRIRSFSDF

SEQ ID NO: 141435 - protein, 82 aa, Heterodera glycines
  Coding regions on vcDNA: vcDNA=SeqID_67858; Strand=-; Position=1 -100,861-1009
MPWKIVALINKKDESTDNEKWLGFFLLCDASEEELPGFMISYPENHSKYAFMILVRIIFLKICSDAGFGIGRKRKPNSYSEL

SEQ ID NO: 141436 - protein, 198 aa, Heterodera glycines
  Coding regions on vcDNA: vcDNA=SeqID_67859; Strand=-; Position=1 -243,289-465,519-694
EEPTTFISIRSVLINGPSVVPLPFLSSLFHLCLCSGQRFFQPLSVPAALCPSASAPPVDPMGPLLALSAADNGQSHPKQQKQDAPLAPRVPFIYQQSLAAAATAADGEDNPPWLRGNPQPKNGLRGSNAWQEAFEGGKAKANFGASFGSELGEAWIEANKATAKERHRMELMAQIEENRQRKMRERQRDWEREEKERI

SEQ ID NO: 141437 - protein, 90 aa, Heterodera glycines
  Coding regions on vcDNA: vcDNA=SeqID_67860; Strand=+; Position=1-273
PPPPPYDAGASSPFEQPHQQHQSPSPYGMMYSGGNVPSPPPPSSPYHQYQQQAPPQMSPPFQPPIGDPQQQVGGMPSQANQEKIDANDGI

SEQ ID NO: 141438 - protein, 98 aa, Heterodera glycines
  Coding regions on vcDNA: vcDNA=SeqID_67861; Strand=-; Position=1 -294,480-482
MLVQQGLMQMLMKTDLEPMNVRCEFCDALHFVEKKMSGRGNSFKDCCHYGKVFVPEIPKQDFPEELKDLFIKFYARHVNFFENIRHLNSSVSFASMNP

SEQ ID NO: 141439 - protein, 57 aa, Heterodera glycines
  Coding regions on vcDNA: vcDNA=SeqID_67862; Strand=+; Position=1-272
RDGPRFRFSHFAFRIIRIFWRFAFRFLARKATFTPLRIGLNSHKIFQNFTYKLANFQ

SEQ ID NO: 141440 - protein, 467 aa, Heterodera glycines
  Coding regions on vcDNA: vcDNA=SeqID_67863; Strand=+; Position=1 -1023,1392-1772
  Homolog annotation: Hit_ID=S08405; Match level="QueryCoverage=73%, HitCoverage=29%, E-value=2e-41, Identity=32%"; Hit description =hypothetical protein 2 - silkworm transposon mag
MVSFFRKFIPNFAQIAYPLNKLTRGGAIEFEWGENEEKAMNLLKNHLLKSPSLRAPNYALPFYLFTDASALAYGGALMQAGNGEMFAIGYWSRTLTDVESRLPPTHGELAAIVHAVHNFRPIVYGTELVILTDHRPLTFLFNKASSNPKLNRWLMAIQEFEPKVIYLEGRANKVADALSRVPIAWNSIEAQFKDEIPHLLAIEEAIDREKLERETKSDHLLSRVITKIRENWIDPIEEELLPYYQSRDSLYMEGGLIRKRPNGLIVVPKTMQIQILEVIHKAHFGIVRSKAKARKHVWWPKITEDIENFVKECVICQRNAASPPRIDPEHRWPESRFPFEREYRSSPCPTLDGNCPAQLFLKREMRTGMDRIKMPKMKDTNGADPQVGDEMRNVQRKGAESRHNSKRNFEPGDAVWAQQAGEKNRWGPGVLLEPIGERMWRMELEGGGEKTVHVDQIKERRIASARH

SEQ ID NO: 141441 - protein, 36 aa, Heterodera glycines
  Coding regions on vcDNA: vcDNA=SeqID_67864; Strand=+; Position=1 -87,325-348
MCQSNGTTVPLVRFIKENINQQEIKKFVNQHNQYAS

SEQ ID NO: 141442 - protein, 135 aa, Heterodera glycines
  Coding regions on vcDNA: vcDNA=SeqID_67865; Strand=+; Position=1 -138,192-293,363-530
MVAEIYAITGNLRPNEEILTEYTGGQRSHVFARNDDMEQFFQALDEKINPCESSKAELLKKNLPSPAAKLRDDKNRTGVELLILPQNDSNSPKNFVKNSQKTEQQQQLVNNREQLPFLPKNLKLECNNVGKVTKI

SEQ ID NO: 141443 - protein, 216 aa, Heterodera glycines
  Coding regions on vcDNA: vcDNA=SeqID_67866; Strand=+; Position=1 -234,286-699
  Homolog annotation: Hit_ID=AAU04808.1; Match level="QueryCoverage =50%, HitCoverage=52%, E-value=1e-15, Identity=36%"; Hit description =unknown [Atrina rigida]
MPLSLLVEEQAHVSAAAEAAAEAASAVDQKMSAAPNDTPAITDTKIDFMTDEQTVAAAPPPLFSEIEPTQQQQQKQQQGRTAEIIAPKVELSAEDNGDDDDDDDDDDDDETGQQVKQEADRNGMDAHHSNCAKGPLLFIDEQENEEEESEEDEDISTTHRRQGMDSSFDYEDDDDDDDNDDDDDDDDEMESVSGCAESDKCGHCHHPHQLPRNALE

SEQ ID NO: 141444 - protein, 74 aa, Heterodera glycines
  Coding regions on vcDNA: vcDNA=SeqID_67867; Strand=-; Position=1 -51,141-314
MAKETDDWTIKADWTHKFEDGLAVNDKWAMSNLLGMASQLNFTFQLGPLGGKRGYMVQLFILETTMVFGMVNNR

SEQ ID NO: 141445 - protein, 257 aa, Heterodera glycines
  Coding regions on vcDNA: vcDNA=SeqID_67868; Strand=+; Position=1 -41,89-257,309-561,894-1018,1669-1851
  Homolog annotation: Hit_ID=CAE73686.1; Match level="QueryCoverage =99%, HitCoverage=28%, E-value=1e-74, Identity=67%"; Hit description =Hypothetical protein CBG21197 [Caenorhabditis briggsae]
MQSWKALKHRTANMDVLVVLATSIAYAYSVSVLILAFLLQWSSSPMTFFDVPPMLFVFISLGRWLENKAKGKTSEALSKLMSMQAKVAILITRDEKTGQITSERGIDTELVQRGDLIKVMAGEKIPVDGIVVEGKSSADESLITGESMHVVKKPDSPVIGGSLNQSGLLIIRATHVGQDSTLSQIVRLVEEAQSSKIRTVVFDKTGTITEGKPRVVKLFTTLPPSQLSIHRLALLMGSAESNSEHPIGGAIVRFAQK

SEQ ID NO: 141446 - protein, 66 aa, Heterodera glycines
  Coding regions on vcDNA: vcDNA=SeqID_67869; Strand=-; Position=1 -136,381-445
MVCGSFVAIAMNVLIIYCALRIFNRKNRDTIHVYIISMTMGDLILVICQFLESMNRLTPVQFISSS

SEQ ID NO: 141447 - protein, 46 aa, Heterodera glycines
  Coding regions on vcDNA: vcDNA=SeqID_67870; Strand=-; Position=1-140
MHRIIAAVKKLVVGSVLAVRCTLCVLLVWLAFLPVFPPALAFTGRR

SEQ ID NO: 141448 - protein, 127 aa, Heterodera glycines; identical to SEQ ID NO: 131127
  Coding regions on vcDNA: vcDNA=SeqID_67871; Strand=+; Position=1 -61,115-374,575-634

SEQ ID NO: 141449 - protein, 26 aa, Heterodera glycines
  Coding regions on vcDNA: vcDNA=SeqID_67872; Strand=+; Position=1-78
PQFECAVIACADNPILVRRHVHTCDL

SEQ ID NO: 141450 - protein, 41 aa, Heterodera glycines
  Coding regions on vcDNA: vcDNA=SeqID_67873; Strand=-; Position=1 -64,474-535
MYHRNKGYYSTYCTFCGGLIKVHFLSKFRHFMEIFFFGNNS

SEQ ID NO: 141451 - protein, 258 aa, Heterodera glycines
  Coding regions on vcDNA: vcDNA=SeqID_67874; Strand=-; Position=1-775
MDDFYIVLPSNTPGPGNSTSKFTVRLPETLELGTNWSVALSSIIYPYSFTALGINGQEFIKVWENDSSVPTQVYLPDMNFKTAGGLGNKINEAFSHHYKIKKQRGRREAKAEDTKDSKIDVAKRAAERAGRDVERHFNQINNISNSIQTQLNTLRETNPHILEEPDIKIWFDKMVEMGTEIQTSRNELKSFQEEVDKAKNITLEHVEKNDLKKAKKSADVAKGIARQAKTKYTSTLEGYNDKSGKGFSGIVNRLNEAL

SEQ ID NO: 141452 - protein, 70 aa, Heterodera glycines
  Coding regions on vcDNA: vcDNA=SeqID_67875; Strand=+; Position=1 -12,269-352,425-541
  Homolog annotation: Hit_ID=NP_490843.1; Match level="QueryCoverage =87%, HitCoverage=12%, E-value=7e-12, Identity=59%"; Hit description =peptidase D, Xaa-Pro dipeptidase (1B816) [Caenorhabditis elegans] gb|AAK18972.1| Hypothetical protein K12
MTSALLDKALADSELSKHINADRLNEFRGTGGVRIEDDVIIWEKGNENMNADVPRTVEEIEQFMAKAKGL

SEQ ID NO: 141453 - protein, 109 aa, Heterodera glycines
  Coding regions on vcDNA: vcDNA=SeqID_67876; Strand=-; Position=1 -180,268-615
STDTNHSKSDQLSDGGRLAGRLNGDGIRPKGGQKPKGGGAELLDDEGPKNGRNLNGLNCCSSLPDSSELLSSDAISDELFGASLCPLTKMAIVKIKAAIKNLLAIICDN

SEQ ID NO: 141454 - protein, 47 aa, Heterodera glycines
  Coding regions on vcDNA: vcDNA=SeqID_67877; Strand=+; Position=1 -127,502-518
MANKFLIAAFILTIAIFVNGQSEAPNNSSEMASEESNSEESGSTNLP

SEQ ID NO: 141455 - protein, 76 aa, Heterodera glycines
  Coding regions on vcDNA: vcDNA=SeqID_67878; Strand=+; Position=1 -164,237-303
MFASACRFVLPLFLFALLALPPANGTGLPMQKMECCQQQQMCCAAPMQCTPSCGGPPFSRCSEGKKRRAHRRSGNS

SEQ ID NO: 141456 - protein, 75 aa, Heterodera glycines
  Coding regions on vcDNA: vcDNA=SeqID_67879; Strand=-; Position=1 -127,741-841
MANKFLIAAFILTMAIFVNGQSEAPNNSSEMASEESNSEESGKFLRTRLSDNTEPSFIYFKNPIICNLANSRKKE

SEQ ID NO: 141457 - protein, 210 aa, Heterodera glycines
  misc_feature (9)..(9): Xaa can be any naturally occurring amino acid
  misc_feature (12)..(12): Xaa can be any naturally occurring amino acid
  Coding regions on vcDNA: vcDNA=SeqID_67880; Strand=-; Position=1 -72,416-529,593-839,1013-1129,1370-1410
  Homolog annotation: Hit_ID=NP_493343.1; Match level="QueryCoverage =94%, HitCoverage=27%, E-value=1e-62, Identity=63%"; Hit description =phosphodiesterase 1C calmodulin-dependent 70kDa (1N904) [Caenorhabditis elegans] emb|CAB03289.1| Hypothet
DEASSSRKXTFXSENLPLISPFSLLRYILHQLNGGQLSLEDLKRNIEYAALVLETAYMDETRRICDEDDDLAEVTPERICDEDDDLAEVTPEAVPDEVREWLTATFTRQTVQSRKEKPKFKSVANAIRTGIFFEKFVRQQQQKSVSSIDAINSLCSELNNWNFDSFDLNEATNGHSLKYIGFELFNRYGFFERFKVPLSLLFLFPSPFSL

SEQ ID NO: 141458 - protein, 149 aa, Heterodera glycines
  Coding regions on vcDNA: vcDNA=SeqID_67881; Strand=-; Position=1-447
MEVEQRLPRYILDEIYLARESAGQWSTDRLRDKLRSILKRKEQIDTLLPKTDHGPRPKPSPRPPGFGSSFNPQPTLTFHTQSRTQPQQPPGSKIRPKLPCLFCDSPDHFSSNCDKFGTPESRLQRLRSLNRCFKCLKTGHPARQCPSPA

SEQ ID NO: 141459 - protein, 35 aa, Heterodera glycines
  Coding regions on vcDNA: vcDNA=SeqID_67882; Strand=-; Position=1 -51,304-360
MTISDGDRRYDQQRGTEAPSHSPLLLPVLSLGFVK

SEQ ID NO: 141460 - protein, 16 aa, Heterodera glycines
  Coding regions on vcDNA: vcDNA=SeqID_67883; Strand=+; Position=1-50
MCDEEVAALVVDNGSG

SEQ ID NO: 141461 - protein, 125 aa, Heterodera glycines
  Coding regions on vcDNA: vcDNA=SeqID_67884; Strand=+; Position=1 -125,532-784
MGITLKHMGDGMDKQRSWGLFIHKILPLIGIPNIHKLFVTFGGAKRLRGLLTSTSAAFLIECPNLRSIYYDWYCNGHDRPVDANAKVREWLLWPRADGRPKVLYRSFCYDISDEYNQASGGKANP

SEQ ID NO: 141462 - protein, 76 aa, Heterodera glycines
  Coding regions on vcDNA: vcDNA=SeqID_67885; Strand=+; Position=1 -156,844-915
  Homolog annotation: Hit_ID=AAN32886.1; Match level="QueryCoverage =69%, HitCoverage=28%, E-value=5e-09, Identity=54%"; Hit description =gland-specific protein G2D01 [Heterodera glycines]
MFAIAASASSHASNNSEWQALSAKFGQQISEIESNVPSLALAFPKCLLTALKEKKQRKGQFTSKDSFQTIGQYVSG

SEQ ID NO: 141463 - protein, 145 aa, Heterodera glycines
  Coding regions on vcDNA: vcDNA=SeqID_67886; Strand=-; Position=1 -117,158-478
MASEFVLVPDEIYRGLTNSDSGDINLDFVQRALQRTKRNELSRYLHLRDEHQNKPAKVEITKGLKTLRGNESDDDDEQIIDLGPEGPKPPASLSRQRQRRHHRYNDDDVEMPPVPPSPTPQAGTRAQKRKQMNFIPHGRRGSKDN

SEQ ID NO: 141464 - protein, 356 aa, Heterodera glycines
  Coding regions on vcDNA: vcDNA=SeqID_67887; Strand=-; Position=1 -291,340-1119
MSINLRDKKSLMENILPAVDISHTINGITVSSERIAVARTIPFDIVGKCKECKATECETEWCISKEGVTIWCTRFKISPRFVPFDVIYELPGYTFFKIRNKGRVFNVDHGSRSDACTQTPAPIYHLPPPPPPPKLPKRKQEQQQADAPAFFSALSAASLGVEFGATTVNPSAQQTQPQESNFASSISAATTGLDFGQMSTQQPTHQNRSEASDFFSPIAAATMAMDVEQKKTNPKPRQQQTDASNFFGPISAATMGIGAEQPKPKMIQQQQGVASEFASAISAATMGMSNEQPKQQPPIEKQKEQTDEEILDEFLESVSAATTYLDVSQKKKPKKKGKKEAEDEEAAAIASISRKQ

SEQ ID NO: 141465 - protein, 25 aa, Heterodera glycines
  Coding regions on vcDNA: vcDNA=SeqID_67888; Strand=-; Position=1 -47,243-273
MMRATRVRFAFLSVVRLQRNLSVVD

SEQ ID NO: 141466 - protein, 36 aa, Heterodera glycines
  Coding regions on vcDNA: vcDNA=SeqID_67889; Strand=-; Position=1-108
MYSLKRNQVATMFWNTEMKNLHHAPSFEAAIEKLIA

SEQ ID NO: 141467 - protein, 62 aa, Heterodera glycines
  Coding regions on vcDNA: vcDNA=SeqID_67890; Strand=-; Position=1-186
MFPHLKIQSHEIWEKIDDRFGKEKNAGAGKGRRRSGTARDAPPVHFASVVAAARCGGQTASR

SEQ ID NO: 141468 - protein, 233 aa, Heterodera glycines
  misc_feature (3)..(3): Xaa can be any naturally occurring amino acid
  misc_feature (96)..(96): Xaa can be any naturally occurring amino acid
  misc_feature (224)..(224): Xaa can be any naturally occurring amino acid
  misc_feature (231)..(231): Xaa can be any naturally occurring amino acid
  Coding regions on vcDNA: vcDNA=SeqID_67891; Strand=+; Position=1 -105,236-409,519-695,758-960
  Homolog annotation: Hit_ID=XP_392633.1; Match level="QueryCoverage =93%, HitCoverage=9%, E-value=7e-30, Identity=33%"; Hit description =similar to mKIAA1112 protein [Apis mellifera]
SRXRSNESDWRNASKYSINQTDQKHSLGWQFDHHIVTLNFQVWEHVAMLRDELPFRAGEEVAVLDCPSPQLWYGVCGPRSGWFPASYVRVNVPQEXGLVQTLCWWSIGSVAQVRPFRRLSIAEMRLLRRRIVQELISTEREYVRLLKNLVQGFVEQCRRRRELFPEGFVEQCRRRRELFPEERVQRIFGNLELILMLHSRLFRELETELDEKEPEKRAVANVFXEMELLLXRS

SEQ ID NO: 141469 - protein, 146 aa, Heterodera glycines
  Coding regions on vcDNA: vcDNA=SeqID_67892; Strand=-; Position=1-439
NGVSKNRNYAQKAPQTILALPITSTIAFIHPIMSAKIIRVPKIACDLSLAKNGVSKNRNYAQKASQTILAYPIPSTIAFIHPIMSAKIIRVPKIACDLRLAKNGVSKNRNYAQKASQPILALPIPSTIAFIHPIMSAKIIRVPKIA

SEQ ID NO: 141470 - protein, 93 aa, Heterodera glycines
  Coding regions on vcDNA: vcDNA=SeqID_67893; Strand=-; Position=1 -42,227-720
VPQRTTEKNRFIFVFGAVPPNRCAQIYGETNPFGNSFPIACTLILRWIFAPHNCLSTPNGHLKKSIFLFSGQSPRTDAPRFMGRPNPSGIASL

SEQ ID NO: 141471 - protein, 15 aa, Heterodera glycines
  Coding regions on vcDNA: vcDNA=SeqID_67894; Strand=+; Position=1-49
LKAIHCLPVLGTAKH

SEQ ID NO: 141472 - protein, 89 aa, Heterodera glycines
  Coding regions on vcDNA: vcDNA=SeqID_67895; Strand=-; Position=1 -41,600-828
GCTRPGPDTERTYTHSVGPTNSAVKKSSNVQLKIEAKFLTQYCPTFVFHSYQKRILQKALVMNNILMIREFAILKMLEPGLDSLLDLDL

SEQ ID NO: 141473 - protein, 72 aa, Heterodera glycines
  Coding regions on vcDNA: vcDNA=SeqID_67896; Strand=-; Position=1 -97,404-523
ARLSFGGHVGPNDRKWDERRPDELQSRGPRSEYHGGTIKNVREAAAKCTKKYNVAIALDTKGPEIRTGLLAG

SEQ ID NO: 141474 - protein, 58 aa, Heterodera glycines
  Coding regions on vcDNA: vcDNA=SeqID_67897; Strand=-; Position=1 -129,502-549
MLGKIGFLKKYLYFHGDKLIKNCARCIFLIVREFFDGLGSRKSHFLSDFFLENLLSYS

SEQ ID NO: 141475 - protein, 66 aa, Heterodera glycines
  Coding regions on vcDNA: vcDNA=SeqID_67898; Strand=+; Position=1-201
MGMMWGNSADLLGKSANLFASPMAYDNAPASPAGFGLPHIVLVIDNYWINTWRVPFCNGICCRNNI

SEQ ID NO: 141476 - protein, 53 aa, Heterodera glycines
  Coding regions on vcDNA: vcDNA=SeqID_67899; Strand=-; Position=1-163
NIKTFLARNILMDLPSKVNVEGAEVPCQNEKAKIGFGCFGTKTMDTRETMRIL

SEQ ID NO: 141477 - protein, 89 aa, Heterodera glycines
  Coding regions on vcDNA: vcDNA=SeqID_67900; Strand=+; Position=1-657
FLSKKFFFGFSGQSPLNRCAQIYGESESFRNSFTIASTLILPWIFAPHNCLSTPNGHLKKSIFLFSGQSPRTDAPRFMGRPNPSGIASL

SEQ ID NO: 141478 - protein, 136 aa, Heterodera glycines
  Coding regions on vcDNA: vcDNA=SeqID_67901; Strand=+; Position=1 -171,474-710
MAEDRQIKLLMEKMDEKFADMKAELKAEISGKFAEIDGKFAEIQDQIQDLKAEINQKAAKISIEVPAQGLTIQQATKAGLLDLESGQLTIMCDTATNLSLAKAIEIGMLDPHSMTVCDSSHGEKRELHLDKALNEG

SEQ ID NO: 141479 - protein, 126 aa, Heterodera glycines
  Coding regions on vcDNA: vcDNA=SeqID_67902; Strand=+; Position=1-381
MTCAYAKLLGPCFKTGRTDDRLLHRERTTESPSWTELVAGTCRTRPPPTPSSSQHGPETIAQFTQSKQHSPDPGTRPRKAGLKTELTQLLRASQRTPPANAPFATEQKDEQTPVWRLAGQRTATNG

SEQ ID NO: 141480 - protein, 176 aa, Heterodera glycines
  Coding regions on vcDNA: vcDNA=SeqID_67903; Strand=+; Position=1 -139,292-683
  Homolog annotation: Hit_ID=NP_740904.1; Match level="QueryCoverage =80%, HitCoverage=34%, E-value=6e-22, Identity=41%"; Hit description =EATing: abnormal pharyngeal pumping EAT-16, regulator of g-protein signaling 7 (54.7 kD) (eat-16) [Caenor
VLESFLDSEFSSENLRFWCCIQDLKFSPNCQVKTKGQHILDEFLAPVSEEHVFTLMSKDSYPRFLRSGIYKAVLDAAKAKGGRKRIIDLIRELSGSAVNTKKVPAKYHKTSRGSADVDNTQQLSLNANNFPKQCSSDSLPVKVGSLGGTSPSLQLPSSGTSSASSPALQTKESNKR

SEQ ID NO: 141481 - protein, 70 aa, Heterodera glycines
  Coding regions on vcDNA: vcDNA=SeqID_67904; Strand=-; Position=1 -27,92-277
  Homolog annotation: Hit_ID=NP_703324.1; Match level="QueryCoverage =82%, HitCoverage=8%, E-value=3e-11, Identity=56%"; Hit description =glutamic acid-rich protein (garp) [Plasmodium falciparum 3D7] emb|CAB63561.1| glutamic acid-rich protein (
MFKSLPLVEKDEIDFHLDDDDEEEDDDDDEEEDDADDDDDEEEEEEEEDKRRPKKKAFGFLKKMFKKKRH

SEQ ID NO: 141482 - protein, 130 aa, Heterodera glycines
  Coding regions on vcDNA: vcDNA=SeqID_67905; Strand=+; Position=1 -181,561-727,1225-1269
  Homolog annotation: Hit_ID=CAE67867.1; Match level="QueryCoverage =73%, HitCoverage=24%, E-value=8e-11, Identity=33%"; Hit description =Hypothetical protein CBG13459 [Caenorhabditis briggsae]
MLLSQNLAWSSIHSLFGFIAFLLTIFQPISALFRCHPDSSSRVLFNVLHAFTGYIGWLCALIAICIACVHFGLFANTSAATVLIIVFLVLLGIVALIMQIVAFRKGHQQQQEQHGTSRLNCNKGKQYWHH

SEQ ID NO: 141483 - protein, 56 aa, Heterodera glycines
  Coding regions on vcDNA: vcDNA=SeqID_67906; Strand=-; Position=1 -75,363-458
MLISIPKMLKLIMDNLNLTFDHFIPNVATFPLECGHNFSMQIQMGITLQQIEIKNI

SEQ ID NO: 141484 - protein, 48 aa, Heterodera glycines; identical to SEQ ID NO: 130859
  Coding regions on vcDNA: vcDNA=SeqID_67907; Strand=-; Position=1-144

SEQ ID NO: 141485 - protein, 37 aa, Heterodera glycines
  Coding regions on vcDNA: vcDNA=SeqID_67908; Strand=+; Position=1-113
ALQFPEGLTMFACVIVDILEKHTGAEFIILARRHLWK

SEQ ID NO: 141486 - protein, 132 aa, Heterodera glycines
  Coding regions on vcDNA: vcDNA=SeqID_67909; Strand=+; Position=1-399
MASNGKATEASSEEVRCSSGAAAASTASFVPSSDSPHNQPGSHAIDWKTYAALLSSPSGADLMAAMFSSAAALGPTKAHGEEEEEESERGEGQENVGEEETTRKGRTTKRTVKDEETEEAEGEEREGKRMEL

SEQ ID NO: 141487 - protein, 39 aa, Heterodera glycines
  Coding regions on vcDNA: vcDNA=SeqID_67910; Strand=+; Position=1-137
FHFILFYFTFHIVVFFDIIYFDFFFMRHIRALMCLWFAQ

SEQ ID NO: 141488 - protein, 53 aa, Heterodera glycines
  Coding regions on vcDNA: vcDNA=SeqID_67911; Strand=+; Position=1 -134,178-407
  Homolog annotation: Hit_ID=AAF01687.1; Match level="QueryCoverage =100%, HitCoverage=27%, E-value=8e-16, Identity=69%"; Hit description= CPN-1 [Caenorhabditis briggsae] emb|CAE67087.1| Hypothetical protein CBG12498 [Caenorhabditis briggsae]
FRKAGLGPKEAEGSKKEWTSEQLRAGDAIIGLQMGSNKGANQSGMIMGNTRHM

SEQ ID NO: 141489 - protein, 284 aa, Heterodera glycines
  Coding regions on vcDNA: vcDNA=SeqID_67912; Strand=+; Position=1 -105,242-328,372-480,523-717,784-1018
  Homolog annotation: Hit_ID=CAE69505.1; Match level="QueryCoverage =99%, HitCoverage=32%, E-value=1e-80, Identity=55%"; Hit description =Hypothetical protein CBG15713 [Caenorhabditis briggsae]
DRLHIDGLSVLFPYEYVYPEQLLYMEQLKKVLDAPGHCLLEMPSGTGKTVSLLALVVAYMRKYPERLHKLIYCSRTIPEIEKCVEERKYPERLHKLIYCSRTIPEIEKCVEELKRLFRYYTNVTGVPPDFLALTLSARPDFLALTLSARKNLCINKSVVSFRYGSAVDGACQRLTASYVRAKRRLNPNLPCCSFFEKFDEKRVLMPNLMPNQSDLRGWGKEHCMCPYFVARHLVNRADIIVYSYHYLLDPKIAELVSRELRPQSCVVFDEAHNIDNVCIESMSV

SEQ ID NO: 141490 - protein, 169 aa, Heterodera glycines
  Coding regions on vcDNA: vcDNA=SeqID_67913; Strand=+; Position=1 -97,785-957,1004-1243
  Homolog annotation: Hit_ID=NP_497182.1; Match level="QueryCoverage =75%, HitCoverage=16%, E-value=2e-51, Identity=77%"; Hit description =TFIIH basal transcription factor complex helicase subunit, DNA excision repair protein Xeroderma pigmento
MEYVKHRMRVKNVQIESPAAFLRDIKSRVFVDRNDQVEITSRFESREDPSVVRNYGTLVLELASIVPDGIVVFFTSYVYMENVVAAWYEQRMIDELVKLKLLFIETTDALETSVALEKYVEACESGRGAILFSVARGKVSEGIDFSHHLGRGTIRLFTPFALLTQEEQS

SEQ ID NO: 141491 - protein, 77 aa, Heterodera glycines
  Coding regions on vcDNA: vcDNA=SeqID_67914; Strand=+; Position=1 -117,868-984
MEGQQTDSGKNAIAEQQQKDEWKRRPNPSRRAQMHYEDNDMKKQSLPLDKFRTFLEKLKVINHGLIYYEKEGQQKNV

SEQ ID NO: 141492 - protein, 75 aa, Heterodera glycines
  Coding regions on vcDNA: vcDNA=SeqID_67915; Strand=+; Position=1 -127,493-593
MRFPAYTIANGEEDEGQQKQANGSGNKTRKSNGRRRKNGRGNAPRSDQTNENDHNFFRNFLKILNHNSSTKNDLD

SEQ ID NO: 141493 - protein, 365 aa, Heterodera glycines
  Coding regions on vcDNA: vcDNA=SeqID_67916; Strand=-; Position=1-1097
EKAQIEGKNEVEVTRTQLGQNKAKNDTLRKESDAQQKLASELNEGSSFCPAKQQVSWIEVNGSEIGQIDGERVPIWKPMEEFEEEEKWEERRTQCKENDEMDQLEKKATDVVEEWNARVGGKVGEEETEVELHFVGGERTEREAATEVCFGRDWANRRTTVRETEDGVGRKAESSVHFEKRKNEMPGRASYFQIHQRMKMGRKLEDDECDKSMPKDTIILEHMNITELEYSGGTIGRRGQCVQTSISTQINRWAADEWFKQIPTREELEEEKDERVKTKEEVRRRRNSRMDESSERVTKVRSIRRKSGTEEDDEEGGGTKGNGEGQPPQLYSEFETIHHGKTEGSITRTRHRQKRQQPKSPSRVT

SEQ ID NO: 141494 - protein, 46 aa, Heterodera glycines
  Coding regions on vcDNA: vcDNA=SeqID_67917; Strand=-; Position=1 -10,59-189
MLAGLYLYLEGLQKLATFQYQLFPVQSPLNNSLGFDLSAGWPADLL

SEQ ID NO: 141495 - protein, 138 aa, Heterodera glycines
  Coding regions on vcDNA: vcDNA=SeqID_67918; Strand=+; Position=1 -48,487-519,739-1074
MSKCALTLYQVTFYRKLSKLGPVAVRGIDYYDSGQFGDANCKYCGAVLLESEANALNKQGRVSPCCSNGQCHTEQMKAEFDELQNPPQLLKDLVAAPDERIRFEFLDNTMPLNNTFAFASVHSEKAPAEQMAGPNGYR

SEQ ID NO: 141496 - protein, 562 aa, Heterodera glycines
  Coding regions on vcDNA: vcDNA=SeqID_67919; Strand=+; Position=1 -534,584-926,1471-1619,1835-2292,2339-2543
  Homolog annotation: Hit_ID=AAD25596.1; Match level="QueryCoverage =47%, HitCoverage=18%, E-value=9e-25, Identity=30%"; Hit description =putative helicase [Arabidopsis thaliana] pir||H84464 probable helicase [imported] - Arabidopsis thaliana
MNYGPPPRKRARLGFTIDELLELQDQQQSGSGPSHPSASPTALGNGLDAYVMKLDEEVEHAPRFTMTKVKSKFMIKDLPADPEALLSQIFQKCLDEAVDESKQHGHTPDRLGCMISSELLNPDIWTPIREITDNTTDVILNRLLSTAQSKKKNGVSPQKITKGCHHKHVCASAGAHHRIDYYDSGQFGDANCKYCGAVLLESEANAINKQGRVSPCCSNGQCHTEQMKAEFDELQNPPQLLKDLVAAPDERIRFEFLDNTMPLNNTFAFASVHSEKAPAEQMAGRMDTVKYNGFWICDKAGKMRELKSGMPQLDPCCFPLLHPRGTFGWRWFMKKTGAQGRPPIFSTTDSVIELAYETFPRKRQLGIKKVGPQENISERQFYRYRLAIRENSRGAFHWLWFSRRLAEYFLIAVLNRIERNEMDHVKAIQQKKNYRQTLARDYIKAIEQGLQQQGRNAKLGSVFMMPHTFAGSRQYYQQKYADLMTVVRHLGNPTWFVTFTGNPSWPELKEALQGRQQYTHRADIVCRIFMDKASEFVRDLIEKNVLGKVAGWCYSVEHQKRG

SEQ ID NO: 141497 - protein, 156 aa, Heterodera glycines
  misc_feature (36)..(36): Xaa can be any naturally occurring amino acid
  misc_feature (48)..(48): Xaa can be any naturally occurring amino acid
  misc_feature (58)..(59): Xaa can be any naturally occurring amino acid
  misc_feature (135)..(135): Xaa can be any naturally occurring amino acid
  misc_feature (150)..(150): Xaa can be any naturally occurring amino acid
  Coding regions on vcDNA: vcDNA=SeqID_67920; Strand=-; Position=1-477
  Homolog annotation: Hit_ID=BAB33421.1; Match level="QueryCoverage =91%, HitCoverage=50%, E-value=9e-55, Identity=76%"; Hit description =putative senescence-associated protein [Pisum sativum]
SKNIAILPRRDSDLEAFSHNPSDGSFAPLVYRPSTXTKCLNLRFLSYXAGLLLATGLXXGKTNLSHDGLNPAHVPYWWVNNPTLGEFCFAMIGRADIEGSKSDVAMDAWPPQASYPCGNFSDTSCWKLYTLKDRXATLSRSVFVLIRIKXAFLFAL

SEQ ID NO: 141498 - protein, 76 aa, Heterodera glycines
  Coding regions on vcDNA: vcDNA=SeqID_67921; Strand=+; Position=1-231
GPPLTNIKRAHKGRFSESSQIEENDEQIGRSTKQLNMTNEDGERQPIRRSKLAGIGILHTARANRLECWASINQFN

SEQ ID NO: 141499 - protein, 57 aa, Heterodera glycines
  Coding regions on vcDNA: vcDNA=SeqID_67922; Strand=+; Position=1 -141,241-273
LNDDIAQLFPNTFLVNESDKQQTVIAEERLNSLKEWLSNDCRVSRQQGQAPIDETNF

SEQ ID NO: 141500 - protein, 124 aa, Heterodera glycines
  Coding regions on vcDNA: vcDNA=SeqID_67923; Strand=+; Position=1 -61,172-348,421-557
YQLDLMDSYIDALMLYDEGSQVEQLKKRQVHDPRLQYECQLLRNRAMHPDKKGMELSAEDRQRLLETLSAPKQRMDEAQVVLDEIREEFPRELNENTRMAAFRTTKAKTDTLGQVDDRLQPIVP

SEQ ID NO: 141501 - protein, 66 aa, Heterodera glycines
  Coding regions on vcDNA: vcDNA=SeqID_67924; Strand=+; Position=1-198
MASRLNRLLLVVYIQIFLIENYIHKCRIYLSINFTQFVACGQSKLGRAGGWQFLQLAMNDDQRCTN

SEQ ID NO: 141502 - protein, 60 aa, Heterodera glycines
  Coding regions on vcDNA: vcDNA=SeqID_67925; Strand=+; Position=1-387
IKLMKIFKQIFFTYFKELIILDYDRILFEFRFTFHINFLRRVYSKKLLGKKGVRRCREAP

SEQ ID NO: 141503 - protein, 65 aa, Heterodera glycines
  Coding regions on vcDNA: vcDNA=SeqID_67926; Strand=+; Position=1-195
MNVVRTLPLIVLATALTACAGKPARSDAPAASTVVPANAAAEAPAAVADGGTIDPAVAVPAAQAP

SEQ ID NO: 141504 - protein, 36 aa, Heterodera glycines; identical to SEQ ID NO: 140971
  Coding regions on vcDNA: vcDNA=SeqID_67927; Strand=+; Position=1 -22,707-795

SEQ ID NO: 141505 - protein, 525 aa, Heterodera glycines
  misc_feature (12)..(12): Xaa can be any naturally occurring amino acid
  misc_feature (17)..(17): Xaa can be any naturally occurring amino acid
  misc_feature (54)..(54): Xaa can be any naturally occurring amino acid
  Coding regions on vcDNA: vcDNA=SeqID_67928; Strand=-; Position=1 -1542,1613-1690
  Homolog annotation: Hit_ID=NP_498506.1; Match level="QueryCoverage =91%, HitCoverage=80%, E-value=7e-87, Identity=37%"; Hit description =RNA-directed DNA polymerase family member (3I9) [Caenorhabditis elegans] gb|AAA21080.1| Hypothetical prot
FLQKFFLKTLLXIIILXFLILPSPTNEVKFNIFGKVLKTYLRNTSPDGITFRLXKNCSSFTPFVTEIRLSLDTGKLPTIWKQSIIIPLHKQGEKSNPMNYRPIALTCSLCKIMEKFIVWAISDFLLKNNLFSDHQFGFIKGRSTTTHLISTLKNWYDGIYNNKNIDCVYIDFRKAFDVIPHNLLLYKVHRIGIRGKILNWISDFLSNRTFRVRVDNTLSSEYKMSSGVPQGSVLGPLLFLIYINDLPELIPKQISIKLYADDVKLYSVHKTKNDRIAMHHALNILSDWSKKWYIKISINKTFIIYFGKNNPREQYKINDNAICEVETIRDLGILIDNKFTFSEHISKITRNAYYRMRLLFRVIKSKKISVWKNIYVSYIRPLLEYSPESWNPQLKSHIIKIEKCQKYFTRIAFRKCCLPYIPYDQRLQFFKLATLEKRRKIFDLLTTYKILHGFTHLDPNSLFKRTNLNTRNKYVKLQSKKSSKSFVNRSVKAWNALDKTYKELLTFEAFLTLTSILFSYKFFVI

SEQ ID NO: 141506 - protein, 277 aa, Heterodera glycines
  Coding regions on vcDNA: vcDNA=SeqID_67929; Strand=-; Position=1-836
  Homolog annotation: Hit_ID=EAK89729.1; Match level="QueryCoverage =98%, HitCoverage=93%, E-value=7e-22, Identity=26%"; Hit description =uncharacterized glycine-rich low complexity protein [Cryptosporidium parvum]
FQSLGLNPPAFQSLGLNPPAFQSLGLNPTAFQSLGLNPPALQSLGLNPPAFQSLGLNSPAFQSLGLNPPTFQSLGLNPPAFQSLGLNPPAFQSLGLNPPTFQSLGLNPPAFQSLGLNPPAFQSLGLNPPAFQSLGLNPPAFQSLGLNPPAFQSLGLNPTTFQSLGLNPPAFQSLGQPTNISITGTQATSISITWAQPNSISITGTQPTSISITWAQPPNISINGTQPYGGLRPHSPNFCVKGTHSAASRPRNWGLRLHSSHQNSISPILRNPITGNE

SEQ ID NO: 141507 - protein, 276 aa, Heterodera glycines
  Coding regions on vcDNA: vcDNA=SeqID_67930; Strand=-; Position=1-830
  Homolog annotation: Hit_ID=XP_522354.1; Match level="QueryCoverage =99%, HitCoverage=31%, E-value=8e-32, Identity=29%"; Hit description =PREDICTED: similar to submaxillary apomucin [Pan troglodytes]
NHWGLNPPTFQSLSTQPTSISITGTQPTIIPITGTQPTNISITGTLPTSISITGTQPTSISITGTQPTSISITGTQPNSISITGTQPTSIAITGTQPTSISITGTQFSCISITGTQPTNISITGTQPTSISITGTQPTSISITGTQPTNISITWTQPTSISITGTQPTSISITGTQPTSISITGTQPTSISITGTQPTSISITWTQPNNISITGTQPTSIPITGTTPNISITGTQATSISITWAQPNSISITGTQPTSISITWAQPPNISINGTQP

SEQ ID NO: 141508 - protein, 30 aa, Heterodera glycines
  Coding regions on vcDNA: vcDNA=SeqID_67931; Strand=+; Position=1-95
QKLQVKRLKLVGFVQNIHVSNPEPEFGQIS

SEQ ID NO: 141509 - protein, 92 aa, Heterodera glycines
  Coding regions on vcDNA: vcDNA=SeqID_67932; Strand=-; Position=1 -164,461-572
MSRNRSSRSTFSSRGGGSDEEVHNHLDRNRSIKQELTVVKNNQKMQNEAHKGSLEMLRESYDRMCNSKGTRAAKQTPMIDFYDYYKDMKARV

SEQ ID NO: 141510 - protein, 129 aa, Heterodera glycines
  Coding regions on vcDNA: vcDNA=SeqID_67933; Strand=-; Position=1 -12,132-285,434-557,722-821
MDARWLNERVNLGCVLPSQEEATVYVQAQQVFDFIDKNASKFELLSPEQYSDFRLKKIHGKSINALENAIIELRHSVIQLNVGGIMPDYERTNNPRRCILNEITTANEDVREALFEMILMIELDALKLV

SEQ ID NO: 141511 - protein, 103 aa, Heterodera glycines
  Coding regions on vcDNA: vcDNA=SeqID_67934; Strand=+; Position=1 -111,176-376
  Homolog annotation: Hit_ID=AAD09400.1; Match level="QueryCoverage =91%, HitCoverage=15%, E-value=1e-38, Identity=79%"; Hit description =gamma-glutamyl transpeptidase precursor [Brugia malayi]
MPNGFGFAPSPANFIEPGKRPMSSMSPMVIFDQENGKLKFVIGASGGSKIISAMAKPVIRVLCFNETIKEAIDAPTLHNQFTPDITQFEETVPKAEKKGKRKN

SEQ ID NO: 141512 - protein, 32 aa, Heterodera glycines
  Coding regions on vcDNA: vcDNA=SeqID_67935; Strand=+; Position=1 -63,473-508
MSAIICIKAHEIEKADFPIHLIRFGFQNQNLY

SEQ ID NO: 141513 - protein, 239 aa, Heterodera glycines
  Coding regions on vcDNA: vcDNA=SeqID_67936; Strand=+; Position=1 -359,831-1188
NYYTRKARRRHNEEQQQQQQQVSFNNGNNNNSCIATGAAAVAVAGGGLLSATNANGGHNIGGGAGNNLSAFLVPTPSAAAAAAIAAGIQQQQQLQQKHNKQANNLLADIQVLMMVVVVNGFFLCIINKIYSLSPLCKDISMVPSCSSTAVAASIVAATQQQQHPMGVGGVQQQQQFMHDVQQQQHGTNMEAAAATQHLHNHGNSHHNRRTIAYPKNSATAKHKSAAVRAKAQQILAAQA

SEQ ID NO: 141514 - protein, 431 aa, Heterodera glycines
  Coding regions on vcDNA: vcDNA=SeqID_67937; Strand=+; Position=1 -231,833-969,1073-1195,1240-1294,1431-1560,2082-2237,2860-3017,3916 -4218
  Homolog annotation: Hit_ID=NP_567824.1; Match level="QueryCoverage =92%, HitCoverage=67%, E-value=1e-136, Identity=61%"; Hit description= dual-specificity tyrosine-(Y)-phosphorylation regulated kinase 1A isoform 3 [Homo sapiens] gb|AAD31169.1
QAQAAQQQLGLVDDDQECDDENNDYIIRNGEVFNYRYRIESSIGKGSFGQVTKAYDMVEEEMVAIKIIKNKKAFYDQAQIEIRLLELMNSHNSEGRYYVVQLRNHFVWRRHLCLVFELLSYNLYDLLRNTNFHGVSLNLTRKFGQQLAATLLFLSQPDLNIIHCDLKPENVLLCNPKRSTIKIIDFGSSCQYDSRIYHYIQSRFYRSPEVLLGISYDTQIDMWSLGCILVEMHTGEPLFPGHSEFDQMMKIVEVLGMPSSQILNSASKANKFFELDENGQWRCKKARDTKSYMAPGSLRLSDVLGVYTGGPFGRRQGEQGHTVEDYMKFKRMLELDPAKRLHPYYAVRHPFLRKTNPGDDQQHQQLQQNVVGTASGGVAAQQQQQPNRSHSSVAISAACQQPQQQQHPSSSSAFHNHHAQQQQHQTMPPTF

SEQ ID NO: 141515 - protein, 89 aa, Heterodera glycines
  Coding regions on vcDNA: vcDNA=SeqID_67938; Strand=-; Position=1-270
MGAVVAGVVGTRRKWPPTSASGSAVVVVAPQLRRSLFQQHFVVAAGVVDHRQGSSCAGMGAAPRSTDATAWPGPTPTCAGSDPVQKCGI

SEQ ID NO: 141516 - protein, 179 aa, Heterodera glycines
  Coding regions on vcDNA: vcDNA=SeqID_67939; Strand=+; Position=1 -159,423-518,785-865,910-1112
  Homolog annotation: Hit_ID=XP_509951.1; Match level="QueryCoverage =100%, HitCoverage=69%, E-value=6e-68, Identity=56%"; Hit description= PREDICTED: similar to Psmc6 protein [Pan troglodytes]
GTRVALDMTTLTIMRQLPREVDPLVYKMSHEDPGNVSYAEIGGLSEQIRELREVVSSAIVDKYIGESARMIREMFNYARDNQPCILDPALLRPGRLDRKIEIGLPNGQSRLEVLKIHATKVLKKEEIDYEAVVKLSEGFSGADLRNVCTEAGLNAIRKERDGVVQEDFMKAVRKVADAK

SEQ ID NO: 141517 - protein, 22 aa, Heterodera glycines
  Coding regions on vcDNA: vcDNA=SeqID_67940; Strand=+; Position=1-66
MALQDAYANAMDAFCGTTGPFW

SEQ ID NO: 141518 - protein, 78 aa, Heterodera glycines
  Coding regions on vcDNA: vcDNA=SeqID_67941; Strand=+; Position=1 -100,342-478
YWWFRVRSQQELDNLRDQLGRPIGVLDSLVLPQPMHELFVDAFLTEIRKNPRVTDVDLDELEPCFSCSQTIAQVKLVK

SEQ ID NO: 141519 - protein, 113 aa, Heterodera glycines
  Coding regions on vcDNA: vcDNA=SeqID_67942; Strand=+; Position=1 -46,658-800,1251-1317,1443-1485,1694-1737
  Homolog annotation: Hit_ID=NP_506125.1; Match level="QueryCoverage =90%, HitCoverage=18%, E-value=8e-50, Identity=89%"; Hit description =EGg Laying defective EGL-10, G protein signaling regulator (63.3 kD) (egl-10) [Caenorhabditis elegans] em
YFWPNCWEPEPSSTAVYLCKRTMQNKAHLELEDFEAENLAKLQKMFSRKWEFVFMQAEAQYKVDKKRDRMERQILDSQERAFWDLHRPVPGCVNTTELNFDKTPKLVLNLFFS

SEQ ID NO: 141520 - protein, 338 aa, Heterodera glycines
  misc_feature (334)..(334): Xaa can be any naturally occurring amino acid
  misc_feature (337)..(337): Xaa can be any naturally occurring amino acid
  Coding regions on vcDNA: vcDNA=SeqID_67943; Strand=+; Position=1 -399,538-623,1400-1616,1987-2022,2112-2142,3112-3356
  Homolog annotation: Hit_ID=CAE75494.1; Match level="QueryCoverage =97%, HitCoverage=60%, E-value=1e-106, Identity=61%"; Hit description= Hypothetical protein CBG23499 [Caenorhabditis briggsae]
VDFRKLSRSGRPKYSASTSLLAQAAAASSSSSSTTTCSNGPAAAAQPTPTKTTAKTVPTRTADECSSTACTSSGAGGGDSAGTSSGGAETATAPNRTTSNAASSSSVREVKYHQRPGFRRQTRLQDSIKTEITDLHNRLAKNVLRTSKVVENYLQYYDHRILFDAFLVQLGSATDPFHGQPNPWISDTVDFWDHDKMYADVSARRLKLWEESLEELLTDPLGRETLQKFLDKEYSGENLRFWMEVQVQRLRKCSCRFVPVLVTKIYNEFIDANATSPVNIDCKVMEITEENLRNNPNRWSFDDAADHIFCLMKNDSYQRFLRSEMYREMVSVCXVIXS

SEQ ID NO: 141521 - protein, 18 aa, Heterodera glycines
  Coding regions on vcDNA: vcDNA=SeqID_67944; Strand=-; Position=1-56
ILFDRARQEKATVGTKFA

SEQ ID NO: 141522 - protein, 68 aa, Heterodera glycines
  Coding regions on vcDNA: vcDNA=SeqID_67945; Strand=-; Position=1-436
NGVSKNRNYAQKASQTILALPIPSTIAFIHPIMNAKIIRVPKIACDLSLEKNGVSKIVITLKKLFKQF

SEQ ID NO: 141523 - protein, 63 aa, Heterodera glycines
  Coding regions on vcDNA: vcDNA=SeqID_67946; Strand=-; Position=1-372
NRNYAQKAFQTILALPIPSTIAFIHPIMSAKIIRVPKIACDLSLEKNGVSKIVITLKKLFKQF

SEQ ID NO: 141524 - protein, 43 aa, Heterodera glycines
  Coding regions on vcDNA: vcDNA=SeqID_67947; Strand=+; Position=1-131
MDNRDERGHSYCYVRGEILGPYQDGLLRKHLARMSSLIKNESQ

SEQ ID NO: 141525 - protein, 41 aa, Heterodera glycines
  Coding regions on vcDNA: vcDNA=SeqID_67948; Strand=-; Position=1-134
ADLKLSIACRFSAQQSTNTVFDSLQKIIPYPKVFYNHILPI

SEQ ID NO: 141526 - protein, 42 aa, Heterodera glycines
  Coding regions on vcDNA: vcDNA=SeqID_67949; Strand=-; Position=1 -71,97-256
FSALLLGRRDVQIVASLHCLNSDGPYKYIILLNTPDNIFLAI

SEQ ID NO: 141527 - protein, 264 aa, Heterodera glycines
  Coding regions on vcDNA: vcDNA=SeqID_67950; Strand=-; Position=1 -189,982-1082,2157-2242,2303-2399,2944-3051,3765-3920,4138-4194
  Homolog annotation: Hit_ID=NP_491690.2; Match level="QueryCoverage =96%, HitCoverage=60%, E-value=1e-85, Identity=53%"; Hit description =aminotransferase, class I and II family member (55.8 kD) (1G400) [Caenorhabditis elegans] gb|AAC24265.2|
QNVRPSPFRRDGFPCDPESVCISGGASESIRNVLKLFVRPNIGTGGQKAGILVPIPQYPLYSASIEEYNLGQVGYYLDEENNWALDMDELERALKEVYQENVYAEGAEFHSFRKVMFEMGAPFDKLELASFYSCSKGYMGECGLRGGYVQFDNIDPTKMISAKLCSTVLGQVAMDCVVDHPKPGDPSYDQWLKEKTAVLDSLHKRAQLVTKAYNQVEGVHCQQVQGAMYAFPRFLLPDKAIAEAKASGVQPDFFYVKQLLEETG

SEQ ID NO: 141528 - protein, 138 aa, Heterodera glycines
  Coding regions on vcDNA: vcDNA=SeqID_67951; Strand=+; Position=1-442
NGVSKNRNYAQKASQTILAHPIPSTIAFIHPIMNAKIIRVPKIACDLSLAKNGVSKNRNYAQKAPQTILALPIPSTIAFIHPIMSAKIIRVPKIACDLSLAKNGVSKNRNYAQKASQPILAHPINSFYNRLYTSHYER

SEQ ID NO: 141529 - protein, 88 aa, Heterodera glycines
  Coding regions on vcDNA: vcDNA=SeqID_67952; Strand=-; Position=1 -131,951-1086
MDIKYGLKKPEIWTKKDKNGQIWTKIWIKNAKIYVVNPQKSQKSIEQDQIVPSFCGRLEPDNVVQRQTAAAKGAHRGHDQPQRYHHGQ

SEQ ID NO: 141530 - protein, 16 aa, Heterodera glycines
  Coding regions on vcDNA: vcDNA=SeqID_67953; Strand=-; Position=1-48
MIHIGQMTKTTSGRKT

SEQ ID NO: 141531 - protein, 201 aa, Heterodera glycines
  Coding regions on vcDNA: vcDNA=SeqID_67954; Strand=+; Position=1 -448,499-656
YIDHSVIAFLRSNHQIFDKRGTNLHLWLPYSNTTNGQPIWDVFAREIWPIFSANIHHLRFPHGDHLDHLLRRTSPTILTDLDQLNSIYSGALLPAAFGDGFDGPISTISAGQALSKWLHSPRKDGQPKRLRCDNYNAQWNTDWINNFKEHFLRANAISSVSYQIHFSVHVPSMEMVPFELVNECTKEKLTLAKANENELDK

SEQ ID NO: 141532 - protein, 84 aa, Heterodera glycines
  Coding regions on vcDNA: vcDNA=SeqID_67955; Strand=-; Position=1 -162,750-842
MATETATFAALKAFANWLCPSSPLPYNSDLLPLKKLKFLCTKKVALAFIAQLKKHKFILKTFIHLCELFLAKQPFLLLLLLTYN

SEQ ID NO: 141533 - protein, 100 aa, Heterodera glycines
  Coding regions on vcDNA: vcDNA=SeqID_67956; Strand=+; Position=1 -11,83-374
MNRRWICNDVWMDIFPCFDHAQLGLKLALLSSRFNALVDKHFDGKSELTIWRPIAIRRKDKGPEPKLSVQMDRKFDKFVEFPLPDRPLPSKIRFKWLRIE

SEQ ID NO: 141534 - protein, 82 aa, Heterodera glycines
  Coding regions on vcDNA: vcDNA=SeqID_67957; Strand=-; Position=1 -121,280-407
MTTQQRIFGNQLLFLCIFLIGVVFFLFSAAVANGAHLVDSSVDQIGRVQHNHNGDINIRRGIERFNDNRMAQNGKEKWRKYE

SEQ ID NO: 141535 - protein, 109 aa, Heterodera glycines
  misc_feature (94)..(94): Xaa can be any naturally occurring amino acid
  Coding regions on vcDNA: vcDNA=SeqID_67958; Strand=-; Position=1 -144,658-822,1480-1499
  Homolog annotation: Hit_ID=AAM75382.1; Match level="QueryCoverage =100%, HitCoverage=40%, E-value=6e-37, Identity=43%"; Hit description= Uncoordinated protein 44, isoform e [Caenorhabditis elegans]
ARHNISPLHVAAKWGRVKLVELLLDRGAIIDCRTRDLLTPLHCAARSGHDTVVELLLERGAPISAKTKNGLAPLHMAAQGDHVDCARWAQKLKXLFGTLTIYYSFPMHL

SEQ ID NO: 141536 - protein, 155 aa, Heterodera glycines
  Coding regions on vcDNA: vcDNA=SeqID_67959; Strand=-; Position=1 -37,2149-2297,2958-3170,4102-4167
  Homolog annotation: Hit_ID=AAM75382.1; Match level="QueryCoverage =99%, HitCoverage=38%, E-value=2e-66, Identity=40%"; Hit description =Uncoordinated protein 44, isoform e [Caenorhabditis elegans]
LLYVARALGYICIVTILVEHGANVNAQSVNGFTPLYMAAQENHEVVVRYLLAHGANQALATEDGFTPLAVALQQGHDRIVALLLENDNTSKVKLPALHIAAKKDDVRSATLLLESEQNPNVTSKSGFTPLHIAAHYGNENIGQLLIEKGANVNFQ

SEQ ID NO: 141537 - protein, 150 aa, Heterodera glycines
  Coding regions on vcDNA: vcDNA=SeqID_67960; Strand=+; Position=1 -49,352-390,447-560,817-999,1049-1116
  Homolog annotation: Hit_ID=G89459; Match level="QueryCoverage=88%, HitCoverage=40%, E-value=1e-12, Identity=31%"; Hit description =protein C52B11.1 [imported] - Caenorhabditis elegans
MVKQEQKQLVMNRPDIAFCEGSISAFFVSANVSVRGANASATILESSEQQCAKYCADNRDNRGRTLLCGSALYESDTRQCKLYRKSRQIFSKIILSQFLNNLNLSAPDGELKRFAENGRRYYEKFCLPDDVPMDCAFTHFARVDDHILKG

SEQ ID NO: 141538 - protein, 162 aa, Heterodera glycines
  Coding regions on vcDNA: vcDNA=SeqID_67961; Strand=-; Position=1-489
MSEIGIPTPKRSKSEFRLPKRSVIAIPTPKMSEIGIPKSKIFSEIAITTPKMSEIGIPTPKMSEIGIPTPKRSEIAIPTPKMSEIGIPTPKKVGNRNSEVQNFFGNSNYDPKNVGNRNSDSQKGRKSEFRSPKFFRKSQLRPQKCRKSQFRPQKYRKSEFRP

SEQ ID NO: 141539 - protein, 108 aa, Heterodera glycines
  Coding regions on vcDNA: vcDNA=SeqID_67962; Strand=-; Position=1 -34,479-771
MICHQLWCPRYDSYGHPITSEAVGEIKQIVIKMILFAKVAIYRQELKVKVILYRQELEAKDANNINAIGIQNEDIIGTSNILRHRFKEIQYLSKVYNGNEVHLYWMFL

SEQ ID NO: 141540 - protein, 80 aa, Heterodera glycines
  Coding regions on vcDNA: vcDNA=SeqID_67963; Strand=-; Position=1-655
LFEFPKRTLEKIDFFVFGAVPPNRCAQIYGETESFGNSFPIACTLILRWIFAPHNCLSTPNGHLKKSIFLFHKYFFQKVL

SEQ ID NO: 141541 - protein, 77 aa, Heterodera glycines
  Coding regions on vcDNA: vcDNA=SeqID_67964; Strand=+; Position=1 -78,127-203,252-328
SQTRPERNPRKIRVVASYPENVVGIHSQTRPERKSRKIRVVATIPKMWLEFIAKLAQKENPEKLGSSLLFRKCGWNS

SEQ ID NO: 141542 - protein, 48 aa, Heterodera glycines
  Coding regions on vcDNA: vcDNA=SeqID_67965; Strand=+; Position=1-149
IAQLTSNEQQPSRDRQKSKKCADAPVRNAAAKLERQQRIPCLVRQQRR

SEQ ID NO: 141543 - protein, 139 aa, Heterodera glycines
  Coding regions on vcDNA: vcDNA=SeqID_67966; Strand=+; Position=1 -153,268-402,510-640
MLMDAWGILPGGDRLAVPLKWLPTDPTAPLTGSPLPFKRPSGWEEFIGVINAMIGGMCANFTFSGDEHLIKREIEKISEFVKDITGNATQWIRAELENSWPLEIIRHVKIGIKNPVIDPYSYNYTANLIDDIVFARGPF

SEQ ID NO: 141544 - protein, 209 aa, Heterodera glycines
  Coding regions on vcDNA: vcDNA=SeqID_67967; Strand=+; Position=1 -180,480-581,648-781,2217-2430
  Homolog annotation: Hit_ID=NP_508537.1; Match level="QueryCoverage =99%, HitCoverage=84%, E-value=2e-78, Identity=30%"; Hit description =spectrin (spc-1) [Caenorhabditis elegans] gb|AAB53876.1| Spectrin protein 1 [Caenorhabditis elegans] pir|
MIQHDHYEKETIRKRLDRLHELWDRLFAMLENKGIKLQQTLKLLQFVRKCDEMLYWIKDKIQFVSTDDLGADLEHVEVMQRKFDEFLKELKSHESRVLDINHEANALIDEGHPEQQQIHGKRDEVNEAWHKLGTLTSTRGEALFGAQQIQRFYRDIDETLAWMGEKELTLATDDFGRDLNNVQALQRKHEGTERDLAALESKVARHGEI

SEQ ID NO: 141545 - protein, 165 aa, Heterodera glycines
  Coding regions on vcDNA: vcDNA=SeqID_67968; Strand=+; Position=1 -190,753-982,1494-1571
  Homolog annotation: Hit_ID=NP_508537.1; Match level="QueryCoverage =96%, HitCoverage=70%, E-value=5e-42, Identity=34%"; Hit description =spectrin (spc-1) [Caenorhabditis elegans] gb|AAB53876.1| Spectrin protein 1 [Caenorhabditis elegans] pir|
GEALFGAQQIQRFYRDIDETLAWMGEKELTLATDDFGRDLNNVQALQRKHEGTERDLAALESKMDKLGTETNHLCQLYPEKSEDIAAKVDEARGRWEALKLSAEQRKRGLDRSYNRHRFMADYRELVEWTKGIQVIGHSPFVASVILSVLSCFEHTQKFKKINKR

SEQ ID NO: 141546 - protein, 108 aa, Heterodera glycines
  Coding regions on vcDNA: vcDNA=SeqID_67969; Strand=-; Position=1-325
MCGRGTTVIRRGSTVIRRGTTAIRRVIKRGTTAIRRVIKRGTTAIRRVIKRGTTAIRRVIKRGTTVNRRGTTAIRRVIKRGTTVNRRGTTVIKKGTTMIRRGTTVIRR

SEQ ID NO: 141547 - protein, 312 aa, Heterodera glycines
  Coding regions on vcDNA: vcDNA=SeqID_67970; Strand=-; Position=1 -141,264-332,385-1112
  Homolog annotation: Hit_ID=NP_997600.1; Match level="QueryCoverage =60%, HitCoverage=25%, E-value=2e-10, Identity=32%"; Hit description =forkhead box P2 [Mus musculus] ref|NP_444472.2| forkhead box P2 [Mus musculus] gb|AAL85482.1| forkhead/wi
MDTLLNELRLQHRMEQQQKDSQTQQIEQQQQQMIVQQQQQQLIAAVQAQLATTHQNVAAQQSQPFQQQHQALVAALANNQLDLMINEIQTQYSRQLSAQQLLAQLSRMNFLGIPPQDISTLQNIASGSALSEIVRQMSPVTAAAAALHSPLSSAGVQNPPPGPSPVQHQMSTTVSNCSGPIGVQNFLNNLESFNNGPSACSATTRISTPTTISANLSAVAVEVGHTTSNLGVFWLLFGFKLLSPLRITRQPAPPAVVIVARLVSLLRFPCGKSVRTSPARPLPESLPPLFQLRPHLPTAFLRLNSRENQPLR

SEQ ID NO: 141548 - protein, 79 aa, Heterodera glycines
  Coding regions on vcDNA: vcDNA=SeqID_67971; Strand=-; Position=1 -66,387-560
MCHEAKNNVETSKEEPQYELKQIEFNAGQIGGTSVSSRLYQIHRHTVKKAGLSVPDDNLPAGAGDTGIAEVLEKHGEEN

SEQ ID NO: 141549 - protein, 86 aa, Heterodera glycines
  Coding regions on vcDNA: vcDNA=SeqID_67972; Strand=-; Position=1 -211,1073-1122
MEKIKNNIGDSFVWISVDETTDKMGRAVANLLIGKLDGQKWHTPHLISVKCLEKVDSAAIARFVNEGLGGSCFCNFKSKISQGFRQ

SEQ ID NO: 141550 - protein, 113 aa, Heterodera glycines
  Coding regions on vcDNA: vcDNA=SeqID_67973; Strand=-; Position=1-342
MPLFVFPPLSSSSINGTANSPVSSALADQFHRQFVSGQQIASITAIPANACLFVSIIDTVADDGGQMARADENGTKTTAKGEKHRIEGTLFRQHFAISGGKNHLVNTNGGTGH

SEQ ID NO: 141551 - protein, 180 aa, Heterodera glycines
  Coding regions on vcDNA: vcDNA=SeqID_67974; Strand=-; Position=1 -176,417-646,958-1094
MLQQNRGHCRLVKRLLFGRRPFVRLALTLFCLLLLTVLALLVEFPSKWALIFNGHGSDGKFSSYANSDGLGDDGNGLAVPPKCCQCADGWRGHFVPAETEARVFQSVRREHIELLAKLNEAQAKMDAIEAKMGEKEAELAKLELRVEELKLLQREYSDSRAVRVQLPHSPPKRGEHFRED

SEQ ID NO: 141552 - protein, 97 aa, Heterodera glycines
  Coding regions on vcDNA: vcDNA=SeqID_67975; Strand=-; Position=1 -143,323-473
IPCTQFAHLKQHNETVKHKAKLERNNGGQQQQFLTTPNNVPNQFNLDLKYIGDSFFGFRWTKRQTKWEERWPIADWKIGWTKIAQPTFDFRQMLGES

SEQ ID NO: 141553 - protein, 287 aa, Heterodera glycines
  Coding regions on vcDNA: vcDNA=SeqID_67976; Strand=-; Position=1-862
  Homolog annotation: Hit_ID=EAK90721.1; Match level="QueryCoverage =44%, HitCoverage=89%, E-value=2e-48, Identity=64%"; Hit description =hypothetical protein CaO19.64 [Candida albicans SC5314]
MNTFNNQQNASADNNNNNNNNNNNNNNNNNNNNNNNNNNNNNNNNNNNNNNNNNNNNNNNNNNNNNNNNNNNNNNNNNNNNNNNNNNEDENDIDFIINNLGGEGDEDEDDVENGDDINDDDDDERDELLPLRLCFFDAETSQERPLQLNNQVAHKHVPLLIVAEFICEPCIRAGININDGQGQRAPGCVCLCGRVRGQQMRQWMSPPFVNAPGDNTPQPEGAPVFNNRRLFFHSFDNEASDPVDQFLDFLIHHGSRKAHTICIAHKRGKYDFHLVLEALHRRSYPPK

SEQ ID NO: 141554 - protein, 45 aa, Heterodera glycines
  Coding regions on vcDNA: vcDNA=SeqID_67977; Strand=+; Position=1 -67,150-220
MHHHPPNHEKAINLSILTVSGPALQPYFPPEPEDGRFREAPHQGE

SEQ ID NO: 141555 - protein, 39 aa, Heterodera glycines
  Coding regions on vcDNA: vcDNA=SeqID_67978; Strand=-; Position=1-117
MVMTGTEDKSSTPEKGLEKWPLRLRMAAGAQITHSQREE

SEQ ID NO: 141556 - protein, 113 aa, Heterodera glycines
  Coding regions on vcDNA: vcDNA=SeqID_67979; Strand=+; Position=1 -71,270-540
MRFPSTILEKSTVKLFQAQKPKSKNKKSQNERLFGPNLLQQRIASRSEKGNPLELDFVHRLLLGIQNDNLWAIEARRIQNFVIFVKAPYYPVAKKLLPDMHKKATLENFYGQV

SEQ ID NO: 141557 - protein, 60 aa, Heterodera glycines
  Coding regions on vcDNA: vcDNA=SeqID_67980; Strand=+; Position=1-181
MGQNMKLILKQKSIESMENWQQNRTHYTEIIDESSEQQNNNYGQGRSKRQLANCKICGRQ

SEQ ID NO: 141558 - protein, 125 aa, Heterodera glycines
  Coding regions on vcDNA: vcDNA=SeqID_67981; Strand=+; Position=1 -217,377-537
MGQNMKLILKQKSIESRENGQQNRTHYTEIMDESSEQQNNNYGQGRSKRQLANCKICGRQCQYIFYGVKSCESMVKCRGCRLDKCLVAGMDPTLINVPPSDKFKQFLTELEKRKLSAMLTHSEKN

SEQ ID NO: 141559 - protein, 95 aa, Heterodera glycines
  Coding regions on vcDNA: vcDNA=SeqID_67982; Strand=-; Position=1 -112,321-456,860-899
MHIEKIFPEILMILILFISFSDSAPPKNKSAETVDASRKYTVTDYTVDIGKQLSRFQTEKLIKQAKQWIKNVQNGLKEDFDQRPLHRCWDRGMTK

SEQ ID NO: 141560 - protein, 90 aa, Heterodera glycines; identical to SEQ ID NO: 136033
  Coding regions on vcDNA: vcDNA=SeqID_67983; Strand=-; Position=1-638

SEQ ID NO: 141561 - protein, 126 aa, Heterodera glycines
  misc_feature (36)..(36): Xaa can be any naturally occurring amino acid
  misc_feature (48)..(48): Xaa can be any naturally occurring amino acid
  misc_feature (58)..(59): Xaa can be any naturally occurring amino acid
  Coding regions on vcDNA: vcDNA=SeqID_67984; Strand=-; Position=1-381
  Homolog annotation: Hit_ID=BAB33421.1; Match level="QueryCoverage =90%, HitCoverage=40%, E-value=1e-46, Identity=78%"; Hit description =putative senescence-associated protein [Pisum sativum]
SKNIAILPRRDSDLEAFSHNPSDGSFAPLVYRPSTXTKCLNLRFLSYXAGLLLATGLXXGKTNLSHDGLNPAHVPYWWVNNPTLGEFCFAMIGRADIEGSKSDVAMDAWPPQASYPCGNFSDTSCW

SEQ ID NO: 141562 - protein, 73 aa, Heterodera glycines
  Coding regions on vcDNA: vcDNA=SeqID_67985; Strand=+; Position=1-222
MNASVWKIGLFEKLKDGKMAECRECKANGRAKYEFGLPDFSTKSLKNHLFSTIHANSELIFLNKAIPMLDYKY

SEQ ID NO: 141563 - protein, 30 aa, Heterodera glycines
  Coding regions on vcDNA: vcDNA=SeqID_67986; Strand=-; Position=1-94
FMENFMNFLSSNKIKSVFVVQHWDGLVQKY

SEQ ID NO: 141564 - protein, 137 aa, Heterodera glycines
  Coding regions on vcDNA: vcDNA=SeqID_67987; Strand=-; Position=1 -106,168-475
MMRPVQNKAIVIDRKKIRRPPKNQCNLKIARALTKGNNKKKQLDEGPYVDAAIYSPEMLEKLEKQAGKKVYVTKKYDLAAHARTVEEAKQNLILYDKKIDQLRKMEAKFAALTYQNNSEEQTEQQRHHILKLIKLIP

SEQ ID NO: 141565 - protein, 258 aa, Heterodera glycines
  Coding regions on vcDNA: vcDNA=SeqID_67988; Strand=-; Position=1 -82,127-178,470-534,1107-1517,1689-1852
MRNSRKFRLIVKKEKSRELIDYKIENQARISDEDLGKLKKLANIRIRGDEAHHSFYDEEIYREIGAARGKNLSEPSGQNRMKQIFNSADHHDPLEPSSSNYDQDDFSFDFGRAWQSPSPNNPRVFKSEARTAPSSPITHFMPSTSNSSPISPRRSSWQGPPVYNDGRGSNSAASSAPSSPTMPKSSATSPSSSPNTKMRKTKKSLSFNKLFGRKSSGDSEKQLTEEDYGGWRRYKECELGIQNAITTIRSRLDQWDAE

SEQ ID NO: 141566 - protein, 80 aa, Heterodera glycines
  Coding regions on vcDNA: vcDNA=SeqID_67989; Strand=-; Position=1 -166,256-332
MIANVKFFPLIIFVYQTLINLIAESGEINSCRTSNVSSPSKSPRRTLAQLFREENESSQRENEDKKMKGKMCKSDSSTQS

SEQ ID NO: 141567 - protein, 284 aa, Heterodera glycines
  Coding regions on vcDNA: vcDNA=SeqID_67990; Strand=-; Position=1 -72,498-522,571-638,708-841,3728-3902,4156-4353,4439-4538,4581-4663
MDPTLVEAEQSEELSQFIQSLYKAEFKADGFSEIGSVIQLLRTMPHFEMLEPTDQVILLSFVTIPLIAMNARFNPLKTNSEIITNNNKFNPLFHAATVKTFEFVPISDTIKNPEKAVEYLDWQIARYRTNSSEKWVIGCSNVLKRMAYFPHNGGQLKKVDFKENVRTILENNVQVLQRSAAFDPRDLYEQVPTVAQIAASTRRTTAKKLTTKTMPKTTRITMKTTSTTTETPAEHEQDYDNLAGAGIEWDANVEAKPPSDSSQKLEGGAVLSVADNELNIAKQK

SEQ ID NO: 141568 - protein, 64 aa, Heterodera glycines
  Coding regions on vcDNA: vcDNA=SeqID_67991; Strand=+; Position=1 -8,276-368,1085-1178
MSYSENLFDFCKANRACEVSNDTKNVRFERERKKPREILCFIWLGIGKFFYKLLEVWTEYGVYV

SEQ ID NO: 141569 - protein, 237 aa, Heterodera glycines
  Coding regions on vcDNA: vcDNA=SeqID_67992; Strand=-; Position=1 -153,206-308,358-521,630-730,792-982
VHLTDGGGGFKEVQIQTLAQCHANNGSKETANKPYGIEFRMPREGGNCDDGLLVCYPALLQRGNNHLEKSRNFKVTRKFIVEAKMDNSLGKECVQNMAKNGRENGTIIWRGIKLRTMPKQNNQNNGRIIILETSISLNKQYNLSAGQHKFSVLFALNQTADNEPFTRFSSVENDFGGRAMQNDFLRSNGPSFLSDYADLWLLGLDMLPMAHQTEEQTEQLKMELFISRSSKCLIEAW

SEQ ID NO: 141570 - protein, 59 aa, Heterodera glycines
  Coding regions on vcDNA: vcDNA=SeqID_67993; Strand=+; Position=1 -30,130-279
MPLRRKINAAMAYTMKLNESCAILGKKFDCSFAWLLERYKLSDKYAIKANTEVKYTIKF

SEQ ID NO: 141571 - protein, 56 aa, Heterodera glycines
  Coding regions on vcDNA: vcDNA=SeqID_67994; Strand=+; Position=1 -80,237-327
MEKKLEWNGIPAFSPLKSRQISLLPDRYLYLNLFLFTNSKMSHNPKEANKEMEKAM

SEQ ID NO: 141572 - protein, 125 aa, Heterodera glycines
  Coding regions on vcDNA: vcDNA=SeqID_67995; Strand=+; Position=1-380
  Homolog annotation: Hit_ID=EAL36504.1; Match level="QueryCoverage =97%, HitCoverage=12%, E-value=7e-11, Identity=39%"; Hit description =hypothetical protein Chro.80404 [Cryptosporidium hominis]
IRRDTTVIRSSTTVIRRGSTVIRSSTTVIRRGTTVIRRDTTMIRRGTAVIRRGSTVIRSSTTVIRRGSTVIRSSTTVIRRGTTVIRRDTTVIRSSTNLIRRGTTVMRRGTTVIRRGTAVIREAQQ

SEQ ID NO: 141573 - protein, 52 aa, Heterodera glycines
  Coding regions on vcDNA: vcDNA=SeqID_67996; Strand=+; Position=1-157
NASHYFFVQSVKCAVALSNLALSVGPSDNSSSNWPPSLPPPNIVGIRRIRME

SEQ ID NO: 141574 - protein, 16 aa, Heterodera glycines
  Coding regions on vcDNA: vcDNA=SeqID_67997; Strand=-; Position=1-49
EAIPEGFGLPINLGAS

SEQ ID NO: 141575 - protein, 16 aa, Heterodera glycines
  Coding regions on vcDNA: vcDNA=SeqID_67998; Strand=-; Position=1-49
EATPEGFGLPINLGAS

SEQ ID NO: 141576 - protein, 216 aa, Heterodera glycines
  Coding regions on vcDNA: vcDNA=SeqID_67999; Strand=-; Position=1 -37,262-429,1442-1544,1888-2218,2300-2311
  Homolog annotation: Hit_ID=NP_502368.1; Match level="QueryCoverage =73%, HitCoverage=13%, E-value=1e-29, Identity=40%"; Hit description =rac effector, Gut on EXterior GEX-3 (129.9 kD) (gex-3) [Caenorhabditis elegans] emb|CAA94604.1| Hypotheti
MCPEERDLVIEKGLKTCNSALDELSKKVIEVFGKLCTDKHQMELNQSPHTCARILAATYKLLAAAENDVAYDIVCLFRDAMLQQSQREDAHGQETLAEVYSKWYLEVLLRKASTGQLLYSDHLQAFVTSEQPQQQQTSAATGAGALFAESYTDPRELRALAQLIGPYGIKAMEERLVWQIASQITELFKLVRENRETLHAARVNFDKPAKLRERFD

SEQ ID NO: 141577 - protein, 25 aa, Heterodera glycines
  Coding regions on vcDNA: vcDNA=SeqID_68000; Strand=-; Position=1-76
MTGKGFGRLYMYSDKLEERRMGIWD

SEQ ID NO: 141578 - protein, 86 aa, Heterodera glycines
  Coding regions on vcDNA: vcDNA=SeqID_68001; Strand=+; Position=1 -47,96-309
MSDNPKEAEKEMEKAIFIAADCWLEVFGLLPRFQLGLGIAMISHRFDRRVDEHFKTRKWTLGRIVIQRKIGENGAKEMEIVNSNGK

SEQ ID NO: 141579 - protein, 139 aa, Heterodera glycines
  Coding regions on vcDNA: vcDNA=SeqID_68002; Strand=+; Position=1 -254,299-464
MQRAIKYFIDYYAINDITQLYALLKSEIDSHPSNYFPNPLLSVSCVHIVNTEFENQPVIVEGTLDLIDELLFSTCYPKTRQGVGWSEPLYVELTDLMVCPGDLPICLSHFGQRKERRPSLMVDELDWHDSDDDAADEAW

SEQ ID NO: 141580 - protein, 95 aa, Heterodera glycines; identical to SEQ ID NO: 124528
  Coding regions on vcDNA: vcDNA=SeqID_68003; Strand=+; Position=1-911

SEQ ID NO: 141581 - protein, 101 aa, Heterodera glycines
  Coding regions on vcDNA: vcDNA=SeqID_68004; Strand=+; Position=1-306
MGRTNEMNGQKTAKKKEKKEKGNETSKRAQKKANGRQEEKRQKAQKEEKEGEEEEEQRENMEEERGETSQMDVNECTTATFEASGKKRKIEDLTVFDFEII

SEQ ID NO: 141582 - protein, 85 aa, Heterodera glycines
  Coding regions on vcDNA: vcDNA=SeqID_68005; Strand=-; Position=1 -124,750-850,896-928
MRFIALDAYEKSGLLVVLLALLLSSLRMHETLKMLCVHSTERRVLALLAVPEAALLRFASAADLRATAVVLALVKGKKCSMMLSE

SEQ ID NO: 141583 - protein, 152 aa, Heterodera glycines
  misc_feature (1)..(1): Xaa can be any naturally occurring amino acid
  Coding regions on vcDNA: vcDNA=SeqID_68006; Strand=+; Position=1 -80,1215-1526,1577-1630
  Homolog annotation: Hit_ID=NP_498468.2; Match level="QueryCoverage =99%, HitCoverage=14%, E-value=2e-31, Identity=48%"; Hit description =yeast Imitation SWI homolog (116.7 kD) (isw-1) [Caenorhabditis elegans] gb|AAA50636.2| Yeast isw (imitati
XEITYVPSSARTASSASRASSNSTKAKKGNLLISFCYFKLEKLKAAPTAKREGALVKSAALGDHRHRMTEKEEDEQLLQQSVRSDDSLIFENSPPFIKNGEMRDYQVRGLNWLIQLEHNRINGILADEMGLGKTLLGKTLQTIAVLGFLKFY

SEQ ID NO: 141584 - protein, 83 aa, Heterodera glycines
  Coding regions on vcDNA: vcDNA=SeqID_68007; Strand=+; Position=1 -126,495-620
MSKRENHPEKEREENRAKFLRSLIDDAHLILAHGNPKIIDHRLFDWDDPGRLEAPAFPPFFDVADALIMSPMVYNILTYSEPL

SEQ ID NO: 141585 - protein, 93 aa, Heterodera glycines
  Coding regions on vcDNA: vcDNA=SeqID_68008; Strand=-; Position=1 -249,363-392
MLYQIELPFASVIMDSSISRNDDVFAYKRFSKFFFKIESFVSPFTIFYADFAKYEKGEHVQLEVFRQGKVPEMMDSKEFTVEQVSYTSKDGTP

SEQ ID NO: 141586 - protein, 92 aa, Heterodera glycines; identical to SEQ ID NO: 124679
  Coding regions on vcDNA: vcDNA=SeqID_68009; Strand=-; Position=1-828

SEQ ID NO: 141587 - protein, 92 aa, Heterodera glycines; identical to SEQ ID NO: 127421
  Coding regions on vcDNA: vcDNA=SeqID_68010; Strand=-; Position=1-304

SEQ ID NO: 141588 - protein, 73 aa, Heterodera glycines
  Coding regions on vcDNA: vcDNA=SeqID_68011; Strand=-; Position=1-220
MIGRAVRNRPFIFEGIFKFILYPRKMSISFFEKFYTSQKRLRMRRRAVHNRHFISQRIFIFILYPRKWLSLFL

SEQ ID NO: 141589 - protein, 37 aa, Heterodera glycines
  Coding regions on vcDNA: vcDNA=SeqID_68012; Strand=-; Position=1-133
LEIGSSVFTRENLGKIFKLVGFFGVLSLGNFCQNDDI

SEQ ID NO: 141590 - protein, 178 aa, Heterodera glycines
  Coding regions on vcDNA: vcDNA=SeqID_68013; Strand=-; Position=1 -351,476-598,722-784
  Homolog annotation: Hit_ID=EAL50742.1; Match level="QueryCoverage =89%, HitCoverage=88%, E-value=2e-13, Identity=31%"; Hit description =hypothetical protein 17.t00039 [Entamoeba histolytica HM-1:IMSS]
MKKIGEKIKKGGDHTIKYSEEQKLQLEIEEDDDNLVKDDDSMGDDDDNIDDNDGNMDDNDEDDLGIDMDAIIRELEMEEGKDGEDEGLGLDYDEGDFEHSGDDDVEEEDAPKAKAFVIAAKKGKKKVLESEDDDEIDLEGSDDDPVEKEDEPKPKAFVIAAKKGKKMVSESEDDFRED

SEQ ID NO: 141591 - protein, 225 aa, Heterodera glycines
  Coding regions on vcDNA: vcDNA=SeqID_68014; Strand=-; Position=1 -390,440-727
MLEPPIVFIDGNVDATKRIEFGSYFKLDISPKLDENSEIVYRVNVYCADNNHFEFKTYTKSLANVVINSNYKVFTPIGSEKMKPDIKGQLCKKYKINVWPIYEKWVDYPKEMSKEKSKWENLVSKKWGNLLRQTEFVVDNGVAIKKDTTYKQVKFPSYFNLTIDPLLDHEADPIYYVKVKCSREDSSTFKTFTHGNTQIVLNEKTCTKFDISVSKLDKEVEFLEV

SEQ ID NO: 141592 - protein, 200 aa, Heterodera glycines
  Coding regions on vcDNA: vcDNA=SeqID_68015; Strand=-; Position=1 -222,375-497,923-1178
  Homolog annotation: Hit_ID=CAE69352.1; Match level="QueryCoverage =88%, HitCoverage=30%, E-value=1e-59, Identity=62%"; Hit description =Hypothetical protein CBG15441 [Caenorhabditis briggsae]
ETIRRVRLLSTADCLRADKSTMANSLEVRVPFLDKQFLALAMGIAPQHKCPKIEPGKTVRPMEKWILRKAFEDKEDPFLPDEILWRQKEQFSDGVGYGWIDELIGHCSAQISDEEMANASSIFPHNTPTTKEAFFMRKIFHQHFPSKSAAQTVLKWVPKWQNNEDPSGRANAMHEQTKTEEQLDNTEEGEKKKKGQKNMN

SEQ ID NO: 141593 - protein, 137 aa, Heterodera glycines
  Coding regions on vcDNA: vcDNA=SeqID_68016; Strand=+; Position=1 -43,243-613
MPFWVWYLVDHPSRDDLLTIIDEKSLSELFIKKAHHLNMGVIFITQNLFEKKMKVARINSQYIVLMSAPNAALQIRNLGVQLFPKNLTFFLSAYKDATASPYGYLFLDLHPASSPLLRIRTKIFKEDEEKALYIQND

SEQ ID NO: 141594 - protein, 189 aa, Heterodera glycines
  Coding regions on vcDNA: vcDNA=SeqID_68017; Strand=+; Position=1-570
MENKFILVPSDLYKNLLKPDAGEINVDNAKNKLSSLLKQRKLDATSKNLLYNQELRRFLKLRKEVEDKPVKVELSDGSLMVFKPKQRERDSKIPTQIVNDEGLDETGSIPTLEDPYTTAEESDAESTTSTPKTRPLIRPMRVGTTKFRQKQKSFVVKKKGKIMSIINNDPEKIGVGSRGHILRADGRHI

SEQ ID NO: 141595 - protein, 221 aa, Heterodera glycines
  misc_feature (199)..(199): Xaa can be any naturally occurring amino acid
  misc_feature (213)..(213): Xaa can be any naturally occurring amino acid
  Coding regions on vcDNA: vcDNA=SeqID_68018; Strand=+; Position=1 -80,131-251,300-465,523-586,654-682,728-790
  Homolog annotation: Hit_ID=CAE64662.1; Match level="QueryCoverage =89%, HitCoverage=16%, E-value=2e-57, Identity=62%"; Hit description =Hypothetical protein CBG09434 [Caenorhabditis briggsae]
IDPPRASVPSAVAIARSAGINVVMVTGDHPITAQAIARAVDHPITAQAIARAVGILTDETETVEDIAIRKQCDISQVDPKEASAIVVHGSELREMSEEASAIVVHGSELREMSEQQLIDVIRNHREIVFARTSPQQKLAIVQAFQQLGHIVAVTGVTGDGVNDSPALKKADIGIAMGISGSDVSKQVTDMVLLDDNFAXFVTDMVLLDDNFAXFPSKLFLA

SEQ ID NO: 141596 - protein, 155 aa, Heterodera glycines
  Coding regions on vcDNA: vcDNA=SeqID_68019; Strand=-; Position=1 -50,371-787
  Homolog annotation: Hit_ID=CAE68969.1; Match level="QueryCoverage =79%, HitCoverage=16%, E-value=9e-12, Identity=34%"; Hit description =Hypothetical protein CBG14950 [Caenorhabditis briggsae]
MSAVDGHTKCQTPTVFGGTQLDSATRRLDQMIDQARYRHSQHRNKFKEAIDYLDHIFEDFQREAADSAARPTTNGGGGKKEKAAAAATTTTSAQQKHQQQLQQHAQAVQDHSPAGGAVVIEPVQATFRQGSVKSAKEAFEKVAAAIASDKQNSRV

SEQ ID NO: 141597 - protein, 41 aa, Heterodera glycines
  Coding regions on vcDNA: vcDNA=SeqID_68020; Strand=-; Position=1 -110,392-407
MPVTRMIRDAEVGGDKMIREAGQRVGENALGMWKMTSKTFF

SEQ ID NO: 141598 - protein, 86 aa, Heterodera glycines
  Coding regions on vcDNA: vcDNA=SeqID_68021; Strand=+; Position=1-259
MSTAPNDSIEEEEEDGSDSAAATTATPASVGSSSLSSPTAGGAAAGVSSNLFASSSITTAAAAVANSESNDGGGVASSEEHNNNNN

SEQ ID NO: 141599 - protein, 43 aa, Heterodera glycines
  Coding regions on vcDNA: vcDNA=SeqID_68022; Strand=+; Position=1-129
MALFFTGYPADVAGAVSSSGNRRNVKYIDYGPLIRQSRKNQNR

SEQ ID NO: 141600 - protein, 58 aa, Heterodera glycines
  Coding regions on vcDNA: vcDNA=SeqID_68023; Strand=+; Position=1-199
GREAALIAQQIYKRARSARLRSRSCVNSPTNLETGAKRPYKPNKIKKTGAKRPFEAAK

SEQ ID NO: 141601 - protein, 77 aa, Heterodera glycines
  Coding regions on vcDNA: vcDNA=SeqID_68024; Strand=+; Position=1-232
MKTLFLFSLLFFSSYENPIRKQRAVRNERAIAGLAQLAASLAAVKAFIAANAALTASTAVALAALGTDIYLAIELVR

SEQ ID NO: 141602 - protein, 91 aa, Heterodera glycines
  Coding regions on vcDNA: vcDNA=SeqID_68025; Strand=+; Position=1-451
NTFYNIYKWVGKKYSNKIVKILHKNGVFLFISRYFPLFASRPPLLLLPAVRLSCYCQPSASLVIASRPPLLLLPAAHFSCYCRPPISLVIA

SEQ ID NO: 141603 - protein, 180 aa, Heterodera glycines
  Coding regions on vcDNA: vcDNA=SeqID_68026; Strand=+; Position=1 -55,101-122,335-420,479-545,596-682,1162-1269,1327-1356
  Homolog annotation: Hit_ID=CAE70782.1; Match level="QueryCoverage =95%, HitCoverage=11%, E-value=5e-54, Identity=63%"; Hit description =Hypothetical protein CBG17537 [Caenorhabditis briggsae]
FERSAAICGSGETSPIFKQVTFREQQVTFREQANIITSYLDGSQIYGSTEVDALDLRDLFSDHGLLRFDDHGLLRFDIVSSAQKPYLPFERDSAMDCRRNDSAMDCRRNFSVENPIRCFLSGDFRANEQGLTAMHTIWLREHNRIATKLLELNPDWDGERIYQEARKIVGARKIVGAMLQ

SEQ ID NO: 141604 - protein, 64 aa, Heterodera glycines
  Coding regions on vcDNA: vcDNA=SeqID_68027; Strand=-; Position=1 -107,281-367
MLLTKKTEKPEKVWDQQCNLEKSSALSIGIDDHNSRRAERVLYIVSVLTLLFVLTELVGGYLAH

SEQ ID NO: 141605 - protein, 23 aa, Heterodera glycines
  Coding regions on vcDNA: vcDNA=SeqID_68028; Strand=+; Position=1-71
TLLFCFCAIPIIVGEMCTQRTHH

SEQ ID NO: 141606 - protein, 21 aa, Heterodera glycines
  Coding regions on vcDNA: vcDNA=SeqID_68029; Strand=+; Position=1-65
MAISFFSWGFDRKLGTNICLL

SEQ ID NO: 141607 - protein, 19 aa, Heterodera glycines
  Coding regions on vcDNA: vcDNA=SeqID_68030; Strand=+; Position=1-59
TFAFSSLALPNTHTIFEML

SEQ ID NO: 141608 - protein, 19 aa, Heterodera glycines
  Coding regions on vcDNA: vcDNA=SeqID_68031; Strand=+; Position=1-59
TFAFSSLALPNTHTIFEML

SEQ ID NO: 141609 - protein, 19 aa, Heterodera glycines
  Coding regions on vcDNA: vcDNA=SeqID_68032; Strand=+; Position=1-59
TFAFSSLALPNTHTIFEML

SEQ ID NO: 141610 - protein, 19 aa, Heterodera glycines
  Coding regions on vcDNA: vcDNA=SeqID_68033; Strand=+; Position=1-59
TFSFSSLALPNTHTIFEML

SEQ ID NO: 141611 - protein, 19 aa, Heterodera glycines
  Coding regions on vcDNA: vcDNA=SeqID_68034; Strand=+; Position=1-59
TFSFSSLALPNTHTIFEML

SEQ ID NO: 141612 - protein, 188 aa, Heterodera glycines
  Coding regions on vcDNA: vcDNA=SeqID_68035; Strand=+; Position=1-564
  Homolog annotation: Hit_ID=NP_920205.1; Match level="QueryCoverage =96%, HitCoverage=12%, E-value=1e-16, Identity=31%"; Hit description =putative DNA helicase homolog [Oryza sativa (japonica cultivar -group)] gb|AAP52492.1| putative DNA helica
MNFRGATEAYAIVHSLPFAKLSHQVVKLNIHMPNQQPIVYRAFQLVSKAQQIQQGELPETQCSAYWKQWQNEWKHDPKLKDMLFEKVPEHFIWAKDKWNKRKYNLTKRPPIGRIVPVPPSDPERFALYSLMRHFPGDPDHLKMVNGLLCTSFTEAAIMHGLLEDDKIWDKTLAEAALSRWPDQMRWLF

SEQ ID NO: 141613 - protein, 50 aa, Heterodera glycines
  Coding regions on vcDNA: vcDNA=SeqID_68036; Strand=-; Position=1-154
LQIYWLKLHMRYISKFFDSVRRFDKDGFRLAISRSTFGNWSRIFSAITCN

SEQ ID NO: 141614 - protein, 82 aa, Heterodera glycines
  Coding regions on vcDNA: vcDNA=SeqID_68037; Strand=+; Position=1 -115,425-558
MKEMLPWSVADGINPLEKFIDWILEFKFSNTVAFGHYAGCKLNHLPCIDDYGPNNMKEDEYDHFMKWYEHNRDTKFELGKRN

SEQ ID NO: 141615 - protein, 52 aa, Heterodera glycines
  Coding regions on vcDNA: vcDNA=SeqID_68038; Strand=+; Position=1 -148,188-198
MKVLAYMIFALNFAISLQMIPSTRRSKPGSLLHSEQSAFVKYKQSSINKVSC

SEQ ID NO: 141616 - protein, 132 aa, Heterodera glycines
  Coding regions on vcDNA: vcDNA=SeqID_68039; Strand=+; Position=1 -87,142-450
RLDDPTYSFHKYIEIKKKKIVENIKQKKETFALHKRRPIPLEGRIVIVVDDGIATGLSAEAALVQLRDKKAAVVMLASPVCPLSTVGKNLVTILRYSKFKYRISLHRAHTYLEQSQEKEYISFLQGWRDTKK

SEQ ID NO: 141617 - protein, 84 aa, Heterodera glycines
  Coding regions on vcDNA: vcDNA=SeqID_68040; Strand=+; Position=1 -92,148-310
MSSSELKEVIRFAFLLRYQQVVQTQISVLQQSSSVANEGSENEAEKIQIKLSHNDIIRAFHDLKNVSMAPFSESVVTEEVVDVD

SEQ ID NO: 141618 - protein, 139 aa, Heterodera glycines
  Coding regions on vcDNA: vcDNA=SeqID_68041; Strand=+; Position=1-828
LFEYPKRTLEKIDFFVFGAVPPNRCAQIYGETESFGSSFPIACTLILRWIFAPHKCLSTPNGHLKKSIFLFHKYFSESALKRTKFYLHVSLGTLMLFLSKREMEKNFFKNFSLYFGYIVLLLVGCLEQWNHAHPSDLAS

SEQ ID NO: 141619 - protein, 43 aa, Heterodera glycines
  Coding regions on vcDNA: vcDNA=SeqID_68042; Strand=-; Position=1-129
MTNSNTEYTPMAQLNDDRFEHRIIFQSKSSKWLGLFMKCILMM

SEQ ID NO: 141620 - protein, 39 aa, Heterodera glycines
  Coding regions on vcDNA: vcDNA=SeqID_68043; Strand=+; Position=1 -64,114-169
MDSVTIEKWAKKIGSKENTSKRRNHYTIAEKMETLKKII

SEQ ID NO: 141621 - protein, 16 aa, Heterodera glycines
  Coding regions on vcDNA: vcDNA=SeqID_68044; Strand=-; Position=1-49
EAIPEGFGLPINLGAS

SEQ ID NO: 141622 - protein, 95 aa, Heterodera glycines; identical to SEQ ID NO: 125597
  Coding regions on vcDNA: vcDNA=SeqID_68045; Strand=+; Position=1-1133

SEQ ID NO: 141623 - protein, 68 aa, Heterodera glycines
  Coding regions on vcDNA: vcDNA=SeqID_68046; Strand=-; Position=1-207
MARNSEFRHFWGRNSDFRLPKNFWVSEFRFPKFLIKSRKFGVGIPISKRPRNATPDTYLGITVLSKGD

SEQ ID NO: 141624 - protein, 104 aa, Heterodera glycines
  Coding regions on vcDNA: vcDNA=SeqID_68047; Strand=-; Position=1 -106,532-740
MNDEQIAQLFEVDDWSFKNWKKISGITETPTVGEKAVSEEISNIIEPLSLVNLEDRSSPIDTFEQFDFGAVHGKASAAVNHQINLSSIIPKNEFENEYKYIQYF

SEQ ID NO: 141625 - protein, 15 aa, Heterodera glycines
  Coding regions on vcDNA: vcDNA=SeqID_68048; Strand=+; Position=1 -23,556-580
MKINELVNCRYPWYS

SEQ ID NO: 141626 - protein, 34 aa, Heterodera glycines
  Coding regions on vcDNA: vcDNA=SeqID_68049; Strand=+; Position=1 -57,353-400
MMPQNPQSHRDSEVLTMSKNFWNNIFHIDVRKPK

SEQ ID NO: 141627 - protein, 92 aa, Heterodera glycines
  Coding regions on vcDNA: vcDNA=SeqID_68050; Strand=+; Position=1 -100,200-378
MRTLMDNYYLLLILLFLLIIFNDGQPSKKRPPKDDAHRWSNRSENTKIIRAMFPNVPNEAKKLDMEGDFIRIDGKVYPAKGILLICRDNANE

SEQ ID NO: 141628 - protein, 114 aa, Heterodera glycines
  Coding regions on vcDNA: vcDNA=SeqID_68051; Strand=+; Position=1 -135,385-445,608-753
MDELNFHYADSDCYRSELAELYTYSEMDEFSLNYECFIRYMREKKGAYGDFADVEVKDFDRWSTEATTEEENGGKGLDAASKWFGDHGTGGFEQDCLVRGALNAYHVYEHGLFQ

SEQ ID NO: 141629 - protein, 95 aa, Heterodera glycines
  Coding regions on vcDNA: vcDNA=SeqID_68052; Strand=-; Position=1 -135,321-475
LKHLEKSFRELMKFTNSVNESAAKFEKGNNSKAKNSAGLYDDEKELIKITKALVNQNWQLGRSRSTSIIGRFATGNCRTNAHLCIINWTKSGHRQ

SEQ ID NO: 141630 - protein, 97 aa, Heterodera glycines
  Coding regions on vcDNA: vcDNA=SeqID_68053; Strand=+; Position=1 -66,133-360
MRNKKDVNRLIEPIRSIKFSEKYENFIVIICTGTQFNAETFCQFVGTRLRYELLEFVENPLSNWVDFCHVYPKLITSAQCLAETGPKKWADKGIKIN

SEQ ID NO: 141631 - protein, 52 aa, Heterodera glycines
  Coding regions on vcDNA: vcDNA=SeqID_68054; Strand=-; Position=1 -105,145-195
MFSLIFFFIFATISHLNGNDDELWDINLSCKPFIKSLAAKYSDLVRCAVENN

SEQ ID NO: 141632 - protein, 23 aa, Heterodera glycines
  Coding regions on vcDNA: vcDNA=SeqID_68055; Strand=-; Position=1 -58,123-136
MKSDLLIKLLYGFLILISYDKCH

SEQ ID NO: 141633 - protein, 296 aa, Heterodera glycines
  Coding regions on vcDNA: vcDNA=SeqID_68056; Strand=+; Position=1 -141,367-457,508-596,648-740,802-964,1016-1102,1160-1279,1575-1680
  Homolog annotation: Hit_ID=CAE67048.1; Match level="QueryCoverage =85%, HitCoverage=52%, E-value=4e-27, Identity=27%"; Hit description =Hypothetical protein CBG12455 [Caenorhabditis briggsae]
NWEHHKSEKAPQQEVEDQQQEPVEQKHKIDDKKVETHGGIERKEGLSYFAVLVNFLKSIIGAGVLSLPMAFKDAGIWGALVLLNVAAILNCYCMMQLVETTQFHYKRLNVTYLSYGNLAKEACKYSFPWMRKFKLMAKRLVNGSVLLLEFGFCSTYYLLISTNLREVFNFLTVSDTSIKVWLVLIYVPMVFMTLIRSMRILSFFSLAGNVLMFMSLFYILYALAYRLLSEEEKPEIHAIGSFSGMLLASSTMIFSYEAQTLNECRGQIGSLCVHLLFLPSANVRHRRWYGIPIGRN

SEQ ID NO: 141634 - protein, 18 aa, Heterodera glycines
  Coding regions on vcDNA: vcDNA=SeqID_68057; Strand=+; Position=1-56
YTEAIPEGFGLPINLGAS

SEQ ID NO: 141635 - protein, 73 aa, Heterodera glycines
  Coding regions on vcDNA: vcDNA=SeqID_68058; Strand=-; Position=1 -92,689-818
MGRRIRLGHFVIMFLTKNQIIGDSLISFRLRKIIFEIVLEKRICAFAFFAHCHFGRVSAFIRRYTKKPTIKKL

SEQ ID NO: 141636 - protein, 122 aa, Heterodera glycines
  Coding regions on vcDNA: vcDNA=SeqID_68059; Strand=-; Position=1 -55,463-776
MPTLCSNRRNFYKLTKKHFPFGVLSKDEVIAVYQFKSLPNCHGISDGFFPMPFPTNGRISDRKKGTLLIDIEKVSEFALEKVGSSRYSKKVYINGLPWRIMAKIKTKIGSTDNNEKWLGIFI

SEQ ID NO: 141637 - protein, 209 aa, Heterodera glycines
  misc_feature (34)..(34): Xaa can be any naturally occurring amino acid
  Coding regions on vcDNA: vcDNA=SeqID_68060; Strand=-; Position=1 -120,706-767,824-927,982-1181,1237-1472
  Homolog annotation: Hit_ID=CAE59952.1; Match level="QueryCoverage =66%, HitCoverage=10%, E-value=7e-15, Identity=37%"; Hit description =Hypothetical protein CBG03440 [Caenorhabditis briggsae]
DEGAEEVEAKTLPMAEEAGETIEENESEESSEEXCDFSFSAPKSNGEQMAAIDTNLYSRQIYALGHSAMEHLRKASVLVYALGHSAMEHLRKASVLVSGLGSVGVEVAKNLILGGVRSVGVRSVTLHALAFLSAPFAVRAVCFLALPVCALSVLSFVFLVVLASFSVGWRLVVLASFSVGWRRFSAARLFSAFVLGFVVSGCVAVPFCS

SEQ ID NO: 141638 - protein, 28 aa, Heterodera glycines
  Coding regions on vcDNA: vcDNA=SeqID_68061; Strand=+; Position=1-88
IPNKGDLCAYWVQFRDLGPQIIKNVRSS

SEQ ID NO: 141639 - protein, 115 aa, Heterodera glycines
  Coding regions on vcDNA: vcDNA=SeqID_68062; Strand=+; Position=1-345
  Homolog annotation: Hit_ID=CAG83749.1; Match level="QueryCoverage =88%, HitCoverage=18%, E-value=3e-10, Identity=45%"; Hit description =unnamed protein product [Yarrowia lipolytica CLIB99] ref|XP _499823.1| hypothetical protein [Yarrowia lipol
MYLLYLFNHFCTSFIKFVPLLITVVPLLIIVVPLLIIVAPLLITVVPLLITVVPLHITVVPLLITVVPLLITVLFLLIIVVPLLITVVPLLIIVVPLLITFVPLLITVVPLLISV

SEQ ID NO: 141640 - protein, 163 aa, Heterodera glycines
  Coding regions on vcDNA: vcDNA=SeqID_68063; Strand=-; Position=1 -297,356-482,934-963
  Homolog annotation: Hit_ID=CAE59843.1; Match level="QueryCoverage =97%, HitCoverage=31%, E-value=2e-26, Identity=40%"; Hit description =Hypothetical protein CBG03316 [Caenorhabditis briggsae]
PVPVGKFIPFPSLCLWDAVTSPPPSAYFQVVFLPTRVYFLLCLFGRQFRIWEQRDSMAYFEYYFPLMTFLQLMCYMGWLKMAESLLNPLGEDDEDFESGYIIDRNLAVGMTMGYIIDRNLAVGMTMVDEFYGQLPTQKPDKFGKEGEVPSAYTEEAAQIEINR

SEQ ID NO: 141641 - protein, 91 aa, Heterodera glycines
  Coding regions on vcDNA: vcDNA=SeqID_68064; Strand=-; Position=1-276
MCKAVRPLKKQCQILSKQHRTRKMPLMTIQCQMSPKLRTLKMPLMSIQYQMSSKLWTLKMPIISIQCKMSAKTMDNENAIIYNKNENVIQK

SEQ ID NO: 141642 - protein, 138 aa, Heterodera glycines
  Coding regions on vcDNA: vcDNA=SeqID_68065; Strand=-; Position=1 -60,107-215,393-550,609-697
MEWAAAFLQLEGPFMEHFNRTLNHTVQRHSDSKSRWTDMVTTSDQGSCISHTQRKFVRPNLRMVLTDFMLNNCGRAAAVQQRWDELADVAHRVRSGVDYCTSTEKPKKEPPVAGYDFVPATKAEEMYKRHGLAQALLC

SEQ ID NO: 141643 - protein, 71 aa, Heterodera glycines
  Coding regions on vcDNA: vcDNA=SeqID_68066; Strand=-; Position=1 -132,239-322
MHSSVDDGQGTVRLVWGLRTHIVPYIKRLQIVEEEEKRLLEDRTDFVEVWISSFGAKFVFSCPINFTTKII

SEQ ID NO: 141644 - protein, 100 aa, Heterodera glycines
  Coding regions on vcDNA: vcDNA=SeqID_68067; Strand=-; Position=1-303
LFLSATIAVSFIIWLHSFEHDADSNGDQFELVNSCTRERLTGRIIGEDDQFLIERCPIVGKSADHPDEWGREEAWKTKGEGRSKMLTFGTPFFEWNNTFS

SEQ ID NO: 141645 - protein, 65 aa, Heterodera glycines
  Coding regions on vcDNA: vcDNA=SeqID_68068; Strand=-; Position=1 -191,827-833
MGGQTIGGNSGNLKDKKAKISNKINLQKKYVEFEQERERAKAEGEAAHEEAVRKFSEAAKKADKK

SEQ ID NO: 141646 - protein, 33 aa, Heterodera glycines
  Coding regions on vcDNA: vcDNA=SeqID_68069; Strand=+; Position=1 -32,125-194
MHEKFRSVFTSCAANRAEAPKGATRVNDGNENV

SEQ ID NO: 141647 - protein, 217 aa, Heterodera glycines
  Coding regions on vcDNA: vcDNA=SeqID_68070; Strand=-; Position=1 -246,487-894
MCAFHVKQAINRRIQSMGFMQLYSSKEPNGLEFQRLVRKIGALQFCPPNYLARSLQLMRHLITHSPLETLQQGALSELLDYCELSHAEEETAVAVDEGRQLPARPLELTLELDRGIASAKADILAFLNTDYCNDEFVEAMSNYYGRIGHLVGFNPPSNRNEAEEMIIEEDARLLLEQSLDENGLHVDQYFEEMGLNEVQDENSPDVNSEDGEVDIMN

SEQ ID NO: 141648 - protein, 147 aa, Heterodera glycines
  Coding regions on vcDNA: vcDNA=SeqID_68071; Strand=+; Position=1 -195,335-583
MFLLKLSILFAHYFINVQLAEEQKCGEYSIGELVKRTKYRSYKNRKQPKEVKTSGNDDFSGSFGELFPFSLFTLFDFGFPKISVGFIVYENQKQCVAVKFFKNEKDEKETDESGNLKLHTKAIEVAKRITKCLEEKERRHLIEMIDA

SEQ ID NO: 141649 - protein, 199 aa, Heterodera glycines
  Coding regions on vcDNA: vcDNA=SeqID_68072; Strand=+; Position=1 -66,143-352,988-1311
MIIHEAFVDKLRQENGKETLELEDRERFMTEMRNLYDYESFSKSYIMKMLNKSSNITSIDQFDAKTWERNNNLVEIVLEFWQRYPKTALLVTNMLHPTWQQRLTAKGILDFVAGKCYLREFKWARKAKNLRLFNYFKFGELKQMIVRKQRMVRVQFWKKNRKQMQEKFGNLKRKVAEIMEQQQKEMAEISKMSTNCENE

SEQ ID NO: 141650 - protein, 66 aa, Heterodera glycines
  Coding regions on vcDNA: vcDNA=SeqID_68073; Strand=-; Position=1-200
  Homolog annotation: Hit_ID=CAB88203.1; Match level="QueryCoverage =98%, HitCoverage=69%, E-value=2e-29, Identity=75%"; Hit description =putative cuticular collagen [Globodera pallida]
GHPGQPGGQGPPGPLGAPGQPGQPGTSGQPGQPGAPGHPGKDSGYCPCPPRSSVLAVKKKMAAAKK

SEQ ID NO: 141651 - protein, 143 aa, Heterodera glycines
  Coding regions on vcDNA: vcDNA=SeqID_68074; Strand=-; Position=1-432
VIQDSQEAKDRPDLLARPVSPASLEPLASLDSPEHRDIPARTAATVRARPALPCWQSKRRWRQPRKHKRQAQGEENRKTKDRRESEAEDDHNWVEVVVGICVHQRISHTNKGHSLIAVFCIFENAEIALVNFLFNSALFILTH

SEQ ID NO: 141652 - protein, 556 aa, Heterodera glycines
  Coding regions on vcDNA: vcDNA=SeqID_68075; Strand=+; Position=1 -161,337-397,1329-1545,1600-1880,1945-2086,2167-2323,2376-2441,2486 -2542,2651-2756,2951-3036,3099-3238
  Homolog annotation: Hit_ID=NP_499836.1; Match level="QueryCoverage =99%, HitCoverage=71%, E-value=1e-133, Identity=45%"; Hit description= tyrosinase family member (77.8 kD) (3O835) [Caenorhabditis elegans] emb|CAB04594.1| Hypothetical protein
LRATEILLILPLLLLVQTSDFPARVSEGIINFCVVPPRPTSHPSLKQTQSSRSGQKRFRFSPRPPTAFPSLLRQTKIQLRQIDRKARQALTRRVKQMVSPPSMPGSPAWLKPLPVPVNHRGQIASHPFECMTLRCLCPFFKVIGLNGLCYLPSGKPLGLCYLPSGKPLSMAYRKEYRMLSDEERRRFHVAMNELKRQGIYRFFGTQHRRVATGGAHSGPAFLPWHREFVKRLEIALRLLDPSLAVPYWDSVMDNYLPDPRDSIFFSMDNYLPDPRDSIFFSPMFAGDTDPNGYVVNGPFAFWRTLEGRAAILRDDLGKDAQLFTERQLLAVANERNIWNVLSYTVPFRGCPIPTNFDALEYSHTNVHFWVGGDLATPEHFWVGGDLATPELSANDPIFYMHHSFVDLIFEIWRQMHHSFVDLIFEIWRQMQQSRFLKISLRKTDLKSCANEFHFSHSLMAPFNTLTNIDGLSNAYTDQLYRYALRPVCTRKRPTCDSRYLFCDLDHGVPYLFCDLDHGVPHCVSKVKLGGNCRGFEGKDACFNGLCLFGLCQPGPT

SEQ ID NO: 141653 - protein, 33 aa, Heterodera glycines
  Coding regions on vcDNA: vcDNA=SeqID_68076; Strand=-; Position=1 -48,104-157
MAECEERVTKMLEDKLKQIKALDRKRNQTVFEQ

SEQ ID NO: 141654 - protein, 65 aa, Heterodera glycines
  Coding regions on vcDNA: vcDNA=SeqID_68077; Strand=-; Position=1 -101,1434-1530
MVAHSDNRWTAKAILVAIFIMSPTKSNESTIAKSKNKLFAILSNPRNDQIQHSGILLLLLADRQL

SEQ ID NO: 141655 - protein, 863 aa, Heterodera glycines
  Coding regions on vcDNA: vcDNA=SeqID_68078; Strand=-; Position=1-2592
MRTETEIIKKVEIEMEGTNKTQKEVKNVSEPKLTGNIKIEKEIVENLPKSLENEIVADQGESLEIEDENLEENNGMSYENEEEFEIYDVDRRKRTTVTTPDARWIKKVEGSKLRKKGGQENKNMNTRVNYALYRLNEERKRQYDHIFTQACENSNFQLQLAKAILQISPNEGVRRIFDRDDLVARWKGQTLEVGFCVPIIPEKIIWDKKIGADCYEQTPIFAENTTFFVQAGTRELSILGRRIECGKIEDLENVQNATQKEIIHKLNKNLEKIRPKYRNMQNPLILKSGALFESETIRIEETMLEYRRKANNLPSSALRLIQRPNLTDVIKLIKDEATEKLDVVLGKTGSWLEMMRDIPKKAKEAVNYLKGISYALIIIPLFILIAIVIYIVVKYWTVISAGFRAGTFLARIIRSIIGLKRKRTQIVAVPTAPDLDSIDEDAYVLDYLPPRRVAVITNDPRRLPSIRVHFNGLLTSALVDSCASVSYCRESTARKAGLKISELSERNSNLTAANDSQIQILGKTNAKIRIEDQTTGKTGEWELTLLVSPDKHCPGPLLLGLPLLSDLKGIIAFGERKVRLGEIWTNIVSVIDAHVPKTIKVTMEKTEIFEPRTENVTTLDIRKEDRLSVIGKVGLGFNGRRMAENCIRSAEKSILQSEIIQPEGMRKQIPVRNELEAKETEEELERRKRFAAKTPATQGQFANCVWEETAQNTKEEKMKKIENSICQKINQIQQQMTKAFGGLKELAKEMDELTKIAKKEMEKAEEFHPNSNRFANTNTSTWRQHDEFRYRNRGTVGRWVNNSRGRGRQRPYHHNWRGNEGWARNDHSQSEPSTSGAFNRLPKINLKMIRINTDHRIVMMVNI

SEQ ID NO: 141656 - protein, 68 aa, Heterodera glycines
  Coding regions on vcDNA: vcDNA=SeqID_68079; Strand=-; Position=1 -94,185-297
MHAFCARAIYHRACQSKAKQQRWCFEQIKGIESVHRLLEKYICNLSTILRSELEMINFTIQTNFCCSN

SEQ ID NO: 141657 - protein, 80 aa, Heterodera glycines
  Coding regions on vcDNA: vcDNA=SeqID_68080; Strand=+; Position=1 -173,267-335
VIVKFEKFVRDETRNFDAKLVALRIENALKTGENLDDSSLGAGANSSTDDVVTTNCDSSPKAVTGNADNEAETLFEEQFQ

SEQ ID NO: 141658 - protein, 113 aa, Heterodera glycines
  Coding regions on vcDNA: vcDNA=SeqID_68081; Strand=-; Position=1-483
STGYREAIPEGFGLPINLGASVRGDCPENKKIDFFKCPFGVLKQLWGAKIQRRIKVQAIGKLFPKDSFPHKSGRIGSGGLPRKQKKSIFSSVRLGYSNNYGEQKSNAELKYRL

SEQ ID NO: 141659 - protein, 92 aa, Heterodera glycines
  Coding regions on vcDNA: vcDNA=SeqID_68082; Strand=+; Position=1-657
MFEYPKRTLEKIDFFVFGAVPPNRCAQIYGETESFGSSFPIACTLILRWIFAPHNCLSTPNGHLKKSIYFCFRGSPPEPMRPDLWGDRILRE

SEQ ID NO: 141660 - protein, 103 aa, Heterodera glycines
  Coding regions on vcDNA: vcDNA=SeqID_68083; Strand=+; Position=1 -97,357-571
MDFATGPTKKFCEICRSWIDLFEDKIQVEKLMMHKRCFVCAICDCPLEPGNCSRDDGIIYCQFMCNDRVPVWFCSAHMMLGSGEKCQLLKEKWMKENEEKQEI

SEQ ID NO: 141661 - protein, 329 aa, Heterodera glycines
  Coding regions on vcDNA: vcDNA=SeqID_68084; Strand=-; Position=1 -67,242-367,421-528,776-868,933-1004,1073-1127,1584-1708,1755 -1797,1847-1876,1925-1971,4127-4207
  Homolog annotation: Hit_ID=NP_741710.1; Match level="QueryCoverage =96%, HitCoverage=19%, E-value=3e-92, Identity=56%"; Hit description =aboc, EXpulsion defective AEX-3, Rab3 Guanine nucleotide Exchange Factor, regulator of presynaptic activi
RREFEDPLLLGKIIYDMYFFMHLCHVPIRVIQQKIRRLLGKAHIGLIYSKRINLLLDELSNLFGAKIPLKPLGFGAKIPLKPLGSRLIQKEVFTVHTGSSPDGPMCFLEVCDDALILRDANGVVQERWWYERLVNMTYSPKTRVLCLWRRHDDQVYMHKFHTKKCRHLYNSMKTAMECRHLYNSMKTAMERAASRGKVQVAGRELGGEFPIHDVERNEGGLLKVRIDGIALQFVNSQEFIELSEFIELSNIKKCNTIGGNIFILEEFNGNIFILEEFNRANNQLIQRRANNQLIQRRYISSVADQICYSVLCVFSFAAAHRHSILTHQK

SEQ ID NO: 141662 - protein, 124 aa, Heterodera glycines
  Coding regions on vcDNA: vcDNA=SeqID_68085; Strand=-; Position=1 -114,367-496,538-668
MPPPQPPPLSFTMDAPPPVPKRPSLPTTDKKPSLTAASEAPKIQVPQHLNLNSLEAMLPSTSFVDEQIPPRNFLFYDLIGPYLFRAFLSAKSFVKCVMATDAVVGNRLSGHGCTGEGQNWSNLK

SEQ ID NO: 141663 - protein, 111 aa, Heterodera glycines
  Coding regions on vcDNA: vcDNA=SeqID_68086; Strand=+; Position=1 -161,363-506,555-583
MADSERKSEAELAKAKEELRQLKLQAAKEAEEQKRELEEAQRMERELKERVNRKNMHKYPFGNAKGVTRSSARSNANPPSAATEWFHRKFGAAIQLSERKKNECERKQKKQ

SEQ ID NO: 141664 - protein, 150 aa, Heterodera glycines
  Coding regions on vcDNA: vcDNA=SeqID_68087; Strand=+; Position=1 -157,488-783
LLATHSDFFRALFFGPNADENPKIVIDDEGENAVANFERTISMLSSPDAELDDDYVENVLLLANRFLFDSIENRCVNFLMNDSQKPKIFKFRLANQCAIIGMKVKNWTNKIKSRKERQLIKHASPLISAIFYIGENSITSKIAKIPANLS

SEQ ID NO: 141665 - protein, 133 aa, Heterodera glycines
  Coding regions on vcDNA: vcDNA=SeqID_68088; Strand=-; Position=1 -307,573-667
MAKDGGGSSGNWSSTARSSSEEAEKGEKEDEEEKEEAMGEEERQREKGKREGQKEMGKAMGNGSQTEQIGTTEMGTAAEGQTEQNCESSDAQRHANVAVFVLVIVFIVVGVLLTAFLCCRQLVTPLPPDNRCS

SEQ ID NO: 141666 - protein, 41 aa, Heterodera glycines
  Coding regions on vcDNA: vcDNA=SeqID_68089; Strand=+; Position=1-276
SVPSNSNPFSVIVFIVVGVLLTAFLCCRQLVTPLPPDNRCS

SEQ ID NO: 141667 - protein, 93 aa, Heterodera glycines
  Coding regions on vcDNA: vcDNA=SeqID_68090; Strand=+; Position=1 -122,220-274,979-1080
  Homolog annotation: Hit_ID=CAE70374.1; Match level="QueryCoverage =100%, HitCoverage=11%, E-value=8e-21, Identity=85%"; Hit description= Hypothetical protein CBG16933 [Caenorhabditis briggsae]
INADDCSHDGSLSVENVLWANTVLASGTAIGLVVYTGRETRSVMNTTLPDSKVGLLDREVVRSSTIPEELGRISFLLSDKTGTLTRNEMRFKK

SEQ ID NO: 141668 - protein, 29 aa, Heterodera glycines
  Coding regions on vcDNA: vcDNA=SeqID_68091; Strand=-; Position=1-88
MAKKHNKDGNKQNSGSDDDESKGSDSSSE

SEQ ID NO: 141669 - protein, 33 aa, Heterodera glycines
  Coding regions on vcDNA: vcDNA=SeqID_68092; Strand=-; Position=1 -71,298-328
MNKKERLRFLKNFLEQASSAIISVTLCEKIFMN

SEQ ID NO: 141670 - protein, 237 aa, Heterodera glycines
  Coding regions on vcDNA: vcDNA=SeqID_68093; Strand=-; Position=1 -252,967-1047,1167-1239,1578-1690,2005-2043,2100-2252
  Homolog annotation: Hit_ID=NP_509581.2; Match level="QueryCoverage =40%, HitCoverage=3%, E-value=8e-26, Identity=60%"; Hit description =Filamin/ABP280 repeat family member (XK45) [Caenorhabditis elegans] gb|AAN60532.1| Hypothetical protein C2
MLRAQQHQQHGLETVGVVTETVTVSPQPTVETVMVDQRRPAAMPTHIVDPFSSTIVDAGGPPPMTPGTRHRLQEHGVHKAHDLKETLPSPVEGRGSATTTDHEAESETPRQFKAFFKSNNAAAELEIPGQRQNGRREQRVAEPTAAQPQAVEIVHRLRKTGSKTWEISFKPTEVGTHKVLVFVNNMPHPQTPFPIRVYDAGQIVVEDIVTEATVNDTVEFTVDAGRAGFGNLEMAIK

SEQ ID NO: 141671 - protein, 76 aa, Heterodera glycines
  Coding regions on vcDNA: vcDNA=SeqID_68094; Strand=+; Position=1 -31,453-652
MGLISPKTSYVSASVLAPLLYSANAPLSRALCARRAPASGVACRVSSAVARRHQQWWTKKGPQCVLALPLDAVGLP

SEQ ID NO: 141672 - protein, 188 aa, Heterodera glycines
  Coding regions on vcDNA: vcDNA=SeqID_68095; Strand=-; Position=1 -155,341-496,756-863,933-1022,1116-1175
AVYGSPPTPRGASVPLERGPSSAYHSSVSPHADTASSYAPSPSSPAYIARAHSQHASPVEQRRHDLSAEPVTTAGDLRSTSLLQSAMRQREKSEPPRGLLGYTQFGGRIPSPSPKAAVSPPHKYFGTETDVKKPPPPPGADSEAAQFEMTRSAELTLLKEHPSTSEQKENCSIALCFYYFLQNFKYAK

SEQ ID NO: 141673 - protein, 91 aa, Heterodera glycines
  Coding regions on vcDNA: vcDNA=SeqID_68096; Strand=-; Position=1 -11,308-572
MDLLIISAKASFARPPNRKNCFCFLNSLKMSSGDGLGPPLSSPRYVSQLYVIPAVDATEAGKGQLEISVNQGQVPNNVQMQGEFGQYFNLF

SEQ ID NO: 141674 - protein, 37 aa, Heterodera glycines
  Coding regions on vcDNA: vcDNA=SeqID_68097; Strand=+; Position=1 -111,170-172
MSITDGRPADPSSTAALGVVTSAGSGGKRVVQAKHNQ

SEQ ID NO: 141675 - protein, 85 aa, Heterodera glycines
  Coding regions on vcDNA: vcDNA=SeqID_68098; Strand=-; Position=1 -162,399-494
MQNTFLDLLFTRGSHNWNVSVIFVTQSLYGRDIKTARANAHYLVLMRNPSGQLQLRSEGEYSIPKEACLHQIRTKEERINRKRYS

SEQ ID NO: 141676 - protein, 29 aa, Heterodera glycines
  Coding regions on vcDNA: vcDNA=SeqID_68099; Strand=-; Position=1-187
LISQRLFIFCKNLPLYLKLNYIEVHEIRH

SEQ ID NO: 141677 - protein, 129 aa, Heterodera glycines
  Coding regions on vcDNA: vcDNA=SeqID_68100; Strand=-; Position=1 -90,152-331,639-758
MNYYYFICIFFLILLNHRNFNAFASVNAAVNEDDALVALAKGPEHFDRFCAINGLTIDEKKQLLSEKYEAHLGTLYYLRMDWHEIQQITKQNQFYAPEWERSRKFAFILYEYLFREYVAEYVKGSNNFQ

SEQ ID NO: 141678 - protein, 316 aa, Heterodera glycines
  Coding regions on vcDNA: vcDNA=SeqID_68101; Strand=+; Position=1 -33,81-339,393-555,649-928,987-1199
  Homolog annotation: Hit_ID=CAE73149.1; Match level="QueryCoverage =31%, HitCoverage=13%, E-value=2e-09, Identity=39%"; Hit description =Hypothetical protein CBG20540 [Caenorhabditis briggsae]
MSGDDEDFVVMNTCQSVFDQVNQPQQMVVHHHHYEKKKKKGSKKKRSSSTSSSSSSSSEESSVSRRRKKEKKKSKKEKKRERKRKHSDELAESSADEGRSTSKKQPIVYSEFDHKRNPWKLLRKNEWVHKPMHMVVDTFGDPENAKYDNSHRFTFVPLLSGDVPDYRAPNSEDSPFWRVFSELYKGLLSNPESGAVGKEQRAFSARVMKQWGKCAPERVFRNRANDKFENYVKISHAPCPPDEEGAVSLGVIKHEMDPQMLNTINIEDFEHIMRSQNASYEEALESDVQTRYSILQAMVLREPDNVDAWLKFVDIQ

SEQ ID NO: 141679 - protein, 617 aa, Heterodera glycines
  Coding regions on vcDNA: vcDNA=SeqID_68102; Strand=+; Position=1 -42,473-624,676-856,932-982,1040-1165,1241-1416,1462-1612,1684 -1872,2138-2257,2302-2431,2580-2742,3034-3127,3175-3452
MRQNDRAVFDLRKMALAEFHFFRPEVYKNFRPDTKPHVMQQELKKGFKTFWTSGLPRIGEPSANGWLRFERSDVDSQHPKHDEAEVLEQKWSCMHEEEKALMAKYKGLGLSSVEIRRRLEKFRAKWFWFPVHFKHDDEKLYEHKARIVSFEELEPLLFSFNDTNCVKDLIFKLLHIFGVPIPDIFIETQENILRQFSRSYFHSNSPISLDLNGFSKFIDCFVTQIAESPMMDSPRIYTALITSISNSPLSTQKKYNTLRQLVRGKIQTLKRHGKETKLSREVQLSLYLTAFEEMIKIKQEHNDECTDATDESNPPITESEECKMCLAVLRMNLDAKDRSLWEIGETGDVDKRKEKLVAENAETKQKAYKNFVERLSHPAALILDDPLRWIGDENELVFELCAYYNYEFPISPLVRISSFVRVDSPFYTTKLAELLKERPSHCGHKCILYTGRIARTAQPIGAAFSAQHPNFASTSACWQRFSQAPLFGTTSWYSGSALPDDYIWVFLMQHITSERTMLPRRVIDEVFTIGQGRCPWSKQFLMESLRGCCDRTDPSVTMVNATMKTHGISVYCTDPEVQLLLEKYSNNNTFRLPSNDFHFSVLACDFGLRTNDAFIAW

SEQ ID NO: 141680 - protein, 206 aa, Heterodera glycines
  misc_feature (4)..(4): Xaa can be any naturally occurring amino acid
  Coding regions on vcDNA: vcDNA=SeqID_68103; Strand=+; Position=1 -178,323-480,678-729,779-978
  Homolog annotation: Hit_ID=EAL41690.1; Match level="QueryCoverage =100%, HitCoverage=53%, E-value=8e-58, Identity=50%"; Hit description= ENSANGP00000025604 [Anopheles gambiae str. PEST]
RALXQITCAFRCSGIWPRSASHWPSQHVQWPSIEMAKEIRQEGFDLLSKDLCASSPSTSMMEGDAWLMSTVQAEDKLLQAHTNREKVFSILKTLRDRHLDFSGSATTKQLVKVLVLYECEKHYANYEWNDFCLGDRIIGIFCLGDRIIGILLQMVNCLQCRRCPHFFLPQMDLLKNRSPKSLDESARAVWALVRQLMLNGKALEQL

SEQ ID NO: 141681 - protein, 38 aa, Heterodera glycines
  Coding regions on vcDNA: vcDNA=SeqID_68104; Strand=+; Position=1-117
ENSHPRFETIVLDETEDDGHHNNLVGTDSDKENDELEL

SEQ ID NO: 141682 - protein, 100 aa, Heterodera glycines
  Coding regions on vcDNA: vcDNA=SeqID_68105; Strand=+; Position=1 -173,431-560
MPPNLIFTSLHFKRAKDGTGAVLETSKDWAQKMEVELVPMNSIPFQRRIKQFGTLAITYIDRTVIAFLHSIKHVFSLDNSRRNSLMGRAGILCAKWPRKM

SEQ ID NO: 141683 - protein, 76 aa, Heterodera glycines
  Coding regions on vcDNA: vcDNA=SeqID_68106; Strand=-; Position=1 -107,186-306
MTSLATQNRAENEKADEWPPIELCAPKLGILSQFSSVSADSVAHVLVRELAERVDRPSAAEVNSFKNDTEVEWVMQ

SEQ ID NO: 141684 - protein, 143 aa, Heterodera glycines
  Coding regions on vcDNA: vcDNA=SeqID_68107; Strand=-; Position=1 -123,188-378,544-659
MEVDHQSLDSICENILSISRHLGLPLTDNLDNAHLSLFKTKLTEFAKESKKQKAIPSLLLPSNLSLNDNEWAKFGQYVDLMNADYAERALLLKRRAEVTIDSFLWSDRVKQIEDKIRQVLEVGGFTNVHFDPVHADDVLAANL

SEQ ID NO: 141685 - protein, 45 aa, Heterodera glycines
  Coding regions on vcDNA: vcDNA=SeqID_68108; Strand=-; Position=1 -39,373-471
MICEKMVICEREKHLCKLNKKSKHRRLPRTNKIIIFFKLLQIFKN

SEQ ID NO: 141686 - protein, 126 aa, Heterodera glycines
  Coding regions on vcDNA: vcDNA=SeqID_68109; Strand=+; Position=1 -144,198-434
MANDKNSILLINLKIQVNSLQIKGSRQRVFTNPKDFRYNWTRIEVDCYKADAGTVSFWGYSNPETKEIIRVDELHCLTYETAGVPKRFKSLQVEEQPPMKKLSPSPFLANNASSLIHVFVPFVGHP

SEQ ID NO: 141687 - protein, 19 aa, Heterodera glycines
  Coding regions on vcDNA: vcDNA=SeqID_68110; Strand=+; Position=1-59
TIENFLESNMENLKMLVHI

SEQ ID NO: 141688 - protein, 52 aa, Heterodera glycines
  Coding regions on vcDNA: vcDNA=SeqID_68111; Strand=+; Position=1-159
CSSICLLLAFAFCRSHCGCTPFRLLTGRKLVLSSPSANIQIKINKKICQKNW

SEQ ID NO: 141689 - protein, 92 aa, Heterodera glycines
  Coding regions on vcDNA: vcDNA=SeqID_68112; Strand=-; Position=1 -121,421-578
MKEKQQRTLTLDELGIDMEQFMEFVEAISTTAIHKPILPNPKNVLILLKLADYFQVDWLKSRCEAHLINCPEIPLIDRFLMIDHYRLDNFKA

SEQ ID NO: 141690 - protein, 110 aa, Heterodera glycines
  Coding regions on vcDNA: vcDNA=SeqID_68113; Strand=+; Position=1 -287,340-385
AFANASSPANFIAIISFPLPFADSVVPFALTNELTREQLALKVIDNSHRFLFVRCPIARDESKWTKWEKEAIGWRISYLWNRIDIQINYERQIGDGLLDEIPGPSDQQQK

SEQ ID NO: 141691 - protein, 16 aa, Heterodera glycines
  Coding regions on vcDNA: vcDNA=SeqID_68114; Strand=-; Position=1-49
EAIPEGFGLPINLGAS

SEQ ID NO: 141692 - protein, 58 aa, Heterodera glycines
  Coding regions on vcDNA: vcDNA=SeqID_68115; Strand=-; Position=1-294
SLSLNVILLLLLACQIHWAIEATDAAPLGKWWGKQILSSTSRGMCSRRMAFSASNRIT

SEQ ID NO: 141693 - protein, 37 aa, Heterodera glycines
  Coding regions on vcDNA: vcDNA=SeqID_68116; Strand=-; Position=1-116
CFFQDLNVSYINIPTEVQNFSFSVFWGFRFVASSTPK

SEQ ID NO: 141694 - protein, 379 aa, Heterodera glycines
  Coding regions on vcDNA: vcDNA=SeqID_68117; Strand=-; Position=1 -35,2073-3124,3258-3336
  Homolog annotation: Hit_ID=NP_510671.1; Match level="QueryCoverage =99%, HitCoverage=39%, E-value=5e-63, Identity=40%"; Hit description =predicted CDS, endonuclease/exonuclease/phosphatase family and RNA -directed DNA polymerase (XR69) [Caenor
NFFSKITKRYKNRQCKTDPTKKALYDSISLHIKIQTNKFHSQIEKKAISKGRNSIFKYLQKYDVNPFEIPNLVFENKCYHDGDEKCELFANLFANSFNNSDVDPGYLNLGKCFISDIDFNIIETQKLLKKLPNKNGTSPDNISYKILKNCHSSLATVITDLFRISLDSGSLPDIWKESIVFPLFKKGDKFNPENYRPISITCSLCRVMERILSQNIYNFLLKNNKISEYQFGFVRNRSTTSQLNSCGRLEAIINGKNVDCIYIDFQKAFDSVPHNLLLYKLEKIGIKGKLLMWIKGFLSNRTFRVKIGDSLSSSKVTSGVPQGSVLGPLLFLIYINDLPDALPSGVKIKLYADDIKLYADDVNIFVKEQEPTQKLCIKH

SEQ ID NO: 141695 - protein, 49 aa, Heterodera glycines
  Coding regions on vcDNA: vcDNA=SeqID_68118; Strand=-; Position=1 -30,107-197,395-423
MEQQEPISAEMLRFHAAIELVKQRVAVANLSGVRLVRLFHQFFILVKLF

SEQ ID NO: 141696 - protein, 71 aa, Heterodera glycines
  Coding regions on vcDNA: vcDNA=SeqID_68119; Strand=-; Position=1 -88,140-267
MDLFCGTELAFSNSYFGPTRHSRIIKISSDTPVRSLTTAEIPPSAGSFSSSDGGLQSRFILWHAFSHWPTD

SEQ ID NO: 141697 - protein, 288 aa, Heterodera glycines
  Coding regions on vcDNA: vcDNA=SeqID_68120; Strand=+; Position=1-867
  Homolog annotation: Hit_ID=XP_497988.1; Match level="QueryCoverage =94%, HitCoverage=51%, E-value=2e-24, Identity=34%"; Hit description =PREDICTED: similar to Hypothetical protein CBG24508 [Homo sapiens]
MQSEHQPTFTAQAMPFEYQTQAMAPEHQPTFTAQAMPFEYQTQAMAPEHQPTFTAQAMPFEHQPTFTAEAIPFKQLTQTMQSEHQPTFTAQAMPFEHQPTFTAEAIPFKQLTQTIQSEHQPTTFTAQAMPFEHQPTFTAQAMPFEHQPTFTAEAIPFKQLTQTIQSEHQPTTFTAQAMPFERQTQVMPSEHQPIFTAESIPFEHQPTFAAEAVPFEHQTQGGQTEYQNQPTSTAQTMPFEHRTQTTFIKQANLIRYQSQPAENCNSSSPPPVFWHYETDNDLNGIFAP

SEQ ID NO: 141698 - protein, 96 aa, Heterodera glycines
  Coding regions on vcDNA: vcDNA=SeqID_68121; Strand=-; Position=1 -30,118-217,850-1012
  Homolog annotation: Hit_ID=NP_492093.1; Match level="QueryCoverage =93%, HitCoverage=4%, E-value=5e-32, Identity=66%"; Hit description =protein kinase C family member, UNCoordinated locomotion UNC-13 (207.2 kD) (unc-13) [Caenorhabditis elegan
KKARLQGTIEDFHAYVTLKLQNVKSTTIAVKGNQPQWEQEFVFETDQLDQGLVLELWNKGVLWDKLLGVHFLPLRQIGYAQEAGPGRWLQGKKKMP

SEQ ID NO: 141699 - protein, 18 aa, Heterodera glycines
  Coding regions on vcDNA: vcDNA=SeqID_68122; Strand=-; Position=1 -31,154-179
MARHEILDHLEQINYYKN

SEQ ID NO: 141700 - protein, 76 aa, Heterodera glycines
  Coding regions on vcDNA: vcDNA=SeqID_68123; Strand=+; Position=1 -61,143-312
MSDELSIETLVNGMKYGPKTDPNFCENFKRAYAEYSKTMKDNQIAAQIYKVCQSKISYWKKICGIEFKLKKKMTNN

SEQ ID NO: 141701 - protein, 86 aa, Heterodera glycines
  Coding regions on vcDNA: vcDNA=SeqID_68124; Strand=+; Position=1 -96,585-749
MFFFIFDFDFLGFCLTFLFTAQKLLFIPLLFYGWGGYGYVYPYGFYGKRQAGFGPSENAGTFGGGGEGNSNGGGRRGGGPSSPNNF

SEQ ID NO: 141702 - protein, 78 aa, Heterodera glycines
  Coding regions on vcDNA: vcDNA=SeqID_68125; Strand=-; Position=1 -95,536-677
  Homolog annotation: Hit_ID=CAE75491.1; Match level="QueryCoverage =94%, HitCoverage=39%, E-value=2e-22, Identity=58%"; Hit description =Hypothetical protein CBG23495 [Caenorhabditis briggsae]
MEDIYGGNWGVLIIKEPDLISTIIHWTFPDHRHRDGSAAFCLQVENGWQYNVFKTGDIDTEDRLTVEKVMEQINRQIN

SEQ ID NO: 141703 - protein, 40 aa, Heterodera glycines
  Coding regions on vcDNA: vcDNA=SeqID_68126; Strand=+; Position=1 -115,596-603
MFANCCTLLLINTSALTAHCARANVWWWWTTETRIGSTAE

SEQ ID NO: 141704 - protein, 64 aa, Heterodera glycines
  Coding regions on vcDNA: vcDNA=SeqID_68127; Strand=+; Position=1-289
GKKLVKIVENGGPAVPIGAAGKHFWKFECYLLRNLPIKLFNFRLGGGGGNSKKISIICWKIFKN

SEQ ID NO: 141705 - protein, 145 aa, Heterodera glycines
  misc_feature (11)..(11): Xaa can be any naturally occurring amino acid
  Coding regions on vcDNA: vcDNA=SeqID_68128; Strand=+; Position=1 -196,340-413,503-589,699-785
  Homolog annotation: Hit_ID=XP_321655.1; Match level="QueryCoverage =86%, HitCoverage=11%, E-value=1e-38, Identity=62%"; Hit description =ENSANGP00000011500 [Anopheles gambiae]
NGNCIFFCKYXSFQFSKKVALTSPSSPQILRFGMAFGEMNHEWVGNEWLPSLGLGKYRTEFMECLVDARMLEHLSKRDLKMKMIDSFHRTSLHYGIVCLKKLNYDRAMEERRNASENRISEFHLFSCVRDTKIVRQNERKRNANL

SEQ ID NO: 141706 - protein, 79 aa, Heterodera glycines
  Coding regions on vcDNA: vcDNA=SeqID_68129; Strand=+; Position=1 -202,410-447
MSHELSREFIKDIDEWIAQLYECKQLSETQVRLLCDKVGHFKFGQWKIAVMSRNVTKIALPKCHFLLGGFSVTNLTSVS

SEQ ID NO: 141707 - protein, 128 aa, Heterodera glycines
  Coding regions on vcDNA: vcDNA=SeqID_68130; Strand=+; Position=1-1295
MQTRYFCSVRFHLIGFTSSLTLSSKCFATFPHGTCSLSDSWPYLVLDEVYHLIWAAIPNNPTPRHVKMGRHRQLDRSCTFSGAPVKGNLNKRANPSSRSIRYTSQPQRSCDSALDSSQFTRRYYGNPR

SEQ ID NO: 141708 - protein, 210 aa, Heterodera glycines
  Coding regions on vcDNA: vcDNA=SeqID_68131; Strand=-; Position=1-632
MGKADCDVLDEEVSKKTMAQHGIKAEANIYVLVDGFEILVEYEEEEIDKYGVVKWKSKPYYIYFVNATATVATLKRKIAEEIDSFHSIRTIYAHQLTIRHGSHYDIALDDNKTMKDYGIGRLGIVYASTFEFEIFVLHGGKPYTIKMNNGNTVQTLKQRIKSRIGIPPERQTLRLNNPYAKVLEDNKETMENCHIEKETIIFLALDEFES

SEQ ID NO: 141709 - protein, 92 aa, Heterodera glycines
  Coding regions on vcDNA: vcDNA=SeqID_68132; Strand=+; Position=1 -235,277-320
MHFSLIQMMMTIFTKCALIMGMLENSELIAVGNKLVTTVAHESQMIPTLSTTLVPVKIRVKYRESGEPGHVYVTVGDYEFDMTRSSARRRKL

SEQ ID NO: 141710 - protein, 84 aa, Heterodera glycines
  Coding regions on vcDNA: vcDNA=SeqID_68133; Strand=-; Position=1 -201,370-423
MFTYKHPCDFLSPVWMVPMFLGPPKLYSIAYPCFHFAIAFERIRSTFLAKRYERMGTQSTVIIIWIIGAKHVKLNQKIHFWSFK

SEQ ID NO: 141711 - protein, 97 aa, Heterodera glycines
  Coding regions on vcDNA: vcDNA=SeqID_68134; Strand=-; Position=1-304
MIGRAVRNRPFIFEGIFKFILYPRKMAISFFEKFYTSQKRLRMRRRAVHNRHFISQRIFIFRGYPRKMAISFFDKFYTHTNALEHDREGGAQYTFYF

SEQ ID NO: 141712 - protein, 97 aa, Heterodera glycines
  Coding regions on vcDNA: vcDNA=SeqID_68135; Strand=-; Position=1-304
MIGRAVRNRPFIFEGIFKFILYPRKMAISFFEKFYTSQKRLRMRRRAVHNRHFISQRIFIFRRYPRKMAISFFDKFYTHTNALEHDREGGAQFTFYF

SEQ ID NO: 141713 - protein, 508 aa, Heterodera glycines
  Coding regions on vcDNA: vcDNA=SeqID_68136; Strand=-; Position=1 -316,436-503,546-1043,1085-1392,1439-1492,1660-1831,1882-1992
  Homolog annotation: Hit_ID=NP_507780.1; Match level="QueryCoverage =75%, HitCoverage=30%, E-value=1e-26, Identity=24%"; Hit description =predicted CDS, DNA polymerase type B, organellar and viral family member (5T899) [Caenorhabditis elegans]
MVAKSRGWASWKFRRYVHSQHGQQGCLQRDALQLMQQIGARPGLNAYDAEIVVPRVVDHWNNSQQRHRFAVFIFGSTGQYKPLYKYINNYYDTPISLYLNNGHFDESKQCKECGVIWNVRDNNRNGRKGHQCHETYCQLCNTYHNPERGCFIQSIEPKEQDPYSIVAFDLETMQHQALDPQQPEKKEHQPNFIAARVACPDCIQNGKWKRATAGCQICGPRRTVVFCQHRFMDTQVDKQVIAENPLEPFVNWLVFELPKKCDTYAYSHFGGRFDMVLVFLELFRIGFNPEMLRRGNKMYEMKVRKQKRRNPNIVFRDSFNLIPCSLAALIPSYGLDVEDKPFFPHLANRPENYGREIHPMPDDYLANGMMPGKRRQFDEWYSEHRHEPFRLDEALASYCTNDFEILIAALVAFRRARLRQRSKSKPSRLTVLPLVLGGVGVEVQTAHSAGGEKRIGPYSVDGWIEAEGRAIEGCTWHGCKKCYPIDNMLLPNGKTAGQVLGTISAQTA

SEQ ID NO: 141714 - protein, 122 aa, Heterodera glycines
  Coding regions on vcDNA: vcDNA=SeqID_68137; Strand=+; Position=1 -199,248-415
MFSSENAKRGSFAKKSLNGNELESEANEGDAEDIGKSLEEQSHQLALPRLFKALLSFEFANYSRLNESEVDPLLLSWDVLMRFFGDLDVLSRVRFCDAIDVKTLSNALAHLFNSLSDPPAHK

SEQ ID NO: 141715 - protein, 96 aa, Heterodera glycines
  Coding regions on vcDNA: vcDNA=SeqID_68138; Strand=-; Position=1 -94,185-241,594-733
MHAFCARAIYHRACQSKAKQQRCCFERIKGIESVHRLLEKYICNLSTILRESVNRLLEKYICNLSTILRSELEMIIFTIQANFRNVINRDKNIRIN

SEQ ID NO: 141716 - protein, 161 aa, Heterodera glycines
  Coding regions on vcDNA: vcDNA=SeqID_68139; Strand=+; Position=1 -220,593-855
  Homolog annotation: Hit_ID=AAP30771.1; Match level="QueryCoverage =100%, HitCoverage=40%, E-value=3e-77, Identity=89%"; Hit description= putative gland protein G23G11 [Heterodera glycines]
SKKDPHLYLDVSEVQWGNVYIFDLNKTEVIAVRPRRVADELRKLEERDQPPVKREQPKRTHFWNLVKKILKVGAQPQPQPQPQPVTFQKILSGLVWPTTEKYTLLVSSRDFDLDGRGSPIKQRATNPDPTRAETNYKGTFDVKMALTERPETFYVWVSSAK

SEQ ID NO: 141717 - protein, 32 aa, Heterodera glycines
  Coding regions on vcDNA: vcDNA=SeqID_68140; Strand=-; Position=1-98
LLGPDPGSRSRVLKSSGPGPGRANGNQENQAL

SEQ ID NO: 141718 - protein, 91 aa, Heterodera glycines
  Coding regions on vcDNA: vcDNA=SeqID_68141; Strand=-; Position=1 -34,629-714,861-943,1152-1221
MISFVLLALLVYWTRLLFLMCVAKLKRQKNFNKQKQRHVLVLYPLEFSDENILRSIKQFCFPLKRSMSGFLWVNFFYKLLNTISFVFNNGN

SEQ ID NO: 141719 - protein, 186 aa, Heterodera glycines
  Coding regions on vcDNA: vcDNA=SeqID_68142; Strand=+; Position=1 -33,88-615
MLSQEETGDRLERTSVCGIEGSDGLSGRFAEMSVTLRTSEGSAQLGRRRAGLARRRRRRRRHNRRSLVKELCLFNKCRPEYLAMMLRRRKKENIKFIGDRKIETVHLRQNLQIYPESFTLFGANRMYAYRGMLGVTVEQHLYAKHRVRLKFPNLPCVVQDGGNGHQSYFPLELLKISSLAMQDETA

SEQ ID NO: 141720 - protein, 915 aa, Heterodera glycines
  Coding regions on vcDNA: vcDNA=SeqID_68143; Strand=-; Position=1 -348,394-905,955-1966,2010-2170,2218-2308,2353-2976
  Homolog annotation: Hit_ID=NP_001004509.1; Match level="QueryCoverage= 87%, HitCoverage=55%, E-value=1e-111, Identity=32%"; Hit description =si:busm1-180o5.3 [Danio rerio] emb|CAD60788.1| novel protein similar to DNA polymerases [Danio rerio]
MPEEEQTYRIIVWDTETRLEKLEDEGQCIHVVNFLSARITCTDCCDASELETDCEICCQTNGTFERTKEWLSKLSKFIFHYQNSNRSEADGDEQPVAAFVEWILRAWNNQYKTYIWAHNASRFDGHFALNYICKTVRRPDVVMNGLKIYEFRVRHSPKHSMLIWRDSCLIMPIPLADLKTTFNLDCEDKPFFPYAFNRRENYCIRLEKLPDQKMYEPGSMKADKYEKFKKWYSENEDTPFFLPEQLRTYCHNDTEILLKALVKFRHILINKITQGFDVLPISCTIASACMNIFKAQFMQEDQLAMVPELGYERNDRASVIAIKYLDWRAKSEGIDIQHAGNGREKQWKKFKLDGWIESQQRCIEVIGCYWHGCDRCFKPDEQLVDEKTCQELNEMTQDRLRQLREPDTDGRSLQVEEIWECEINDQLKKNHEMKVFFDDLANERGPLDPRLAYCGGRTGPLRLFAEASADEKISVFDIVSLYPWVNYDTAYPIGVPTIIRPSAEEMIVNWTKPEHLSYQGLYRVRVIPPRGLRIPVLPMKIDERLLFSCCHRCAALFRKSVTRCAHKCEHSEQQRAFTGNFTHIELEKALEMGYVIDRFWRAWHYDEWSDQVFKGYVRQFIRLKVESSGFPDGVETLEEKHQYIREYRRIYGVDLEFGSIKKNPGLRFIAKLMLNSLWGKFSMRNQLGSNKVITRPQEFYDLVLNHRMEISSIIPISDAAIRVLYKPKKNFIVEHTSSNIVLSLWTTSRARLKLLDYMLQCYNTPGTELLYTDTDSVIVRHKRDLVPVHTGEYLGQMSEEYADYDILTFACGGAKQYAMKMVHKQTKAVKFVQKIRGITFDVNNSQELQFEHFVRKVINYGKEDEQENAVVFNYNKIQPTKDNRIITRKQNKKYLPVCQKGIINQTLEVLPFGYE

SEQ ID NO: 141721 - protein, 46 aa, Heterodera glycines
  Coding regions on vcDNA: vcDNA=SeqID_68144; Strand=+; Position=1 -97,846-889
MFDALGGQGSRRKRKASTPHPNLFDHAPYNPLDNLMFNKHGNGVGD

SEQ ID NO: 141722 - protein, 113 aa, Heterodera glycines
  Coding regions on vcDNA: vcDNA=SeqID_68145; Strand=-; Position=1 -251,436-526
MCNTLFYLFFAVAFLLFLPTIGAEDKWEVVTNARRANCTAAGSKCWKPIGYVRPLICLKADYDLNLTDQWPDIAEDHHWSDKKIFQKNGRPETRASDNHGTVRALPCFFEPVK

SEQ ID NO: 141723 - protein, 437 aa, Heterodera glycines
  Coding regions on vcDNA: vcDNA=SeqID_68146; Strand=-; Position=1 -207,416-689,1155-1375,1865-2378,2516-2613
MSNFWRETALVKKPKHQLKLIKPIFRKLIKDKGKQIADPINIDDDEDKDKEETVEKFMNLKDRYTKRKQFLCQESDDDEPDECEECKKVAKIDATISQMRETLHGTQQIVDQMIASANKTDASSSTGPKSKTKARMMKISSESAKKYLNMAGDTIYMAILGVYLSFIAIYNGDDKLNVLSEISPQMVEGIGDALNRHKGLVNDKLKKYVDEIKYRQLKENGQFLPKNELIKNMEGFLQAVEQKVPNKKELFKNINFYINLYADMKVNLTHQQTQIRSLAIGNNANASPANLVDVLKSVAAIIDKLLAKFHVLLQKATDAEEEERRNPVIVEISSDSSADEKESAEKKHGEQEKDSDETLSDCPTDELGKITILCCRYTGNIIFLNFWLIFIEKSAIDCDFLYRTKEIFLEYTQNVLALQKTSLFYFYTLFWKNVKIF

SEQ ID NO: 141724 - protein, 91 aa, Heterodera glycines
  Coding regions on vcDNA: vcDNA=SeqID_68147; Strand=-; Position=1-273
MQHILLDIHFLDYFLAKTEINQRENEQKIQIYTIIYLLRVKAEQNKAKLERMERQQSEEEKRAGRKQQKKKKGRSERSDECLRKIGRRIGK

SEQ ID NO: 141725 - protein, 32 aa, Heterodera glycines
  Coding regions on vcDNA: vcDNA=SeqID_68148; Strand=-; Position=1-98
FLFFIPQFFISFLLCNFEIAHFLLELITFPCQ

SEQ ID NO: 141726 - protein, 139 aa, Heterodera glycines
  Coding regions on vcDNA: vcDNA=SeqID_68149; Strand=+; Position=1 -65,265-390,813-910,971-1030,1087-1155
  Homolog annotation: Hit_ID=CAH72141.1; Match level="QueryCoverage =94%, HitCoverage=77%, E-value=5e-54, Identity=70%"; Hit description =OTTHUMP00000060266 [Homo sapiens] gb|AAD34121.1| CGI-126 protein [Homo sapiens] sp|Q9Y3C8|CGC6_HUMAN Prote
MDESAKKTLKQIPLLKTNAGPRDGPLWLERLKEEYNSLIAFIEHNKQGDADWFRLESSADGTRWFGKCWTYHNKIKYEFDVEFDVPITYPKTAPEIALPELDGKTAKMYRGGKICLSDDHFKPLWARTISLFLNLEKFK

SEQ ID NO: 141727 - protein, 89 aa, Heterodera glycines
  Coding regions on vcDNA: vcDNA=SeqID_68150; Strand=+; Position=1 -124,416-561
MTMILMYTTIAAVAPSLCPRRRHQIVAIAKATGAPIKILILEFLTTTTMTNCCSYQGQQQQMEINVKAIAFCFRPPPPVSRPPCPSPPR

SEQ ID NO: 141728 - protein, 54 aa, Heterodera glycines
  Coding regions on vcDNA: vcDNA=SeqID_68151; Strand=-; Position=1-163
MRFFLPLRLLIVIILALCINFCDGMFQDPSTDLSLSQPGRKISKGSMYDKFEFI

SEQ ID NO: 141729 - protein, 121 aa, Heterodera glycines
  Coding regions on vcDNA: vcDNA=SeqID_68152; Strand=-; Position=1 -208,254-411
MKRSAATLSTAAAAAPNQHENKIEPIPTHVEAEPDHETKGPPTKKRAVEDRDLWKLAKGKYLLTTYLCPDDWNRLYHNQQKVKRLDDDRFSINFELCQECVRVNCRATDLIAPMKKKPNNE

SEQ ID NO: 141730 - protein, 340 aa, Heterodera glycines
  Coding regions on vcDNA: vcDNA=SeqID_68153; Strand=-; Position=1 -106,541-883,929-1500
  Homolog annotation: Hit_ID=NP_001004509.1; Match level="QueryCoverage= 89%, HitCoverage=20%, E-value=1e-39, Identity=34%"; Hit description =si:busm1-180o5.3 [Danio rerio] emb|CAD60788.1| novel protein similar to DNA polymerases [Danio rerio]
MSKVIKRGTTVIRTGSTVIRRGATTEGKGTTVIRRDCTWHGCKKCYPIDNMLLPNGKTSGQVRERDAKRMEYIRARVNRVDVYWECKITSIVERSKAMRKSFANYVDDGPLVIRDAFTGGRTGPLKLLRKAGPGEKISYYDFTSLYPYINFTTRYPVGHPKVHVLNQQVQWTSASDNPFPLALIKVWVVPPRKIDVAVLTVKVDDRLCFPLCITCAKEYPTGGVDYDYHCQHTDQQRGWVSTCTSIELNVALDEGYRVTRVFRVLEYEQSDDKLFRPYIAEFMAQKIQASGFDSSIRGDAEKEEQFVRECAEQFGINIDPAKMVVNKGKRSLAKLCLNNL

SEQ ID NO: 141731 - protein, 63 aa, Heterodera glycines
  Coding regions on vcDNA: vcDNA=SeqID_68154; Strand=+; Position=1 -33,285-443
MATINTSSDDQIYLAYRFAGPSADLIVPAVALNLVALVGIVLNGTVLVVTVKSRQMPWHFKIF

SEQ ID NO: 141732 - protein, 53 aa, Heterodera glycines; identical to SEQ ID NO: 126996
  Coding regions on vcDNA: vcDNA=SeqID_68155; Strand=-; Position=1-352

SEQ ID NO: 141733 - protein, 46 aa, Heterodera glycines
  Coding regions on vcDNA: vcDNA=SeqID_68156; Strand=-; Position=1 -57,164-245
MGSSASESPPPPKLVAIQDLPIYKAESVPAARAARPVDTIGRPATF

SEQ ID NO: 141734 - protein, 29 aa, Heterodera glycines
  Coding regions on vcDNA: vcDNA=SeqID_68157; Strand=-; Position=1 -23,641-707
MTIQEVYKVIGKPPLCLQTADEDSDEQRW

SEQ ID NO: 141735 - protein, 552 aa, Heterodera glycines
  misc_feature (181)..(181): Xaa can be any naturally occurring amino acid
  misc_feature (200)..(200): Xaa can be any naturally occurring amino acid
  misc_feature (484)..(485): Xaa can be any naturally occurring amino acid
  misc_feature (511)..(512): Xaa can be any naturally occurring amino acid
  Coding regions on vcDNA: vcDNA=SeqID_68158; Strand=-; Position=1 -23,2185-2344,2372-2581,2629-2904,2948-3170,3220-3527,3566-3718
  Homolog annotation: Hit_ID=NP_001004509.1; Match level="QueryCoverage= 92%, HitCoverage=30%, E-value=3e-50, Identity=28%"; Hit description =si:busm1-180o5.3 [Danio rerio] emb|CAD60788.1| novel protein similar to DNA polymerases [Danio rerio]
FKKEAAIMGGRTGPMKLFAKSNEKKKISVYDIVSLYPSVNYGTAYPIGFPKIIIPKSDEINKFNGLYKVRVHPPRGLRIPVLQLKCKSDEINKFNGLYKVRVHPPRGLRIPVLQLKCDERLLFPLCWRCASTFKKETTRCDYNCPHDEAQRRYVATYTSVELAKALECGYTVDRFYRAWHXAKALECGYTVDRFYRAWHXEEEADNLFKGYVRLFLKLKEEASGFPKGVETGEQKDMWREEYKEKYGIDIELAKVKKNPALRYISKLMLNSLWGKFSMRNYLNKNAGKFSMRNYLNKNAVIDRASEFYKIACDHKIELCDIVEYSEEAIRLIYRDKEEFVMEHKSSNIVISYGEFKKFFLAESNGGEILYTDTDSIFVAESNGGEILYTDTDSIFVLHDRDVEPITTGKYLGEMSEEGGYEIEEYCCGGAKQYGKQTGETEYVMKIRGITFDWNRKTLHYDTFREMVLNYGKGEVRFKKILTHXXPNIKANAGFENYGKGEVRFKKILTHXXPNIKANAGFEGGDEEKHKMYKPVCQKGIIDEELNVMPFGF

SEQ ID NO: 141736 - protein, 225 aa, Heterodera glycines
  Coding regions on vcDNA: vcDNA=SeqID_68159; Strand=-; Position=1 -134,362-418,463-855,901-994
  Homolog annotation: Hit_ID=NP_507780.1; Match level="QueryCoverage =99%, HitCoverage=17%, E-value=2e-11, Identity=24%"; Hit description =predicted CDS, DNA polymerase type B, organellar and viral family member (5T899) [Caenorhabditis elegans]
LKEEASGFPKGVETGEQKDMWREEYKEKYGIDIELAKVKKNPGLRDKEDFVMEHKSSNIVISLWTTSMARLKLLEFMREAESNGGEILYTDTDSIFVLHDRDVEPITTGKYLGEMSEEYGGYEIEEYCCGEAKQYALKMRNKQTGEIEYVMKIRGITFDVDNKKTLHYDTFREMVLNYGKGEVDPAFFVYKNDFGPTRDSKVVTREKHKMYKPVCQKGIIDEELM

SEQ ID NO: 141737 - protein, 43 aa, Heterodera glycines
  Coding regions on vcDNA: vcDNA=SeqID_68160; Strand=+; Position=1 -75,349-405
MPTAQPAATIHLQNVHAAVVRAVAAVSHVAVVVVGVAAAVVVV

SEQ ID NO: 141738 - protein, 62 aa, Heterodera glycines; identical to SEQ ID NO: 131736
  Coding regions on vcDNA: vcDNA=SeqID_68161; Strand=+; Position=1 -81,222-527

SEQ ID NO: 141739 - protein, 68 aa, Heterodera glycines; identical to SEQ ID NO: 131735
  Coding regions on vcDNA: vcDNA=SeqID_68162; Strand=-; Position=1 -18,428-616

SEQ ID NO: 141740 - protein, 385 aa, Heterodera glycines
  Coding regions on vcDNA: vcDNA=SeqID_68163; Strand=-; Position=1 -147,205-422,473-564,686-1111,1649-1923
  Homolog annotation: Hit_ID=NP_727026.1; Match level="QueryCoverage =70%, HitCoverage=22%, E-value=4e-09, Identity=25%"; Hit description =CG3125-PB, isoform B [Drosophila melanogaster] ref|NP_572253.2| CG3125-PA, isoform A [Drosophila melanoga
MGVYEDYVKSLIAIGLGPKRELEPQAARPHAFGNPFKLDKKSNLYIADEVGEMNAGASTSALPSSDVPSSSSSNGGGASSGGSGRRRRAVSEVGTMATTAGSVRPPRRRPGPIDANRLAMWRRRRRSSSIASCPDEAVAVTAETTEGTSTANESNEMPTTTALLRTSTIDGTVATNTLGTPPPAETASGFLDEELAPLRMADEEDEEESDGGIQWRDEAVAAPTAADEGPIAVPEEAELRFGIAQITPAAASPPPPSSSSLPPPSNGAAPFALAECQLLEKQRQIRHIVRQKGPSNSLLAERVAAVAASTSPSSRKRARELLELGIEEARRFKRAKLCEMIGQHLQRQQRPVDASVTSNNSPSLNNNGGSAFASARQNGYSNNSR

SEQ ID NO: 141741 - protein, 17 aa, Heterodera glycines
  Coding regions on vcDNA: vcDNA=SeqID_68164; Strand=-; Position=1 -45,161-169
MGTIGPSAVEERHFYNL

SEQ ID NO: 141742 - protein, 40 aa, Heterodera glycines
  Coding regions on vcDNA: vcDNA=SeqID_68165; Strand=+; Position=1-173
  Homolog annotation: Hit_ID=CAG06138.1; Match level="QueryCoverage =92%, HitCoverage=42%, E-value=4e-09, Identity=67%"; Hit description =unnamed protein product [Tetraodon nigroviridis]
VLGQCKHPFHMHCIVKWTNTQSGQKPACPLCRQEWKFATS

SEQ ID NO: 141743 - protein, 16 aa, Heterodera glycines
  Coding regions on vcDNA: vcDNA=SeqID_68166; Strand=-; Position=1-49
EAIPEGFGLPINLGAS

SEQ ID NO: 141744 - protein, 49 aa, Heterodera glycines
  Coding regions on vcDNA: vcDNA=SeqID_68167; Strand=+; Position=1-148
KLLMNEMTDSSSVGRRFLRHKIGVIITKIKCWQFMFFWKRNNCGVISGR

SEQ ID NO: 141745 - protein, 51 aa, Heterodera glycines
  Coding regions on vcDNA: vcDNA=SeqID_68168; Strand=-; Position=1-153
MINIFYGQRLLVSNIFTDKHGQFEKFIPVDDVILIENCKKIYIGFYSGKSE

SEQ ID NO: 141746 - protein, 78 aa, Heterodera glycines
  Coding regions on vcDNA: vcDNA=SeqID_68169; Strand=-; Position=1 -74,525-623,1067-1129
  Homolog annotation: Hit_ID=NP_872058.1; Match level="QueryCoverage =100%, HitCoverage=26%, E-value=3e-24, Identity=67%"; Hit description= RhoGAP domain containing protein (37.9 kD) (2P555) [Caenorhabditis elegans] emb|CAD59137.1| Hypothetical
LCGSDEMEQRYRGRIEKFVAPTNDVLLLKVNKEGPLKKDIWRAPGNQAQVRKLSHIMQHGRLVNISNISVYTAASVIK

SEQ ID NO: 141747 - protein, 90 aa, Heterodera glycines
  Coding regions on vcDNA: vcDNA=SeqID_68170; Strand=-; Position=1 -87,170-220,270-402
  Homolog annotation: Hit_ID=NP_496170.1; Match level="QueryCoverage =100%, HitCoverage=12%, E-value=2e-36, Identity=72%"; Hit description= procollagen-lysine precursor, LEThal LET-268 (84.4 kD) (let-268) [Caenorhabditis elegans] emb|CAA91321.1
VGFEHHWLQILDNYVAPMQEKVFIGFYQRPIHANMMFVVRYRPDEQASLRPHHDASTYSIDVALNKKDVDYEGGGVRYVRYNCTVPADQI

SEQ ID NO: 141748 - protein, 130 aa, Heterodera glycines
  Coding regions on vcDNA: vcDNA=SeqID_68171; Strand=-; Position=1 -12,523-608,679-831,1338-1476
  Homolog annotation: Hit_ID=NP_496170.1; Match level="QueryCoverage =95%, HitCoverage=16%, E-value=6e-37, Identity=53%"; Hit description =procollagen-lysine precursor, LEThal LET-268 (84.4 kD) (let-268) [Caenorhabditis elegans] emb|CAA91321.1|
MREQGGAQKIRLLREYLEPFKDRKDLILLFIDAYDVILNADSDIILRKFLSLFPDNRIVFGAEPFCWPDRTLAPQYPPVVFGERYLNSGMFIGFAREIYALLAIAGDLNLQDGDDDQLFYTRVFLDTDNR

SEQ ID NO: 141749 - protein, 139 aa, Heterodera glycines
  Coding regions on vcDNA: vcDNA=SeqID_68172; Strand=-; Position=1 -262,541-698
MAAENAMFYKGIKMARDTGDSTPALVAGHEAAHSVAVIMQTHMPHDFISATNIATPENEGLMLASAVQPRNCLIKQIQALQSGGIVVAALKKGMEAATWKNAKKALDRAIKKVIDESTEAAKEFLEANWSAIERVFSYF

SEQ ID NO: 141750 - protein, 72 aa, Heterodera glycines
  Coding regions on vcDNA: vcDNA=SeqID_68173; Strand=-; Position=1 -70,252-366,451-484
MDKKKSSNFCMTEKKWHFSPYLSGWSEQQRPGQGHQQREHGPSKSIVEMPRKRVPQLDEPDLHAMQMRGRNA

SEQ ID NO: 141751 - protein, 19 aa, Heterodera glycines
  Coding regions on vcDNA: vcDNA=SeqID_68174; Strand=-; Position=1-59
TFSFSSLALPNTHTIFEML

SEQ ID NO: 141752 - protein, 19 aa, Heterodera glycines
  Coding regions on vcDNA: vcDNA=SeqID_68175; Strand=-; Position=1-59
TFAFSSLALPNTHTIFEML

SEQ ID NO: 141753 - protein, 19 aa, Heterodera glycines
  Coding regions on vcDNA: vcDNA=SeqID_68176; Strand=-; Position=1-59
TFSFSSLALPNTHTIFEML

SEQ ID NO: 141754 - protein, 19 aa, Heterodera glycines
  Coding regions on vcDNA: vcDNA=SeqID_68177; Strand=-; Position=1-59
TFAFSSLALPNTHTIFEML

SEQ ID NO: 141755 - protein, 19 aa, Heterodera glycines
  Coding regions on vcDNA: vcDNA=SeqID_68178; Strand=-; Position=1-59
PFSFSSLALPNTHTIFEML

SEQ ID NO: 141756 - protein, 160 aa, Heterodera glycines
  misc_feature (150)..(150): Xaa can be any naturally occurring amino acid
  Coding regions on vcDNA: vcDNA=SeqID_68179; Strand=+; Position=1 -141,199-516
  Homolog annotation: Hit_ID=CAE60124.1; Match level="QueryCoverage =93%, HitCoverage=26%, E-value=1e-34, Identity=47%"; Hit description =Hypothetical protein CBG03667 [Caenorhabditis briggsae]
DLVVNHNVPRCSKTYVHRVGRSARAGRFGAAVTFVTQYDVLLLKTIEGVIGKQMGVIGKQMEELKVSHKEVSLYAGKVLATKREAEIRMQRRGFGERREIWKRKELATEGLSEEEIEKAIEQWKNGGRKIVKAHNQHEAEESQKGRTKEXKPTQENDLEE

SEQ ID NO: 141757 - protein, 60 aa, Heterodera glycines
  Coding regions on vcDNA: vcDNA=SeqID_68180; Strand=-; Position=1 -74,120-251
  Homolog annotation: Hit_ID=NP_506570.1; Match level="QueryCoverage =91%, HitCoverage=16%, E-value=7e-09, Identity=52%"; Hit description =DeHydrogenase, Short chain (37.2 kD) (dhs-22) [Caenorhabditis elegans] emb|CAB02732.1| Hypothetical prote
RAGAQTPLFLALSRQINGVPGKYYSDCKEAKVHQFAEDEIACEILYNNSLEQCGLDHSAI

SEQ ID NO: 141758 - protein, 97 aa, Heterodera glycines
  Coding regions on vcDNA: vcDNA=SeqID_68181; Strand=-; Position=1 -135,268-426
MYISEQNLPLQTPISCFTKFKSKLLRRSPAGRRRPELPQLGLVPEELSSKCGGRVYSMCTTAFLLCSLSQGNASLQNDFKNWKRFLRLDDTNGNSKI

SEQ ID NO: 141759 - protein, 180 aa, Heterodera glycines
  Coding regions on vcDNA: vcDNA=SeqID_68182; Strand=-; Position=1 -122,177-597
MRMFIFCFDNFNSFHKAKSWGYCPSYHRASAQAKSTWMYDDCEHERRATEARAVAAAADVSTEASTTAEDAPTYRPDADSLEQEDDETQDSVASDSLMGVCWWTTRTVMMMIRTSRRRKPDGRLPPQHTCIIRRAQSCPLPPSPQLTVFFNLFVFYHTIANFGTLFDSQFWHLFNFIVSK

SEQ ID NO: 141760 - protein, 51 aa, Heterodera glycines
  Coding regions on vcDNA: vcDNA=SeqID_68183; Strand=+; Position=1 -13,833-975
MVIGTIDGPEQRLSLKKVLVFYEKSMGANLEAKLFTSKDFRGNMGTNRKER

SEQ ID NO: 141761 - protein, 40 aa, Heterodera glycines
  Coding regions on vcDNA: vcDNA=SeqID_68184; Strand=+; Position=1 -38,443-527
MIDKMIFHHIFGGTSTAPIRALTSKTTHNVAEQVQLQFEP

SEQ ID NO: 141762 - protein, 92 aa, Heterodera glycines
  Coding regions on vcDNA: vcDNA=SeqID_68185; Strand=+; Position=1-279
MCSCGTNKKEQLTHRLMIFRYPFFEPIIMILESAFTVAHVMKIIKIPLFTMTLPNFGILIFLGEYGTTRDVGIFIRCRITAPFRLVMLAKFH

SEQ ID NO: 141763 - protein, 199 aa, Heterodera glycines
  Coding regions on vcDNA: vcDNA=SeqID_68186; Strand=-; Position=1 -302,336-399,445-487,626-741,794-824,965-1008
  Homolog annotation: Hit_ID=NP_508395.1; Match level="QueryCoverage =97%, HitCoverage=76%, E-value=4e-69, Identity=54%"; Hit description =DumPY : shorter than wild-type DPY-3, collagen family member (29.6 kD) (dpy-3) [Caenorhabditis elegans] g
MWREMLHVQAITGGLPTSSDNGTAPLAVTAARVKRQTVGTTAYDAQMLAGAVAGGGSPPGSSGNPQGGSCCSCQVGPPGPPGPPGRDGRPGSVRQSKLCPGAPGRPGNPGPPGRDGVLLPGPPPKPPCQKCPPGPPAGSSGRDGAPGLPGPPGPQGPQGPPGLPGDKGPPGEPGKVINGAPPGPPGPPGAPGPQGWFGV

SEQ ID NO: 141764 - protein, 31 aa, Heterodera glycines
  Coding regions on vcDNA: vcDNA=SeqID_68187; Strand=-; Position=1-95
LCVLCPLSSAAVSALAATVAAVAIVVVTVVA

SEQ ID NO: 141765 - protein, 24 aa, Heterodera glycines
  Coding regions on vcDNA: vcDNA=SeqID_68188; Strand=-; Position=1-80
RTLSTAVRQRSSKIYSMPQILWAG

SEQ ID NO: 141766 - protein, 270 aa, Heterodera glycines
  Coding regions on vcDNA: vcDNA=SeqID_68189; Strand=-; Position=1 -274,405-506,642-1078
MEENYAKMEICMDSANTFTNLEILEEIRLEFLQRMNKIWRINFLGKKTFFFGDYGGSSTDGQKSILKSVFAMHEQSLKPLLLVNQFRQKLKEIYIDTERIGGELHENSAVFSIIKELCLGVLYSDEEKNMYKLLKKYFLLLIRTSDEPISEEEKQKFNIETYKANNEIVVANLLKFVSNLNAENERQLIWIVSEAATELANLGLIHTKRDKSEEELGEESIGEKLRKICYFESFSFWLANNGTILKSEKWRKFILQQNYVSKVTFLYLKN

SEQ ID NO: 141767 - protein, 292 aa, Heterodera glycines
  Coding regions on vcDNA: vcDNA=SeqID_68190; Strand=-; Position=1 -118,439-1068,1316-1446
MRIENNEKAILEFKSAVEQLIGPILLSQIENRHPFLMAFDLVTNAKWADEYLLILSKETIVAGIGEFRISSRIYFSRIFEIFQKFYLLQRKYLHKTDAKISNIFKEIEEKWEENINMFSVLFKENKVKDISDIVEIFDFWQKLALLYNKMPMLEAHEKIQRVEENAKVWHNESHLKILFARMELVDEHAQNVLRFYAEFLAQHLQNSLFESTGALYRLKKFLCPKQMEKFVSFGQLTQKYPQLKEILRRRLNTVEIMQLQMVNYISLFDFDTAAPHWKQSQFLLDNLAYYIW

SEQ ID NO: 141768 - protein, 85 aa, Heterodera glycines
  Coding regions on vcDNA: vcDNA=SeqID_68191; Strand=+; Position=1 -78,678-857
MALNGTYLFNLSLYCSNSMHEVRAVQMFCIFCHFSSNFSDLPLGKNLIILKLNINLNGCASGSTLISFTDENVEKFLICNCKNNR

SEQ ID NO: 141769 - protein, 234 aa, Heterodera glycines
  Coding regions on vcDNA: vcDNA=SeqID_68192; Strand=-; Position=1 -82,129-446,651-955
MPFCHLTSAIFAFFVLFSFDRANCISFVLTIKEIDALYSQLLNLPNEQKALENELPKKEMKLKLELALFYDVSHQIFVSMKNKKLTNVQQKLIEEKRVEFSELAERIEKTDEWTAEIGKCKLWKFWHHLKIFLAEILGEEFGRMILESENTAQKMIDCEQIEQMLSKNDENGIGSDEQIEIIKKYLEDTKSATHFKALMALMEGQKKGENWQNEGKWHWQGLLKRRNYYYIIFN

SEQ ID NO: 141770 - protein, 19 aa, Heterodera glycines
  Coding regions on vcDNA: vcDNA=SeqID_68193; Strand=-; Position=1-59
TFAFSSLALPNTHTIFEML

SEQ ID NO: 141771 - protein, 19 aa, Heterodera glycines
  Coding regions on vcDNA: vcDNA=SeqID_68194; Strand=-; Position=1-59
TFAFSSLALPNTHTIFEML

SEQ ID NO: 141772 - protein, 19 aa, Heterodera glycines
  Coding regions on vcDNA: vcDNA=SeqID_68195; Strand=-; Position=1-59
TFSFSSLALPNTHTIFEML

SEQ ID NO: 141773 - protein, 19 aa, Heterodera glycines
  Coding regions on vcDNA: vcDNA=SeqID_68196; Strand=-; Position=1-59
TFAFSSLALPNTHTIFEML

SEQ ID NO: 141774 - protein, 19 aa, Heterodera glycines
  Coding regions on vcDNA: vcDNA=SeqID_68197; Strand=-; Position=1-59
TFSFSSLALPNTHTIFEML

SEQ ID NO: 141775 - protein, 19 aa, Heterodera glycines
  Coding regions on vcDNA: vcDNA=SeqID_68198; Strand=-; Position=1-59
TFAFSSLALPNTHTIFEML

SEQ ID NO: 141776 - protein, 68 aa, Heterodera glycines
  Coding regions on vcDNA: vcDNA=SeqID_68199; Strand=-; Position=1 -66,206-274,332-400
MFDEDENDRYFCEPRTRIRTITELDNVINSCEMSANANNGTNDEGVAAAVNNGGTNSANANNRTNCEG

SEQ ID NO: 141777 - protein, 126 aa, Heterodera glycines
  misc_feature (13)..(13): Xaa can be any naturally occurring amino acid
  Coding regions on vcDNA: vcDNA=SeqID_68200; Strand=-; Position=1 -147,221-403
  Homolog annotation: Hit_ID=NP_498776.1; Match level="QueryCoverage =85%, HitCoverage=83%, E-value=1e-23, Identity=47%"; Hit description =heat shock protein (hsp-12.2) [Caenorhabditis elegans] gb|AAA27953.1| Heat shock protein protein 12.2 [Ca
IALLKCRICLRPXMLSHLKHKDGVVRVDNGHDRWEVGLDAAFFRPDEIEISLAGDHLFVYCHHEEISLAGDHLFVYCHHEERSDEHGSISREIKRSYKLPDDVDTATIRSHLTLQGILRVTAQKKK

SEQ ID NO: 141778 - protein, 27 aa, Heterodera glycines
  Coding regions on vcDNA: vcDNA=SeqID_68201; Strand=+; Position=1-81
MHRIIAAVKKLVVGSVLAVRCTLCVLL

SEQ ID NO: 141779 - protein, 65 aa, Heterodera glycines
  Coding regions on vcDNA: vcDNA=SeqID_68202; Strand=-; Position=1 -68,89-313
SEFFSNSPPQTKIKKLYIGEDFSNKCSNSKFPKIFSGGAYRHRRTYIFHYFYKFFALKRPKFGHF

SEQ ID NO: 141780 - protein, 104 aa, Heterodera glycines
  Coding regions on vcDNA: vcDNA=SeqID_68203; Strand=+; Position=1 -28,424-710
MPSSSPPSPVTIVYIIVYEKHFLSHWQVIISDGGVPTVAQTYNTFAEFKWQFPPSALRRKSANPKHDKDHDDDDGDDQHHGSNDQETEIQRLCPATRPSNQQQQ

SEQ ID NO: 141781 - protein, 42 aa, Heterodera glycines
  Coding regions on vcDNA: vcDNA=SeqID_68204; Strand=+; Position=1 -51,519-596
MRQQMHTGAVRPWPIWEKIKDNVLNFLANLGSILKQIYKDKS

SEQ ID NO: 141782 - protein, 115 aa, Heterodera glycines
  Coding regions on vcDNA: vcDNA=SeqID_68205; Strand=-; Position=1 -69,276-554
MVAGAVKQMLEENNRQREEAAIEELEQNAGNSGTTKPTAHIRFSIPALFGIPTRHFVASKRAAGGDWQIVPPAAAAASDQQQMIKRGKQQQQKMRVEAGGEQQQKKVAKSSGSMG

SEQ ID NO: 141783 - protein, 234 aa, Heterodera glycines
  Coding regions on vcDNA: vcDNA=SeqID_68206; Strand=-; Position=1 -285,326-453,728-801,852-949
  Homolog annotation: Hit_ID=CAE67057.1; Match level="QueryCoverage =82%, HitCoverage=32%, E-value=4e-58, Identity=61%"; Hit description =Hypothetical protein CBG12465 [Caenorhabditis briggsae]
RRSRNSQPFFAKINKIKCIFLPFLGQFSKIKLGSWARSPLLDGPGYPIFCQYDPPDEPREYIHRVGRTARGDTGTGHALLILRPEELGFLRFLKAAKVTLNEYEFSWNKLAAAKVTLNEYEFSWNKLANIQPQLEEVISRNYYLNKSAREAYKCYIRAYDSHSLKKIYNVNTLDLVQVSKSFGFETPPFVDLPVSNKPKLVSKSFGFETPPFVDLPVSNKPKLKQDKARLMGAG

SEQ ID NO: 141784 - protein, 242 aa, Heterodera glycines
  misc_feature (235)..(235): Xaa can be any naturally occurring amino acid
  Coding regions on vcDNA: vcDNA=SeqID_68207; Strand=+; Position=1 -166,339-480,531-652,707-735,978-1025,1100-1220
  Homolog annotation: Hit_ID=NP_499176.1; Match level="QueryCoverage =97%, HitCoverage=33%, E-value=2e-49, Identity=45%"; Hit description =calnexin (69.2 kD) (cnx-1) [Caenorhabditis elegans] emb|CAA80183.1| Hypothetical protein ZK632.6 [Caenorh
LSSKKYVPPTYQTPIIDQNAFFFLELFEETQSIGKKWLKSESKKEGAEEAISKYNGWQIGSPTDEILANDYGLIVRTKARHHAISARLRKPFKFDGSALVVQYEVKYEQGQECGGGYLKYEVKYEQGQECGGGYLKLLRDDASKDLKQFNDKTPYVIMFGPDKCGMTSKPDKCGMTSKVHLILKHKNPKNGTISEHHAIQPNEHHAIQPNKSLRNYFEDKNNHLYPLETRPTTHXSLSGDHT

SEQ ID NO: 141785 - protein, 250 aa, Heterodera glycines
  Coding regions on vcDNA: vcDNA=SeqID_68208; Strand=-; Position=1 -131,182-355,493-619,703-769,954-1207
  Homolog annotation: Hit_ID=CAE65122.1; Match level="QueryCoverage =99%, HitCoverage=39%, E-value=2e-39, Identity=36%"; Hit description =Hypothetical protein CBG09987 [Caenorhabditis briggsae]
MIKNPNYKGVWSARLIDNPAYFEADPYRQLEPIGAVGIELWTMSEQIVFDNIALANDVDSVRELATQTFDLKHEQEKLFLSSTGDAKSALRSAMDTLEEKPWLWVVVIFAVLVPIILICIFCFNRKARPMHRKKTDEPTEDDEKFEGLDQGEEEEGEEERPTDLRPDEAKNDVHASASQSSSSKKSESPSRSRSPSRRVRKASQPATDDVQQQEADAVEVDDDHEEGPSSSMPKASPQQPVRRSRPRRQD

SEQ ID NO: 141786 - protein, 292 aa, Heterodera glycines
  Coding regions on vcDNA: vcDNA=SeqID_68209; Strand=+; Position=1 -124,240-395,670-804,859-997,1062-1126,1256-1303,1397-1463,2311-2412
  Homolog annotation: Hit_ID=AAV38924.1; Match level="QueryCoverage =93%, HitCoverage=79%, E-value=4e-69, Identity=52%"; Hit description =tumor necrosis factor, alpha-induced protein 1 (endothelial) [Homo sapiens] ref|NP_066960.1| tumor necrosi
CGKKNVPFVQLFPASSFFLTTVARLTKCDSMLKAMFSGRMEVRRDTDGYVLIDRCGKHFGLILNFLREGTLPLPDCRTEVLEILIEAKYYLLQELVDLCYSSLKALHHDQLVSTLGICRVPVVVSKKQVEQIVQSCAGPVIELLMPVIELLMNRQNNKYSYNASSDENFLRNQELFDKLILRFNNRVLFIKIGIGSSEICQWTFYGKTNRKIEICCTSIVYATDKKQTKVEFPEARIVEFPEARIYEEALNVLLTFDQGGMDEDGPSSWSSSTSTASASCCCTSSEAETPYE

SEQ ID NO: 141787 - protein, 95 aa, Heterodera glycines; identical to SEQ ID NO: 124813
  Coding regions on vcDNA: vcDNA=SeqID_68210; Strand=-; Position=1-537

SEQ ID NO: 141788 - protein, 83 aa, Heterodera glycines
  Coding regions on vcDNA: vcDNA=SeqID_68211; Strand=+; Position=1 -220,302-333
MTITIYTVRLTKEIISSICSSAENLQSQSYNQIDLINDSSDILYDHVKNKCRRSLTHSTISASSCRRRTRRDDARKGPGPAQL

SEQ ID NO: 141789 - protein, 247 aa, Heterodera glycines
  Coding regions on vcDNA: vcDNA=SeqID_68212; Strand=+; Position=1 -162,215-325,413-516,787-906,1348-1467,1544-1589
  Homolog annotation: Hit_ID=NP_505989.1; Match level="QueryCoverage =89%, HitCoverage=26%, E-value=1e-48, Identity=49%"; Hit description =prestin family member (84.4 kD) (5M359) [Caenorhabditis elegans] emb|CAB04606.1| Hypothetical protein K12
KTIYYKMIFSINLKKYFFSFVPILNWLPAYQWRQCLLADAIGGLTVGIMHVPQGIAYALLARLHPVIAYALLARLHPVVGLYTSFFPPLFYMLFGTSRHNSIGSFAVVSSFAVVSLMAGMAVEQFSSNDTFFSGGDEDKVKNKLSDASSPVRVASTLAFTVGLLQLLMGLLRLELITTYFSDQVVAGFTTGASMHVFVAQLSDLFGLRSVGLPHRNGAGYLFMKLYDTASNIKLYDTASNIHRANAI

SEQ ID NO: 141790 - protein, 433 aa, Heterodera glycines
  misc_feature (237)..(237): Xaa can be any naturally occurring amino acid
  misc_feature (242)..(242): Xaa can be any naturally occurring amino acid
  misc_feature (411)..(411): Xaa can be any naturally occurring amino acid
  Coding regions on vcDNA: vcDNA=SeqID_68213; Strand=+; Position=1 -166,418-531,646-723,938-1033,1090-1180,1267-1352,1437-1511,1674 -1717,2114-2216,2553-2651,2752-2806,2865-3066
  Homolog annotation: Hit_ID=NP_505989.1; Match level="QueryCoverage =93%, HitCoverage=49%, E-value=2e-99, Identity=47%"; Hit description =prestin family member (84.4 kD) (5M359) [Caenorhabditis elegans] emb|CAB04606.1| Hypothetical protein K12
SDFHLSLPTPILPNLSLVPSLLPDALGISAVVIAVHISLAKMFAKKMAYRVDAGQELYALGFCASLSSFFPVYPVSCSLGRTLVNVEAGTKTQFSTLFSSLLLGAIILYIGQWLRTLPMCVLSAVIIVALKGMFKKITDLKTLWPLSKIDFAIWLVSFCATVCWDVTEGLAVAIWLVSFCATVCWDVTEGLAVSIIFALMTTVFFRTQWPRWHFLANLSGTNDFRDSERYQTLIHFXLIHFXGICIFRFDSPLLFTNVDNFKESIHKAFHRWNNGRRIHCPLRHRRQLLCTARATTPKGKNGRTTTTAQFRFSEKASSIFFRHFIIDCSGFTFVDCMGVNALKEIFTEMREQRVLVYFAAAKAPVRDLFEKCPVRDLFEKCGFFRYVQKHNFYPTIRDAVAIARKRQINKXLKCEIMVKEGEGSLKIMKHSTN

SEQ ID NO: 141791 - protein, 65 aa, Heterodera glycines
  Coding regions on vcDNA: vcDNA=SeqID_68214; Strand=-; Position=1-196
MPRGSPRPPVRAASQQQQQQTPYAKAPDGTESSATVTLLTRPERLLQQEMNRLKRQNSDPSPALK

SEQ ID NO: 141792 - protein, 105 aa, Heterodera glycines
  Coding regions on vcDNA: vcDNA=SeqID_68215; Strand=+; Position=1 -299,891-909
MYADPAGSRTKIKFADPVAGLELIFCRTGSGRINPAFSKKCRIADLGSCLQNPAQDPVLLRALVLMLYIFFLNNTKCSNSKILTQKETFYDDFFFQHFFPFYRKL

SEQ ID NO: 141793 - protein, 147 aa, Heterodera glycines
  Coding regions on vcDNA: vcDNA=SeqID_68216; Strand=+; Position=1 -137,225-453,512-589
  Homolog annotation: Hit_ID=CAC83611.1; Match level="QueryCoverage =83%, HitCoverage=29%, E-value=2e-18, Identity=42%"; Hit description =EXPB1 protein [Globodera rostochiensis]
MSAAASGSLFNSSASWVASCMSDGRYLLNDPICMNKCVKIEYNGKRLIGRIERYRIILLIYFRNFKKFIDIYRILWPLPDLVTFFSFLSLTVPINNQCPECEVNHVDLSTEAFLWLEPAGGTVPPLHIWNVPKEIGLEEEMHRRWNR

SEQ ID NO: 141794 - protein, 118 aa, Heterodera glycines
  Coding regions on vcDNA: vcDNA=SeqID_68217; Strand=-; Position=1 -110,746-990
AISDLINDKSTEKSPNYHAENEHLTKDKEAISQEIRRIDSQIMVYKRASLSLNEACELQVDSDKLELSNPLYSGAFIHFISEGAAFCTKIKMGKSVNYPDLNANKGYNFFEELIEVPR

SEQ ID NO: 141795 - protein, 40 aa, Heterodera glycines
  Coding regions on vcDNA: vcDNA=SeqID_68218; Strand=-; Position=1 -96,701-727
MCCAPPIGLLEKRHTLYHEQSSKFGGMNPSVKKKLVLNIN

SEQ ID NO: 141796 - protein, 85 aa, Heterodera glycines
  Coding regions on vcDNA: vcDNA=SeqID_68219; Strand=-; Position=1-256
MPPKRKNIYLESYEKEFRHIKKSRKGEEFALCVVCNDDINLLSIGKAAISHHQKTGKHQKAAKAANRSIPLQEFLPNTSAPSTED

SEQ ID NO: 141797 - protein, 99 aa, Heterodera glycines
  Coding regions on vcDNA: vcDNA=SeqID_68220; Strand=-; Position=1 -256,498-541
MKYNRNCPHGILFLMVFCAFFTVISATIAKEHGDKVGTVNYIRLQTHHYVTHPNNGNSLSPSYTGWGYETPKDKEARLKNYRKLMGSLTTNLKPILTIA

SEQ ID NO: 141798 - protein, 262 aa, Heterodera glycines
  Coding regions on vcDNA: vcDNA=SeqID_68221; Strand=-; Position=1 -268,630-1128,1348-1369
MKFNKTFNIFGIISMAFSTIFTRTNAGNIISDIMKKADSGNEEENANASTVPPKLTSSNPSASSSYVTGWEYETKKDKAARQKYYKKLLEGKPIMEMPKLTKPYKMLSLPSPCKMPPIPKLSKIPSMPDLCNSMAHKMLCKQTHSNLNEEYDTDNDSTKVELSHKSDESESDSENDLSIKTWMENEGGNGGKSKGMWTENANGDGTSGEIEVDDGSIFGGIPSASSSHIDLINRSAQIEQRRLMRRLSKKEHNFSFKIEEID

SEQ ID NO: 141799 - protein, 61 aa, Heterodera glycines
  Coding regions on vcDNA: vcDNA=SeqID_68222; Strand=+; Position=1-183
MTNIWRNLGRNHKTVNASILAQFYSSGWVDVLATDIRLVFSMGMLHSGEHPSCACSAAQRT

SEQ ID NO: 141800 - protein, 80 aa, Heterodera glycines; identical to SEQ ID NO: 130323
  Coding regions on vcDNA: vcDNA=SeqID_68223; Strand=-; Position=1 -270,323-674

SEQ ID NO: 141801 - protein, 51 aa, Heterodera glycines
  Coding regions on vcDNA: vcDNA=SeqID_68224; Strand=-; Position=1 -36,160-279
MKRHIKQSTKIEQLADLSFGFFHKRTNWIQLQQKIRDHTDAFIKKLVKRGA

SEQ ID NO: 141802 - protein, 95 aa, Heterodera glycines; identical to SEQ ID NO: 124528
  Coding regions on vcDNA: vcDNA=SeqID_68225; Strand=+; Position=1-816

SEQ ID NO: 141803 - protein, 209 aa, Heterodera glycines
  Coding regions on vcDNA: vcDNA=SeqID_68226; Strand=-; Position=1 -84,226-770
MSYFAATISSIIISYSLLLPISSGNPLPQNEDKAFIEFVKGETFFDEIYETYKKEKELVNFYPKPLTNFHNFDLKKHLIQKYQAHLGFLFALRNHWKCEKIGKEFDQNEQKECHRFRQYVDILYEYLFQTAQKKTVVKPEFLVNEKAESLIGVLKALNQISTFYFDDEFNAKFGKNLAKFFKMDPCEPKLQNEKELDDLKKAIEDKRHE

SEQ ID NO: 141804 - protein, 193 aa, Heterodera glycines
  Coding regions on vcDNA: vcDNA=SeqID_68227; Strand=-; Position=1-582
MQCISSTVLNLEDDSSGPIDSSSPTNVADCATLSNTAGDQSDQQQQQQIQPNDVENDATALAAEQLQIHAQQFEAVQALKREANERVQQLELELTTVRQSVHKFVASIIGRPIPAPFNQILLSSTTKADDGIACADVDDLDSVERLIEELLHNYGTLTEVRAELERQVEQLNEQIERAEADHAVKEHKVGAKN

SEQ ID NO: 141805 - protein, 38 aa, Heterodera glycines
  Coding regions on vcDNA: vcDNA=SeqID_68228; Strand=+; Position=1-115
AVAMFQQTVCTAPSTRANSGAYSLAFLFAQFRENALGL

SEQ ID NO: 141806 - protein, 116 aa, Heterodera glycines; identical to SEQ ID NO: 127487
  Coding regions on vcDNA: vcDNA=SeqID_68229; Strand=+; Position=1-351

SEQ ID NO: 141807 - protein, 130 aa, Heterodera glycines
  Coding regions on vcDNA: vcDNA=SeqID_68230; Strand=+; Position=1 -38,296-395,434-688
  Homolog annotation: Hit_ID=CAE68266.1; Match level="QueryCoverage =90%, HitCoverage=95%, E-value=3e-30, Identity=52%"; Hit description =Hypothetical protein CBG13943 [Caenorhabditis briggsae]
MGCNDMKVDNYEDPTCGTILTLSDGKDYCKQFSCGSCSYTLPISKKLTSRIYSKKKEDEKIIGGTEMWENAQVTNGLLGSKLRKCAFVCSERCPSCSHDKAYFQQIQTRSADEPMTIFYRCANCGHRWKE

SEQ ID NO: 141808 - protein, 148 aa, Heterodera glycines
  Coding regions on vcDNA: vcDNA=SeqID_68231; Strand=+; Position=1 -198,326-459,566-680
MSLSSIHHMSRLKLWMTPVRDNHFGLDDLKIFNSDGYSENAPFSRESSRNSSADGSIACNADAADAPQKTCGFCYIQYKRHCQRLGVAFPRVTDKGFWVGHTTKDEHGDVICPELRKLKCPLCYASGKKAHTLKFCPLNSIKGRRDEA

SEQ ID NO: 141809 - protein, 181 aa, Heterodera glycines
  Coding regions on vcDNA: vcDNA=SeqID_68232; Strand=+; Position=1 -32,236-432,1471-1776,2550-2560
MTHQIMTYSKRHRIKFSDPEPLFRILYTEILMGRIEITDLLTVDYWIKQTIFDFVQRNCANPTVEKKICNDLNGVLHDYAFPTKPVILMWTSVFGQNSLKLGPDCPFFDQCFFTYQRRALAHADAVLYHVPDIKWTSDERPDFPEQMLLPANVRNVFLTQENPSALRDYHHAEKLRKAGIM

SEQ ID NO: 141810 - protein, 41 aa, Heterodera glycines; identical to SEQ ID NO: 133620
  Coding regions on vcDNA: vcDNA=SeqID_68233; Strand=+; Position=1-386

SEQ ID NO: 141811 - protein, 38 aa, Heterodera glycines; identical to SEQ ID NO: 131546
  Coding regions on vcDNA: vcDNA=SeqID_68234; Strand=-; Position=1-361

SEQ ID NO: 141812 - protein, 167 aa, Heterodera glycines
  Coding regions on vcDNA: vcDNA=SeqID_68235; Strand=+; Position=1-501
MGKVEKLLKGRDGLVRTARVHTKGKTLVRAINLLYPLEINTSAEDEVSQIQVTAIMDSPSAVMEGGDPQTVTTESSLPPGTVMQDSQIVTTESSLSPIRGRNERQAVKERRIRKRQPTEEVRGKGKPKKNGPYDPLRPGNYRIPRRNPFFPSQVAYNEQTRTYRRRR

SEQ ID NO: 141813 - protein, 152 aa, Heterodera glycines
  Coding regions on vcDNA: vcDNA=SeqID_68236; Strand=-; Position=1 -26,72-260,337-447,581-713
MASAMTFTETKTAASPASASKGSNNKPKQQKNSASASMTSVMKRTQLASKYFGNYLVVFQDHNRSISSAGIWTKTAASPASASKGSNNKPKQQKNSASASMTSVMKRTQTKTAASPASASKGSNNKPKQQKNSASASASMTSVMTLTQLAIK

SEQ ID NO: 141814 - protein, 250 aa, Heterodera glycines
  Coding regions on vcDNA: vcDNA=SeqID_68237; Strand=-; Position=1-760
  Homolog annotation: Hit_ID=S08405; Match level="QueryCoverage=99%, HitCoverage=21%, E-value=2e-39, Identity=32%"; Hit description =hypothetical protein 2 - silkworm transposon mag
VADALSRVAIKWEQIEGKSREDIPFVLTVDEEIGLHRKTIEKETFEDSILSRVLSQIKASWVEPIDDDELMPYFRERDKLYLDGKIIRMGRQIIIPQKMRKRVLKMIHRAHFGIVRCKARTRDLVWWPNWSEEVENYVKECHICQRNASNEPRVDPEYKWPEAKYPFERVHADLAGPIWGTNFLIIVDAYSKYPFVCQMNSTHSPAIVNYLREVFAFFGSPQCLVTDNGPQFVSSETEQFENEGVRHLKP

SEQ ID NO: 141815 - protein, 134 aa, Heterodera glycines
  Coding regions on vcDNA: vcDNA=SeqID_68238; Strand=-; Position=1 -243,412-571
MFEQSARSIGARLITELTQRGRGFALSHGSNSAKMEDEEQLDINMDNEDDDDDVEEEEEAQNGVQYDGQQQSDDEEDGGSTGPEKFFGLSYRGQTDRSKQRKKQKSGKKGTFGCSLQAGHFRAMRRHAQQQTTN

SEQ ID NO: 141816 - protein, 101 aa, Heterodera glycines
  Coding regions on vcDNA: vcDNA=SeqID_68239; Strand=-; Position=1-305
NLLSDFPTTTAGANQWSSPQSVPPQQQQTHSPTTRTTHPQATTSSLSSSSSSSSSELSQENDFTEAMTDEEFQLMLAFKESLTNVEDGDLHLLSGLSSEKR

SEQ ID NO: 141817 - protein, 165 aa, Heterodera glycines
  Coding regions on vcDNA: vcDNA=SeqID_68240; Strand=+; Position=1 -215,352-634
  Homolog annotation: Hit_ID=AAL78214.1; Match level="QueryCoverage =73%, HitCoverage=62%, E-value=1e-11, Identity=29%"; Hit description =putative esophageal gland cell protein Hgg-20 [Heterodera glycines]
MAFVSRRFDALVDEHFKTRKWTLGFLKIECRKIGDNGTTEMEIVNLQQQKKMPMPQKPLPNKIIAFRMIILDCFDQNVIDFLQNFRQIFASGTNLCIGYYDIKDDIVEFVVRNIWPMLKDNIRGIHYHIENKQSHQLQQFVTSILNECQTLRFLFLSALSLFFDR

SEQ ID NO: 141818 - protein, 95 aa, Heterodera glycines; identical to SEQ ID NO: 124528
  Coding regions on vcDNA: vcDNA=SeqID_68241; Strand=+; Position=1-816

SEQ ID NO: 141819 - protein, 528 aa, Heterodera glycines
  Coding regions on vcDNA: vcDNA=SeqID_68242; Strand=+; Position=1 -201,262-369,426-556,729-846,928-1044,1177-1499,1563-1616,1669 -1769,1823-2044
  Homolog annotation: Hit_ID=NP_493307.1; Match level="QueryCoverage =96%, HitCoverage=18%, E-value=8e-62, Identity=31%"; Hit description =cdc42 guanine nucleotide exchange factor zizimin 1 (1N773) [Caenorhabditis elegans] emb|CAB07369.1| Hypot
CFSEAAVCQSHSLAIVGRLLQKKGLLTPMDWSVLDVLNEQIAAVETVDNVTENSTVDTFPNHANFGIRFKELTQNLMRFKELTQNLMLAKRYEAIGPICRLIIPLFERNADFKSLIAIHSQIQQAYQCVSLIAIHSQIQQAYQCVDQITTNGRQQLASYFRVSFHGRAQFGDDHGSEWIYRERPLTSLAEACDRLRESVQSSLANCRVQLSVSSLLPLSVSSLLPLPVDDPSVAYIGVAHVEPCKTVRTTHSSEKANNYWLHTNVRTFVLNERQADSTVSDNAPELARMTLRRTTLTGVPQVVGGSFAVENPFPGTRRRQRVVHMEQTVLSPLELACESILQKADQIRHILSSAGLRRRVDVKQLQLFLQGAVMRVDVKQLQLFLQGAVMPTVNAGLLAYAETFTAPAQQKRVNAGLLAYAETFTAPAQQKRYGNKGLLRLWNALKTLLDELDEATLLDELDEAMRVNEATMGNERREYQQMLRNAYENTVEKLNGIRTRQRVAGDGQTAEYEHRQGEAEQQAGHADQ

SEQ ID NO: 141820 - protein, 43 aa, Heterodera glycines
  Coding regions on vcDNA: vcDNA=SeqID_68243; Strand=+; Position=1 -63,778-846
MNYRIPQLGTPGYHLLKNIEVRNSEGNETEPIIPFNRFFDCSN

SEQ ID NO: 141821 - protein, 155 aa, Heterodera glycines
  Coding regions on vcDNA: vcDNA=SeqID_68244; Strand=-; Position=1-468
MSENYLKMVAIGQIRIQKPWAKFESKSHGPNSNPKAMGQIRIQKPWAKFESKSHGPNSNPKAMGQIRIQKPWAKFESKSHGPNSNPKAMGQIRIQKPWAKFESKSHGPNSNQKAMGQIRIQKPWAKFESKSHGPNSNPKAMGQIRIQKLCKSIAI

SEQ ID NO: 141822 - protein, 172 aa, Heterodera glycines
  Coding regions on vcDNA: vcDNA=SeqID_68245; Strand=-; Position=1 -132,438-824
MNSNGRFKMFVGGERPIRAMLGSHGGMGEFDTPISGNPENLYIWSGKIQRFVIKNPNFFKNYALDFRDGEVIEYDRVNAVLEKLQQKSLYFNVKDMLEKQIETNFKKLKNNLFDEMDEIIDEKFSKFSNGLRKSEQNLRKLKSYVIDEIREKLAHEISIFKRKKWTFRLADG

SEQ ID NO: 141823 - protein, 75 aa, Heterodera glycines
  Coding regions on vcDNA: vcDNA=SeqID_68246; Strand=-; Position=1 -66,572-735
SSEPSLADYDDSHKKEILQIEVLETGVVQGKRLFGSFVSTLMGQVNKAVFAEPSKKAADEYQASTSSSNKKNLTN

SEQ ID NO: 141824 - protein, 51 aa, Heterodera glycines
  Coding regions on vcDNA: vcDNA=SeqID_68247; Strand=+; Position=1 -67,112-198
MEVDEAEYEAKKREHRSFVENDGSHYYDEEDDSEDEFEEEERSTKLKKSKK

SEQ ID NO: 141825 - protein, 41 aa, Heterodera glycines
  Coding regions on vcDNA: vcDNA=SeqID_68248; Strand=-; Position=1-123
MELQREYGQNAFDIAKVDAESLPEVSMAQKVCAVPSVIIFK

SEQ ID NO: 141826 - protein, 169 aa, Heterodera glycines
  Coding regions on vcDNA: vcDNA=SeqID_68249; Strand=-; Position=1 -110,193-405,1288-1474
MTDQMVEFGHLKPTKEMANGQQNECPATLNLTDFTRSAPLCKIWLIGLQLNDAIKNINEENEEKINEKLSKELDAKIYKEYESEVLKGLFQHVRLKSTFVTSEQLAQCLYYRPYLLDNITSIDPLIFLSGKLHLLCPKAKMLTLKSLPDLSSFKINKQMYKDKIESYKT

SEQ ID NO: 141827 - protein, 461 aa, Heterodera glycines
  Coding regions on vcDNA: vcDNA=SeqID_68250; Strand=-; Position=1 -499,662-795,1302-1391,1486-1710,1902-2339
MLNIGAFINEIQHRIETIEKISKSNGMENSQRKIGGEKENLKKLMEKHKNENGGIGTLEIKQKLCGILKRIATEKDTNCGDESTVGDGGRSTVEKEIKLVQMQLHKNKMAKTIIGEGENGTDIWPKMTKSDILNDLFETKQTKANSMDRFNEHIENWRNLLRQQNLDKKLSERFSGRSETERENLENLCEMHENLQQIYFQGREYKTKDEMLHQILEENGYGRKETPKDLMEGIKRTISKWSNGDARLIVTGSHLLDTQTPGSDIDTICIMPQKLSYLEEKNKFFGNYIFNCHHLNDGNLEERKCGDDSLFCQFCKNPKLDEITKISSAYIQMLQLKMSGVKFDISLVLIPGMEYLPDEPLDGDDIEWMMEVLANQQRPQRAMLRTLSSRTRDFEKRLDLDMDSMVDLDLDFMDKNPGKIQAPRDLDPGLDLEFLKLILKIKNKCLKKSINCLGTSKNINL

SEQ ID NO: 141828 - protein, 107 aa, Heterodera glycines
  Coding regions on vcDNA: vcDNA=SeqID_68251; Strand=-; Position=1 -24,480-779
MALFGKKKPLLAIYETQQHGNNMCQFRPKFLIIIYALLALLSNFGIVWPFEVIVEDGTEPETADMEKTLALSKTHFLRHMVEDWHCESGQMKTPKELGYEKMPERFG

SEQ ID NO: 141829 - protein, 33 aa, Heterodera glycines
  Coding regions on vcDNA: vcDNA=SeqID_68252; Strand=+; Position=1-104
SVWGTQTIMGAKIQRRIKVQAIGKLFPKDSVSP

SEQ ID NO: 141830 - protein, 95 aa, Heterodera glycines
  Coding regions on vcDNA: vcDNA=SeqID_68253; Strand=-; Position=1-652
LFEYPKRTLEKIDFFVFGAVPPNRCAQIYGETESFGNSFPIACTLILRWIFAPHNCLSTPNGHLKKSIFLFSGQSPRSDAPRFMGRPNPSGIASL

SEQ ID NO: 141831 - protein, 68 aa, Heterodera glycines
  Coding regions on vcDNA: vcDNA=SeqID_68254; Strand=-; Position=1 -94,185-297
MHTFCARAIYHRACQSKAKQQRCCFERIKGIESVHRLLEKYICNLSTILRSELEMINFTIQTNFRCSN

SEQ ID NO: 141832 - protein, 49 aa, Heterodera glycines
  Coding regions on vcDNA: vcDNA=SeqID_68255; Strand=-; Position=1 -57,104-195
NFKENKKRKLMATTSGEGACQECPCSAYREDGIADENDRCWYCWCGHLL

SEQ ID NO: 141833 - protein, 138 aa, Heterodera glycines
  Coding regions on vcDNA: vcDNA=SeqID_68256; Strand=-; Position=1 -37,271-647
MNANLKQQNHLVVDGRRKKVRKRQRAKEEANCEVTVHFSPENAKKEQNRLVTAFGIEGTSRIEEHLKELTIENFAYEKVCKRQKEERESGNDENEEQIAMKETKMAKKESEEKGKKELKQKGKKTPKEEEDEDKTKKE

SEQ ID NO: 141834 - protein, 54 aa, Heterodera glycines
  Coding regions on vcDNA: vcDNA=SeqID_68257; Strand=-; Position=1 -53,199-310
MRQKLQATIMRINHLNDMIQHDRMKEKRKTGLSFLGLVVGVEGIGQNMQMKRIK

SEQ ID NO: 141835 - protein, 1154 aa, Heterodera glycines
  misc_feature (673)..(673): Xaa can be any naturally occurring amino acid
  Coding regions on vcDNA: vcDNA=SeqID_68258; Strand=+; Position=1 -732,790-3500,3878-3895
  Homolog annotation: Hit_ID=NP_491240.1; Match level="QueryCoverage =100%, HitCoverage=87%, E-value=0.0, Identity=38%"; Hit description =zn-finger, CCHC type and RNA-directed DNA polymerase  and Integrase, catalytic domain containing protein f
LKKEQFYALMLLTALKSPSDAALRQRILAKLERMDKTCRMMELWKTSSTSNQRLRRLERSKRRSALEMLMLSTKRASKTSCRRTNSPKVDKPQRRTKVVGDAENVTISHSTRFKLTKCHKCGTTGHLGKKCESVPWRKEKSAKMLGNKKIGHLRIGMTSCSINALSLMQIKILLNQQIVKFYLDTGSDIDVIDELTYADIGEPPIEPCNEIGKTFDGKEVPFIGKGIGIFKFGEIKVKRPFFLLDEMKQLLDEMKQKISNVAVNLCKAGRPKGEKIIPSGTKQMAGTEAKIEALKRAFPEVVKDGLGLCTKEKAHLSLKKDATPIFRKARPVPYNSLEVVEKELGRLEKMDVISKVDHLNWAAPILIVKKADGSARLCIDYSTGLNDALLDCQHPLPVPEDIFATLKGKIFSQIDLRDAYLQIELDEESKDLCGLATHKGNYRMERLPFGVKSAPSIFQSIMDKMLAGLNFAATAYLDDIIVVSGTTEQHVRHLEEVFSRIQTYGFRVKLEKSTFFRDQIKYLGQIIDRNGRRPDRKIHAIVQMPSPKDISSLRSFLGMVNHYQQFVKDMRFTRKPLDDMLKDEIEWKWTEKRQKAFQKLKEVLTSKLLLTHYDPKLDIIVAADASELGIGAVISHKFLNGQSKAIAHASRSLTPAEKNYSQIEKEGLVHGFXVQKFHKMIYGRHFTLQTDHKPLISIFGSKKGIRQCSANRLLRWSLTLLAYDFDIEYVNTNEFGQADALSRLIAKEFECDDERVIAACNIDEDLGTVLDMAKQILPIKFENLVSESKKDKTMQIVMKFVRDGWPDERKLTPQSEEIELFGRRKADLTILKDCLMYGERIVIPKKFRTKILTLLHKGHPGIKRMKQLARQYVFWPKLDQQIEEFVKNCDCQLAAKAPTKTDLHSWPKSTRPWQRIHADYAGPFFGKEFLIVVDSYSKYPEVFEMATKSAAATIERLRYLFTRHGIPETLVTDNGTQFAASEFAKFTEANGIAHLFSAPYNPMSNGQAERFVDTFKRAFRKIKGEGVPNKEIINTFLVTYRTTPNDSLPDAKTPAEMLLGRKPRTTIDLLMPPLPQPTERDTKMEHHFNRRFGARPQKFVSNKPVWARHRLSQNWRAGTIECSGVIYTVKFPDGSTNRFHANQLRNRENTSSLP

SEQ ID NO: 141836 - protein, 102 aa, Heterodera glycines
  Coding regions on vcDNA: vcDNA=SeqID_68259; Strand=+; Position=1 -124,187-371
FRQQTAAPAPGSTQNGTTSAGPPRVRRAEVESVVQLHNANAVVAHAADLQHTQMDHPLSSTFDVFVHNSVRRRWTGGGRRSGRGSFGVLKRQSVFVVRHLLV

SEQ ID NO: 141837 - protein, 25 aa, Heterodera glycines
  Coding regions on vcDNA: vcDNA=SeqID_68260; Strand=+; Position=1-84
ILKSVPPLSCCLPVFVDSLDIFKSD

SEQ ID NO: 141838 - protein, 153 aa, Heterodera glycines
  misc_feature (28)..(28): Xaa can be any naturally occurring amino acid
  misc_feature (61)..(61): Xaa can be any naturally occurring amino acid
  Coding regions on vcDNA: vcDNA=SeqID_68261; Strand=+; Position=1 -20,177-624
  Homolog annotation: Hit_ID=NP_671477.1; Match level="QueryCoverage =92%, HitCoverage=48%, E-value=6e-29, Identity=55%"; Hit description =rRNA promoter binding protein [Rattus norvegicus] gb|AAK21974.1| rRNA promoter binding protein [Rattus no
DSRISPIHATARLTRPLEPILFPKLRIXFADFPYLHYSRLEAVHLGDLLRISVRSGRRFKXLPSHFQGPCGAHETPQEPRCFTGATSLSQAEPLPGTHTLNEKRTLARTPHDVCEFICVTAQNSSCEPSFLAWRGNEPTSLSATGWTNCASTE

SEQ ID NO: 141839 - protein, 200 aa, Heterodera glycines
  misc_feature (44)..(44): Xaa can be any naturally occurring amino acid
  misc_feature (49)..(49): Xaa can be any naturally occurring amino acid
  Coding regions on vcDNA: vcDNA=SeqID_68262; Strand=+; Position=1-1356
MQTRYASSVRFHLIGFTSSLTLSSKCFATFPHGTCSLSDSWPYXVLDEXYHLIWAAIPNNPTPRHVKMDRHRQLDRSCTFSGAPVKGNLNKRANPSSRSIRYTSQPRGAAIQRWTIPSSLAVTTGILVSCFPPLTDMLKFSGCSRLSSGRKIKAGMPVIQALRHSMQSIGAPELRSVKRELEPQVRASTPKHHSRAEQVT

SEQ ID NO: 141840 - protein, 92 aa, Heterodera glycines; identical to SEQ ID NO: 125147
  Coding regions on vcDNA: vcDNA=SeqID_68263; Strand=+; Position=1-304

SEQ ID NO: 141841 - protein, 97 aa, Heterodera glycines
  Coding regions on vcDNA: vcDNA=SeqID_68264; Strand=+; Position=1-304
MIGRAVRNRHFIFEGIFKFILYPRKMSISFFEKFYTSQKRLRMRRRAVHNRHFISQRIFIFRGYPRKMAISFFDKFYTHTNALEHDREGGAQLTFYF

SEQ ID NO: 141842 - protein, 104 aa, Heterodera glycines
  Coding regions on vcDNA: vcDNA=SeqID_68265; Strand=+; Position=1 -86,337-558,799-805
  Homolog annotation: Hit_ID=NP_501164.1; Match level="QueryCoverage =93%, HitCoverage=19%, E-value=9e-09, Identity=33%"; Hit description =somatostatin receptor family member (4I71) [Caenorhabditis elegans] gb|AAA81482.1| Hypothetical protein F
MFVTACLTNVVRSVLRVVGFHMICWGPFWVFVLIPIIEYFQLSQLPRALDSEFSRNIRMVSRREFFKMNFQKPFNTFLIYSFLPYLNSAGNWIFYAAMNREMRI

SEQ ID NO: 141843 - protein, 31 aa, Heterodera glycines
  Coding regions on vcDNA: vcDNA=SeqID_68266; Strand=+; Position=1 -6,823-912
MKTISVQLYQKRIESKRYIDKGMWSQTTHHS

SEQ ID NO: 141844 - protein, 63 aa, Heterodera glycines
  Coding regions on vcDNA: vcDNA=SeqID_68267; Strand=-; Position=1 -63,275-403
MFNFWRFGKIKRNFWKMWVMEIYSIDAQERVDDGKMHLMEVNREGNLIKLKVDDGKCKNNKSI

SEQ ID NO: 141845 - protein, 156 aa, Heterodera glycines
  Coding regions on vcDNA: vcDNA=SeqID_68268; Strand=+; Position=1-471
MKLCILFFSIALFLIALIEIGAEKKKFEQKTFDEIFGEKWEEKENEQKKKEIIHKFYKIKEKIKQKGRKYSTKEWNKIEQKIAKKLGTNRTKIYKWIKELNLPEIKSYKSKTDEQKIEIVQKFMAMKNEYKQNGRKYSRKEWKRNYAEICHKLGVG

SEQ ID NO: 141846 - protein, 24 aa, Heterodera glycines
  Coding regions on vcDNA: vcDNA=SeqID_68269; Strand=-; Position=1-72
MPKFWFPSTILEINTVKISKHKSQ

SEQ ID NO: 141847 - protein, 76 aa, Heterodera glycines
  Coding regions on vcDNA: vcDNA=SeqID_68270; Strand=-; Position=1 -93,142-279
MRRGLQKFVLFALASYMLIQLWGCYINIADKRFFSAGASFFAFDQSHIYSMLHWHCSSNGCTNGQCRFKIHWAICN

SEQ ID NO: 141848 - protein, 231 aa, Heterodera glycines
  Coding regions on vcDNA: vcDNA=SeqID_68271; Strand=-; Position=1 -302,353-427,571-886
MGSSGGGSGRRRSTAGSGGVHRSIASLLFKPLIGAKSSPRGNDHHESEVAAGVASGGITMAWCFHPHHGTGVVHLCALSSAFVPEFQLGLAPGQLSTRPIEFVNESPSSASAGRVTAQRNLQHNTKFIKRADYPENQARQRHRTESAATAAMQSANRRTHLNPVNNGPKYLTTEQGRQRRVSSSLMDTVIEMHKCAPPSNAFGGGPINIHCGKRSISILIAWFIDRVDQCA

SEQ ID NO: 141849 - protein, 462 aa, Heterodera glycines
  Coding regions on vcDNA: vcDNA=SeqID_68272; Strand=-; Position=1 -180,472-730,785-856,1059-1231,1404-1610,1715-2210
MPLFYLPCHSAPDLEAVIRWACFIKVGRPLPLPDDVPDALRQIFDGCWQWKKDERPSIVEKLATETQQKEAPAEVVLEQMQQQQQQQKMFSISEQKVQLYLERVYKKSYKKPTKMERILAAWFQPPDPKRQKRTAKLEKRSIGTPSGFRHIVSAQVERADNSGDQPTVKLYANAELAPLQRQQSHRSHDSLLECGRERGGDRGGKNGAPAVGYATLPRTFRVQQPQQKSPLSHNLLPPALPPKSSCCRAHPCCAKKLGGLVKTKTAKSNPELNILGTKSGGGKVFPMGMSGAQNAGGKQQKIRHRSPQPISRPHDYLSLLPSSCPSGHQQQMNACQKLKRPTPPITTYSSVGPERDCPLRKDRAEPNWTETDEAICDDSDLIGIMQRQYVNLPHSTQKAARRTNAVRQRMVADATESSDCSSDVTTPNGAIMEELASLATEGDGAAMARENGSEKSTSSSRT

SEQ ID NO: 141850 - protein, 142 aa, Heterodera glycines
  Coding regions on vcDNA: vcDNA=SeqID_68273; Strand=+; Position=1-425
SSCPSGHQQQMNACQKLKRPTPPITTYSSVGPERDCPLRKDRAEPNWTETDEAICDDSDLIGIMQRQYVNLPHSTQKAARRTNAVRQRMVADATESSDCSSDVTTPNGAIMEELASLATEGDGAAMARENGSEKSTSSSRTG

SEQ ID NO: 141851 - protein, 81 aa, Heterodera glycines
  Coding regions on vcDNA: vcDNA=SeqID_68274; Strand=+; Position=1 -42,351-554
MKLSGIRLEYICYNKSLEIDILKNAWTWIPCWTWTWISWTKIQENPGPGKIQAPRDLDPGLDLDFLKFILKIKKMLKKLFI

SEQ ID NO: 141852 - protein, 121 aa, Heterodera glycines
  Coding regions on vcDNA: vcDNA=SeqID_68275; Strand=-; Position=1-365
  Homolog annotation: Hit_ID=AAG51656.1; Match level="QueryCoverage =81%, HitCoverage=12%, E-value=9e-12, Identity=40%"; Hit description =hypothetical protein; 92104-88279 [Arabidopsis thaliana] pir||E96636 hypothetical protein T7P1.21 [importe
IVRSPAKTPPPPPVAAASTFTTFTPPTPPPFPTPFHKHFSFLTPSPPPPATVDLDQIPLPPTPPATFSLDFWLPPAPPPPPAATVHLDMNPTSSSKAAAADEIEREKKRKKRLGNRWSSTQ

SEQ ID NO: 141853 - protein, 49 aa, Heterodera glycines
  Coding regions on vcDNA: vcDNA=SeqID_68276; Strand=+; Position=1 -38,524-620,969-983
MHIGMHQIARCLALAAEEARKEQQRQAQEGLIGRKTTLGGAVREKSCHH

SEQ ID NO: 141854 - protein, 28 aa, Heterodera glycines
  Coding regions on vcDNA: vcDNA=SeqID_68277; Strand=-; Position=1-86
VCSAGDGLVSGTLWDYVRMVGIDSNKCL

SEQ ID NO: 141855 - protein, 64 aa, Heterodera glycines
  Coding regions on vcDNA: vcDNA=SeqID_68278; Strand=-; Position=1-192
MLESDTLAQNQSASVSPGWNDPPPLANPATTTAAAHAGLTNGVANGAGRLHLQRQRRPVDPSVQ

SEQ ID NO: 141856 - protein, 57 aa, Heterodera glycines
  Coding regions on vcDNA: vcDNA=SeqID_68279; Strand=-; Position=1 -94,1255-1334
MPWPPSPFWCAIVAAAYAPVDVYLLAAAATFGIKDLSQLAWISWTKAQENPRKMALT

SEQ ID NO: 141857 - protein, 27 aa, Heterodera glycines
  Coding regions on vcDNA: vcDNA=SeqID_68280; Strand=-; Position=1-81
MHRIIAAVKKLVVGSVLAVRCTLCVLL

SEQ ID NO: 141858 - protein, 127 aa, Heterodera glycines
  Coding regions on vcDNA: vcDNA=SeqID_68281; Strand=+; Position=1 -61,115-374,575-634
MTGLIRDRSRYFSSLPPRVESPFSGVEPLSSVTRHHHGSQIHYHRKLIRQTLERHVAGTRPCDQLSCSESTLDARRALGFVAKKCAPLWGDWSFGACISSRITTVIQQKQLRSAQECAWAAKATEQV

SEQ ID NO: 141859 - protein, 38 aa, Heterodera glycines
  Coding regions on vcDNA: vcDNA=SeqID_68282; Strand=-; Position=1-116
CTSSNHSCTSSNHFVPLLITVVPLLITVVPLLITVVPL

SEQ ID NO: 141860 - protein, 256 aa, Heterodera glycines
  Coding regions on vcDNA: vcDNA=SeqID_68283; Strand=+; Position=1-770
  Homolog annotation: Hit_ID=ZP_00289916.1; Match level="QueryCoverage =100%, HitCoverage=61%, E-value=6e-52, Identity=39%"; Hit description= hypothetical protein Mmc102001633 [Magnetococcus sp. MC-1]
EEDKVEDKVEEEQKVEEEQKVEEEQKVEEEQKVEEEQKVEEEQKVEEKVEEAQKVEEKQKVEEKQKVEEEQKVEEKVEGEQKVEDKVEEEQKVEEEQQVEEKQKVEEEQKVEEEQKVEEEQQVEDKVEQKEEQKEEDKVEDKVEEEQKVEEEQKVEEEQKVEEEQKVEEEQKVEEEQKVEEEQKVEEEQKVEEEQKVEDKVEGEQKVEDKVEQKEEQKEEDKVEEEQKVEEEQKVEEKVEKAQKVEEKTEVEEKQK

SEQ ID NO: 141861 - protein, 168 aa, Heterodera glycines
  misc_feature (94)..(94): Xaa can be any naturally occurring amino acid
  Coding regions on vcDNA: vcDNA=SeqID_68284; Strand=-; Position=1 -90,283-375,468-586,811-1012
  Homolog annotation: Hit_ID=AAC46628.1; Match level="QueryCoverage =90%, HitCoverage=46%, E-value=2e-34, Identity=46%"; Hit description =cuticular collagen Bmcol-2
SPMCALSEETDLKALLREAENFRRVAFFGVTTAVVATLMAVMSVPMMYNYVQQMHSQMRDEADFCKLRSTSIWKEVARAQVSKQNGKILKIFFXTFQFVATNDPVKSSPIGAAVTDGAYVTAAAAAAQQSTCCGCGQSPQGVPGLPGMPGSDGAPGQQGPPGKDGPDA

SEQ ID NO: 141862 - protein, 86 aa, Heterodera glycines
  Coding regions on vcDNA: vcDNA=SeqID_68285; Strand=+; Position=1 -94,146-254,507-563
  Homolog annotation: Hit_ID=CAG13359.1; Match level="QueryCoverage =89%, HitCoverage=25%, E-value=6e-10, Identity=39%"; Hit description =unnamed protein product [Tetraodon nigroviridis]
HGRESDATLRLPFTYNVTTVAIYGYAAALKRFAPNIKIIHFLGKQKPWALLYGDGAAGMAFVSDYHKQWYQLYANIVQQLLPPSSS

SEQ ID NO: 141863 - protein, 136 aa, Heterodera glycines
  Coding regions on vcDNA: vcDNA=SeqID_68286; Strand=+; Position=1-411
MTNSNLDSIMASSTPIEFAVNGRGEGAAKVPFGKGTTDGMAKIITDGKGHFCGGGRMDDGGRRGKAGDDGQKEQKQIGVGQNVTTLLSAHVRWEGNGKRNNLRSFFSYNSIVIIEYSDSPSGDQQKCQRPSVRLSS

SEQ ID NO: 141864 - protein, 183 aa, Heterodera glycines
  Coding regions on vcDNA: vcDNA=SeqID_68287; Strand=+; Position=1 -426,640-762
MAEASSNGTEIHGTIIFAAYAMAFLELGTFIPTIPIVAFCASILYKTSILHRNLKGILLAQLFSIMMNLWPRAFMLIAQIFVTKNIFLLPPNFISGAATAALTFNNMAGHVLIVERICATVYVGTYESYRSWTFTALWLSITIILCLALTIYQLLVLDSSFAFTNIFVGLYIGAMIASLIEIF

SEQ ID NO: 141865 - protein, 113 aa, Heterodera glycines
  Coding regions on vcDNA: vcDNA=SeqID_68288; Strand=-; Position=1 -228,717-827
MEPIEQQQIQQQQIHTQQQQQPPHQTVPKIVGATVFQPDEAAPPPVVVSPTAPPEEEEEEGTTEPMGGGSRKGSQNALKTVNCPKSEEDLEELGLSRRGMPIVQSFSVGGKTK

SEQ ID NO: 141866 - protein, 247 aa, Heterodera glycines
  Coding regions on vcDNA: vcDNA=SeqID_68289; Strand=-; Position=1 -69,165-422,742-963,1029-1223
MPQALLITPQQQHQAYHQQQHQQLLAAQQIAVAQQQQQQQSHPQGSMPMPAHHGTAGMPMPSVTSVAQMPPVSVMSGAGTVSVAAAAQQSAAVSVAHGIVPQGTTHLQTELDLSTGITNDSKRKTKPTTDGKDREAEETDKSNHAKEFQKKIAERLKYGADSDDFKAEGNGTVPTITPPPAVPIAREGNDDQTKQNDGPTAERWTQKVPPPSQRQYGQGELGMFIVNLVKRNGETETGKTHGNSVNR

SEQ ID NO: 141867 - protein, 183 aa, Heterodera glycines
  Coding regions on vcDNA: vcDNA=SeqID_68290; Strand=-; Position=1 -541,914-924
MVLVSEFCAQFLSCPTKSLRDRLNHPEDRVRVLQQLIGKKVQTTYKDRNGMRKSFLVGGMTERGAAFEPAYGRLRKPFNINVAAHFYTRHRVKLHYPYVPCIIEGFTRGEDRYYPMELLEIVDDKKGGRLFGRLFTEIEEQEEEDTKSEASHSSNSSYLQFNGKGCKWYESIDEITNTGREIK

SEQ ID NO: 141868 - protein, 46 aa, Heterodera glycines
  Coding regions on vcDNA: vcDNA=SeqID_68291; Strand=+; Position=1 -24,87-202
MVRTHYVMYDNDRLLRSTDCHELFGRVADESCENEKETDGKGRTDH

SEQ ID NO: 141869 - protein, 148 aa, Heterodera glycines
  Coding regions on vcDNA: vcDNA=SeqID_68292; Strand=+; Position=1 -99,146-384,449-555
SLAFDSLSIDSSEIDIDNGIRLPNCDTLIKPAIRQNPTLLGKKLPKIKEGITTDFYRIIKRALYLKKVSAENQQIPSLLVSRLLLTDSMLSSLEGDLFRNMDLMKLDYPRMPMWFLETLDHWFDDNELTFVNGGVFLYSKARFTSNFS

SEQ ID NO: 141870 - protein, 92 aa, Heterodera glycines
  Coding regions on vcDNA: vcDNA=SeqID_68293; Strand=-; Position=1-636
PYFYSALDFAPHICLSTSNGHLKNRFFFFGAVPPNRCAQIYGETESFGNSFPIACTLILRWIFAPHKCLSTPNGHLKKSIFLFHKYFFQKVL

SEQ ID NO: 141871 - protein, 246 aa, Heterodera glycines
  Coding regions on vcDNA: vcDNA=SeqID_68294; Strand=+; Position=1 -148,1073-1233,1291-1579,1752-1894
  Homolog annotation: Hit_ID=A48145; Match level="QueryCoverage=60%, HitCoverage=100%, E-value=2e-49, Identity=62%"; Hit description =ubiquitin-conjugating enzyme ubc-2 - Caenorhabditis elegans
MEGASFVRRLGRSLMGGPPMVQVSAVIHRCRGVTRRDQFLMQLRQFLQIEHNYLRLSSSSLHCATTTTLQKRPHRRFSSFVRPSVLHINSLAVFAMALRRIKQELAELKQEPITGCTAAPMDDGKDMFHWKATIKGPPESPYEGGTFNMDIVFHRDYPFTPPVVKFETPVYHPNVNKQGGICLDVLKMSHWAPSLTISKVLLSISSLLCDPNPDSALEMDIAIIYRNDREQYNRNAREWTQKHAMK

SEQ ID NO: 141872 - protein, 49 aa, Heterodera glycines
  Coding regions on vcDNA: vcDNA=SeqID_68295; Strand=-; Position=1-146
EQNYLRLSSSSLHCAITTTLQKRPHRRFSSFIRPSVLHINSLAVFAMAR

SEQ ID NO: 141873 - protein, 146 aa, Heterodera glycines
  Coding regions on vcDNA: vcDNA=SeqID_68296; Strand=+; Position=105 -152,214-606
  Homolog annotation: Hit_ID=AAP30767.1; Match level="QueryCoverage =100%, HitCoverage=100%, E-value=4e-73, Identity=94%"; Hit description=putative gland protein G21E12 [Heterodera glycines]
MATYLFIAAAAFGAGIYCWKAYLGPMLDQTKSDDEEKPKPEGGEEATTAGDKEEKKAGSKGDKHKKKDKKGEGAAAAAPAADKKEEKRKDKHRSKEAGKSDDSKAGKKDKHGKKDKKGKKKDTADASTVDEALGEQSTAETSQAEE

SEQ ID NO: 141874 - protein, 142 aa, Heterodera glycines
  Coding regions on vcDNA: vcDNA=SeqID_68297; Strand=-; Position=1 -286,454-596
  Homolog annotation: Hit_ID=A48145; Match level="QueryCoverage=90%, HitCoverage=85%, E-value=5e-42, Identity=60%"; Hit description =ubiquitin-conjugating enzyme ubc-2 - Caenorhabditis elegans
MAELHQELVTTGYTAAPMDDGRDLYHWKASIKGPPESPYEGGTFHLDIVFRRDYPFTPPNVKFDTIIYHPNVGERGDICLDILKQMWAPSLTISKVLLSISSLLCDPNPNSALRQDIATMYRDNREEYNRIAREWTKNHAMR

SEQ ID NO: 141875 - protein, 49 aa, Heterodera glycines; identical to SEQ ID NO: 141872
  Coding regions on vcDNA: vcDNA=SeqID_68298; Strand=-; Position=1-146

SEQ ID NO: 141876 - protein, 151 aa, Heterodera glycines
  Coding regions on vcDNA: vcDNA=SeqID_68299; Strand=+; Position=1 -24,84-372,546-688
  Homolog annotation: Hit_ID=A48145; Match level="QueryCoverage=99%, HitCoverage=100%, E-value=2e-49, Identity=62%"; Hit description =ubiquitin-conjugating enzyme ubc-2 - Caenorhabditis elegans
MALRRIKQELAELKQEPITGCTAAPMDDGKDMFHWKATIKGPPESPYEGGTFNMDIVFRRDYPFTPPIVKFETPVYHPNVNKQGGICLDVLKTTHWAPSLTISKVLLSISSLLCDPNPDSALEMDIAIIYRNDREQYNRNAREWTQKHAMK

SEQ ID NO: 141877 - protein, 143 aa, Heterodera glycines
  Coding regions on vcDNA: vcDNA=SeqID_68300; Strand=+; Position=1 -171,585-845
MRKGPNDWSPNRKGKWQNLRGQKVKNGYKIRKIGTKGGERFHLAKVEEMSDLIEPDKVQAANRRPICLICLKKMTQVRQVRTICDHVFHYVCFHRWLKYRLFCPVCLLNFRTELYHSGNAVFEGAYNDGHVVLIPDGEQSNSG

SEQ ID NO: 141878 - protein, 170 aa, Heterodera glycines
  Coding regions on vcDNA: vcDNA=SeqID_68301; Strand=-; Position=1 -105,617-890,1088-1218
MQKTTAEEGGGGGYIQLTLFPHMIPTVKIVLLYLTFYCPNNLFMYNTKLDIAFVRSQLEMSADHLSTVALFTIRYEHNVSIVVRALKHGVSRMIQFRAKVEQTDGAKQTIFEPTVEADVVEHVVTDAVPAAAFLLLPMRRLSLALRALNGSLPLPLGLAIQWRRESHKTK

SEQ ID NO: 141879 - protein, 151 aa, Heterodera glycines; identical to SEQ ID NO: 141876
  Coding regions on vcDNA: vcDNA=SeqID_68302; Strand=+; Position=1 -24,84-372,555-697
  Homolog annotation: Hit_ID=A48145; Match level="QueryCoverage=99%, HitCoverage=100%, E-value=2e-49, Identity=62%"; Hit description =ubiquitin-conjugating enzyme ubc-2 - Caenorhabditis elegans

SEQ ID NO: 141880 - protein, 306 aa, Heterodera glycines
  Coding regions on vcDNA: vcDNA=SeqID_68303; Strand=-; Position=1 -63,486-646,908-1047,1650-1817,2408-2601,2677-2871
MMSRSAQICSQNRSAHPSNLLYGRIAQTLVVGFSAGLSDHNVRTMHLPNYTTAGIQQACWNFMRPFNREKDGHSWYPHVSCIYMSASRFELVDRRLPTRRITEFFHKKALGVECDGQQQCSGNGDDEDDDVIFLAEMNLPKECDGGGNAQRREDDNVEQQQEAAACSNSEAQQPANDGTDGDDEIVFLGKQKDERHNGRRRRRRQSLTRLITEFYRPRQQRMRTMMMMAKPILCATGNNAVDELMFFMHYENDYSIIQKINPKRGREAEVEQKQREKEHEGDRRGKEEGEEKGGEEQEEKTEDEEE

SEQ ID NO: 141881 - protein, 133 aa, Heterodera glycines
  Coding regions on vcDNA: vcDNA=SeqID_68304; Strand=-; Position=1 -83,361-439,486-557,822-962,1403-1428
  Homolog annotation: Hit_ID=CAE66466.1; Match level="QueryCoverage =81%, HitCoverage=18%, E-value=1e-16, Identity=44%"; Hit description =Hypothetical protein CBG11743 [Caenorhabditis briggsae]
MRHLCPIIHLCRVPAIEGVEKGDISKYRDASGEIFKVLVDFSDQIVVEKASVDEAFLDLTAHCEMELNSQPMEELVQKLNDDIAQLFPNTFLVNESDKQQTVIAEERLNSLKEWLSNDCRVSRQQILAKLVCA

SEQ ID NO: 141882 - protein, 45 aa, Heterodera glycines
  Coding regions on vcDNA: vcDNA=SeqID_68305; Strand=-; Position=1 -40,673-770
MGESIRVIALIDMGPLPSTIQPEPSESNGEWTATRFEFQQSPNSI

SEQ ID NO: 141883 - protein, 23 aa, Heterodera glycines
  Coding regions on vcDNA: vcDNA=SeqID_68306; Strand=+; Position=1 -66,149-154
MRAYDFITEARHKVVVQALRQAI

SEQ ID NO: 141884 - protein, 175 aa, Heterodera glycines
  Coding regions on vcDNA: vcDNA=SeqID_68307; Strand=+; Position=1 -123,188-293,714-810,864-934,992-1020,1066-1166
  Homolog annotation: Hit_ID=CAG07650.1; Match level="QueryCoverage =97%, HitCoverage=72%, E-value=4e-16, Identity=31%"; Hit description =unnamed protein product [Tetraodon nigroviridis]
QLSCEIAELEKLRQQSQLPNVQKAIDELIGRWKVKKEEQKMKTDKGTAETLSAPTEAPKLISGSVHVRPTKKLTTYAFDESDKFVKLYYSLPGISDSVPGTISTDFRENSFSIVCSDVKGIDYEIRVQGLCQAVEPEKCVVKQKSGDQLLIMLKKAKERQNWGSLLKLEKEVGKS

SEQ ID NO: 141885 - protein, 65 aa, Heterodera glycines
  Coding regions on vcDNA: vcDNA=SeqID_68308; Strand=+; Position=1 -148,1125-1174
  Homolog annotation: Hit_ID=NP_740814.1; Match level="QueryCoverage =63%, HitCoverage=6%, E-value=4e-12, Identity=80%"; Hit description =alpha-CaTuliN, catenin/vinculin related (ctn-1) [Caenorhabditis elegans] gb|AAM19065.1| Alpha-catulin (cat
MTILNGFSQIGTAVEAAVERFVAVGETIADENPDIQPELYDACNEARMAEYSHFLISIKNNRIFF

SEQ ID NO: 141886 - protein, 270 aa, Heterodera glycines
  misc_feature (3)..(3): Xaa can be any naturally occurring amino acid
  misc_feature (217)..(217): Xaa can be any naturally occurring amino acid
  Coding regions on vcDNA: vcDNA=SeqID_68309; Strand=+; Position=1 -132,295-429,474-566,733-825,877-981,2014-2197
  Homolog annotation: Hit_ID=NP_740814.1; Match level="QueryCoverage =96%, HitCoverage=37%, E-value=2e-70, Identity=54%"; Hit description =alpha-CaTuliN, catenin/vinculin related (ctn-1) [Caenorhabditis elegans] gb|AAM19065.1| Alpha-catulin (ca
IFXNNIAGGDEQRLQNGSNEITVERLNRRLKDLRKQLQVVALEQIATVFRQNEDQAILSSLKTCSISGDIDGVERFLEQFRLHAEHLQEVCRLLHHISVCRLLHHISLTDALHVFTGHAERNLRALAPLTLLAGRVLCVHPSSRIARENLEVFCDTWAINVNDLARMSKELDAAVNDLARMSKELDAACSGRLAAEKQAYMSLPRPGVSENESKRSXRNWKDSGGRKRNGPFQSDLREGGRTGHSSTAKTEEEGGLAGEEEAQRGRRRAW

SEQ ID NO: 141887 - protein, 300 aa, Heterodera glycines
  Coding regions on vcDNA: vcDNA=SeqID_68310; Strand=-; Position=1-903
  Homolog annotation: Hit_ID=XP_308737.1; Match level="QueryCoverage =80%, HitCoverage=19%, E-value=4e-33, Identity=36%"; Hit description =ENSANGP00000015074 [Anopheles gambiae]
MVEVKPSESITQMVTEAKIIFESAGIRIREFFGSHIDELKELDSSELAKDLENTKVLGIEWKPRHDQLIFKMPVFSSPTTKRKILSHIAKVYDPLGLISPALLPAKHFLQIVQNLNFKWDDPLPEKMAIDWIKLMHAWDGFGFNFRVEFPRHIATSSSEEFHCFCDASKSGLGVALYQLADTSYGKKESNLIFGKSHIKPLKVADHDSTIPKLELQALTLEVKVTKFVQTQLNFTDEQVILWTDSQCSIERLKEERKYDRFVNNRLKKIREACFKVRHIRTDENPADIASRGTDPQSLQS

SEQ ID NO: 141888 - protein, 107 aa, Heterodera glycines
  misc_feature (7)..(7): Xaa can be any naturally occurring amino acid
  misc_feature (14)..(14): Xaa can be any naturally occurring amino acid
  Coding regions on vcDNA: vcDNA=SeqID_68311; Strand=-; Position=1 -193,453-596
  Homolog annotation: Hit_ID=CAE74364.1; Match level="QueryCoverage =89%, HitCoverage=24%, E-value=3e-30, Identity=65%"; Hit description =Hypothetical protein CBG22088 [Caenorhabditis briggsae]
DTLTTIXSISPIFXICHPFTPKIMPFCSLSLAYILMSGIMPFDDDCRSRLYTHIITANYVYYPQFWSGSEQAKHFVDTLLDTSPDHRPSASDALHHHWVTGDRPHSK

SEQ ID NO: 141889 - protein, 137 aa, Heterodera glycines
  Coding regions on vcDNA: vcDNA=SeqID_68312; Strand=-; Position=1 -141,541-646,698-864
MKRLILTQGQLKRLQLLDIEQYRQAVIGFYVRVNYPGLPSKFSTTIFEEESPTLGFVHQKQNDLAQAIKTLELDDSIKKEERVSPPIKKDNLIQIALSPSMLRLLAKLEFERFRDTVTGCFVFMPCISKEKVVGGGV

SEQ ID NO: 141890 - protein, 23 aa, Heterodera glycines
  Coding regions on vcDNA: vcDNA=SeqID_68313; Strand=-; Position=1 -17,369-423
MQLFRTVLIFALFATLPTAGDVE

SEQ ID NO: 141891 - protein, 282 aa, Heterodera glycines
  misc_feature (248)..(248): Xaa can be any naturally occurring amino acid
  misc_feature (254)..(254): Xaa can be any naturally occurring amino acid
  Coding regions on vcDNA: vcDNA=SeqID_68314; Strand=+; Position=1 -750,4153-4250
  Homolog annotation: Hit_ID=NP_499726.1; Match level="QueryCoverage =97%, HitCoverage=11%, E-value=2e-30, Identity=32%"; Hit description =predicted CDS, RNase H integrase-like protein family member (3O318) [Caenorhabditis elegans] pir||T26836
MKLSQEILSNIYVDNLLLCCDDPLVGKNKISNVISLFETVSLPIREFASNSSEAISDLPNDRMLSGTIHKFLGVSWNTLNDNLLLTVSPPPENLCTKRSILSFIASNFDPLGLISPVILPLKIFMQTLCVESVEWDQPITLNSQNKWNHLFKNWVPAEKIEIPRNPLTLPLQNRSYELHCFSDASNLAMCAAVFLCVSNPNSEFSDCFLIFSKKKLKPNKGTNLTIPKMELIAAEMGSKMLNLLIRFXQISFTXAQILFEKNVFLFSEVVKKYFRGFSGSLI

SEQ ID NO: 141892 - protein, 18 aa, Heterodera glycines
  Coding regions on vcDNA: vcDNA=SeqID_68315; Strand=+; Position=1-57
YREAIPEGFGSPHKSGRI

SEQ ID NO: 141893 - protein, 70 aa, Heterodera glycines
  Coding regions on vcDNA: vcDNA=SeqID_68316; Strand=+; Position=1-669
STGYREAIPEGFGLPINLGASVRGDCPENKKIDFFKCPFGVLKQLWGAKIQRRIKVQAIGKLLPKDSVSP

SEQ ID NO: 141894 - protein, 59 aa, Heterodera glycines
  Coding regions on vcDNA: vcDNA=SeqID_68317; Strand=+; Position=1-237
IHSFGGPCRVPRGKQCWFVSSRHRTFWLVSNRYVTCQIGRVRMIPRGEAPHQKQNDITK

SEQ ID NO: 141895 - protein, 86 aa, Heterodera glycines
  Coding regions on vcDNA: vcDNA=SeqID_68318; Strand=+; Position=1 -67,353-484,535-596
MNFWYFTIALLTKIRKILICDQTKKSVFFPSIELIEFTINLLGFSPENVQSEWNPLIYEFLDKYIKGLIVQTMHLEKRQVCCVKSE

SEQ ID NO: 141896 - protein, 41 aa, Heterodera glycines
  Coding regions on vcDNA: vcDNA=SeqID_68319; Strand=+; Position=1 -86,226-265
MDPVPFQFGRLQCNEQLIPNGLFTAPIFGAYILTLIKLIDF

SEQ ID NO: 141897 - protein, 170 aa, Heterodera glycines
  Coding regions on vcDNA: vcDNA=SeqID_68320; Strand=+; Position=1 -88,141-565
MHGFGLFLSLLAAINLSRGQIGPKDESKKGLFLMANEFLETGKMLLDEFPGNKQAENKSDDGLNSQKANGKALEEKSDNFQQKAFEFLCGIEMKAKNDEKGNDKTKKDDNLLAFKELEEKRLNFCQNWKNGKSIWKGLKEAGISIVTSVNNLKLNQQIYGESEQWRKWKF

SEQ ID NO: 141898 - protein, 96 aa, Heterodera glycines
  Coding regions on vcDNA: vcDNA=SeqID_68321; Strand=+; Position=1 -152,271-409
MEVLSDEEEGMALSDLKETAKKNNEEAKRREFDRRLPIIHSYLGDVNQGEFFCYKRSLSVSGPENANPIPPKVGHPICAQCTPSAKYPCPFHCGRP

SEQ ID NO: 141899 - protein, 19 aa, Heterodera glycines
  Coding regions on vcDNA: vcDNA=SeqID_68322; Strand=+; Position=1-56
IIGDWGINGDWGIIRANTV

SEQ ID NO: 141900 - protein, 159 aa, Heterodera glycines
  Coding regions on vcDNA: vcDNA=SeqID_68323; Strand=-; Position=1 -34,2086-2531
MSLLKKNILHRVHFLEIFRDLNSQPYTYHEATDPTFIHSLINILIVTKFAQMKNNHFGFSLLSAVGIASAWLIMAMLLMMPSSSIADDDDEVFQIFARYGYKSYTVEVKGTDTVATLRQKIGQKIGIVPGQIRRVPYGVIKDGETLNRYGIEKDTTIFL

SEQ ID NO: 141901 - protein, 109 aa, Heterodera glycines
  Coding regions on vcDNA: vcDNA=SeqID_68324; Strand=-; Position=1-330
MKNNHFGFSLLSAVGIAAAAWLIMAMLLMMPSSSIADDDDEVFQIFARYGYKSYTVEVKGTDTVATLRQKIGQKIGIVPGQIRRFPYGVIKDGETLNRYGIEKETTIFL

SEQ ID NO: 141902 - protein, 38 aa, Heterodera glycines
  Coding regions on vcDNA: vcDNA=SeqID_68325; Strand=+; Position=1-184
IFKCLDFFFWLTKTSSNLVLSILFQIAPNFVYSLTRPY

SEQ ID NO: 141903 - protein, 41 aa, Heterodera glycines; identical to SEQ ID NO: 138623
  Coding regions on vcDNA: vcDNA=SeqID_68326; Strand=+; Position=1-349

SEQ ID NO: 141904 - protein, 81 aa, Heterodera glycines
  misc_feature (16)..(16): Xaa can be any naturally occurring amino acid
  misc_feature (28)..(28): Xaa can be any naturally occurring amino acid
  misc_feature (32)..(32): Xaa can be any naturally occurring amino acid
  Coding regions on vcDNA: vcDNA=SeqID_68327; Strand=-; Position=1-244
DALVSKRKMEKNFLKXFFLIFCYIVCFXVGCXDQWNHAHPSDLASKQRLLTSQKVRCRDETNQPLLTPRHPARSPEGMDLI

SEQ ID NO: 141905 - protein, 85 aa, Heterodera glycines
  Coding regions on vcDNA: vcDNA=SeqID_68328; Strand=+; Position=1 -352,522-986
KIDFFVFGAVPPNRCAQIYGETESFGISFPIVCTLILRWIFALHNCLSTPNGHLNKSIFLFSGLSPRTDAPRFMGRPNPSGLASL

SEQ ID NO: 141906 - protein, 93 aa, Heterodera glycines
  Coding regions on vcDNA: vcDNA=SeqID_68329; Strand=+; Position=1 -66,188-403
MAIFTEIFFNTLPALGALLFNWSTGLVMANYVGELSISACPVDAFICAVIYWRNLVKRGGVAQQQQNNINLMTVAKPMTTMANRNVDRRLTIR

SEQ ID NO: 141907 - protein, 29 aa, Heterodera glycines
  Coding regions on vcDNA: vcDNA=SeqID_68330; Strand=-; Position=1-89
MKKFSKFPEKNGFATKSEPKRDIFRKLLK

SEQ ID NO: 141908 - protein, 31 aa, Heterodera glycines
  Coding regions on vcDNA: vcDNA=SeqID_68331; Strand=+; Position=1-94
DYFSKHLVDWGIIEDCGINRDWAIIRAYTVI

SEQ ID NO: 141909 - protein, 510 aa, Heterodera glycines
  Coding regions on vcDNA: vcDNA=SeqID_68332; Strand=-; Position=1 -82,234-325,359-415,897-1183,1323-1400,1548-1849,1908-1981,2044 -2247,2327-2419,2484-2615
  Homolog annotation: Hit_ID=CAE58428.1; Match level="QueryCoverage =99%, HitCoverage=80%, E-value=1e-148, Identity=55%"; Hit description= Hypothetical protein CBG01560 [Caenorhabditis briggsae]
PPAKCYFNFAAATGANRSRTMHQMHQSSVVHESSALGSDGESIEVSPCTSDQSAGGGDTEYIPKVKLRQKPTEYIPKVKLRQKPNRRWSEQDIQKRLSLPPDIRLPQNVIDKLNRTPTLDNPLTRKSKRASLNEIGFGKLETYKKIFDLGEGTYATVYLGKSLLTGKNVALKEIRLEHEEGAPCTAIREVSLLRNLRHANIVTLHDIVYTDRILTLVFEFVERDLREYMEELDGIISIANVKLFLVQLLRGLAYCHCRRILHRDLKPQNLLINRTGELKLADFGLARAQSVPTKTYSNEVVTLWYRPPDVLLGSTDYSTHIDLWGVGCISTDYSTHIDLWGVGCILYEMLLHKPMFPGSTTDEQPMFPGSTTDEQLNLIFQKLGTPSPAVHADICALQAFKNGQFRQHNAKPLLNPPRISPERADLLSKLLKYEGKYRISAIDAMRHPMLNCFPAQLFSLPDTESVLESVLSLPGVHYTRDSKDEAYIETRKSSERTEKPTGQRMRTTIQ

SEQ ID NO: 141910 - protein, 33 aa, Heterodera glycines
  Coding regions on vcDNA: vcDNA=SeqID_68333; Strand=-; Position=1-99
MGQLKLSSRGRIEEEEEEEEEMDEEEQQGEEEE

SEQ ID NO: 141911 - protein, 37 aa, Heterodera glycines; identical to SEQ ID NO: 127515
  Coding regions on vcDNA: vcDNA=SeqID_68334; Strand=+; Position=1-119

SEQ ID NO: 141912 - protein, 89 aa, Heterodera glycines
  Coding regions on vcDNA: vcDNA=SeqID_68335; Strand=-; Position=1 -204,259-321
MGSHGVDCAVTVRGNSCGCVTICDTCCENGWWQRYVDAARDQAARQVEDSIDPWTGIVRGDEDSQRLWVEGHDVRPKCLGCQAVRVDYL

SEQ ID NO: 141913 - protein, 102 aa, Heterodera glycines
  Coding regions on vcDNA: vcDNA=SeqID_68336; Strand=-; Position=1-309
MTNEYKQKRKYSLKEWHQNYEEICKKIGVGYGTIKRWKKQFGISCKITEKEKMEKMKKYWKIKSENPKMSDKETAKILQIDRRTISKWKKQFGGEILEDLNG

SEQ ID NO: 141914 - protein, 150 aa, Heterodera glycines
  Coding regions on vcDNA: vcDNA=SeqID_68337; Strand=-; Position=1 -200,300-495,763-823
  Homolog annotation: Hit_ID=NP_500240.1; Match level="QueryCoverage =95%, HitCoverage=11%, E-value=2e-33, Identity=46%"; Hit description =putative secreted or extracellular protein precursor (4D416) [Caenorhabditis elegans] gb|AAK68577.1| Hypo
HMTFNIHSTKIQIWNLSRRLSTAVSCQWALNELCLRHVSCRELWTLFRRNCAVDAQNQCKMANKNNDCWQSFEGISWTGLGSCTCAGNNSDCHWIRLQTNYNKCICVLALLKTDQKRIIDQSIQRNLKIEEKEKRHIEKQWRKRRRRRRG

SEQ ID NO: 141915 - protein, 238 aa, Heterodera glycines
  Coding regions on vcDNA: vcDNA=SeqID_68338; Strand=-; Position=1 -136,543-628,683-858,975-1179,1340-1453
MPFLNFFGAYYSAFFAIFGAFLVVLYSLPFLAHILEIFYNQGANKAPATIRAQVLQNTCTPVLASFPSKDATKKVIKRLRRDENAPRAEPLNLEQLEIPNTYRVYKRTEIDEEQFLLADTGVFKIHGQNGPQRFLDNYTGRMRFNVPMTHLCLTHTNGMFISAPWMVLIGRTTSPRHSIGNFIGNLAELIQQFGDSLTRSDTGAGQDPAQDFAGSQSAILHILENTGFAGLILPDPVL

SEQ ID NO: 141916 - protein, 70 aa, Heterodera glycines
  Coding regions on vcDNA: vcDNA=SeqID_68339; Strand=-; Position=1-333
LETGNFKFADPVAGLEFKIFYRTGSGRINPAILHLKSAGSCAGLRILGNFKKFCINKKVFQSIKKYSIYF

SEQ ID NO: 141917 - protein, 30 aa, Heterodera glycines
  Coding regions on vcDNA: vcDNA=SeqID_68340; Strand=+; Position=1-95
RGGGALTATGKDQQKGDEKGQEKGVGGGRH

SEQ ID NO: 141918 - protein, 98 aa, Heterodera glycines
  Coding regions on vcDNA: vcDNA=SeqID_68341; Strand=-; Position=1-309
DKIGREQTTTRCRVVYFVVLIPVSDGALLFSFFLFSVISTLFPSFFLDMVQNVDDCFRNKTSNCTNATFLIYSKLFCFGFGPVRANCLCFDDARCHFG

SEQ ID NO: 141919 - protein, 61 aa, Heterodera glycines
  Coding regions on vcDNA: vcDNA=SeqID_68342; Strand=+; Position=1-184
DNEARHVGQRRTSEAGHFEAALGPVDVQWSRTALLHRGQPTEPFGIEQPIGKQSQNRHRLR

SEQ ID NO: 141920 - protein, 43 aa, Heterodera glycines
  Coding regions on vcDNA: vcDNA=SeqID_68343; Strand=+; Position=1-130
RDVREVIFTGNRETIREPRNDPGKRYENRDPKNPRNFSTRESR

SEQ ID NO: 141921 - protein, 126 aa, Heterodera glycines
  Coding regions on vcDNA: vcDNA=SeqID_68344; Strand=-; Position=1 -48,109-185,243-498
  Homolog annotation: Hit_ID=AAH47137.1; Match level="QueryCoverage =78%, HitCoverage=78%, E-value=1e-21, Identity=51%"; Hit description =Histone 2, H2bb [Mus musculus] ref|NP_783597.1| histone 2, H2bb [Mus musculus] gb|AAO06250.1| histone prot
MARRRRKKEPRKQSYKLYVRRVLKEVHPGKEISMRALNIMNSFVIDALDRIATEATRMAHNDRRKTITLRDMEFSVRLCLPDVMAKDANQKAQKTVTKFYAAKVRDRMRRTEMRRGEFAMMQMAAL

SEQ ID NO: 141922 - protein, 268 aa, Heterodera glycines
  Coding regions on vcDNA: vcDNA=SeqID_68345; Strand=+; Position=1 -697,736-804
  Homolog annotation: Hit_ID=NP_502797.1; Match level="QueryCoverage =99%, HitCoverage=73%, E-value=4e-47, Identity=36%"; Hit description =HASI (4P602) [Caenorhabditis elegans] emb|CAB16520.1| Hypothetical protein Y57G11C.19 [Caenorhabditis ele
VEKILSKIYFNLKSPASFAGIQKILNEAKKIDPKITTDDVNKFLEKQKTYTIHKPIRKRFPRLKTIPSGFHTDWQCDLCIFDQLKKHNDGYKYLLVCIDVLSRMIFSAPAKSKKSEDMIEAFDRVFEKSKIIPMKIYSDSGLEFQAGKIKNILRKNFIKNVMYSPDLHAGVVERANRTIKERLYRYFTKKDTLRWVDVIDKIITNINNSVNRTLGAKPSSINLKMPVRSGKKKFKIGDIVRITKEKKFKIGDIVRITKEKGKFSKGYL

SEQ ID NO: 141923 - protein, 29 aa, Heterodera glycines
  Coding regions on vcDNA: vcDNA=SeqID_68346; Strand=-; Position=1 -49,95-133
EAIPEGFGLPINLGASRAFGVLKQLWGAK

SEQ ID NO: 141924 - protein, 56 aa, Heterodera glycines
  Coding regions on vcDNA: vcDNA=SeqID_68347; Strand=-; Position=1-170
  Homolog annotation: Hit_ID=YP_046143.1; Match level="QueryCoverage =100%, HitCoverage=11%, E-value=4e-22, Identity=91%"; Hit description= putative transport protein [Acinetobacter sp. ADP1] emb|CAG68321.1| putative transport protein [Acinetob
MYLCMCLSMSEMATMLPTAGGGYSFARTAFGPFGGYLTGTAILIEYAIAPAAIACF

SEQ ID NO: 141925 - protein, 143 aa, Heterodera glycines
  Coding regions on vcDNA: vcDNA=SeqID_68348; Strand=+; Position=1 -207,248-385,554-640
MKNTIKSELLAVEEGETIFHGPPEGMLTLEELISRLEEKVAGYEAEKHFCVGPLYRQTDHREAKELAQTIAQKQAVAVHLQPTAEQLEQMVFQLMSAAEETTLHLIEQREEDFKWPIWTTGEAQGDEEEDAEMEEVQDDDWED

SEQ ID NO: 141926 - protein, 110 aa, Heterodera glycines
  Coding regions on vcDNA: vcDNA=SeqID_68349; Strand=+; Position=1 -236,299-395
MSFGRLNNATPIELFELENERTNEKLTLKGVSRHPGNWLLKRCPTNGETTTVQQQKDENSDVNLHNVHFVLDIDKQCIGPLSPPSEEEKAGQSNDEMFSTTPEPSNQRNE

SEQ ID NO: 141927 - protein, 221 aa, Heterodera glycines
  Coding regions on vcDNA: vcDNA=SeqID_68350; Strand=+; Position=1 -23,81-359,421-784
MNRQLKKIYICTDVWMDILPFFERVELGLTLALLSPRFDVLVDAHFDGKRKLTIWRRIIVRKGKNAEKVLVGIYWCKEEHYTLMDCCPLPNKIRFDCLQIEYIDHSVLAFFRSNQQIFDKGTNLTIHIQSSKTESNVQPIWDVLVRQIWPIFTATNVHHLRFGNADHLDTLLRLTSPTIPSDLNINSIQSYRGLFPDALGGDDGPNISKRCDQTFVKPLTN

SEQ ID NO: 141928 - protein, 44 aa, Heterodera glycines
  Coding regions on vcDNA: vcDNA=SeqID_68351; Strand=-; Position=1-135
NKGNSQHSTPSVRRAHKKHSEAGKTSGEEGNGGEGAQESAFDKA

SEQ ID NO: 141929 - protein, 115 aa, Heterodera glycines
  Coding regions on vcDNA: vcDNA=SeqID_68352; Strand=-; Position=1 -120,193-420
MSNRTNFAILFAEGSGQRGNEQSDEERGADFIGYSPIIPGQRIVDVKMAVDFQRQITKYALTYKMVMELFEFEYVSKNELENADECAVCLNEFDEEEKFVMIHKNERQQTKPVKN

SEQ ID NO: 141930 - protein, 29 aa, Heterodera glycines
  Coding regions on vcDNA: vcDNA=SeqID_68353; Strand=-; Position=1-88
PPSHFRPIKRAPFSLNAHFHISIHSFLLL

SEQ ID NO: 141931 - protein, 41 aa, Heterodera glycines
  Coding regions on vcDNA: vcDNA=SeqID_68354; Strand=-; Position=1-123
KRQALEEKDQLELYASALDEDLERLSTDSEDEQETRKARPN

SEQ ID NO: 141932 - protein, 211 aa, Heterodera glycines
  Coding regions on vcDNA: vcDNA=SeqID_68355; Strand=-; Position=1 -75,307-445,736-997,1282-1441
MTAVIYHGKKSLRKLNTNLAFIRWRLASFIRAFLVILMAFLFQLWHPKFVCSFQMRLCHIYCTNFSRFTQNGNKILSEHQKNWQTLFNEVKIEEKFKNFAVIVGLTSQFDNFTENCAFQRSKIRNKLFEWAKRENVADKLDHYQLNAELEEKVRCKIFSKSAFCCYWLVGLRLNAQNFHRVADLVPIYGQNSSKKFFMRSFFSATKNLSKL

SEQ ID NO: 141933 - protein, 55 aa, Heterodera glycines
  Coding regions on vcDNA: vcDNA=SeqID_68356; Strand=+; Position=1-167
MFGQHFGALFGASDLSPSAAEDKQQAVPSSGAELAPAGAENGTAPEAPKTPSFCT

SEQ ID NO: 141934 - protein, 16 aa, Heterodera glycines
  Coding regions on vcDNA: vcDNA=SeqID_68357; Strand=-; Position=1-49
EATPEGFGLPINLGAS

SEQ ID NO: 141935 - protein, 246 aa, Heterodera glycines
  Coding regions on vcDNA: vcDNA=SeqID_68358; Strand=+; Position=1 -83,1198-1527,2092-2239,2280-2459
  Homolog annotation: Hit_ID=NP_741716.1; Match level="QueryCoverage =40%, HitCoverage=15%, E-value=2e-32, Identity=66%"; Hit description =putative protein, with at least 10 transmembrane domains, of ancient origin (68.2 kD) (XB658) [Caenorhabd
MDNSSEKKLLPFSNHPNIDENTPLLSTRPFILSPFMPTIATQVSINNGQPDRHRATTNPSVTLSSSLPQPPIMTKAKVIVPRIIGGPSERGDVRVVGQAKYGAVPNSTTDKNVTVGSVVKHTIAESESESSDEDEEERFLNLLPGGNVFFFASLIIRCAEALGDACFVTSSFAISAKCFPGRIATIVGIMETFAGLGYTAGPVIGGVLYEYGGFQLPFFVLGSVLIMATLLSYYLIEEIEGFYFIY

SEQ ID NO: 141936 - protein, 85 aa, Heterodera glycines
  Coding regions on vcDNA: vcDNA=SeqID_68359; Strand=-; Position=1 -163,473-567
MIVVVRGNPIDSTPQPPSVGPMNELNLVNMSNILMLSKEGTQMRRLTGKPPTHSPLATVEDKAPQRSSQTVETTTEQKNKANHSR

SEQ ID NO: 141937 - protein, 210 aa, Heterodera glycines
  Coding regions on vcDNA: vcDNA=SeqID_68360; Strand=+; Position=1 -177,225-407,466-582,659-802
  Homolog annotation: Hit_ID=NP_932138.1; Match level="QueryCoverage =95%, HitCoverage=20%, E-value=6e-46, Identity=45%"; Hit description =D10Ertd802e protein [Mus musculus] gb|AAH42443.1| D10Ertd802e protein [Mus musculus]
FQKIRSTVAAQVHSVAALSQALPGNPIFREYTIGAQIGSAGPGLCWKIFSGTKNTTKKEVTIWLEVTIWLFEKRQTENWAPAKREEFPEILKRGVSQLTRLRHPRILTVDRALEESRDCFAFCTEPLFACPLFACLANCFGDLTKKEFQLLDVERRHGLYQIIAEALAFLHNDTKTVHGNVSPSSVLINSKGAWKLGGLDFCILGNTSIP

SEQ ID NO: 141938 - protein, 577 aa, Heterodera glycines
  Coding regions on vcDNA: vcDNA=SeqID_68361; Strand=+; Position=1 -159,557-772,816-932,987-1112,1157-1333,1385-1507,1575-1688,1878 -2064,2159-2351,2413-2532
  Homolog annotation: Hit_ID=BAA92598.1; Match level="QueryCoverage =97%, HitCoverage=63%, E-value=6e-90, Identity=33%"; Hit description =KIAA1360 protein [Homo sapiens]
FVHNSRSVAFHNDTKTVHGNVSPSSVLINSKGWKLGGLDFCILGNTSIPGKVNFAVPGWSQNEISALCPDLDFVSPELAEGLRCDTFVDIFSLGVLSFAAFNNGKPLFECNNSFRLHRENLKKLKQSLQTLLSIVPEPFDDDIKMNLKKLKQSLQTLLSIVPEPFDDDIKMCLNETPELRPDAIQFTKLSYFELSYFEHPLLKTLNCLEQRLAMDNTQKMQLFKGLPTILAQFPKRSLLLTVFRSLLLTVFPHLAAEFAAPPLIPFILPSVFLIVELTSPEEFVLSVMPSLLSVFPIQTPYQIGLLLMQRVNLLIGLLLMQRVNLLLEKMPPDAVKQHLLPLIYNSLTGDNVRVQELTLIEVPNELTLIEVPNIVKFVDREQMRTQLIPKLIRLMLESKDLSIRVQTMVCLAKLLPHMEPWMVTDQLLPALPKITSKDPSVLMAVLGIYKIVHENTKFGINKEQCARSVLPYLISTAVEPTLNLQQFGQYMELVHQLIRRVETEQRHCLEQLSASQEEQRWTERSHSHFQSNEMNKTNQSNEMNKTNQSEVDLGDLARALSGTSANDGICNRTTDKR

SEQ ID NO: 141939 - protein, 97 aa, Heterodera glycines
  Coding regions on vcDNA: vcDNA=SeqID_68362; Strand=+; Position=1 -166,929-1056
  Homolog annotation: Hit_ID=AAK60209.1; Match level="QueryCoverage =97%, HitCoverage=42%, E-value=1e-37, Identity=82%"; Hit description =vap-1 [Heterodera glycines]
MPAGSNLIQQKYVTEGIETVAQNWANGCSMAHSDSSQRNGMGENLYMTSSSSISEADALKQACDMWWAELKQYGIQESLVLDREQFNKGIGHWSQAK

SEQ ID NO: 141940 - protein, 21 aa, Heterodera glycines
  Coding regions on vcDNA: vcDNA=SeqID_68363; Strand=-; Position=1 -3,466-528
MRNCVVIITVRNIDQYKWTVQ

SEQ ID NO: 141941 - protein, 76 aa, Heterodera glycines
  Coding regions on vcDNA: vcDNA=SeqID_68364; Strand=-; Position=1 -132,210-308
MFYFLLFSLIFYIGDSAYTKKQLKNCLGQCGLTFDPMPEVGTFRVKRALITTTSSYVENQDIVYVFFIKNMIFQKF

SEQ ID NO: 141942 - protein, 286 aa, Heterodera glycines
  Coding regions on vcDNA: vcDNA=SeqID_68365; Strand=+; Position=1-861
LNEKTWAKSEFVGTKEGSMSEVIRNFDEVVLSSKVKWLIVMAGKDSILAGESIDSIMEKVKRLRQLCSKFGHLKIFWLLPPFIFAKKNESEEFCARMRAFFRKKSEIELISVNEEGRSLLEVFRFGKSYNNEHVNQNGWMTEKGMKVMKAWLTSLVPGFPGDRELGIRTVKSKVVVPDVEQGSGPVDPPQIRYKGPVKNVGGGPGDPSPSPFDSFSDDGPTHSVRSVNVRNFGGEFSQFGRAGTAYRSAHRGGPSSSHYHPYQRARGGPVYHSTPSRRRSDFVPRR

SEQ ID NO: 141943 - protein, 31 aa, Heterodera glycines
  Coding regions on vcDNA: vcDNA=SeqID_68366; Strand=-; Position=1 -52,288-331
MEKACKIWRDYIDFSALELLELASSRLFLAF

SEQ ID NO: 141944 - protein, 24 aa, Heterodera glycines
  Coding regions on vcDNA: vcDNA=SeqID_68367; Strand=-; Position=1-149
KFLDFLFISLFDSESIREPYLTFN

SEQ ID NO: 141945 - protein, 109 aa, Heterodera glycines
  Coding regions on vcDNA: vcDNA=SeqID_68368; Strand=-; Position=1 -202,592-719
MIVLSVYPLLLLLLSLPVLHFSFSSSVSSISVSDQSPGLIRNSTDQQEIAPGLSSLTFVFDRTGSMNGFGSVSSRLIHLRFYGRPFQRLSLGGDRAQSDPGEAKLGVFK

SEQ ID NO: 141946 - protein, 191 aa, Heterodera glycines
  Coding regions on vcDNA: vcDNA=SeqID_68369; Strand=-; Position=1 -85,183-256,306-375,535-738,820-912
  Homolog annotation: Hit_ID=CAE73893.1; Match level="QueryCoverage =94%, HitCoverage=93%, E-value=6e-30, Identity=36%"; Hit description =Hypothetical protein CBG21493 [Caenorhabditis briggsae]
FFLPFFLCFGILSSFVSAHTCGNNRIPYGIEIYHNGMPSLLCSRPNCFDKMYADCDERATRKACDSKTDCDERATRKACDSKTTWVGGFDKALPLSLYLQCCEFEMLPTLSKELYSNVIIRPGEYFEGEEIMDKYGEEVIAFDLITNLRKINGDGTKNSTYSVYSVDIRRFHCDQTRPKRFKPWKWPQQIA

SEQ ID NO: 141947 - protein, 22 aa, Heterodera glycines
  Coding regions on vcDNA: vcDNA=SeqID_68370; Strand=+; Position=1-68
ASVKVEAADNPNLRINEADPML

SEQ ID NO: 141948 - protein, 27 aa, Heterodera glycines
  Coding regions on vcDNA: vcDNA=SeqID_68371; Strand=-; Position=1 -41,284-326
MSGSEPMSNEIINKFLSTIMIAFIFIN

SEQ ID NO: 141949 - protein, 95 aa, Heterodera glycines; identical to SEQ ID NO: 124528
  Coding regions on vcDNA: vcDNA=SeqID_68372; Strand=-; Position=1-657

SEQ ID NO: 141950 - protein, 28 aa, Heterodera glycines
  Coding regions on vcDNA: vcDNA=SeqID_68373; Strand=+; Position=1 -34,347-399
MLYFKKRLAILAKSADKLALQLDEKMEF

SEQ ID NO: 141951 - protein, 346 aa, Heterodera glycines
  Coding regions on vcDNA: vcDNA=SeqID_68374; Strand=-; Position=1-1038
MADDSNNNYFFVVLPSNVTDYVDNSTSKYRVHLPKPVQFRGSWVCGLYSIQYPHSWASTIGTVEDQWIDIHYIDGRLLRVHLPKSSQQNTEGLQRHLNGTLTTALSRKSTEDGQTPSIKRSKRSVDQGQQQSREETEKESKTGTMEINDEGERVPQDNRGVECIKIGKLTKCKRITPIAPEEEQNQESSSKDLPKDDDSSNDEGERVQQDNNAVECRKIGRLTKCKRIKPIVTENDNKNDGKDGEAVIDTKTSASDTTLKNSEITPPSNPSAQRQQQQHDEPRAQALTRGEQLGKRLRKTENEVQSQQKSPVNESLEAQTQFSDAKDQSETHADVFKDRLSTIHGD

SEQ ID NO: 141952 - protein, 305 aa, Heterodera glycines
  Coding regions on vcDNA: vcDNA=SeqID_68375; Strand=-; Position=1-918
MYANRFVLVPEEIYKGLTATATSGDPNLDFTRRALDEVKREHADPTTKNAHYNQELRRYLHLKKAYDERPVKVSIDNASAPVQQSEIPVVTPSQKKRAKRSIVDRRGRNKLSSSTPATSRRSSTSNGEVSFSTDIEENGGAETDSGSKIDTADSSWTSAKSAETTGTLRAESEVSSATKTATPEQRSKWINEFGVLFMANPGKYGVSADGGIRNQQGARIANSNIRRSLEWIFNVGTRATTKRPPGTSQIEQIFERERLLRAYLPQPQQQQGHQQKQKGSSSRPLIGKEEVAKFDPKLWKYTDKD

SEQ ID NO: 141953 - protein, 323 aa, Heterodera glycines
  Coding regions on vcDNA: vcDNA=SeqID_68376; Strand=-; Position=1 -492,921-1400
MDNKSLTSQLLPTVNFLVTTQGVTVHSDRLDTPRVVFFNDDGTICRQCRYNMDLDYLISKDGVYIHSSRLKGTEKFVPFDRVYDLPRFCAFRVRSRRIFKVPYIFSDSPLEKAMSSTVTSTTENPLIDNVERKKARFDSDSRDITTKNGEDEKPELTNRTDELNHRITNVQLHAGVPDAEMISSLTKPAMIILDDLLYSIDERYLAELFTKKAHHQNFGVVFISQDLFDRKLKVVRQNSMYIVLLRAPNSALAIRNLGVQLFPRQLDFFLDAYRQATRQKYSYLLIDLHPSSDPLLRLRTNIFKEDNSDTAIQQTIFLPKAGI

SEQ ID NO: 141954 - protein, 117 aa, Heterodera glycines
  Coding regions on vcDNA: vcDNA=SeqID_68377; Strand=+; Position=1 -72,117-398
MEGPDEDEFTIVGWDPEKKVVMDLEAAIHSAQTMERSFTLRTKNGMVEHNGHTVDTEIGAMETVQTSSIDTSPLFNTQPVRQSLPPISLLLSNIPQPVKSVLNNINNNSKCEIPFYE

SEQ ID NO: 141955 - protein, 48 aa, Heterodera glycines
  Coding regions on vcDNA: vcDNA=SeqID_68378; Strand=+; Position=1-149
LCNVTGHLDSGHLDSGHYDSGHLDSEVIWTEPDNWTVDITTESEFFYY

SEQ ID NO: 141956 - protein, 81 aa, Heterodera glycines
  Coding regions on vcDNA: vcDNA=SeqID_68379; Strand=+; Position=1 -88,188-345
MNVERQESETGLSIVAKLFLAYQEAKNYDFNLFTEMAKNTTTGLGTIMSILMARQGERTPPQNSWDELFVAKQPALNDLIG

SEQ ID NO: 141957 - protein, 27 aa, Heterodera glycines
  Coding regions on vcDNA: vcDNA=SeqID_68380; Strand=+; Position=1 -21,369-431
MFKNQYRDVLPNFYWKENAIFRHSNHV

SEQ ID NO: 141958 - protein, 76 aa, Heterodera glycines
  Coding regions on vcDNA: vcDNA=SeqID_68381; Strand=+; Position=1 -170,650-710
MIGRRVVEMKYYANDQQAKDYADHVTRFLRESKSRKCNAESTKKNSRSRVFGSFSLSKEKQIEYKLNTYVTQRMQN

SEQ ID NO: 141959 - protein, 128 aa, Heterodera glycines; identical to SEQ ID NO: 125618
  Coding regions on vcDNA: vcDNA=SeqID_68382; Strand=-; Position=1-387

SEQ ID NO: 141960 - protein, 95 aa, Heterodera glycines; identical to SEQ ID NO: 125597
  Coding regions on vcDNA: vcDNA=SeqID_68383; Strand=-; Position=1 -30,198-820

SEQ ID NO: 141961 - protein, 101 aa, Heterodera glycines
  Coding regions on vcDNA: vcDNA=SeqID_68384; Strand=-; Position=1-305
MPKADDSHVKSATVPEMTSSDHLIADEQKGTSGGKHTLLELLGIDPNQVQTYSADMPKAYDTCGKSTMAHVMASSDQRIAEEQKGMLGGKRTLSELLEEEH

SEQ ID NO: 141962 - protein, 113 aa, Heterodera glycines
  Coding regions on vcDNA: vcDNA=SeqID_68385; Strand=-; Position=1 -222,271-387
MSNNSTIAMPNNTTNSSPSELIFCSGIVLTYIELAVHPISLLSTFFFVVLIIKTSVFHANLKRILLGQSAGIVMFEMARITYVLIKVVAGNVFMQGPIVIQIFGLFGYILRNA

SEQ ID NO: 141963 - protein, 70 aa, Heterodera glycines
  Coding regions on vcDNA: vcDNA=SeqID_68386; Strand=-; Position=1 -80,137-267
MQQTDKGEEGKISLVASKDGLEMILGWKNGTQHRYIERKARPTSLQIFIDVGSVEVFSDQGEWSCTARIP

SEQ ID NO: 141964 - protein, 47 aa, Heterodera glycines
  Coding regions on vcDNA: vcDNA=SeqID_68387; Strand=-; Position=1-144
GILHKDNRWHNAVCECSGLIPLGDPLSLQTLWAFVYSMSNSVDEDGR

SEQ ID NO: 141965 - protein, 71 aa, Heterodera glycines
  Coding regions on vcDNA: vcDNA=SeqID_68388; Strand=-; Position=1 -66,145-294
MPQPQALTIIHLKKHCWTKRRRGQPPENDEENANDDESQQPYERSQTIPLLIMFIVYVFIGNVCFLLMSRT

SEQ ID NO: 141966 - protein, 73 aa, Heterodera glycines
  Coding regions on vcDNA: vcDNA=SeqID_68389; Strand=-; Position=1 -70,146-297
MLTLANFCQKFWMVGKELVGVQKKKFNFFGAIFVPSQKNTASFHSSMHKTIAFWTQTTTIRALWNVYKPFVGM

SEQ ID NO: 141967 - protein, 18 aa, Heterodera glycines
  Coding regions on vcDNA: vcDNA=SeqID_68390; Strand=+; Position=1-56
MQQRQRAEERTPSKDENT

SEQ ID NO: 141968 - protein, 211 aa, Heterodera glycines
  Coding regions on vcDNA: vcDNA=SeqID_68391; Strand=+; Position=1 -46,169-230,463-610,710-749,800-844,978-1030,1086-1142,1192-1236,1314- 1369
  Homolog annotation: Hit_ID=NP_510032.1; Match level="QueryCoverage =100%, HitCoverage=75%, E-value=6e-43, Identity=46%"; Hit description= reductase (29.2 kD) (XM767) [Caenorhabditis elegans] emb|CAA91943.1| Hypothetical protein M153.1 [Caenor
LKIGFIGAGKMAQALARTFVNLGRYPAEQLMASCPKARENEVIILSVKPMQIGKVTPEIAPHVKQSHLLISLALGKITVKGIRSFLPSNSRVVRAMPNTPAVVGAGVTAYTMGTPAVVGAGVTAYTMGDSNLVHNLFSTVGHSFETPTPEIQMDAIGALSGCGPSYVFSIIEGVFSIIEGLADGGVKMGLSRELGLSRELSIGAMTLLRAA

SEQ ID NO: 141969 - protein, 242 aa, Heterodera glycines
  Coding regions on vcDNA: vcDNA=SeqID_68392; Strand=+; Position=1 -233,358-532,581-898
MTFGNTAPRKYSISPEFEQIKFEKRVAETRVGQLNELLDNARELAEAFKRELQQRKEEMAHKDQRLQNLPKLEYFPRQRQLDELRQTLERERKSHSLLEESFLNLQREKSHLQDELVETLHRHGQKHEAMLAAMAESSQRESELNATVRQLQNEVLQFRKHSHGAMGLAPVGSATNSLSSALSTSSLLSSSTIALHNISIGESSIELEELSREELIRRCNELTERCKREIRSKNKEKQLKEE

SEQ ID NO: 141970 - protein, 419 aa, Heterodera glycines
  Coding regions on vcDNA: vcDNA=SeqID_68393; Strand=+; Position=1 -316,358-466,1301-1466,1512-1628,1678-1798,1846-2276
  Homolog annotation: Hit_ID=NP_507780.1; Match level="QueryCoverage =45%, HitCoverage=12%, E-value=6e-14, Identity=31%"; Hit description =predicted CDS, DNA polymerase type B, organellar and viral family member (5T899) [Caenorhabditis elegans]
MWPLRSTGNEKNSKNVPIFPLKRCYWYGCPSCFPDDAAIVGGGETAGALRARDAKRTRYIAREFEVEVVWECHLNAMLEDNPAMKAYFDNCPDSGPIDFHDAFFGGRTGPEYLGASVINPETGDWKSRTIKVKDFNSLYPSRNRLTKTEIVECHAELAKLLNDSKIEVSSIDQLTEKFWMVCYKAKDEHVVEHSTSNVAIALWTTSAARIHLLESLKKVYGPAPGVERYDTRILYMDTDSIFYDYLTRLGDPLPGGEQLGELADEYPNHTIMEFICAGPKAYGLWLRNNATGEDEYKLKVRGITLDSDACERITFEKMKDMVQNKLGQPDNNVRFNYPTKNFRITKKGEIFTVPLVKQFNPTVNKGVIRDHGLKVVPFGYSDEEWCKWNCPGACTCLFNSDLNVNMFTEEELNDPDIMP

SEQ ID NO: 141971 - protein, 183 aa, Heterodera glycines
  Coding regions on vcDNA: vcDNA=SeqID_68394; Strand=+; Position=1 -121,171-601
DTDSIFYDYLTRLGDPLPGGEQLGELADEYPNHTIMEFICAGPKAYGLWLRNNATGEDEYKLKVRGITLDSDACERITFEKMKDMVQNKLGQPDNNVRFNYPTKNFRITKKGEIFTVPLVKQFNPTVNKGVVRDHGLKVVPFGYSDEEWCKWNCPGACTCLFNPDLNVNMFTEEELNDPDIMP

SEQ ID NO: 141972 - protein, 471 aa, Heterodera glycines
  Coding regions on vcDNA: vcDNA=SeqID_68395; Strand=-; Position=1 -558,843-1425,1472-1746
  Homolog annotation: Hit_ID=CAE56395.1; Match level="QueryCoverage =57%, HitCoverage=36%, E-value=6e-43, Identity=37%"; Hit description =Hypothetical protein CBG24082 [Caenorhabditis briggsae]
MYNQQLRRYLKMRKEHKERPVRVQLSNGAQLLNKTVETGVQVRPGPDEPKDKSVMVTDEDEEEEIEVPKFLTPTSPTQGSSRSPRTNKKAAKQQKLIEKKDHLLAIIMSDPQRFGATDRGKIINPKTGREFIDSDLAWSIERLVDPRPENAPSPRGTKELKRKLAQNPLASSLLNRLFVGSGFVGQGSDVQADLADFQALSRKNSGYRYLLLAVDVLSRRMFGAPVKSKRPADMKRAFEELFEQMPRVPDTLYTDRGLEFVAKPLKEFYAEKGIQKFETSSKKKAAVAERAIRTLKTRLYKYFSANNTSVWVDVLPKFLSAINNSVCRATGLRPNEISDANAREVWKRVYGEGLAQLDKTPKIRAGETVRIPEPKHIFEKGYIPNYSDHVYTVDEARSTNPQHYLLKDYYGTKLKRKFYLPELTKVQVDENTMYRIEKKYKERVRDGKREILVKFIGFPEKYWVKNDEINE

SEQ ID NO: 141973 - protein, 158 aa, Heterodera glycines
  Coding regions on vcDNA: vcDNA=SeqID_68396; Strand=+; Position=1 -33,85-526
  Homolog annotation: Hit_ID=AAS00714.1; Match level="QueryCoverage =91%, HitCoverage=25%, E-value=4e-11, Identity=25%"; Hit description =serine-aspartate repeat family protein [Staphylococcus capitis]
MRDTDKKKKKEEIIAAGTNNVVSEQQQDGVPGDEHSDSDNSTEERAQNGVPGDEHSDNATEERAQNGVPGDEHSDNATEERAQNGVPGDEHSDSDNSTEERAQNGVPGDEHSDSDNSTEERAQNGVPGDEHADSDNSTEERAQNGVPGDEHSDNATEE

SEQ ID NO: 141974 - protein, 91 aa, Heterodera glycines
  Coding regions on vcDNA: vcDNA=SeqID_68397; Strand=+; Position=1-497
LFEYPKRTLEKIDFFVFGAVPPNRCAQIYGETESFGNSFPIVCTLILRWIFAPHNCLSTPNGHLNKSIFLFHKYFFRKCSKAHQILFTSQF

SEQ ID NO: 141975 - protein, 43 aa, Heterodera glycines
  Coding regions on vcDNA: vcDNA=SeqID_68398; Strand=+; Position=1 -104,270-297
MHDDILHNVGLDSRAAIPTSSCRRTAVIISLHFGLHKNSQKSA

SEQ ID NO: 141976 - protein, 57 aa, Heterodera glycines
  Coding regions on vcDNA: vcDNA=SeqID_68399; Strand=-; Position=1-171
MATPPKANALVEAAGKFNKLFIMPPNRPTRIKKAMNILFGRTEEEKRVTGNFVSRIA

SEQ ID NO: 141977 - protein, 36 aa, Heterodera glycines
  Coding regions on vcDNA: vcDNA=SeqID_68400; Strand=-; Position=1 -85,484-509
MRKAKCETPKNANNAKGEMRKAKPRPIPGNDKFQPG

SEQ ID NO: 141978 - protein, 42 aa, Heterodera glycines
  Coding regions on vcDNA: vcDNA=SeqID_68401; Strand=+; Position=1-597
SVEQLFQNKFEYISLLCIFSVHYKIKSFFVLILLFNYFLLTK

SEQ ID NO: 141979 - protein, 294 aa, Heterodera glycines
  Coding regions on vcDNA: vcDNA=SeqID_68402; Strand=-; Position=1 -77,888-1317,1480-1811,1963-2008
MGLKLFLILKMSDNPKEEEKQMDKEIYIDHNVVVFLCRFLPIFASYGTNFAIQTESDRVLAFVVRNIWPMLRSEIRAIEFTHHNNLHHFRQSSSSILRDCQTLHSVFSYGQFPAFPADDSATATDCQALAKWLLCSPPRPDGSPRMFHCELESTEQEYQLAPKIDEFKAAFLYASSPANFIINICLVSLAHTSILPFDLTNDLTGERMVLTKTVLEYGQYGTITVPEYVTKFVMVRSPMCRDENKWAKWEKEAEEWEDNMNQRNRNLIEIDVNEENLDDGLLNTITSPNDQQQK

SEQ ID NO: 141980 - protein, 806 aa, Heterodera glycines
  Coding regions on vcDNA: vcDNA=SeqID_68403; Strand=-; Position=1-2419
  Homolog annotation: Hit_ID=NP_491240.1; Match level="QueryCoverage =96%, HitCoverage=57%, E-value=1e-176, Identity=41%"; Hit description= zn-finger, CCHC type and RNA-directed DNA polymerase  and Integrase, catalytic domain containing protein
HPLPRPDDIFNALRGATVFSQIDFKDAYLQVELDEESKQLVGLNTHRGLFQYQRLPFGVKSAPSIFQKLMDELTSGLEGVFVYLDDFIVASTTTEKHFQILSKFFKRLQDWGLRVKINKCQFLCTELKFLGHVISADGIRPDPDRSRSIKEMPAPSDQRTLRSFLGAINYYSRFVSQMRDIRAPLDELLKKDKEWNWGPEQQQAFENAKQIITSDLLLTHYDPSKPIVVAADASSKGIGATISHVFADGKEKVVEHASRSLSPAERNYSQIEKEALAIIFAVQKFHRMLYGRKFTLLTDHKPLISIFGSKNGIPIYTASRLQRWALTLSNYDFKIKYISTKDFGQVDVLSRLIMQHREAQQDDDYVIATAQTNSDFNSSSEDSIEHGTAAVEYVLHATLDQLPVTATEVAEKTNQDEELLEVLQNCRNHWPKTAHSSPLSAFYTQRARLTEVDGCLLMGDRVVIPSSLRNRILTALHFTHPGIVRMKSLAKQFVYWPRMDLDIDRWVRNCQECLSAAKMPPKVPLSPWPSPSEVYERLHMDFAGPCADGNKYLVVVDSYSKWPEIFKMKTTTARILVDKFIWLFSRYGYPKEIVTDNGQPFKSFEISKFCREHGIRHTFAPPYHPMSNGRAERFVDTLKRQLKKCGETDSHWVQNSLLAYRSTPNASLNGKTPAEFFLGRPVRTILSLVRPNEKKKHSDTTDKQYRHKMAQQFNRHYGTKERTFCTDNPVQFANYRNGSKMWLSGRIVSGNGVVWRIYSPQLNAVVTRHSNQIRKSFPIPYRDSSEPNEQQDQNEQQQEAPQSPRH

SEQ ID NO: 141981 - protein, 111 aa, Heterodera glycines
  Coding regions on vcDNA: vcDNA=SeqID_68404; Strand=-; Position=1 -58,196-305,597-764
MSELNFQIWCFSFKTNTADARKYNISGLISRCLKIPISNLSNVFLAIAQARLFDLENFSHQCLRYICQNAGQLFGSEEFLQIDQNLLCELFDRDQLVVSNEFEIWKAVILT

SEQ ID NO: 141982 - protein, 142 aa, Heterodera glycines
  Coding regions on vcDNA: vcDNA=SeqID_68405; Strand=+; Position=1-429
MMELKMVAETDQPANKCLLLTVQHAFPKSAIFTLISLFIGQKTLSSHAEDGDVCPLRIGTRALSAAIRATSRGSSATRTFGNGWKVRESKGRRGGHLRLNVRVNNAAFAVQIGETLKNRGERHLKCGREIDILSFWPLFLFK

SEQ ID NO: 141983 - protein, 18 aa, Heterodera glycines
  Coding regions on vcDNA: vcDNA=SeqID_68406; Strand=+; Position=1-56
ILFDRARQEKATVGTKFA

SEQ ID NO: 141984 - protein, 212 aa, Heterodera glycines
  Coding regions on vcDNA: vcDNA=SeqID_68407; Strand=-; Position=1 -201,842-1089,1142-1329
  Homolog annotation: Hit_ID=NP_491393.1; Match level="QueryCoverage =66%, HitCoverage=61%, E-value=1e-21, Identity=45%"; Hit description =C.Elegans Homeobox (26.7 kD) (ceh-17) [Caenorhabditis elegans] gb|AAK18908.1| C.elegans homeobox protein
DPCAILHFRRPSQRHTEQFSDLTPNSQFSVSHSLAAAAAASLTPFMGFASNGLYGMSAAAPGLMYGQNGPFHPYNNNSNPSSSSNSSVPSSSSSSAAMSSLFIGGSALSPYKLPPQQHNPSSSSIKLSFGSASVPSADHSLLCSASLSAGINPNERRKQRRIRTTFTSAQMRELENTFTETHYPDIYMREDIAMRIDLTEARVQVEHRETKK

SEQ ID NO: 141985 - protein, 27 aa, Heterodera glycines
  Coding regions on vcDNA: vcDNA=SeqID_68408; Strand=-; Position=1 -24,272-331
MTGFFSNGANENYIFIAAGKCVSGKMQ

SEQ ID NO: 141986 - protein, 24 aa, Heterodera glycines
  Coding regions on vcDNA: vcDNA=SeqID_68409; Strand=+; Position=1-73
MDGRSDFNKVLSADKMPVRAKAAS

SEQ ID NO: 141987 - protein, 120 aa, Heterodera glycines
  Coding regions on vcDNA: vcDNA=SeqID_68410; Strand=+; Position=1 -105,723-836,888-1028
  Homolog annotation: Hit_ID=NP_995657.1; Match level="QueryCoverage =83%, HitCoverage=21%, E-value=2e-14, Identity=43%"; Hit description =CG13384-PF, isoform F [Drosophila melanogaster] ref|NP_723386.1| CG13384-PE, isoform E [Drosophila melano
MTVFPMIAEFSLMPQLLCYKWASVYSNMTSSLRTFGQAMVLPMENKMRFPGEMVSRVGVLSTGMALTAIFDAAVGFLGYAKFGEHIQGSVTLNLAPTPLLVLVRLIFTAISFLDFLLQQY

SEQ ID NO: 141988 - protein, 46 aa, Heterodera glycines
  Coding regions on vcDNA: vcDNA=SeqID_68411; Strand=+; Position=1 -68,231-283,603-622
MAWHSTTDIGCGVAKCQDAQWKLGNVLGQTIYGSGDTCSVSLTSGY

SEQ ID NO: 141989 - protein, 142 aa, Heterodera glycines; identical to SEQ ID NO: 126125
  Coding regions on vcDNA: vcDNA=SeqID_68412; Strand=+; Position=1 -132,394-690
  Homolog annotation: Hit_ID=CAE64315.1; Match level="QueryCoverage =64%, HitCoverage=40%, E-value=5e-22, Identity=57%"; Hit description =Hypothetical protein CBG08993 [Caenorhabditis briggsae]

SEQ ID NO: 141990 - protein, 35 aa, Heterodera glycines
  Coding regions on vcDNA: vcDNA=SeqID_68413; Strand=+; Position=1-187
DQKRPRFCESIKKTRKSTAMMLTPVILNLKFFINF

SEQ ID NO: 141991 - protein, 65 aa, Heterodera glycines
  Coding regions on vcDNA: vcDNA=SeqID_68414; Strand=-; Position=1-199
DGTLLLSKVEVEEDSERSAWKTDDEDEGDDDEHGIEEEEKLEEDGRGATTEATTREGDNTKTNKQ

SEQ ID NO: 141992 - protein, 333 aa, Heterodera glycines
  misc_feature (81)..(81): Xaa can be any naturally occurring amino acid
  Coding regions on vcDNA: vcDNA=SeqID_68415; Strand=+; Position=1-1015
  Homolog annotation: Hit_ID=AAL40415.1; Match level="QueryCoverage =91%, HitCoverage=29%, E-value=3e-54, Identity=40%"; Hit description =endonuclease/reverse transcriptase [Branchiostoma floridae]
LYDSISLHIKIQLLKFHSQLEQKAISIWKKFFLNIYKNMIFEIPNLVFENKCYHNDQEKCELFANLFVNSFNNSELIQAFXAWTTLVNQSFISDIEFNIIETQKLLRKLPNKNGTSPDNISYKTLKNCHPSLATVITDLFRISLDSGSLPDIWKESIVFPLFKKGDKFNSENYRPISLTCSLCRVMERILSKNIYNYLLKKNKISEYQFGFVRNRSTTSQLITVVEDWYDAIINGKNVDCIYIDFQKAFDSVPHNLLLYKLEKIGIRGKLLMWIKSFLSNRTFHVKIGDALSSNKKVDSGVPQGSVLGPLLFLVYINDLPGCLPSGVKILYAD

SEQ ID NO: 141993 - protein, 99 aa, Heterodera glycines
  Coding regions on vcDNA: vcDNA=SeqID_68416; Strand=-; Position=1 -3,628-924
MGHTTSIIQRLWFPGAWPCRPLHRRSGRLGPAVDRHSRIRDVSAVHGVAISAPATTEGGRGGHGRLRRRRRRVGRGRKGRGRREGVKRERRRRAKQCAD

SEQ ID NO: 141994 - protein, 47 aa, Heterodera glycines
  Coding regions on vcDNA: vcDNA=SeqID_68417; Strand=-; Position=1 -135,291-299
MTTKQQRSDNNDGTAATVAGRRRNDSSNCTAECHQHGQPNDVHDKKD

SEQ ID NO: 141995 - protein, 92 aa, Heterodera glycines
  Coding regions on vcDNA: vcDNA=SeqID_68418; Strand=-; Position=1 -17,84-345
  Homolog annotation: Hit_ID=NP_955136.1; Match level="QueryCoverage =81%, HitCoverage=43%, E-value=2e-15, Identity=51%"; Hit description =CNPV113 thymidine kinase [Canarypox virus] gb|AAR83459.1| CNPV113 thymidine kinase [Canarypox virus]
MFSGKTTELFRLAQRYILAGRKVAVVKYALDTRYDESHACTHDKRKMEAISATKMEDAFEELNKFDVIGIDEGQFVGFFPPLIYHIWHFHLC

SEQ ID NO: 141996 - protein, 119 aa, Heterodera glycines
  misc_feature (84)..(84): Xaa can be any naturally occurring amino acid
  Coding regions on vcDNA: vcDNA=SeqID_68419; Strand=+; Position=1 -130,203-476
  Homolog annotation: Hit_ID=NP_955136.1; Match level="QueryCoverage =78%, HitCoverage=57%, E-value=3e-16, Identity=43%"; Hit description =CNPV113 thymidine kinase [Canarypox virus] gb|AAR83459.1| CNPV113 thymidine kinase [Canarypox virus]
VIVIGYKIILVSLPPNNDIPRTELFRLAQRYILAGRKVAVVKYALDTRYDESHACTHDKRKMEAISATKMEDAFEEIWHFHLCXFKDIVKYAQELANTGKTVIIAALNGDYRQEVHRRR

SEQ ID NO: 141997 - protein, 92 aa, Heterodera glycines; identical to SEQ ID NO: 129555
  Coding regions on vcDNA: vcDNA=SeqID_68420; Strand=-; Position=1-304

SEQ ID NO: 141998 - protein, 101 aa, Heterodera glycines
  misc_feature (87)..(87): Xaa can be any naturally occurring amino acid
  Coding regions on vcDNA: vcDNA=SeqID_68421; Strand=-; Position=1-305
MIGRAVRNRPFIFEGIFKFILYPRKMSISFFEKFYTSQKRLRMRRRAVHNRHFISQRIFIFRGYPRKMDISFFDKFYTHTNALEHDXGGRCAIDLLFLREF

SEQ ID NO: 141999 - protein, 133 aa, Heterodera glycines
  Coding regions on vcDNA: vcDNA=SeqID_68422; Strand=+; Position=1 -81,130-447
MCYYAISFYFINVIVHFFIAISSATSPVEDNALLAFMKSYGLHKQNEIQTGEYSAQKYEAHLGIVYFMRENWQCAKIWDKFDEFEQGECQKYRKYLEILYEYLFTEYIGMPAVKRKFVFEKFKFEIEGPIIYA

SEQ ID NO: 142000 - protein, 18 aa, Heterodera glycines
  Coding regions on vcDNA: vcDNA=SeqID_68423; Strand=-; Position=1-54
MRTRPIWQVKQRLLTSQK

SEQ ID NO: 142001 - protein, 71 aa, Heterodera glycines
  Coding regions on vcDNA: vcDNA=SeqID_68424; Strand=+; Position=1 -153,369-431
MQRQKDGGVPCEEALHQVLGLYRVTPHPATNSSPAEKLFGRKLRTMLDLVRNIMKPKTHVSPIQSIPNLFL

SEQ ID NO: 142002 - protein, 139 aa, Heterodera glycines
  Coding regions on vcDNA: vcDNA=SeqID_68425; Strand=+; Position=1 -97,270-500,1207-1295
MEKIMIESKMVSILQNNETFLERFNVVSISPTTWGVFCACVSIVAVFVLFFKGLPFFWQFQEGERKMTEKLEQTFCAIGWTFATCNGRFSPIPSLRKPKDNLVNKTLMDVSSNVNSQRQILPKLVTELDLELTRFGEFQ

SEQ ID NO: 142003 - protein, 211 aa, Heterodera glycines
  Coding regions on vcDNA: vcDNA=SeqID_68426; Strand=-; Position=1 -322,756-1055,1220-1233
MEILKKKIFFPQELRDVLAAREQRLVGELSQCRTDGQRYFDARFATLHALIADSGKAKSSAKASFVSRMEKFNAKKTDDLEVALTARFLCDNNASSAISVAISQLGTVPAVSAVEPTPTPAAVITQNGDNHNINNNNNKRCGEASSNKTVAPAAAAAAVSTNAAAPPHPPPPARNENVVKRSNSPSSLVSSVGEDSGLGGQISPVNHDKQK

SEQ ID NO: 142004 - protein, 196 aa, Heterodera glycines
  Coding regions on vcDNA: vcDNA=SeqID_68427; Strand=-; Position=1 -97,879-944,1473-1899
  Homolog annotation: Hit_ID=NP_491063.1; Match level="QueryCoverage =58%, HitCoverage=36%, E-value=8e-15, Identity=40%"; Hit description =serine-rich spermatocytes round spermatid protein like (32.2 kD) (1D445) [Caenorhabditis elegans] gb|AAF3
MAAVAAQPKVEKKIMDEKIAKVREVVKNISTNDIVLALHNFELDVARTIHAFCEGGSEVALGDWERTGGAKKRNQKKKSSSKGGAAIANASSLSHQSNNSGTTTPSVASSLVNCSNVSSATNLADKLLLTNGSGPAATALPTNASVGVVTHQQLQQQQPSLLLNERGNDGVADCEEKSFSTTQNHHHNHQQQPQKH

SEQ ID NO: 142005 - protein, 33 aa, Heterodera glycines
  Coding regions on vcDNA: vcDNA=SeqID_68428; Strand=+; Position=1-99
MTDEPETKDQLIYLIIVCEKARRFDDMVEAMKK

SEQ ID NO: 142006 - protein, 154 aa, Heterodera glycines
  Coding regions on vcDNA: vcDNA=SeqID_68429; Strand=+; Position=1-465
  Homolog annotation: Hit_ID=NP_702063.1; Match level="QueryCoverage =77%, HitCoverage=2%, E-value=5e-11, Identity=24%"; Hit description =hypothetical protein PF14_0175 [Plasmodium falciparum 3D7] gb|AAN36787.1| hypothetical protein [Plasmodium
MNDKIDWLGRFAASHPILGFFSNRRDSIHQHSITGTQSTSISITGTQSTNIPINGTQSTSIQSLGLNSPAFQSLGLNPPTFQSTGLNPPAFQSLGLNPPTFQSLGLNPPAFQSVGLNPPTFQSTGLNPPAFQSLGLNPPTFQSLGLNPPAFQST

SEQ ID NO: 142007 - protein, 93 aa, Heterodera glycines
  Coding regions on vcDNA: vcDNA=SeqID_68430; Strand=-; Position=1-282
MAKCFPWVQLRLIGQPSLELDEDFDEEFELFKRYQMQVHRERASDLTPDAFRRFLASSPLFPSPPHEGQQQQQVEGAEDILALIRTLPPILPI

SEQ ID NO: 142008 - protein, 184 aa, Heterodera glycines
  Coding regions on vcDNA: vcDNA=SeqID_68431; Strand=+; Position=1 -432,2158-2280
  Homolog annotation: Hit_ID=CAE64783.1; Match level="QueryCoverage =75%, HitCoverage=63%, E-value=1e-29, Identity=42%"; Hit description =Hypothetical protein CBG09576 [Caenorhabditis briggsae]
MLIRCQCEPIKPQCPPGPPGPPGEHGIDGQPGQHGMPGKDYTLVYMPSAVCPVMDYSQCMPCPSGPPGPPGPPGSQGRPGCEGEPGEGGRLGKHGAPGKEEFGKVFNRVLGQRGMAGEAGLPGLPGLPGLPGAAGEDAEFAPTLIVGRVIALSTFLFAMYIFRMDERFIRLCENIMKEIDDDDH

SEQ ID NO: 142009 - protein, 35 aa, Heterodera glycines
  Coding regions on vcDNA: vcDNA=SeqID_68432; Strand=+; Position=1 -46,139-198
PLELLLPLTFCCLDIESQKTLFDVNLALNPSKRSL

SEQ ID NO: 142010 - protein, 95 aa, Heterodera glycines
  Coding regions on vcDNA: vcDNA=SeqID_68433; Strand=+; Position=1-285
MTDCEHHSVPPSAPPVDFCPSSPPPSYASSPTAPRNNANDRQQQNTAKGCFLPSCKNAKRATKENDAGGTEPSQPTSATVVVPMAKDKVTILCLG

SEQ ID NO: 142011 - protein, 62 aa, Heterodera glycines
  Coding regions on vcDNA: vcDNA=SeqID_68434; Strand=-; Position=1-220
ALFPNLAPIIPRHISLAPALIHSRIITICKTTVSTVPSFARLTVVLTTVPRVSTVVGSLNAE

SEQ ID NO: 142012 - protein, 20 aa, Heterodera glycines
  Coding regions on vcDNA: vcDNA=SeqID_68435; Strand=+; Position=1-60
LNNFTDSFAPFMCFYFPFKS

SEQ ID NO: 142013 - protein, 25 aa, Heterodera glycines
  Coding regions on vcDNA: vcDNA=SeqID_68436; Strand=-; Position=1 -19,194-252
MVIFDKKRAENSWLEDLMVILTKVK

SEQ ID NO: 142014 - protein, 68 aa, Heterodera glycines
  Coding regions on vcDNA: vcDNA=SeqID_68437; Strand=-; Position=1 -10,50-148,242-339
MNESISNLVDTLRAGIDTLYRAMNTGPSTSTVPKKRKNSTAPEEEEKKKPEGEGGNEHGKGGGEKEKP

SEQ ID NO: 142015 - protein, 20 aa, Heterodera glycines
  Coding regions on vcDNA: vcDNA=SeqID_68438; Strand=+; Position=1-61
RAHEQLNRMQVPPVAVRLTV

SEQ ID NO: 142016 - protein, 235 aa, Heterodera glycines
  Coding regions on vcDNA: vcDNA=SeqID_68439; Strand=+; Position=1 -143,230-376,431-472,575-739,785-904
  Homolog annotation: Hit_ID=NP_498671.1; Match level="QueryCoverage =90%, HitCoverage=24%, E-value=1e-34, Identity=41%"; Hit description =tyrosine specific protein phosphatase and Purine and other phosphorylases, family 1 (3I730) [Caenorhabdit
SFSDARFFHSELPRFLPLQTVVLFHLGLSTLNTDFKEQFGDVKFVCFVCTGGSSTRMSEYAKFFSAMANVASGGNLCNRTDRFVMFKTGPVLWANHGIGMPSASILLCEHGIGMPSASILLCELFKLLRLACCADVLFIRLGTCGGIDVKPGTVIISNGVVNAAMENKFVQWIQGKEVKRDALLDAQLGDDLFDTVKRDALLDAQLGDDLFDTATEMHLPVDRGLTFCTDDFYEG

SEQ ID NO: 142017 - protein, 104 aa, Heterodera glycines
  Coding regions on vcDNA: vcDNA=SeqID_68440; Strand=+; Position=1-315
MQMDLVQIDFKMGKLLQALRMTGFGLHKSVAQHKYEELKSKMEQKKRGGKLGIIDVCQLWSCAEDIKKISQLMNKTISNIKKEINNAEQLLKRSKKFDLTIINY

SEQ ID NO: 142018 - protein, 87 aa, Heterodera glycines
  Coding regions on vcDNA: vcDNA=SeqID_68441; Strand=-; Position=1 -126,207-243,312-411
  Homolog annotation: Hit_ID=NP_509693.1; Match level="QueryCoverage =100%, HitCoverage=3%, E-value=3e-25, Identity=58%"; Hit description =glutamate synthase (XK721) [Caenorhabditis elegans] emb|CAA90070.1| Hypothetical protein W07E11.1 [Caenor
MVLISQKQFDELSTQSLWRPQLEKDACGVGFCVSVRGIPTHKILQEGRVMLERMVHRGACFCDDDSGDGAGVMTAIPDKLYRDELKK

SEQ ID NO: 142019 - protein, 76 aa, Heterodera glycines
  Coding regions on vcDNA: vcDNA=SeqID_68442; Strand=-; Position=1 -114,519-632
  Homolog annotation: Hit_ID=NP_508412.1; Match level="QueryCoverage =52%, HitCoverage=8%, E-value=4e-09, Identity=70%"; Hit description =vacuolar atp synthase (54.2 kD) (XC857) [Caenorhabditis elegans] gb|AAA91266.1| Vacuolar h atpase protein
MVTEQNGATFAVDVEEIAAGHHVTPVDMTTATSKLQLEEDKSRVEIFHDYARRQKRTIWSWFQGILTRNDSFIVNQ

SEQ ID NO: 142020 - protein, 94 aa, Heterodera glycines
  Coding regions on vcDNA: vcDNA=SeqID_68443; Strand=-; Position=1 -16,63-165,404-486,616-698
  Homolog annotation: Hit_ID=XP_311435.1; Match level="QueryCoverage =100%, HitCoverage=95%, E-value=1e-18, Identity=45%"; Hit description= ENSANGP00000018599 [Anopheles gambiae]
MVCEKCTKKLSKLATVHVEKSDQTAKRVTNENKLLSSKQKFKPASEEFKKCRICNKMTHHISAYYCQDCSYQKGICPMCGRKQIETAKYRQSLT

SEQ ID NO: 142021 - protein, 276 aa, Heterodera glycines
  Coding regions on vcDNA: vcDNA=SeqID_68444; Strand=-; Position=1-828
MSAKIIRVPKIACDLSLAKNGVSKNRNYAQKASQTILAHPIPSTIAFIHPIMNAKIIRVPKIACDLSLAKNGVSKNRNYAQKASQTILALPIPSTIAFIHPIMSAKIIRVPKIACDLSLAKNGVSKNRNYAQKASQTILALPIPSTIAFIHPIMSAKIIRVPKIACDLSLAKNGVSKNRNYAQKAPQTILALPIPSTIAFIHPIMSAKIIRVPKIACDLSLAKNGLSKNRNYAQKASQTILALPIPSTIAFIHPIMNAKIIRVPKIACDLSLAKNG

SEQ ID NO: 142022 - protein, 31 aa, Heterodera glycines
  Coding regions on vcDNA: vcDNA=SeqID_68445; Strand=-; Position=1-93
MGSKNPTQNKSTGYREAIPEGFGLPINLGAS

SEQ ID NO: 142023 - protein, 17 aa, Heterodera glycines
  Coding regions on vcDNA: vcDNA=SeqID_68446; Strand=+; Position=1-51
KIFNSFLNRPKSLGLTF

SEQ ID NO: 142024 - protein, 1125 aa, Heterodera glycines
  Coding regions on vcDNA: vcDNA=SeqID_68447; Strand=+; Position=1 -350,550-3536,3666-3706
  Homolog annotation: Hit_ID=NP_508324.1; Match level="QueryCoverage =53%, HitCoverage=22%, E-value=1e-65, Identity=30%"; Hit description =predicted CDS, peptidase family A16 and RNA-directed DNA polymerase and Integrase, catalytic domain and Z
MTAPIQALIRGCASKLGALLGTEIPPDLGINALPNQCQRRLYKFRNLLNDLERVVQKIEDNLGLANEYIGKLSRDNAIRKETEMQELMQELQINEKQKAADVLIPILRDKIEALEESYLDSCIEGKASAIIQGIPISESGYDDAIDLLLKTYGETKRLIRTLNREFMSLPISESLEDDESLYLKSEKIFRQLISMNQNVEDGMYYSNLEGKMSPAEVLDKYCVIKDAEENDDWDTSKFRNAFSRALDQIKHRQELRKNVIEPKRDKHELTMSFTAFSKNDKYQGRNKFPQRNSDQSPPRGRKFEPRKFRDQRHDNSDSSVSHSPMRDRRNSPYPKRDWSSSPEREKRKKDEQRKCQLCQGEHSASKCPKYMDALSRRNKVLKMELCFICLRTGHWASQCTLKGYKCNICNRAGHHISLCRSKDIPKDRRNSSSESSPVRSKINTTQDFSESEEVEKEITSVTSCVTSKTTKLSLLKCKYVTIYNPENPRQRKRILVFMDDGSQKTYISTKLAQFLGLKPIGNQRFELSGLSNVELGKFESPIYEFGLKKGNFDILMKCRALDKILKKIPVIELNQLSQEQLRKTKLKVPEVYGEPDLIIGNDYYNRLSISVLEELQSGLYINDSNIGQFLSGQGKVQFFKSLNGSQSDISSSVIHHTVNQKCGNDIQWIIGQVSDSNHEGSVEWELNGDQLSPNDLNKMIMDWNGLEHVGMSDLNSDKQNVRQRMIDKISFNGDRYQTELLWDEELAAQLPTNYDMAFRQLMSNLGRLRKTPDLLRQIHEIIMEQVETGFIEECEPLPIEERYLVGSKVHYLPHHPVVKETSEHTKVRIVYNASARCRGGLTLNQVLEKGDNDYNDLAGILIRSRIKPILLTCDIAKAFHQILIHPKDRNAMRFLWVRDPYVEDSPLMEYRFTRVTFGVICSPAHLSLTIKLHLSKYKDKKVREIERDIYVDNIILGLERAEEIQSYYSLLKEIFSKAGMNVREFVSNCTKEIEKLPSEDQVVKGGVKLLGIKWDINNDTLVIHFPVFKSEKLTRRKVLAQIAKPFNPNGFAAPAILPAKLFRQRVETNKKLKWDTSLSNEELNEWITLMKDWENQSITVPRNIIPKEMIKNSIIPSKYRTIPIL

SEQ ID NO: 142025 - protein, 65 aa, Heterodera glycines
  Coding regions on vcDNA: vcDNA=SeqID_68448; Strand=+; Position=1-197
VGNYDCVPNGTANSTLVAVYMEPLFHIRLYNMAMFAWMCAATASFAFLYWNGRRKAKRTTTAGAK

SEQ ID NO: 142026 - protein, 118 aa, Heterodera glycines
  Coding regions on vcDNA: vcDNA=SeqID_68449; Strand=+; Position=1-403
FNKNRNYAQKASQTILALPIPSTIAFIHPIMNAKIIRVPKIACDLSSLEKNGLSKNRNYAQKGSQTILALPIPSTIAFIHPIMNAKIIRVPKIACDLSLEKMVQVKIVITLKKLLKQF

SEQ ID NO: 142027 - protein, 173 aa, Heterodera glycines
  misc_feature (11)..(11): Xaa can be any naturally occurring amino acid
  misc_feature (32)..(32): Xaa can be any naturally occurring amino acid
  misc_feature (151)..(151): Xaa can be any naturally occurring amino acid
  Coding regions on vcDNA: vcDNA=SeqID_68450; Strand=-; Position=1 -284,642-889
  Homolog annotation: Hit_ID=NP_498863.1; Match level="QueryCoverage =90%, HitCoverage=24%, E-value=3e-31, Identity=44%"; Hit description =GTP-binding protein LepA like (3J519) [Caenorhabditis elegans] gb|AAA28191.2| Hypothetical protein ZK1236
LPWKEYLFVGXYIFPLEFLEPMYLVSIVTPAXYFSNIERLCQNARGEVLETTYIDEKRMILRWRLPLVEIIVDFFDKLKLTTSGFASFDQKDDGYRDCRLEKICIFVNDKPIDELSALCPGVNAKAKAAEIVKKLADEIPQHQFEVMVKAXGTSKAVAQRTVRMKKDFTGVLK

SEQ ID NO: 142028 - protein, 192 aa, Heterodera glycines
  Coding regions on vcDNA: vcDNA=SeqID_68451; Strand=-; Position=1 -395,437-617
  Homolog annotation: Hit_ID=NP_493879.1; Match level="QueryCoverage =52%, HitCoverage=24%, E-value=2e-14, Identity=39%"; Hit description =transposase family member (2B289) [Caenorhabditis elegans]
MESFCCVCKAIYGGSHNCSVCKLPCHTFCGDSGGVENEGFGGMVVCHNCVNEGNAPIAEGSENDDYEPQNEENEGTQAKDKKRHRNNDATKKLDAVEWAQENSIHSAARKFKVDRKQIKNWMAHENKLRNQIMTPNGGKRMRLGGAGRPVQRPDIDIAMAEWITEKRKNKLPVSRNIIRRMATSLFIDTDIK

SEQ ID NO: 142029 - protein, 152 aa, Heterodera glycines
  Coding regions on vcDNA: vcDNA=SeqID_68452; Strand=-; Position=1 -202,252-433,665-739
MKNLKTKLKVSPMLNKQTNAFKGPSKVRSPVEVADVEIGPFKAMLRYIYLDDLNGLNDDTLFEVLFVAKKYKVNGLIKACADFPIWKLRNVFIAYSKANSLGEKVTIIITYLSNQIFMATFECQNDILANRGYIGLSNDTNNVGFGWQRKKL

SEQ ID NO: 142030 - protein, 68 aa, Heterodera glycines
  Coding regions on vcDNA: vcDNA=SeqID_68453; Strand=+; Position=1-205
MLTSNLKILVISFFIAFILTTTQSLGQNDGDTNDGEGDEDDDNPLVKREDNVVLLNADGETDVLKQSP

SEQ ID NO: 142031 - protein, 24 aa, Heterodera glycines
  Coding regions on vcDNA: vcDNA=SeqID_68454; Strand=+; Position=1-74
CTCGVVVKLSTFHNFSPGFNSPLG

SEQ ID NO: 142032 - protein, 52 aa, Heterodera glycines
  Coding regions on vcDNA: vcDNA=SeqID_68455; Strand=+; Position=1 -67,226-317
MPQSIDALKFADEMDQEEEQLIMHFFKNFTKILMPTGQPKSVLIVPTEGVRY

SEQ ID NO: 142033 - protein, 77 aa, Heterodera glycines; identical to SEQ ID NO: 137953
  Coding regions on vcDNA: vcDNA=SeqID_68456; Strand=-; Position=1-234

SEQ ID NO: 142034 - protein, 77 aa, Heterodera glycines; identical to SEQ ID NO: 137953
  Coding regions on vcDNA: vcDNA=SeqID_68457; Strand=-; Position=1-234

SEQ ID NO: 142035 - protein, 105 aa, Heterodera glycines
  Coding regions on vcDNA: vcDNA=SeqID_68458; Strand=+; Position=1 -186,636-769
  Homolog annotation: Hit_ID=NP_491426.1; Match level="QueryCoverage =100%, HitCoverage=3%, E-value=2e-36, Identity=75%"; Hit description =chromodomain-helicase-DNA-binding protein   like (1F254) [Caenorhabditis elegans] gb|AAC17559.1| Hypothet
SLLNFEPEQFANSEFLHQFGQCQTEEQVQKLQEILKPMMLRRLKEDVEKELQPKEETIIEVQLSNIQKKYYRAVLERNFTHLMKGSTPSLISLNNTMMQLRKCCN

SEQ ID NO: 142036 - protein, 50 aa, Heterodera glycines
  Coding regions on vcDNA: vcDNA=SeqID_68459; Strand=+; Position=1 -128,581-605
MAAAQMSAAQVSFWLGGASVCGATVAAQMSAAQMSANRRHKKQTRYSDSV

SEQ ID NO: 142037 - protein, 1381 aa, Heterodera glycines
  Coding regions on vcDNA: vcDNA=SeqID_68460; Strand=-; Position=1-4143
  Homolog annotation: Hit_ID=NP_491240.1; Match level="QueryCoverage =84%, HitCoverage=86%, E-value=0.0, Identity=38%"; Hit description=zn- finger, CCHC type and RNA-directed DNA polymerase  and Integrase, catalytic domain containing protein fa
MDKTLAEILEKLTQAIKQQSASTSTATQPAQNITLPDIHPFSTDNAEEFEEWLERFQFAFDCAVANMADEAKLKLLMTKLNPSAFGEYKRYCLPEEITKFDFTDTKTRLIKLFSHPPSLAIDRYKCLRVCREDGEQFEIFVNRIKAALRKFRFSELNEEEFKCLVLLTSLKSPSDAKLRQHILARLTAEGTKTTKTSKLFDKVIEDLNTQLKTEAEAKILEQPKPKINAIQHGKSSPNKHQNRGNGRPNQKFTGKSKAKIPPSNCYRCGELHWAQDCPKKENICSKCNRRGHINRQCDKIRAFHQNKGRNFNTNTVMLPAAYINSVHSSNLLKAPINVNGTTIGFILDSGAEIIIINEDDYNAMGRPPIQICSEEARFFDGKRCKFIGRGTATFQFNGIQTIQPFYVAKSGSLNLLGTPAMEAFGFLEEIRRMINPAQINQISSNDADKIQQFVEILPQKYEQIFSDGLGYCSKMKANLVLKEGANPTFKRARPVPYSTLPIINAELDRLEKMNVVTPVEHTNWSAPILVVKKANGTARLCADFSTGLNDSLQLNQHPLPLPADIFATLNGGKFFTKLDLSDAYLQIELDGTSKKLCTIATHRGHYQYERLPFGVKSAPGIFQSVMDNMFSDFPFALAYLDDVIIVSATFDQHCQHLNQIFTRISEWGFKVRMDKCSFFKNEIKYLGVIIDQSGRRPDPSKITAIAEMRIPSNVSELRSYLGMVNYYQEFVRNFRFIRQPLDELLKKDAKWDWSPKCQNAFTKIISMLQSELALTHFDPNLPIIVAADASQHGIGGVISHKFANGSIKAVSHFSRSLTPAEQNYGQIEKEALALVEAVKRFHKMIFGRKFTLLTDHQPLKKIFGNKDGVPKHSHNRLVRWSLILTAYDFEIQYVKTDKFGQADALSRLISVQKSKSDDDEVIIASFEVESALDRNLINNVNQLPITFKNLAQETANDQALQQIRQFVKNIWPEPKNFQPIEGLDEAKFIQFYRRRDEISIVKDCLMFGDRTVIPKSLQKQILKMLHQGHPGVKRMKSLARMHVYWPMMDAEIETFVQKCTSCAAVAKNPIKTTLQSWPKSDGPWKRIHIDYAGPFHGKMYLIVVDSFSKYPEIFEMNSTNAMATISKMRSLIAHYGIPETIVSDNGTQFQSHQFQNFVKSNGIEHIFTAPYMPQSNGQAERMVDTFKRAFAKIKGEGVDGNVLDTFLLTYRTTPSETLDGKCPAELFLGRKPRIGLDLLRPPLSIPIVKDNKMEDQFNRKHGAKFRSFEIGQLVFTRRHNSAEWRHGKIIDKKGVIYTVELPNNSRGRFHANQIRARQIPDEDIEDPLDVINGTFGLPIPLRDQNLAEVPPANQSPPVRRYPIRNRRPVDRLQIDPSRSSY

SEQ ID NO: 142038 - protein, 213 aa, Heterodera glycines
  Coding regions on vcDNA: vcDNA=SeqID_68461; Strand=-; Position=1-642
  Homolog annotation: Hit_ID=NP_495557.1; Match level="QueryCoverage =68%, HitCoverage=12%, E-value=3e-21, Identity=40%"; Hit description =zn-finger, CCHC type and RNA-directed DNA polymerase  and Integrase, catalytic domain containing protein
RRMPQSNGQAERMVDTFKRAFAKIKGEGVDGNVLDTFLLTYRTTPSETLDGKCPAELFLGRKPRIGLDLLRPPPSIPIIKDGKMEDQFNRKHGAKFRSFDIRQLVFTRRHNTADWRPGKIIDKKGVIYTVELPNSSRGRFHVNQIRARQIPDEDIEDPIDVINGTFGLPIPLRENNLEEIPPANDPPPARRYPTRNRRPVDRLQIDPSRSSYV

SEQ ID NO: 142039 - protein, 301 aa, Heterodera glycines
  Coding regions on vcDNA: vcDNA=SeqID_68462; Strand=-; Position=1-906
  Homolog annotation: Hit_ID=CAE64508.1; Match level="QueryCoverage =94%, HitCoverage=92%, E-value=9e-32, Identity=33%"; Hit description =Hypothetical protein CBG09238 [Caenorhabditis briggsae]
MANADSPILISDEDLSDDETHLRKLLLSEKQQQQLREQQFNPDRPYSSTVHSLPINHVQIMTPAQAEKLKREQQLALINQKIKEMEAAKKQIEEEESAEEEGRILKEKAWKAEEQRKRAKRELDEKVKKREEEKKAEEKAKKDKEEVKAAFKKIGMSTEVGGKEDENKPKKKKSKNNKGKDTENGNLEAEKLNEGHREAKKDAEEKANRKAEAKKDTEKKARREAEAKKDAEEKANREAEEKRDAEERANREAEAKKDAEEKANREAEEKRDAEERAKREEEGKEAAVETKETQKARQNTQ

SEQ ID NO: 142040 - protein, 395 aa, Heterodera glycines
  Coding regions on vcDNA: vcDNA=SeqID_68463; Strand=-; Position=1-1188
  Homolog annotation: Hit_ID=AAQ72730.1; Match level="QueryCoverage =59%, HitCoverage=55%, E-value=4e-12, Identity=25%"; Hit description =putative integrase [Petunia x hybrida]
MSSTFKSLAKTWGFEHQTTVPYHQSANGQVERYNRTIVDMLVTSTEGKNWAAALPLICFAYNSSINYQIGNSPFYVMHGFDPRLPSEVTLGKVEDHFSDMAVYVQELTKRMEEVKTTVKENLRKCADQMIKQQKWTKEIPWMEGMLVLKRRIDKRNKLEQNYDGPFRIITVEKPNLTLKEMHADAMGFTVHMDQCKPYFSKEEQILVPNEEPNSGSKRKIGDKNLEDTDEEEETEINTISMEMLTEFDDGNNLNKHGLLFWMEIILDGIVITALYPKDSFEFSSIPKSMVQSQWEIHKTKEGDEYLTAWIFDENIQLFITGEREDLIIGNGIQAWLNQNGNVICENGEATYWETYLDMDGLIYKNKITPEFWITYNEPEMCKEYESRHAPLQRFF

SEQ ID NO: 142041 - protein, 79 aa, Heterodera glycines
  Coding regions on vcDNA: vcDNA=SeqID_68464; Strand=+; Position=1 -105,358-492
MAPLATTQAAAPFVAPTHSAAPPNQNQPVGAAPDGETRTAVGPVGVVEQPVLGQSAGQNVASTSEEMPSDTSSTSAVGV

SEQ ID NO: 142042 - protein, 150 aa, Heterodera glycines
  Coding regions on vcDNA: vcDNA=SeqID_68465; Strand=+; Position=1-451
MSAPFREQIRQAYEEAQDILLDQKDFPLPARQPEHTVTLYHAELRSILSELDTELKNSEEILKEVNEPYEKWMSLRTSMTGNERTQDGPLYDEFVLTVPFLSAITNLRKYIRSLRSQRAKIEQSITTDPGSNKTFPSLVHLPKTTLPTFS

SEQ ID NO: 142043 - protein, 254 aa, Heterodera glycines
  misc_feature (111)..(111): Xaa can be any naturally occurring amino acid
  misc_feature (130)..(130): Xaa can be any naturally occurring amino acid
  Coding regions on vcDNA: vcDNA=SeqID_68466; Strand=+; Position=1 -93,202-322,375-429,484-620,682-760,825-945
  Homolog annotation: Hit_ID=NP_508768.1; Match level="QueryCoverage =100%, HitCoverage=34%, E-value=4e-41, Identity=40%"; Hit description= Apg16L beta (XF78) [Caenorhabditis elegans] gb|AAA96208.1| Hypothetical protein F02E8.5 [Caenorhabditis
RLDLDMGGGRILACSVDSSVRVWSLEGQRLRFTFTGHSEKVTTARFFNSGRSVVSGSNDRTIKVWDIVKSICQKTLFPASTVADLVSQKTLFPASTVADLVSNESASKSLXISCHFDKSIRFWDASKSLXISCHFDKSIRFWDFRSGDQPAKFLKLGARVTSLDITSGECSLLCSARDETLTLSLLCSARDETLTLIDLRTFATLHIYSAEQYRAEQYRTSSDFGRAVVSPSDSFVASGSADGHIFVWNLLTTR

SEQ ID NO: 142044 - protein, 87 aa, Heterodera glycines; identical to SEQ ID NO: 129152
  Coding regions on vcDNA: vcDNA=SeqID_68467; Strand=-; Position=1-796

SEQ ID NO: 142045 - protein, 75 aa, Heterodera glycines
  Coding regions on vcDNA: vcDNA=SeqID_68468; Strand=-; Position=1-330
CFSIKKEDGEKIFPYILVISFCFWWGAWNSGIMRTRPIWQVKQRLLTSQKVRCRDETNQHCLPRGTRHGPPKEWI

SEQ ID NO: 142046 - protein, 152 aa, Heterodera glycines
  misc_feature (134)..(134): Xaa can be any naturally occurring amino acid
  Coding regions on vcDNA: vcDNA=SeqID_68469; Strand=+; Position=1 -23,436-846,1262-1290
  Homolog annotation: Hit_ID=AAG50897.1; Match level="QueryCoverage =100%, HitCoverage=49%, E-value=1e-58, Identity=75%"; Hit description= bacterial IS-element [Arabidopsis thaliana] pir||D86488 bacterial IS -element [imported] - Arabidopsis tha
LKKSIFLRGGGRTLFEKAFPVSEQCSKKAHDQFLADLASILPSNNTPLIDSDAGFKVPWYKSVEKLGWYLSRVRGKVQYADVGAENWKPISNLHDMSSSQSKSLGYKSLAKSNTMSCQILLYKYRSEGRKNIHXARPPPPPPAPLPGSIPAK

SEQ ID NO: 142047 - protein, 75 aa, Heterodera glycines; identical to SEQ ID NO: 132731
  Coding regions on vcDNA: vcDNA=SeqID_68470; Strand=-; Position=1-225

SEQ ID NO: 142048 - protein, 248 aa, Heterodera glycines
  Coding regions on vcDNA: vcDNA=SeqID_68471; Strand=+; Position=1 -173,220-335,397-573,613-745,795-941
  Homolog annotation: Hit_ID=NP_494384.1; Match level="QueryCoverage =96%, HitCoverage=17%, E-value=3e-67, Identity=50%"; Hit description =patched family member (ptc-3) [Caenorhabditis elegans]
GGRLDEEMNFLPNAKLNYHRREKRAVSPIVAQNNRTETKAANVAELPTENTFGGGFQVVIQTPEVPGENILTREGLQRHVAILEEISKFSVEMFGEKWHLSDICFKPPPPASAKDELAQFMGDIMSQIIPCVWITPIDCFWEGSKPLGPFPEYDLGPFAQFVPFVPNGKLSWKTLNPEALLNTTRSFVDVGMVGELFERAGIGEAYQDRPCIDPLDPDCPSTAPNHFDRCAAYEHFSKWNSELPPDRR

SEQ ID NO: 142049 - protein, 106 aa, Heterodera glycines
  Coding regions on vcDNA: vcDNA=SeqID_68472; Strand=-; Position=1-321
MPSDKYERKRKKELDFDTTQELKKKRDDDDEFGNQTHRRHRSRSPKKYGNGFDLKGLKNRIIFLRSSRHKKHRDTSPGDDGERAGEAGFDTTILKGWHLAKQNAFV

SEQ ID NO: 142050 - protein, 195 aa, Heterodera glycines
  Coding regions on vcDNA: vcDNA=SeqID_68473; Strand=-; Position=1-588
PEVIFLPVHFPGHWTLIIHDVQCGTHILDSLPTPYGRLDWQLTEKIGKIISDILPSTVLTGIFNAVNLTVQHDGNSCGYFVCLYAESWLMNNRTFVLPDLSINYEKRRILWHINELYNSDNVPYHPREGVPTPCPIVYRHADEAPSTSKAAEPVEVDDHDDIMIIEPQTSGQAVVAIPTQAQVAGENQEDTRGLE

SEQ ID NO: 142051 - protein, 50 aa, Heterodera glycines
  Coding regions on vcDNA: vcDNA=SeqID_68474; Strand=+; Position=1-182
EHSAASRPHDGRFAPVFNFFGDIRPLRGLITGASRPSFNFLRTFGRLAAS

SEQ ID NO: 142052 - protein, 275 aa, Heterodera glycines
  misc_feature (5)..(5): Xaa can be any naturally occurring amino acid
  misc_feature (12)..(12): Xaa can be any naturally occurring amino acid
  misc_feature (19)..(19): Xaa can be any naturally occurring amino acid
  misc_feature (26)..(26): Xaa can be any naturally occurring amino acid
  misc_feature (33)..(33): Xaa can be any naturally occurring amino acid
  misc_feature (40)..(40): Xaa can be any naturally occurring amino acid
  misc_feature (47)..(47): Xaa can be any naturally occurring amino acid
  misc_feature (54)..(54): Xaa can be any naturally occurring amino acid
  misc_feature (64)..(64): Xaa can be any naturally occurring amino acid
  misc_feature (78)..(78): Xaa can be any naturally occurring amino acid
  misc_feature (85)..(85): Xaa can be any naturally occurring amino acid
  misc_feature (92)..(92): Xaa can be any naturally occurring amino acid
  misc_feature (99)..(99): Xaa can be any naturally occurring amino acid
  misc_feature (106)..(106): Xaa can be any naturally occurring amino acid
  misc_feature (113)..(113): Xaa can be any naturally occurring amino acid
  misc_feature (120)..(120): Xaa can be any naturally occurring amino acid
  misc_feature (127)..(127): Xaa can be any naturally occurring amino acid
  misc_feature (134)..(134): Xaa can be any naturally occurring amino acid
  misc_feature (141)..(141): Xaa can be any naturally occurring amino acid
  misc_feature (148)..(148): Xaa can be any naturally occurring amino acid
  misc_feature (162)..(162): Xaa can be any naturally occurring amino acid
  misc_feature (169)..(169): Xaa can be any naturally occurring amino acid
  misc_feature (176)..(176): Xaa can be any naturally occurring amino acid
  misc_feature (183)..(183): Xaa can be any naturally occurring amino acid
  misc_feature (190)..(190): Xaa can be any naturally occurring amino acid
  misc_feature (197)..(197): Xaa can be any naturally occurring amino acid
  misc_feature (204)..(204): Xaa can be any naturally occurring amino acid
  misc_feature (213)..(213): Xaa can be any naturally occurring amino acid
  misc_feature (220)..(220): Xaa can be any naturally occurring amino acid
  misc_feature (227)..(227): Xaa can be any naturally occurring amino acid
  misc_feature (234)..(234): Xaa can be any naturally occurring amino acid
  misc_feature (241)..(241): Xaa can be any naturally occurring amino acid
  misc_feature (248)..(248): Xaa can be any naturally occurring amino acid
  misc_feature (255)..(255): Xaa can be any naturally occurring amino acid
  misc_feature (262)..(262): Xaa can be any naturally occurring amino acid
  misc_feature (269)..(269): Xaa can be any naturally occurring amino acid
  Coding regions on vcDNA: vcDNA=SeqID_68475; Strand=-; Position=1 -177,828-1281,1402-1597
  Homolog annotation: Hit_ID=AAK50002.1; Match level="QueryCoverage =100%, HitCoverage=34%, E-value=4e-42, Identity=45%"; Hit description= ORF73 [Human herpesvirus 8]
EVQQXLEEVQKXLEEVQQXLEEVQQXLEEVQQXLEEIEQXLEEVQQXLEEVQQXYEEVQEVQQXYEEVQQRLEEVQQXLEEVQKXLEEVQQXLEEIEQXLKEVQKXLEEVQQXLEEVQQXLEEVQQXLEEIEQXLEEVQQXLEEVQQXYEEVQQRLEEVQQXLEEVQKXLEEVQQXLEEVQQXLEEVQQXLEEIEQXLEEVQQXLEEVQQQRXLEEVQQXLEEVQQXLKELQQXLEEVQQXLEEVQQXYEEVQQXLEEIEQXLEEVQQXLEEVQQ

SEQ ID NO: 142053 - protein, 84 aa, Heterodera glycines
  misc_feature (84)..(84): Xaa can be any naturally occurring amino acid
  Coding regions on vcDNA: vcDNA=SeqID_68476; Strand=-; Position=1 -133,257-338,503-707
KNGREAPVLRPRSGRMSPKNLKKRARRARPEVAKRPNAPQKIKKRARSARPEAAKRPNVPQKLKKRARSARPEAAKRPNIPRKX

SEQ ID NO: 142054 - protein, 66 aa, Heterodera glycines
  Coding regions on vcDNA: vcDNA=SeqID_68477; Strand=+; Position=1-197
CTLQFYCPNNLFMYNTKLDIAFFRSQLEMSADHLSTVALFTIRYEHNVSIVVRALKHGVSRMIQFR

SEQ ID NO: 142055 - protein, 28 aa, Heterodera glycines
  Coding regions on vcDNA: vcDNA=SeqID_68478; Strand=+; Position=1-87
QLSLIIYALMLEPRGLRLDADGFVHNLQ

SEQ ID NO: 142056 - protein, 43 aa, Heterodera glycines
  Coding regions on vcDNA: vcDNA=SeqID_68479; Strand=-; Position=1 -90,210-251
MKGRRQLDTAAAKRLFKYADEMDGCDGQPPYFEAPRWSTNEEG

SEQ ID NO: 142057 - protein, 54 aa, Heterodera glycines
  Coding regions on vcDNA: vcDNA=SeqID_68480; Strand=-; Position=1-161
APIRAAPLAYNHRLRGHTPTQRQPLARPFILPLNDLGVATRCPMTNDDVIDRNG

SEQ ID NO: 142058 - protein, 351 aa, Heterodera glycines
  Coding regions on vcDNA: vcDNA=SeqID_68481; Strand=-; Position=1 -35,97-342,445-901,1372-1686
  Homolog annotation: Hit_ID=AAL78214.1; Match level="QueryCoverage =48%, HitCoverage=94%, E-value=4e-23, Identity=36%"; Hit description =putative esophageal gland cell protein Hgg-20 [Heterodera glycines]
MSDHPNVALADLSCVANDVWLDTLFWIDRVEVGTKFALIDARFGKLVATHFNLRKWRLGELGVHRAPSGWDRGGTAAVTVMDDNALINRLPLATYVDLEVIAFLQCLQRVINRGIAVQFTIHSTDLRCWAVMAQRIWPLISHAVLALNDMKAVNFALLRRHVSPNVLFDCANLRAITNTHMFPIRPPPSAVHINALLNPPDEFDEKPKHNLFRWLHTPRKDGRPKIVTIRKWRKPQWASFMPSLITFFNASAVPVNFLVICHIACNTNFQKMERENEETDERLTPNARVPAHAVIVRQRNGTDQRTVAKWKWEANRILDTAMHQQFGFSIFSSRMANDVWLDTLFWIDRTE

SEQ ID NO: 142059 - protein, 155 aa, Heterodera glycines
  Coding regions on vcDNA: vcDNA=SeqID_68482; Strand=+; Position=1 -96,787-878,1471-1750
MANAMYAARARAAKAEKRQAQLRKAARARAGNARKREVVAIAWQTAEGWKERTTDHTMNDCRVNLDSIPLIIKVPSNRFLFPFCPFAFVAHNWTTDQKKIAGIFHFFQRQLFPSQFVGQIEELNGISRRRQMKLNDDNEIDGRRSIGKCLMGEIG

SEQ ID NO: 142060 - protein, 63 aa, Heterodera glycines
  Coding regions on vcDNA: vcDNA=SeqID_68483; Strand=+; Position=1 -99,169-261
MFYGYGNKIAKLLMFVTNFAIFLIGVRFFVAFSPKFGTKFPDFDSEAHFVDELDKVFNWAKIG

SEQ ID NO: 142061 - protein, 132 aa, Heterodera glycines
  Coding regions on vcDNA: vcDNA=SeqID_68484; Strand=-; Position=1 -207,297-488
  Homolog annotation: Hit_ID=AAP30754.1; Match level="QueryCoverage =100%, HitCoverage=70%, E-value=1e-58, Identity=84%"; Hit description= putative gland protein G11A06 [Heterodera glycines]
PCCPGSQKVVSLMANYVGTFAHSFSKSSLCLDAKSVAGALKGQLIGCSKGGDATLLADIEASLANHSSDECAHSLGFVRAMFAIAASASSHASNNSEWQALSAQFGGQISEIDSKCAEFGISIAKVSFDGPK

SEQ ID NO: 142062 - protein, 141 aa, Heterodera glycines
  Coding regions on vcDNA: vcDNA=SeqID_68485; Strand=-; Position=1 -240,286-471
MTFSLLPVQAIIMYESALNWTTSVHILPNDRRSSICLVELFKKWHSHYYRFKQLSFPKALSIGQQAFIFCLIDRRSSICLQLSFTKALSIGQQAFIFCLIDRRSSICLVELFKNGILIITGSSNYHLRKRSQLDNKRSYFA

SEQ ID NO: 142063 - protein, 184 aa, Heterodera glycines
  misc_feature (170)..(170): Xaa can be any naturally occurring amino acid
  misc_feature (181)..(181): Xaa can be any naturally occurring amino acid
  misc_feature (183)..(183): Xaa can be any naturally occurring amino acid
  Coding regions on vcDNA: vcDNA=SeqID_68486; Strand=+; Position=1 -51,97-503,1291-1365
  Homolog annotation: Hit_ID=NP_497001.2; Match level="QueryCoverage =98%, HitCoverage=9%, E-value=6e-27, Identity=35%"; Hit description =PLeXin A (plx-2) [Caenorhabditis elegans]
INEQCSRDFREMPFKILCFPPPIYCFPPPIYFSPRSGPLEGGTVVDIVGHDLGSRLQDVQDRVQVAGVPCRVLHYELSVRILCVTERSPLPFRAPIRLTIGRSARRNAQSAEHFEFRSPQVLSAQPTFGPQSGGTRLQLIGTNLDVGRNASVYLDNLECPCSALTTDLMXVIATPAKNQIXKXK

SEQ ID NO: 142064 - protein, 587 aa, Heterodera glycines
  misc_feature (92)..(92): Xaa can be any naturally occurring amino acid
  misc_feature (339)..(339): Xaa can be any naturally occurring amino acid
  Coding regions on vcDNA: vcDNA=SeqID_68487; Strand=+; Position=1 -431,538-748,843-1009,1121-1338,1686-2012,2069-2158,2224-2374,2464 -2527
  Homolog annotation: Hit_ID=CAE57926.1; Match level="QueryCoverage =96%, HitCoverage=27%, E-value=2e-74, Identity=33%"; Hit description =Hypothetical protein CBG00979 [Caenorhabditis briggsae]
FLLSAPTVPSASPYELELISELGACHPLNSSALSCDSPSLALPTALLRQSSMARWMVGMAMDGVRTVRNLGPIIQVSSAEGRSEGQKKCQKXMASIHLQLTTVPDPQFSPFAGLHILQAEQPLMLSGQWLSQAATPAEYSVTIGTALCPVFLLEPDRLLCRPPTVPPLPTDDSGSEMPDGRPLVVVSVSRHFRHCYFSVPCRSSFTCLLPGAGVLGLAVAGVLGLAVLLVIVIVVLVAVGLAWRRRQGEHERTYRRIQLQMEQMESQVRSECKQAFAELQTDVLAELDGVDDGAGIPFLESRESVARLLLRDFEPTINGARRSDLFEVHRQRRNIYGQXFINYPFFCLTLWHSVPLPPFVSASERASLASLLLAVLSRNLAFASDVVLSLLSAHVQRCSLMHSPHLLFRHSDSLVEKLFQQWLALCLLPHLRDSEGPARSLFLLYRALKSLTEKGPVDAVTGQARYSLSEQSLGPVDAVTGQARYSLSEQSLLRESVEARPLTVIPLDGFVIPLDGFDQAPVPIRTLDCDTISQLKAKLLDTLYRNVPYSTRVGIDQFDLEWRCPRRWRCPRRGKGLLLDDDQPQRS

SEQ ID NO: 142065 - protein, 599 aa, Heterodera glycines
  misc_feature (14)..(14): Xaa can be any naturally occurring amino acid
  Coding regions on vcDNA: vcDNA=SeqID_68488; Strand=-; Position=1 -237,280-410,458-581,639-720,779-815,897-1010,1061-1130,1216 -1348,1406-1557,1626-1766,1918-2106,2213-2314,2588-2688
  Homolog annotation: Hit_ID=NP_500276.2; Match level="QueryCoverage =93%, HitCoverage=41%, E-value=2e-92, Identity=37%"; Hit description =one of two C. elegans orthologs of L1/Neuroglian 4b9, immunoglobulin and fibronectin III domain-containin
RTDWSLSEKSGSHXNTTKSIPHSVIKVNYTFRMFAHNSYGASPASAPSASVPCATPPDVPFSNPMEVHAQGTEPDNLVIRWTPLSRNVIRWTPLSRNVWNAHGLKYLVRYRQMDDSAPTDWHEFFVEDPFANQTTIREQPTFRNQTTIREQPTFRPFLVQVRAVNSRGFSAIEPETVLGWSGEDVPLEAPRGLRLVPLEAPRGLRLVAHRNHSTVELGWEELNFSSVFSSVRGHFVGFRLDHWPLDHWPSVRPFLITSQIVPNISTVATISGLQALTNYEAKVCVLNGQYESEVCVLNGQYESEGSNLLKFTTIEGAPSKVHNLRVHSVGSRSLLATWEPPLHPNGNLRGYLAFESAIAPTEETFVLRRQLFYLHTEETFVLRRQLFYLHESLSPETPFRVAVWAETGGGEGPRTWRNTRTWPLRDPPDPPLFSIHSLSPTILRVRWFPSGNAYWRMSGSSFLLNYTKKGTSQWHQTVPIVLPQVVFDLRNLAEGTDYVLIGEAREGPKRRRASEALDIRTESSRGRPPFSNERLRSAAWFLAVLIACALTFALLAVACVVAQRNADRFLAEAQRRLSGAMDSKEREKRQKTREKGERD

SEQ ID NO: 142066 - protein, 119 aa, Heterodera glycines
  Coding regions on vcDNA: vcDNA=SeqID_68489; Strand=+; Position=1-438
NGLSKNRNYAQKASQTILALPIPSTIAFIHPNMSAKIIRVPKIACDLSLEKNGLSKNRNYAQKASQTILTLPIPSTIAFMHPIMSAKIIRVPKIACDLSLEKNGQVKIVITLKKLLKQF

SEQ ID NO: 142067 - protein, 113 aa, Heterodera glycines
  Coding regions on vcDNA: vcDNA=SeqID_68490; Strand=+; Position=1 -119,172-391
  Homolog annotation: Hit_ID=NP_502088.1; Match level="QueryCoverage =98%, HitCoverage=15%, E-value=8e-24, Identity=49%"; Hit description =suppressor of var1 3-like 1 (81.2 kD) (4L917) [Caenorhabditis elegans] emb|CAA97429.1| Hypothetical prote
ICPPRLSETQVKRFNDQNDPCKILLATDAIGMGMNLNIKRVIFTTLKSRDGSLLPAYFVKQIAGRAGRYASAYCTGEAMALDDADAGLLEKLMNEPIDSIDQAGILPSFDQIE

SEQ ID NO: 142068 - protein, 68 aa, Heterodera glycines
  Coding regions on vcDNA: vcDNA=SeqID_68491; Strand=-; Position=1 -94,185-297
MHAFCARAIYHRACQSKAKQQRWCFERIKGIESVYRLLEKYICNLSTILRSELEMINFTIQTSFRCSN

SEQ ID NO: 142069 - protein, 68 aa, Heterodera glycines
  Coding regions on vcDNA: vcDNA=SeqID_68492; Strand=-; Position=1 -94,185-297
MHAFCARAIHHRACQSKAKQQRWSFERIKGIESVNRLLEKYICNLSTILRSELEMINFTIQTNFRCSN

SEQ ID NO: 142070 - protein, 21 aa, Heterodera glycines
  Coding regions on vcDNA: vcDNA=SeqID_68493; Strand=+; Position=1-65
MAISFFSWGFDRKLGTNICLL

SEQ ID NO: 142071 - protein, 19 aa, Heterodera glycines
  Coding regions on vcDNA: vcDNA=SeqID_68494; Strand=+; Position=1-59
TFAFSSLALPNTHTIFEML

SEQ ID NO: 142072 - protein, 19 aa, Heterodera glycines
  Coding regions on vcDNA: vcDNA=SeqID_68495; Strand=+; Position=1-59
TFAFSSLALPNTHTIFEML

SEQ ID NO: 142073 - protein, 19 aa, Heterodera glycines
  Coding regions on vcDNA: vcDNA=SeqID_68496; Strand=+; Position=1-59
TFSFSSLALPNTHTIFEML

SEQ ID NO: 142074 - protein, 19 aa, Heterodera glycines
  Coding regions on vcDNA: vcDNA=SeqID_68497; Strand=+; Position=1-59
TFSFSSLALPNTHTIFEML

SEQ ID NO: 142075 - protein, 64 aa, Heterodera glycines
  Coding regions on vcDNA: vcDNA=SeqID_68498; Strand=+; Position=1 -49,443-588
  Homolog annotation: Hit_ID=XP_420740.1; Match level="QueryCoverage =75%, HitCoverage=4%, E-value=2e-10, Identity=64%"; Hit description =PREDICTED: similar to replication factor C large subunit [Gallus gallus]
MKSPKKRQSILSLQAAARPNQFQAQVDGATFKAALLSGPPGIGKTTCALLCCKELGLAFVEMNA

SEQ ID NO: 142076 - protein, 108 aa, Heterodera glycines
  Coding regions on vcDNA: vcDNA=SeqID_68499; Strand=+; Position=1 -27,236-382,440-592
  Homolog annotation: Hit_ID=AAP30770.1; Match level="QueryCoverage =100%, HitCoverage=40%, E-value=5e-23, Identity=52%"; Hit description= putative gland protein G17G01 [Heterodera glycines]
MLCSVDFYEFFVFRYAFPSVFGWCASAALSSRLLINWTNFWTCFNFRADYTIVPLVTLVLSIVLACSSVFEIFFMNSVLKKKCPVCAYASTDDYDDDDDYLVTECAID

SEQ ID NO: 142077 - protein, 353 aa, Heterodera glycines
  Coding regions on vcDNA: vcDNA=SeqID_68500; Strand=-; Position=1 -102,149-427,478-892,952-1217
  Homolog annotation: Hit_ID=AAL78214.1; Match level="QueryCoverage =42%, HitCoverage=78%, E-value=2e-15, Identity=32%"; Hit description =putative esophageal gland cell protein Hgg-20 [Heterodera glycines]
WRAVPLLLVDCGASILWFFFDRVKKRRRPPKKEIFICADCWLLVFDFLAPSQLGLEIALISRRFDFYVDEHFKTRKWMLNKQLLITWKIVGNGPKQMQIDDADGNPLPIPRNPLPNKVIGFRRIQIIYIDQNVIEFLHRFHRLFGTCATALDITTENVRILDYFLLHIWPMFRASMHLMILNTIFFRRLRQLAPSSLSDCPSLRVVWLDDGTFPEFPPDDSAMASDGQAVAKWVLTPRPDGQPKLLKSPVNSPDQWSSTIEQFKAAFSNASSPVSFSINFLPSSPLNSAVPFDRINEATGEQLTLEQYDTNNFWLDRCPIGWDDKKWDNVWKELGAARTNSIDIQIEDGGYDD

SEQ ID NO: 142078 - protein, 121 aa, Heterodera glycines
  Coding regions on vcDNA: vcDNA=SeqID_68501; Strand=+; Position=1 -81,157-468
YTKIVVAIWPLPQLFKTPNQIVGPFIACLVIIVRLNNAHHVEFALHRLKVVHGHPRPHYRFHDIFRVLSPHTVRLITVAKGVAVSSARPIVSDVNDALISSVHVFAARRAFVQHFQRTVTV

SEQ ID NO: 142079 - protein, 32 aa, Heterodera glycines
  Coding regions on vcDNA: vcDNA=SeqID_68502; Strand=-; Position=1-184
WSASIGSLKSKQKYHQSINPIHHSSKRSVIIS

SEQ ID NO: 142080 - protein, 21 aa, Heterodera glycines
  Coding regions on vcDNA: vcDNA=SeqID_68503; Strand=+; Position=1-65
MLCEILERDELQIPEEIQCGM

SEQ ID NO: 142081 - protein, 31 aa, Heterodera glycines; identical to SEQ ID NO: 126976
  Coding regions on vcDNA: vcDNA=SeqID_68504; Strand=+; Position=1-93

SEQ ID NO: 142082 - protein, 68 aa, Heterodera glycines
  Coding regions on vcDNA: vcDNA=SeqID_68505; Strand=+; Position=1 -94,184-296
MHAFCARAIYHRACQSKAKQQRCCFERIKGIESVNRLLEKYICNLSTILRSELEMINFTIQTNFRCSN

SEQ ID NO: 142083 - protein, 84 aa, Heterodera glycines
  Coding regions on vcDNA: vcDNA=SeqID_68506; Strand=-; Position=1 -151,208-311
MKIIAEARDGTGAHCFDNVDQTMAVFAFKLRLANSVHTTAHSLRLFVFKEGTIPMEDNRILGYYITSDRHLFYQRVQGQQNNPN

SEQ ID NO: 142084 - protein, 22 aa, Heterodera glycines
  Coding regions on vcDNA: vcDNA=SeqID_68507; Strand=+; Position=1-71
VRLGYSNNYGEQKSNAELKYRL

SEQ ID NO: 142085 - protein, 30 aa, Heterodera glycines
  Coding regions on vcDNA: vcDNA=SeqID_68508; Strand=-; Position=1-91
MSEKFRQDMPPQGGYPSFHVHRTLPKSFLS

SEQ ID NO: 142086 - protein, 49 aa, Heterodera glycines
  Coding regions on vcDNA: vcDNA=SeqID_68509; Strand=-; Position=1 -38,338-449
MAILNYYPPSSNRCGTELNSSNELNQGFQQLLQVHLSLFKMKMASCFKK

SEQ ID NO: 142087 - protein, 58 aa, Heterodera glycines
  Coding regions on vcDNA: vcDNA=SeqID_68510; Strand=+; Position=1 -67,115-209,821-835
  Homolog annotation: Hit_ID=AAC72366.2; Match level="QueryCoverage =96%, HitCoverage=4%, E-value=2e-23, Identity=91%"; Hit description =guanylyl cyclase [Heterodera glycines]
MPRYCLFGDSVNTASRMESNGKAGKIHISSSSNRFLTTVIGGYVTEPRGEVIIKGKSF

SEQ ID NO: 142088 - protein, 304 aa, Heterodera glycines
  Coding regions on vcDNA: vcDNA=SeqID_68511; Strand=-; Position=1 -150,441-548,852-950,1208-1645,2224-2340
  Homolog annotation: Hit_ID=NP_499021.1; Match level="QueryCoverage =47%, HitCoverage=9%, E-value=2e-16, Identity=34%"; Hit description =CEll Death abnormality CED-11, TRP homologous cation channel protein (ced-11) [Caenorhabditis elegans] emb
MPCPRLVCPADRVRVLCVPQAAQLAHFVRAVREDSKASGGGGRSDLEVPARRKGIAQCLATDHPDFGGRAPNSPQSKYIVVYKNPSQQVDKNNGTTKGAQRWKVMATEGGEEEKPTRLEVPASERDWLQLQPHYRPNSFSKAANQFPAELQKHVDDHSAKGLIEIGRQWRQRCLQAIFSAIDECKQSPNSRRAKRSISLNGAGIPLNPGGRTGMAGRGKFARFGPNRMLIYALIRRIVDEEEEENDCRKEDEDDNCEQNGAEEIQRLLKPSPAIAGRRRIFVAISSAVGAGAAPICGEGVENVP

SEQ ID NO: 142089 - protein, 206 aa, Heterodera glycines
  Coding regions on vcDNA: vcDNA=SeqID_68512; Strand=+; Position=1 -355,407-568,680-780
MGDDGEINHRQPQKITAVGAGKGPPVWKIPKKSTSKKGSDGAGKPSRESHNNRESHNNQQSDSAAKGGYNGLNIDGLFEEIEQQKNQRTINENGGNRKEHNEVADTDSGNNGVQWEMQSELCSANGRDDLVRSPSLAPQSSPNKLQTSKGIPKQECDDEKSQGFFGSHKSSTLGLALYKAEKEGRELRSRHLRSGQSPQNVPNSSV

SEQ ID NO: 142090 - protein, 47 aa, Heterodera glycines
  Coding regions on vcDNA: vcDNA=SeqID_68513; Strand=-; Position=1-141
AVGAGKGPPVWKIPKKSTSKKGSDGAGKPSRESHNNRESHNNQQSDS

SEQ ID NO: 142091 - protein, 77 aa, Heterodera glycines
  Coding regions on vcDNA: vcDNA=SeqID_68514; Strand=+; Position=1-234
MRFVLSLALLALFVVQCSADDSSPSSEAADENPSAAHAAAEPSAAGDGVPPPPPSAEGAAAERKKRSGGKVAPALIL

SEQ ID NO: 142092 - protein, 130 aa, Heterodera glycines
  Coding regions on vcDNA: vcDNA=SeqID_68515; Strand=-; Position=1-443
KSELRSTSFSNNFSASNSFYNRLYTSHYSAKIIKVPKIACDLSLEKNGLSKNRNYAQKASPTILALPIPSTIAFIHPIMSAKIIRVPKIACDLSLEKNGLSNNRNYAPKSFSNNFSASNSFYNRLYTSPL

SEQ ID NO: 142093 - protein, 70 aa, Heterodera glycines
  Coding regions on vcDNA: vcDNA=SeqID_68516; Strand=-; Position=1 -73,365-504
MSAHQKEEEDKNENIVANKNDNFEKKRSAKAQKTPKAKARLVLRGGQGRIGHVPDGSAKIWRQTEGWLCA

SEQ ID NO: 142094 - protein, 129 aa, Heterodera glycines
  Coding regions on vcDNA: vcDNA=SeqID_68517; Strand=+; Position=1 -88,145-216,281-510
LAALTFIQSNRNLWSPDEGEMGEGDLPLEEELADWVQAETSDGQFYYWHIYTGETRWEQPEKFYTSAQYAERYANIVEETTDQREVGQCANSAYDLTQSSVLKKVLQIRTEELRRICPSPAQVRLLVLN

SEQ ID NO: 142095 - protein, 127 aa, Heterodera glycines; identical to SEQ ID NO: 133730
  Coding regions on vcDNA: vcDNA=SeqID_68518; Strand=-; Position=1-384

SEQ ID NO: 142096 - protein, 170 aa, Heterodera glycines
  Coding regions on vcDNA: vcDNA=SeqID_68519; Strand=+; Position=1-513
MMIILSTKLITLSVLLLPILLGIANAAGIGDRQKRAVEEEGRKSVSELCAIHEQKFKELFEVERGSAEKEEVLWMEKIENKADKEEEKEKQKEKEKREEKAAEERMDAKNEAWLSTLLGNYLCQKLRGKGGEQNDEKLDYAIEKNVWTTPATVDPLLACKISKSCFSKHF

SEQ ID NO: 142097 - protein, 75 aa, Heterodera glycines
  Coding regions on vcDNA: vcDNA=SeqID_68520; Strand=-; Position=1 -38,420-609
MLCCTALSIQAIRCIFNPDPESGLRVGVRGWKRRGSGFSPKMAKNVGVGDATLDKSDKKCSRVTRGQAVISGMNE

SEQ ID NO: 142098 - protein, 135 aa, Heterodera glycines
  Coding regions on vcDNA: vcDNA=SeqID_68521; Strand=+; Position=1 -124,166-237,279-487
MNTADTVLHEIFRINQSYTEFDLLQQPISCIIATYSTPVGTGFNPLDYCEIKELGRICVKNMDNFCLFYALVLSRFYQLINKNDEEKISMDQFRKIIKNEQRQSEAVKKLIIDAKINMNEKTYGLNHLQIVQDFW

SEQ ID NO: 142099 - protein, 75 aa, Heterodera glycines
  Coding regions on vcDNA: vcDNA=SeqID_68522; Strand=-; Position=1 -57,296-466
MASEEIDEKSNEKKYTLKQIELNGGSIGGYGTPQPLTALHRRMLSNVGIDNSISVMPENLTSEMLATAMYRAWSV

SEQ ID NO: 142100 - protein, 71 aa, Heterodera glycines
  Coding regions on vcDNA: vcDNA=SeqID_68523; Strand=-; Position=1 -138,189-264
ILFVHPKIRIFLLVEARAIQYAMERIFEGKPKPKCVFLTLEEGIDRLKLNSDNFLILDGKFTVAVSMARNA

SEQ ID NO: 142101 - protein, 41 aa, Heterodera glycines
  Coding regions on vcDNA: vcDNA=SeqID_68524; Strand=-; Position=1 -53,132-204
MPYAINYGTLITRDGKFREIFFREIFKFIKHGNVYKNVLDT

SEQ ID NO: 142102 - protein, 54 aa, Heterodera glycines
  Coding regions on vcDNA: vcDNA=SeqID_68525; Strand=-; Position=1-163
HYTSLILPHASHFSLLLGTGKVSPLVSAQSFASRIRSIKTFSSLSMFSTQYFTS

SEQ ID NO: 142103 - protein, 104 aa, Heterodera glycines
  Coding regions on vcDNA: vcDNA=SeqID_68526; Strand=-; Position=1-438
NGLSKNRNYAQKASQTILALPIPSTIAFIHPIMSAKIIRVPKIACDLSLEKNGLSKNRNYAQKASQTILALPIPSTIAFIHPIMSAKIIRVPKIACDLSLEKMV

SEQ ID NO: 142104 - protein, 99 aa, Heterodera glycines
  Coding regions on vcDNA: vcDNA=SeqID_68527; Strand=+; Position=1-300
HPEVHSLQRIQSNWVPLIRLKLINFDHEIDIVFASIPGEQQIDADDLRQQNILTKFEEMIEKLDNKIKQLKEEEDRNDQASLTNAKEQILKSLRSLAGN

SEQ ID NO: 142105 - protein, 71 aa, Heterodera glycines
  Coding regions on vcDNA: vcDNA=SeqID_68528; Strand=+; Position=1 -61,147-301
  Homolog annotation: Hit_ID=NP_496067.1; Match level="QueryCoverage =87%, HitCoverage=11%, E-value=9e-09, Identity=43%"; Hit description =poly polymerase   family member (2J898) [Caenorhabditis elegans] emb|CAA87419.1| Hypothetical protein T15
MTKKNNNFHKLLLLLKLWAKSNYIYNNAMGFFNGTSLGVLAAKIVLLYPEATVPFLLERFFFTYYSWSNFN

SEQ ID NO: 142106 - protein, 90 aa, Heterodera glycines
  Coding regions on vcDNA: vcDNA=SeqID_68529; Strand=+; Position=1 -164,851-959
MARAFACTRVISVKLRVLRVQVARLTCSPVRKSCSSSNSSKRVRSPCPHQQQMTRHPNGKESADMVVRFNPAKNVLAELFIKVFAGFSME

SEQ ID NO: 142107 - protein, 249 aa, Heterodera glycines
  Coding regions on vcDNA: vcDNA=SeqID_68530; Strand=+; Position=1-749
  Homolog annotation: Hit_ID=EAL50634.1; Match level="QueryCoverage =100%, HitCoverage=81%, E-value=2e-60, Identity=47%"; Hit description= hypothetical protein 19.t00007 [Entamoeba histolytica HM-1:IMSS]
KANAEAKAKKDAEEKAQKDAEAKAKKDAEEKAQKDAEAKAKKDAEEKANAEAKAKKDAEEKAKKDAEAKAKKDAEAKKKDEEMKKQKAKPEEKPEAPAEAVAVVPEAKKAEETKEKLKQEEKPVKVPPSPAEKKRKDAEEKAKKDAEAKAKKDAEEKAQKDAEAKAKKDAEEKAQKDAEAKAKKDAEEKANAEAKAKKDAEEKAKKDAEAKAKTDTEEKAQNDAEAKAKKDAEENANAEAKPRKTQKRR

SEQ ID NO: 142108 - protein, 51 aa, Heterodera glycines
  Coding regions on vcDNA: vcDNA=SeqID_68531; Strand=+; Position=1 -97,155-213
MGRRRRFDGSGITKFWAILTESSLGWMVSSALGIVSVRREAGQSIEMGGAF

SEQ ID NO: 142109 - protein, 81 aa, Heterodera glycines
  Coding regions on vcDNA: vcDNA=SeqID_68532; Strand=-; Position=1-244
MAALRRAPISSCLPFLILIINFPPTIQAWQLKRAEDNLLLAYDPIAENYVGNQQCCSRVSGPDLRKDSGFIGLGLESRKDS

SEQ ID NO: 142110 - protein, 21 aa, Heterodera glycines
  Coding regions on vcDNA: vcDNA=SeqID_68533; Strand=-; Position=1 -13,405-457
MAKYGLQQSRKKYGFPYYYKP

SEQ ID NO: 142111 - protein, 360 aa, Heterodera glycines
  Coding regions on vcDNA: vcDNA=SeqID_68534; Strand=+; Position=1 -186,257-490,633-839,885-1072,1122-1389
MNTTAPTDIDLFLFFLGGAVELLTNFVGIPLSIANLILVARTSVIHPNMKAILIFQSLFIILRGSCRFVICLFKFFLWDPIGAESTLFFPALLKMYFIGIYARNFVPHVLVVERILSTLFVRTYEKNRGNLFSILWMPFALIIPIYIATTTSSPHDHNQPITNLITTAVQLLVGSIVLGIFYQLSRYNSKIYQKMFQNIGSNNLSIRYQLSENIRIGKQLIPPLFLNLGNIFAGTMILLWDFLDLPFYIYIFNLAAIINSIFGLLIEFFIITCHPFLNRDLCQFLNRIGKMFGFNHLAYNHRIGDATVTFGTNNTAPSLAAVNGIAQRNLISGKALIDNQTKPEDHFAMLKEAWEKGPMK

SEQ ID NO: 142112 - protein, 189 aa, Heterodera glycines
  Coding regions on vcDNA: vcDNA=SeqID_68535; Strand=+; Position=1-570
MDKLGRLVQMCATFPHVTFFWLPPPFVRDRQFEHETLIGKMRDFFGQKKNIQFVATTATGRSLLEIWRYGNGYNTDHVSPEGVMKEKGLNMLKAWLLTQVKEFPGDQELGIEKKKPESGEKGKGAGTAADRQHGRTEPPPFRRDGPVFRRSNSRPFVQHPYSRTAVDRHPFRPFRTPNLPNPNRRHFDR

SEQ ID NO: 142113 - protein, 59 aa, Heterodera glycines
  Coding regions on vcDNA: vcDNA=SeqID_68536; Strand=+; Position=1-180
VTSPSTTGSTGSTMTTTTTTTTTTTSSTPTTPNGTTTKNWSESLAAAVGGKTTLVLIIV

SEQ ID NO: 142114 - protein, 63 aa, Heterodera glycines
  Coding regions on vcDNA: vcDNA=SeqID_68537; Strand=+; Position=1-189
  Homolog annotation: Hit_ID=AAC31853.1; Match level="QueryCoverage =100%, HitCoverage=12%, E-value=3e-28, Identity=92%"; Hit description= putative NADH dehydrogenase (ubiquinone oxidoreductase) [Arabidopsis thaliana] ref|NP_180560.1| pyridine
VLGSGWAGCRLMKGLDTQIYDVVCVSPRNHMVFTPLLASTCVGTLEFRTVAEPIARIQPAISR

SEQ ID NO: 142115 - protein, 376 aa, Heterodera glycines
  misc_feature (375)..(375): Xaa can be any naturally occurring amino acid
  Coding regions on vcDNA: vcDNA=SeqID_68538; Strand=-; Position=1 -36,75-216,373-602,683-804,1106-1249,1304-1392,1521-1657,1843-1923
  Homolog annotation: Hit_ID=NP_499693.1; Match level="QueryCoverage =99%, HitCoverage=76%, E-value=1e-100, Identity=47%"; Hit description= dehydrogenase, E1 component (3O58) [Caenorhabditis elegans] pir||T26758 hypothetical protein Y39E4A.3 -
RISFYMTNFGEEASHMGSAAALELRDLVYGQYREVGVLLEASHMGSAAALELRDLVYGQYREVGVLLWRGFSLDQCMNQCYGNELDEGKGKQMPVHYGSSPLNFVTISSPLGTQLPQAVGTAYAFKLANAQRSADEKRVVCVYFGEGAASEGDAHAAFNFAAALRCPVRCPVLFFCRNNGFAISTPASEQYAGDGIAGKGIGYGMHTIRVDGNDPFAVYKVTSEARKLALENNPVMIEAMTYRVGHHSTSDDSSAYRPMEEVKEWAELDPPIGRPMEEVKEWAELDPPIGRFRRFLERRQWWDEKVTIPNPLEVRREVMNSFAKAEKLKKRAPEELFVDVYAEIPKHLKDQQAQLREHLSEFGSEYSQMEHFQKXS

SEQ ID NO: 142116 - protein, 89 aa, Heterodera glycines
  Coding regions on vcDNA: vcDNA=SeqID_68539; Strand=-; Position=1 -93,1482-1658
MAWTWIQEKSRPGSRSRSNSNKKYWKTRMAQVKFTEKLEFRSSANEVPMPIYQCINSRGEFVDGSEECPLPKVLIRKSPTEFSVSGHCS

SEQ ID NO: 142117 - protein, 56 aa, Heterodera glycines
  Coding regions on vcDNA: vcDNA=SeqID_68540; Strand=+; Position=1 -68,256-358
MGCIKAIVEGIGSAKIVGGAFGALRSHAIFGTLIILAFIMGCIKAIVEGIGSAKIV

SEQ ID NO: 142118 - protein, 146 aa, Heterodera glycines
  Coding regions on vcDNA: vcDNA=SeqID_68541; Strand=-; Position=1-439
NGVSKNRNYAQKASQPILALPIPSTIAFIHPIMNAKLIRVPKIACDLSLEKNGVSKNRNYAQKAPQTILALPIPSTIAFIHPIMNAKIIRVPKIACDLSLAKNGLSKNRNYAQKASQTILALPIPSTIAFIHPIMNAKIIRVPKIA

SEQ ID NO: 142119 - protein, 134 aa, Heterodera glycines
  Coding regions on vcDNA: vcDNA=SeqID_68542; Strand=-; Position=1 -123,208-489
MGEALKNRIEQIPEEEKTKGKTRGEILKEKIGASKPIEEEIERRKFSIDFNDQRIDFIELSAQLGYILGFEDPTKILSGAIAKYYCDLKGGIDSLCVYINGITENVIVGDQLASLLRIVVVEGKFGDVIESKGN

SEQ ID NO: 142120 - protein, 57 aa, Heterodera glycines
  Coding regions on vcDNA: vcDNA=SeqID_68543; Strand=+; Position=1 -43,107-237
MEYLNKTNERLKATAYYYRHSKTALDEVQKRIAVMEVIVGLLIFLIFTSPFAYYFSF

SEQ ID NO: 142121 - protein, 244 aa, Heterodera glycines
  Coding regions on vcDNA: vcDNA=SeqID_68544; Strand=-; Position=1 -34,81-218,258-308,365-508,554-619,668-748
  Homolog annotation: Hit_ID=CAD27347.1; Match level="QueryCoverage =88%, HitCoverage=38%, E-value=3e-54, Identity=54%"; Hit description =alpha-tubulin [Mucor circinelloides]
KREVVSLHIGQAGVQIGNACWELYCGVQIGNACWELYCLEHGINSEGRFVDSEEGPADNSVDTFFAETRINKYVPRALFIDLESKYVPRALFIDLESTVIDEVRGGAYRQLFHPEQLIEVRGGAYRQLFHPEQLITGKEDAANNYARGHYTVGKELIGVCMDRIRKVAENCSGLQGFLLFVAENCSGLQGFLLFHSFGGGTGSGFSALLAECLTVEYGSGFSALLAECLTVEYGKKAKWNFPYP

SEQ ID NO: 142122 - protein, 123 aa, Heterodera glycines
  Coding regions on vcDNA: vcDNA=SeqID_68545; Strand=-; Position=1 -10,57-171,1030-1273
MKQTVGLSQFGTALRVSPDRKCNGGASPQEPCLGDRRNSPASIASQPAAKLQAVQQQQHPPHQQRHCDNTPTTPATSATSFMAMSSATPGTRNCSNGTSQCSMSMAGSTAAAMGAPVMTITYR

SEQ ID NO: 142123 - protein, 163 aa, Heterodera glycines
  Coding regions on vcDNA: vcDNA=SeqID_68546; Strand=+; Position=1 -78,646-832,880-1025,1072-1149
MALSPPNLPIELLRLLLLLLFVFTSTAQILSPNDLDGLERSIDDFKVFLAEQDRMSAFLSKKPKAHLLLFHFVPFARQHQFIGLLDEQGDEALHSVWRRLEQWWKCMPDAEQILQQLEHHFVNNWLLDTGRIDELKRNYEERKGEDDTDEEAAEEIDYECQID

SEQ ID NO: 142124 - protein, 126 aa, Heterodera glycines
  Coding regions on vcDNA: vcDNA=SeqID_68547; Strand=+; Position=1 -356,427-485
SVFCSKSTALTSRWTARTFNGQPFTTTTAHFLAMGLVTVYGLGVRTLRRRTCSNRTTCDQRELSPGADPNNKCQIYCCNNANSVVTVHHRLLVLFRFGDLLIGALIRTNSFLRWPFLSHSLPVGTE

SEQ ID NO: 142125 - protein, 132 aa, Heterodera glycines
  Coding regions on vcDNA: vcDNA=SeqID_68548; Strand=-; Position=1-397
MCENFFDACAPHAWACLTHEHMQYAMMRGAARGAEKRHGGDSVQRQMAEQHQQRESGQEGECGGGKEAECRAFALQLVHKLDALAYKTAEGQTTEAAECDEDACDAAGAEASVTPERMCAWMQFASAYSGLT

SEQ ID NO: 142126 - protein, 108 aa, Heterodera glycines
  Coding regions on vcDNA: vcDNA=SeqID_68549; Strand=+; Position=1-327
TQVLCKGRQKIGLVYFLLLSKKADAECFSFSKIDPNSCDVLPFHCVALNPSIANMESVKNRHVAAVVIASRRCLYLLFANLTKNYFAIVGINCSAANFSDPVTNKCRF

SEQ ID NO: 142127 - protein, 119 aa, Heterodera glycines
  Coding regions on vcDNA: vcDNA=SeqID_68550; Strand=-; Position=1-438
NGVSKNRNYAQKASQTILALPIPSTIAFIHPIMSAKIIRVPKIACDLSLEKNGVSKNRNYAQKASQTILALPIPSTIAFIHPIMSAKIIRVPKIACDLSLEKNGQVKIVITLKKLLKQF

SEQ ID NO: 142128 - protein, 100 aa, Heterodera glycines
  Coding regions on vcDNA: vcDNA=SeqID_68551; Strand=+; Position=1 -99,157-360
MTEYVNYDEMHKAMEKSYGKLCERNYIDFSELPGWSRPVINRYPRFSVMPVFDPQFTVSVFGAKKPGFGSMKLLEVHRDPRSRFTVPIHGYSVKNLHWIN

SEQ ID NO: 142129 - protein, 261 aa, Heterodera glycines
  Coding regions on vcDNA: vcDNA=SeqID_68552; Strand=+; Position=1-785
  Homolog annotation: Hit_ID=CAE60523.1; Match level="QueryCoverage =22%, HitCoverage=9%, E-value=4e-13, Identity=58%"; Hit description =Hypothetical protein CBG04143 [Caenorhabditis briggsae]
DHLLQMSESSPLSPPAEAAHPIAPGTLFQPISVAGGNNRNSTGSTNSSQASSGFESAKVGPMNANGHTLIDVPLPDSEFQFAPFGNFDQFRQLFIRHRFVDRCSCPPPLFRLSPQRFARSSRQRFLPPLFRWLFNSLSFFRLLFHLRWVGFVNWPWRDFDSPKKDKRKMPPSKYHRNDGQGHTGNIQPKAVKFIMGLKKEAEIYAEWLQRLCLSEYLALFLGQGYDLPTLARSSPEDLTTLGITRPEDRKRLFQDIQTWRN

SEQ ID NO: 142130 - protein, 86 aa, Heterodera glycines
  Coding regions on vcDNA: vcDNA=SeqID_68553; Strand=-; Position=1 -213,393-440
MALWLSCCCAIITFFTMAPLILQWHHCEAAYDQEIFDTIQMIHICQFIHDHIAEEGEVENIAVITCGKEIEPMAKLLRNQTEKYLI

SEQ ID NO: 142131 - protein, 151 aa, Heterodera glycines
  Coding regions on vcDNA: vcDNA=SeqID_68554; Strand=-; Position=1 -211,486-728
MSGSYFVLAEFILAIIFHSVAIVQIFLLLRSNVRKNISLFFMALLINWLCAALLLLPYEIHAIIIWHPTEGVLYDGATLFFIALSAHLLLSTIPMSVFFMTIDRICIICFEHNYGSQIKRVLKRCFLSALAVGILFNFIGMLSAMPVPTNT

SEQ ID NO: 142132 - protein, 82 aa, Heterodera glycines
  Coding regions on vcDNA: vcDNA=SeqID_68555; Strand=-; Position=1 -105,581-724
MNGEDDGARDAEGSAGMVEIEHPDDEKLPPLVKIQGLFDALSTNITSISTNFEPGPEYEQKVENSIFRFRTFILKLIKTSRK

SEQ ID NO: 142133 - protein, 128 aa, Heterodera glycines
  Coding regions on vcDNA: vcDNA=SeqID_68556; Strand=-; Position=1 -37,88-178,231-371,420-602
  Homolog annotation: Hit_ID=BAB14535.1; Match level="QueryCoverage =86%, HitCoverage=62%, E-value=2e-12, Identity=34%"; Hit description =unnamed protein product [Homo sapiens]
AHSAHCCPAGFACAREEERCVSEQNGISLSTQMFPTHHATKRRFHGTKMPTECPDGTFCGSSTDICCAHSLPTNEGEQTTTFGCCPLSKGICCKESQKCCPMGYKCSAEGCERMEVRERIVRLFLDKN

SEQ ID NO: 142134 - protein, 70 aa, Heterodera glycines
  Coding regions on vcDNA: vcDNA=SeqID_68557; Strand=-; Position=1 -109,153-256
  Homolog annotation: Hit_ID=AAH73022.1; Match level="QueryCoverage =47%, HitCoverage=4%, E-value=9e-09, Identity=63%"; Hit description =LOC443608 protein [Xenopus laevis]
TEVRSVLPVPTCCPLGDGFGRRRKDFWRLETNAQQSISYGCCPAERAVCCADHVHCCPHGTQCNARGGEC

SEQ ID NO: 142135 - protein, 223 aa, Heterodera glycines
  Coding regions on vcDNA: vcDNA=SeqID_68558; Strand=+; Position=1-671
  Homolog annotation: Hit_ID=CAG06684.1; Match level="QueryCoverage =90%, HitCoverage=13%, E-value=2e-10, Identity=29%"; Hit description =unnamed protein product [Tetraodon nigroviridis]
GLSVLLKRDGGADEDDEVVNTQPRPPAPPPPPPPPPHHPSQQHHRRPPSLPDQQSSSSDDSHPPRPPRPPRPQRTKKNHQSSLKHGRLNQWQQRRRDLQQQQPVVRDLLAEAAAAPLPESDDEQMLEGGYLLPTPSQNYGDIPVLPDYADEIEEMDTAQQRLASRRKLKEEQRLDKNKKYKIYYSPPPSPTLPPVYKRPDHPPPPPPPRSIPKVELKRDPQPT

SEQ ID NO: 142136 - protein, 103 aa, Heterodera glycines
  Coding regions on vcDNA: vcDNA=SeqID_68559; Strand=-; Position=1 -53,326-584
  Homolog annotation: Hit_ID=XP_146481.3; Match level="QueryCoverage =65%, HitCoverage=8%, E-value=5e-10, Identity=52%"; Hit description =PREDICTED: similar to carboxylesterase 2; carboxylesterase ML3; acylcarnitine hydrolase M1 [Mus musculus]
LCAYPVEKNTIRPRDLRRVLGNSLWELNHPEDALYEYEKADEQPGDEEEEGEEAEEEEAEEDDGGAAEGSGEGEEEGEEEEEEPEEEPENGQRFDYVFKKKTF

SEQ ID NO: 142137 - protein, 34 aa, Heterodera glycines
  Coding regions on vcDNA: vcDNA=SeqID_68560; Strand=+; Position=1 -10,188-282
MKIENDNEKCRFCRSVFENFKKANPEREWLSSLR

SEQ ID NO: 142138 - protein, 75 aa, Heterodera glycines
  Coding regions on vcDNA: vcDNA=SeqID_68561; Strand=+; Position=1-227
MIGRAVRNRPFIFEGIFKFILYPRKMSISFFEKFYTSQKRLRMRRRAVHNRHFISQKDFIFYRLSQKNGYLLFLI

SEQ ID NO: 142139 - protein, 92 aa, Heterodera glycines; identical to SEQ ID NO: 125147
  Coding regions on vcDNA: vcDNA=SeqID_68562; Strand=+; Position=1-304

SEQ ID NO: 142140 - protein, 69 aa, Heterodera glycines
  misc_feature (20)..(20): Xaa can be any naturally occurring amino acid
  Coding regions on vcDNA: vcDNA=SeqID_68563; Strand=+; Position=1-209
EILYLTKALEYETEGCAQSXILFHRGFLYLDVIPEKWLSLFLINFIHIQMLSSMIGRAVRNRPFIFEGI

SEQ ID NO: 142141 - protein, 202 aa, Heterodera glycines
  misc_feature (178)..(178): Xaa can be any naturally occurring amino acid
  Coding regions on vcDNA: vcDNA=SeqID_68564; Strand=+; Position=1 -102,146-215,256-363,417-439,604-740,2465-2517
  Homolog annotation: Hit_ID=CAE62535.1; Match level="QueryCoverage =98%, HitCoverage=50%, E-value=3e-48, Identity=47%"; Hit description =Hypothetical protein CBG06644 [Caenorhabditis briggsae]
MGLCKCPKRKVTNLFCFEHRVNVCEFCLLSNHESCVVQTYLSWLTDSDYCVVQTYLSWLTDSDYDANCLLCFESLSSKETLRLRCLHLFHWSLSSKETLRLRCLHLFHWDCFDSRARQLPQTTAPAGYKCPYKCPSCLECIFPSENQSSPVVDKLRAKLQTVNWGRFGLGLPSVCLIXHTYFNYSGTPAPPPPPLRHLPSPH

SEQ ID NO: 142142 - protein, 274 aa, Heterodera glycines
  Coding regions on vcDNA: vcDNA=SeqID_68565; Strand=-; Position=1 -473,521-872
  Homolog annotation: Hit_ID=CAA82671.1; Match level="QueryCoverage =49%, HitCoverage=33%, E-value=1e-10, Identity=38%"; Hit description =glue protein [Drosophila virilis] pir||S50125 larval glue protein Lgp3 precursor - fruit fly (Drosophila v
MTFITRQTEEPMRTAKGEKGQWHGQQKPRRTFDTEARRTLDTEARRTLDTEARRTFDTEARRTLDTEARRTLDTEARRTLDTEARRTLDTEARRTLDTEARRTLDTAMQIIAAISKSLPPTPPESARKIRHPTQSPLKGHFQVGHSTTIPKPFRLASRSPVPCRFAKRHLEAMLEERRRKEEAERRREPFRAKPVPQSTYRADSDIRIGQLKRKRTLSLPDKAKQQNVPMRGQSVPLSTYIRPNSAMEETRKLRRQRRAVEELAKATGPRGMEV

SEQ ID NO: 142143 - protein, 147 aa, Heterodera glycines
  Coding regions on vcDNA: vcDNA=SeqID_68566; Strand=+; Position=1 -62,250-631
  Homolog annotation: Hit_ID=XP_508521.1; Match level="QueryCoverage =89%, HitCoverage=18%, E-value=3e-26, Identity=44%"; Hit description =PREDICTED: stress-induced-phosphoprotein 1 (Hsp70/Hsp90-organizing protein) [Pan troglodytes]
MCGKAVEVGRENRADYALVAKAYARMANSYKMKDDPKKALHFYEKALSEHRDPDIVKKHKELAKEVKEMEQKAYIDPELSDKEKNLGNQLFKKGKQWEKGRKHWEGNQSEIGNGKSMDNLALCLYHFIPFKFLRRLPRGYETLQRGD

SEQ ID NO: 142144 - protein, 22 aa, Heterodera glycines
  Coding regions on vcDNA: vcDNA=SeqID_68567; Strand=+; Position=1-67
KNFDFFPEIEKFFGLSGTFESR

SEQ ID NO: 142145 - protein, 66 aa, Heterodera glycines
  Coding regions on vcDNA: vcDNA=SeqID_68568; Strand=+; Position=1 -122,222-300
MHFNFNHQKLLKFDVRPHWAKYYLMKPCQFLPNYPRLEEFRQLAEAMDPAHKFRNKFIKENVFNEI

SEQ ID NO: 142146 - protein, 210 aa, Heterodera glycines
  Coding regions on vcDNA: vcDNA=SeqID_68569; Strand=+; Position=1 -621,746-757
MLPIKFCFFKLFLYWQFTLILSQQISSKKECREFEQNLLVLFGGNKAFSGAIEFEPLEKWTKECFADWFCEKIKTKFEKSAQINGEIEEKMSKMQAKFCEENEKGKSIEKAMKSVEKETEEIIQNMKIDQKMQEKMRKIMEDGINKNALIGEKLKKIMDHFKIQSFSDLINGKSISFGFINLQIQGYFKFCSVKRKKSNAVIDKAQKKNP

SEQ ID NO: 142147 - protein, 33 aa, Heterodera glycines
  Coding regions on vcDNA: vcDNA=SeqID_68570; Strand=+; Position=1-6,48- 143
MKGRGKRRERTAPPITQTLFVIIVLSRSTKKTQ

SEQ ID NO: 142148 - protein, 96 aa, Heterodera glycines
  Coding regions on vcDNA: vcDNA=SeqID_68571; Strand=+; Position=1 -231,695-750
  Homolog annotation: Hit_ID=NP_502704.1; Match level="QueryCoverage =100%, HitCoverage=9%, E-value=7e-28, Identity=55%"; Hit description =solute carrier family 12 member 2 (4O872) [Caenorhabditis elegans] emb|CAB05202.1| Hypothetical protein Y
IMFVLHWSTSLVTFFVFIVLFVFIKHNKSHINWGTSTEANRYRRALNSLLKISRTEDHVKNYRPQLLVLSGNPVARQALVDFAYCISNGRSLLLCG

SEQ ID NO: 142149 - protein, 335 aa, Heterodera glycines
  Coding regions on vcDNA: vcDNA=SeqID_68572; Strand=-; Position=1 -130,459-693,747-829,874-936,998-1194,1421-1569
  Homolog annotation: Hit_ID=NP_505694.1; Match level="QueryCoverage =99%, HitCoverage=47%, E-value=2e-52, Identity=34%"; Hit description =putative protein family member, with at least 9 transmembrane domains, of ancient origin (5K982) [Caenorh
DGMFRYGILTIAALCLTSISSNMIAFNFTQIVMRRTNWENASFSHVVPPTVPYSSREKSALLYAVGAASIVSTFPFSALYTRFGARFVFFGAGVASAVATALLPLAAARGMTAFLLVRFVQGFAYGANFAAIGFICHRWAGFAYGANFAAIGFICHRWANLRQHGLFLSCMTSFTPLSQTLTNTSCMTSFTPLSQTLTNTVAGFVSSPSFGWPSVYFGHASSPSFGWPSVYFGHAMVAPFLFGLWLFLYTDFPETHKCVGRREKAAISEGKSSAERAISGKVPYWSILQNKVVLVVWLNSFADIVTIVFMTTYMPIYVSKVLPYGVRETGIWSAL

SEQ ID NO: 142150 - protein, 189 aa, Heterodera glycines
  Coding regions on vcDNA: vcDNA=SeqID_68573; Strand=+; Position=1 -344,557-782
MGGGDLDEADEEKGGHAAGGSQRQKCGGHGTGDAGAEEHETSAEARVQGTERKSADDAGRADSVKQRRLFPRRIGHRRRHHVAAVQHEPGQHVLLTTEWRLIRPMANLGYHIRKSKMDEFLGKDAFSQLVLLITIWVKLNAIILDEIDVRQSAAIVRMPYLNIPSRQQHTLVELSLSFSAFSRLLPPIE

SEQ ID NO: 142151 - protein, 153 aa, Heterodera glycines
  Coding regions on vcDNA: vcDNA=SeqID_68574; Strand=-; Position=1 -192,239-362,413-558
MHFAQIEKFGNVMLVQGDDPAYFLAAHSCDIVFVDREMPYRTAHLLFRRGSPFTALFNKVILGSVIESEKVAIRRSYDRYRMLREMIRNQECEEKMAKSHLYKPLGFVPMFGLLAMCGISSGTALLIFAIECAIGSRKSKEISDEIEEERFRK

SEQ ID NO: 142152 - protein, 129 aa, Heterodera glycines
  Coding regions on vcDNA: vcDNA=SeqID_68575; Strand=-; Position=1 -32,76-165,238-438,555-621
GTAFSAPLPTGEGTVDTGCLFYQKSPPRMADFDYSLPIYSTLSRIAIRDHNSFPLAEIWRLFHPFSVDTWLAIVLFIALHSFVFMVIEKIEFLVNRRTVAQMPIFHNILWRLLRLQLLQPKSVRLATVS

SEQ ID NO: 142153 - protein, 105 aa, Heterodera glycines
  Coding regions on vcDNA: vcDNA=SeqID_68576; Strand=-; Position=1 -259,480-538
MPTLLTKLCALILICQITLLASTNPLEEAPQKSLAKKRLKILVYSPTIGWSHMQFMGSIADTLVGAGHDLVNQMINQKLMNYKIWGTHFSRFNEQKGRGIAQGSV

SEQ ID NO: 142154 - protein, 27 aa, Heterodera glycines
  Coding regions on vcDNA: vcDNA=SeqID_68577; Strand=+; Position=1 -36,217-264
MNVERIKMNSNKIFFNRNSNYRTQTCD

SEQ ID NO: 142155 - protein, 95 aa, Heterodera glycines
  Coding regions on vcDNA: vcDNA=SeqID_68578; Strand=+; Position=1-926
MFEYPKRTLEKIDFFVFGAVPPNRCAQIYGETESFGNSFPIVCTLILRWIFAPHKCLSTPNGHLKKSIFLFSGQSPRTDAPRFMGRPNPSGVASL

SEQ ID NO: 142156 - protein, 46 aa, Heterodera glycines
  Coding regions on vcDNA: vcDNA=SeqID_68579; Strand=+; Position=1 -25,291-406
MRLFFILTAVQTIDTIQVRSANTNNNMNNIRSSQQMNVHSINLNRY

SEQ ID NO: 142157 - protein, 64 aa, Heterodera glycines
  Coding regions on vcDNA: vcDNA=SeqID_68580; Strand=-; Position=1-717
KNRFIFVFGAVPPNRCAQIYGETESFGNSFPIACTLILRWIFAPHNWLSTPNGHLKKSIFLFSG

SEQ ID NO: 142158 - protein, 75 aa, Heterodera glycines; identical to SEQ ID NO: 138893
  Coding regions on vcDNA: vcDNA=SeqID_68581; Strand=+; Position=1-228

SEQ ID NO: 142159 - protein, 104 aa, Heterodera glycines
  Coding regions on vcDNA: vcDNA=SeqID_68582; Strand=+; Position=1 -181,271-404
MADRRTIERFLRPPPPPQPQQQQPKTFLVKTLKTVLKIREKLGKNFQNIDCLDLGNLISSENLKNFLLPTAATTGISKMLVLVNVCKQNDQQKWECEEQLHFIF

SEQ ID NO: 142160 - protein, 33 aa, Heterodera glycines
  Coding regions on vcDNA: vcDNA=SeqID_68583; Strand=-; Position=1-142
AASRPRTGASRPFFKFCWAYTGASRPFLNLLGY

SEQ ID NO: 142161 - protein, 80 aa, Heterodera glycines
  Coding regions on vcDNA: vcDNA=SeqID_68584; Strand=+; Position=1 -4,304-542
MCIPPIIYLALNKTVRRDVYIMMMKPLSKLFYCCIKAPADPSTTRLFNTVTVRRMAAGGKVVPASSNVHTAKISNSNMKY

SEQ ID NO: 142162 - protein, 123 aa, Heterodera glycines
  Coding regions on vcDNA: vcDNA=SeqID_68585; Strand=-; Position=1 -134,583-820
MHDSTIENLHRTNNAIEGWHLAFRQRFAGLHPPFSKYCSTKLRKKAKPQMSGRKCPILAWAAKFSKKLGRKCPKMALKKWAANVRAANVRAANVGPQMSDLAGAANVRAANVRAANVRDAKVG

SEQ ID NO: 142163 - protein, 48 aa, Heterodera glycines
  Coding regions on vcDNA: vcDNA=SeqID_68586; Strand=+; Position=1 -73,125-198
MRKKWNSTFTINLSEKIGTVKNITLFIFSSVFEIKIYGPDLLQTFESR

SEQ ID NO: 142164 - protein, 77 aa, Heterodera glycines
  Coding regions on vcDNA: vcDNA=SeqID_68587; Strand=+; Position=1-234
MSSVGPFVTFAQFHSSLLVLLPTPKRCLSNIPMQMVHCFDDRFDVAIHWLIKKPSVKRRQNIFNAKRMRRILQIRDF

SEQ ID NO: 142165 - protein, 35 aa, Heterodera glycines
  Coding regions on vcDNA: vcDNA=SeqID_68588; Strand=+; Position=1 -77,201-231
MPDRTGLVFSKMTGFGIRSLIIRSIRNLVHQKMSS

SEQ ID NO: 142166 - protein, 75 aa, Heterodera glycines
  Coding regions on vcDNA: vcDNA=SeqID_68589; Strand=+; Position=1 -81,265-411
  Homolog annotation: Hit_ID=CAE62116.1; Match level="QueryCoverage =98%, HitCoverage=6%, E-value=7e-25, Identity=57%"; Hit description =Hypothetical protein CBG06155 [Caenorhabditis briggsae]
MKKQTLLMRNQIEQVYAERDILTFTDNSAGTLPIELARLYVAETVLAIEYLHSCGIVHRDLKPDNLLITSMGHIN

SEQ ID NO: 142167 - protein, 68 aa, Heterodera glycines
  Coding regions on vcDNA: vcDNA=SeqID_68590; Strand=-; Position=1-318
AVLVRFITAPNLLASQQSLLNLPDRTGAHDSTVPSTPPKAKRYNQNIRKNFLKNFFSIFLFDKRASEC

SEQ ID NO: 142168 - protein, 39 aa, Heterodera glycines
  Coding regions on vcDNA: vcDNA=SeqID_68591; Strand=-; Position=1 -61,412-470
MRRIISWSSFKCEFRRQKVTGKSIATYDFEEAEAESYLC

SEQ ID NO: 142169 - protein, 648 aa, Heterodera glycines
  Coding regions on vcDNA: vcDNA=SeqID_68592; Strand=+; Position=1 -127,226-1883,2730-2852,2916-2954
  Homolog annotation: Hit_ID=XP_318550.1; Match level="QueryCoverage =87%, HitCoverage=59%, E-value=1e-119, Identity=40%"; Hit description= ENSANGP00000020240 [Anopheles gambiae]
MTNRLFAHFSEPLLYYSRFIKKMRELRAPLDQLFGKDELWNWADASKDGIGATISHIFPDKTEKVIEHASSVLSEAQRNYSQVEKEALALIFAVQKFHRMIFGRKFTLLTDHKPLISIFGSKKGIPIYAASRLQRWALILSNYEFDIRYINTTAFGQVDMLSRLIANYPRPEEDILIAKICTETECFIGTILQSRIDQLPVTATEIAEMTQKDEILQKVAKFSKEGWSQKCNDPDLAPFFPKRNEILQIENCLLYQNRVIIPTVLRDRTLKALHMAHPGIVRMKALARQHVYWPGMDSAIEKLVKSCEECQIAQKAAPKTLLSPWNATKRPFQRVHIDFAGPCQDGHVYLLLLDSFSKWPEVYQMNTMTSKATISVLRLIIHRLGIPEEIVSDNGRQFRSSEFSEFCKEFGIRHTFTPPFHPQSNGQVERFVDTFKRAMQKCSKKDKNWAEKMLLSYRTTPNSAINGHSPDQLFFGRKLRTQLSLTHPTGKVNETIDKTIFHQKQEKYRTKMAQNFNEKHGVKSNEFLPTDPVLVLNYQHGKSHWLQGTIIERLNNSPTYRVNVPRLGRNIHRHANQMRRRYVFEESLGFVGPAQFIFNKAIGSPSYFSDESYSFMVLSPEVYSPNVASKLSNSIFLILFLEREAYLI

SEQ ID NO: 142170 - protein, 45 aa, Heterodera glycines
  Coding regions on vcDNA: vcDNA=SeqID_68593; Strand=+; Position=1 -42,154-249
MDEIARLIKGNVSRKLKNANDKRFCTSGHRFGHIRTFFNPKGHET

SEQ ID NO: 142171 - protein, 61 aa, Heterodera glycines
  Coding regions on vcDNA: vcDNA=SeqID_68594; Strand=-; Position=1 -102,416-468,526-556
MGSRRIGEMVFLGKKGKCSSAVDYVQARYIAQLVGAADLEQTRFLSFTEIYQHLGPPMEED

SEQ ID NO: 142172 - protein, 92 aa, Heterodera glycines; identical to SEQ ID NO: 127421
  Coding regions on vcDNA: vcDNA=SeqID_68595; Strand=-; Position=1-304

SEQ ID NO: 142173 - protein, 75 aa, Heterodera glycines; identical to SEQ ID NO: 138893
  Coding regions on vcDNA: vcDNA=SeqID_68596; Strand=-; Position=1-228

SEQ ID NO: 142174 - protein, 182 aa, Heterodera glycines
  Coding regions on vcDNA: vcDNA=SeqID_68597; Strand=+; Position=1 -57,253-365,779-922,1001-1080,1204-1358
  Homolog annotation: Hit_ID=AAH77974.1; Match level="QueryCoverage =67%, HitCoverage=24%, E-value=3e-20, Identity=45%"; Hit description =MGC81027 protein [Xenopus laevis]
SGCLSGGHHPHSQHQGHENNAHAERHTAKSERNRRPVHRGQQLFSRFSVFVQHGPCGTVIRVFSIPDGERLYEFTRGVTRYAQINSLAFSQDSRFLCLSSNTETVHLFALLTPFEQQQAYHHHSHHHQCQKSDETSQEGLSSWVSYLSQQASAYLPQHVNELMLREKKTAPARLPILGTLSR

SEQ ID NO: 142175 - protein, 56 aa, Heterodera glycines
  Coding regions on vcDNA: vcDNA=SeqID_68598; Strand=-; Position=1-168
MDEEETLKLIDYDGATFIPVGLFENPRKLANKVVPREFYVATPTYVAIEYYEEDIM

SEQ ID NO: 142176 - protein, 204 aa, Heterodera glycines
  Coding regions on vcDNA: vcDNA=SeqID_68599; Strand=-; Position=1 -558,1215-1271
  Homolog annotation: Hit_ID=NP_996669.1; Match level="QueryCoverage =97%, HitCoverage=93%, E-value=1e-22, Identity=33%"; Hit description =similar to Hypothetical protein CBG21647 [Homo sapiens]
MIKRGTKMIRRGTNLIRRGTNLIRRGITVIKSGTKVIQRGISVIKKRTKVIRRGAKVIRRGTKVIQKRTKVIQRGTTVIKRGTAVIKRCTAVIKRGTAVIKRGTTVIKRGTIVIKRGTAVIKRCTAVIKRGTAVIKRGTAVIKRGRTVIRRGTKVIKRGTIVIKRGRTVIRRGTTVIRSGTTLLGENRVMNFFLKNRKFPEILE

SEQ ID NO: 142177 - protein, 75 aa, Heterodera glycines; identical to SEQ ID NO: 124542
  Coding regions on vcDNA: vcDNA=SeqID_68600; Strand=+; Position=1-225

SEQ ID NO: 142178 - protein, 187 aa, Heterodera glycines
  Coding regions on vcDNA: vcDNA=SeqID_68601; Strand=+; Position=1 -94,137-316,362-651
  Homolog annotation: Hit_ID=AAL93203.1; Match level="QueryCoverage =90%, HitCoverage=25%, E-value=8e-11, Identity=25%"; Hit description =transposase [Bactrocera dorsalis]
MDIYRELLKLKKCVQSFWLDLRKDSVIWRMRNYMLFQHSWTLGEQLSINGSERITSEHVETVSLFVVPPPPKQRRTLLDSLSEMASTSKSFVQIESTFDDELKKYCSVDLIGQELDPLDWWKINEGLFPIIAALAKRYISAPATTIGSEQLFSVARDVFDYRRSKLKAEHAEMLIFLNKSIPKIRFY

SEQ ID NO: 142179 - protein, 155 aa, Heterodera glycines
  misc_feature (30)..(30): Xaa can be any naturally occurring amino acid
  misc_feature (63)..(63): Xaa can be any naturally occurring amino acid
  Coding regions on vcDNA: vcDNA=SeqID_68602; Strand=+; Position=1-479
  Homolog annotation: Hit_ID=NP_671477.1; Match level="QueryCoverage =92%, HitCoverage=50%, E-value=5e-29, Identity=55%"; Hit description =rRNA promoter binding protein [Rattus norvegicus] gb|AAK21974.1| rRNA promoter binding protein [Rattus no
ASHGQKPPFHATARLTRPLEPILFPKLRIXFADFPYLHYSRLEAVHLGDLLRISVRSGRRFKXLPSHFQGPCGAHETPQEPRCFTGATSLSQAEPLPGTHTLNEKRTLARTPHDVCEFICVTAQNSSCEPSFLAWRGNEPTSLSATGWTNCASTE

SEQ ID NO: 142180 - protein, 41 aa, Heterodera glycines
  Coding regions on vcDNA: vcDNA=SeqID_68603; Strand=-; Position=1-124
DNYVMKPSREGGGNNFWGDEIPKKLREMSRAELSGHILMQK

SEQ ID NO: 142181 - protein, 116 aa, Heterodera glycines
  Coding regions on vcDNA: vcDNA=SeqID_68604; Strand=-; Position=1 -153,290-425,665-727
  Homolog annotation: Hit_ID=CAA58318.1; Match level="QueryCoverage =96%, HitCoverage=23%, E-value=4e-10, Identity=32%"; Hit description =glutathione synthetase [Arabidopsis thaliana]
KKFDDKDAIILIVAGKLYRNYEQYQLNYLMENVSKNKIKIVQMSLTEAAEELTQGNDHSLLYGTQKVAIAFYRSISSLRDERIFNARLMIERSTAIKIPTVANALASQKKIQQVIL

SEQ ID NO: 142182 - protein, 53 aa, Heterodera glycines
  Coding regions on vcDNA: vcDNA=SeqID_68605; Strand=-; Position=1 -12,547-696
MTAMPYYEEMAKVCRKRCHLCDKAMPLNKRIAKKVADRAKRINDGLSDEEMNE

SEQ ID NO: 142183 - protein, 677 aa, Heterodera glycines
  Coding regions on vcDNA: vcDNA=SeqID_68606; Strand=-; Position=1 -480,1185-1368,1650-1982,2121-2344,2707-2958,3189-3269,3560-4039
  Homolog annotation: Hit_ID=BAA95789.1; Match level="QueryCoverage =33%, HitCoverage=45%, E-value=5e-15, Identity=28%"; Hit description =KED [Nicotiana tabacum]
MANGFNYGDYDGEITLDFEFARPLDIDEEEGKEDENTEEENSKKEEKEEDEKVGKTESSDRQADSVENSEAKKETKTVQMKKMVKKLTKQQTEKEEKLIQYLCEVRQCDSQKTEECWMKLFDALTALDDEDRYDNMRQYCSANKSWIRYCSNMAMCDDIDKVIVFKKKTEEDEVIIEEDEEEKEDDNEKEKAQIKEREEAKGKEKKTKQGKSSDKKPMQNEVSSEKIAKPKKSSTKPPSAAGVKKKPNKEVPPINLMDEPYVGQPQALQYSVSNIGYGNQIQEPYTTQRNDSLMYTTGSPMLPHSMSSIGPSMTLSDSVYPTPTNNITPYQTVPSVQQQHQHQIQYPPTQQYSMSFNGVPSPQYQTYTSFSMPPNSSQYRDIGLPQSHLASTAGGSGSLAPLNQYPPQPGMAGPPSFVGNDANAMVNNNYPSSSDHHKQRSRRQKRGDRSPYDFSMYNNSDKSASTQSVPSSSSSRRQKARTPNIVQKANVEKKIETPEEHMSNHLKMYMQCVKKLLTEHLLVDNRNEDKVSKNFRQLLYGVMLPKPVFIAQQLNMALNGMPKDGIDIASLMSAPSYSMANPFVAAKKIIKDKGLSEKSTKNNEMETKQHKKGMLAQPPIKQDLRVLLEIASTQSRWPTKGGGLGKAKVGRVLGIFYNSLENLQKNYLKGRLLGFFV

SEQ ID NO: 142184 - protein, 86 aa, Heterodera glycines
  Coding regions on vcDNA: vcDNA=SeqID_68607; Strand=-; Position=1 -93,395-562
MNPQQKLTHTAVIGRAVSSSGRPGTWQDLGWTLPDSEILQILESNEKDNFNAIDPNLFVDPSTKRFWLQYGSFWMGIFQAIFSFPK

SEQ ID NO: 142185 - protein, 49 aa, Heterodera glycines
  Coding regions on vcDNA: vcDNA=SeqID_68608; Strand=-; Position=1 -54,173-268
MQKYLCFCHRKRLDERTKVNIFPNFHFIVPSVRVISQKTVVGDRRKVQI

SEQ ID NO: 142186 - protein, 96 aa, Heterodera glycines
  Coding regions on vcDNA: vcDNA=SeqID_68609; Strand=+; Position=1 -82,403-611
MNSEDTKEMWRRIDCFYAGRRDEVKDHRHFPDPDPNNFGIIRKPRLCRLRQIVSIFDLTIFKVCKKRSKMEHLKKVQILTRFSNTVRTILNRLGCR

SEQ ID NO: 142187 - protein, 94 aa, Heterodera glycines
  Coding regions on vcDNA: vcDNA=SeqID_68610; Strand=-; Position=1 -127,172-328
IADQLLAFSDAHIALVLNRPEKNEKLSELATEHSENVSQFDSFGTGDNARITRLLGKSLCDGIVAFQMGQFERTFDLVYPIRTQLYKISGSNAQ

SEQ ID NO: 142188 - protein, 137 aa, Heterodera glycines
  Coding regions on vcDNA: vcDNA=SeqID_68611; Strand=-; Position=1-414
AVPTSIWAANDDDMYKPKQYDQQEQPKQAERPAAAYGAKLADDDMYNPKQYTEQQKAAAAGGGGRPTYEAALADDGLYNPKQYSQKPQQQQQTGADDDDLYKPPQQYNQQQQQKMGRPKSYEDELDEDDLYNPKQYN

SEQ ID NO: 142189 - protein, 25 aa, Heterodera glycines
  Coding regions on vcDNA: vcDNA=SeqID_68612; Strand=+; Position=1-77
SKSSLTTAQKNMFFVRFRPRGAQEK

SEQ ID NO: 142190 - protein, 31 aa, Heterodera glycines
  Coding regions on vcDNA: vcDNA=SeqID_68613; Strand=-; Position=1-95
MRTSLLIPLSLFSLITLLFIVSFSEADIEMD

SEQ ID NO: 142191 - protein, 52 aa, Heterodera glycines
  Coding regions on vcDNA: vcDNA=SeqID_68614; Strand=-; Position=1-291
LTGAIYYLILLKTKQKNMLSKARIIVEQSSSKFLSFYYKMPLMFLPLFRQLL

SEQ ID NO: 142192 - protein, 45 aa, Heterodera glycines; identical to SEQ ID NO: 124527
  Coding regions on vcDNA: vcDNA=SeqID_68615; Strand=-; Position=1-138

SEQ ID NO: 142193 - protein, 92 aa, Heterodera glycines; identical to SEQ ID NO: 124679
  Coding regions on vcDNA: vcDNA=SeqID_68616; Strand=+; Position=1-681

SEQ ID NO: 142194 - protein, 69 aa, Heterodera glycines
  Coding regions on vcDNA: vcDNA=SeqID_68617; Strand=-; Position=1-270
LFEYPKRTLEKIDFFVFGAVPPNRCAQIYGETESFRNSFPIACTLILRWIFAPHNCLSTPNGHLKKSIF

SEQ ID NO: 142195 - protein, 53 aa, Heterodera glycines; identical to SEQ ID NO: 139101
  Coding regions on vcDNA: vcDNA=SeqID_68618; Strand=-; Position=1-214

SEQ ID NO: 142196 - protein, 36 aa, Heterodera glycines
  Coding regions on vcDNA: vcDNA=SeqID_68619; Strand=-; Position=1 -44,236-302
MVVTVWWHKVAVGPSFLFISPAALSEALWAPASLIL

SEQ ID NO: 142197 - protein, 98 aa, Heterodera glycines
  Coding regions on vcDNA: vcDNA=SeqID_68620; Strand=+; Position=1 -82,123-337
MHLPWTFGIIHFFRFIYTLKIESVVMEKNLKIPKLLLSFFFLETKSLMAISRSENPILTTISTQFRTPNTVSNKKPKIQFFEFAFLVYKWLKSTLLKQ

SEQ ID NO: 142198 - protein, 168 aa, Heterodera glycines
  Coding regions on vcDNA: vcDNA=SeqID_68621; Strand=-; Position=1 -109,268-366,614-796,1160-1273
  Homolog annotation: Hit_ID=AAH75453.1; Match level="QueryCoverage =99%, HitCoverage=46%, E-value=6e-38, Identity=47%"; Hit description =MGC76123 protein [Xenopus tropicalis] gb|AAH64218.1| Hypothetical protein MGC76123 [Xenopus tropicalis] re
MAPLLAGTVARTMAVSVVSPLELVRTKMQSERLSYSELRGAIVRTVKSDGYMALWRGWTATIMRDIPFSAIYWSLYEFSKPRLMQIAHRQQPNFALSFASGALSGSVAALLTLPFDVVKTHQQITLGQIDAERHAHHEKAAKMSTRNTNMFGVMRELVNSKGLGALFT

SEQ ID NO: 142199 - protein, 166 aa, Heterodera glycines
  Coding regions on vcDNA: vcDNA=SeqID_68622; Strand=-; Position=1 -105,401-468,796-908,1041-1154,1309-1407
  Homolog annotation: Hit_ID=NP_001002360.1; Match level="QueryCoverage= 100%, HitCoverage=41%, E-value=1e-40, Identity=48%"; Hit description =zgc:92520 [Danio rerio] gb|AAH76052.1| Zgc:92520 [Danio rerio]
MDHLCRVCGNRAAGIGTGSEQCEWFNRPGHFSGTLDAFVKIVRIEGLRSLWSGLSPTMLSAIPATVFYFTMYDNMLCMWRNALASNKNNSTFSGAAFMAPLLAGTVARTMAVSVVSPLELVRTKMQSERLSYSELRGAIVRTVKSDGYMALWRGWTATIMRDIPFS

SEQ ID NO: 142200 - protein, 18 aa, Heterodera glycines
  Coding regions on vcDNA: vcDNA=SeqID_68623; Strand=+; Position=1-56
PYRDRDLSFSKSGTGNRD

SEQ ID NO: 142201 - protein, 104 aa, Heterodera glycines
  Coding regions on vcDNA: vcDNA=SeqID_68624; Strand=-; Position=1 -68,119-211,537-645,707-748
  Homolog annotation: Hit_ID=NP_501127.2; Match level="QueryCoverage =97%, HitCoverage=7%, E-value=4e-34, Identity=70%"; Hit description =RNA Polymerase, Class III (C), rna polymerase (rpc-1) [Caenorhabditis elegans] gb|AAA83341.2| Rna polymera
MGEHGIELDRRHVQLLADLMTYRGQVLGITRDGLVKMKESVLLLASFERTIDHLYEAAFFGQQDRISGVSECIIIGTPMGIGTGMFKLLQNQKPVKFVQQSDKQ

SEQ ID NO: 142202 - protein, 58 aa, Heterodera glycines
  Coding regions on vcDNA: vcDNA=SeqID_68625; Strand=+; Position=1 -86,160-250
MMRSIAEEKGGLLSSTFQFLVQSDSSELRKMIMFQVPIHEKLILLLLGVPDHESEHLF

SEQ ID NO: 142203 - protein, 305 aa, Heterodera glycines
  misc_feature (3)..(3): Xaa can be any naturally occurring amino acid
  Coding regions on vcDNA: vcDNA=SeqID_68626; Strand=+; Position=1 -140,197-322,375-451,504-591,642-845,999-1082
  Homolog annotation: Hit_ID=AAG23825.1; Match level="QueryCoverage =99%, HitCoverage=20%, E-value=2e-69, Identity=51%"; Hit description =guanylyl cyclase [Heterodera glycines]
FAXGLTGYVTVETDQNTRVFVLSNRNGQGNALQIFMQFAWVDGKLNVTLRNASSVMWDTRGGVIPNVTLRNASSVMWDTRGGVIPQAVPPCGFDGNGCTVSVFELYKGYFISGIVLFVLIIGSSLLIGYFISGIVLFVLIIGSSLLIMVYLIHSKIVENRKTNLLWQIPFSKIVENRKTNLLWQIPFAMMKRVKQRVSFHGAERSHHSLRHGAERSHHSLRSNQTNVSALTHSTMDSLAQSKNFSLYTYNGDKCIVCTFGSMTAAAPLSVAEMAECRAMPLFHHKRTRFLGLILDGPNGLGGGNF

SEQ ID NO: 142204 - protein, 110 aa, Heterodera glycines
  Coding regions on vcDNA: vcDNA=SeqID_68627; Strand=-; Position=1-330
MSPYGHGTVAAGYQQQQQQQQQSPFAALNFIPYGAAPPEGIEERHNANHNNKMMMMNSNERKRHSINTTAAAEAALMGTTGVPELELGPDGARGSVSLQMAYEPANLALQ

SEQ ID NO: 142205 - protein, 45 aa, Heterodera glycines
  Coding regions on vcDNA: vcDNA=SeqID_68628; Strand=-; Position=1-434
LNLKKCQRLLFLKFFEILTFSSIIYYFAKLIHKYSLERALKRTKC

SEQ ID NO: 142206 - protein, 121 aa, Heterodera glycines
  Coding regions on vcDNA: vcDNA=SeqID_68629; Strand=-; Position=1-646
LFEYPKRTLEKIDFFVFGAVPPNRCAQIYGETESFGNSFPIACTLILRWIFAPHNCLSTPNGHLKFGAVPPNRCAQIYGETESFRNSFPIACTLILRWIFAPHNCLSTPKRTLEKNRFFLF

SEQ ID NO: 142207 - protein, 42 aa, Heterodera glycines
  Coding regions on vcDNA: vcDNA=SeqID_68630; Strand=+; Position=1-129
LDETVAESFYGGVLALYSISQIIASPLLGYWSNRVQSHKLPL

SEQ ID NO: 142208 - protein, 71 aa, Heterodera glycines
  Coding regions on vcDNA: vcDNA=SeqID_68631; Strand=+; Position=1 -107,484-589
  Homolog annotation: Hit_ID=NP_510453.1; Match level="QueryCoverage =97%, HitCoverage=14%, E-value=3e-24, Identity=73%"; Hit description =UNCoordinated locomotion UNC-3, Olf-1/EBF transcription factor (55.0 kD) (unc-3) [Caenorhabditis elegans]
LHRAHFEHPPPPNLRKSNFFHFTVNLYDRDNQPIEIEQAIFAGFVEKEKEVHGENTRNGIHYRASLLFANG

SEQ ID NO: 142209 - protein, 39 aa, Heterodera glycines
  Coding regions on vcDNA: vcDNA=SeqID_68632; Strand=+; Position=1-118
MTRAYGKLLGPCFKTGRTDDRLIHRERTTESPRWTALVA

SEQ ID NO: 142210 - protein, 76 aa, Heterodera glycines
  Coding regions on vcDNA: vcDNA=SeqID_68633; Strand=-; Position=1-231
MDGIVPPADEDEQVPTMDEEETDEEEEAMPPPAVVEDGAVEDEEEGANAISDGETGGYGNDNDGMAFLGVLFWIGQ

SEQ ID NO: 142211 - protein, 69 aa, Heterodera glycines
  Coding regions on vcDNA: vcDNA=SeqID_68634; Strand=-; Position=1 -54,183-305,460-492
MWPPPILFERTNGEESVFRENVRAYFSEHCDTISEVHECDLFFVQLNGGEGWFPEDDQIFFALVRQWPI

SEQ ID NO: 142212 - protein, 291 aa, Heterodera glycines
  Coding regions on vcDNA: vcDNA=SeqID_68635; Strand=+; Position=1 -121,166-920
  Homolog annotation: Hit_ID=AAH78128.1; Match level="QueryCoverage =77%, HitCoverage=22%, E-value=6e-17, Identity=31%"; Hit description =LOC397995 protein [Xenopus laevis]
MDFDHSPTLFSETGSETEKSEGNEEGTKREQKEKDASTKQSDDEEEEEETDESSTAEEKGGEALSEREECWKRMEEEEEDGEEEGEEEEEEEGEKEEVGREKGQRGRGKEKGNGRDGRIKTAENGRGGGGKPGGENRPTTVRSMKRKCANTSAGGPLFQYPSEVSRRAEKRPTEFDSQMYAAGEQFSREVKTKNEKSYNKILGGRRTAKNTRKQTERATDDNQPKTGGGGEGEGGEAGGRTDGRTIKLDILNRMFDNTFKPTKHERAQLAQDSGLSMRVIQVKRNGKSAKE

SEQ ID NO: 142213 - protein, 193 aa, Heterodera glycines
  Coding regions on vcDNA: vcDNA=SeqID_68636; Strand=+; Position=1-582
MLSDNWSLRAVAKWTRECRRRSLVPHQCRSKFEVGTEEPENYNWHSCYFYFTFGLKWSASPGKMNRFLGNWVANITDDHRNFIVAATYLIASLIARQHQHNLGGKLLLQFQIALIYQKKITLTAIFPTLFVPPEPEVGLEHGTSIDANKFTRLSVPHPLTVRPLTSSHLQTLHRSRRSPNVKSLAGERPLHGL

SEQ ID NO: 142214 - protein, 22 aa, Heterodera glycines
  Coding regions on vcDNA: vcDNA=SeqID_68637; Strand=-; Position=1-65
CFLRMSTITQANIVRPSGNCKA

SEQ ID NO: 142215 - protein, 17 aa, Heterodera glycines
  Coding regions on vcDNA: vcDNA=SeqID_68638; Strand=-; Position=1 -23,58-88
MSKIKSIGSSSGYLFLF

SEQ ID NO: 142216 - protein, 24 aa, Heterodera glycines
  Coding regions on vcDNA: vcDNA=SeqID_68639; Strand=+; Position=1-76
ITGVSIIAVLFLVFLMPSQNLVRF

SEQ ID NO: 142217 - protein, 24 aa, Heterodera glycines
  Coding regions on vcDNA: vcDNA=SeqID_68640; Strand=-; Position=1-156
KFLKYLFISLFDSESIREPYLTFN

SEQ ID NO: 142218 - protein, 532 aa, Heterodera glycines
  misc_feature (5)..(5): Xaa can be any naturally occurring amino acid
  misc_feature (11)..(11): Xaa can be any naturally occurring amino acid
  misc_feature (14)..(14): Xaa can be any naturally occurring amino acid
  misc_feature (432)..(432): Xaa can be any naturally occurring amino acid
  Coding regions on vcDNA: vcDNA=SeqID_68641; Strand=-; Position=1 -133,178-424,476-554,596-695,742-901,956-1015,1064-1155,1209 -1538,1593-1692,1756-1839
  Homolog annotation: Hit_ID=NP_741131.1; Match level="QueryCoverage =96%, HitCoverage=15%, E-value=5e-76, Identity=38%"; Hit description =furry (3G219) [Caenorhabditis elegans] gb|AAF99910.1| Hypothetical protein F21H11.2a [Caenorhabditis eleg
FSSVXFLFFFXQLXLEISKIRWEATDVRDSVVLGIGSINPECFEFLLEEFNFLLEEFNSKGILREINDRKNETNVRRRKRKDLLRLQILRIIEFTLFRDFLKNCAIFERNSGTLPQSLLELFDSIRFHTENDNDRDLNVLTDRDLNVLTSLRLHFAKLISLIINGTPIEQREKLLEQREKLLPPDIKRSLFFLFLSWCGRTIGTIDKRKGVDVGISVEHHAIRAMCAKGVDVGISVEHHAIRAMCALATLGPMFECPGRICEEEAMFRWLETLLSSTNSIVDEICEQIVDEICEQILCHILHLNEHNPLLELVVQMCYTKLLELVVQMCYTKNDLVGIRCFNAISMLFSQREFPEFPCEYISLLCLCQSFASSIELASVRQTAFLLVQLLRHQFLNTHNSHADNDKQQFCNKWTVRNVRGIIAEKLNCSNFXHPTNQFGISKSLSSQYPQLTMPIFSEICCRLESARPNRQLICCRLESARPNRQLSLLAILPEWLRNVHFVDPNAEEEQSVALNGCGSEESTQLILNNLLY

SEQ ID NO: 142219 - protein, 1051 aa, Heterodera glycines
  misc_feature (44)..(44): Xaa can be any naturally occurring amino acid
  misc_feature (75)..(75): Xaa can be any naturally occurring amino acid
  Coding regions on vcDNA: vcDNA=SeqID_68642; Strand=-; Position=1 -153,181-345,408-622,677-816,987-1084,1135-1292,1337-1386,1462 -1592,1645-1798,1840-1995,2041-2128,2172-2385,2429-2946,3006 -3108,3158-3249,3310-3427
  Homolog annotation: Hit_ID=NP_741131.1; Match level="QueryCoverage =99%, HitCoverage=29%, E-value=0.0, Identity=40%"; Hit description =furry (3G219) [Caenorhabditis elegans] gb|AAF99910.1| Hypothetical protein F21H11.2a [Caenorhabditis elegan
RGDDSYNLLRALSGVCETCLPSILKVMIMWYEHQQRVSITEIGXPFFVCDARDRAIKRTLAASYLFCIVITEIGXPFFVCDARDRAIKRTLAASYLFCIVLIEILPQLHFHPCGCDEQINFIIDNSFKQISYRDPALFGNALFGNNYDNSLLVAELFAEVIGILSQSHSKQIQKTFFDHLNEYRKDALTSSIALRSIISLLMGTKFFRVQANQVSEFEIGVGFLNELQVSEFEIGVGFLNELGSYFLEVDLKQKDLKHALAGLLVEILLPMTAQIRTETNIPSLISFVDLYGPTYELVNKKQHKNASYPLLTCLLCISQANSSFSTWNASYPLLTCLLCISQANSSFSTWVQFLNLTLANLKNKDSMVSRMALESLYRLIWVYIIRISCEGNTATRVYIIRISCEGNTATRSRLESICGSLFPRGSLESICGSLFPRGSRNLVPRDAPLNFFVKIIHFIAQFKVDFAFKEIIFDLIGCARAEIIFDLIGCARAASRQLAIYPERMNVGLRALMVIADGLQQKESPPGMSRSLAPNTSGTIPNTSGTIHRTKRYITKPLSMDVARAIGLEQYYPHCRKAFDAILRTLDGQIGRPLMMTAPQMRGKEYNDLIRPLMMTAPQMRGKEYNDLIGADMKAKLDLFRTCIAAIPRLLPDPFRTCIAAIPRLLPDPMSHQDLIDFLTRMCIHVDEELRTTAYQSLQNLVTECPEWREDIIHNFIRFFISSIQDTFPALIESMDTFPALIESMVRLLLQLLTVWKANILMEQQRKKVEESTQNLSDNFTKHYPSASESTAQTNPSMAEKATPSQQKLVMQAAANIIATSTSSTGNTTSLALVPLFPIFSTFILVQMGLPKSSVPSFPLFPSLNINPTFVLHCVEGLGIALLCQTRLSTKKAVIQLLREVKQLIELIKLQNHEMAVIDILDSAIKLQNHEMAVIDILDSATPYVLDKYVVHLPALEKKKWPKDFKKWPKDFALVCERISMLETDANLVNVANGNEYMQWDPWACALSGYCEYMQWDPWACALSGYCEKKFLPTQCSTASTVSSSFPHIFL

SEQ ID NO: 142220 - protein, 147 aa, Heterodera glycines
  Coding regions on vcDNA: vcDNA=SeqID_68643; Strand=+; Position=1 -58,339-593,876-1005
  Homolog annotation: Hit_ID=NP_000240.1; Match level="QueryCoverage =68%, HitCoverage=16%, E-value=5e-18, Identity=46%"; Hit description =MutL protein homolog 1 [Homo sapiens] gb|AAC50285.1| DNA mismatch repair protein homolog [Homo sapiens] g
MPRIIQLQQEVVDKIAAGEVNHYESIFEMIFRMKDNGHGIAREDMSLACSRFATSKLHAAEELRSIGTFGFRGEALASISIVANSVTITSKTQSDKCAHRALYRAQSALFSVVLTAEEEAAVVVTFAQMETETNTAQFAHYSMPKCP

SEQ ID NO: 142221 - protein, 16 aa, Heterodera glycines
  Coding regions on vcDNA: vcDNA=SeqID_68644; Strand=-; Position=1-49
EAIPEGFGLPINLGAS

SEQ ID NO: 142222 - protein, 58 aa, Heterodera glycines
  Coding regions on vcDNA: vcDNA=SeqID_68645; Strand=-; Position=1-177
  Homolog annotation: Hit_ID=AAG57913.1; Match level="QueryCoverage =100%, HitCoverage=15%, E-value=6e-26, Identity=100%"; Hit description=L-1,2-propanediol oxidoreductase [Escherichia coli O157:H7] ref|NP_289354.1| L-1,2-propanediol oxidoredu
SPQDTCKAIGIISNNPEFADVRSLEGLSPTNKPSVPILAIPTTAGTAAEVTINYVITD

SEQ ID NO: 142223 - protein, 183 aa, Heterodera glycines
  Coding regions on vcDNA: vcDNA=SeqID_68646; Strand=+; Position=1-552
MPRRALLSIQTDIEQAAKALSTETVGQVAKPSKRIKRNLSWKKLEGKAEPKDAQPNQEQNLGGSQKEGGAESVEQNAEPIDAMDSAPPVHQRFELIGINWTIKKTITKIRGMPHRVQCAISPQTEQPRGKERVAERPETVGVPCVAELVAFGRQNSQPKSVGGKPRQHIGHYEKQLRKRGHSE

SEQ ID NO: 142224 - protein, 51 aa, Heterodera glycines
  Coding regions on vcDNA: vcDNA=SeqID_68647; Strand=-; Position=1 -53,99-198
LSRLQRTFVVGFWADNPKLLSRKLRGPVDFGEFAADCPILVSLALPLQQIR

SEQ ID NO: 142225 - protein, 185 aa, Heterodera glycines
  Coding regions on vcDNA: vcDNA=SeqID_68648; Strand=-; Position=1 -229,290-423,470-596,637-761
  Homolog annotation: Hit_ID=NP_508800.2; Match level="QueryCoverage =83%, HitCoverage=34%, E-value=2e-25, Identity=38%"; Hit description =putative protein, with at least 3 transmembrane domains, of bilaterial origin (50.4 kD) (XF295) [Caenorha
MTNVLSRLAANTFGLRILTAECHEFSHTWHPHCFWSLRDPFLPAWLFCLRTYGTLYALKALVDRRGRVHRVNWLRVLFNTLRSSFFLTTTEILFLVWLCIFRRLLGFATWPTVSVLNAFAACSMSVWIESKARRGILVPYLLNLASEALFRQAQNRRWICRSPPPFPHFQSLLFGISVASAVALL

SEQ ID NO: 142226 - protein, 241 aa, Heterodera glycines
  Coding regions on vcDNA: vcDNA=SeqID_68649; Strand=-; Position=1 -56,174-263,308-432,594-711,843-956,2582-2702,2757-2859
  Homolog annotation: Hit_ID=AAP31908.1; Match level="QueryCoverage =29%, HitCoverage=33%, E-value=6e-24, Identity=71%"; Hit description =cell junction protein VAB-9 [Caenorhabditis elegans] ref|NP _495836.2| cell junction protein VAB-9 (2I924)
FFTSVRSDSGKNVPIVEAVSADQFEAIRERMCQLEKQVNQQQEEKEKYADSLIQQQNAEQSEFCAKIDELSEKFGQFKEMHEEFVMKIDEKINANAEVANATQRKSTELEEQQNKLKNCVDILNYRFGNALIDQILELQNEQKTILGRLNEMEKKQQKDEEKETENYVLAELIALVGFPICFYLSIHSYGLRNWEFDWSYGVAWGALLFVFGALLLLICDKEHEEVYYKEKTIYNPPNGFA

SEQ ID NO: 142227 - protein, 182 aa, Heterodera glycines
  Coding regions on vcDNA: vcDNA=SeqID_68650; Strand=-; Position=1 -142,315-401,484-570,653-739,822-908,992-1047
  Homolog annotation: Hit_ID=ZP_00315999.1; Match level="QueryCoverage =90%, HitCoverage=23%, E-value=2e-11, Identity=26%"; Hit description =COG2304: Uncharacterized protein containing a von Willebrand factor type A (vWA) domain [Microbulbifer
REIRTELEKQKLITENIVLKAKIVNIEQHQMKQNKQNGKEDEQQGENVSADQFEAIRERMGQLEKQVNQQQNDNQHVSADQFEASRERMCQLEKQVNQQQNDNQHVSADQFEAIRERMGQLEKQVNQQQNDNQHVSADQFEAIRERMCQLEKQVNQQQNDNQHVSADQFEAIRERMCQLEKQ

SEQ ID NO: 142228 - protein, 117 aa, Heterodera glycines
  Coding regions on vcDNA: vcDNA=SeqID_68651; Strand=+; Position=1 -52,135-221,304-399,474-592
MCQLEKQVNQQQNDNQHVSADQFEAIRERMGQLEKQVNQQQNDNQHVSADQFEAIRERMGQLEKQVNQQQNDNQHGKYVSADQFEAIRERMCQLEKQVNQQQNDNQHGKYGSDTVFL

SEQ ID NO: 142229 - protein, 81 aa, Heterodera glycines
  Coding regions on vcDNA: vcDNA=SeqID_68652; Strand=-; Position=1 -61,291-473
MSTSTPNISLTTFGDITSDQNHLWPSFALSDDENDLDRLQGQRKALDAKIAELERRQMIMEGTEATPKAKGNFEPSTNNGN

SEQ ID NO: 142230 - protein, 23 aa, Heterodera glycines
  Coding regions on vcDNA: vcDNA=SeqID_68653; Strand=+; Position=1-96
KPKLFGLFKKELKIFKNFIHLPF

SEQ ID NO: 142231 - protein, 111 aa, Heterodera glycines
  Coding regions on vcDNA: vcDNA=SeqID_68654; Strand=+; Position=1 -187,228-373
AQPLSPRDLDELETSIDQFRTFLNDQPRMRTLLALKPKVHLLLNHFVPFARQHQFLALLDEQGDEALHSVWRRLEQLWKTMPDEEQMRQLLEHHFVSNWLLDTGKIDEMKR

SEQ ID NO: 142232 - protein, 124 aa, Heterodera glycines
  Coding regions on vcDNA: vcDNA=SeqID_68655; Strand=-; Position=1-375
MWLTIRYGAKECKIEVDIGGETDGDQQKQSNEGGEEKVEEQKNADEKQTKVAEKEEMEGGGKNEENGTDCEAAKPSEAKQQMPTNLGELRERICAETGYENGTMKLIHKGKMPMAVRKTMAGFG

SEQ ID NO: 142233 - protein, 56 aa, Heterodera glycines
  Coding regions on vcDNA: vcDNA=SeqID_68656; Strand=+; Position=1 -39,145-276
MADRNSELEKQKKVLLDFRQNSWDAKACHEDLEISSDNSLTVKRKGTNLGTYWELI

SEQ ID NO: 142234 - protein, 126 aa, Heterodera glycines
  Coding regions on vcDNA: vcDNA=SeqID_68657; Strand=+; Position=1 -196,239-421
  Homolog annotation: Hit_ID=NP_510427.1; Match level="QueryCoverage =92%, HitCoverage=14%, E-value=3e-17, Identity=45%"; Hit description =putative protein of eukaryotic origin (XP188) [Caenorhabditis elegans] emb|CAB01868.2| Hypothetical prote
IHDKTIRQVLFFKQLSWRLLKIEASAHPKCGADEQREPLRSKTNSPLRLLTVDGKCRISIKKSSQNCSLLAGKIELILKEIHWLATMLHLRMAIDFHKHLVDLANCQKKADSVTPFLGQRQNPFTV

SEQ ID NO: 142235 - protein, 100 aa, Heterodera glycines; identical to SEQ ID NO: 134221
  Coding regions on vcDNA: vcDNA=SeqID_68658; Strand=-; Position=1-303

SEQ ID NO: 142236 - protein, 92 aa, Heterodera glycines; identical to SEQ ID NO: 125147
  Coding regions on vcDNA: vcDNA=SeqID_68659; Strand=-; Position=1-304

SEQ ID NO: 142237 - protein, 50 aa, Heterodera glycines
  Coding regions on vcDNA: vcDNA=SeqID_68660; Strand=+; Position=1 -115,447-484
MGLEDREVSIECIKGALFLQMFQEAVKEKADEELKALNNIITFDHFYNAV

SEQ ID NO: 142238 - protein, 244 aa, Heterodera glycines
  Coding regions on vcDNA: vcDNA=SeqID_68661; Strand=+; Position=1 -169,1017-1582
  Homolog annotation: Hit_ID=EAK95016.1; Match level="QueryCoverage =52%, HitCoverage=13%, E-value=3e-11, Identity=36%"; Hit description =hypothetical protein CaO19.11553 [Candida albicans SC5314]
MFHSVRKSFRSKSSTDPNKRYGFMDLLKEMEDTIRGNEFFMKKVKAITKKAGIKEGGGFGALDQYYAKEARLVFAKGSGQDFLRNIIDLSQWMTAKEVRECAEKFKWIRGLNAKESWDIEVNGSGKASSVSADLRKDQSDKAINDRHNEDNAYGGTFGSERGGEDEDGSGSGSEQREYDEDGRGSGSEQREDDEDGRGSGSEQREYDEDGRGSGSEQREDDEDGRGSGSEQREDDEYGSGSGKD

SEQ ID NO: 142239 - protein, 190 aa, Heterodera glycines
  Coding regions on vcDNA: vcDNA=SeqID_68662; Strand=+; Position=1 -484,534-622
MNTWNLFIFTNRTVMKWEMNKLNKWPIGVMKTFIKMLRMTKIKKMVSKKREIIKKFDAIKEKLREKGQNTSKDKAKIEMKIGKLLGLNRSLIYKWKKELNLNKNKIKKNFYDEKKRKFIERFDEFKELYGQGKQKEFAKELGISKQTFIKWKKELVPNDHKKENKLRKMKHYLQIKEANPKMSDEIIVKK

SEQ ID NO: 142240 - protein, 91 aa, Heterodera glycines
  Coding regions on vcDNA: vcDNA=SeqID_68663; Strand=-; Position=1-273
MNTIIIFLISFSCIFLAHFLQFVHAAPKVTVCFGYGEPFTAKAYLGHVFKRNYDTRAVQTYNGKQCVKINAQNWSQSDGNAAIFFLLENGT

SEQ ID NO: 142241 - protein, 24 aa, Heterodera glycines
  Coding regions on vcDNA: vcDNA=SeqID_68664; Strand=+; Position=1-76
ITGVSIIAVLFFVFLMPSQNLVRF

SEQ ID NO: 142242 - protein, 235 aa, Heterodera glycines
  Coding regions on vcDNA: vcDNA=SeqID_68665; Strand=-; Position=1 -77,162-192,249-390,449-503,569-662,789-885,946-998
  Homolog annotation: Hit_ID=NP_504659.1; Match level="QueryCoverage =91%, HitCoverage=28%, E-value=6e-63, Identity=55%"; Hit description =long-chain-fatty-acid-CoA ligase (70.5 kD) (5H11) [Caenorhabditis elegans] gb|AAD14712.1| Hypothetical pr
QYIDMMSHAEYPSFDYSSIRSGIVAGAPCPVTLCSRLVNELLVNELGMKDLQVCYGTTETSPVSFMSIREDPPEQRIRNVGHIMDHLEAVIVDKEGRVTPRGQRGDAVIVDKEGRVTPRGQRGDLFVRGYSVMYGYWDSVTHGFVRGYSVMYGYWDSVTHGSSEVTKDRWYRTGDIGLMHSSGTVSIVGRSKDMIVRGGENVYPTEVEQFIDRHRSVIVEQFIDRHRSVIPFALI

SEQ ID NO: 142243 - protein, 28 aa, Heterodera glycines
  Coding regions on vcDNA: vcDNA=SeqID_68666; Strand=-; Position=1 -37,96-145
MLLQKNGHDYVLSDDNENEQSKSIANSD

SEQ ID NO: 142244 - protein, 113 aa, Heterodera glycines
  Coding regions on vcDNA: vcDNA=SeqID_68667; Strand=-; Position=1 -94,157-404
MGQNEREEIVVKTEQIDQKEQNENSATVDQMAIKENLRAKGKYQNKHRTKIEFKIGSVLGASRKKELNLNKVKIENIHFVDQMDGENLKSPNEKIETIQKFERIKEKLKENGK

SEQ ID NO: 142245 - protein, 69 aa, Heterodera glycines
  Coding regions on vcDNA: vcDNA=SeqID_68668; Strand=-; Position=1 -157,317-369
MTTRCAPPPTRWSSSRLATTASTRRTWRRRTAARWTSNTCWPKCGTPTASVPVIKTVYTSNIKKEFSVK

SEQ ID NO: 142246 - protein, 123 aa, Heterodera glycines
  Coding regions on vcDNA: vcDNA=SeqID_68669; Strand=-; Position=1-369
MANSVHAEHHQPGALSTIGDVNGDFGLVKDFTSLLGFDCILPVMRDCEQNENGREAEEEGAKEENEENGGTNKQILLLRKNDYGRTKVSQDGEGKRHGGRDEGHGAPRGTGEAPPVATTGASP

SEQ ID NO: 142247 - protein, 173 aa, Heterodera glycines
  Coding regions on vcDNA: vcDNA=SeqID_68670; Strand=-; Position=1 -182,236-398,457-630
MRYFHLAVILLIICRGCHAEGDPPPTEPPAAGDDGPLNMENFVCAKKDTKHGFITQKDGMIVMDSEGVPPDASLYYFQQKNEGKLSIRMAVEEECKDAFDKNVQFTVDNSCEKKPNDGGGPCPESIPNCKFFDIVCPITMRAVIDPSDAGVFKAKLKDLANLSKTCKKWQGFV

SEQ ID NO: 142248 - protein, 87 aa, Heterodera glycines; identical to SEQ ID NO: 129152
  Coding regions on vcDNA: vcDNA=SeqID_68671; Strand=-; Position=1-776

SEQ ID NO: 142249 - protein, 240 aa, Heterodera glycines
  Coding regions on vcDNA: vcDNA=SeqID_68672; Strand=-; Position=1 -86,139-355,400-573,622-774,817-909
  Homolog annotation: Hit_ID=EAL42187.1; Match level="QueryCoverage =97%, HitCoverage=50%, E-value=1e-27, Identity=31%"; Hit description =ENSANGP00000020626 [Anopheles gambiae str. PEST]
MALICLASLPLSFVEDQALKNLLSILAPISRRHFTSDVLRNLYANVKARVKEDIRKTDFISLTIDGWSSHEGKHSLLSVTVHYIDSNMEPTFRVMEAVPIKGSHTGEKMCGLLSQVLNDYGVNAEKVHLIVRDNESAMQKATRIAGFESLHCTAHNFNLCVWDGIKKLSIDALLEKIKKSIRKIRKSRVLGDEFSALQDETGIPQRNLVKGITVRWNSVFLMLERFYENEEALVLMPAKD

SEQ ID NO: 142250 - protein, 41 aa, Heterodera glycines
  Coding regions on vcDNA: vcDNA=SeqID_68673; Strand=+; Position=1 -103,258-280
MSTMFCVSFQFTVISGLKTCAPINMLFNSFVFEGDYFFIFS

SEQ ID NO: 142251 - protein, 132 aa, Heterodera glycines
  Coding regions on vcDNA: vcDNA=SeqID_68674; Strand=+; Position=1 -277,343-451,727-739
MDDETCFCSGALYPKPGEAPDGSRMVVQLNCRCTGAYHLGCIAKHLIKRGGKCPTCRTETITENCRPTERWVQLMRDAGDVSEQEEDIVFLDEVLQPQTPPPPAAANDVAEGTAQARGRGRRTLRDNFRKRH

SEQ ID NO: 142252 - protein, 203 aa, Heterodera glycines
  misc_feature (6)..(6): Xaa can be any naturally occurring amino acid
  misc_feature (40)..(40): Xaa can be any naturally occurring amino acid
  Coding regions on vcDNA: vcDNA=SeqID_68675; Strand=+; Position=1 -114,388-543,600-953
  Homolog annotation: Hit_ID=NP_501671.1; Match level="QueryCoverage =82%, HitCoverage=16%, E-value=2e-54, Identity=60%"; Hit description =g-protein beta WD-40 repeat and Coatomer WD associated region (111.1 kD) (4K227) [Caenorhabditis elegans]
HDYPNXVLLLSTPRILNFQCKILLILKDYEQKCLENQSSXGHTHYVMQLVINPKDNNTFATASLDKTIKVWQFGSSVPNFTLEGHEKGVNCVNCVDYYHGGEKPYLISGADDRLIKIWDYQNKTCVVTLDGQSHMVSRQCCLPRIRIFVGGSGDMVVRSGHSRHQRLRAVAAHGWWRYWCHVDSATAATNTLMAQQQAAAAGN

SEQ ID NO: 142253 - protein, 229 aa, Heterodera glycines
  Coding regions on vcDNA: vcDNA=SeqID_68676; Strand=+; Position=1-689
  Homolog annotation: Hit_ID=EAL39610.1; Match level="QueryCoverage =64%, HitCoverage=100%, E-value=3e-14, Identity=33%"; Hit description= ENSANGP00000016373 [Anopheles gambiae str. PEST]
MPKSEIDGKGGQVPTENESASEGTTTQRTTEEGKAEEKGSQRTTEEGKAEEKGSQRTTEEGKAEEKGSQRTTEEGKAEEKGSQRTTEEGKAEEKGSQRTTEEGKAEEKEGPSSEESAEESVMKESTTIRTTMEEEKLLGEEEQSNSKRTTTKRATAKGANLKRKVPPGLKHNRRRVTMRTPIAEGKRQKQFDESGGETGLPQFGPNVFFNYNFFLCHSNPTKLISFESL

SEQ ID NO: 142254 - protein, 198 aa, Heterodera glycines
  Coding regions on vcDNA: vcDNA=SeqID_68677; Strand=+; Position=1 -88,438-946
  Homolog annotation: Hit_ID=CAE64712.1; Match level="QueryCoverage =59%, HitCoverage=25%, E-value=3e-10, Identity=34%"; Hit description =Hypothetical protein CBG09498 [Caenorhabditis briggsae]
MRTPIAEGKRQKQFDESGGETGLPQFGPHVKGEAQALYDYEEAKSGEDGLTGKKSAASKLFEVEFLAWKDKFLRGLKVFAGTFQLCRNIADYLKERKRNARQKRIPKGETKECNNGLMAQIMASAIIEDSSISKRLIKRALKFSFPESQFDIICAAGGALSLFNGAEKDGTSGVLSYAIYGRRHCQVKRRSVTCLAFE

SEQ ID NO: 142255 - protein, 39 aa, Heterodera glycines
  Coding regions on vcDNA: vcDNA=SeqID_68678; Strand=+; Position=1-119
KSPFALFLIAHFIVALLSFELVVQTITNVFCKGLCSVRL

SEQ ID NO: 142256 - protein, 68 aa, Heterodera glycines
  Coding regions on vcDNA: vcDNA=SeqID_68679; Strand=+; Position=1 -117,585-674
MDCIVCSITRVDFILRPPYTMCGLLGILTSFEKGANMDSEKSLMLKRSKEQQVLLTVRPLKTAQIFKQ

SEQ ID NO: 142257 - protein, 27 aa, Heterodera glycines
  Coding regions on vcDNA: vcDNA=SeqID_68680; Strand=+; Position=1 -44,136-175
MFNIEGPPRDREAAEKGSETHLILFTC

SEQ ID NO: 142258 - protein, 27 aa, Heterodera glycines
  Coding regions on vcDNA: vcDNA=SeqID_68681; Strand=-; Position=1-81
MHRIIAAVKKLVVGSVLAVRCTLCVLL

SEQ ID NO: 142259 - protein, 17 aa, Heterodera glycines
  Coding regions on vcDNA: vcDNA=SeqID_68682; Strand=-; Position=1-52
GNDEMRTGTNICFQQFR

SEQ ID NO: 142260 - protein, 95 aa, Heterodera glycines
  Coding regions on vcDNA: vcDNA=SeqID_68683; Strand=-; Position=1 -112,172-347
  Homolog annotation: Hit_ID=S74181; Match level="QueryCoverage=95%, HitCoverage=65%, E-value=1e-20, Identity=52%"; Hit description=tumor antigen UK114 - goat
MEPGKTELVPGGARAEAKQAMTNIGELLQAGGSSFKHVVFAKILLADMSDFQAVNETFKSYFTPDTYPARSLCQVVKMPKNGRVKIDVVAIAEKP

SEQ ID NO: 142261 - protein, 153 aa, Heterodera glycines
  Coding regions on vcDNA: vcDNA=SeqID_68684; Strand=+; Position=1 -286,341-516
  Homolog annotation: Hit_ID=AAH87800.1; Match level="QueryCoverage =93%, HitCoverage=89%, E-value=2e-23, Identity=43%"; Hit description =Unknown (protein for IMAGE:7016565) [Xenopus tropicalis]
MAAAPSIRIIATSKAPAATGYRWSKQWMTIEKAQLYLLFCSQAVLVNNQTLYVSGQTGMMPGKTDVVSGGARAEAKQAMTNIGELLTYAGSSFKHVINCNIMVANMSDFQDVNETFKNFFTADTYPARSFFQVVKLPKNALVMIDAVAVVSGQ

SEQ ID NO: 142262 - protein, 252 aa, Heterodera glycines
  Coding regions on vcDNA: vcDNA=SeqID_68685; Strand=+; Position=1 -93,607-1272
MAWAATAEEIRESQMRAKAQYDKQNRVLDIQLNRIKAIILCLQMESVSLDPGEEFQEELTEELEEELLGKEEKWVTAQNSENEVEGEEKQKDEGEEVELNEDAEKKKKEWATAQNSTNNEKEVEKCGEKEVEKSKKKMKWVTAQNHSEGFGNGGFGEQTKKVVEVLLLDLETSAQIREYVVCQLQSKGVVLVYPNPSEKNNFPYFIFLPDVFDGKFERPLLPGDRVFVEDYAWVEGKEHLDKSRWIYAEQIR

SEQ ID NO: 142263 - protein, 22 aa, Heterodera glycines
  Coding regions on vcDNA: vcDNA=SeqID_68686; Strand=+; Position=1-69
GAEAWPWIDDVVEEVECECFEE

SEQ ID NO: 142264 - protein, 411 aa, Heterodera glycines
  Coding regions on vcDNA: vcDNA=SeqID_68687; Strand=+; Position=1-1236
  Homolog annotation: Hit_ID=NP_495557.1; Match level="QueryCoverage =83%, HitCoverage=28%, E-value=3e-73, Identity=42%"; Hit description =zn-finger, CCHC type and RNA-directed DNA polymerase  and Integrase, catalytic domain containing protein
MSLEIIPFHRRREALSIENGCIIYADRVVIPASLQKEVLQQLHQGHPGMKRMKNLARQYVYWPGMDQQIEDSVRSCQACAEEAKAPVKTLLHSWPKEDGPWKRVHIDYAGPFFGKMYLICVDAFSKWPEVFEMSSTGSAATIDKIRYLCSRHGLPETLVTDNGTQFTSNEFKEFTRKNGISHLFSAPYCPMSNGQAERFVDTFKRTFRKLKKEGVANRLDTFLTTYRTTPNESLAGNKSPAEMFMQRKIRTTLDLLRPKRRPIIERDETMERSFNRRHGAQPREFMVNGKVFARHRISQPWKAGRVTQKKGVIYDVSFSDGSSSRFHANQMLVRHTPDYEEDPLDMLNDAFGLPLAPSVVENPDGQAEVQLPMRADTPEPLNDGPLDEDVPSIPEGRPKRNRRPPQRFSPG

SEQ ID NO: 142265 - protein, 1066 aa, Heterodera glycines
  Coding regions on vcDNA: vcDNA=SeqID_68688; Strand=+; Position=1-3201
  Homolog annotation: Hit_ID=XP_318550.1; Match level="QueryCoverage =57%, HitCoverage=61%, E-value=1e-131, Identity=43%"; Hit description= ENSANGP00000020240 [Anopheles gambiae]
MALTVEQLLQAIAQQNQNPSLSGIDLFELGDESTNIEDWLQQFCFALDCSAPNIKDEQKVKLLMTKLSKAAFSEYKKSCLPKDVTDYNFAKTEEQLKALFAKPQSVWIDRYECLRAFKSEDENFRSFINRHKRLLRDFEFKKLNEEQFYCLMLLTALKSPKDGELRKRILGKLAADGDRAKYDKVVEDLQMYLSTIAEAKCIEQQPAPPKQILAVKQNCAVRTKGFEARGQVQQQLKVCWRCGRSSHFPSVCPHIKVACRKCSKVGHLEAQCNQHQAWLIRQGKMQSRKQGNLKLGGVLINSMNQPKRLIECPIKMNGNFVEFALDSGAEVVVVNEETHEAIGKPKLSPCNVEAKYHDGTKCTLIGKGEAEFEFGGIIRKGQFYVEAIRRMPIPTNVSTLRSFLGMVNHYQQFVKNLRFIRQPLDDLLKQDTVWNWSSECQKAFDQVIGTLQSDQLLTHYDPSQEIIVSADASEHGIGAVISHRYADGSIKAIAHASHSLAPAERNYAQIEKEGLALIYAVQKFHKYLYGRHFILQTDHKPLLSIFGNKKGIKSCTANRLQRWALILLAYDFDIEYQNTSEFGQADALSRLISKTTIEDDEVIVANLMNVETELLNAVVKQFPLNSDQIIVEIGKDEVLKKVMKYLRTQWPTSKNMSLEIIPFHRRREALSIENGCIIYADRVVIPASLQKEVLQQLHQGHPGMKRMKNLARQYVYWPGMDQQIEDSVRSCQACAEEAKAPVKTLLHSWPKEDGPWKRVHMDYAGPFFGKMYLICVDAFSKWPEVFEMSSTGSAATIDKIRYLCSRHGLPETLVTDNGTQFTSNEFKEFTRKNGISHLFSAPYCPMSNGQAERFVDTFKRTFRKLKKEGVANRLDTFLTTYRTTPNESLAGNKSPAEMFMQRKIRTTLDLLRPKRRPIIERDEAMERSFNRRHGAQPREFMVNGKVFARHRISQPWKAGRVTQKKGVIYDVSFSDGSSGRFHANQMLVHHTPDYEEDPLDMLNDAFGLPLAPSVVEDPDGQAEVQLPMRADTPEPLNDRPLDEDVPRIPEGRPKRNRRPPQRFSPG

SEQ ID NO: 142266 - protein, 566 aa, Heterodera glycines
  Coding regions on vcDNA: vcDNA=SeqID_68689; Strand=-; Position=1-1698
  Homolog annotation: Hit_ID=NP_508324.1; Match level="QueryCoverage =96%, HitCoverage=21%, E-value=4e-74, Identity=33%"; Hit description =predicted CDS, peptidase family A16 and RNA-directed DNA polymerase and Integrase, catalytic domain and Z
MVGGEAEFPETPRHTPTIAMLTSHPSNVESFPSFRTVNDFWSLEAIGITDDPNQNDDQVAMQQFSNTVRQLPSGRYSVRLTWREPRPPLPSNWAIAYRRLLSTTKRLQCSPELLDRYSAELTRQMDADIIELTGRNNDEHFLPHHAVINPKKLRIVIDASAHAKGTPSLNDCLHRGPVLLPDLCGILLRFRSATIPVLADVQGAFHAIEVEPEDRRFCKMHWLKNPARPVSGDNLLIYRYKRLVFGATCSPFILAAVLLQHFDKHEHPFAQALAANMYVDNLLIECETEEEAIDKSSIAKQILKDADMNLREFLSHSPNVMKQIPEDDRLDKTPAKVLGLTWDTPSDCVTFSLPKDTDATATRRSVLSIIASTFDPLGLVGPCLLPAKRLFQRLWGEGTAWDAPLPDTEAATWSQTLSLWQNQTIVIPWHSILGKQSRLQLHVFCDASEHTFAAAVYIRSETADSSEANLIFAKNRLRPRTANQRFTIPRLELLAILVGIRAMRFAEKELRRPINGRHLWSDSQIALSWVKSDEPKAQFEQRRLVEIRQGQHTTFHFVRTDQNPAG

SEQ ID NO: 142267 - protein, 76 aa, Heterodera glycines
  Coding regions on vcDNA: vcDNA=SeqID_68690; Strand=+; Position=1-230
FDHPSLFSLPPADPLGSRQLNPSLSADHLRPPALITQIKSPAALLGSRQTLTESSAAHFRLSTIHHSSPSRQPPFQ

SEQ ID NO: 142268 - protein, 608 aa, Heterodera glycines
  Coding regions on vcDNA: vcDNA=SeqID_68691; Strand=-; Position=1-1827
MSELIRQRLTAEVRTLSDLVKRLRQRVGRLTEFTRMAPEEIPLAEETKLAKGVRTDRQLLQRSIDRVNGMLRECFDHIQLLGDPFLKQAEEDLLAVLPTFDDEQADPNVEEWPVITLLSKAQLILDGLQVYIEARFDTTDAISSRSSSRVSDHGADDENRIHRQRQSTDPPTQAQPANAHQPSNSARADQTLFNQRTPAFPLNLTFPRASNRPTHRSEPHHGHFRQSTNDDDALRVSRIEIPRFSGSAEEWVTFWAAFDFAVHSRQYPAFQKHLLLLQYLEKGSPPRRMIEGYPPSDANYSTVVSILRDRYGDVGNRRDQLNAQLLHLKPARNNLKELRQLQQEIERICTQLCSLEPEGELSPIANSSLVTNLIKSKLPPPVLLDLIRMERESYTSWTARNWREGFATIVTDKEQVDLCVRTFQDMDIQPRERPPERAPSRPGGRSFRPPPPAPERRYLENTRAFPALAQPVSANGISCSLCEQEGHRPSACQRYTTVIQRRRRLEEQGRCLRSPSRPHHSRLLSSRSMFEMSGERPSLPPLPVNRPPGANKPSTRESRAEWKCVPQRQSCHGSQRRTGPTESDSHHNRTARVRRGRKHSRGGMRRRL

SEQ ID NO: 142269 - protein, 37 aa, Heterodera glycines
  Coding regions on vcDNA: vcDNA=SeqID_68692; Strand=+; Position=1 -66,638-685
MVAHCDKRLGHLSTHLAIRRGDIPNLFIFVGNEAYYG

SEQ ID NO: 142270 - protein, 161 aa, Heterodera glycines
  Coding regions on vcDNA: vcDNA=SeqID_68693; Strand=+; Position=1 -232,276-405,450-572
MAECRECKENGRPKYEFSLSDSSTKSLKIHLFSTIHADSEYVKNFQQLEKMKKESKEKADKKQPTIENLIGTNLTSSGILSVADKRIISMITCNNLSFGLLSDPTFKAQCKYELKDESDYRKRVLPEAYKLVKAKILKDLDDCANLSFTIDCWAGPSDNFL

SEQ ID NO: 142271 - protein, 55 aa, Heterodera glycines
  Coding regions on vcDNA: vcDNA=SeqID_68694; Strand=-; Position=1-229
LSLTGHGVTKNWVQKNFVLAVHHFPGQHSGNAIACNVRKLLDSWKINDDRVFAFV

SEQ ID NO: 142272 - protein, 16 aa, Heterodera glycines
  Coding regions on vcDNA: vcDNA=SeqID_68695; Strand=+; Position=1 -42,229-237
MMANGQPTIFSSRHKV

SEQ ID NO: 142273 - protein, 60 aa, Heterodera glycines
  Coding regions on vcDNA: vcDNA=SeqID_68696; Strand=+; Position=1 -107,249-324
MIQQNSVVIFSGFIDKNKPIKVQFSYLGTHLAAYLYGFIDKNKHIKVQFSYLGTHLAAYL

SEQ ID NO: 142274 - protein, 320 aa, Heterodera glycines
  Coding regions on vcDNA: vcDNA=SeqID_68697; Strand=+; Position=1 -279,358-863,1123-1297
  Homolog annotation: Hit_ID=NP_500551.2; Match level="QueryCoverage =98%, HitCoverage=6%, E-value=5e-36, Identity=32%"; Hit description =protein conserved (4F151) [Caenorhabditis elegans] gb|AAC17540.2| Hypothetical protein F55F10.1 [Caenorhab
MDNGDDGACADNDLRNDVNHQQQRLDKSQVDGADEADWTAGQDEGDKAKPTAVDERAEEHGDAEGDDQQQSMEDEGAAAGGHQRQLQQQEMGELSAHGSASLEQARQTRALFHSHLRRLRQQQQQQQQLDQSQLEEADQAADDQMADQDEAAAAVEEEGMDESAGFNFGDLLNGTEVMRFDPKLWQNDEQNGGQQQQQKEEAMEEEEREGTSRDDGDDQQQQLQHRLQLKWALITDSVAPLAAELAESLRAIIEPTIASRLEGDYRTGKRLNMRRLIPYIASDYRKDRIWMRRTRKARRNYQICIAVDNSQSMQHNHMTE

SEQ ID NO: 142275 - protein, 32 aa, Heterodera glycines
  Coding regions on vcDNA: vcDNA=SeqID_68698; Strand=+; Position=1-99
GGGDSSSNSSEGEEEEANEEEEEKGQSREGDE

SEQ ID NO: 142276 - protein, 86 aa, Heterodera glycines
  Coding regions on vcDNA: vcDNA=SeqID_68699; Strand=+; Position=1 -193,241-305
MPNLLQVLFGPVVYRPYQPNLLESGGNKLFSIGAGAYNTCVVLSPILVPYIAFSWTHSHHFSFVVALRFGVLCHCLFLPYDWSADK

SEQ ID NO: 142277 - protein, 124 aa, Heterodera glycines
  Coding regions on vcDNA: vcDNA=SeqID_68700; Strand=+; Position=1 -220,478-632
MMVNKFIKLFVLLLLISPTNEKPHQKRALVTIALIGALAQLKAYLLAHTGVILTASMITALTTLSLAVYVKLKPSPSETTRKIKKSDEDMGLLLCNPKPRTAGNLRLPLIQEAGNLRLPLFHFL

SEQ ID NO: 142278 - protein, 227 aa, Heterodera glycines
  Coding regions on vcDNA: vcDNA=SeqID_68701; Strand=-; Position=1-684
MLWEQNNRGLEEEAKQRQIRNKIEELTAKLAGKPREEMGEEEAKELGKEKERFENPPEPPRERRPFYSSAVARFECQSELDSASKLRGREERGDRERNLGMSGKRLFTNMLKSAVGTVNDRPCIPPEGLNREMLKRRPTPAPVPQFTTRSAERSPVRKTYAPFRKGMPLERAEEAIYKIRKSLLQAADALSELADELFPHGEAREKDEGKEDEEAQWGGPGPSHSFM

SEQ ID NO: 142279 - protein, 173 aa, Heterodera glycines
  Coding regions on vcDNA: vcDNA=SeqID_68702; Strand=-; Position=1-522
  Homolog annotation: Hit_ID=NP_506158.1; Match level="QueryCoverage =84%, HitCoverage=81%, E-value=1e-15, Identity=38%"; Hit description =predicted CDS, putative protein family member (5N108) [Caenorhabditis elegans] pir||T22808 hypothetical p
MTNIPSTIRPIATTNIPLTIRPITTTNIPPTIRPIAITNIPPTIRPIATTNIPPSIRPIATTHTPPTTRPIATTHIPPTIRPITTTNIPTTIRPTSTIHSPIIIKPTTTIPTTTIQTPTKLIFTTATPNTVSPHTTKSADDTAPTTASYHSILDELRGLAEEADEEGILFLRR

SEQ ID NO: 142280 - protein, 198 aa, Heterodera glycines
  Coding regions on vcDNA: vcDNA=SeqID_68703; Strand=+; Position=1 -267,321-604,659-704
MELPAPIFHRLRHFVPSILKDCISLRVINTYSYGFFIEFPCDDSAAASDGQAVAKWLFTPRPDNVPKVFKCYLDKDDANLTSKVEAFKTAFANASSPANFIVSIWFRYFADFVVPFDQINELTREQLTLKRTDFHYCFLLVRCPIARDESKWTKWEEEAIDWQSYGQWNRISICPIFVDDIGDGLLDEIPGPSDQQQK

SEQ ID NO: 142281 - protein, 126 aa, Heterodera glycines
  Coding regions on vcDNA: vcDNA=SeqID_68704; Strand=-; Position=1-381
MGTQISWHSKHWGLNPPTFTDIPITENQATSIPISETQFSGFPIVGLNPSVFQSLRLKSPAFQTLGLNPPTFNDIPISGTQPTSISISETQFSGFPIAGTQPTSISISGTQISGIPNTGTQPTNFQ

SEQ ID NO: 142282 - protein, 82 aa, Heterodera glycines
  Coding regions on vcDNA: vcDNA=SeqID_68705; Strand=+; Position=1 -31,389-468,535-669
  Homolog annotation: Hit_ID=NP_501802.1; Match level="QueryCoverage =100%, HitCoverage=13%, E-value=1e-26, Identity=63%"; Hit description= glycoside hydrolase, family 47 (4K764) [Caenorhabditis elegans] pir||T20009 hypothetical protein C47E12.
MRRGRPKCRFGDGEPPNYLNVDIKDGFVLNTWLDALQASFAGVQVLAGDLDDAICSHAFYYAIWRKYELLPERFNWHSKAPD

SEQ ID NO: 142283 - protein, 139 aa, Heterodera glycines; identical to SEQ ID NO: 139758
  Coding regions on vcDNA: vcDNA=SeqID_68706; Strand=+; Position=1 -743,908-1170

SEQ ID NO: 142284 - protein, 335 aa, Heterodera glycines
  Coding regions on vcDNA: vcDNA=SeqID_68707; Strand=-; Position=1 -80,766-971,1013-1734
MPIRALPCPTTALTHRPLNSARPVPLTDKTLTYQNTHKTVIFLEQKPTNTPKILLQINQYPSHSVKRTTRSASRAPTNPNEVEEEEKKEKTPPKKIIRTHSPSEQTEVQFLGSTPTSEKSDPVTLSPETQKLLAKLKASEIKVQTKQLKKAIDCVEQTVKTNQNADLIQTTNAVKKFNSIRENTPDQPNFHSNFSPEIDNGFLKKLTTLEDERSEIWSNAVKECKKQEERRVRSVELQTNNILESVAKAIRAEDFNRKILEELLKTVQSTTYATRAARDKTVICAQKLQNNLLHQRRFLTAQERTATFIRKTFGLPTGTKEVDNSGATTSADGQQ

SEQ ID NO: 142285 - protein, 148 aa, Heterodera glycines
  Coding regions on vcDNA: vcDNA=SeqID_68708; Strand=+; Position=1 -111,176-286,339-449,508-618
  Homolog annotation: Hit_ID=CAE66851.1; Match level="QueryCoverage =100%, HitCoverage=85%, E-value=6e-21, Identity=41%"; Hit description= Hypothetical protein CBG12223 [Caenorhabditis briggsae]
TIPVTKAKPPVESESSSSGDDDEVPAKKPAQKAQPAKTIPVTKAKPPVESESSSSGDDDEVPAKKPAQKAQPAKTIPVTKAKPPAESESSSSGDDDEVPAKKPAQKAQPAKTIPVTKAKPPVESESSSSGDDDEVPAKKPAQKAQPAK

SEQ ID NO: 142286 - protein, 44 aa, Heterodera glycines
  Coding regions on vcDNA: vcDNA=SeqID_68709; Strand=-; Position=1-147
FFNLCFYLDHSCDQGQTTGGVRVEQFGRRRRSAGQKTGPEGTAG

SEQ ID NO: 142287 - protein, 47 aa, Heterodera glycines; identical to SEQ ID NO: 132414
  Coding regions on vcDNA: vcDNA=SeqID_68710; Strand=-; Position=1-141

SEQ ID NO: 142288 - protein, 74 aa, Heterodera glycines
  Coding regions on vcDNA: vcDNA=SeqID_68711; Strand=-; Position=1 -51,706-876
AVSRPPPPPAKKTDKGKIVPPSMLSKPQKIEPFKVRANRLPLLSPQFACHFLCLSHSHRRWGLPNPKKDARIGI

SEQ ID NO: 142289 - protein, 22 aa, Heterodera glycines
  Coding regions on vcDNA: vcDNA=SeqID_68712; Strand=+; Position=1 -12,161-217
MRAKWRKKRMRRLKRKRRQAKK

SEQ ID NO: 142290 - protein, 45 aa, Heterodera glycines
  Coding regions on vcDNA: vcDNA=SeqID_68713; Strand=-; Position=1 -94,717-760
GTPLGLYCKLTEMHKAGQVSFANVVTFNMDERSIAAAGGIDLFVS

SEQ ID NO: 142291 - protein, 110 aa, Heterodera glycines
  Coding regions on vcDNA: vcDNA=SeqID_68714; Strand=-; Position=1 -189,470-613
  Homolog annotation: Hit_ID=XP_393224.1; Match level="QueryCoverage =84%, HitCoverage=21%, E-value=5e-10, Identity=39%"; Hit description =similar to ENSANGP00000021067 [Apis mellifera]
MSGEKESTPGQYRLVEVSVGGQKVEATAAQVPGKMAEFVEWLNAEDAQTNDVATFAATAHYKMAKIHPFWMETDALAMNFILKRKGWNTVILPDKYRRAYYECFDTGFNC

SEQ ID NO: 142292 - protein, 109 aa, Heterodera glycines
  Coding regions on vcDNA: vcDNA=SeqID_68715; Strand=-; Position=1-330
MSSDDSQMPQEESSEDAPTPPEDYFDTPEDHQKAVDIQRGREAGRNTAGGMRRDRDVSASFDDDKDFLYILDTEGMDPKIISEQVEYFCCKRKGDKTFQELNCFDGCMR

SEQ ID NO: 142293 - protein, 115 aa, Heterodera glycines
  Coding regions on vcDNA: vcDNA=SeqID_68716; Strand=-; Position=1-348
MNDTNSDDSAKLPSFVLKKVPINGHFCFKNAGTNVACVCSPAEQSAADWPSVGSFFCVLCQRKRRKSAKEIAKDSETSRERRAMRRRSIREEEETADSEKEGKSAQILKGLINCK

SEQ ID NO: 142294 - protein, 48 aa, Heterodera glycines; identical to SEQ ID NO: 130859
  Coding regions on vcDNA: vcDNA=SeqID_68717; Strand=-; Position=1-144

SEQ ID NO: 142295 - protein, 38 aa, Heterodera glycines; identical to SEQ ID NO: 130615
  Coding regions on vcDNA: vcDNA=SeqID_68718; Strand=-; Position=1 -52,124-188

SEQ ID NO: 142296 - protein, 36 aa, Heterodera glycines; identical to SEQ ID NO: 134159
  Coding regions on vcDNA: vcDNA=SeqID_68719; Strand=-; Position=1-155

SEQ ID NO: 142297 - protein, 127 aa, Heterodera glycines
  Coding regions on vcDNA: vcDNA=SeqID_68720; Strand=-; Position=1 -80,443-515,566-595,653-851
MADFEGRVKAYRLVDYTTVSFSIITLFRAHGYLPRPRRSSAQKSAEKKKQKPYAEPIYAGEEKIIIFCPNKAADDGEKGTAENAIGDDAEENADEQQFGEPPMLARATLNRAGLEEEDEEETADEAS

SEQ ID NO: 142298 - protein, 50 aa, Heterodera glycines
  Coding regions on vcDNA: vcDNA=SeqID_68721; Strand=+; Position=1 -78,116-190
MAKPIVLNFASQSMDLAALGPILIKKVRRGANKCHRWGKSLSLAWTEIFI

SEQ ID NO: 142299 - protein, 190 aa, Heterodera glycines
  Coding regions on vcDNA: vcDNA=SeqID_68722; Strand=-; Position=1 -78,652-714,1315-1446,1498-1795
MPTVREILESLQKPTKRPRMPANEDSKEILHGNVSFKALGETSDFGLILWQKKCNKQATKQKRGGAQKRWTKWEERREKAERRDKADGPRKPLPSRTHAKTPQPSEEEPSTSEAPARDNDGRPPSNPTPMTPQEMDVPSVEMLEIDVSYPSTPADDDQQAEPMPSTSTARCELMTTPSTSKGAGGFGLDD

SEQ ID NO: 142300 - protein, 281 aa, Heterodera glycines
  Coding regions on vcDNA: vcDNA=SeqID_68723; Strand=+; Position=1 -546,755-775,1469-1747
MAHDNVTIIKISANTNQNRPANALGNGPVDAVENEPADAVDYGPVDAVGNGPVDAVENEPADAVGHGPVDAAVLKIRRKRVPALLLAAVPLAKKFAVALLVAAGKEIGKNLFSGSKIKDNPAADGYSDSKQFYVSEECKRDFNCTFFACHPHPDAEGDSFCRKGFTRKCCQVFNLNFYQMELEYNDGEKEKCFYNFPICGESGCVSDRKYYTIKSKGGKVEIISHAKPPPECAFDAVLLFYAIKMMLNHLKQASMVGVKYYYPYDYGEGVQGVIYQHIVVF

SEQ ID NO: 142301 - protein, 201 aa, Heterodera glycines
  Coding regions on vcDNA: vcDNA=SeqID_68724; Strand=-; Position=1 -166,257-488,531-655,1045-1067
  Homolog annotation: Hit_ID=NP_495796.1; Match level="QueryCoverage =99%, HitCoverage=59%, E-value=1e-35, Identity=41%"; Hit description =RiboNuclease H (33.2 kD) (rnh-2) [Caenorhabditis elegans] emb|CAC70103.1| Hypothetical protein T13H5.7 [C
HPIQQILTYSLRIVHPRTISAQMQRRVKQSLNEISHLCAISLIEKAIQNGICISEVFVDLVVFVDLVGNKEEVYQTFLNERFPTLKITVSKKADAIFRIVGAASIVAKVTRDDKLAEWVFDEIGFIAPERGLGSGYPSDPITKHFIRTMVDPIPITKHFIRTMVDPIFGYPSLVRFSWKTVERVLERKAIKYTWEKKNFDG

SEQ ID NO: 142302 - protein, 43 aa, Heterodera glycines
  Coding regions on vcDNA: vcDNA=SeqID_68725; Strand=-; Position=1 -14,244-361
MPPKLIYFEVFLVKMKNMDVKHGLMLANILRQYWDDEVIFWKN

SEQ ID NO: 142303 - protein, 16 aa, Heterodera glycines
  Coding regions on vcDNA: vcDNA=SeqID_68726; Strand=+; Position=1-48
MHILGYFIAGIQYIKY

SEQ ID NO: 142304 - protein, 64 aa, Heterodera glycines
  Coding regions on vcDNA: vcDNA=SeqID_68727; Strand=+; Position=1 -129,607-672
MGNGNSHHQTATHYLDPAIIHEPPPAPYPDMNMIFKSIPKMMQVADDMHRMSNYVSPFPNIYQN

SEQ ID NO: 142305 - protein, 57 aa, Heterodera glycines
  Coding regions on vcDNA: vcDNA=SeqID_68728; Strand=+; Position=1 -58,809-924
MCSLFFAVFTVFSPFVQQNFFSTVRPGRVMITDQNSGNELIDWLLMRLCDPMLAFAI

SEQ ID NO: 142306 - protein, 339 aa, Heterodera glycines
  Coding regions on vcDNA: vcDNA=SeqID_68729; Strand=+; Position=1 -276,331-754,803-1083,1135-1174
  Homolog annotation: Hit_ID=AAL78214.1; Match level="QueryCoverage =41%, HitCoverage=75%, E-value=2e-12, Identity=31%"; Hit description =putative esophageal gland cell protein Hgg-20 [Heterodera glycines]
FISADCWLEVFVLLPRSQLGFGIAMISHRFDYFVDEHFKTRKWKLRPIVIQHKIGQNGAKEMEIVNYDGNELPIPQIPLPKKVIGFGSISIGSIDQNVITFLGHFDRFFATCATTLSIDTENIRILEFLLLSIWPMFKDTIYQLSLDIIAFRRMRQLAPSMLNDCPSLRFFNLSNGISLEFPPDDSANATDGQTVAKWLFTPRHDNLMNNLTIYIENSAMEQQWSATVEQIKASFSSASSPVSFGISVLIPPSSSIDSIVPFELTNEFTGEKLALSKEDEEADLSGFSLIRCPIVSDDKRQQQMIIELGDRWNQINIFIGDDGVGDGLLDGSPGPSDDH

SEQ ID NO: 142307 - protein, 109 aa, Heterodera glycines
  Coding regions on vcDNA: vcDNA=SeqID_68730; Strand=+; Position=1 -47,107-389
  Homolog annotation: Hit_ID=AAL78214.1; Match level="QueryCoverage =85%, HitCoverage=48%, E-value=3e-10, Identity=34%"; Hit description =putative esophageal gland cell protein Hgg-20 [Heterodera glycines]
MSHNPKEAEREMEKAIFISADCWLEVFVLLPRSQLGFGIAMISHRFDYFVDEHFKARKWTMGPIVIQRKIGQNGAKEMEIVNNFNGKELPIPQIPLPKKVIGFGSITIE

SEQ ID NO: 142308 - protein, 234 aa, Heterodera glycines
  Coding regions on vcDNA: vcDNA=SeqID_68731; Strand=+; Position=1 -54,233-881
  Homolog annotation: Hit_ID=AAC95573.1; Match level="QueryCoverage =88%, HitCoverage=44%, E-value=2e-32, Identity=32%"; Hit description =orf 48 [Ateline herpesvirus 3] pir||T42963 hypothetical protein 48 - ateline herpesvirus 3 (strain 73) ref
MKAFFHTIFEGVLEIVVLSKSAIYSYDRAWCESLGKKKEKDRQEEEAEEQGEEEEEEEHRPEQERQEQERPEEERPEQERQEQERPEEERPEQERQEQERPEEERPEQERQEQERPEEERPEQERPEGERPEQERQEQERPEEERPEQERPEGERPEGEDRPEGELPEGERPEGERQEKQRQEDGEEEDGDDDDDDDDDNEDGAVQCKVILRRGGEGDDDDSAGGNSGGNGAKD

SEQ ID NO: 142309 - protein, 128 aa, Heterodera glycines
  Coding regions on vcDNA: vcDNA=SeqID_68732; Strand=-; Position=1-386
MKRTNASNITPPRAKRSMAPALDLDPNTVALAEQERQRTLVFIGLPESNAIRPSERVQEDREAATKILDHLEVEAQPTAVFRLGRYDPQRTTPRPLKVVMPTTTHQHMALGGWKRERARLRSLQNLNR

SEQ ID NO: 142310 - protein, 84 aa, Heterodera glycines
  Coding regions on vcDNA: vcDNA=SeqID_68733; Strand=-; Position=1 -53,1114-1315
MDLFDGRDGPGHFGRTDSFTSGSALLRFVCQHSAACGARDDCRRNRHTAICEHGGSVEKNGEGAEELLRERIAKDALIVRRSTE

SEQ ID NO: 142311 - protein, 767 aa, Heterodera glycines
  misc_feature (763)..(763): Xaa can be any naturally occurring amino acid
  Coding regions on vcDNA: vcDNA=SeqID_68734; Strand=-; Position=1 -335,381-442,505-823,933-1077,1126-1153,1211-1352,1398-1511,1561 -1886,1955-2101,2207-2384,2429-2634
  Homolog annotation: Hit_ID=NP_919343.1; Match level="QueryCoverage =97%, HitCoverage=54%, E-value=1e-95, Identity=30%"; Hit description =ubiquitination factor E4B, UFD2 homolog [Danio rerio] gb|AAK33012.1| ubiquitination factor E4/UFD2 [Danio
LQLNLHSVVHALVVNSSTRHQTLDYFFHILTTNRKLSQLHADFSQLANCTSVLNVFSVILLLSDKIVIEKVQSDYLFHPKCRIDTTDESRINMDSEKLESYRKELGKFITATYVPNFNTECFYLGIEFMRISATYVPNFNTECFYLGIEFMRISVNVNAMSNAFSRLKRFYLSDLRRRVQEMEERMNAWKQCQPGASHRIKSAMRRAKEMLKATNIDADLLTFVDNCPLAIQSQCLLLRMFVARPQFGGNVCAFHQQTAQSFFAFPETYLEVAVEFLTLLVRYLLGFCFRLFTFPFSKSKMSRIFLKNFIKNPFIGSKIKNPFIGSKVVDLVVDLLFMLCPLVNHDASVFYRQIVSDSLAVEGLFPSLVKFYSAVETTGSHTEFFDKFNIRRNIQVIFKCETTGSHTEFFDKFNIRRNIQVIFKCMWSDLSHRDRMVQYAGFSPSFVRFSPSFVRFINMVLNDTTFLLDESLDKLKVIHDIESVMSNETEWDKLSQEEQQLKTDQLRDSKGQVKMWIQLGTDTMELFVTLTSDAPQIFRNEALGERVAAMLNHNLVQLCGPKCAQLKVHDAINLCGPKCAQLKVHDAINRFEWDPRTLTQQIVKVYINLGSEMFAKQIAQDERSYTPEAFSTIIERFKMRNILTINHLELFANLAEQAEAAYKEKMMFEEEFEDEVPEEFKDALVYTMMSDPVELPSGQALVYTMMSDPVELPSGQICDRKNILRHLLSDPTNPFTRQPLTTDELRPGGIRGDVKPREHSELXLGKC

SEQ ID NO: 142312 - protein, 16 aa, Heterodera glycines
  Coding regions on vcDNA: vcDNA=SeqID_68735; Strand=+; Position=1-53
SLSLVKISDYYPPFLF

SEQ ID NO: 142313 - protein, 27 aa, Heterodera glycines
  Coding regions on vcDNA: vcDNA=SeqID_68736; Strand=-; Position=1-82
MIVVVEVQIEETFSLLRTQFESHGKCR

SEQ ID NO: 142314 - protein, 68 aa, Heterodera glycines; identical to SEQ ID NO: 134199
  Coding regions on vcDNA: vcDNA=SeqID_68737; Strand=+; Position=1-387

SEQ ID NO: 142315 - protein, 66 aa, Heterodera glycines
  Coding regions on vcDNA: vcDNA=SeqID_68738; Strand=-; Position=1 -88,673-785
MLIKKGSNTKLIRSLLHGDLISPFWLGTRENVRNILSKWGIEPRQKIMKGRKFNHYTTCACVYSHD

SEQ ID NO: 142316 - protein, 17 aa, Heterodera glycines
  Coding regions on vcDNA: vcDNA=SeqID_68739; Strand=-; Position=1-66
HKHLFDLFYHIHNLIKI

SEQ ID NO: 142317 - protein, 82 aa, Heterodera glycines
  Coding regions on vcDNA: vcDNA=SeqID_68740; Strand=-; Position=1-249
MEETESGRESGKGIESLRESGKGIESLRESEKGIESLRESGKGIESLRESGKGTGSGRENGRDRKWKRKWKRQKVEEKVEKE

SEQ ID NO: 142318 - protein, 414 aa, Heterodera glycines
  Coding regions on vcDNA: vcDNA=SeqID_68741; Strand=-; Position=1 -27,189-647,1513-2268
MQSLGNRQLRGVNRIEEKTLGKEENGEKEKMKLKSERDKIAALERALEKSVTEYTAKRNEQTERIAQLGQLRREAEKSASPLDTGQSVAKKTPRKETTVKGFLVELHNIKTELLHSFRQSLSSLDRLCVETNDKMEFLNGLKLAALREGETSAELNKPSFDMKRPNEVEVKRIFSLKMPDESEAVQTVPMQSVADQRLAQRISEAASPPKPQLVSVGVQSPDFAAQSREKTPKSTRGWLCVSVTLIGLNHFSKGAPLKKTSTPKAAKNGGQSLRNAVPISSTPLSFSTLSPKPTEAVSKETPIVEKPMEKVPGKVAMPLATPPTEKAIPSPPETVAILSQSQATEKGLTGGEEGTEKQRESQPTGESAEKANVAEEGMDDEAADAAREAVTFDFMKYVLPQERSVSNISTGLVW

SEQ ID NO: 142319 - protein, 101 aa, Heterodera glycines
  Coding regions on vcDNA: vcDNA=SeqID_68742; Strand=-; Position=1-306
MTRQRCRTALPPLQSLLTTNFPPLLNIPRLLSASTPLLLLITNFHQIRIPNGVPPNCGLTANRLAQTRLTATRLLRQHRPFTAAPALPHRNVLNSTAAEGR

SEQ ID NO: 142320 - protein, 59 aa, Heterodera glycines
  Coding regions on vcDNA: vcDNA=SeqID_68743; Strand=-; Position=1 -33,185-322,504-512
MAHDLAEMTFESEDIELKRQLALATRAYHCHMQSLNTNQALHTLRTFIGDRVNNEYLLR

SEQ ID NO: 142321 - protein, 69 aa, Heterodera glycines
  Coding regions on vcDNA: vcDNA=SeqID_68744; Strand=+; Position=1-215
GNELLAPHRDCQLTPFLCAAPTTNQIFVVYAVANERAQRVQCLVCVQRLHVAMVGASGECQLSLQLNVF

SEQ ID NO: 142322 - protein, 234 aa, Heterodera glycines
  Coding regions on vcDNA: vcDNA=SeqID_68745; Strand=+; Position=1-705
MFISPTPDLGAESAPPPVLLRRILPFPTTTPFTSSHRAKGPSHWINGNATQRGRLRSVIVVPNAAGNGQKLGETSARTAGPPANSGERSPRPSTSSSSAQPPKSPATTAPELRARPTEQLAKVAELLGQVGEEMAKILEAEEKSTDGKEDLLSLPSDGEEVVPETPPPPAAMSRNRDESWGEGSGQLSFTRGSGGHYNARKIDEEEENRWATPGAWFTAPPRVSGPKKKKPWYH

SEQ ID NO: 142323 - protein, 212 aa, Heterodera glycines
  Coding regions on vcDNA: vcDNA=SeqID_68746; Strand=+; Position=1 -64,570-685,736-987,1041-1247
  Homolog annotation: Hit_ID=CAF93783.1; Match level="QueryCoverage =95%, HitCoverage=32%, E-value=1e-92, Identity=73%"; Hit description =unnamed protein product [Tetraodon nigroviridis]
MIAEPLEKGLAEDIEGEIVKITIRNVKFKMLDAQIAKEPLYRGGGQIIPTSRRCAYSAFLMATPRLMEPYYFVEVIAPADCVTAIYTVLSKRRGHVTTDAPIPGSPLYTIKAFIPVIDSFGFETDLRTHTQGQAFCMCVFSHWQIVPGDPLDKSIAIRPLELQPAPHLAREFMIKTRRRKGLSEDVSVNKFFDDPMLVELAKQQDLFSGFGV

SEQ ID NO: 142324 - protein, 45 aa, Heterodera glycines
  Coding regions on vcDNA: vcDNA=SeqID_68747; Strand=+; Position=1-138
VQAWIQASRLFTKYRPLLNSPPELMVGLTRGQGPLVSQCESLHGK

SEQ ID NO: 142325 - protein, 65 aa, Heterodera glycines
  Coding regions on vcDNA: vcDNA=SeqID_68748; Strand=-; Position=1-198
LFIGFDYECPRGHRFMVVEPGKVLRHRRMSGTLKTDAAPLMDNDLAIWMPCPCKKEPRMTAQLMR

SEQ ID NO: 142326 - protein, 57 aa, Heterodera glycines
  Coding regions on vcDNA: vcDNA=SeqID_68749; Strand=+; Position=1 -129,371-415
MSMCADNKDVEKEEEEKAKKKVEKEDGELKEESEDDDGDEIQLHNEKALGLSFNELF

SEQ ID NO: 142327 - protein, 80 aa, Heterodera glycines
  Coding regions on vcDNA: vcDNA=SeqID_68750; Strand=-; Position=1-243
MSAVGRVADCPVLLRMLRLLVNLMVKHGRRLKTNGHERLLLRHGREHVLLDELESGDGRDGEDQRLILKGVESQWPFAFK

SEQ ID NO: 142328 - protein, 47 aa, Heterodera glycines
  Coding regions on vcDNA: vcDNA=SeqID_68751; Strand=+; Position=1-141
MFPSMSQQQPLMPIRLQPSSMLHHQINQQAEHSQQDGTVSDSPDSGH

SEQ ID NO: 142329 - protein, 224 aa, Heterodera glycines
  Coding regions on vcDNA: vcDNA=SeqID_68752; Strand=+; Position=1 -310,625-989
MESPKGSLPEIVQASSCCHFQSAPGGRPNVFAAQQTIGAGGDISADQHQQLITAGGGAAGADHSLLSSFQHQQQQQTASSAGVGPPDGVGCSGFHMLPPPYGNNLSSLAAAGGGQMCSSQPFGQICPYSPPCAGHNNATANSQYGTMNSSNRRLTETGILYGGGLSKQQRDSQVMDKTNGMGQKTQRDNRTEGQMVEKIGKTNADNETKEMERNRKLKFSGNCF

SEQ ID NO: 142330 - protein, 50 aa, Heterodera glycines
  Coding regions on vcDNA: vcDNA=SeqID_68753; Strand=+; Position=1-151
  Homolog annotation: Hit_ID=AAG57380.1; Match level="QueryCoverage =100%, HitCoverage=12%, E-value=1e-21, Identity=100%"; Hit description=orf, hypothetical protein [Escherichia coli O157:H7] ref|NP_288825.1| hypothetical protein Z3507 [Escher
LSRAGAPLLACEVVPSQEETLAQTAHWITERRANHFAGLALAVSGFENEH

SEQ ID NO: 142331 - protein, 99 aa, Heterodera glycines
  Coding regions on vcDNA: vcDNA=SeqID_68754; Strand=-; Position=1 -147,196-348
MGLCFEKPRLEWSQKAEIPETIRDYSLMEPQILELLNANHPTYRVKICEKFSIPQQFCWDANSCHSDLKIVDDKCLTIHYIGNGKGKLFKTFLIALIIN

SEQ ID NO: 142332 - protein, 134 aa, Heterodera glycines
  Coding regions on vcDNA: vcDNA=SeqID_68755; Strand=-; Position=1 -207,437-634
MRKLIAKRDAARDEDDVGHSHKQSLHSENQTSWNISNDCPVEKRCKRFLVKQKNLIDHFRPYHEQRIMKVKMKKAPSVKKRKRQRNIRKSDNQIIIKKTCKRERLNLRLIDTHQNSGSSRLPECKHGSFAGWYI

SEQ ID NO: 142333 - protein, 15 aa, Heterodera glycines
  Coding regions on vcDNA: vcDNA=SeqID_68756; Strand=+; Position=1-49
LKAIHCLPVLGTAKH

SEQ ID NO: 142334 - protein, 103 aa, Heterodera glycines
  Coding regions on vcDNA: vcDNA=SeqID_68757; Strand=+; Position=1-312
MGTVKKKLEEKLFDEIFGEKWEEKEEEKRNELKKREIIAKYYRIKEKIKQKGRKFSKKEWNKIEEKITKKLGTNRMKIYKWIKELGLNQKFNLSKLKTDEQKF

SEQ ID NO: 142335 - protein, 256 aa, Heterodera glycines
  misc_feature (8)..(8): Xaa can be any naturally occurring amino acid
  misc_feature (75)..(75): Xaa can be any naturally occurring amino acid
  Coding regions on vcDNA: vcDNA=SeqID_68758; Strand=-; Position=1 -246,830-891,948-1051,1106-1401
  Homolog annotation: Hit_ID=CAE59952.1; Match level="QueryCoverage =89%, HitCoverage=18%, E-value=4e-40, Identity=42%"; Hit description =Hypothetical protein CBG03440 [Caenorhabditis briggsae]
FFSLISAXKRMGNKFRNSCQNEGPDATKAKKGDENELDDQNDEGAEEVEAKTLPMAEEAGETIEENESEESSEEXCDFSFFAPKSNGEQMAAIDTNLYSRQIYALGHSAMEHLRKASVLVYALGHSAMEHLRKASVLVSGLGSVGVEVAKNLILGGVRSVGVRSVTLHDTKALAFRDLSAHFYAKESDVGTNRAKVCFDKLAELNDTVNCALSVENLSEDFVKQFDVSTLTSFSRSPNSVVLSVGRSHMRPFPLRR

SEQ ID NO: 142336 - protein, 42 aa, Heterodera glycines
  Coding regions on vcDNA: vcDNA=SeqID_68759; Strand=+; Position=1 -109,358-377
MAALNEMLARNVPAKNGDPAFFEICQQIWAILGQFLGKVSKL

SEQ ID NO: 142337 - protein, 1475 aa, Heterodera glycines
  Coding regions on vcDNA: vcDNA=SeqID_68760; Strand=-; Position=1 -3790,3911-4548
  Homolog annotation: Hit_ID=CAE56861.1; Match level="QueryCoverage =17%, HitCoverage=17%, E-value=3e-21, Identity=25%"; Hit description =Hypothetical protein CBG24691 [Caenorhabditis briggsae]
MEKANNDLVSFQDGVNRSLRHINRLVKANYDAINRAAAEVNTNLQTCEAQIISLSDRMDLFKLEHKDGTDSQGGNSVNFTGGNGQQNTSLIRVDPFVEQNPDNNNEVNTLTGVTGLEIFSQESVTAFDKWSRRFRDYIQVVGKNLDEAEKLDRLRLALDDVPRDLYDTLTPAETTTVLRALKFLREKLDSPQRKELAKRNLALCKQRDDEPVGIFLRRLAPLVEVAYSNLDPDQLKERLSEELIDRLRPDLAFLIRLTGLSKGKELDIVKAQAEELELLLKTHKGQIPDPILQTVHAVQQNPWTPSRERDRRQNYNSNEAGPSNSYRNFSNSPNRGRYGQGRGGGTFNQRQRGRGNWRGPNNMADRSWNQRPYCTFCKRTGHMAYNCFQRKNQFSQRQFTPNSGPNLNAIHDSPEFHQDANRQSSNVTLDINELLRAFSVMNTQGPSSRGGNESASMNAISTMPADHPRVAEVAYQGTGKTQVNPCEPSDQQKISQWEGIGPKLSKYFMVLTAFMLLITGLINTTTANTIPKHPMVCQMIKDGVLWQIPNLSSCPKFSLDYLENPKIKSLRLYTPNVFEHQTPAWSCRKIRKSIKKYTSLTNVPISEMLEPIPLEISSDECWQMIRHRKCKLGVLIEDSGLWHTDLKIDNSPRHWLIGSWKWETVFIDNCYLIPTNITSHFGGNTVSIQNFEELNCPYEKGTCLTQDNSLIVWTPENETNCEFQSIGNWKGEMMGQHWISSNEPLMLEFSHNAKTILDCDRNLTISQQGFAADTVSLRGRKRTRVTRTTDGLITSSQLASELSFLNWNISNTMSFSFQHTTHSICEYMEQTRRWVISASISEPITFARITFKNPNLVAKNLAPGIIKIWPCVPLEPNQYSFYPLEESNPVTNECFEFLPIKIEMRGIHQMAFVDPTTMIINPSSKKAPCSSNQKQMIVIDNEILEVDQKSASVSRIKIKEIGNLSFNQLTTPILQPFSFHQLVLTNVTDILTHSYTSNMIKESQIAFRIHFQNKGTSIVPDEQWTKTGKEFKHFLIGDWDGIFWKILTILVFINTADLILRFYFILRNQYINLGRSNTEKRNNNTHIDDRPGSSQSFERSGFVNERPEYTPIRPLSEIEKAPLRNKTRRVSFKLRRKTETATNRTIIGNVNALTQIGANSELLSMMSLSNTAVISTIINSQIVRCLVDTGSSVTVASRALIDILGCKTVPSHEDAISASGHIISFREKAKVMLKVADICVPITIYFVNEQKSVCNRDYQLILGSFAAENYTIPPSSQVMIRANIKTALQPKHSLVVDKPDLNLLNNDLGIVPSVSAPFVEDIPLTIINPSNDPKILFKGMHLAYLNEIVENDGIFYESDQEKIKSGNPDPNGLTDPSFKIDLSKSDINEREREALKNLLEEFKDIFSKSQYDLGSFSGGEHHFDTTTEAPISSPPRRMPYKYRDELKKHIEQLLNKGVMVESETYRKRMVELDHV

SEQ ID NO: 142338 - protein, 175 aa, Heterodera glycines
  Coding regions on vcDNA: vcDNA=SeqID_68761; Strand=+; Position=1 -159,214-240,282-623
  Homolog annotation: Hit_ID=CAE68824.1; Match level="QueryCoverage =100%, HitCoverage=20%, E-value=1e-53, Identity=61%"; Hit description= Hypothetical protein CBG14783 [Caenorhabditis briggsae]
GYLPSNSPPQGEVLIHGANVALGYFKNEEKTKEDFVELDGKRWFATGDIGEFREDGSLCIIDRKKDLIKLAHGEYIALGKVETALLTNPNVDNICVYGESHKDYLIALVVPNLKNLQVLAEKVPFEIRSSFRFFTMIPQRFSPLQNDVNEPSIERICANKEMPKILQKELHSFVS

SEQ ID NO: 142339 - protein, 48 aa, Heterodera glycines
  misc_feature (5)..(5): Xaa can be any naturally occurring amino acid
  Coding regions on vcDNA: vcDNA=SeqID_68762; Strand=-; Position=1-397
  Homolog annotation: Hit_ID=CAE68824.1; Match level="QueryCoverage =95%, HitCoverage=6%, E-value=2e-10, Identity=67%"; Hit description =Hypothetical protein CBG14783 [Caenorhabditis briggsae]
REEIXRKVIICAEPWTADSGMLTEALKLKRKNIEKKFEEEIRQLYEEN

SEQ ID NO: 142340 - protein, 498 aa, Heterodera glycines
  Coding regions on vcDNA: vcDNA=SeqID_68763; Strand=-; Position=1 -117,434-590,642-729,804-986,1218-1369,1418-1727,1786-1999,2051 -2188,2230-2366
  Homolog annotation: Hit_ID=XP_313781.1; Match level="QueryCoverage =82%, HitCoverage=42%, E-value=5e-32, Identity=26%"; Hit description =ENSANGP00000017059 [Anopheles gambiae]
MPFPPLADDPWLPSEGFFDVRGRAIGIYRNWDERRQTFDCNDSSTNAQHFVRCQITSDQLTVTHLNNERHLKRITCCEMVGLADGQSALLIGTIIGNIYALLVRNMELTEHVVFLDTALKDISEFDSQQKQVNGVNVHSEDQSKLYILFNNSFVVFYDITSDEVLQTFKSETPITVTNGNEHSCDEFVIFAGGVPLDELDNRFTLSVFCADKSLILDFDSAILDFCVFCANDNSSHILFVLCEDEIVAIDLLDPIWRMLPLPFLHPIHSSPVTCVTTVNSLSEKAQTLLGRLANLQRNASNIFSRSNLTLKNGQIAQRRRINNTNAANDLQLVVTGHENGVINVWLASEFSFKPWISLNTARDFEGFIDDSAPNLLQNSNEELTRKEPADANSDENNANFCLPPVRKAGLFDPYSDDHRLAVQKVFVDSQSGEIAVGGTAGQLLVYEGLPNSKKDMPRNEVLLLDMTSSEDAAHLRLTGRLPSESPIQARNVPANYPP

SEQ ID NO: 142341 - protein, 201 aa, Heterodera glycines
  Coding regions on vcDNA: vcDNA=SeqID_68764; Strand=-; Position=1 -117,180-241,293-460,711-889
  Homolog annotation: Hit_ID=NP_500006.1; Match level="QueryCoverage =90%, HitCoverage=36%, E-value=4e-31, Identity=42%"; Hit description =protein kinase (4B641) [Caenorhabditis elegans]
FCDKYFCLILLISTPLFRLCGYPPFFSHLPIPGMKSRIRAGQYNFSGPEWRIRAGQYNFSGPEWDRVSEAAKDLIRRCLVTDPDERAKDLIRRCLVTDPDERATITQLMQHKWITHYQQKPATALATQKVLNEREVDWSDFSEEMENALATMRVGDVHIKQMGDARNALLEKRRKRTTEEEEQKETLPEGTTTEEGEKMTK

SEQ ID NO: 142342 - protein, 19 aa, Heterodera glycines
  Coding regions on vcDNA: vcDNA=SeqID_68765; Strand=-; Position=1 -19,243-283
MTNSNLASNEHSAFNFEGK

SEQ ID NO: 142343 - protein, 18 aa, Heterodera glycines
  Coding regions on vcDNA: vcDNA=SeqID_68766; Strand=-; Position=1 -31,170-195
MTNLPSISKGRNDKFQPG

SEQ ID NO: 142344 - protein, 83 aa, Heterodera glycines
  Coding regions on vcDNA: vcDNA=SeqID_68767; Strand=-; Position=1 -72,747-926
METLLDKNTFAVTAGFKFFLPFPNSLKNKFSSSIIRITIAMDTFEEFVIVNEKSFTDILLTFGYNRGGNSEIKFSDVTQFAAL

SEQ ID NO: 142345 - protein, 98 aa, Heterodera glycines
  Coding regions on vcDNA: vcDNA=SeqID_68768; Strand=-; Position=1 -364,628-768
KVFYNHLLPIYFLADLKLSIACRFSAQQSTNTVFDSIQKIIHYPKVFLQPLIANIISCRFKAIHCLPVSAQQSTNTVFDSLQKIIHYPKVFYNHILPI

SEQ ID NO: 142346 - protein, 223 aa, Heterodera glycines
  Coding regions on vcDNA: vcDNA=SeqID_68769; Strand=+; Position=1-671
MSTDHKERATQAKKVGIKTTKNRAKFEPDSRPSTSKVAPRSKKEPEFQLDPRPSTSRQAGYIPPPAPKIVPKHEPTKRPVPYRIPKREPKIVEETPQRQQQPPAAAVVEEMFLVPPPRRGTKRRYPVIGENDAEVRIRKRVRQARRVRVQYSPEPGPSTSAQSDEQQHRELFAIPSNQLTMNQRVERLYIKCNRYADRMGVRGNTINTANGKPLAHSNLRMAI

SEQ ID NO: 142347 - protein, 101 aa, Heterodera glycines
  Coding regions on vcDNA: vcDNA=SeqID_68770; Strand=+; Position=1-306
MPNLNCVEFDDTCAWHNCQTPADQLMWFRTSANISSDQMMTTTGTGVMPSWDFAISKIRFFFIFLLVSKENKKFRRIFHENILNLLFKRPFAMKITEKALI

SEQ ID NO: 142348 - protein, 275 aa, Heterodera glycines
  Coding regions on vcDNA: vcDNA=SeqID_68771; Strand=+; Position=1 -263,503-615,1247-1695
  Homolog annotation: Hit_ID=NP_500292.1; Match level="QueryCoverage =81%, HitCoverage=22%, E-value=3e-32, Identity=30%"; Hit description =aminopeptidase (4D842) [Caenorhabditis elegans] gb|AAG23372.2| Hypothetical protein Y67D8C.9 [Caenorhabdi
MDIFLAPKLPVGGMENWGLVVLHADAVRISTSDGPLPLGTDDSSSSSRAASREERAREQKQHSLMLVDRRSEQYRAEKAITHELVHQWFGNLVGIWEWEELWIAEGFATYFVFDFLNAANHPHLTGAVMVKMLKDLVGPAEFRAGITRFLRENSFKSVDRRAIWAAFPTVADHGVDPVRLKDAMEPWLVNRGVPEVEVQRNYEDQSVRLKQRPADQNRHIVYLDDEAMQQMRMNWKDEEDEEGGREKKGVGRGAGDEEHDEEDVGEDWWKMKRMD

SEQ ID NO: 142349 - protein, 67 aa, Heterodera glycines
  Coding regions on vcDNA: vcDNA=SeqID_68772; Strand=+; Position=1 -107,161-257
MLTSIAFVPIGGLTEAVNALDVEFRNLPEMQPMLEWLMNNYTVVHALMVRERNRVSKPKLGMSRKER

SEQ ID NO: 142350 - protein, 98 aa, Heterodera glycines
  Coding regions on vcDNA: vcDNA=SeqID_68773; Strand=+; Position=1-297
MENRLILGHSLIALIIGNSLIANFDYVLTKIARIIMRMKNGEEKCLKLVTMASNSEQYSTADGMPMAKAKKRGHKLELAKMVMAEKNGAETEEPIGGG

SEQ ID NO: 142351 - protein, 89 aa, Heterodera glycines; identical to SEQ ID NO: 140574
  Coding regions on vcDNA: vcDNA=SeqID_68774; Strand=-; Position=1-400

SEQ ID NO: 142352 - protein, 48 aa, Heterodera glycines
  Coding regions on vcDNA: vcDNA=SeqID_68775; Strand=+; Position=1-248
LKITILAFCHYFFTISAFFGKFLNKNAIKPKNTPLRIDLKIFSKNTPL

SEQ ID NO: 142353 - protein, 185 aa, Heterodera glycines
  Coding regions on vcDNA: vcDNA=SeqID_68776; Strand=-; Position=1 -243,361-520,643-797
  Homolog annotation: Hit_ID=CAE66742.1; Match level="QueryCoverage =52%, HitCoverage=11%, E-value=3e-09, Identity=34%"; Hit description =Hypothetical protein CBG12092 [Caenorhabditis briggsae]
MPGTSSTHKESVFMKLNKRLTVLEQNMSLSSEHLLELSRRCVNGAARAENELKQQREGIAKEAERMAKQEANRVETEMKQKITELQNEVRRLSQQLQSVQTTVQATGTGGFFYRPMLSPMHGYSASDSHCRGEQACLLSDAMMGTTLSPLHSTSAAPYSANSMPVSAHSAFEGKTMDGLWTVIYE

SEQ ID NO: 142354 - protein, 24 aa, Heterodera glycines
  Coding regions on vcDNA: vcDNA=SeqID_68777; Strand=-; Position=1 -41,124-157
MPWLRVPQLDEPDMHAMRSHERSA

SEQ ID NO: 142355 - protein, 70 aa, Heterodera glycines
  Coding regions on vcDNA: vcDNA=SeqID_68778; Strand=-; Position=1-210
MAGVDYVLKFMQIAEHSEQQRSSGRTPKLSQQKWAMAEEDEMPQFIKRPFRVPSAHSVDKFVDESLKSDG

SEQ ID NO: 142356 - protein, 63 aa, Heterodera glycines
  Coding regions on vcDNA: vcDNA=SeqID_68779; Strand=-; Position=1 -21,380-542,620-627
MQKNTVLPSPPTERECYDNDVCCIQWAANGTCKTAPRYMNTWCQGSCRFDGCRPYADYGKPEF

SEQ ID NO: 142357 - protein, 138 aa, Heterodera glycines
  Coding regions on vcDNA: vcDNA=SeqID_68780; Strand=-; Position=1 -108,178-486
MNKKHNVTMARRRPTKSAAFPPANAPNAPPTKREAVTKVGCHEVQAVTDYACSIAKQKAPEGAKPTDQTQKQSGGGRLGVIRSSRGQMELNGRDQTNQQKRERERKEQKRMHTQFGTAKEMRPFVNDGPISAFLSMRK

SEQ ID NO: 142358 - protein, 576 aa, Heterodera glycines
  misc_feature (466)..(466): Xaa can be any naturally occurring amino acid
  Coding regions on vcDNA: vcDNA=SeqID_68781; Strand=+; Position=1 -177,215-379,428-621,692-972,1031-1155,1209-1428,2311-2355,2418-2667
  Homolog annotation: Hit_ID=NP_388707.1; Match level="QueryCoverage =95%, HitCoverage=94%, E-value=2e-80, Identity=34%"; Hit description =hypothetical protein BSU08260 [Bacillus subtilis subsp. subtilis str. 168] emb|CAB12655.1| yfiG [Bacillus
QLHLSSAASDHSESSSATLFLSLISWFCALGGLLLGYGTSIISDSLHFMTADLRLNTFRQSQGITTASLLVGGAFGALAGGKAADLQSQGITTASLLVGGAFGALAGGKAADLVGRRRAMVTLCFLFIVGNLCSSLAPTFPLLLSARIFLGFSLGGFLLLSARIFLGFSLGGFSSVVPIFLSELSPSSIRAQVVTRSTLNIVAGQLLAFVVGALLGSVWEERLDIWRWMNLDIWRWMNAVSLFPALLLLSALLLFVPESPRWLVSSGQMGNAFVVLCRIRHNAEEAREELAEIAQSQTETKKSSPFRHFWDRWLRNCVMIGLGIALIQQIVGVSAPLGIALIQQIVGVSAPMYYGTNILERCGMDIELAMIVNIAIGIVSLVSMAFGIWLMGRIVSLVSMAFGIWLMGRCGRRPMLLVGMVGSSLSHLLVALIFWLMPSGNAKGVVVLLLLLLFCAFMQCAITSVXWFILAEIFPLRVRGITMGLCSAIVWMTKMGLCSAIVWMTKFAYGLFLPLAMDFLGISATFLLLLLFTSLSTIFVWLFLPETRDKTLEEMEKQFRGRLGSTEEEREEEKQR

SEQ ID NO: 142359 - protein, 34 aa, Heterodera glycines
  Coding regions on vcDNA: vcDNA=SeqID_68782; Strand=-; Position=1-103
LYALPIFHYFTFLPLNSLFCGSIKNACRGIRKGH

SEQ ID NO: 142360 - protein, 168 aa, Heterodera glycines
  misc_feature (1)..(1): Xaa can be any naturally occurring amino acid
  Coding regions on vcDNA: vcDNA=SeqID_68783; Strand=+; Position=1 -212,330-409,437-491,655-732
  Homolog annotation: Hit_ID=NP_499891.1; Match level="QueryCoverage =95%, HitCoverage=35%, E-value=2e-38, Identity=51%"; Hit description =parvin alpha, Paralysed Arrest at Two-fold PAT-6 (43.0 kD) (pat-6) [Caenorhabditis elegans] gb|AAC48090.1
XKSLLIAGQSLRTLTIESRDDKVQEICQLLLYWLNDELAEERIVVRNLQEDIYDGQVIQKLTEKLAQVKIEVPEVSQSEEGQKQKWRIIVDALNRTINQPGGQPKWTAEMIHAKRIIVDALNRTINQPGGQPKWTAEMIHAKDIVAILHLLITLALHYRAPIRFPNNV

SEQ ID NO: 142361 - protein, 16 aa, Heterodera glycines
  Coding regions on vcDNA: vcDNA=SeqID_68784; Strand=-; Position=1-49
EAIPGGFGLPINLSAS

SEQ ID NO: 142362 - protein, 16 aa, Heterodera glycines
  Coding regions on vcDNA: vcDNA=SeqID_68785; Strand=-; Position=1-49
EAIPEGFGLPINLGAS

SEQ ID NO: 142363 - protein, 17 aa, Heterodera glycines
  Coding regions on vcDNA: vcDNA=SeqID_68786; Strand=+; Position=1-53
ALPGPGPKQPWYHSKAK

SEQ ID NO: 142364 - protein, 115 aa, Heterodera glycines
  Coding regions on vcDNA: vcDNA=SeqID_68787; Strand=+; Position=1 -229,474-592
  Homolog annotation: Hit_ID=NP_510674.1; Match level="QueryCoverage =35%, HitCoverage=16%, E-value=5e-10, Identity=68%"; Hit description =carbonic anhydrase (28.1 kD) (cah-3) [Caenorhabditis elegans] gb|AAB52498.1| Carbonic anhydrase protein 3
MKQQNVQIAEEETFGKTNDEMPNGAQKQQNGQAKEKQKVGQTAPVARPLTVKDWDYDERGQCGPKHWLRIAKCEHLVQFQPDPQIEPPEIYGGLLDQNYRFVQYHFHWAQNDNEG

SEQ ID NO: 142365 - protein, 64 aa, Heterodera glycines
  Coding regions on vcDNA: vcDNA=SeqID_68788; Strand=+; Position=1 -50,97-175,426-489
  Homolog annotation: Hit_ID=NP_510674.1; Match level="QueryCoverage =84%, HitCoverage=21%, E-value=9e-14, Identity=61%"; Hit description =carbonic anhydrase (28.1 kD) (cah-3) [Caenorhabditis elegans] gb|AAB52498.1| Carbonic anhydrase protein 3
MASSAEHFVSSFVRYEGSLTTPPCSENVTWTVFTDPLLITREQMSLLRALKDCKGNVIEKNYRP

SEQ ID NO: 142366 - protein, 77 aa, Heterodera glycines
  Coding regions on vcDNA: vcDNA=SeqID_68789; Strand=-; Position=1 -155,202-280
MGEKANWANLFFCMAGKTDAVKWEKKNIDHRTEQSPITTELEAAEAAKHYYCIGIMIRINEELKAGGKKGICLVMIR

SEQ ID NO: 142367 - protein, 16 aa, Heterodera glycines
  Coding regions on vcDNA: vcDNA=SeqID_68790; Strand=+; Position=1 -40,187-197
MALFKCSAYLYLKGNL

SEQ ID NO: 142368 - protein, 74 aa, Heterodera glycines
  Coding regions on vcDNA: vcDNA=SeqID_68791; Strand=-; Position=1 -21,67-138,414-545
  Homolog annotation: Hit_ID=CAE65910.1; Match level="QueryCoverage =100%, HitCoverage=10%, E-value=1e-20, Identity=62%"; Hit description= Hypothetical protein CBG11077 [Caenorhabditis briggsae]
MAMAPVILTPYVLSPNILNPFAMSPLILSPTVLSPDILSPQILGGAILSPTVGSPAILTETFLAASVLSPSVLS

SEQ ID NO: 142369 - protein, 49 aa, Heterodera glycines
  Coding regions on vcDNA: vcDNA=SeqID_68792; Strand=+; Position=1 -45,94-198
MASINDLDYVRDYDYIKKMKEILGIMMCLKSITMLRDKDLWMVVPVRDK

SEQ ID NO: 142370 - protein, 64 aa, Heterodera glycines
  Coding regions on vcDNA: vcDNA=SeqID_68793; Strand=+; Position=1 -129,174-239
MDNRFIDRALFENSATKKYFVGTFPADRLPKCTKFPCSLIVNLDPSGMPGTKKRSNPRIPLYFS

SEQ ID NO: 142371 - protein, 36 aa, Heterodera glycines
  Coding regions on vcDNA: vcDNA=SeqID_68794; Strand=-; Position=1-110
MLGKCSPPVTKLASTADEIEESVPETSSGCWKRFRQ

SEQ ID NO: 142372 - protein, 77 aa, Heterodera glycines
  Coding regions on vcDNA: vcDNA=SeqID_68795; Strand=+; Position=1 -43,96-286
MAQAESAEETYEHAMDFYFQLDNYVQMSQNLTIDDQLPPGWDATAEVRVYCATPTVEASTPAGWTIHAVASNFTLLG

SEQ ID NO: 142373 - protein, 470 aa, Heterodera glycines
  Coding regions on vcDNA: vcDNA=SeqID_68796; Strand=-; Position=1 -65,237-501,581-784,978-1202,1262-1334,1374-1507,1632-1825,1896-2075
  Homolog annotation: Hit_ID=NP_508732.2; Match level="QueryCoverage =99%, HitCoverage=85%, E-value=1e-130, Identity=54%"; Hit description= twk-8 protein like family member (XE894) [Caenorhabditis elegans]
GISRVFILHYLEASNEILVSHNVISRESFNGLGQEYFDKLIAHSFSACRNQFTNERHLLNRTHGAEMLWTYANSLFFATTVITTIGPKQSNSKNSHLSFSGYGNLVPMTEFGRIACICFALFGIPLLLVTIADIGKFLSDFLNFLYRTYRTFKTKVPSSPFGLLSSFQVRKQSRRSSVSTMTKAGSINLNEINEADVEESAPHELRIPVVMVLFVLLCYCAIGGFLFHWEGWTYFEAFYFCFITMATVGFGDIVPTHFGDIVPTHSSTYIILAYIIFGLSLATMCIDLAGTATMCIDLAGTEYIRKIHYLGTKMEDAKGTVITGLKAGEQILKHRGIEVIRTASGKIVQVGGAMLSLRQAQELGVEYILSEFKYKHKNILYEPLSPAVQRLIKNKNIKILPGDISDNDGLILQNILPGDISDNDGLILQNRSYGKPFLLLQTSPNAIHRYTMPAEDDAILVPFILKETNI

SEQ ID NO: 142374 - protein, 158 aa, Heterodera glycines
  Coding regions on vcDNA: vcDNA=SeqID_68797; Strand=-; Position=1 -150,618-769,888-950,1050-1160
  Homolog annotation: Hit_ID=CAE74013.1; Match level="QueryCoverage =97%, HitCoverage=36%, E-value=9e-42, Identity=49%"; Hit description =Hypothetical protein CBG21661 [Caenorhabditis briggsae]
VDFRGKILTAPWIWLDGQFRQNVHLKIDDKGKIVQIMEGHHEAEKQCDDGALLPGFVNAHSHAFHRCLRGRSQIGGQGTNNFWKWRQDMYNLVRHIDYARIFQICVGTFREMLSAGITTVGEFHYVHHADDEKFGLDLAVVEAALEVGIRLVLIGRFE

SEQ ID NO: 142375 - protein, 234 aa, Heterodera glycines
  misc_feature (198)..(198): Xaa can be any naturally occurring amino acid
  Coding regions on vcDNA: vcDNA=SeqID_68798; Strand=+; Position=1 -85,195-312,379-446,497-568,612-680,753-902
  Homolog annotation: Hit_ID=NP_506130.1; Match level="QueryCoverage =69%, HitCoverage=29%, E-value=3e-39, Identity=52%"; Hit description =innexin, putative gap junction protein, OPUs gap junctional protein (54.6 kD) (inx-11) [Caenorhabditis el
SCFITLAYLTIKLLYLSNVFAQLYFMIKFLFLETDRYNWYGLGVFLDIMAGIPWQTSGYFPRVSLCDFTVVRQVANIQKYSVQCVLVINIFNEKIFILLWFWYALLLLVTSISFNEKIFILLWFWYALLLLVTSISFIYWLTMLIFPQFGRWYVAQALELNYLIYWLTMLIFPQFGRWYVAQALELNYLNHLKISNLXGSQGILKHFVRFLPGVFALLVPFSAHLRFFLVFSLF

SEQ ID NO: 142376 - protein, 51 aa, Heterodera glycines
  Coding regions on vcDNA: vcDNA=SeqID_68799; Strand=-; Position=1 -18,219-356
MCGAKKVVFGVGFFGIADHESDIHFNQIPKTGPELLQKNLKFKLSNFGFLV

SEQ ID NO: 142377 - protein, 142 aa, Heterodera glycines
  Coding regions on vcDNA: vcDNA=SeqID_68800; Strand=-; Position=1-427
YIDHSVIKFLRSKKRFFDKSGTKLEVFVHSIDTDVQPIWDVFTREILPIFATNVRHLCFPNANHFYNLRRHTSPTLLTDLDQLNSIDSGALLPDGISDDGPKATAGQALSKWLHTPSKNGKANELYCCAYFCEITWINTFKE

SEQ ID NO: 142378 - protein, 166 aa, Heterodera glycines
  Coding regions on vcDNA: vcDNA=SeqID_68801; Strand=-; Position=1 -479,662-683
MAFVILIFVLIFIINSTDKCLCVHKLSDLNGKTRPTFVEIFGQGWEIDQNSNWQNDQNELNLEDSIGNDQNNEQFNDQQKREIVHKFHVIKEKIKKRGKYSAKVRTKIEQKIAVKLGISRKKIYKWKKEFNLKKIKKNDKNYYEKKKQEFIERIDEIYRRWNSVFE

SEQ ID NO: 142379 - protein, 82 aa, Heterodera glycines
  Coding regions on vcDNA: vcDNA=SeqID_68802; Strand=+; Position=1 -243,760-765
MKLLVEQSWWKVGMQKTESENCLLSKISLFGTPGLETCVYKKDAKINGTFVPGIWMSEDNNRALVFDKNSKKAEACGEKLRK

SEQ ID NO: 142380 - protein, 147 aa, Heterodera glycines
  Coding regions on vcDNA: vcDNA=SeqID_68803; Strand=+; Position=1-444
MDFDFHVLILMLLLIISSTDKKFVFKKNGKTRPTFAEIFGQGWEIDQNSNWQNDQNELNSEDSIDNDQNNDQFNDQQKCEMVHKFDAIKEGIKNRGKYSPKIWNRIEQKIAKNRAFFQKSPLFLFIRCFIDEFLDFGSVWKIYGSNK

SEQ ID NO: 142381 - protein, 87 aa, Heterodera glycines
  Coding regions on vcDNA: vcDNA=SeqID_68804; Strand=+; Position=1-266
NLKSPPLTEPKSSVRRPPIRNTSDVRLTPKNTCLPRRLSIAMLFLPPKILPRRALAHRHVTVKAETLNGRHRDERIRCHQRHTANAA

SEQ ID NO: 142382 - protein, 33 aa, Heterodera glycines
  Coding regions on vcDNA: vcDNA=SeqID_68805; Strand=+; Position=1-195
KRARSARLRPRSCLNSPTNLETGAKRPYKPNKI

SEQ ID NO: 142383 - protein, 285 aa, Heterodera glycines
  misc_feature (3)..(3): Xaa can be any naturally occurring amino acid
  misc_feature (9)..(9): Xaa can be any naturally occurring amino acid
  misc_feature (267)..(267): Xaa can be any naturally occurring amino acid
  misc_feature (282)..(282): Xaa can be any naturally occurring amino acid
  Coding regions on vcDNA: vcDNA=SeqID_68806; Strand=-; Position=1 -182,233-467,568-642,696-1014
  Homolog annotation: Hit_ID=CAE68958.1; Match level="QueryCoverage =86%, HitCoverage=45%, E-value=6e-41, Identity=39%"; Hit description =Hypothetical protein CBG14938 [Caenorhabditis briggsae]
SAXLFNNGXLDQIDFWRPPPFVNSSGDVMVDVLHGRHFLDFLRKFQVEFKVLVDDLSKLIEEKEIGPLIEEKEIGPSPYATKNGPILRDTFDRFEGFGLRMGDYHSFADLLAFMQNVQNAMPSRAQLRTIGWTAEGRPLQGIQFGKSDKSRPVVWIDAGIHAREWTAVHTAAYFIFYFANQVHTAAYFIFYFANQIRLGNDQRLLKCLERVDILVLPCLNPDGYEFTRSEPRNPAVRMWRKNRSKERCATSEGRPNALLSENWGGNXKGKSQEMEENEGKAXRTI

SEQ ID NO: 142384 - protein, 74 aa, Heterodera glycines
  Coding regions on vcDNA: vcDNA=SeqID_68807; Strand=-; Position=1 -62,406-568
MMGIECVRSTAPRPWDSESERFHQVHHSSDGYGRDGIGTHPPMSGVALQFDRFEVQAFYQNIPFIVWVEEITFH

SEQ ID NO: 142385 - protein, 39 aa, Heterodera glycines
  Coding regions on vcDNA: vcDNA=SeqID_68808; Strand=+; Position=1 -39,127-207
MKLELAKNNTVFSSKLSPFGRKMVEHYNIEFNNVEKDAN

SEQ ID NO: 142386 - protein, 74 aa, Heterodera glycines
  Coding regions on vcDNA: vcDNA=SeqID_68809; Strand=+; Position=1-283
SIKKGSGRKKFFLIFWLYCFCFGGGAGTSGIMRTRPIWQVKQRLLTSQKVRCRDETNQHCLPRGTRHGPPKEWI

SEQ ID NO: 142387 - protein, 189 aa, Heterodera glycines
  Coding regions on vcDNA: vcDNA=SeqID_68810; Strand=-; Position=1 -39,90-185,230-399,1196-1460
  Homolog annotation: Hit_ID=NP_871912.1; Match level="QueryCoverage =93%, HitCoverage=95%, E-value=3e-49, Identity=43%"; Hit description =ROLler: helically twisted, animals roll when moving ROL-8, COLlagen structural gene (rol-8) [Caenorhabdit
MRPIAFVAVVVSTVAVIASVVTLPMLYNYVQSFQSHLMVETDYCKARARDMWLEMTALQIGKGHVNRIKRGWLFGQWVPESGADAYAAGKHSTDEPSLGFFGPKGQPGPDGQSFEGPPGPPGDAGRPGREGRPGGTVSVFTRFSPNQTPKGPSGPPGQDGEKGSCDHCPEPRTPPGYFVEAGKSGGHYH

SEQ ID NO: 142388 - protein, 69 aa, Heterodera glycines
  Coding regions on vcDNA: vcDNA=SeqID_68811; Strand=+; Position=1 -107,409-513
  Homolog annotation: Hit_ID=NP_702697.1; Match level="QueryCoverage =98%, HitCoverage=9%, E-value=4e-10, Identity=48%"; Hit description =hypothetical protein [Plasmodium falciparum 3D7] emb|CAD49135.1| hypothetical protein [Plasmodium falcipar
AEEEDEEEADEEDEEEADEEDEEEADEEEEADEEDVFMHFFCIFCVKKEDEEKLSASAEEEEADQSNGN

SEQ ID NO: 142389 - protein, 159 aa, Heterodera glycines
  Coding regions on vcDNA: vcDNA=SeqID_68812; Strand=+; Position=1-477
  Homolog annotation: Hit_ID=CAB62280.1; Match level="QueryCoverage =41%, HitCoverage=87%, E-value=4e-14, Identity=54%"; Hit description =hydroxyproline-rich glycoprotein DZ-HRGP [Volvox carteri f. nagariensis]
MRRDLADRPAKVELTKGMSVLLRRGGEDEDGEVVDTTPRPPAPPPPPPPPGRRPPRGPPPPPTGRRPPSGPTTPRPSPPGSPPPRPERPQRPSRASRRGGRLEKWRKGRYNIQQRQPVVRDLLAEAAAAPLPESDDEDDYMLESGFALPAPSQYYGDLP

SEQ ID NO: 142390 - protein, 55 aa, Heterodera glycines
  Coding regions on vcDNA: vcDNA=SeqID_68813; Strand=-; Position=1 -21,439-585
MMHKTDTLLVQLDKMRDDLRHASAAMAGSVSDMVSLSPKSLPKIVLIKCERSFSS

SEQ ID NO: 142391 - protein, 261 aa, Heterodera glycines
  Coding regions on vcDNA: vcDNA=SeqID_68814; Strand=-; Position=1 -120,621-739,922-994,1090-1168,1794-1938,2484-2730
  Homolog annotation: Hit_ID=CAE72104.1; Match level="QueryCoverage =81%, HitCoverage=7%, E-value=2e-29, Identity=33%"; Hit description =Hypothetical protein CBG19196 [Caenorhabditis briggsae]
MPTVRQNIMPKSASSATTTTMSTIAVRAEPHSTIVVAIVRVEELLGRAEKLVTEQTEPDDILIYEAMADGLATAWKSLSRQLSIRGYILTDTQHLYEIALKHEELAKLANSRLCKNGAIQSPDELQRIIDELAELTREGLEIGSTVIAQIRILGALTDNEERPREVLNACLAIEKIMLRIAQSWELIENNWRIQRDGGQVVAIESAKKEKPAPPKTVGSFSANNLVAAEQWLLTAAQRFDRVRDCEEDEELELAILITDIK

SEQ ID NO: 142392 - protein, 134 aa, Heterodera glycines
  Coding regions on vcDNA: vcDNA=SeqID_68815; Strand=+; Position=1-405
MAKMLHLLATIALTAGPIDEGRDSKAERGEEEEEAACWSSTDLLVTHIKPQREGKAHPSAPSLFFFSSRHQTLFLERVGLLRPRQYGGLLINMEIEANLERALNRQTGRADRQAADKQRQRQSIGFIFYCCCGD

SEQ ID NO: 142393 - protein, 155 aa, Heterodera glycines
  Coding regions on vcDNA: vcDNA=SeqID_68816; Strand=-; Position=1-568
RDPLNSRFKFGYILDGIVCNVMLICSLNTFWDDNLSIPPLLLFVECPPMAKMLHLLATIALTAGPIDEGRDSKAERGEEEEEAACWSSTDLLVTHIKPQREGKAHPSAPSLFFFSSRHQTLFLERVGLLRPRQYGGLLINMEIEANLERALNRQT

SEQ ID NO: 142394 - protein, 16 aa, Heterodera glycines
  Coding regions on vcDNA: vcDNA=SeqID_68817; Strand=-; Position=1-49
EAIPEGFGLPINLGAS

SEQ ID NO: 142395 - protein, 47 aa, Heterodera glycines
  Coding regions on vcDNA: vcDNA=SeqID_68818; Strand=+; Position=1-165
QSHVTHSQPISNNHFYVNCCNNIPVCRRLRPLAVSIAAGCGKLCTFL

SEQ ID NO: 142396 - protein, 30 aa, Heterodera glycines
  Coding regions on vcDNA: vcDNA=SeqID_68819; Strand=-; Position=1 -52,101-141
MKALSLPNFYITKLWTKGFLIEIFTKQEKN

SEQ ID NO: 142397 - protein, 152 aa, Heterodera glycines
  Coding regions on vcDNA: vcDNA=SeqID_68820; Strand=-; Position=1 -18,83-157,448-727,900-985
MLAHSHNYTKASLQHVQRNLMKNNVAPDLFQNLELNMQLAMSDFSGSSTKRRKKTTNIWPSFSSSNNWTRRVRRSVRLPKGGHGQNVRDEMPGQKADQTQAGQVTSTNQTFIRTFTGETLALNENSRQIVLHFGFDERRRFALPSLPARRIQ

SEQ ID NO: 142398 - protein, 88 aa, Heterodera glycines
  Coding regions on vcDNA: vcDNA=SeqID_68821; Strand=+; Position=1 -134,285-417
MMKLIRRFMFFDFLKEPFWVFEDRPKIGLNFVTRPKQRNTREQFGMNVTNKQLGYMDTVFGQKPGPGIARPKKAGFESKFLNRARVSG

SEQ ID NO: 142399 - protein, 125 aa, Heterodera glycines
  Coding regions on vcDNA: vcDNA=SeqID_68822; Strand=+; Position=1 -283,324-418
  Homolog annotation: Hit_ID=XP_345184.1; Match level="QueryCoverage =96%, HitCoverage=56%, E-value=7e-14, Identity=41%"; Hit description =similar to CG14852-PA [Rattus norvegicus]
MRRGATVIRRGATVIRRGATVIRRGATVIRRGATVIRRGATVIRRGATVIRRGATVIRRGATVIRRGATVIRRGATVIRRGATVIRRGTKVIKRGTMIRRGATVIRRGATVIRRGETVIRRGISD

SEQ ID NO: 142400 - protein, 212 aa, Heterodera glycines
  Coding regions on vcDNA: vcDNA=SeqID_68823; Strand=+; Position=1 -543,633-728
  Homolog annotation: Hit_ID=BAC58076.2; Match level="QueryCoverage =92%, HitCoverage=7%, E-value=7e-18, Identity=36%"; Hit description =large tegument protein [Cercopithecine herpesvirus 1]
GAAAVFCDAVPSVDVPPAGAAAVFCDAVPSVDVPPAGAAAVFCDAVPSADAPPAGAAAVFCDAVPSADAPPAGAAAVFCAAVPSVDVPPAGAAAVFCDAVPSADAPPAGAAAVFCAAVPSADVPPAGAAAVFCDAVPSADAPPAGAAAVFCAAVPSADVPPAGAAAVFCAAVPSADVPPAEHGRAANAGRTGRGGGQRQTDGTERSTWWNFR

SEQ ID NO: 142401 - protein, 193 aa, Heterodera glycines
  Coding regions on vcDNA: vcDNA=SeqID_68824; Strand=-; Position=1-583
  Homolog annotation: Hit_ID=NP_494447.1; Match level="QueryCoverage =98%, HitCoverage=61%, E-value=1e-26, Identity=38%"; Hit description =c-type lectin precursor family member (2D393) [Caenorhabditis elegans] gb|AAD12833.1| Hypothetical protei
APAGGTSALGTAAQKTAAAPAGGTSALGTAAQKTAAAPAGGASALGTASQKTAAAPAGGTSALGTAAQKTAAAPAGGASALGTASQKTAAAPAGGTSTLGTAAQKTAAAPAGGASALGTASQKTAAAPAGGASALGTASQKTAAAPAGGTSTLGTASQKTAAAPAGGTSTLGTASQKTAAAPAGGTSTLGTAS

SEQ ID NO: 142402 - protein, 754 aa, Heterodera glycines
  Coding regions on vcDNA: vcDNA=SeqID_68825; Strand=-; Position=1 -146,198-288,342-628,686-859,924-1062,1114-1287,1345-1447,1506 -1691,2278-2620,2705-2933,3248-3642
  Homolog annotation: Hit_ID=NP_491691.1; Match level="QueryCoverage =34%, HitCoverage=36%, E-value=2e-39, Identity=38%"; Hit description =oxysterol-binding protein-like protein 9 (76.7 kD) (1G409) [Caenorhabditis elegans] gb|AAC24270.1| Oxyste
AADFKMQAPDWGNYDTNGTDYDYIYNNSDERDNWNSEQAGVFRHLVTQLGTTQTLQNLALPTFVLERRSLLEMYADFFAHPDELIAGAYENTAEKRSRLVDDNAFESTIFQIPCRPQILLELLLSCTQNRRREEAVQSDPGRSVPLPLDPAWRAVVRKPNRRWTVPGLSNQPGPMTFIGEQVSHHPPISAFYVEHPESGVTCTSHIYTESHFAGLTSLGVRNIGRATVRLQNHNETYMATFPDAFARNVFGRPWFELAGKVGPFRSILLFQQTKFFHTGAAHVLRKCAPNSWPSLPQGGGGDATERRLARRNCPEAKCPQSLRTLYKCAGEVRRDKGMCQGAGPEEQRKPKIVASSHRCSVLQRHKNGEPSQALHRATPAGRGQATQRTTETPVEAAPFSTRWDWYADRRLEIPRRAGMNVMAIRAHLRCCLMKPLSPNDLADLLRRHPVPVDGSITNPSYVPMQENQSIKFVLAFLIFDSQLTNFIKLIPTAKVTHLAASPAPQFAAQQQEERTKRPMAMPRAESAKKNGGGTEDISLRCPTSQAPTSFLSRQIFRCPSPNSAVPPLSDLATRLCRLPCRRPTSPPSLLACPQPIAWPMDRTAPADGTAECARAAATRGCEMRRLFSPNVCPAEKRRLRRLFLRYRFPYRCAACRSAPLVQCFSPFTHFAALSAPSGAAQNAEGQRGAAGAATAAQPTDDEAMTAQKETMQMIPLASALSTHCLAALSQIPILFPLSVCPLSALPLCLPFLSI

SEQ ID NO: 142403 - protein, 235 aa, Heterodera glycines
  Coding regions on vcDNA: vcDNA=SeqID_68826; Strand=+; Position=1 -574,893-1026
MPCSSSSSPSSSSAASFSSVFPVPFPASHPWNPFASAAPFVIAIGSGSVCVKNGECRQYNQLKRHYHESAPVAAEVPSVDEGMNATDKRRKKRGPSALATLSALLLLGVALIVSLAFVAWTIHRMVNEKKRPNDARESGKIELQNEQHKECAEAMKTQAERIEVLESAVTKQKRTEEKETEEPNDNGKKSHDRRQFSQRKQPKELTGNGGRDFVIFMKGRPISGRHFMAQGKKAK

SEQ ID NO: 142404 - protein, 98 aa, Heterodera glycines
  Coding regions on vcDNA: vcDNA=SeqID_68827; Strand=-; Position=1-297
MCAQQEVQFNRIWHYDNAKNIHFGRGRNVTNLKWTNGNFEEENGQKKWQKLGEGGENDNGEAFRKNENGRKHQQHQTVFPAEPIPPKRTARERTEEYV

SEQ ID NO: 142405 - protein, 143 aa, Heterodera glycines
  Coding regions on vcDNA: vcDNA=SeqID_68828; Strand=-; Position=1-432
  Homolog annotation: Hit_ID=E86336; Match level="QueryCoverage=97%, HitCoverage=34%, E-value=3e-32, Identity=51%"; Hit description =hypothetical protein F14O10.11 - Arabidopsis thaliana gb|AAF88160.1| Contains weak similarity to an unknown pr
MKKAKEEREDEEKEEEKKKEEEEVDEKEEQKVKEEQREDEEKKDEGKGKEEQKEEEEKKEEEEEENVEEEREDYNEEEEEKKEEGKGKEEQKEEEEKKEEEEEEREDYNEQEEEKKEEGKWKEEVEHTADQMGEEEEAEKGRD

SEQ ID NO: 142406 - protein, 113 aa, Heterodera glycines
  Coding regions on vcDNA: vcDNA=SeqID_68829; Strand=-; Position=1 -192,370-422,466-560
  Homolog annotation: Hit_ID=CAE68967.1; Match level="QueryCoverage =100%, HitCoverage=13%, E-value=5e-41, Identity=76%"; Hit description= Hypothetical protein CBG14947 [Caenorhabditis briggsae]
MSEKVGPVSFDTPEPGEMAFDKPYSEATAQLIDQEVRDMVSAALRRTRELLMSKVEQIERVRETVALRLLEKEILAREDMIELLGPRPFAEKHTYEEFVAGTGSMDEDTTLPK

SEQ ID NO: 142407 - protein, 146 aa, Heterodera glycines
  Coding regions on vcDNA: vcDNA=SeqID_68830; Strand=-; Position=1 -124,601-771,817-962
MHFIVRLAQHSLAHGVARTFFDFVQCLPKTEEELQQKWTRTGFRGRNSWCLSEDTDCTEYIERFGTVATVDAVLSALLGESVPASIADELQTNPKFGQVLAKLDDIEDEFILRTTQYNILFAKELMESAEGQGIIEEEAHKCTFLI

SEQ ID NO: 142408 - protein, 129 aa, Heterodera glycines
  Coding regions on vcDNA: vcDNA=SeqID_68831; Strand=+; Position=1 -209,786-966
TCSTVVKYLNRVVQNADKCGIKDCVDGGNLRVILAELGDNFYATILAHALSFAYNLAGAMLLLCDVSTYKKPFSDMTFYGSSALPNGTKGPNADDFLYANGTDSIAASTAELSKDEMFVEDLLHAHEAK

SEQ ID NO: 142409 - protein, 34 aa, Heterodera glycines
  Coding regions on vcDNA: vcDNA=SeqID_68832; Strand=+; Position=1-105
EKKRVPAWCDRILYWVKDKNVGIEQVTYESAHQG

SEQ ID NO: 142410 - protein, 45 aa, Heterodera glycines; identical to SEQ ID NO: 124527
  Coding regions on vcDNA: vcDNA=SeqID_68833; Strand=-; Position=1-138

SEQ ID NO: 142411 - protein, 32 aa, Heterodera glycines
  Coding regions on vcDNA: vcDNA=SeqID_68834; Strand=+; Position=1-121
ILVKNFPKHFLSKKGIKKFIYIIILFLFLLIF

SEQ ID NO: 142412 - protein, 101 aa, Heterodera glycines
  Coding regions on vcDNA: vcDNA=SeqID_68835; Strand=+; Position=1 -152,523-676
MDVTPTLQCAFECFVFKVSAVRTNYRSWLRSSSIHEPSDPPIRLEFILQQNTERYTTAPTYGSTPKAWLVRQLPRNVGQRPQVISNDLCPSADGGIWLCQR

SEQ ID NO: 142413 - protein, 71 aa, Heterodera glycines
  misc_feature (29)..(29): Xaa can be any naturally occurring amino acid
  misc_feature (45)..(45): Xaa can be any naturally occurring amino acid
  Coding regions on vcDNA: vcDNA=SeqID_68836; Strand=-; Position=1-933
  Homolog annotation: Hit_ID=AAL31950.1; Match level="QueryCoverage =95%, HitCoverage=15%, E-value=4e-09, Identity=54%"; Hit description =CDH1-D [Gallus gallus]
VVNRNHLGNDPAAGSPTATLLRLLPGSSXLRLNRFQSAYRPKPEXNRPRISRNGSVPGSDGRCVQRAGTYS

SEQ ID NO: 142414 - protein, 55 aa, Heterodera glycines
  Coding regions on vcDNA: vcDNA=SeqID_68837; Strand=-; Position=1-165
MAADGKKIEDSERPFVVWQRLDPSDKLGAPKPAPVPSKVKPSSGQSPSPSGIERR

SEQ ID NO: 142415 - protein, 93 aa, Heterodera glycines
  Coding regions on vcDNA: vcDNA=SeqID_68838; Strand=+; Position=1 -112,173-342
  Homolog annotation: Hit_ID=NP_500998.1; Match level="QueryCoverage =92%, HitCoverage=19%, E-value=5e-28, Identity=65%"; Hit description =i-45 protein (49.8 kD) (4H318) [Caenorhabditis elegans] gb|AAB09107.2| Hypothetical protein C43G2.1 [Caen
MIGVLGLGAVVVSLWDKFNDKRYRPFRATIFSLMGLSGIIPTIHFVYTDGFRQLVAETSFYWLVAMAVLYLFGALLYATRTPERFFRMRNKKF

SEQ ID NO: 142416 - protein, 45 aa, Heterodera glycines
  Coding regions on vcDNA: vcDNA=SeqID_68839; Strand=-; Position=1-136
MFFFCCVSILGYPTYVMLNLDNVRPFKQTHFNDELNEKLEERRRL

SEQ ID NO: 142417 - protein, 174 aa, Heterodera glycines
  Coding regions on vcDNA: vcDNA=SeqID_68840; Strand=-; Position=1 -84,138-215,265-340,527-811
  Homolog annotation: Hit_ID=CAE72829.1; Match level="QueryCoverage =85%, HitCoverage=83%, E-value=3e-40, Identity=58%"; Hit description =Hypothetical protein CBG20111 [Caenorhabditis briggsae]
MNTAISKLFELRPDPYDNSQRKYLRLCLFLNVENASDLADLVKVMDIALIRAELVLEPFILLVAANRALFQAAHNQLSTRSLSAELIYCLSPNRNIRESLATFGIAGTTRALLVAIFDDAKGKKMREAAKHIKGTPVTLEKLRENADEALIRQVINQTVAYYFGELPMLIYHWM

SEQ ID NO: 142418 - protein, 97 aa, Heterodera glycines
  Coding regions on vcDNA: vcDNA=SeqID_68841; Strand=+; Position=1 -192,597-698
CDVKKAVPQNKRNGGAGAASFIRGGNLIMRNAYIGGGAAAHHASIGMGGGGGSMRGSSHHHPQQQMPMYSNASAAAYAQWYYNAAAAAAYGAGGYLS

SEQ ID NO: 142419 - protein, 24 aa, Heterodera glycines
  Coding regions on vcDNA: vcDNA=SeqID_68842; Strand=-; Position=1-80
RTLSTAVRQRSSKIYSMPQILWAG

SEQ ID NO: 142420 - protein, 55 aa, Heterodera glycines
  Coding regions on vcDNA: vcDNA=SeqID_68843; Strand=+; Position=1-165
MQYNAFKPRREAGQFQNFVPHFTVESPSTLLDNYVSMSTVAFGQLWNGKMGISDG

SEQ ID NO: 142421 - protein, 76 aa, Heterodera glycines; identical to SEQ ID NO: 131927
  Coding regions on vcDNA: vcDNA=SeqID_68844; Strand=-; Position=1-388

SEQ ID NO: 142422 - protein, 69 aa, Heterodera glycines
  Coding regions on vcDNA: vcDNA=SeqID_68845; Strand=-; Position=1-275
LLIMQYNAFKPRREAGQFQNFVPHFTVESPSTLLDNYVSMSTVAFGQLWNGKMGISDGVRSYLKIPLFV

SEQ ID NO: 142423 - protein, 185 aa, Heterodera glycines
  Coding regions on vcDNA: vcDNA=SeqID_68846; Strand=+; Position=1 -206,896-1244
MSQNESLDNAQHQQQKQQQNPNTEAELALQQAQVGLNLFWLIQQAAAMQQQQQQVEEGQGTAPTSSLTERTQCAGGRHHFGVLSKQTHAPGEWQGEGANSPKAFRVQVKVIKARQPRRFAKLAKREKKWDKKEEEEQQRNGKRKGGNEIGEPKEKEGDEEKGGEAKEEAEMGGMAGEALIEYSQN

SEQ ID NO: 142424 - protein, 95 aa, Heterodera glycines
  Coding regions on vcDNA: vcDNA=SeqID_68847; Strand=-; Position=1-289
LIHLNDPCPSIAFHLSFNGAVSGYDGGPFSVGGGTSAAADGGRPWRQHQKPTPPLMVAQQNAVVQQQGNADHWQMPTTNGPEMEWKGGEAAANSD

SEQ ID NO: 142425 - protein, 199 aa, Heterodera glycines
  Coding regions on vcDNA: vcDNA=SeqID_68848; Strand=-; Position=1-597
MVLIIILIFFATFNGIFGVGEGGEENDLFSDLWKNCFNAKNVQKANVGRNGGQKVTNRVKMEERDGGVEMGAVGIRMPPKLAQMLIKTEPTAAAAVFDQLLKNVKHEPKEEEFEQLDIGKMGVVGIRMPPKLAHSVIKDEPPFDQQREHQQKQANKEPNHLDYGIERMEATENSLESNGKISQKSAKKGAKKKSQWQKE

SEQ ID NO: 142426 - protein, 25 aa, Heterodera glycines
  Coding regions on vcDNA: vcDNA=SeqID_68849; Strand=+; Position=1 -3,134-208
MKLGQNFIFLSNKLCFCQINSECLN

SEQ ID NO: 142427 - protein, 185 aa, Heterodera glycines
  Coding regions on vcDNA: vcDNA=SeqID_68850; Strand=+; Position=1 -177,1009-1098,1741-1877,2417-2570
  Homolog annotation: Hit_ID=AAS78778.1; Match level="QueryCoverage =62%, HitCoverage=77%, E-value=1e-36, Identity=64%"; Hit description =thioredoxin [Ascaris suum]
MSMCEKEKEKKRDTVVRKGREKRMGDRRNEGKVREQWRKILGGQSKTKRGRTEIKRAREGCEVVALYFSAHWCPPCRNFTPVLKKFYDELKKSPETAHFEIVFVSFDRSADDLSNYLRESHGDWLYIPLGSEHIETLSKKFGISGIPALVVLKQDGTLVTKDGRADVQVEDNLLFFDDFSNKIGQ

SEQ ID NO: 142428 - protein, 18 aa, Heterodera glycines
  Coding regions on vcDNA: vcDNA=SeqID_68851; Strand=+; Position=1-57
YREATPEGFVSPHKSGRI

SEQ ID NO: 142429 - protein, 158 aa, Heterodera glycines
  Coding regions on vcDNA: vcDNA=SeqID_68852; Strand=-; Position=1-4,59- 285,335-580
MDIDDDVILVNSQSSHAEERPVLKKRGRKSRWEKLLEDVNNAKKSNPAEVEVTDVDERKAANVFDYPTIFWKLARPKYGVFTFMCNECRNENFKRGDKRFILNTGSGQEKLEFTQTFCQDCAKLNFDCTDLIMKHQKKDDGPSAQKNVGRNTYFKMEK

SEQ ID NO: 142430 - protein, 18 aa, Heterodera glycines
  Coding regions on vcDNA: vcDNA=SeqID_68853; Strand=+; Position=1-56
YREAIPEGFGLPINLGAS

SEQ ID NO: 142431 - protein, 173 aa, Heterodera glycines
  Coding regions on vcDNA: vcDNA=SeqID_68854; Strand=+; Position=1 -184,236-377,426-528,577-669
  Homolog annotation: Hit_ID=NP_507780.1; Match level="QueryCoverage =84%, HitCoverage=10%, E-value=2e-10, Identity=30%"; Hit description =predicted CDS, DNA polymerase type B, organellar and viral family member (5T899) [Caenorhabditis elegans]
MEPGAKKRRKRKNAENTDGEAMECEEEEDAVDEDAENNWMLGYEEAGEKPESVTTYAYAHAGSRYDHVLIYGEMLRMGVRPELIRQGNHLLEMKARKTGVYTTTVFRDSYKLIPIKLANFVKTFGLEIEGVENKKYFPHKFNKAENYGTVLDTLPPIENYYLRWTLPGRARKV

SEQ ID NO: 142432 - protein, 660 aa, Heterodera glycines
  Coding regions on vcDNA: vcDNA=SeqID_68855; Strand=-; Position=1 -49,122-223,327-424,540-642,855-989,1035-1144,1441-1579,1757 -2295,2349-2667,2727-2872,3648-3890
  Homolog annotation: Hit_ID=CAF90422.1; Match level="QueryCoverage =35%, HitCoverage=52%, E-value=1e-17, Identity=26%"; Hit description =unnamed protein product [Tetraodon nigroviridis]
MSFSPNSTIAEFTSDQAPYQNESLTPTEELQQMRITEMERIQKMSLHGGYDSGHKMGMAKPDTLADRMKLLLSTAKGVDAHFLLVHAHKAILIASSNVFEAMFQTDKENSNGTNAGKISANCSVVEEVPDVEPAAFKVMLSFIYTDDLSELNGDNAMAVLNAAKKYNIPGLIRPSLQIPISELRNVFLAYDQALIFELEALRWADEKCRQNGIECSSGNRRSVLGPALFKIRFPNIHEEDFAKCVVPSGVLTVEEVLGVYQFNSHPFLYLRGVPGLYSSKFPSHGRIFNWNKAKGNRRGTLSMEIEKMSEFARESVGRSRFSDAVYINGFPWKIEAEIRKKTEDTDEKKYLGFYLLCDAKEGPILINIKNIIIIKIGGPWNCVISATYRIVSEKTEAENSIWTLCDRVINRSNIGRGFGFLITFAELMDSNKCFYNKAEDKLALAIDVITVDEPKMEKFISDPNKSNGTLSMEIEKVSEFAREIIGSQRKSETVHIKGMPWKIVAQIEKKDESTDNEKWLGICLLCDAPKEAENWSCKCSANFRIVSLKSGVKDFRRKLDDDVFDNKTYSWGYANYISFAELMDQSNGFYNREEDKVTLAIDVTVKDDKKEKCISDPDKSNGIISMEIEKVSEFAREIDRSERKSESVTYINGLPWKILA

SEQ ID NO: 142433 - protein, 104 aa, Heterodera glycines
  Coding regions on vcDNA: vcDNA=SeqID_68856; Strand=-; Position=1 -69,168-261,356-507
  Homolog annotation: Hit_ID=CAE62132.1; Match level="QueryCoverage =89%, HitCoverage=15%, E-value=4e-09, Identity=32%"; Hit description =Hypothetical protein CBG06176 [Caenorhabditis briggsae]
MPSSMDRMKHLLSTGEHSDVHFLVLPAHQLILKSASDVFEAMFRFDAKKERPENAPANCPADVEVPDIEPSAFKLMLSFIYTNDLSELNGDNAMAVLYAGGFII

SEQ ID NO: 142434 - protein, 159 aa, Heterodera glycines
  Coding regions on vcDNA: vcDNA=SeqID_68857; Strand=-; Position=1 -165,436-750
TFGCICGRILTKDKEICGKIEQIALESKGKAAKIEQLIVENRITLEKKTAKEKQKEFFVLWENGPEDVTLLKALKICAEESFDEMHKMDRIKNYESKKKALRNFAESIGVTFIICMSKNLKRKTKKDKFLSRMHFEKISQLIDNQSKGDEFKELFSKNG

SEQ ID NO: 142435 - protein, 180 aa, Heterodera glycines
  Coding regions on vcDNA: vcDNA=SeqID_68858; Strand=-; Position=1 -66,173-307,360-600,650-749
  Homolog annotation: Hit_ID=NP_505118.1; Match level="QueryCoverage =77%, HitCoverage=21%, E-value=4e-16, Identity=35%"; Hit description =component oligomeric golgi complex 6 (73.6 kD) (5I700) [Caenorhabditis elegans] gb|AAA96179.1| Hypothetic
MTLEGERGGLDALLTARLDEDEQFIATINYLNDNLRLDAETTEQKLRMVLEDRELELNQQYLEQLEKMNDRVQGFVQQIRSMNSICCELTERIQTNKEKTRELLKRTAVLQTEKRELGAKNAFLDEFFAKYSLNEEEETALALPNQQGSPSDAFFSALRRLLEVEKNVTEQLALEPNSLA

SEQ ID NO: 142436 - protein, 256 aa, Heterodera glycines
  Coding regions on vcDNA: vcDNA=SeqID_68859; Strand=+; Position=1 -119,224-299,376-684,838-1024,1102-1181
  Homolog annotation: Hit_ID=NP_501856.1; Match level="QueryCoverage =49%, HitCoverage=76%, E-value=2e-31, Identity=47%"; Hit description =transthyretin-like family member (4K923) [Caenorhabditis elegans] pir||T24917 hypothetical protein T14G10
VRGALQCHRDPSKHQNVEVRVIDRDGWGPLKVLDPDDMMGVSFTEQDGTFQLDGCGNDMNFLPGVPNLPDPFVRILHFCNSEEGETIELPEFRIFVVILKLFVLKLAFPLQPDTYDLGILVLDQKTLPNSTVNFPVPENPRRRLQQAKRPTEVGTLDESNGKKGAEDGFVTVDAPKSHNAKGLDDLLPPGKTVTKTNGDLLWETQSVEMEEVPAEYDTSIRQSQQHNWEEESKGDGNERKNWTKKKQPTKEEKKRK

SEQ ID NO: 142437 - protein, 90 aa, Heterodera glycines
  Coding regions on vcDNA: vcDNA=SeqID_68860; Strand=+; Position=1-305
GGRCAIDLLFLREFLNLYSIPEKWLSLFLRNFIHIQKLLSMRGRAVRNRHFIFERIFIFRLYPRKMAISFFDKFYTHTNALEHDREGGAQ

SEQ ID NO: 142438 - protein, 121 aa, Heterodera glycines
  Coding regions on vcDNA: vcDNA=SeqID_68861; Strand=+; Position=1-368
FGDAQLLINYSDALFHDGTTLIHVIGTLSAQLSVWIRWMDSELMEKQNSMRIVDRKIYEKIWANARLEFEVKKGVLLELFAKNKNTKLNCTNIENFANIMILIIRAAKNICKNGQTMYINM

SEQ ID NO: 142439 - protein, 49 aa, Heterodera glycines
  Coding regions on vcDNA: vcDNA=SeqID_68862; Strand=-; Position=1 -85,200-264
MNVCVNLVEFCGHDNNNTTSADLQLIGQFISTNCMRISGEFNIDGHLLV

SEQ ID NO: 142440 - protein, 1004 aa, Heterodera glycines
  Coding regions on vcDNA: vcDNA=SeqID_68863; Strand=-; Position=1-3012
  Homolog annotation: Hit_ID=NP_498959.1; Match level="QueryCoverage =79%, HitCoverage=36%, E-value=1e-110, Identity=32%"; Hit description= zn-finger, CCHC type and RNA-directed DNA polymerase  and Integrase, catalytic domain containing protein
MDPESVEKTAFVTEFGLHEFNVLPFGLCNAVATFQRFMTRLFEGMINDSVFVYIDDVLIASESWSEHLKHLREVFKRIDEAGLKLKISKCRFAVKEIPFLGHILTREGVKMDMDKVKPVIELPTPTSKKELHSLLGFLTYYRKYIFGFGSLAAPLFRLLKKDVKFEIKEVELGAIKALKKSILDHAMLYFPDFKAAVDDQKRQFVMLTDASKIGLAAILCQPDENGNLRPIYFASRQCNRHEARYCPTELEALAIRFGTKKYAQFITMIPTRVITDHRALVSMFKSKNETGNSRVDKWLMAMNSRFILQVEYQPGKKNILADLLSRSKTLLNATENVESENSKAEIPISKEIFRIGQIRENQVAEQAEDLSDEQRKDWVEKTKESELAFVYEFLEKRVLPHDVRDRQKLLSSLHNFSLINGLLFRNENDGKLQLFVPKEFREMMIRERHSGICAGHLSGKKIFRQLSELYFWPNMYGECIRAALRCRVCAHARKPRSNEPPLNIVETKEPLELVCIDILSIGPAASSNRYILVAVDHFSKYLVACAIPNKNAETIAKNVVKNFICILGTPKKLHSDKGKEFVNETLEEISKTLKIKRTTTSGYDPQANGVTERVNQTILGMLRKSTYSAWEWDERLPFVVFAYNSTPSEVTGISPHHLMFGKPANFPLEHELKFAVNPLYTIDQNTYIQLFRESLMQLVDEARKNSQISRAKMKEHFDAQAKVTENKFQIGDRVMVIFPGSHIRSPHKKILWNHFGPFRITELNKSTATVIPSDNPYGNPMTVPLERLVRVPKELQNICTMPKGKNPYKNVLNGLISVAGLICQENIKLYGEEKLNSKPDGIIGQLRSIAFLGGEEEHMETEQTDDKEAETNESENEENVEEKMDGKEVDANGSEKEANLEEEDQISVVQEEEEPKTLSWTLACAGDEHKCCSDVVVADLDAVLDRSGIGLTKIENPLKALLTMFLLKSEAVASASAAKKLISQILDTDADWELATYCSAREDD

SEQ ID NO: 142441 - protein, 344 aa, Heterodera glycines
  Coding regions on vcDNA: vcDNA=SeqID_68864; Strand=-; Position=1-1055
  Homolog annotation: Hit_ID=AAD20658.1; Match level="QueryCoverage =99%, HitCoverage=22%, E-value=5e-67, Identity=37%"; Hit description =putative retroelement pol polyprotein [Arabidopsis thaliana] pir||G84493 probable retroelement pol polypro
SPCVDYRGLNSVTVKDAFPLPNIDSTLLALGGKKFFSVIDFMSGYWQIRMDPESVEKTAFVTEFGLHEFNVLPFGLCNAVATFQRFMTRLFEGMINDSVFVYIDDVLIASESWSEHLKHLREVFKRIDEAGLKLKISKCRFAVKEIPFLGHILTREGVKMDMDKVKPVIELPTPTSKKELHSLLGFLTYYRKYIFGFGSLAAPKEHWTTQCFISRISKQQLTTKRQFVMLTDASKIGLAAILCQPDETIYFASRQCNRHEARYCPTELEALAIRFGTKKYAQFITMIPTRVITDHRALVSMFKSKNETGNSRVDKWMAMNSPFILQSEYQPGKKNILADLLSRA

SEQ ID NO: 142442 - protein, 108 aa, Heterodera glycines
  Coding regions on vcDNA: vcDNA=SeqID_68865; Strand=-; Position=1 -219,288-392,491-493
MIEPGKSVNLLCKLKCSSCLNFKYEEEKDGQNGKYGQNVTDGQNETDKSKQPNKLLLTKTSYIKKEETENEIKIDFELKSAIFNGNAAEIVRKEDITKGNEFTAKYLD

SEQ ID NO: 142443 - protein, 94 aa, Heterodera glycines
  Coding regions on vcDNA: vcDNA=SeqID_68866; Strand=+; Position=1-356
PKYSYLFFLIFLPQTWYQQLPSLVWPYQTILRYLKRKQKKFLTKKWLSLFSHFFTANLVPTVAFSCLALSNNLTIFETQTKKILDQKIAISFFS

SEQ ID NO: 142444 - protein, 196 aa, Heterodera glycines
  Coding regions on vcDNA: vcDNA=SeqID_68867; Strand=-; Position=1 -123,188-387,438-621,689-772
  Homolog annotation: Hit_ID=CAE59110.1; Match level="QueryCoverage =94%, HitCoverage=12%, E-value=1e-44, Identity=45%"; Hit description =Hypothetical protein CBG02405 [Caenorhabditis briggsae]
MHPQDHYPESEDCSKAEQIGQHYIESAASPMLFSCKYGPLKPNRNYSATVWAENKAGSSIAVSIGSQCVMDYAEPEHIEPPSVASRPNISSFGLRFEHEPNQENGPIVCYYLAILPLPLNVSIEMLPMPANVTMDNYDKALKNNQNQHAITNKQFFAYIAESYLQYPRQTVVGDRETSAGTDACTVPYMTRHTPSD

SEQ ID NO: 142445 - protein, 66 aa, Heterodera glycines
  Coding regions on vcDNA: vcDNA=SeqID_68868; Strand=-; Position=1 -72,334-462
MSFGLGRAESVTRLSAFEPRPNPSMDNHWFDKFYYFSPIFKGTQPYKCHVARRALPPGGTVISLPL

SEQ ID NO: 142446 - protein, 82 aa, Heterodera glycines
  Coding regions on vcDNA: vcDNA=SeqID_68869; Strand=+; Position=1-249
MTLLSKESSGEGEEKGMEEQRKRKADQRHKSGEKQKQKTKSMEKAKAWRKSSCQMGGGEADQTDQSIKRKQKAFINSLIILQ

SEQ ID NO: 142447 - protein, 77 aa, Heterodera glycines
  Coding regions on vcDNA: vcDNA=SeqID_68870; Strand=+; Position=1 -15,136-354
MSPVFFRATVSQLSVRVVAITTNSIKVQWYPITAGQIDNKKIVKYKLHYKCTSPDHQWSETDAYEVKFEERLYFDFV

SEQ ID NO: 142448 - protein, 706 aa, Heterodera glycines
  Coding regions on vcDNA: vcDNA=SeqID_68871; Strand=-; Position=1 -295,358-1062,1204-1547,1604-1820,2149-2706
  Homolog annotation: Hit_ID=AAG00551.1; Match level="QueryCoverage =30%, HitCoverage=94%, E-value=6e-26, Identity=36%"; Hit description =retinitis pigmentosa GTPase regulator [Homo sapiens]
MQPDLENLFFKIELQMDLIAWSESATDKAAKKAHKREIMSLRSDKDKLFPEEAQVIVIEKGEENRSNLLATEISLLTMHDEIMEGLIENEQHFLDKVKTIFINEQRLQKMIPRMTLAYQILMENAKGSKQQRNENENNGKEDDEEKGKGRGEIVEEKGEERGGANGEVEGGGEKVGENSEGRKVTKEDEKTRKREEKGDEKEERDKKEKGEERGGAVEEKGEEGKSGEINEEGNEKGREKEPAGEKRKAEEKEEERGGAVEEKGGREEKGRGEQNGVENSEGREEKGEKRGGADGEKGEEEKSEEINEVGDKKGREKGSESGRAENERCVDSDADSDLISCYQHLMLADRPISSRDKKLLEVNTVYYQLKSLINQLLSIIKQIKKGVAIEIEIMAQKTLLLGKPENFDEKIVKICYLKSFWAYVISNRNLYNESESWRTYFTYNFAGKLNAPFPTEGEQKWDNSICEEMKNVLEIFQGFLKSPTFEGTQEFVLNNLLEKNKKFVDFINYNFGKMPIFKKYARFDDVHEMDLFYLALFSSTDSDTTFQAEIFLGIKLMESIIYQTEKVVINPANFTEIIRTRAKLRAMVAVQLHFWHAEKFRIICYQIAYVTYLVNKRNFPSTDWQSPTECFLNTREETLSSMRTVLQSSHWDFVVNRVTGTVRNGISDTVRHKRGAIALLEKLIGGTAMVKLWENKEARAKLMEAN

SEQ ID NO: 142449 - protein, 218 aa, Heterodera glycines
  Coding regions on vcDNA: vcDNA=SeqID_68872; Strand=-; Position=1 -526,630-760
MAIFVMSNSFGKMKLKGRKGHETMKKIYPEIRKIWSEKFCEICAQIKTNVQENSFEKIYKFWHKLADLYNKIPILEKHEKILIIYDEFALQRTDELLWRAKDQLMVEHSEIVTQLTVCQSAECQNALSRFLAHSIGQMKGAKHRLRTFFTSPLKGTAILDNLLQGNASFAQVFRSDLTTDEISQLQVKYYLNYMDSDSETDVHTRALFMANFLAFYHW

SEQ ID NO: 142450 - protein, 135 aa, Heterodera glycines
  Coding regions on vcDNA: vcDNA=SeqID_68873; Strand=+; Position=1-1244
MQTRYASSVRFHLIGFTSSLTLSSKCFATFPHGTCSLSDSWPYLVLDEVYHLIWAAIPNNPTPRHVKMGRHRQLDRSCTFSGAPVKGNLNKRANPSSRSIRYTSQPQRSCDSALDSSQFTRPYYGISLVSFPPLM

SEQ ID NO: 142451 - protein, 41 aa, Heterodera glycines; identical to SEQ ID NO: 140664
  Coding regions on vcDNA: vcDNA=SeqID_68874; Strand=+; Position=1-123

SEQ ID NO: 142452 - protein, 68 aa, Heterodera glycines
  Coding regions on vcDNA: vcDNA=SeqID_68875; Strand=+; Position=1-205
MKMPGRPNIPHKNPYHYKVQQQNRNQVQYKQQKTIEETIQEQEKGRSSVLGKKLRHGGRGNPVHALNY

SEQ ID NO: 142453 - protein, 237 aa, Heterodera glycines
  Coding regions on vcDNA: vcDNA=SeqID_68876; Strand=+; Position=1 -459,508-762
MDSFGTVAWILRPTAQTTGTAVGSMEYEEEENGTGKLVHSDTATVTTPTTAEFRLEKEAPSSEKDGAEEGSGGHGTLLFIESDDGEEEEEDIEDTPVATDSPSATTATVVDDSSNTVKGVEQRSSEHSDMTNGTGGGGGSEGAKLLGGGEEEEPVRMPLLNYLCAFNDCSMKELQLLFHSVHARQRMVAHLQQHCRLHTAHLKPAERNIALHCHDLSVQNANRTFACGGYLELTVSR

SEQ ID NO: 142454 - protein, 107 aa, Heterodera glycines
  Coding regions on vcDNA: vcDNA=SeqID_68877; Strand=-; Position=1-324
MPDAEQRVPVPCTRFVRTKRAEVFTRRGTKLYQPVYTKGLVVALDEREAGGGAGNAYFTRPFGWYDDDDDADRDNAEEEEAEDGELLDESDTDDDDDDDEIDFLVLG

SEQ ID NO: 142455 - protein, 95 aa, Heterodera glycines; identical to SEQ ID NO: 124528
  Coding regions on vcDNA: vcDNA=SeqID_68878; Strand=+; Position=1-827

SEQ ID NO: 142456 - protein, 74 aa, Heterodera glycines
  Coding regions on vcDNA: vcDNA=SeqID_68879; Strand=-; Position=1 -148,191-267
MNFGTKNGMTFNSFLTQFKLLIRRNLSYFLSTKCQTIEKKRRRKKWQKQSSSPPTGGCVCSICFRLSHLGLELR

SEQ ID NO: 142457 - protein, 77 aa, Heterodera glycines
  Coding regions on vcDNA: vcDNA=SeqID_68880; Strand=+; Position=1 -159,541-615
MQPFYPLICSKKQQQQSLQVHCLRGKRRVQPKRRNFERTKAPFWEAWHLKAAETDWHMKISNLKLRISEIGCRSKCN

SEQ ID NO: 142458 - protein, 26 aa, Heterodera glycines
  Coding regions on vcDNA: vcDNA=SeqID_68881; Strand=-; Position=1 -65,297-312
MGWAVLLHFINGVGVVQAQPAILIAV

SEQ ID NO: 142459 - protein, 35 aa, Heterodera glycines
  Coding regions on vcDNA: vcDNA=SeqID_68882; Strand=+; Position=1-107
MILFLFTFLTHLCFITINANNVKITNVLGDGNCLF

SEQ ID NO: 142460 - protein, 297 aa, Heterodera glycines
  Coding regions on vcDNA: vcDNA=SeqID_68883; Strand=+; Position=1 -390,881-950,993-1072,1114-1343,1391-1511
  Homolog annotation: Hit_ID=CAE63785.1; Match level="QueryCoverage =56%, HitCoverage=30%, E-value=3e-43, Identity=50%"; Hit description =Hypothetical protein CBG08326 [Caenorhabditis briggsae]
MVDAHFAGCAHIKSEYVVLRSETQRQEGGNKPPNESNPLEGNSHEGILPRNVRARGMDRQREQKMAKARAENRQKIVRICPSVLFESEGRKCKYGEKCDAEHSLTKYWAKKPPDIGEFWHPTPNTIFLWKGLPSELSLMKRHPSEKIFGVQLAGGYPDSLGKAVQLITDNFNVDFIDLNLGCPLDSVNEKGAGCSLANKSNKLVSVLQCMQKSATGVPVSVKMRYGVKEGERTAHYTMGTIAERSPPQLLTLHPRSREQRYTKAAEWDYVLECEQRINGRFPFFVCGDVMDYEEYYQ

SEQ ID NO: 142461 - protein, 131 aa, Heterodera glycines
  Coding regions on vcDNA: vcDNA=SeqID_68884; Strand=-; Position=1 -331,380-444
MCQSERNAMNSDEMKRQIQKLTTNGPLILSDMKAAEKELQKSKEQNENEQFRHNFADLATKLCSKTLPGGHFKNAVIEFLQRKKGQMLWPSDLAQFLLTKMNVVRANNANENLEIIIKYIHKVARPTVQMA

SEQ ID NO: 142462 - protein, 554 aa, Heterodera glycines
  Coding regions on vcDNA: vcDNA=SeqID_68885; Strand=+; Position=1-1665
  Homolog annotation: Hit_ID=XP_318550.1; Match level="QueryCoverage =86%, HitCoverage=48%, E-value=3e-95, Identity=38%"; Hit description =ENSANGP00000020240 [Anopheles gambiae]
MLYGRKFTLLTDHKPLLAIFGSKKGIPIYSASRLQRWALILSNYEFDIKYVNTKAFGNADVLSRLIANYPRPSEDILIANICNDTDCCVNFVFEAKIEQLPITAKIIAEETAKDEILQQISAFTKQGWPQKLNDIKLSPFLPKKGQISEIEGCLAYGERIIIPSSLRNNILKSLHFAHPGIVRMKAIARNHVYWPGIDSEIERVVKQCEECHSAAKNPTKATLQPWKAANGVFERIHIDFAGPCADGQTYLVLVDAYSKWPEVWQMERTSSQLTISMLKSFVHRLGIPKEIVSDNGSQFRSAEFAQFCKEFDIKHTFTPPFHPMSNGAAERFVDIFKRSMKKCRQEGKDWLQKVLLAYRTTPNTALNGHSPDELFLGRRMRTRIALVHPEKQKLQPPNLENFQQFQGQYIKKMENQFNIKHGAKSAIFQNEEPIYFWNLKYNKATWLPGKIIEKLGTSPTYRILAPTLGRAIHRHANQIRRRFPIELEDNDQVVENDQTQAQNPQQSPIAHKPQTNRQQSPAQPVLLRRSGRVKQAPQRLVLDPTKPKYGLIRS

SEQ ID NO: 142463 - protein, 151 aa, Heterodera glycines
  Coding regions on vcDNA: vcDNA=SeqID_68886; Strand=-; Position=1 -91,150-313,413-610
MLVSAPLIQQQQQQQVFQQQRPSTSASSADAVLLPHATEASAPTPYQQQQTEDQLELPTSVPSAADSQRQHRATQQPQRFFKSGSKSKKMFYGVFEVADHETGLRPALPFICPVNCTSTNTCASGAPYEQHDHKIFDNFNALYKHQNYTLL

SEQ ID NO: 142464 - protein, 56 aa, Heterodera glycines
  Coding regions on vcDNA: vcDNA=SeqID_68887; Strand=-; Position=1 -48,325-447
MPRLLKLLVNFLTTVNDILNKLKFADIIGIFDASYSLLASWLTGQSPDQTVPLVIG

SEQ ID NO: 142465 - protein, 256 aa, Heterodera glycines
  Coding regions on vcDNA: vcDNA=SeqID_68888; Strand=+; Position=1 -289,331-811
  Homolog annotation: Hit_ID=NP_740973.1; Match level="QueryCoverage =83%, HitCoverage=37%, E-value=5e-09, Identity=25%"; Hit description =M protein repeat containing protein (72.5 kD) (2C572) [Caenorhabditis elegans] gb|AAM97999.1| Hypothetica
MEDFYIVLPSNTPGPGNTASNFTVRLPHTLELDSKWSVALSAIIYPYSFPSISVDEDDSISVKLVNPNYREDAGNSDEESQKFINLSVKIPNVQFQKCLRYKIGGSSLNDGTPNKRAKRQTELSESGAGVIEVENFFTRNPFDYWQQIGELRKKHYQLRERVEKMTKEYNSTADGERKTFLSTELGVFQGRETFLKKHLHLIEEEAKRRDGEQQESNEQRLIDRFFARYPANYREQLDEWRSSYLRDVLDLQTKMG

SEQ ID NO: 142466 - protein, 34 aa, Heterodera glycines
  Coding regions on vcDNA: vcDNA=SeqID_68889; Strand=+; Position=1-103
MALWPTCLDFISIVQLNRDELLHQLEKALLIFIF

SEQ ID NO: 142467 - protein, 95 aa, Heterodera glycines; identical to SEQ ID NO: 124528
  Coding regions on vcDNA: vcDNA=SeqID_68890; Strand=-; Position=1 -787,954-1199

SEQ ID NO: 142468 - protein, 133 aa, Heterodera glycines
  Coding regions on vcDNA: vcDNA=SeqID_68891; Strand=+; Position=1 -63,182-319,484-684
MVESVSSETNIVEMEAKSDAKTPGLPDWAHGFFSALDKNLLIQTANVANFLSATQFVEHLANFIALKSHSRDFDSLIPPIVILFLAFFERKYNFAFHHAQCREMDSSAEIMEFLNVGTDDLEGEELRKELYNH

SEQ ID NO: 142469 - protein, 35 aa, Heterodera glycines
  Coding regions on vcDNA: vcDNA=SeqID_68892; Strand=+; Position=1-124
DICGQRNAKLSFLFQINYTKYFYLTHSPIILFNDL

SEQ ID NO: 142470 - protein, 69 aa, Heterodera glycines
  Coding regions on vcDNA: vcDNA=SeqID_68893; Strand=+; Position=1-208
MNRKKIENLQKCRKRKFLDNNDSENETLSADHREQNENNNDRDDDFEEHAIVNFELGETKRGGVCIWFN

SEQ ID NO: 142471 - protein, 118 aa, Heterodera glycines
  Coding regions on vcDNA: vcDNA=SeqID_68894; Strand=+; Position=1-357
  Homolog annotation: Hit_ID=NP_823727.1; Match level="QueryCoverage =79%, HitCoverage=9%, E-value=7e-11, Identity=41%"; Hit description =putative translation initiation factor IF-2 [Streptomyces avermitilis MA-4680] dbj|BAC70262.1| putative tr
MDDDYDNYVPQISTMDYSLLQPGGSGGGGATGGGGTAGMGGSGGQPQQQHFLYDAGGGGCGTVMPPGAVTASGGRAGLPPGSGGGHPQFGGHFGAAEFGGAMPGQVNMPNCKAKDGLY

SEQ ID NO: 142472 - protein, 143 aa, Heterodera glycines
  Coding regions on vcDNA: vcDNA=SeqID_68895; Strand=+; Position=1-432
MAPPPHMQQMMAHRQQQQQQLMGGGQPQFDPRYGGGSAAVVPKMSAAAAQMMSQHQQSTAASGTKAGKSGGSKKGGKKASAAAAAAAAAAAAEAAGGGAVTVMDHGGNQAPCAAVGKGKAVICRLPSASFCLMRHFVHQAKSS

SEQ ID NO: 142473 - protein, 150 aa, Heterodera glycines
  Coding regions on vcDNA: vcDNA=SeqID_68896; Strand=+; Position=1 -94,248-456,538-687
MLIVSLFFVFCQILLLLTVKGDGNYSRQSDYGAEKTVDEFLSKFEALSARTDSDDVGVLMAQLSQNISSFFELALPVGSLIAGALQISDKVIHNYHSTEYTPESEQYKAMEKLHDKFDAKLKELDTKIVRSWQKIDVSTRIFNSYEDVIS

SEQ ID NO: 142474 - protein, 165 aa, Heterodera glycines
  Coding regions on vcDNA: vcDNA=SeqID_68897; Strand=+; Position=1 -41,210-340,472-797
  Homolog annotation: Hit_ID=NP_058747.1; Match level="QueryCoverage =86%, HitCoverage=64%, E-value=5e-54, Identity=69%"; Hit description =superoxide dismutase 2 [Rattus norvegicus] gb|AAH70913.1| Superoxide dismutase 2 [Rattus norvegicus] emb|
MISKCNGVCRLSIGYDYNALEPAISAQIMQLHHQKHHATYVNVLNTAEEKTQEALSKGDFRTAIQLQPMLKFNGGGHINHSIFWTVLAKDGGEPSGDLLKTIERDFGSVQKMQEKVSTKAVGVQGSGWSWLGYNKELKRLQVAACMSQDPLEETTGEHSHTNILG

SEQ ID NO: 142475 - protein, 69 aa, Heterodera glycines
  Coding regions on vcDNA: vcDNA=SeqID_68898; Strand=+; Position=1-207
MVTQFLRTIPQFPPALDKNGTVLLGTVGIDRMPSPSPHAANAPATNPLKWVPAAERAAREGELRRSKRK

SEQ ID NO: 142476 - protein, 132 aa, Heterodera glycines
  Coding regions on vcDNA: vcDNA=SeqID_68899; Strand=+; Position=1-398
MFVKERFVPLSKFVQQSPVISRQFLGEFCTNQHGSAIAKLNGFDKIIAFLWHGFLEEPTDEFLFLGLKYEKDQPTDLLGKARLVEKLDEGRTRDNSEGGGHEKAQRAEGPRNAEEQRLILSILWHLKHQKGQ

SEQ ID NO: 142477 - protein, 143 aa, Heterodera glycines
  Coding regions on vcDNA: vcDNA=SeqID_68900; Strand=+; Position=1 -68,873-1236
  Homolog annotation: Hit_ID=EAL42187.1; Match level="QueryCoverage =85%, HitCoverage=23%, E-value=1e-09, Identity=33%"; Hit description =ENSANGP00000020626 [Anopheles gambiae str. PEST]
MKCRDRTGPGPVPVFTGPGNRNRKTALPIVYQRVRHKIKDELKESAFITLTTDCWSGSTCNLLWYIITLFINHHGFYCSLTAHSISKWKSMSRVLAITEFSESHTGKNIALKIEDLLLKWGIPKERVHAIISDSAANMKRVII

SEQ ID NO: 142478 - protein, 33 aa, Heterodera glycines
  Coding regions on vcDNA: vcDNA=SeqID_68901; Strand=+; Position=1-101
MAEVKKEPIFTEVKKEPIFAAETPAAEPRRDSA

SEQ ID NO: 142479 - protein, 54 aa, Heterodera glycines
  Coding regions on vcDNA: vcDNA=SeqID_68902; Strand=+; Position=1 -64,106-189,241-369
KKKGNETSGQLSASPVNNLFEGVELPPFTDNQMNVWFKYLSCINSRIREITEDA

SEQ ID NO: 142480 - protein, 118 aa, Heterodera glycines
  Coding regions on vcDNA: vcDNA=SeqID_68903; Strand=+; Position=1 -127,815-1041
  Homolog annotation: Hit_ID=CAE64960.1; Match level="QueryCoverage =98%, HitCoverage=46%, E-value=6e-35, Identity=46%"; Hit description =Hypothetical protein CBG09794 [Caenorhabditis briggsae]
MPNTVSVQSPATICGDIHGQFYDLMKLFQIGGDILETNYVFLVSHQYGFYDECQQKYGNSVVWSWCCRVFDVLPIAAVVDNQIFCVHGGLSPELPTLDSIMCLQRNVEVPANGPLCDL

SEQ ID NO: 142481 - protein, 38 aa, Heterodera glycines; identical to SEQ ID NO: 130624
  Coding regions on vcDNA: vcDNA=SeqID_68904; Strand=-; Position=1-346

SEQ ID NO: 142482 - protein, 121 aa, Heterodera glycines
  Coding regions on vcDNA: vcDNA=SeqID_68905; Strand=-; Position=1-364
MSEFESECSGTAKLNQLGPVEINADTLYTTLVVHAVEHHDGGDQEMPSKNKNNANTDGTTIDGGGQRRQIVDEEEELKEEPMDVRRGQTQTMEADEEGGQCCNEAEKSGGTASSLDKTSDG

SEQ ID NO: 142483 - protein, 147 aa, Heterodera glycines
  Coding regions on vcDNA: vcDNA=SeqID_68906; Strand=+; Position=1-442
  Homolog annotation: Hit_ID=EAL47145.1; Match level="QueryCoverage =97%, HitCoverage=68%, E-value=1e-16, Identity=34%"; Hit description =transcription initiation factor TFIID, putative [Entamoeba histolytica HM-1:IMSS]
MQRPIIVNIIALANLGTGIKLNSLTITECEFKYNPRKFNAAVIKCISPIKATALLWESGKMICLGTKSLIDCENAIKKFIEIIKCSGCPGASYTGHTIENIVSTFKFGHEIELNEFRKNRRAFYEPEIFCGLNFKRGKSMTALIFWT

SEQ ID NO: 142484 - protein, 239 aa, Heterodera glycines
  misc_feature (84)..(84): Xaa can be any naturally occurring amino acid
  Coding regions on vcDNA: vcDNA=SeqID_68907; Strand=-; Position=1 -141,185-496,522-651
  Homolog annotation: Hit_ID=CAE68699.1; Match level="QueryCoverage =98%, HitCoverage=50%, E-value=4e-38, Identity=39%"; Hit description =Hypothetical protein CBG14618 [Caenorhabditis briggsae]
DHFHLLAIGCCSVALFSVLALAIGVPILYSQIDSERSNILAKSQKFKADSNRVWAVLHFPTFTEADSNRVWAVLHFPTFTEAKXALFLSRTWRPKCLRLRSCSMLSCPQGPPGPPGLPGPDSPPGQAGSPGESGVDGLDIVVESELDLPCTVCPGGPPGQRFVHGIRGHQGERGMSGIAGLRGEEGIEGGQRFVHGIRGHQGERGMSGIAGLRGEEGIEGREGSPGPRGSVGPRGNLPK

SEQ ID NO: 142485 - protein, 148 aa, Heterodera glycines
  Coding regions on vcDNA: vcDNA=SeqID_68908; Strand=+; Position=1-444
MTTKEGITLWCTRVDKTQFIPFDVVYDLPGHCFFRVKNKARVFNVPYSDLSSDTISTTTTTTKTTTSTQGTQTEEQELKRKAKVALDLVEAGLLADAMQDGARWKKAKTAINVLGNLLLAESLSNNNNNNKADKKDEPPVNGPSTQPI

SEQ ID NO: 142486 - protein, 127 aa, Heterodera glycines
  Coding regions on vcDNA: vcDNA=SeqID_68909; Strand=+; Position=1-384
MGQVKKPQQHVKIGQLIKDNSNWLCALARTKSQKKCKKLILKANTEQLLALVEICLNLVASRFQLTTRQTKRLMPYVHTVRRMSRARSERGARRAIVQKGAGFGGLFAALLTPVLIELAKSVVSKNA

SEQ ID NO: 142487 - protein, 341 aa, Heterodera glycines
  misc_feature (130)..(130): Xaa can be any naturally occurring amino acid
  Coding regions on vcDNA: vcDNA=SeqID_68910; Strand=+; Position=1 -177,514-917,2622-3070
  Homolog annotation: Hit_ID=CAD22154.1; Match level="QueryCoverage =93%, HitCoverage=52%, E-value=3e-49, Identity=35%"; Hit description =pherophorin-dz1 protein [Volvox carteri f. nagariensis]
PPRPPAPPPPPPPRGPRPPAPPRPPPPGRHPPRGPSPPAPGPSPPTSPPPRPERPPRPTPRLPSPPRSKEKTEPRPPAPRPTAKREKQQAKLDWKKTEHPTPAPRAKREPELKLDPRPSTSRQAGYFPPXTPKIKPKYEHQPTKRPVPYRIPEREPKIERTPQQQQPPPPTAVVEEMPYVPPPRRGTKRPHPKTPVTPSVTTPAPPTTAKPPVTVPSPTTKPITPPTPTTTTPTPTTKSTTSPPPTTTVPPAITKPSTSPPPTTTVPPPITKPSTGPPSTEKPITTVPAPPKTTTTTSTPAISAVPSPSVKPTIPVPPSCWYYGRVGGAEHWATRAGASRE

SEQ ID NO: 142488 - protein, 35 aa, Heterodera glycines
  Coding regions on vcDNA: vcDNA=SeqID_68911; Strand=-; Position=1-182
MFGFFLAYQNFIEPGSFYSLSNRPQIFFYSLTRPY

SEQ ID NO: 142489 - protein, 176 aa, Heterodera glycines
  Coding regions on vcDNA: vcDNA=SeqID_68912; Strand=+; Position=1-529
MVVAFVKGQQEIPFSEYSKQKYEANLGIVYFMINNWHCDKIDEKFKEYERTECQKYRKYLDILYEYLYREYVGIPTAKPKFVFQNQIEIDGPIIYAVNCLTKISQFYLIKSVGQKYEYKLNKMFYLVDNFEPKLLNEKRFNYKFKLKDVSKMPINEMILQLAIETANEWQTNESLN

SEQ ID NO: 142490 - protein, 130 aa, Heterodera glycines
  Coding regions on vcDNA: vcDNA=SeqID_68913; Strand=-; Position=1 -65,251-304,564-657,711-731,787-945
  Homolog annotation: Hit_ID=NP_497338.2; Match level="QueryCoverage =92%, HitCoverage=29%, E-value=2e-21, Identity=43%"; Hit description =modulation of locomotion defective protein 1 family member (58.5 kD) (3C216) [Caenorhabditis elegans] gb|
PYPAGYWHELTMKFHFSRRAGCMDFFCARYTGHSGPNNARNLPKVSYVKAIDIWLLSCMTFVFFSLLELAWVGYLSRKEADSREAAKEAQDAVAAVVQQVTVPPPRYGSVDAQSVGASYQQLNMQQRLIK

SEQ ID NO: 142491 - protein, 84 aa, Heterodera glycines
  Coding regions on vcDNA: vcDNA=SeqID_68914; Strand=+; Position=1 -93,416-577
MESDVTDGLWDKMVLCLRSIVALPPNLDRQSVYPNSSSSIGLALIVSNFRFEDRDNRDGTNVDEQNLRSKSIPTFFKWFSIFDL

SEQ ID NO: 142492 - protein, 82 aa, Heterodera glycines
  Coding regions on vcDNA: vcDNA=SeqID_68915; Strand=+; Position=1 -46,479-681
MSEIGIPCHPCCGSLGQSPLMQAAMSDNLEACCLLVEEWVAEVNQPNIEGEFTALICAASRGYLGRKCRNGGHMLEEFGKTK

SEQ ID NO: 142493 - protein, 144 aa, Heterodera glycines
  Coding regions on vcDNA: vcDNA=SeqID_68916; Strand=+; Position=1-432
  Homolog annotation: Hit_ID=CAE66341.1; Match level="QueryCoverage =57%, HitCoverage=21%, E-value=3e-12, Identity=45%"; Hit description =Hypothetical protein CBG11593 [Caenorhabditis briggsae]
MGVTLARKVIQGGSAHIGGDGGDEKSASPNKCHLGNPIRHRVHTLVGIAGANYGLCLCTANLAVLSSPACNKETGFWTHSDGCAAAMTYKHHQMERRRLEEKRHCDDGKSVGTECQSKEEEEEQYSTVLRELNAPDKAKDAIFV

SEQ ID NO: 142494 - protein, 46 aa, Heterodera glycines
  Coding regions on vcDNA: vcDNA=SeqID_68917; Strand=+; Position=1 -23,90-207
MNKWSALVLLIALISALDSAVVRQQRAADADASKPEPNNEKPGKLK

SEQ ID NO: 142495 - protein, 56 aa, Heterodera glycines
  Coding regions on vcDNA: vcDNA=SeqID_68918; Strand=+; Position=1 -125,169-214
MENTHARNWEEFIGKIKQKLGVTERTIEKWAKKITNIKIFQKAEGLHNCRKMELNK

SEQ ID NO: 142496 - protein, 92 aa, Heterodera glycines
  Coding regions on vcDNA: vcDNA=SeqID_68919; Strand=-; Position=1 -20,234-492
MYWLRGTENQKADELGTLAKIIQDEVGPITAMPAYHSFVFLRVSALSERNANLPVGLSNTMYMGQTGYSMLEVYMHHWLPKNEEHFKLLLFL

SEQ ID NO: 142497 - protein, 343 aa, Heterodera glycines
  Coding regions on vcDNA: vcDNA=SeqID_68920; Strand=-; Position=1 -135,220-339,698-751,874-1086,1489-1623,1904-1972,2035-2080,2124 -2159,2205-2257,2375-2455,2836-2853,2910-2978
  Homolog annotation: Hit_ID=NP_499869.1; Match level="QueryCoverage =97%, HitCoverage=91%, E-value=1e-58, Identity=38%"; Hit description =predicted CDS, COLlagen structural gene (col-99) [Caenorhabditis elegans] pir||T33149 hypothetical protei
GEPGAPPLGPPYHHISSSNANNINNGTATCYQPCRDGLPGRDGVPGAKGEPGVPGMAPSMLAHVGGGTNTLLQGPPGPSGPKGEKGDLGPPGLPGQPGKKGRKQHHHHHKQHHKNQKQLLAGAAIQEQELPYSKERQAQYGDDINYQRQQHALVQQLLPMLKEQLLRNLSSQAQHPFGIHTVPGPPGPRGLPGLQGLPGHGGEKGERGDIGLPGLPGQPAPPATPTVFTGNGQPKMVIPGPRGPPGLPGLPGPPGPPGPLGPQGTLGLPGLPGPMGLRGPPGVDGRSGLPGPKGDTGPLGPPGTKGDRGPKGDQGLPGLDAPCPPGPDGLPLPYCGDPAPLPE

SEQ ID NO: 142498 - protein, 41 aa, Heterodera glycines
  Coding regions on vcDNA: vcDNA=SeqID_68921; Strand=+; Position=1 -3,730-852
MVWIQVPRSLDFSWTWIFLDFCPGNPGPDPGPGFFKMSISS

SEQ ID NO: 142499 - protein, 30 aa, Heterodera glycines
  Coding regions on vcDNA: vcDNA=SeqID_68922; Strand=-; Position=1-255
LCFFVHLFQSASALRFCVLTLLFFPFISIG

SEQ ID NO: 142500 - protein, 51 aa, Heterodera glycines
  Coding regions on vcDNA: vcDNA=SeqID_68923; Strand=+; Position=1 -90,546-611
MPHTFRTFTSAKSNHWDFDNTCCPAPLSLQIKEKVDIYTFIARALGLKWTE

SEQ ID NO: 142501 - protein, 413 aa, Heterodera glycines
  Coding regions on vcDNA: vcDNA=SeqID_68924; Strand=+; Position=1 -95,136-238,293-444,508-613,656-847,902-1140,1295-1483
  Homolog annotation: Hit_ID=CAE63144.1; Match level="QueryCoverage =97%, HitCoverage=53%, E-value=2e-74, Identity=40%"; Hit description =Hypothetical protein CBG07446 [Caenorhabditis briggsae]
RFQWVHVPRFLVPGGLFKLYFYWDTYWILKGLYFSNLVELYFSNLVETARGMLENFAHLLRFRGFIPNSGNVQLSRRSQPPLFTQMIADLSRRSQPPLFTQMIADYYEVTKNKSFLAEYLPMAENELAWWEANRTVEVQPDQSADQSAAFKAITDCPRPENFLEDYQLGMESDDATFFWSSTASACESGLDFSSSSTASACESGLDFSSRWYKWHRIESNAKDCHRTSEVLPVDLNVFMALNYQTLAKLYDEELKEQKARKNKEIAEAITKARKNKEIAEAITAHIDRTFWDDEEGVWFDFDLTEKKLRKKFYPSNIYPMLLKNDGKGTGEKCQKVVEYLKRSGAIGFKGGVPSSLERNSNEQWDFPNGWAPQQHLVVLSLLKCQNVSGEAAGIARKIAEAFLTTTYNGLFTP

SEQ ID NO: 142502 - protein, 168 aa, Heterodera glycines
  Coding regions on vcDNA: vcDNA=SeqID_68925; Strand=+; Position=1 -328,374-552
MKLNGKLEGKKKKCQKIIAKHLGTNIRNIYYWKKQLKSGKLVQNQKNDEQKREIVEKYFKIKIKFMQNRKHSRKEWEEFRAKIKQMFGIYYRTIEKWAKKIGVFENVSKKRKILTIGEKMELATQYYQIKKENPKIKEYEIAKIFNIPKNSLRKYKAKFGIKPKNKLH

SEQ ID NO: 142503 - protein, 179 aa, Heterodera glycines
  Coding regions on vcDNA: vcDNA=SeqID_68926; Strand=-; Position=1 -371,466-633
  Homolog annotation: Hit_ID=CAE63144.1; Match level="QueryCoverage =59%, HitCoverage=16%, E-value=9e-16, Identity=38%"; Hit description =Hypothetical protein CBG07446 [Caenorhabditis briggsae]
MPRHCFFFQLLISLLPLFSSGGNGSTFFFHKVWPLFFRRMAFGKMPIPRQKWLAFFTDVQKDSDVFTRDHVKVNCSEPICIGHYREIYCEGAIMWAAWYFGLQNECPGNRMRFEAEVILKNFDSSFDQQGRLYREDFRRFCKENFDDRPYLEEAQVKDWTADLEFLDRITSPKMKSNCI

SEQ ID NO: 142504 - protein, 38 aa, Heterodera glycines; identical to SEQ ID NO: 125263
  Coding regions on vcDNA: vcDNA=SeqID_68927; Strand=-; Position=1-144

SEQ ID NO: 142505 - protein, 64 aa, Heterodera glycines
  Coding regions on vcDNA: vcDNA=SeqID_68928; Strand=+; Position=1 -33,122-283
MCIRTAMQTGAMPTVVIPDNDWFRYQEAIKKFTIKSDDNPELTSEPAIQFIEKLLQGAPGDEKK

SEQ ID NO: 142506 - protein, 158 aa, Heterodera glycines
  Coding regions on vcDNA: vcDNA=SeqID_68929; Strand=+; Position=1 -130,353-499,552-748
  Homolog annotation: Hit_ID=AAM97979.1; Match level="QueryCoverage =98%, HitCoverage=12%, E-value=2e-35, Identity=59%"; Hit description =Membrane calcium atpase protein 3, isoform c [Caenorhabditis elegans]
MCVLDKQKILAGVSDGDGAVAQHAPDITLGEGAKPLLDEEGEENIKLDGYNGAIPPGSAGRAKDDLEVQPAKKERSVLQAKLTRLAIQIGYAGSFVAACTVLILGIRFCIQHYLIDQKPFVVADFRYFVNFLIIGVTVLVVAVPEGLPLAVTLSLAYS

SEQ ID NO: 142507 - protein, 95 aa, Heterodera glycines
  Coding regions on vcDNA: vcDNA=SeqID_68930; Strand=-; Position=1-701
LFEYPKRTLEKIDFFVFGAVPPNRCAQIYGETEFFGNSFPIVCTLIQRWIFAPHNCLSTPNGHLKKSIFLFSGQSPRTDAPRFMGRPNPSGIASL

SEQ ID NO: 142508 - protein, 25 aa, Heterodera glycines
  Coding regions on vcDNA: vcDNA=SeqID_68931; Strand=-; Position=1-130
QITNTNVYQRHVTHNCVTLNSNNEH

SEQ ID NO: 142509 - protein, 107 aa, Heterodera glycines
  Coding regions on vcDNA: vcDNA=SeqID_68932; Strand=+; Position=1-324
MPSAVLASQQWWWLTAMAANPNGTSNSSELCRPKMLPRINDELGPAFLFYWEQLICDGWEQLICDGWKLSVMNWVQLFVVNWDLWDQIYDVGSVFYDEMVTIHCDKL

SEQ ID NO: 142510 - protein, 49 aa, Heterodera glycines
  Coding regions on vcDNA: vcDNA=SeqID_68933; Strand=-; Position=1-148
MVEKETDIAAAVPNNAANIGHVEAVDPSASKSAKEVPNNTEKHSAEDLM

SEQ ID NO: 142511 - protein, 64 aa, Heterodera glycines
  Coding regions on vcDNA: vcDNA=SeqID_68934; Strand=-; Position=1 -141,249-302
MTLKCLPPELLFELMPFVPAENAVPDAISSCRLFHCLLFKRVLNWKKNLITKDLEVVFKLYLKR

SEQ ID NO: 142512 - protein, 118 aa, Heterodera glycines
  Coding regions on vcDNA: vcDNA=SeqID_68935; Strand=+; Position=1 -242,289-403
MSEEYGGYEIEEYCCGGAKQYALKMRNNQTGEIEYVMKIRGITFDVDNRKTLHYDTFREMVLNYGKGEVDPAFFVYKNDFGPTRDSKVVTREKHKMYRPVCQKGIIDEELNVMPFGFC

SEQ ID NO: 142513 - protein, 127 aa, Heterodera glycines
  Coding regions on vcDNA: vcDNA=SeqID_68936; Strand=-; Position=1-536
RRKHMMNSHEIEIFLSKHPTTRKYFIGVFASDKMPKLKDRHFPYCFVANTDRAGTIGEHWVACFVNSPTEIEYFDSLGDYPNEDLSSYLNLFERILFNERIVQHQFSDACGQFCIYFLTQRCSGILY

SEQ ID NO: 142514 - protein, 82 aa, Heterodera glycines
  Coding regions on vcDNA: vcDNA=SeqID_68937; Strand=-; Position=1 -117,247-377
NQFCDLNKTFLYLSTSIERKDKSNWIPITKDSEADQHVEDVKKGLCEASCYYVDDVDQDDYTNSGFKNRASRFADGAKCETM

SEQ ID NO: 142515 - protein, 71 aa, Heterodera glycines
  Coding regions on vcDNA: vcDNA=SeqID_68938; Strand=+; Position=1 -79,397-533
MMRNAMLLPVVFAMLFYFSALLQFGYALKCRALYTTENATANELIKQITNPGDFKCTRNEKNCGVTFCSAG

SEQ ID NO: 142516 - protein, 21 aa, Heterodera glycines
  Coding regions on vcDNA: vcDNA=SeqID_68939; Strand=+; Position=1-68
SVWGTQTIMGSKNPRRIKYRL

SEQ ID NO: 142517 - protein, 38 aa, Heterodera glycines
  Coding regions on vcDNA: vcDNA=SeqID_68940; Strand=-; Position=1 -111,257-262
MHLGFEMALAKTLPQMEKKKELLKMLIYVENALILVKV

SEQ ID NO: 142518 - protein, 29 aa, Heterodera glycines
  Coding regions on vcDNA: vcDNA=SeqID_68941; Strand=-; Position=1 -42,167-214
MNFTRYSLIYPQLRTYRGPLELSNYTKNV

SEQ ID NO: 142519 - protein, 24 aa, Heterodera glycines
  Coding regions on vcDNA: vcDNA=SeqID_68942; Strand=+; Position=1 -52,295-317
MEKACKIWRDYIDFSALELLELAS

SEQ ID NO: 142520 - protein, 54 aa, Heterodera glycines
  Coding regions on vcDNA: vcDNA=SeqID_68943; Strand=+; Position=1 -31,577-710
MCCHCDFIHIGQTEVVTRTMSQQWEVQHDMYDYDHYPKDDGPKEKGSKNCCTIM

SEQ ID NO: 142521 - protein, 18 aa, Heterodera glycines
  Coding regions on vcDNA: vcDNA=SeqID_68944; Strand=+; Position=1-56
YREAIPEGFGLPINLGAS

SEQ ID NO: 142522 - protein, 118 aa, Heterodera glycines
  Coding regions on vcDNA: vcDNA=SeqID_68945; Strand=+; Position=1 -157,211-410
MEEKQKFIHQFDKIIGKKEQQSVGRKDKLEIAERVGINLRTIDKWKSEMGLKVTKESQRIALVKEYYRIKKEDPKVPTKEIAKSFNASKATLFYWKKQFDKNNYESSSSPDGPEQLSW

SEQ ID NO: 142523 - protein, 44 aa, Heterodera glycines
  Coding regions on vcDNA: vcDNA=SeqID_68946; Strand=+; Position=1 -64,396-466
MKLVPRKILGFNGLPLLGLSHANFSILSTGESFRFCLLKAFDEN

SEQ ID NO: 142524 - protein, 37 aa, Heterodera glycines
  Coding regions on vcDNA: vcDNA=SeqID_68947; Strand=+; Position=1 -48,2065-2130
MNANNKLNIRSSSLPASYKTVLVNTIILNESKWMSAK

SEQ ID NO: 142525 - protein, 43 aa, Heterodera glycines
  Coding regions on vcDNA: vcDNA=SeqID_68948; Strand=+; Position=1 -121,383-393
MPMPSPTPDHRQRRPLPWATNWSPLRWTPTGHTLRWWPRQENK

SEQ ID NO: 142526 - protein, 44 aa, Heterodera glycines; identical to SEQ ID NO: 126591
  Coding regions on vcDNA: vcDNA=SeqID_68949; Strand=-; Position=1 -45,128-217

SEQ ID NO: 142527 - protein, 147 aa, Heterodera glycines
  misc_feature (136)..(136): Xaa can be any naturally occurring amino acid
  Coding regions on vcDNA: vcDNA=SeqID_68950; Strand=+; Position=1-446
  Homolog annotation: Hit_ID=AAP92584.1; Match level="QueryCoverage =81%, HitCoverage=24%, E-value=2e-30, Identity=59%"; Hit description =Ab2-057 [Rattus norvegicus] gb|AAP85373.1| Aa1262 [Rattus norvegicus] gb|AAP85367.1| Aa1011 [Rattus norveg
WPFLVRGAICLVYSDNERDSSLLNSWLIASVGTLLRGISVFSRTKLSNTGSVMPLDVRGCTRATLAKSACLPSPKGVGKPVKICRDWDRTLQLLSVNEEFLVGASHQLALNTSLPFVHTARRCPGLSHFEKFGDGXCSGRSVCRLEP

SEQ ID NO: 142528 - protein, 92 aa, Heterodera glycines
  Coding regions on vcDNA: vcDNA=SeqID_68951; Strand=+; Position=1-808
LFEYPKRTLEKIDFFVFGAVPPNRCAQIYGEIESFRNSFPIACTLILRWIFAPHNCLSTPNGHLKKSIYFCFRGSPPEPMRPDLWGDRIPRE

SEQ ID NO: 142529 - protein, 77 aa, Heterodera glycines
  Coding regions on vcDNA: vcDNA=SeqID_68952; Strand=-; Position=1 -103,563-691
  Homolog annotation: Hit_ID=NP_492127.1; Match level="QueryCoverage =100%, HitCoverage=1%, E-value=4e-14, Identity=48%"; Hit description =EGF motif related, Low-density lipoprotein Receptor Related (lrp-1) [Caenorhabditis elegans] emb|CAA98124
NIYVTGVVGAENIANAEAAGRRKRRWSQPLDETGIVFGQLQIPTAIVTLPKLGRICYSDAGLEAKIECADMDGNRRQ

SEQ ID NO: 142530 - protein, 181 aa, Heterodera glycines
  Coding regions on vcDNA: vcDNA=SeqID_68953; Strand=-; Position=1 -74,130-600
MAAKRNGTSQQSGPSTKKWDFRSIGNNFIEEMETFKLMDYRSTICEKFGFTKNIAEFTINPDVGRPDEAMRDAIDTMIKAAFKTTEERMKRKVRMFGVVITGAGLAFPVWVPYRAFPQNNADVIMQEINKLGQSGDGDENKKMLLLSEQITMKITCVTMPGGEGPRNVHKFDFGFKEHQRI

SEQ ID NO: 142531 - protein, 15 aa, Heterodera glycines
  Coding regions on vcDNA: vcDNA=SeqID_68954; Strand=-; Position=1 -32,294-309
MYMNLPPKLKGHSRI

SEQ ID NO: 142532 - protein, 67 aa, Heterodera glycines
  Coding regions on vcDNA: vcDNA=SeqID_68955; Strand=-; Position=1 -44,477-636
MSNQSAAQIADEYERHFKDCPPPLLILWQVEHKHGHPEGDTRRIVDNAVKGEEKRKEKERTTSQSSK

SEQ ID NO: 142533 - protein, 110 aa, Heterodera glycines
  Coding regions on vcDNA: vcDNA=SeqID_68956; Strand=+; Position=1 -156,417-527,1330-1395
  Homolog annotation: Hit_ID=NP_510298.1; Match level="QueryCoverage =96%, HitCoverage=39%, E-value=8e-45, Identity=81%"; Hit description =5'-amp-activated protein kinase (30.2 kD) (XO377) [Caenorhabditis elegans] emb|CAB04480.1| Hypothetical p
MRSMNSTGAQPSQDTPNDRELERLREFTQQLPDRRDFEKAANPPILPPHLLQVILNKDTPVQCDPNVLPEPNHVMLNHLYALSIKDGVMVLSATHRHRKKYVTTLLYKPI

SEQ ID NO: 142534 - protein, 794 aa, Heterodera glycines
  Coding regions on vcDNA: vcDNA=SeqID_68957; Strand=+; Position=1 -67,151-212,258-563,608-717,806-1001,1119-1271,1312-1393,1436 -1577,1625-1770,1837-1962,2048-2228,2281-2399,2468-2655,2705-2834
  Homolog annotation: Hit_ID=NP_495958.1; Match level="QueryCoverage =92%, HitCoverage=72%, E-value=1e-139, Identity=40%"; Hit description= yeast SEC homolog (100.4 kD) (sec-5) [Caenorhabditis elegans] emb|CAA92702.1| Hypothetical protein T23G7
ASQSANTFRSNAPLVTGVSPHQGPPGTLITIRGERFGEDANDLVALVICGTDCLATAKWKSSVALVICGTDCLATAKWKSSSKIVARLGGQAKRGPGDIVMVTRSGGRGQSAVQFRVFIEQIGPLQESAVWVDEAKTVPGRNLIRNVQEGGDPEDALGLGIDQSKTDIASLIKLFPDGTGSRKMENFDQSKTDIASLIKLFPDGTGSRKMENFSPEWYLLENYKLASVSDLKRGMANLEKQIAHEEECSKNVHKANLFLLISCVDALTSLHSKIQSKSTSEDWPISAKLAEKVEKAAKTADRLFRDVLTRKDHADSTRNALSMLTRFRFIFFLAESIETNMAKGEFSTILNGEFSTILNDYARAKALFKDTEVNLFKEVMAVLDEMAVLDENIGKLRECIRSKLMDISTPFEEQNRLIKFLKILDPESDPAWDCMMSYNGWLENILWELQIHFHGWDCMMSYNGWLENILWELQIHFHGKCKCWLSFGFSFLYFNALAMEAHQRNFRHAFVIDLLGLFRHAFVIDLLGLLTEKLQTFWKISQNFAVTGPTTSAAVSALTLQLQQMLTNTINVGSWLLLNALVPDALPESVNKQYKDRFVQWPRLSPNQWDVMFPSIKTLRASIKTASIKTLTELSRSHLQPLVELCTTVRLKCLGMLVERGKEAVVLLLGAQENWRVDLMADPPRTALPDLFETEVNELVADVKVILSSNNFPGEIDLFLKERWRQMIIDLFAVLLLGVRDCYDHLLKRQMIIDLFAVLLLGVRDCYDHLLKLRRENKRPNTLLDNVSLEVLMR

SEQ ID NO: 142535 - protein, 99 aa, Heterodera glycines
  Coding regions on vcDNA: vcDNA=SeqID_68958; Strand=+; Position=1 -242,596-652
MHAFRARAIYHRACQSKAKQQRCCFERIKGIGYFEEVSKKHAAISLQNLISGKYMSIEFIFRKCQHTFGKIYLQFINNFEKKCPHTFGKIYLQFINNFE

SEQ ID NO: 142536 - protein, 16 aa, Heterodera glycines
  Coding regions on vcDNA: vcDNA=SeqID_68959; Strand=-; Position=1-50
MAIVPGPPSRYASAFV

SEQ ID NO: 142537 - protein, 292 aa, Heterodera glycines
  Coding regions on vcDNA: vcDNA=SeqID_68960; Strand=+; Position=1-879
  Homolog annotation: Hit_ID=ZP_00020514.2; Match level="QueryCoverage =99%, HitCoverage=37%, E-value=7e-26, Identity=30%"; Hit description =COG2152: Predicted glycosylase [Chloroflexus aurantiacus]
SINGTQPTNIPITGTQPSSIPITGTQSTNILIIGTQSTNIPFNGTQPTSIPITGTQSTNIPITGTQFSYISITGTQPTNIPIIGTQSTNIPINGTQPTNIPINGTKPTNIPINGTQPTNIPIIGTQSTSIPITGTQFSYISITGTQSTNIPITGTQFSYISITGTQPTNIPIIGTQSTNIPINGTQPTNISLGLNPPTFQSLGLNPPTFQSTGLNPPTFQSLGLNPPAFQSLALNSPTFQSLGLNPPTFHSTVTPPTTNPFTATQFSDNPITATQPTNIPYHMDSTPPPFQS

SEQ ID NO: 142538 - protein, 308 aa, Heterodera glycines
  misc_feature (9)..(9): Xaa can be any naturally occurring amino acid
  misc_feature (149)..(149): Xaa can be any naturally occurring amino acid
  misc_feature (169)..(169): Xaa can be any naturally occurring amino acid
  misc_feature (239)..(239): Xaa can be any naturally occurring amino acid
  misc_feature (279)..(279): Xaa can be any naturally occurring amino acid
  Coding regions on vcDNA: vcDNA=SeqID_68961; Strand=-; Position=1-935
  Homolog annotation: Hit_ID=XP_521405.1; Match level="QueryCoverage =79%, HitCoverage=87%, E-value=4e-34, Identity=43%"; Hit description =PREDICTED: similar to putative N-myristoylated protein (4I499) [Pan troglodytes]
GMLGIESQXLEWWRIESTVIGMVVVLSPCDKEVGGLSRSDWIVGELCSRNGLVVGGVTVEWNVGGLSPNDWNVGELSASDWNAGGLSPNDWNVGGFSPVDWNVGGLSPSDWNVGGLSPSNVGGLSPVDWNVGGLSPNDWNVGGLSPSDXNVGELSASDWNVGGLSPSDXNVGELSASDWNAGGLSPNDWNVGGLSPVDWNVGGFSPVDWNVGGLSPVDWNVGGLSPNDWNVGGLSPSDXNVGELSASDWNVGGLSPSDWNAGGLSPVEWNVGGLSPNDXNVGGLSPSDWNAGGLSPSDWNVGGLSPID

SEQ ID NO: 142539 - protein, 28 aa, Heterodera glycines
  Coding regions on vcDNA: vcDNA=SeqID_68962; Strand=+; Position=1-85
IFFVCVSNIVRLFDRARQEKATVGTKFA

SEQ ID NO: 142540 - protein, 108 aa, Heterodera glycines
  Coding regions on vcDNA: vcDNA=SeqID_68963; Strand=-; Position=1 -3,301-621
MLCFKDIFSIFAKIPLVCSHFVYLSVAFLHFGNRKGAALGLNLSLITHILGILSSVFVSVRPSVGRFGSLSVRLSILSNVHIRNVYWHPALLLRSPTPLLLLPFDALR

SEQ ID NO: 142541 - protein, 50 aa, Heterodera glycines; identical to SEQ ID NO: 135818
  Coding regions on vcDNA: vcDNA=SeqID_68964; Strand=-; Position=1-154

SEQ ID NO: 142542 - protein, 43 aa, Heterodera glycines
  Coding regions on vcDNA: vcDNA=SeqID_68965; Strand=+; Position=1-129
MARKDFRFPTFLGSEFRLPKFLMKSRKFLKFLFQKTSKFCTIS

SEQ ID NO: 142543 - protein, 157 aa, Heterodera glycines
  Coding regions on vcDNA: vcDNA=SeqID_68966; Strand=+; Position=1 -272,327-455,508-577
  Homolog annotation: Hit_ID=AAK54042.1; Match level="QueryCoverage =98%, HitCoverage=39%, E-value=8e-43, Identity=55%"; Hit description =G protein alpha subunit 2 [Strongyloides stercoralis]
MEELLRGMNMYKIGFTEPKGTVNGVPPIKRCRPDIKECARVVMETIRNGEESEPFSDELAAAMKRLWADPALNTATYSRRLEFHLHDSAKHFLDSLDRISNPSYRPSQQDILLTRIKTTGIVEIQFLIKGVPFRVFDVGGQRSERKKWIHCFEDVNS

SEQ ID NO: 142544 - protein, 310 aa, Heterodera glycines
  Coding regions on vcDNA: vcDNA=SeqID_68967; Strand=-; Position=1-931
  Homolog annotation: Hit_ID=XP_320889.1; Match level="QueryCoverage =84%, HitCoverage=32%, E-value=4e-79, Identity=50%"; Hit description =ENSANGP00000012033 [Anopheles gambiae] ref|XP_313651.1| ENSANGP00000013044 [Anopheles gambiae] ref|XP_314
VQNDVDTELDRLIELGVLKKVDYSRWAAPIVAVRKANGKVRICFDFSTGLNAALEPHHHPLPRPEKLFAQLNGAKIFSQIDFKDAYLQISVDEQSRQLLGVNTHKGLYQCQRLAFGIKSAPGIFQWTMDQLASGIPGVVGYMDDFIIASSTVNEHFSTIFKFFKRIQEFGFRIQMDKCKFLVKEIKFLGQIVSSDGIRPDQNRTRALQEMPPPTDITTLRSFLGAINYCGKYIKNIHQIRAPLDELLKQGVEWQWNEKHREAFDQAKAILLSDLALTHYDPHLPIIVTADASNKGIGATISHRFPDGKEK

SEQ ID NO: 142545 - protein, 88 aa, Heterodera glycines; identical to SEQ ID NO: 124691
  Coding regions on vcDNA: vcDNA=SeqID_68968; Strand=-; Position=1 -96,135-305

SEQ ID NO: 142546 - protein, 19 aa, Heterodera glycines
  Coding regions on vcDNA: vcDNA=SeqID_68969; Strand=-; Position=1-59
TFAFSSLALLNTHTIFEML

SEQ ID NO: 142547 - protein, 19 aa, Heterodera glycines
  Coding regions on vcDNA: vcDNA=SeqID_68970; Strand=-; Position=1-59
TFAFSSLALPNTHTIFEML

SEQ ID NO: 142548 - protein, 19 aa, Heterodera glycines
  Coding regions on vcDNA: vcDNA=SeqID_68971; Strand=-; Position=1-59
TFSFSSLALPNTHTIFEML

SEQ ID NO: 142549 - protein, 19 aa, Heterodera glycines
  Coding regions on vcDNA: vcDNA=SeqID_68972; Strand=-; Position=1-59
TFAFSSLALPNTHTIFEML

SEQ ID NO: 142550 - protein, 19 aa, Heterodera glycines
  Coding regions on vcDNA: vcDNA=SeqID_68973; Strand=-; Position=1-59
TFAFSSLALPNTHTIFEML

SEQ ID NO: 142551 - protein, 19 aa, Heterodera glycines
  Coding regions on vcDNA: vcDNA=SeqID_68974; Strand=-; Position=1-59
TFAFSSLALPNTHTIFEML

SEQ ID NO: 142552 - protein, 87 aa, Heterodera glycines; identical to SEQ ID NO: 129152
  Coding regions on vcDNA: vcDNA=SeqID_68975; Strand=-; Position=1-671

SEQ ID NO: 142553 - protein, 73 aa, Heterodera glycines
  Coding regions on vcDNA: vcDNA=SeqID_68976; Strand=+; Position=1 -175,292-338
MEIEKVSEFALEKVGSERLSKAMNIWGFSWKIMAEIRTKDENNEKWLGFFLYNYGTEKEIFIFYYLIIFIYEI

SEQ ID NO: 142554 - protein, 89 aa, Heterodera glycines
  Coding regions on vcDNA: vcDNA=SeqID_68977; Strand=+; Position=1-269
MQFVFPLAPSFEALLSSPGYAIFIIFLFLIARFLKLTSFDEKPKITLRKNKRRNSSQKCSHLMEEGSQCATGPFVELAELFVQCSILQE

SEQ ID NO: 142555 - protein, 40 aa, Heterodera glycines
  Coding regions on vcDNA: vcDNA=SeqID_68978; Strand=-; Position=1 -73,825-874
MKKLGFLLLLAITFPTRPPLLYFVQKSFWLTTYCFFAGEI

SEQ ID NO: 142556 - protein, 71 aa, Heterodera glycines
  Coding regions on vcDNA: vcDNA=SeqID_68979; Strand=-; Position=1-216
MQIERPFFTEIEKVSEFAQEIFWSQRISETVHIKGFSWKILAQIRKNLLGTDNEKWMGFYLLCDAPKEGAN

SEQ ID NO: 142557 - protein, 216 aa, Heterodera glycines
  Coding regions on vcDNA: vcDNA=SeqID_68980; Strand=-; Position=1 -40,300-428,476-585,791-929,1046-1278
MFRFDSKNAKSENATTDYPVEVPDVEAAAFKVMLSFIYTGELAELNGDNAMAVLYAAKKYNIPGLVDASLQVPVSSLRNVFVAYVQAELYELEALRWADAKCRQNCIERSAKNRRAVLGPALFKIRFPLIPNEEFSKKIVPSEVLSEDEVIDIYQFHALPNCHGISDGFFPMPFPTNGRISDRKKGRILMDIKKMLEFAREGIKSSRYSEKIYING

SEQ ID NO: 142558 - protein, 98 aa, Heterodera glycines
  Coding regions on vcDNA: vcDNA=SeqID_68981; Strand=-; Position=1 -40,309-437,485-612
MFRFDSKNAKSENATTDYPVEVPDVEAAAFKVMLSFIYTGELAELNGDNEMAVLYAAKKYNIPGLVDASLQVPVSSLRNVFVAYVQAELYELEVGWTE

SEQ ID NO: 142559 - protein, 95 aa, Heterodera glycines
  Coding regions on vcDNA: vcDNA=SeqID_68982; Strand=+; Position=1-288
MVRISRYLIIDHDNLPVRPPSLDEINLRWIYKQNSEEILQFLAYHGLIKNQMECKKCFNKMSLTKKTNTKDGFLVMHIGMSKICTKIDQNMYINM

SEQ ID NO: 142560 - protein, 219 aa, Heterodera glycines
  Coding regions on vcDNA: vcDNA=SeqID_68983; Strand=+; Position=1 -58,388-482,638-731,778-912,993-1102,1191-1358
  Homolog annotation: Hit_ID=NP_964008.1; Match level="QueryCoverage =84%, HitCoverage=43%, E-value=2e-25, Identity=37%"; Hit description =BTB (POZ) domain containing 6 [Mus musculus] gb|AAH31195.1| BTB (POZ) domain containing 6 [Mus musculus]
MPTKTDSSDDESDEENSAAAESPGNKWMKLMLSTGKYADVHFLVGDGDAKMRVPAHKLILEEASDVFKAMFRFDAKKEKAENDSANCPADVEIPDVEAAAFKVMLSFIYAGDLSELNGDNAMAVLYTAKKYIIPGLVERSLQIPISELRNVFFAYAQARLFDFEDYCNDCLDYIDGNADALLKSDGFLQIDQKLLCEILGRQLQIHEEFSIWEAVIFLI

SEQ ID NO: 142561 - protein, 16 aa, Heterodera glycines
  Coding regions on vcDNA: vcDNA=SeqID_68984; Strand=-; Position=1 -45,702-707
MRWEKVTQMRMNFWTK

SEQ ID NO: 142562 - protein, 42 aa, Heterodera glycines
  Coding regions on vcDNA: vcDNA=SeqID_68985; Strand=-; Position=1 -57,148-219
MEALTMRNGWAFTLCVNKKELMDPSKGFYNKSEDKVTLAIDP

SEQ ID NO: 142563 - protein, 39 aa, Heterodera glycines
  Coding regions on vcDNA: vcDNA=SeqID_68986; Strand=-; Position=1 -59,433-493
MTMFLTINRTTGDTITFQLLSMFTIFGLGFIALILLGFT

SEQ ID NO: 142564 - protein, 380 aa, Heterodera glycines
  Coding regions on vcDNA: vcDNA=SeqID_68987; Strand=-; Position=1 -59,284-431,741-894,987-1165,1372-1511,1587-1704,1747-1912,2318 -2400,2457-2552
  Homolog annotation: Hit_ID=NP_497573.1; Match level="QueryCoverage =98%, HitCoverage=30%, E-value=3e-33, Identity=29%"; Hit description =predicted CDS, WD repeat domain 7 (3D602) [Caenorhabditis elegans]
MGGRRGTRLDPTADGPFGTWKFVTCSEDGTVCLWDSIDGRVIDSVKSNFIHRTIKPYVRVTALLANRCLTLKNGAQNVLFCIGDYADVIVLHPYDLNVLFTLGSKIEPEWTASIALATPMDVLVGTSLSGIVKLWSLHNVDPKDCGASVSFECESKVLATGADGVKSIVCSPKNLRMMLIIIDPSTLDQLIVSECAIEALDGVIVDIDKVAIAFADSTIVLFQLPRKKLCGRQIREKFGENPTNVFNIEQAFVFALLKGTLSTPLKPSLTPVQFFFDESRNSDKKVVVAYRVDEQGAISMWHIPNNLDFLVNEFIRHRRPIVYEPTIKQHISEAWARLVPPPPTLVDTEDDERIVTATIYVGTQGKLFHGRDDGSIMVSF

SEQ ID NO: 142565 - protein, 87 aa, Heterodera glycines
  Coding regions on vcDNA: vcDNA=SeqID_68988; Strand=+; Position=1-264
MGPVKSMITQQQQQNQEVQAVQQQQQILMGNEMKMDNSKNGETREEEGNSIGEGGETEEKERKRKNSAQKGGENEAEKRKEQQQIGT

SEQ ID NO: 142566 - protein, 15 aa, Heterodera glycines
  Coding regions on vcDNA: vcDNA=SeqID_68989; Strand=+; Position=1-47
MRIHARFSGKKLNMA

SEQ ID NO: 142567 - protein, 70 aa, Heterodera glycines
  Coding regions on vcDNA: vcDNA=SeqID_68990; Strand=+; Position=1 -139,184-257
MKERQQLQLQQEDMEADWYMRQARGDEVGGDRMAWDVDQDAILFMDTDPGLHSQNRIAMTRLQPQKPAAP

SEQ ID NO: 142568 - protein, 50 aa, Heterodera glycines
  Coding regions on vcDNA: vcDNA=SeqID_68991; Strand=+; Position=1 -139,772-785
MIRRGTAVIRRGSTVIRSSTTVIRRGTTVIRRDTTVIRSSTNLIRRELLE

SEQ ID NO: 142569 - protein, 168 aa, Heterodera glycines
  Coding regions on vcDNA: vcDNA=SeqID_68992; Strand=+; Position=1 -171,906-1175,1332-1397
DRQLRQFVSHWTVGDPEDVSVACQIAGIDPSFGFARVCDETSARRVFQEAMVRRTVMHNNNANIASIVRAKRRDGAAALSPRPPSAPSPPSLTADNGQHFAQQMVVEMRGRCFNATLAVRAHLSRCPWCPDPNVHIHVDGSEGSAQQQLIRKPEKGEGRIGILSVINC

SEQ ID NO: 142570 - protein, 237 aa, Heterodera glycines
  misc_feature (171)..(171): Xaa can be any naturally occurring amino acid
  misc_feature (182)..(182): Xaa can be any naturally occurring amino acid
  misc_feature (205)..(205): Xaa can be any naturally occurring amino acid
  Coding regions on vcDNA: vcDNA=SeqID_68993; Strand=+; Position=1 -149,412-658,1054-1380
  Homolog annotation: Hit_ID=CAA91145.2; Match level="QueryCoverage =84%, HitCoverage=28%, E-value=3e-33, Identity=38%"; Hit description =Hypothetical protein C08H9.3a [Caenorhabditis elegans] sp|P52887|ALG8_CAEEL Probable dolichyl pyrophosphat
SLIGIHSFFYSIKINFVLGAFLFAVLLNFKHIFLYYSPAFVAFYLFRFFFLTTKFFLLPSNRATKVKIECFFQIYKLFFSFKFSDGFFALRHILARLFPFKRGLTHACWAPNFWALYNFADLFAHKIVAKIHISFLHAPLYLSLWQEYEHAVLPNISFLRNSENRRTNAFXFRTFSAFAFFXFGWHVHEKVLCHYLKTIIMCVIXKKGRNHFCLGFALIKGKFLIRCYYSSRSKTIE

SEQ ID NO: 142571 - protein, 95 aa, Heterodera glycines; identical to SEQ ID NO: 124528
  Coding regions on vcDNA: vcDNA=SeqID_68994; Strand=+; Position=1-653

SEQ ID NO: 142572 - protein, 56 aa, Heterodera glycines
  Coding regions on vcDNA: vcDNA=SeqID_68995; Strand=-; Position=1-173
RKFPGLQYQSWFKIRDTVPVFRVPLSPYKSLSRRVDTVLGGFVRSAILANFSTKMA

SEQ ID NO: 142573 - protein, 336 aa, Heterodera glycines
  Coding regions on vcDNA: vcDNA=SeqID_68996; Strand=-; Position=1 -54,102-134,239-369,497-635,725-813,880-1004,1079-1213,1403-1454,1541- 1731
  Homolog annotation: Hit_ID=CAE71393.1; Match level="QueryCoverage =96%, HitCoverage=49%, E-value=5e-84, Identity=46%"; Hit description =Hypothetical protein CBG18300 [Caenorhabditis briggsae]
TILWHIGRVASFIKEKFPQVTILAWQVTILAWHDMLVQVQMTEKELADYQMTDKLEPVLWSYAEDLDMFLPFSHWMALKPFRNVWGASAFKGADGPMRFHSNPMHYVRNHESWVNQMTRVYKEFDRFQGLIITGWSRYDHLAILCELFPVGIPALSMSIETIAMGIETIAMGRPLNGKYEKTRELLKCQPPSEPGYSGCQFPGKRYELINECFYELRQFRKYFTSDFDLNGWVSAFAERETFSSPFYIAKVLPNIDLYLAILERIEHDLRIEFDLRIEFQKHFFTELADEFVLTYMAPEMASLRAKKAVAQSILKAKTFARRPFVKFPPMSTKDNE

SEQ ID NO: 142574 - protein, 166 aa, Heterodera glycines
  Coding regions on vcDNA: vcDNA=SeqID_68997; Strand=-; Position=1-501
MHDLFNSFIIGQLSAANGTNGSMSQPSDPMTHNQNRLVETNFAKFSRETNQANNHRGGTSKQQTKSMSSKSEEKIPWPSTNQPNGVPLDMDKVRLFSNAIAFIAMEFVASSSESRAELYTCKCLSDNEMEKKIFGPNGAILSHLNASFLNSAQKKRQFLKLLFSFG

SEQ ID NO: 142575 - protein, 303 aa, Heterodera glycines
  Coding regions on vcDNA: vcDNA=SeqID_68998; Strand=-; Position=1 -60,121-270,319-500,545-620,1014-1226,1424-1568,1628-1712
  Homolog annotation: Hit_ID=CAE62725.1; Match level="QueryCoverage =98%, HitCoverage=81%, E-value=1e-103, Identity=55%"; Hit description= Hypothetical protein CBG06885 [Caenorhabditis briggsae]
ECKTSNIAREAAITAGFPDSIPCNTVTLACISSGVSIQNISLMISTGYLKAGIAGGVELLSDFPIRYNRKVRLSLIDLQKAKSFGERFKHLKTVASNWFSPELPAVSEFTTGEVMGNSGDRLAAAFCVSRREQDEFAIRSHTLADKAFRENKLKDVAFIKPHGSVTAGNSSYLTDGASAALLASEEFAREKGYRPKVFIRETLFVAQDPKDQLLLGPAYVIPKLLDKNYMKRKAKFGLLPLEKVNMWGGSLSLGHPFGATGVRLLAHAANRLQAEGGRFAVIAACAAGGHGMGMLVENYESKQ

SEQ ID NO: 142576 - protein, 143 aa, Heterodera glycines
  Coding regions on vcDNA: vcDNA=SeqID_68999; Strand=+; Position=1 -222,868-1077
MLCNFDNFNCSSSRHFSLASVLLQQQKFAAVSSPPNKNWNAVLIEAMRLKSTSIVQDDAITEHGHDDHGHGHHAKVYKELKQKFITYLAMSFVFFMFCCYVGYSTDVLGHSAWKLPGSYRNRKAINARLDAEEAKAKAGEGEQ

SEQ ID NO: 142577 - protein, 73 aa, Heterodera glycines
  Coding regions on vcDNA: vcDNA=SeqID_69000; Strand=-; Position=1-222
MSPFLRRFLLLYPYASPSVPCPPHHRDQMCRALSVQRAVPSHFDDDKSFAHALLWSKDLPKDNLRAQLTPKLT

SEQ ID NO: 142578 - protein, 31 aa, Heterodera glycines
  Coding regions on vcDNA: vcDNA=SeqID_69001; Strand=+; Position=1-94
TITVHGQTICHRRSVKGLHVELREHDTFDPD

SEQ ID NO: 142579 - protein, 76 aa, Heterodera glycines
  Coding regions on vcDNA: vcDNA=SeqID_69002; Strand=+; Position=1 -81,232-381
MLGLFRPLETTTATQSTTTKEASILDRFMPKIPNIFNSFVGGRTTMATTTATTPPTLFPFLSFFTEKPTTTKAFCF

SEQ ID NO: 142580 - protein, 194 aa, Heterodera glycines
  Coding regions on vcDNA: vcDNA=SeqID_69003; Strand=+; Position=1 -117,715-1180
  Homolog annotation: Hit_ID=NP_500013.1; Match level="QueryCoverage =86%, HitCoverage=12%, E-value=2e-30, Identity=39%"; Hit description =predicted CDS, polyprotein family member (4B673) [Caenorhabditis elegans] gb|AAC02594.1| Hypothetical pro
VVADPFLHTLTIRHEDGNTYEVNLLEEQAADPEAAAYISEFCSMLYIDKKYACPHWSQGNASTERTFRTFHNILAKYISKTQPDFDEFLDAANFCYNTSVHASTGETPFFLMFGRDPIFCVDQIIDPKVRDPIAISDRNEFKQKLVVAIRHAWHAAADEYAKAQRKMKEQYDRKARPQQITIGDRVLIRNYDGR

SEQ ID NO: 142581 - protein, 407 aa, Heterodera glycines
  Coding regions on vcDNA: vcDNA=SeqID_69004; Strand=+; Position=1-1224
  Homolog annotation: Hit_ID=AAN87269.1; Match level="QueryCoverage =82%, HitCoverage=13%, E-value=4e-45, Identity=37%"; Hit description =ORF [Drosophila melanogaster]
RIGCLECKREKLKPYTYPEAPNLPKERVNETRPFNNTGIDYFGPLKVKRGLETVKVYVALFTCLAIRAIHLEVAEDYSAEAFLRVFRRFAARRGVPRVILSDQGTNFIAGAKVIKENWTTDLLTLEVQEQLAHQGITWNFNTAHAPWKGGTWERLIGITKNALRKSIGRRLLTFDEFGTLVVEIEAIVNHRPLTFESDREPDPVLRPVNFLIPYGSTETNFPSMATDPEDPEYTPNPNKLKTMLQKADSRLNSFWEIWRSDYLLSLRERANQRLNNERQTPNEGDIVLVEEEANPRSVWSLARVLKVQIGRDNKSRSALISHKGKEKWRAVNQLYNLEIQPEFPEIHSTAFVMSNLDNDIDSVSLAGSEDEMPQPKNKFRIPKRKRAFLRPIPQQHSPLQGPRRKRR

SEQ ID NO: 142582 - protein, 34 aa, Heterodera glycines
  Coding regions on vcDNA: vcDNA=SeqID_69005; Strand=-; Position=1-102
HDREGGAQSTFLFLREFLNLYSIPEKWLSLFLIN

SEQ ID NO: 142583 - protein, 56 aa, Heterodera glycines
  Coding regions on vcDNA: vcDNA=SeqID_69006; Strand=-; Position=1-247
SEKTYIDLSDFAFRLRPIDRSSAYPSPPLPHQIIPSIHTHSHLILFCMLRLPNYVN

SEQ ID NO: 142584 - protein, 271 aa, Heterodera glycines
  Coding regions on vcDNA: vcDNA=SeqID_69007; Strand=-; Position=1-5,57- 504,555-835,896-977
IMVHRSLRHRFLRLNHQIFDKRGINYILCIPSPHNTDGQRIWDIIVREIWPIFSTNIRCLGFTGGDHLDHLRRLTSPTILTDLNQLNSIHSYGLLPEAIDDDFNGTNATISAGQILYKWLHIPRKDGQPKRLRCDDYNTQANTDWINNFKEHFRRANAISSVSYEIHFSVRVPSMQMVPFELVNEWTKEKLTLAKAKGWNNRWIMKRCKIIGETAAVQQQKKEENWDNNWDNVFIWLYICNNSIGQLSPPPEEVEEEAAQNITKGPSSDNE

SEQ ID NO: 142585 - protein, 73 aa, Heterodera glycines
  Coding regions on vcDNA: vcDNA=SeqID_69008; Strand=-; Position=1 -120,246-347
MSAHAELIDSKILRQDLVHLSPVCPQGFFCQFSAIHKTSHGDSGSPLLREIGGSLYAIGIVRGHESKKSKSGN

SEQ ID NO: 142586 - protein, 88 aa, Heterodera glycines
  Coding regions on vcDNA: vcDNA=SeqID_69009; Strand=-; Position=1 -156,212-322
MHDFVLPVKASEMQVTVGSKDITKGTVHEVARIKRHEFYRLTSSANDITLLELKDVLECGPQITEFVFQINNHGVERQQQSSAGERQN

SEQ ID NO: 142587 - protein, 89 aa, Heterodera glycines
  Coding regions on vcDNA: vcDNA=SeqID_69010; Strand=+; Position=1 -127,818-960
MCRIGIVIVIGIAINRILGHNRNRIIVIGFALKSDYYTPKNCELWAKTACQTKTDPLTKLASTKTAQTKNRQTKLTQSVQDHHLMPCST

SEQ ID NO: 142588 - protein, 209 aa, Heterodera glycines
  Coding regions on vcDNA: vcDNA=SeqID_69011; Strand=+; Position=1 -279,332-682
  Homolog annotation: Hit_ID=AAL78214.1; Match level="QueryCoverage =71%, HitCoverage=75%, E-value=1e-12, Identity=30%"; Hit description =putative esophageal gland cell protein Hgg-20 [Heterodera glycines]
WICNDVWMDIFPSFDRPQLGLKLALLSPRFNALVDKHFNGKSELAIWRRIEIRRKDKGPETKLSVQIGDKLVEFPLPDRPLPSKIRFKHLQIEYIDHSVIAFLRSNHQIFDKRGTNLYLWIPSPHNTNGQLIWDVFVREIWPIFSTNIRHLGFNDGDHLDNLLRRTSPTILTDLNQLNSIYSHRLSPAAIGDGFDGPNSTISAGQVLSK

SEQ ID NO: 142589 - protein, 224 aa, Heterodera glycines
  Coding regions on vcDNA: vcDNA=SeqID_69012; Strand=+; Position=1 -250,419-843
  Homolog annotation: Hit_ID=NP_729778.1; Match level="QueryCoverage =70%, HitCoverage=8%, E-value=1e-18, Identity=35%"; Hit description =CG32096-PB, isoform B [Drosophila melanogaster] gb|AAF49967.2| CG32096-PB, isoform B [Drosophila melanogas
MRSPQWSGAQLDLSDSHGRPAAMHGIEAGHSSTVALLLERGSALFARDSHGNTMLHLLGRHPNKCLIYRLSEDGLSLEDKNKEDLRPIEVAIRAGQLVAVDTFLRRGARLRSLTWQIALSSHPPLVLVLLRKLLDDAQILLRRKRTAEAQHRLSYALQKCDELLEKAEAEDNEALRRMGPQLRRVKVGEGNEIFKKQMEKWTRERERGEDEGEEREERNGTGIG

SEQ ID NO: 142590 - protein, 61 aa, Heterodera glycines
  Coding regions on vcDNA: vcDNA=SeqID_69013; Strand=+; Position=1 -72,406-519
MERMEEQQIGRTFHFDASTEWWNLYVQNLTVPMMDDICHKVLDSIAPANGEDAPMANGTKN

SEQ ID NO: 142591 - protein, 80 aa, Heterodera glycines
  Coding regions on vcDNA: vcDNA=SeqID_69014; Strand=-; Position=1-323
FLPGGTQFFTLTTPALFFFNYFFHFITQRSRLIRSSPNFAGKLLRTLQMLINFLRIFCLEEHSSSHLPHQHYFFLIIFCI

SEQ ID NO: 142592 - protein, 87 aa, Heterodera glycines; identical to SEQ ID NO: 132477
  Coding regions on vcDNA: vcDNA=SeqID_69015; Strand=-; Position=1 -217,381-951

SEQ ID NO: 142593 - protein, 84 aa, Heterodera glycines
  Coding regions on vcDNA: vcDNA=SeqID_69016; Strand=+; Position=1 -123,175-306
  Homolog annotation: Hit_ID=CAE74963.1; Match level="QueryCoverage =89%, HitCoverage=17%, E-value=4e-18, Identity=53%"; Hit description =Hypothetical protein CBG22854 [Caenorhabditis briggsae]
MFLAVPVVERQLQNDLAVNGKVWPRGALAVVAPILIHHNEQVYPNHWHFDPDNFLPEKMAKRNAFDYIPFSWGPRNCIGNYWII

SEQ ID NO: 142594 - protein, 55 aa, Heterodera glycines
  Coding regions on vcDNA: vcDNA=SeqID_69017; Strand=-; Position=1 -94,380-453
MIPSMLNLDASGKSYGVDQKLIIFMVINFQPSLSQDFFGALYFSRKTVTCLGNIK

SEQ ID NO: 142595 - protein, 45 aa, Heterodera glycines
  Coding regions on vcDNA: vcDNA=SeqID_69018; Strand=+; Position=1 -63,117-191
MAFFTIFLSIGIIFLANIISRAFPCDNKVVYVPGERCCHGTDNFK

SEQ ID NO: 142596 - protein, 182 aa, Heterodera glycines
  Coding regions on vcDNA: vcDNA=SeqID_69019; Strand=+; Position=1 -110,164-602
MARCVTSLAFLPIGDLTPGIIALDMALPDELTPVLDWFIMNYTGRLKNDGSRTRPRFDPNTWSVYTRTMQGDDRTNNHSEAANRRLQCSFACSHPSIWRFIDLLRKDQKLSDDDFAKCSTGQEPPQKAKKYREADRRILTMVQNYLPLNNGDTNIFPIHQPFNHHFIITFLIGISRNYEMRP

SEQ ID NO: 142597 - protein, 223 aa, Heterodera glycines
  Coding regions on vcDNA: vcDNA=SeqID_69020; Strand=+; Position=1-671
  Homolog annotation: Hit_ID=NP_608540.1; Match level="QueryCoverage =99%, HitCoverage=64%, E-value=2e-29, Identity=36%"; Hit description =CG2839-PA [Drosophila melanogaster] gb|AAF51469.2| CG2839-PA [Drosophila melanogaster]
MRNRKWKRKWKRNRKWKRNRKWKRNRKRKRRRGTESGRETESGRERVRGTESGRESVRGTESGRESGSGRGTERGRESGRGTESGRESERGTESGRGTESGRERERGTESGREIGREEEEQKVEEKVEDEQKVEEEQKVEDEQKVEEEQKVEEEQKAEEKVEEEQKVEEEQKAEEKQKWKRNRKCKRRRGTESGRETESGRGTESAREEEEQKVEEKQKEEEK

SEQ ID NO: 142598 - protein, 124 aa, Heterodera glycines
  Coding regions on vcDNA: vcDNA=SeqID_69021; Strand=-; Position=1 -63,115-188,245-479
MSTTDNQQQQQQTVIELTPEEEPFGKLGGQSAKNGGNEVTRKRRSSANANDGDANEMREGAMSESSSLKSNVSQSKMRKMVEDPLNEIRSGLMEAMNANDGDGSEVADSGRTSAETLAGEGPQK

SEQ ID NO: 142599 - protein, 43 aa, Heterodera glycines
  Coding regions on vcDNA: vcDNA=SeqID_69022; Strand=-; Position=1 -50,127-358
HPGGWVPKIGIRQIYKREYPKFLRSFSKYVLDKANGTALALPL

SEQ ID NO: 142600 - protein, 515 aa, Heterodera glycines
  misc_feature (356)..(356): Xaa can be any naturally occurring amino acid
  Coding regions on vcDNA: vcDNA=SeqID_69023; Strand=+; Position=1-1571
  Homolog annotation: Hit_ID=NP_507613.1; Match level="QueryCoverage =96%, HitCoverage=21%, E-value=1e-68, Identity=33%"; Hit description =predicted CDS, RNA-directed DNA polymerase  and Integrase, catalytic domain containing protein family mem
HLWSLESIGIRDPLDSNDDELASDLFRDSVKFEGRYEVGWPWRPGGKIKLSNNFFLAYSRLSGLSQKLRSNSFREKYQATIMEQFKKGIIEPAVRTGGNEHFIPHHAVVTKKLRIVYDASAHEKGKASLNEMLIPGPNLVPELAGVLLRFRSSAFPVLGDIQKAFLAVGLRDEDREVAKFLWLKDPSLPLTHENLVVYRFKRIAFGVNSSPFLLASVLQHHLTLNGDPLGKRNFYVDNLLLCSETATEAAKAVHIARQVMTRAGMHLHEFVAADPRVTSPPKKFWWAMYKEFWGFVGTQEKIFFEFPAKSNFPTTRRGVLSTIASLFDPLGLCSPCLVKAKMFFQSLWDSAKGWDXSIGPKLEKNWVAIISEWDCPPVTFARYTPCGQASLQLHVFSDAGPNSFASAVYLRSALNGSVRVSLLFAKSRLRPKKFKNDGFTIPRLELLGLITAIRAKNFVVSNLDFSFENIYFWADSQIVLSWLASTASQPIFIANRLAEIRKEKGAFFKFVRSTD

SEQ ID NO: 142601 - protein, 30 aa, Heterodera glycines
  Coding regions on vcDNA: vcDNA=SeqID_69024; Strand=-; Position=1-93
FLTVAIKEKLPTEIKAQLYDKEMEEGGPWT

SEQ ID NO: 142602 - protein, 87 aa, Heterodera glycines
  Coding regions on vcDNA: vcDNA=SeqID_69025; Strand=-; Position=1 -143,213-333
IKIGAGAGHGPYFAGPRKAIPNCLVKLRDYRQESDPTFLPTRGNSYTNIRTRLFFVVLPNQKVHIPHQHPCTANASSDPTICQRPTF

SEQ ID NO: 142603 - protein, 53 aa, Heterodera glycines
  Coding regions on vcDNA: vcDNA=SeqID_69026; Strand=+; Position=1-352
LFFENFFVFFSAGTASDNVFYLFRKIIFFFLLIYFNYISSLNFLINIFKLSPY

SEQ ID NO: 142604 - protein, 53 aa, Heterodera glycines
  Coding regions on vcDNA: vcDNA=SeqID_69027; Strand=+; Position=1-324
LFSKYFLSFFSAGTASDNVFYLFRKINFFFLLIYFNYISSLNFLINIFKLSPY

SEQ ID NO: 142605 - protein, 101 aa, Heterodera glycines
  Coding regions on vcDNA: vcDNA=SeqID_69028; Strand=+; Position=1 -83,212-337,393-489
  Homolog annotation: Hit_ID=CAE62813.1; Match level="QueryCoverage =78%, HitCoverage=9%, E-value=5e-12, Identity=43%"; Hit description =Hypothetical protein CBG06989 [Caenorhabditis briggsae]
MPLEMEKAASKVAECLGSIELREPRVNVYSNFTGKCHTRRLTQMRTDIARQVNNPVKWEQIMQILFNKTKTKNSLRILRLAPAANWAQFCTKLAKKLQEHM

SEQ ID NO: 142606 - protein, 25 aa, Heterodera glycines
  Coding regions on vcDNA: vcDNA=SeqID_69029; Strand=+; Position=1 -24,92-145
MDQRLDDPQALEENGRDNFFNILLH

SEQ ID NO: 142607 - protein, 51 aa, Heterodera glycines
  Coding regions on vcDNA: vcDNA=SeqID_69030; Strand=+; Position=1 -78,182-259
MWTNLFLGSSDDDGYVVDGFLANWITSNGDRVQRNLGIDGELLAEDEFVNS

SEQ ID NO: 142608 - protein, 136 aa, Heterodera glycines
  Coding regions on vcDNA: vcDNA=SeqID_69031; Strand=+; Position=1 -244,1396-1562
MATEDLKNGNLSTKTKSEMAYPSANERNEVISPAIAVVQITQHHLCTTHRVENAFNACIIASCNSLSLVKLAFPVASIRTDNFANKSLRFIWQNASPLFESEEFLQIDQNLLGEILGLDQLVINSEFAIWQVVILN

SEQ ID NO: 142609 - protein, 86 aa, Heterodera glycines
  Coding regions on vcDNA: vcDNA=SeqID_69032; Strand=+; Position=1-262
KEWQQNYAEICEKIGVSHSAIRKWRKQFGMSKSLTEKEKMEKMKIYWQIKGEMPKMSDKEIGKMMKITSRTIAYWKKQFGEGIVDE

SEQ ID NO: 142610 - protein, 72 aa, Heterodera glycines
  Coding regions on vcDNA: vcDNA=SeqID_69033; Strand=-; Position=1 -59,481-544,948-1016,1290-1316
MVNKMGVAANKSNLIMQPLEYKYENVHMEIMHSCAGGEPKKISIHIPTIDKFEKNMMINDHVMQKKYEEFLG

SEQ ID NO: 142611 - protein, 19 aa, Heterodera glycines
  Coding regions on vcDNA: vcDNA=SeqID_69034; Strand=-; Position=1-59
TFSFSSLALPNTHTIFEML

SEQ ID NO: 142612 - protein, 19 aa, Heterodera glycines
  Coding regions on vcDNA: vcDNA=SeqID_69035; Strand=-; Position=1-59
TFAFSSLALPNTHTIFEML

SEQ ID NO: 142613 - protein, 19 aa, Heterodera glycines
  Coding regions on vcDNA: vcDNA=SeqID_69036; Strand=-; Position=1-59
TFSFSSLALPNTHTIFEML

SEQ ID NO: 142614 - protein, 19 aa, Heterodera glycines
  Coding regions on vcDNA: vcDNA=SeqID_69037; Strand=-; Position=1-59
TFAFSSLALPNTHTIFEML

SEQ ID NO: 142615 - protein, 19 aa, Heterodera glycines
  Coding regions on vcDNA: vcDNA=SeqID_69038; Strand=-; Position=1-59
TFAFSSLALPNTHTIFEML

SEQ ID NO: 142616 - protein, 19 aa, Heterodera glycines
  Coding regions on vcDNA: vcDNA=SeqID_69039; Strand=-; Position=1-59
TFAFSSLALPNTHTIFEML

SEQ ID NO: 142617 - protein, 63 aa, Heterodera glycines
  Coding regions on vcDNA: vcDNA=SeqID_69040; Strand=-; Position=1-741
QLMSLFGFFFKQFSVIAHQLLGVQQRRHLHPMQLFTGSLTLFLFFFYLFSERSYNNFSQQFCI

SEQ ID NO: 142618 - protein, 117 aa, Heterodera glycines
  Coding regions on vcDNA: vcDNA=SeqID_69041; Strand=+; Position=1 -130,372-593
MTQRVNELKLEEGQATVGHGRGEWAKQLVEERKTKAEQMQQRNEYGNSEGSGLNCTSANAMRIPLSSVFEGISTEGQKIDNEEKERTNEEETKKRKKGQEIVEERKGEKQQHNVEKE

SEQ ID NO: 142619 - protein, 291 aa, Heterodera glycines
  Coding regions on vcDNA: vcDNA=SeqID_69042; Strand=+; Position=1 -55,628-756,1062-1156,1526-1630,1675-1712,1943-2094,2772-2858,3775 -3927,3978-4037
  Homolog annotation: Hit_ID=CAE75082.1; Match level="QueryCoverage =93%, HitCoverage=48%, E-value=1e-95, Identity=56%"; Hit description =Hypothetical protein CBG23000 [Caenorhabditis briggsae]
MEHTKQPLDEYMAQFKNVCWIEPLLDRIHKNASTVVCPVIDVIDDNTFEYHSSKAFFTNVGGFDWSLQFNWHPIPERDRKNRRHIDPVPSPTMAGGLFSIDRAYFEKLGTYDPGFDIWGGENLELSFKIWMCGGRLEIVPCSHVGHIFRKRSPYKWRTGVNVLKRNSIRLAEVWLDDYKKYYYERINDQLAPTPMQILQMVFEQHFPGAVHPWRCCSEGRGIPTFIHSFIRSFICQIANGAMVKHQRLCLDCAIKKRDKLKPVGLWPCHGQDSQWVCAAGRLGHRVLCGQR

SEQ ID NO: 142620 - protein, 286 aa, Heterodera glycines
  Coding regions on vcDNA: vcDNA=SeqID_69043; Strand=-; Position=1-858
  Homolog annotation: Hit_ID=AAA59875.1; Match level="QueryCoverage =60%, HitCoverage=63%, E-value=3e-16, Identity=33%"; Hit description =mucin
MSNSFFVFLPSNVSDYPDNQPNKFRVRLPKPLHFNGSWVCGLHSISYPYSWSTIGTLDAQWIDIHFTDRRATDEDRQRVIRVPVPKASHSRVEQLRDFLAVTLRNRSGAKLLPTPREVEANRNRTKLLDSPPPLKREKRDVSSPPVFDASGKRLQDSPPLYNINEDERLEESPPPFEETKISAAPPPPVTSPVKPTTTVKTPAAPAAAPSATAKPATQSTVTKQAPQSPKPTAKPTTATPVKSTTAPPPTVKTTTAPPPTVKATTAPPPTVKATTAPPPTVKTTTE

SEQ ID NO: 142621 - protein, 75 aa, Heterodera glycines; identical to SEQ ID NO: 138893
  Coding regions on vcDNA: vcDNA=SeqID_69044; Strand=-; Position=1-228

SEQ ID NO: 142622 - protein, 75 aa, Heterodera glycines
  Coding regions on vcDNA: vcDNA=SeqID_69045; Strand=-; Position=1-228
MIGRAVRNLPFIFEGIFKFILYPRKMAISFFEKFYTSQKRLRMRRRAVHNRHFISQRIFIFRGYPRKMAISFFDK

SEQ ID NO: 142623 - protein, 27 aa, Heterodera glycines
  Coding regions on vcDNA: vcDNA=SeqID_69046; Strand=-; Position=1 -43,132-172
MRGAKAPLEAAKRPKTALNAIQNLFTS

SEQ ID NO: 142624 - protein, 67 aa, Heterodera glycines
  Coding regions on vcDNA: vcDNA=SeqID_69047; Strand=-; Position=1-204
  Homolog annotation: Hit_ID=CAA33463.1; Match level="QueryCoverage =95%, HitCoverage=1%, E-value=5e-12, Identity=57%"; Hit description =twitchin [Caenorhabditis elegans]
VNTHPVYDCAYTDERVKPGHCYYYRVVAVNEAGLDKPSDQSELAWAKPKFEASRFELDDINGKEVID

SEQ ID NO: 142625 - protein, 501 aa, Heterodera glycines
  Coding regions on vcDNA: vcDNA=SeqID_69048; Strand=+; Position=1 -135,175-259,298-426,681-805,846-1089,1132-1359,1573-1700,1742 -1946,2143-2282,2323-2409
  Homolog annotation: Hit_ID=AAO61963.1; Match level="QueryCoverage =23%, HitCoverage=44%, E-value=1e-08, Identity=34%"; Hit description =DNA polymerase [Aster yellows phytoplasma]
MVDELISSTKIDTNKNSYGIEDLIVIQNYFDTKFPNRFLIVAFSKEHGLKPIFKGQGHREHLICVFNENGHWDGLKSIKQFFNVKYKYCVYCEQTFQSTTKHSIKCIIKCSRCGSWGEKICKVCKTKHTKTESCYIRKIKVPNKLPKYRIICYDVECSTDNRIKEGKYFGFYEHKINFISARYTCSMCEGVNINCQICGPKGNRHKKWCTNETQKPMIEFLKWVLSFKQFNTYCYAHYAGRYDAHFVLKELTNLGYAPQLIISDLKIYQIKIDKIYFRDFWLLSQIKLADLPKTFGMNCAPKLYFPYKYNSEKNYEEQLEIYCGQDTEILLQAVLHMRRIFLEITTDNESPNGFDIIKDVTTIAGAAMRIFRAKFLKELHLPIVPENGFEKRDTQSVIATKYFEWFMYKNAVKGRHAGNGGEIEISGCPKCFKSFHVCPNGNTAEENFLKTGNRMQKLRKVALEYKLKVEEVWECEIKIKLNPKNKSYDKEMKNFFDNCPD

SEQ ID NO: 142626 - protein, 97 aa, Heterodera glycines
  Coding regions on vcDNA: vcDNA=SeqID_69049; Strand=+; Position=1 -57,98-185,832-868,910-979,1639-1680
MQKLRKVALEYKLKVEEVWECEIKIKLNPKNKSYDKEMKNFFDNCPDKALELGYVIDKFYRAYHFEEFDSDLFKGYVRKFLKIKIVSFTNIPWAKLL

SEQ ID NO: 142627 - protein, 31 aa, Heterodera glycines
  Coding regions on vcDNA: vcDNA=SeqID_69050; Strand=+; Position=1-93
MPSNFIKYQSFLSGNKNEVLTIKELIDCRLK

SEQ ID NO: 142628 - protein, 73 aa, Heterodera glycines
  Coding regions on vcDNA: vcDNA=SeqID_69051; Strand=-; Position=1 -174,217-264
MTQEKLNYNNTMLLLLGLLFVVIGQCLAENLPTIVAKKNFDATIEAEKLSAAIREMNTSNIIAIICSINNNQV

SEQ ID NO: 142629 - protein, 223 aa, Heterodera glycines
  Coding regions on vcDNA: vcDNA=SeqID_69052; Strand=-; Position=1-672
MKLCLLFFSIVFLIIKIEIGAEKEKAEQKTFEEIFGEKWEEKENEQKKREIIQKYYQIKERIKQKGRKYSSKEWNKIELKIAKKLGTKRHKIYKWIKELGIYKWHNKSKTDVQKIEIVQKFNAMKNEYKQNGRKYSTKEWKRNYAEIGKKIGVSYVTIQKWKKQFGMGEGMTEKEKMDKMKMYWKMKRENPKMSDEKISKILKINQRTIFKWRKQFEEELNED

SEQ ID NO: 142630 - protein, 128 aa, Heterodera glycines
  Coding regions on vcDNA: vcDNA=SeqID_69053; Strand=-; Position=1 -139,617-864
MAKGEGRTDAVEEDELAKGKTKMHPKWAAGRSEADEGEEDEAEDEAEIRTNWTGGERRREAEENGEEKWTNKVRRTEAEEREGDETSTESAKLRSESAATEETEEAEEGRRSEGGRRSRRTKPKPDIV

SEQ ID NO: 142631 - protein, 70 aa, Heterodera glycines
  Coding regions on vcDNA: vcDNA=SeqID_69054; Strand=+; Position=1 -94,156-274
MCGKKEMIDRQNPIDILISDGEYGDVIVDYFDFALSNDTKKIGFVRTWKKLLYKNPGLSIDWTHKGRLDR

SEQ ID NO: 142632 - protein, 51 aa, Heterodera glycines
  Coding regions on vcDNA: vcDNA=SeqID_69055; Strand=+; Position=1 -65,420-510
MKSDEKRRQKRMDNNNNNNGVRTDSNHIFFICDFVFDDILFPRMSLCFFQF

SEQ ID NO: 142633 - protein, 159 aa, Heterodera glycines
  Coding regions on vcDNA: vcDNA=SeqID_69056; Strand=+; Position=1 -260,475-694
MPPSENLFNISLNVNDLEARPLPEPQQPEQQQQPQQQQAELLIQIGDVEDALLLNVHEGEERGEEAEQEEEEHNVEQIEELMRLHADYFIFVKYPMRQKSSPRKIVNPDNNNNNNNNNNVASSYSDRLKKFANDEVKKALIEIEEERNKKKQKQRQEKQ

SEQ ID NO: 142634 - protein, 853 aa, Heterodera glycines
  Coding regions on vcDNA: vcDNA=SeqID_69057; Strand=+; Position=1 -238,378-2171,2217-2530,3042-3257
  Homolog annotation: Hit_ID=NP_507780.1; Match level="QueryCoverage =47%, HitCoverage=27%, E-value=1e-38, Identity=29%"; Hit description =predicted CDS, DNA polymerase type B, organellar and viral family member (5T899) [Caenorhabditis elegans]
MFHDLQEGQCVFNDYVARQRFHGPEASHLLRRAGIDVNKYMYTLEDVGRLQQWVDEHYGEGQIRLTVFEKEQQYRIVFKGYCVDCERRVTRKYHPQECKVVCRLCLRFGVDYPCQQQQFPDGSNSKRQCLQCQFVFPNLDCYNYHLLNRAPATLDGRSGRRFSPICEWRRICRICGGIIYATFEHICLRGIRQQQQQQQQCLQCWGEHGQAEPCFIQPLDEFRAPRRSNQQLQQQQHEQRQERTIENDVDADEDEDDSECDDSEENNRGPINGRRSRKLKPIRYCFFDAETSQDQPLQLRTQVAQKHVPLLIIAEVICERCIAAGITVHAGVGQKANGCVCGTPTGPRGRQWCSPPFRNAPGDNTEMPIHITYNQRRLFFHCFDDATKNPVDQLLDFLISTGPRKSHTICLSHNGGKYDMHLVLEALHQRNLPPKRICTTGLKIYSMTLKGNLQRQVTFKDTLNFFFCELDALPRTFSLPNNIATSKPFFPYLYIRHQNLNVRLQGLPGIEFYQPDHMKTAKREQFLRWYAVERTAAKFQLREQLITYCANDVAILRESVLKFRELIMENTRGLDPFVIASTGAGLALATFRRCFLARNKLVNTPEGGYLRGRRASAESARYIRMYELMNPGVHVQSAQWSVGEAHVDDTGYRLDGLHVRSPPQRNVAIEYMGCYYHGCPKCYPNERQRHLAGGRTAEELYEQTQRRLWELEHTHGLELHVIWGCELKKNLRTNPMLRQLYNDAFVPRPLDPREDALRGGRTEPFTLQHVCTQNEEIILIDIVWHYDAWDGEMFRGYMNTFVGMKVQASGWPAGCENEQQRAEYIVDFERVEGFRLAREKIGNNPGLRMVAVS

SEQ ID NO: 142635 - protein, 258 aa, Heterodera glycines
  Coding regions on vcDNA: vcDNA=SeqID_69058; Strand=-; Position=1-777
MLFSFFLFQFYSVVCSIASKRSPEPWGDTLKSIDDNARDFKWPDRHEKGTWAAVAATGEGSRAKAETGVNREEGSGMEEEEDSHIVRAEALSEREGGVAVAAANKGQTQKTSDDDNDYHDGAHQQVVVMARGGEDARAKAEASGGPRSVVETRISDNQRGGERLALGSAIIHRQGRRRGGGGGGRNRNRQRGKEEQGRGRRPIANDKFHPRPPQYMELNNRQKGNEQVTLNNNVHTMSPVSYPYLLRKQVGRECFCTC

SEQ ID NO: 142636 - protein, 225 aa, Heterodera glycines
  Coding regions on vcDNA: vcDNA=SeqID_69059; Strand=-; Position=1 -213,254-583,632-766
MATDWIHNAYPEYEQSGGGGGGGEENNESNDAAIADGINWLRVIDEEDEEEQNKRRNGNTMKSDEEAAAPETNNSNSTSNKCHCGRSGPYSQQQQQHEAQEIEMPLIEHLCERYKCSAKELQVLLQNLKTRRQILQYMRFNVRLRTNYLRPAIRNFVVQCSDLSTLSATDAFAMRGYLGITVRIYYYVKHGLRLRHPNLPCVVRLGGGEHYDLFPLECLNVVKQN

SEQ ID NO: 142637 - protein, 152 aa, Heterodera glycines
  Coding regions on vcDNA: vcDNA=SeqID_69060; Strand=+; Position=1 -403,600-655
MGSIGGVPVNTHAGAPGEEIVKQKARDVGGKLLMVLDDLMIGIGQNFLDTIFTRGSHNWGVSVVLVTQHMFTKELRIARNNSHYLVLMRNPAGALQVRTLATQLFPGRAEHFMEAYRDATGKQFGYLVVDMHPENTTTNVTGGDKRTIIMFC

SEQ ID NO: 142638 - protein, 1031 aa, Heterodera glycines
  Coding regions on vcDNA: vcDNA=SeqID_69061; Strand=+; Position=1 -727,1009-1787,1833-2079,2371-3324,3538-3926
  Homolog annotation: Hit_ID=AAA93301.1; Match level="QueryCoverage =28%, HitCoverage=82%, E-value=4e-44, Identity=35%"; Hit description =HASI
MRMFLVPEDLFNSVINSSKAPADGTALGLVRQRLHQIERNRNMDENERLANYHQEFKRLNKIVREQEERPMDVRLQNINEIMSAIPPPPSPNLSGPLQTFHPPQNTGTKTKSVASTKPFRIVNKRKSIKEKLLRKKAKKSYFNTKNGDENEDDDDGEDDEWGRNSAEKEDQTMRQQQQTSSSAFPYKLRSGSAAEGEEPQKGTKKSKNAPNQKLVAILEHIKKNAEALGVTADGKILRRVSTTIIMVLEKKKRTILDHLYKDINSPVSYTSMVPLLNEARKTNSSIKRRDVEEYLAEQPSYTLHRQAIRRFKRLPTLASGLHTDWQADLAVFDRLAPQNKGFRYLLVCVDTLSRQLFVEPVKSKKSEDMVHAFDRLFAHSKYIPWKLVTDQGLEFTAKRMQTYFDSKNVKHFCMYTSPQFHAGIAERANRTIKERLFRYFTARQTQRWLDVIQDIVNGINHSYNSSIQMRPVDVTFRNADTLREKLANEAAMSRPKRLPRFHKGYVGRFTSEIFKVDSADEGRSPVTYRIRDADNELIKGRFYASDLCRVRKNTHQDGEKLYDIEKVLRKKKKDGVEYAYVKWKELEWKTGNVVTIPVPSSNIIRPYELSKSLYSLLDISSEHLSNQVHDAQQSYKRAMNAARKHAQREYLNMKSDLDRARPKRSKISAGDDAIPLLTSLLVAVDTIADALIYNEDGTANSMLTADALLDREKRAATSNVPLRRDSDSDEEYQKKLDNYFMKIRDTDDLQLYRELVAKHLELELNKLTKDQLSLNNSIKDLGMDAWIQAYRKVSSVLQFIFDVQQNRFTLSINTKFIKRVKLSEQLAYILGFAPQTEFKRSKNPAKFMPDMSGGVSTLHVYVPDLIVPMMIGNVIAPIMRITTIRGNPDEMVEEQFYSIQYHPDKIMFSPRSSLLPQCFVANIDTSDMIGTHWVAFYCDRIGRIEYYDSSGVWPPISEHISNFLSKFPSVRYNRVPLQSPYARSCGKHVIFFLHHRCLQCSFDEIVQQLWLAKQSPDTIVNTFAREKIFRI

SEQ ID NO: 142639 - protein, 198 aa, Heterodera glycines
  Coding regions on vcDNA: vcDNA=SeqID_69062; Strand=+; Position=1-597
MTSLYACGGLHYTRRRISLYTCGGLHSTLAEDFTLRLRRTSLYAAEDFTLRGGGLHSTRRRTSLYATEDFTLRGGGLHSTRRRTSLYAAEDFTLRGGGLHSTRRRTSLYACGGLHSTLAEDFTLRLRRTSLYAAEDFVFTLRQRRYFSLSLSRRGGGLSLYACGGVSACPGIELPLTKSLSNTLHGPLTNCNANNIST

SEQ ID NO: 142640 - protein, 253 aa, Heterodera glycines
  Coding regions on vcDNA: vcDNA=SeqID_69063; Strand=-; Position=1 -258,605-805,872-967,1278-1484
  Homolog annotation: Hit_ID=NP_649008.2; Match level="QueryCoverage =56%, HitCoverage=23%, E-value=3e-14, Identity=44%"; Hit description =CG32190-PA [Drosophila melanogaster] gb|AAF49304.3| CG32190-PA [Drosophila melanogaster]
MPAQLQPVSVQQAMPAQLQPVSVQQAMPAQLQPVSVQQAMPAQLQPVSVQQAMPAQLQPVSVQQTMPTQLQPVSVQQEQPTQQQATQQQQIQLQPPVQPAVQQQTLPMNVQMPTAQFESFLVQMPQAPPPVLQTQQGQPAQQPDDMFRLIGENEEAAPGILSTSGRSGGGGGGGGGGVNGLDPSMMGNRHLARSPPPPPPPPGLTRTELTQIFPVVEVDEAIAEEICTICQEHLVATSLEATVTPCGHYFHFD

SEQ ID NO: 142641 - protein, 193 aa, Heterodera glycines; identical to SEQ ID NO: 134779
  Coding regions on vcDNA: vcDNA=SeqID_69064; Strand=+; Position=1 -178,219-493,537-665

SEQ ID NO: 142642 - protein, 286 aa, Heterodera glycines
  Coding regions on vcDNA: vcDNA=SeqID_69065; Strand=-; Position=1 -277,320-602,650-950
MAQRVGFTQIKYTRTPAEFHQLLDDPTLDKLDFVHVSEHMDRVVVRKRPEFAKAPLTNCLPVAIYVTSYARLHLYSYMEKVIALEGAELLYCDTDSIYYVNKMGGRCVPEGEALGQMKREHVDRRIVEFVAGGPKNYGIRHTARDGTDERANLKIRSFRLSYATQQLLNFEAMKDLTLATYNIDGPIDDVIDNDDLYVYGGGGAHRCIRVTFPQIDRNVRSDVYTCEAHKDYRPFYAKGRVRPGMQTRPFGYVEDVSHPPIQPTAERRKRTLIDPDPTRPGYSGWF

SEQ ID NO: 142643 - protein, 683 aa, Heterodera glycines
  Coding regions on vcDNA: vcDNA=SeqID_69066; Strand=-; Position=1 -125,170-374,419-2140
  Homolog annotation: Hit_ID=NP_507780.1; Match level="QueryCoverage =91%, HitCoverage=35%, E-value=9e-27, Identity=24%"; Hit description =predicted CDS, DNA polymerase type B, organellar and viral family member (5T899) [Caenorhabditis elegans]
MYTLEDVAQLQQYINNENGVGQIRLVIFEKEQEYRIVFKGEGTAAQFNLCILLERGHFNYIGRIAQLFKVPGYCIDCERRADARYHAIGCKAACRLCFRFGGGYPCQRERLSDGQISSRKCTECGFIFPNDNCYEYHLANDAPAPIDGRGHRQRRSLCQWRRFCPTCGRVAYFGIHQCPSIRRAIGPVDCFRCKGPHMLDEPCYIQPIGVAPPLPMLGPVHNNDDNNNNNNNNNNNEDENDIDFIINNLGGEGDEDEDDVENGDDINDDDDDERDELLPLRLCFFDAETSQERPLQLNNQVAHKHVPLLIVAEFICEPCIRAGININDGQGQRAPGCVCLCGRVRGQQMRQWMSPPFVNAPGDNTPQPEGAPVFNNRRLFFHSFDNEASDPVDQFLDFLIHHGSRKAHTICIAHNGGKYDFHLVLEALHRRSYPPKRLCTSGLKIYSMKLRGMNQRRITFKDSINYFFCELDALVKSFDLPQHLATVKPFFPYLYIKRQHLHQRLDGLPPIEFYSPNTMKADKREKFLRWHCNNNGDARFQLREQLIMYCINDVAILRESVLRFRKLIGEHTQGLDPFLVSSTAAGLALSTLRRCFLPFNRLVHSPEGGYLRGRRASAESRRYIRFFELENPGAQVQCADWSVGEANIEDTGYRVDGLWRREPPLRPLAIEWMGCYYHGVLSS

SEQ ID NO: 142644 - protein, 168 aa, Heterodera glycines
  Coding regions on vcDNA: vcDNA=SeqID_69067; Strand=-; Position=1 -364,409-551
MRNTLRNTRGEVCEIRFLPLEDNERPDLVMEILIQHLLDRVLEGHPSPILVGLQLQPPGFDRPYVIRLRPPEQNNAAALAAAIERLNEQSAAGIDLLSGTTVTKVLAVWPLESVRVDAQRGGACDLDNEHHLSHNVQSIVRVVNPNDRYCLARAVLLGLCDRETQMPN

SEQ ID NO: 142645 - protein, 56 aa, Heterodera glycines
  Coding regions on vcDNA: vcDNA=SeqID_69068; Strand=-; Position=1 -48,411-533
MPETDVERISRLFVDHVIQFLDPITKLGALREKYRLHFVITNEQLALLRDFGDYLR

SEQ ID NO: 142646 - protein, 167 aa, Heterodera glycines
  Coding regions on vcDNA: vcDNA=SeqID_69069; Strand=-; Position=1-504
MKRSTRNASKRENKKSRSSDSLRQEKHQEKSQNCIKKIDEYTTSSKKFQLLRSKSKFVVQNIDQCDNPTKELEECIKSSINEAIEDAKRTLGGADKAGVVISSEMLDQGDIIVPITPISSNVADAVFNQFIKVEQSVVRKSLNIYGTPFVITVTVLNINGLRKKNKE

SEQ ID NO: 142647 - protein, 1017 aa, Heterodera glycines
  misc_feature (237)..(237): Xaa can be any naturally occurring amino acid
  Coding regions on vcDNA: vcDNA=SeqID_69070; Strand=+; Position=1 -639,757-1943,1971-2110,2138-3194
  Homolog annotation: Hit_ID=NP_001004509.1; Match level="QueryCoverage= 100%, HitCoverage=69%, E-value=1e-119, Identity=29%"; Hit description= si:busm1-180o5.3 [Danio rerio] emb|CAD60788.1| novel protein similar to DNA polymerases [Danio rerio
LYHNNNHFDGIKTLSKFFNKRYYCLSCESVYERKSQHSMNCSSLCHGCNYPCEPQQGYFKKCLHCNNYFYNNDCYEPPPQGFCTKFQRCEDCGVIYNVKVHGNVGHQCGERFCLHLKEEDGENPCKSCFIQPLKPHKLKPYRIIAYDFEATQDKNEHEVNFAAATVICTECSTTTTGTNLYKEIPAKFVAYRTITFAHFGGRYDMTMIIKEVLAQGIHNPDIIKQGNRLYELNQGQXTLPTHIMPIKLSGLIKSFGLHIKDKQHFPHMFNKSSNYDNILSHLPPREEYCPDQMKIPDQQKFDKWYNNNYNQPFNLKEKLPEYCCNDVQILTHALVELRREFKQLTQRNGKHGGIDILWQAMTIASACVKNFALNHLKPNSLAIVPEKGYTPQQQSALAIKYLDWYSHINNVNIQTAHSRYGEYVFKREGQVYQVDGYIKDGKRDKIIEVNGCLWHGCEECFEDLDEETKMRKTLGQLRERGVRKHEILRRYVDLEVWEHEINEQLKKDKQMREFFDNWKDHSPIKIRDAFHGGRTGPMKLLHTAKPGQKISYKDFTSLYPWTNFTTDYPLSHPKIISFRLNEQTPYKGLLKVLLLPPNNNINVTVMPIKFDERLTPYKGLLKVLLLPPNNNINVTVMPIKFDERLLFPLCEKCAKHITNEHPCPHFNPNDRAFVSTCPHFNPNDRAFVSTCTHLELNAALEVGYTVRKLFHVLQYDQWSDNIFKSYVSEMMALKIHATGFPSWCESEEEKKEYIEENRQRFGILLDNEKMKAEPGKRYIAKLCLNSLWGRFSMRNLLSKAIINNDPCVLRQYTDDKKIELVDLEMIDDDIFMLTYKPKEEFVDENKYSNVVISLFTTSAARLYLYEVLKKVADKILYFDTDSIIYVHPEENDPLPTGKGHLGELTDENPDHNILEFISAGCKNYGMAATQGHRCLKIRGFTLDAQTVQKIHYDTVKDQILRYGSEDPPDPIIVTYPHFIRPNLIQGKVYTHSLTKHYQPIFTKGIINDSFQVLEFGY

SEQ ID NO: 142648 - protein, 123 aa, Heterodera glycines
  Coding regions on vcDNA: vcDNA=SeqID_69071; Strand=+; Position=1-372
MSSTSSKKTLQSVVEQVIQQDAEIKSSEKPLKQNELEKSERKSTHTVYNLLDHKRSFWKLARPKFAVINFLCPGCRRINYKHKDQFKLMGEDEFHFTQVMCPGCVKYNMMQTDIYNKHTKNPH

SEQ ID NO: 142649 - protein, 277 aa, Heterodera glycines
  Coding regions on vcDNA: vcDNA=SeqID_69072; Strand=-; Position=1 -186,245-333,385-454,508-995
MLWTLMSMTTDQPNLKLSRSPCTIKARAQFAVRLGYGTTLGTAPSIAKFAPTGASTFILKMKAGFSLGRLLTFVSIYANENGQLNVQKARRVVFARAGEQDFALQGLIDGQCVPLERLADVPPAPAAVPPAAAIAPPAVVLPAPAEVPPADVEIELDIDGEQLTNFPAQQHPQQLFPAQQQQPQQLFPAQHQQQLLLPPRPLISQIVDRAVSVLQMHFHNMSPLRPAFPPFFINSPFPRLQGALELPPLQFGQQQNQHAFAPALQIAPVDDAPTPQP

SEQ ID NO: 142650 - protein, 284 aa, Heterodera glycines
  Coding regions on vcDNA: vcDNA=SeqID_69073; Strand=+; Position=1 -53,108-405,460-865,2450-2547
MQQNRRPSNSFWPRRSTGANNCPQCSIEGTKGTKKCANHCRSSPSYGNGHCVPLPTVIVLETVQHPSKMPSELHFMVWQQQGGALQKGLNTTMDTFTQKELDHGFVRFEIDEAKGVPDTKMGFHFLLNDGRHQLDPEFFLLQFDEILPSKKEDGTMPTQSTLSSTPTIHLPVPSVAIGPKIERNAKLGTAPGVPAVIGPNLLKATGGGKIPVEKVIFHLTKQPMHGRLVNGFPRTARDCCPLLFSCSTAPWGVSHIYPKYSNQINTFGHFRRFAAVPTIHSIGH

SEQ ID NO: 142651 - protein, 268 aa, Heterodera glycines
  Coding regions on vcDNA: vcDNA=SeqID_69074; Strand=-; Position=1 -156,203-370,416-524,569-767,1143-1316
  Homolog annotation: Hit_ID=CAE58730.1; Match level="QueryCoverage =70%, HitCoverage=12%, E-value=3e-69, Identity=66%"; Hit description =Hypothetical protein CBG01916 [Caenorhabditis briggsae]
CRYLGCVANRWLSVRLEFIGNCIVLFAALFAAITRGSTSAGILGLSVSYSLNITFALNFAVRQISKLETSIVSVERVKEYADVIPEAKWKIPGREPPVGWPNHGEIHFDHYSTRYRSGLDLVLYDIHATIRPAERVGIVGRTGAGKSSLTLALFRMVEPTGGRIFIDGVDITQLGLHDLRSRLTIIPQAFVDSQLVIIRPLFILGSRPLLRSYPGHNTAEVQQLHHFYNCSPSRDHYGLRPRDRFAQRANPGIRHTSKFAGPSKFNLR

SEQ ID NO: 142652 - protein, 18 aa, Heterodera glycines
  Coding regions on vcDNA: vcDNA=SeqID_69075; Strand=+; Position=1-56
YREAIPEGFGLPINLGAS

SEQ ID NO: 142653 - protein, 62 aa, Heterodera glycines
  Coding regions on vcDNA: vcDNA=SeqID_69076; Strand=-; Position=1-250
FEYPKRTLEKIDFFVFGAVPPSRCAQIYGETESFRNSFPIACTLILRWIFAPHNLLSTQTDT

SEQ ID NO: 142654 - protein, 120 aa, Heterodera glycines
  Coding regions on vcDNA: vcDNA=SeqID_69077; Strand=+; Position=1-468
PKNSYLFFLIFLPQTWYQQLPSLVWPYQTILRYLKRKQKKFLTKNGYLFFLIFLPQTWYQQLPSLVWPYQTILRYLKRKQKKFLTKKWLSLFCHFFTANLVPTVAFSCLALSNNLTIFET

SEQ ID NO: 142655 - protein, 50 aa, Heterodera glycines
  Coding regions on vcDNA: vcDNA=SeqID_69078; Strand=+; Position=1 -31,125-246
MWLTEFLEGYGNINHNVVDRISGRLRYSQGDSWSCHSLDLIFKNGRDFHV

SEQ ID NO: 142656 - protein, 54 aa, Heterodera glycines
  Coding regions on vcDNA: vcDNA=SeqID_69079; Strand=-; Position=1 -16,58-206
MDDLLEFKYTLDSDFSADFDNLFPFVSLKEFTDEIEANFGPNFKFERSALSVEE

SEQ ID NO: 142657 - protein, 39 aa, Heterodera glycines
  Coding regions on vcDNA: vcDNA=SeqID_69080; Strand=-; Position=1-117
MLFAGVNCSTNIRFATLCVEVSPCVHNDAGNEGSPLVMK

SEQ ID NO: 142658 - protein, 65 aa, Heterodera glycines
  Coding regions on vcDNA: vcDNA=SeqID_69081; Strand=+; Position=1 -20,284-353,389-496
MYVKSISAIRVLLEKSPSLLHERDPTNGNTVALKILIFFSVPFWHSSFKPIYSSTVCFFDQNYLI

SEQ ID NO: 142659 - protein, 101 aa, Heterodera glycines
  Coding regions on vcDNA: vcDNA=SeqID_69082; Strand=-; Position=1-743
LFEYPKRTLEKIDFFVFGAVPPNRCAQIYGETESFGNSFPIACTLILRWIFAPHNCLSTPNGPLKKSIFLFSGQKARSDAPRFMGRPLTTAILPYSLYFNS

SEQ ID NO: 142660 - protein, 188 aa, Heterodera glycines
  Coding regions on vcDNA: vcDNA=SeqID_69083; Strand=-; Position=1-567
IYEISFQIVHANIACCGLAVSARINRRHLDGINPEDLKLGSLVTVVVANIPQDSLVSMGYILPDSSPFKLGTERRAETPEFFGAVACIRPHLLEWPNLNANMTPKVYPCSAELTKHHVVAMEHVVGAALQIEMEREVDMMIEARFEGRARKFDGADCLIVLGSRSKKEVNELAKVWEPESQVKVFKEI

SEQ ID NO: 142661 - protein, 106 aa, Heterodera glycines
  Coding regions on vcDNA: vcDNA=SeqID_69084; Strand=+; Position=1 -94,185-241,595-651,846-958
MHAFCARAIYHRACQSKAKQQRWCFERIKGIESVNRLLEKYICNLSTILRKSVHRLLEKYICNLSTILRKSVNRLLEKYICNLSTILRSELEMIIFAIQTNFRCSN

SEQ ID NO: 142662 - protein, 187 aa, Heterodera glycines
  Coding regions on vcDNA: vcDNA=SeqID_69085; Strand=+; Position=1 -141,315-737
AEISVVTSGSSTRKENAEEVEKEDNDLRILHQKSKEKALVTEGTENNASSHAIAGMPIPTIPSSPSTAVIKKPLIQNHQQHTSPPPLMAITVPPPSLHVPPPSLALTAVPPPPLIMPSQLAMAATTTNASVAGGAAAIQKHGGPQQQQMHTHSPTAAAVDRPIGSGILHRIQCEPSSVCDRRSLRIN

SEQ ID NO: 142663 - protein, 88 aa, Heterodera glycines
  Coding regions on vcDNA: vcDNA=SeqID_69086; Strand=-; Position=1-265
EYALATFLDVRFKDKVLTENSATFRARVTVWIKNELKEWEIDNDLDGLQQNEFVRPVMSPQPENPPAKRRMSFFERLKHITGANTVNR

SEQ ID NO: 142664 - protein, 196 aa, Heterodera glycines
  Coding regions on vcDNA: vcDNA=SeqID_69087; Strand=-; Position=1 -22,313-442,652-835,881-1135
  Homolog annotation: Hit_ID=AAL93203.1; Match level="QueryCoverage =67%, HitCoverage=19%, E-value=1e-13, Identity=40%"; Hit description =transposase [Bactrocera dorsalis]
MSSIWQIAQLSFDKKILHFLVTKNISFGAVDDQTFHSLFPHQKVKSEWFYSLTAHSISKWKSLSRVLAITEFSESHTGKNIALKIEDLLLKWGIPKECVHIIMSDSAANMKRAFVERDENENRILPIPNGPCAAHLLNLAVQEAFKRDESISSLLAKTRHIVGRFKHSNTAFSELKKIQKLLDAPSHTLLQVKVKY

SEQ ID NO: 142665 - protein, 123 aa, Heterodera glycines
  Coding regions on vcDNA: vcDNA=SeqID_69088; Strand=+; Position=1 -309,1051-1113
MRSEQLKSGNYIEFANSKDTSRDMQHSDRNGKCLRTDSRPRLLCQLFRPFVRQDIRPLRVLLLGPAVAGCVRRHGPTYDGVDRRGPTLLCDVPNLVKLLNLKMPKNGTPNGANRFYNEKLASD

SEQ ID NO: 142666 - protein, 18 aa, Heterodera glycines
  Coding regions on vcDNA: vcDNA=SeqID_69089; Strand=-; Position=1-54
MRTRPIWQVKQRLLTSQK

SEQ ID NO: 142667 - protein, 191 aa, Heterodera glycines
  Coding regions on vcDNA: vcDNA=SeqID_69090; Strand=-; Position=1-573
MNLDRVFVNDRSNDNEQNLEYAYVFDNDYEVVESSYDILEEHNYSKRSRMDVVGGESQVSLNSDIGIAGPSRMSDSQFEERRRTEYLKRKRERERMRRENESQNQRVLRLEQMRDRNNSQRTEENANERRLRLEQMRNRNNSQRSEENAYERQLRLEQQRIRQRVIRQGEINVYAAGSYVNAHEHGLGLMN

SEQ ID NO: 142668 - protein, 87 aa, Heterodera glycines
  Coding regions on vcDNA: vcDNA=SeqID_69091; Strand=-; Position=1-438
LRSKSFSNNFSASIPSTIAFIHPIMSAKIIRVPKIACDLSLEKNGLSKNRNYAQKASQTILALPIPSTIAFIHPIMNAKIIRVPKIA

SEQ ID NO: 142669 - protein, 76 aa, Heterodera glycines
  Coding regions on vcDNA: vcDNA=SeqID_69092; Strand=-; Position=1-270
IHPIMNAKIIRVPKIACDLSLAKNGLSKNRNYAQKASQTILALPIPSTIAFIHPIMSAKIIRVPKIACDLSLEKMV

SEQ ID NO: 142670 - protein, 30 aa, Heterodera glycines
  Coding regions on vcDNA: vcDNA=SeqID_69093; Strand=-; Position=1 -20,292-361
MYVKSISAIRVLLEKSPSLLHERDPTNGNT

SEQ ID NO: 142671 - protein, 113 aa, Heterodera glycines
  Coding regions on vcDNA: vcDNA=SeqID_69094; Strand=+; Position=1 -157,654-718,765-884
MPIIFNFHFLLFNWIHFLAEEKQQKESVGQQNKNTEQKLDGKYAVVDKNNVLVALVTSSGDHSPSAVVSAKVAKEVPNSQQQNDWDAKVCHKDIEIIGEKQLTINCKGNRFGI

SEQ ID NO: 142672 - protein, 116 aa, Heterodera glycines
  Coding regions on vcDNA: vcDNA=SeqID_69095; Strand=+; Position=1 -23,82-409
MKVFKLESFAAIGFATKEVPLDGSIGQILNSYGYRSDGSFGCNGINRPCKMPMSLFGSSFSPVAMQSADVEMAYKSSEFSTGDVVGCGIFLDTRLIFLTKNGQRMGGPIKMKKQIN

SEQ ID NO: 142673 - protein, 18 aa, Heterodera glycines
  Coding regions on vcDNA: vcDNA=SeqID_69096; Strand=+; Position=1 -42,139-153
MELVLKITKLELKNKGLQ

SEQ ID NO: 142674 - protein, 153 aa, Heterodera glycines
  Coding regions on vcDNA: vcDNA=SeqID_69097; Strand=-; Position=1-3,66- 218,289-594
MLNSIDSYGLLPEAIAIGDDLAHTEKRWPTQAIVLHTFERQVYFDWVNNFKKQFLRANAISSVSYQIHFTVHAPSIVTFELVNEWTKEKLTLAKAKELDNRWIMQRCKIGEAVTVQQQKNDENWDNNCNNVFFLLLVALIASGSSEKSLTKMQ

SEQ ID NO: 142675 - protein, 172 aa, Heterodera glycines
  Coding regions on vcDNA: vcDNA=SeqID_69098; Strand=+; Position=1-521
KIKQKGRKYSTKEWNKIERKIAKKLGTNRTKIYKWIKELGLQQQIQKSYNSKSDEEKIEIVQKFIELTKEYKQKRKYSPKEWKQNYAEICKEIGVSHFIINKWKKQFGIRYMRITEKEKMEKMKIYSQIKRENPKMSDNAIAKTVNTSHQNIFNWKKQFGEEMFQRTTEEEA

SEQ ID NO: 142676 - protein, 118 aa, Heterodera glycines
  Coding regions on vcDNA: vcDNA=SeqID_69099; Strand=+; Position=1-469
PKNSYLFFLIFLPQTWYQQLPFLVWPYQTILRYLKRKQKKFLTKKWLSLFCHFFTANLVPTVAFSCLALSNNLTIFETQTKKILDQKMAISFFSFFYRKLGTNSCLLLSGPIKQSYDI

SEQ ID NO: 142677 - protein, 25 aa, Heterodera glycines
  Coding regions on vcDNA: vcDNA=SeqID_69100; Strand=-; Position=1-75
TCTCGVVVKLSTFHNFSPGFNSPLG

SEQ ID NO: 142678 - protein, 110 aa, Heterodera glycines
  Coding regions on vcDNA: vcDNA=SeqID_69101; Strand=-; Position=1 -268,558-622
AFSNASSRVTSVIILTLRATLVGSFLPFELINEATGEQLALEQYDTDELSSSVVQLDGFGKIGKMSGKNCVLLDRNGWTFGSETADLTRVFSTPLLPGQVVSNNEAAEMN

SEQ ID NO: 142679 - protein, 226 aa, Heterodera glycines
  Coding regions on vcDNA: vcDNA=SeqID_69102; Strand=-; Position=1 -416,476-594,673-816
MQWIKFNCTLCPIGLQCFYPRKYAKLVLCAHPSVRNITDFLSTGQLDEAATTTTTSVLPTTAETAAAAECAPPPAHLTAWIAVCTALMALLVIAQVVNFGHLSTKSIFLNLACARRIQSAQIFEGPRLQKGDAEPTSSANECRPSQLPTGERADSAYFAGNVGRRFSAPDGRQFDGGPAARQRRADGAIEEGEEPVYDEVPLDSDIVVEMRDEMGRRMRKKMTMIF

SEQ ID NO: 142680 - protein, 100 aa, Heterodera glycines
  Coding regions on vcDNA: vcDNA=SeqID_69103; Strand=+; Position=1 -96,318-524
  Homolog annotation: Hit_ID=CAE65984.1; Match level="QueryCoverage =64%, HitCoverage=37%, E-value=4e-09, Identity=51%"; Hit description =Hypothetical protein CBG11175 [Caenorhabditis briggsae]
MRLFSNFVIKCRTYQYERPDMKYGLPSPQYKHVIVTGAEEHGLPTNYIQWLRENFEDNGYDGPVEVNLKALETMPRPTKKRKLSHKKEGEAESSNMALNN

SEQ ID NO: 142681 - protein, 18 aa, Heterodera glycines
  Coding regions on vcDNA: vcDNA=SeqID_69104; Strand=+; Position=1-56
PGSRSRILKSSGSGPGRA

SEQ ID NO: 142682 - protein, 117 aa, Heterodera glycines
  Coding regions on vcDNA: vcDNA=SeqID_69105; Strand=+; Position=1 -47,537-843
MIGFRLPQNGGNCDGGKFFLLPVYESAMQRAFLCHLRQNGDIFLKDYAELWLLEFDMVRIMKQQGEIKLLVSRSCNCTMEELVMQSLTNWTCFGMTNGNFPNKMIFVCFYVFKAACI

SEQ ID NO: 142683 - protein, 91 aa, Heterodera glycines
  Coding regions on vcDNA: vcDNA=SeqID_69106; Strand=+; Position=1-366
IHPIMSAKIIRVPKIACDLSLAKNGVSKNRNYAQKAPQTILALPIPSTIAFIHPIMSAKIIRVPKIACDLSLEKNGVSKIVITLKKLFKQF

SEQ ID NO: 142684 - protein, 72 aa, Heterodera glycines
  Coding regions on vcDNA: vcDNA=SeqID_69107; Strand=-; Position=1-235
EIGPSYTEYGILPHIYFMGFIFPSMSPQNNSIFGLQMTSDRHKITSLSFKLLVITVFFFSEFFFNNVLEFIS

SEQ ID NO: 142685 - protein, 34 aa, Heterodera glycines
  Coding regions on vcDNA: vcDNA=SeqID_69108; Strand=-; Position=1-309
MFGFFWLTKTSSNLVLSILFQIAPNFFYSLTRPY

SEQ ID NO: 142686 - protein, 73 aa, Heterodera glycines
  Coding regions on vcDNA: vcDNA=SeqID_69109; Strand=-; Position=1 -50,187-279,703-781
MKLELTNKNYDEYFGHLKNQRTTAQPADEATKETETEAKADDERTNGSPVDHFLTMNALNSTALKGVQLKMKI

SEQ ID NO: 142687 - protein, 79 aa, Heterodera glycines
  Coding regions on vcDNA: vcDNA=SeqID_69110; Strand=+; Position=1-240
MKSPKGKNNTAQAVEANGNLKRNGNSGANDGKKLNGEAKAEGKVVEAEEEDEEFEGEAEQQEGGGEGVKSDQNIAMGME

SEQ ID NO: 142688 - protein, 39 aa, Heterodera glycines
  Coding regions on vcDNA: vcDNA=SeqID_69111; Strand=-; Position=1 -79,218-258
MYGKRANVATGGRNASSSTTQTEEKRGLTFIVAKKCQNN

SEQ ID NO: 142689 - protein, 203 aa, Heterodera glycines
  Coding regions on vcDNA: vcDNA=SeqID_69112; Strand=-; Position=1 -328,381-664
  Homolog annotation: Hit_ID=AAC95573.1; Match level="QueryCoverage =89%, HitCoverage=29%, E-value=6e-13, Identity=20%"; Hit description =orf 48 [Ateline herpesvirus 3] pir||T42963 hypothetical protein 48 - ateline herpesvirus 3 (strain 73) ref
MTPPPFTALQFALFGYMILLNAFVPSDTNLSSKPKSDAVEQVDHEHDHRNSKNETDQEVNKEQQFNDRDLDHENDEDNDREKNKKEKDSHENGNGQTSDEEQNGEKDGKSYKNRHSKKYLTERQRILDRLEKLDKSIVKQPAEHNENRSNFANHGSHQKTTDQEGNNEEHDDQNEKSDQEKKQNDEDDVEQKEKKGGEKSNSH

SEQ ID NO: 142690 - protein, 93 aa, Heterodera glycines
  Coding regions on vcDNA: vcDNA=SeqID_69113; Strand=+; Position=1 -41,313-523,647-676
MGGLNYALPIISDGMLMETLVIGFAVNHPAGGFGMDSDQKNGNGSNGTSDTGSDAASDNGNGANGHKPQKKPQVFEKSVPSVVGNFSSEKFLS

SEQ ID NO: 142691 - protein, 26 aa, Heterodera glycines
  Coding regions on vcDNA: vcDNA=SeqID_69114; Strand=-; Position=1-79
FAILVFWLLFVGNQLNGYLIIFIICP

SEQ ID NO: 142692 - protein, 172 aa, Heterodera glycines
  Coding regions on vcDNA: vcDNA=SeqID_69115; Strand=-; Position=1 -90,143-175,217-294,360-388,464-501,701-800
  Homolog annotation: Hit_ID=CAE58597.1; Match level="QueryCoverage =97%, HitCoverage=88%, E-value=7e-49, Identity=56%"; Hit description =Hypothetical protein CBG01764 [Caenorhabditis briggsae]
HGQAANPQQFKCELCSKTFSAHYNLTRHMPVHTGARVHTGARPFQCKVCGKAFRQASTLCRHKIIHTEDPFQCKVCGKAFRQASTLCRHKIIHTEDKPHRCKICGKCFNRCKICGKCFNRSSTLNTHLRIHTGFKPYTCEYCGKGFHQNGNYKNHKLTHQQEKRYKCEVCAK

SEQ ID NO: 142693 - protein, 65 aa, Heterodera glycines
  Coding regions on vcDNA: vcDNA=SeqID_69116; Strand=+; Position=1-196
  Homolog annotation: Hit_ID=YP_069426.1; Match level="QueryCoverage =100%, HitCoverage=25%, E-value=5e-33, Identity=98%"; Hit description= hypothetical protein YPTB0885 [Yersinia pseudotuberculosis IP 32953] ref|NP_406714.1| hypothetical prote
MSANVPTDICFSFTGLVQRGGRTGPHKDGWGITFYEGNGCRTFKDPQPSFNSPIARLVQDYPIKS

SEQ ID NO: 142694 - protein, 96 aa, Heterodera glycines
  misc_feature (91)..(91): Xaa can be any naturally occurring amino acid
  misc_feature (96)..(96): Xaa can be any naturally occurring amino acid
  Coding regions on vcDNA: vcDNA=SeqID_69117; Strand=-; Position=1 -315,479-1010
LFEYPKRTLEKIDFFVFGAVPPNRCAQIYGETESFGNSFPIACTLILRWIFAPHNCLSTPNGHLKKSIFLFHKYFSESALKRTKIYLQVNXSTLMX

SEQ ID NO: 142695 - protein, 118 aa, Heterodera glycines
  Coding regions on vcDNA: vcDNA=SeqID_69118; Strand=-; Position=1 -189,378-545
MHFFEDDQRATVALSRARHAVFIIGDLVSINAGQVWKRFIEMAITRTSVVRAEYVLALLGRTLTTGPSDQAGPSGSGGQQRGAPTLAPQYGRGQGRRGPDNQWMHYGGNPKRQKGGRR

SEQ ID NO: 142696 - protein, 90 aa, Heterodera glycines
  Coding regions on vcDNA: vcDNA=SeqID_69119; Strand=-; Position=1-437
NRNYAQKALQTILALPIPSTIAFIHPIMSAKIIRVPKIACDLSLAKNGVSKNRNYAQKAPQTILALPIPSTIAFIHPIMSAKIIRVPKIA

SEQ ID NO: 142697 - protein, 63 aa, Heterodera glycines
  Coding regions on vcDNA: vcDNA=SeqID_69120; Strand=-; Position=1-372
NRNYAQKAFQTILALPIPSTIAFIHPIMSSKIIRVPKIACDLSLEKNGVSKIVITLKKLFKQF

SEQ ID NO: 142698 - protein, 233 aa, Heterodera glycines
  Coding regions on vcDNA: vcDNA=SeqID_69121; Strand=-; Position=1-704
  Homolog annotation: Hit_ID=XP_522969.1; Match level="QueryCoverage =98%, HitCoverage=86%, E-value=6e-26, Identity=33%"; Hit description =PREDICTED: similar to putative protein family member (XC187) [Pan troglodytes]
IRRVIRRGQKVIRSGTKVIRRGTTVIRSGTKVIRRVIRRGTTAIRRVNRRGSTVIRRVIRRGSTVIRSGTTAIRRVIRSGTTVIRRGTTAIRRVIRSGTTVIRRGTTAIRRGTTAIRRGTTEIRRGTTVIRRGTTVIRRGTTVNRRGTTVIRRGTTVNRRGTTVIKRGTKVIKRGTKVIKRGTKVIKRGTKVIKRGTKMIKRGTTVIKRGTKMIRRGTTVIRRGTTVIKEVQK

SEQ ID NO: 142699 - protein, 43 aa, Heterodera glycines
  Coding regions on vcDNA: vcDNA=SeqID_69122; Strand=-; Position=1-505
CFAVPRTGRQWMALNLQEIRLAISGCKKLLGMELFFEVSQTPY

SEQ ID NO: 142700 - protein, 117 aa, Heterodera glycines
  Coding regions on vcDNA: vcDNA=SeqID_69123; Strand=+; Position=1 -139,261-380,429-523
  Homolog annotation: Hit_ID=CAE71523.1; Match level="QueryCoverage =88%, HitCoverage=21%, E-value=2e-09, Identity=33%"; Hit description =Hypothetical protein CBG18458 [Caenorhabditis briggsae]
FIILFLIFVLFSNSVSDCRNAHSQNCGHKIREEKAYCLTRQTQNGKDAFIVEKSCVTTRQFYQQFPEELEKHSADEVPIGCDATYDGFVNYCLCDEQMCNRNSLSEQAERNGKRREI

SEQ ID NO: 142701 - protein, 154 aa, Heterodera glycines
  Coding regions on vcDNA: vcDNA=SeqID_69124; Strand=+; Position=1 -91,135-204,262-565
MRNKTRTDKEEKHGKSSEEKKRPLFVPSAADLTPIINMRPIKSSAELANQKETGSFGDDPSPPNWLSNWPSSDAPNWPTSAASPILVPATTPPSNLTEQNDRLKKWKQNSERAKRPFESDGGEESSDGKRTILSMGIGIVHAILTLFASLYLML

SEQ ID NO: 142702 - protein, 42 aa, Heterodera glycines
  Coding regions on vcDNA: vcDNA=SeqID_69125; Strand=-; Position=1 -54,413-487
MRGLQIPANLHNLSERYQTSSNFEEKCIENFGKISSKSLLLQ

SEQ ID NO: 142703 - protein, 343 aa, Heterodera glycines
  Coding regions on vcDNA: vcDNA=SeqID_69126; Strand=-; Position=1 -319,466-753,816-1240
  Homolog annotation: Hit_ID=CAB88204.1; Match level="QueryCoverage =88%, HitCoverage=81%, E-value=1e-100, Identity=53%"; Hit description= putative cuticular collagen [Globodera pallida]
MGMALLFFGHSFHGTLSLKAFRVNTDSAWNELMEVQITVTPPAKPRENPFVSIFRSKRQLPGHCQCAGVQQPQCPPGPPGPAGAPGQPGYPGQAGEPGQPGVPGQPVEKREYFATKKKDYLIIKGAPCPDVPHVCQHCPAGPPGKPGDQGPAGQAGQPGRPGQPGQSGGVGPPGPPGPQGQAGSPGRPGGSGQPGQPGPKWRLRPFLDRRDNPGQPGAPGQPGAPGRPGKPGDQGQPGAPGHPGQPGQPGAPGQPGHPGAAGAPGKDASYCACPPRSGGGYGVSGGGGGGAKVEHAPLPAEQAPVPEQPAESVGVAPAPAEVASNAAGGQGEAEAAKGYRKKM

SEQ ID NO: 142704 - protein, 123 aa, Heterodera glycines
  Coding regions on vcDNA: vcDNA=SeqID_69127; Strand=-; Position=1 -229,323-465
  Homolog annotation: Hit_ID=NP_496535.1; Match level="QueryCoverage =74%, HitCoverage=29%, E-value=6e-18, Identity=50%"; Hit description =COLlagen structural gene (col-84) [Caenorhabditis elegans] emb|CAA88865.1| Hypothetical protein K12D12.3
MKVHTATFLASSISGISLLGCLLLIANIYNDVQQIWQELDQQIFLFRSETDDLWRDMMKLGQKARTRRAAAGYEGGSASSHANGGASPGVPPGSVNPPSVPPSIQTGTAGGAGCSEYYQYGTR

SEQ ID NO: 142705 - protein, 97 aa, Heterodera glycines
  Coding regions on vcDNA: vcDNA=SeqID_69128; Strand=+; Position=1-291
MKAWKEWTQQKNQWESGGTAQGGKRFFENTLKSAVISANETRAIPPEGMSWKRHVSSFQTAPPGPGFKRRYHDVSPIRRMDNTGQVTSAASGTEEKI

SEQ ID NO: 142706 - protein, 16 aa, Heterodera glycines
  Coding regions on vcDNA: vcDNA=SeqID_69129; Strand=-; Position=1-49
EAIPEGFGLPINLGAS

SEQ ID NO: 142707 - protein, 309 aa, Heterodera glycines
  Coding regions on vcDNA: vcDNA=SeqID_69130; Strand=+; Position=1-928
MQKPTPLNRPNSSVSKTLACGLEKIVNLSGNEPLSVPVLADRSDPLGLKSVQPDAVPMESAEGTKEVEIMEVDEMSGGKGKRDEMGKEKVKSGGMEEEEESEGSESELLGEGGFGSIQLNPSLRAGNKAVEKEDKGKPYLIAQVRGDGVIAARMKLFWDFPELVFVPFSLFDNAQPIEIGDTFRLHKCEWTKSETGWEERGDWLYEVTGRLNYQATATDVSRLRQRLPTRAVGILVDVQRARDRHVKVALVSAPELSCVMRAYRRHFPAEFTETDIRYRSVVRLQLRQINSPPWVLYSQQFAYVLPSDF

SEQ ID NO: 142708 - protein, 295 aa, Heterodera glycines
  Coding regions on vcDNA: vcDNA=SeqID_69131; Strand=-; Position=1-888
  Homolog annotation: Hit_ID=CAA82797.1; Match level="QueryCoverage =82%, HitCoverage=37%, E-value=4e-16, Identity=27%"; Hit description =gag protein [Ascaris lumbricoides]
MASLIQKGITFTLKALDNARTTTALSLHPDADLSNWENAVKLEAQCTRVNREVQTIEAQLDNLRDLSNNWIDLLNRLEGTEKDKGEKEYVKFDTYEKIAERHDAATTKLRDLRDLEATLSADAKLYRGRAEREARADQQANPPPQTATPPIAAPTFTAPLYQFQPIQLDKFFGQKRKWPEFYESFKSAIGSQSISKAQKLNLLRNLLGGEARELIAGFRLEDQNYETVLQLLKDTYGAPEEHIRALHFELANLKTCRSLRDTKDFLLQLERLTRELNNAGEDIEGPQVFLMLEKW

SEQ ID NO: 142709 - protein, 24 aa, Heterodera glycines
  Coding regions on vcDNA: vcDNA=SeqID_69132; Strand=-; Position=1 -52,295-317
MEKACKIWRDYIDFSALELLELAS

SEQ ID NO: 142710 - protein, 247 aa, Heterodera glycines
  Coding regions on vcDNA: vcDNA=SeqID_69133; Strand=-; Position=1 -112,238-869
MFEQLEKEFDEDGLTEIIKHKLYGFISDGASVMRGTRDYEADFLCATDGKRYEHAQYMLRQQAHTRSTAEENLVVGISPPIPEFNKALREKLINNIVAEIKQYFPFGTLMDEIDLLDPSNLPNRSADINQYANKLKKLANYYNYVGHLIYQEFSNVLSLILNDNRLCSLKNSLTPQRFWKLVIEKLGDTFGEELKNFVHHMLIFGLGSADAERAFSVLFHVRGKRLFYFFGCYNFPKLDLQGLRRLI

SEQ ID NO: 142711 - protein, 50 aa, Heterodera glycines
  Coding regions on vcDNA: vcDNA=SeqID_69134; Strand=-; Position=1-186
RMKASFGRWADRMKECFGDGTFSLAPPMFYQINCFHFFILLIIIFNEKFH

SEQ ID NO: 142712 - protein, 120 aa, Heterodera glycines
  Coding regions on vcDNA: vcDNA=SeqID_69135; Strand=-; Position=1 -111,229-363,558-671
  Homolog annotation: Hit_ID=AAQ84518.1; Match level="QueryCoverage =100%, HitCoverage=36%, E-value=1e-41, Identity=65%"; Hit description= two-pore K+ channel [Caenorhabditis elegans] ref|NP_494333.1| TWiK family of potassium channels (37.0 kD)
MKRQNVRTLSLIVCTLTYLMVGSAVFDALESEAELRQRQQVEAVKSRLVAKYNITETDYALLESIIVRAIPHKAGHQWKFSGAFYFSTTVITTFGYGHSCWVTMGGKILCMFYALVGFRL

SEQ ID NO: 142713 - protein, 18 aa, Heterodera glycines
  Coding regions on vcDNA: vcDNA=SeqID_69136; Strand=-; Position=1-56
YREAIPEGFGLPINLGAS

SEQ ID NO: 142714 - protein, 128 aa, Heterodera glycines; identical to SEQ ID NO: 125618
  Coding regions on vcDNA: vcDNA=SeqID_69137; Strand=+; Position=1-387

SEQ ID NO: 142715 - protein, 91 aa, Heterodera glycines
  Coding regions on vcDNA: vcDNA=SeqID_69138; Strand=+; Position=1 -59,170-386
  Homolog annotation: Hit_ID=NP_492053.1; Match level="QueryCoverage =90%, HitCoverage=4%, E-value=6e-13, Identity=45%"; Hit description =MYOsin heavy chain structural gene, LEThal LET-75 (223.3 kD) (myo-1) [Caenorhabditis elegans] emb|CAA95848
VEEEQRRREEQRENFLMSEKKLNIVLSERDELVVRREQMERDKQRVEAEVQEERARKTELQMDNSQLSAARRQVDNDLQLTKAKNIKIKFE

SEQ ID NO: 142716 - protein, 173 aa, Heterodera glycines
  Coding regions on vcDNA: vcDNA=SeqID_69139; Strand=+; Position=1 -196,240-565
MPSLLLLPTFCFFAFAVVVAHSQMTFSDGWGKRSAVAPFALLADRHMAGNKRHEKPRAAANLFISPTDEDALAMSPAMEACQVGYAQRLMQLHEQMLVRPMDQSLTVGSKMFRPSLLDFVQHVPTMSDKSDDDGDEESVENDERKKGTKSKTKPKAKRHQRKSQCHSKVIHCV

SEQ ID NO: 142717 - protein, 316 aa, Heterodera glycines
  Coding regions on vcDNA: vcDNA=SeqID_69140; Strand=+; Position=1 -239,283-374,708-859,903-1103,1268-1534
MQLHEQMLVRPMDQSLTIGGKTFRPSLLDFVQHVPTMSDKSDDDGDEESVERTTRERKGRKAKRSQKRKDTKGKASVTQNKMPRGKEKLTGKCPGKGSVRPASQSRRKCCLVLTDKRLDATHPNGKEIQPIPNWTTFVRSKQSTQFERTTPCCKSIRASGEVPRRTFGQAKCEGVENEEEGNSEGGCILKTKQTNLEPSAGHCHPLPNFLQTLQNAATFVATTDIETDHHQRMSVFSAQFSEVFGRGQCVRLHPIDQNGRLSDDHWGAAVGGVLRPKKRHGAAALDEGGEFAGTKGQRTARVPNDLLSLNVVGHSS

SEQ ID NO: 142718 - protein, 125 aa, Heterodera glycines
  Coding regions on vcDNA: vcDNA=SeqID_69141; Strand=-; Position=1 -96,187-327,446-585
MCFLNIVSTKYEKRRAPLLDHVNIIINDAVRVQILGVMCEGIVSTEQDDYKFHRLQIREYDRLTKNTALAMSAWVEADLDSAWPDVILSHTKLALETDRNDDISEAEFEKFALLIQQIADERGKQ

SEQ ID NO: 142719 - protein, 174 aa, Heterodera glycines
  Coding regions on vcDNA: vcDNA=SeqID_69142; Strand=+; Position=1-522
MNAKIIRVPKIACDLSLAKNGVSKNRNYAQKASQTILTLPIPSTIAFIHPIMSAKIIRVPKIACDLSLAKNGVSKNRNYAQKAPQTILALPIPSTIAFIHPIMNAKIIRVPKIACDLRLEKNGVSKNRNYAQKASQTILAHPIPSTIAFIHPIMSAKIIRVPKIACDLSLAKNG

SEQ ID NO: 142720 - protein, 100 aa, Heterodera glycines
  Coding regions on vcDNA: vcDNA=SeqID_69143; Strand=-; Position=1-438
SKPRKNGLSKNRNYAQKASQTILALPIPSTIAFIHPIMNAKIIRVPKIACDLSLAKNGVSKNRNYAQKASQTILTLPIPSTIAFIHPIMSAKIIRVPKIA

SEQ ID NO: 142721 - protein, 251 aa, Heterodera glycines
  misc_feature (7)..(7): Xaa can be any naturally occurring amino acid
  misc_feature (19)..(19): Xaa can be any naturally occurring amino acid
  misc_feature (29)..(30): Xaa can be any naturally occurring amino acid
  misc_feature (106)..(106): Xaa can be any naturally occurring amino acid
  misc_feature (122)..(122): Xaa can be any naturally occurring amino acid
  misc_feature (188)..(188): Xaa can be any naturally occurring amino acid
  misc_feature (245)..(245): Xaa can be any naturally occurring amino acid
  Coding regions on vcDNA: vcDNA=SeqID_69144; Strand=+; Position=1-767
  Homolog annotation: Hit_ID=BAB33421.1; Match level="QueryCoverage =99%, HitCoverage=89%, E-value=6e-80, Identity=66%"; Hit description =putative senescence-associated protein [Pisum sativum]
VYRPSTXTKCLNPLFLSYXAGLLLATGLXXGKTNLSHDGLNPAHVPYWWVNNPTLGEFCFAMIGRADIEGSKSDVAMDAWPPQASYPCGNFSDTSCWKLYTLKDRXATLSRSVFVLKIRIKXAFAFLLYERFPSSLSSLGHLRYALTDVPPQSNSPPDTVIGAGRRARVARLNTKMDTRRTPVLPIKXGIDESSGISLAPCGSHLCYTSHDSSQSQTRVKLNRVFFPAKFAKPVPLAVVSLDSRXGQWESR

SEQ ID NO: 142722 - protein, 533 aa, Heterodera glycines
  Coding regions on vcDNA: vcDNA=SeqID_69145; Strand=-; Position=75 -148,204-674,745-952,995-1555,1599-1860,1907-1932
  Homolog annotation: Hit_ID=NP_507780.1; Match level="QueryCoverage =44%, HitCoverage=20%, E-value=3e-11, Identity=22%"; Hit description =predicted CDS, DNA polymerase type B, organellar and viral family member (5T899) [Caenorhabditis elegans]
MTSKRNGTLQKGGPSTKKWDFRAIGNNFTEEMENYKLIDERSTICEKFGFTKNITEFRINSDVRRPDEAMRDAIDTMIKAAFKTTEERMKRKVRMFGVAITGAGLASPVWLPYRAYPQNNADVIMQEINKLGQSGDGDENKKTLLLSEPIMMKITCVTVPSGEGPRNVHKFDFGFKEHQRIRISNVDKICLFYALVASKLYLEVHRNIFNRFMNNIMRQREAAVELLRNCGIDINEYSYGVEHLSNVQNYWDEIYPGKFRIVEFEKSADPRKSIRVLWKGPMGREMVVPIFLENTHWDGLKNYVCFFNRGRKFCVDCECFYSRDIYHTLECRARCYYCNRVGGVPCGKESGVKIECPKCRRYFYNWECYNYHQGHQTCKLWKRCVICDKTYLFNPKKDHECGETYCQLCSVSHDPKRGCYIMPIEEKEDKDVYRIVVWDSETSQDSIYKGDQKEHVINYISVRVTCTECCDDKNRTNCKICGEVRTKDWSEAEGHEPMKDFVEWILTAFTSYDTYIFAHNAGRFDGHFVFNYL

SEQ ID NO: 142723 - protein, 94 aa, Heterodera glycines
  Coding regions on vcDNA: vcDNA=SeqID_69146; Strand=+; Position=1-330
APPVGQVLHLLWSPGQGKLEQAGQPKLTVYTLHLATPEELRFSAGLFPVHSPLLRESSLVSFPPLTDMLKFSGCSRLSSGRKIQAGMPVIQVLR

SEQ ID NO: 142724 - protein, 51 aa, Heterodera glycines
  Coding regions on vcDNA: vcDNA=SeqID_69147; Strand=-; Position=1 -100,376-431
MVSVWGRTEFIKSSTNSHLQFLLISTIIFRGEEAPHSKNINGISVGEGPNL

SEQ ID NO: 142725 - protein, 356 aa, Heterodera glycines
  misc_feature (8)..(8): Xaa can be any naturally occurring amino acid
  misc_feature (113)..(113): Xaa can be any naturally occurring amino acid
  misc_feature (120)..(120): Xaa can be any naturally occurring amino acid
  misc_feature (155)..(155): Xaa can be any naturally occurring amino acid
  misc_feature (162)..(162): Xaa can be any naturally occurring amino acid
  misc_feature (232)..(232): Xaa can be any naturally occurring amino acid
  misc_feature (291)..(291): Xaa can be any naturally occurring amino acid
  misc_feature (311)..(311): Xaa can be any naturally occurring amino acid
  misc_feature (318)..(318): Xaa can be any naturally occurring amino acid
  Coding regions on vcDNA: vcDNA=SeqID_69148; Strand=-; Position=1 -420,506-978,1108-1269
  Homolog annotation: Hit_ID=AAB97874.1; Match level="QueryCoverage =100%, HitCoverage=55%, E-value=9e-58, Identity=40%"; Hit description= surface antigen [Trypanosoma cruzi]
PKSRVPKXRIPKCRVPKCRDPQMSGPQMSGSPKSRVPKCRDPQMSGPQMSGSPNVVIPKSQVPKSRVPKCRDPKSRVPKSRVPKSRVPKCRVPKCRVPKCRAPKLVPKCRVPXVSGLQSXSPKVGSPNVGFLKCRAPKLLVPKSRVLVPKSRVPXVSGLQSXSPNVGSPNVGIPKSRVPKSGSPKVGSPNVGIPKSRVPKCRDPQKSGPQMSGSPKVGFPNVGIPKSRVPKXRVPKCRVPKCRDPQMSGPKSQVPKSRVPKCRDPKSRVPKSRVPKSRVPKCRVPKCRVPXVSGSKVSPQKSVVPKSRVPXVSGLLSXSPNVGFPKSRVPKCRDPQMSGSPKVRSPKVGSPKCRDP

SEQ ID NO: 142726 - protein, 86 aa, Heterodera glycines
  Coding regions on vcDNA: vcDNA=SeqID_69149; Strand=-; Position=1 -65,138-274,518-576
MRTPFYWRTLTLRTLAVASEERFEIHLHFYIFKIKHVGRSILQRRVNFRGQQQGEDFDQDQDSEDGGNSRPFSEFESILDNTYEFW

SEQ ID NO: 142727 - protein, 32 aa, Heterodera glycines
  Coding regions on vcDNA: vcDNA=SeqID_69150; Strand=-; Position=1-96
MNGPSIKQLSTHFAQVQFRIQQIAKAPDEQRN

SEQ ID NO: 142728 - protein, 166 aa, Heterodera glycines
  Coding regions on vcDNA: vcDNA=SeqID_69151; Strand=-; Position=1 -134,273-296,377-483,535-597,647-731,1078-1123
  Homolog annotation: Hit_ID=NP_502084.1; Match level="QueryCoverage =96%, HitCoverage=11%, E-value=6e-56, Identity=68%"; Hit description =DEAD/DEAH box helicase and helicase, C-terminal (4L900) [Caenorhabditis elegans] emb|CAA92767.1| Hypothet
PPPLIDIQLHSDAFCLVMTTKFLRSMLYNGSEVIGLEWCIFDEVHYINDAERGHVWEEVLIMLPAHVKIVMLSATVPNCMEFADWVGRIKNRKIRIKNRKIFVIQTLKRPVPLEHYLYTGQDGKYLYTGQDGKTKKDMFLILDKRGDFLTSGYNIAKNKKNLSYQK

SEQ ID NO: 142729 - protein, 106 aa, Heterodera glycines
  Coding regions on vcDNA: vcDNA=SeqID_69152; Strand=-; Position=1 -32,66-354
MQKNLARILPCPSAHLLRTSTKQMGEDGDDDGGNQQQIENVGRTRPWKGANKKKAAAWKGGAGGGRVEKRRQRREAKRERRKGGDWHRDGQQKRQTEENDGEEMEQ

SEQ ID NO: 142730 - protein, 87 aa, Heterodera glycines
  Coding regions on vcDNA: vcDNA=SeqID_69153; Strand=-; Position=1-659
IIFIQKIFFWVFGAVPLNRCAQIYGETESFGNSFPIACTLILRWIFAPHNCLSTPNGHLKKSIYFCFRGSPPEPMRPDLWGDRILRE

SEQ ID NO: 142731 - protein, 56 aa, Heterodera glycines
  Coding regions on vcDNA: vcDNA=SeqID_69154; Strand=+; Position=1-206
IFLEFFAWRNTVLHTYHTSIIFFKLFFAFDHPTFYTDQKLTKFCRETAENPSNAYK

SEQ ID NO: 142732 - protein, 53 aa, Heterodera glycines
  Coding regions on vcDNA: vcDNA=SeqID_69155; Strand=+; Position=1 -52,109-188,618-647
MVHNITSFLSTPPHIPNESAPASLSSGSVLQLLIVLQIFIILLTAELCQMVNE

SEQ ID NO: 142733 - protein, 99 aa, Heterodera glycines
  Coding regions on vcDNA: vcDNA=SeqID_69156; Strand=-; Position=1 -142,291-448
MSSPSKFSPTKSSPVKKENNVGKAEFVVPSLKAPTRKQSSKNVGMNGDDWNKLYNNKQRVLRKDDGRFAVNFELCEECTWVNARATDLIAPPKAKKRTE

SEQ ID NO: 142734 - protein, 229 aa, Heterodera glycines
  Coding regions on vcDNA: vcDNA=SeqID_69157; Strand=+; Position=1-690
MAINMSDKRGLLRQILGEAEITVTTSGLTISGPRLSTPRFLPFDECGRCRSCKATEVEVDTMVTKEGVTIWCTRIDKVQFVPFDMVYELPGHCFFRLKNKSRVFNLPYGDLPSESCEIPLIQHADDERDLKRKAKAALELVEAGLIADSTVQDGARLKKAKTAMKVISDILLSEPEGDDHKKTVEVADVDKQAQEQQPAPVQQKTASVPAVEQSTVEENTEEDTKDDLD

SEQ ID NO: 142735 - protein, 121 aa, Heterodera glycines
  Coding regions on vcDNA: vcDNA=SeqID_69158; Strand=-; Position=1 -74,564-855
MSNEKAHFHVTKYNCKMSNEKAHFRHNNSVHHCEKKTGNFCANSVRALAVPSRHTSRSSISVNGSSVSVDLPPPVVADDLVAVPSSSDVVDALEQMEYGLVTLSSPPTPLSFKLICGCAKI

SEQ ID NO: 142736 - protein, 43 aa, Heterodera glycines; identical to SEQ ID NO: 131356
  Coding regions on vcDNA: vcDNA=SeqID_69159; Strand=-; Position=1-503

SEQ ID NO: 142737 - protein, 19 aa, Heterodera glycines
  Coding regions on vcDNA: vcDNA=SeqID_69160; Strand=+; Position=1-59
TFAFSSLALPNTHTIFEML

SEQ ID NO: 142738 - protein, 19 aa, Heterodera glycines
  Coding regions on vcDNA: vcDNA=SeqID_69161; Strand=+; Position=1-59
TFSFSSLALPNTHTIFEML

SEQ ID NO: 142739 - protein, 19 aa, Heterodera glycines
  Coding regions on vcDNA: vcDNA=SeqID_69162; Strand=+; Position=1-59
TFAFSSLALPNTHTIFEML

SEQ ID NO: 142740 - protein, 19 aa, Heterodera glycines
  Coding regions on vcDNA: vcDNA=SeqID_69163; Strand=+; Position=1-59
TFAFSSLALPNTHTIFEML

SEQ ID NO: 142741 - protein, 19 aa, Heterodera glycines
  Coding regions on vcDNA: vcDNA=SeqID_69164; Strand=+; Position=1-59
TFAFSSLALPNTHTIFEML

SEQ ID NO: 142742 - protein, 19 aa, Heterodera glycines
  Coding regions on vcDNA: vcDNA=SeqID_69165; Strand=+; Position=1-59
TFAFSSLALPNTHTIFEML

SEQ ID NO: 142743 - protein, 19 aa, Heterodera glycines
  Coding regions on vcDNA: vcDNA=SeqID_69166; Strand=+; Position=1-59
TFAFSSLALPNTHTIFEML

SEQ ID NO: 142744 - protein, 60 aa, Heterodera glycines
  Coding regions on vcDNA: vcDNA=SeqID_69167; Strand=-; Position=1 -153,339-368
MSISSGISFWQNVTKPVPFENEKFLDILTADKFPEAEAKQWVDGRFPLTIQLPKSTLNSL

SEQ ID NO: 142745 - protein, 77 aa, Heterodera glycines
  Coding regions on vcDNA: vcDNA=SeqID_69168; Strand=-; Position=1 -43,601-788
MAPPSASAVGSHIGELANEAPLADQKDGDEEDNDGGGGEAAKNIQSAEGITGTDDGEEDEETEEDEEEEEEEEKEEK

SEQ ID NO: 142746 - protein, 562 aa, Heterodera glycines
  Coding regions on vcDNA: vcDNA=SeqID_69169; Strand=+; Position=1 -1198,1821-2311
MPSSNSFYVIVPSNTNVEGNRTNSFRVRLPRKLQFNSEWDVGLGVIIYPHSWPSLGTSEDQFVQIEWKIGENVQIPIPSSNVTNPVELWKSLYKLLEEGNKPFAVKVEGVQKKFTEAANTARQLGRAEYINKQQQQQQRDKRNVNDDDDDDDDENEEQLLNALLAGVDTLLDLYGATSGGLLEREKRAATSKVPLRNWDDTEEEYQEKLDKYFLRLRGRNLEHLEGLITEKLNAEIALMDDEERKILDQTKELGMTAWIKVFQSAYSACFLHFDSATNRFSLKLDDRYVQKIKISDQLAYILGFNSTDFTEKETIAKFMPDMSGGVASFHVYAPDLIEPMMIGDVIAPVLRIVTIRGKPDEIIEEQFLSVQYHRVLVKEISEIFIEIRTSGGNLMPFQYEVVVQYGGYNVFREVPYQRGSGIGSVFRSLLRYLIPIGKEIGTAIGRQGLESGNRVLSNVLEGRDLKESLVSEGKTGLKNLLEKAANNINAQKSQGFDFKRYTKRNDTREGGAIGKAKKGINKLQSRLGPHDFLPANTPAGRKKKHTKQKSVKRLRTDILGTY

SEQ ID NO: 142747 - protein, 18 aa, Heterodera glycines
  Coding regions on vcDNA: vcDNA=SeqID_69170; Strand=-; Position=1-54
MRTRPIWQVKQRLLTSQK

SEQ ID NO: 142748 - protein, 132 aa, Heterodera glycines
  misc_feature (8)..(8): Xaa can be any naturally occurring amino acid
  misc_feature (17)..(18): Xaa can be any naturally occurring amino acid
  misc_feature (27)..(27): Xaa can be any naturally occurring amino acid
  Coding regions on vcDNA: vcDNA=SeqID_69171; Strand=+; Position=1-489
VPPEPDAXRFMGRPIAXXNSFPIACTXILRWIFAPHNCLSTPNGTLEKIDFFVFGAVPPSRCAQIYGETESFRNSFPIACTLILRWIFAPHNCLSTPNGHLKKSIFLFSGQSPRADAPRFMGRPNPSGIASL

SEQ ID NO: 142749 - protein, 104 aa, Heterodera glycines
  Coding regions on vcDNA: vcDNA=SeqID_69172; Strand=-; Position=1-438
NGVSKNRNYAQKASQTILALPIPSTIAFIHPIMSAKIIRVPKIACDLSLEKNGLSKNRNYAQKASQTILALPIPSTIAFIHPIMSAKIIRVPKIACDLSLEKMV

SEQ ID NO: 142750 - protein, 104 aa, Heterodera glycines; identical to SEQ ID NO: 142103
  Coding regions on vcDNA: vcDNA=SeqID_69173; Strand=-; Position=1-438

SEQ ID NO: 142751 - protein, 95 aa, Heterodera glycines; identical to SEQ ID NO: 137696
  Coding regions on vcDNA: vcDNA=SeqID_69174; Strand=-; Position=1-669

SEQ ID NO: 142752 - protein, 126 aa, Heterodera glycines
  Coding regions on vcDNA: vcDNA=SeqID_69175; Strand=+; Position=1 -275,617-722
MSSSNIILCLFSNHCKILNMMGSMAFGLVLLMNPLHVYLPFIRHFGSLAELMPAFMALCTSVMVMINFWFLMLGAFTYVLIRDKRSLFVYKEEYFNNGYTDEEKMNVKLAMIRRSSSAPISRMYSG

SEQ ID NO: 142753 - protein, 87 aa, Heterodera glycines
  Coding regions on vcDNA: vcDNA=SeqID_69176; Strand=+; Position=1 -132,406-537
ALEELHRMRVPPLLYAQRLLCKDGKLLIRKNEIKSGILTPVDKPALEELHRMRVPPLLYAQRLLCKDGKLLIRKNEIKSGILTPVDK

SEQ ID NO: 142754 - protein, 73 aa, Heterodera glycines
  misc_feature (13)..(14): Xaa can be any naturally occurring amino acid
  misc_feature (36)..(36): Xaa can be any naturally occurring amino acid
  Coding regions on vcDNA: vcDNA=SeqID_69177; Strand=+; Position=1-232
IFRLCTAPIERTXXAATRIRCSSQRALQTYFCFFSXSSLNGVITTVVNCFAFNKPIIKIIIGTEVQAYADFVS

SEQ ID NO: 142755 - protein, 260 aa, Heterodera glycines
  Coding regions on vcDNA: vcDNA=SeqID_69178; Strand=-; Position=1 -109,155-224,377-417,506-656,1148-1281,1329-1500
  Homolog annotation: Hit_ID=CAE66757.1; Match level="QueryCoverage =77%, HitCoverage=32%, E-value=1e-46, Identity=47%"; Hit description =Hypothetical protein CBG12109 [Caenorhabditis briggsae]
PKILFLLLLLPNILCWINENRRIEEEILRNYDRRHRPVKRESTVTQVQPVKRESTVTQVQLFLTINHIEKVDQSEGTMLLHGVLWTSWTDEYLQWNPSEHNYTYVVSLETWKIWQPTFALYNSARSTNWFVYMNGVSATVANDGKVIAAGTFTFHVTCQFDFSAFPNDVQECPIVLADWIFDNSKVNLSGMVPRSIGGINVDWIFDNSKVNLSGMVPRSIGGINVKPAVRLSFDPLSETVKKHVSGGYSNLFFHIFKYFN

SEQ ID NO: 142756 - protein, 47 aa, Heterodera glycines; identical to SEQ ID NO: 127360
  Coding regions on vcDNA: vcDNA=SeqID_69179; Strand=-; Position=1 -450,487-528

SEQ ID NO: 142757 - protein, 20 aa, Heterodera glycines
  Coding regions on vcDNA: vcDNA=SeqID_69180; Strand=+; Position=1-62
MPMPDKALPSKVIGFKSIMI

SEQ ID NO: 142758 - protein, 174 aa, Heterodera glycines
  Coding regions on vcDNA: vcDNA=SeqID_69181; Strand=-; Position=1 -63,106-327,373-612
MPSFNSGLVAGAALGSAIGYYLGSQTSNDNLVIQAEHNHPPVNPRGRGEAQEDVFNEVREALRGQGVHQPTIEQQVETVVALSDFIRRELGGVGNTEQVSNVGETFQTEPASNVGEMFQTEPASNVGETFKTEPASNVNVGETNHVVDRVAYEVYNLLTFIIKAGNEATGNGGE

SEQ ID NO: 142759 - protein, 120 aa, Heterodera glycines
  Coding regions on vcDNA: vcDNA=SeqID_69182; Strand=+; Position=1 -122,163-403
MVPFRDPKTVAEKRFNTALCKGRSVIEHAFGIFKRRFSIAKTSCRLKLRRIATAILAAAVLHNIAIEMRLPEPPATEDLNENDDLNEINNENENRNAILNDRQSRQAGIEKRQELVARFT

SEQ ID NO: 142760 - protein, 92 aa, Heterodera glycines
  Coding regions on vcDNA: vcDNA=SeqID_69183; Strand=-; Position=1-304
MIGRAVRNRLFIFEGIFKFILYPRKMAISFFEKFYTSQKRLRMRRRAVHNRHFISQRIFIFRGYPRKMAISFFDKFYTHTNALEHDREGGAQ

SEQ ID NO: 142761 - protein, 92 aa, Heterodera glycines; identical to SEQ ID NO: 125147
  Coding regions on vcDNA: vcDNA=SeqID_69184; Strand=-; Position=1-304

SEQ ID NO: 142762 - protein, 33 aa, Heterodera glycines
  misc_feature (29)..(29): Xaa can be any naturally occurring amino acid
  Coding regions on vcDNA: vcDNA=SeqID_69185; Strand=-; Position=1-101
AISFFDKFYTHTNALEHDRGGRCAIDLLXLREF

SEQ ID NO: 142763 - protein, 87 aa, Heterodera glycines
  Coding regions on vcDNA: vcDNA=SeqID_69186; Strand=-; Position=1-323
FLPGGTQFFTLTTPALFFLNYFFHFITQRSRLIRSSPNFAGKLLRTLQMLINFLRIFCLEEHSSSHLPHQHYFFLIIFFILSPNVLD

SEQ ID NO: 142764 - protein, 239 aa, Heterodera glycines
  Coding regions on vcDNA: vcDNA=SeqID_69187; Strand=-; Position=1-720
MLVQHKHRPAIIPELQAQITAELEVAEKHKNIRRLFARTLKGCETENNQSGIPIYDFEERECEYLDVKRALEEDRETEKNRDKRPKKETPAYEIYDLNVIYKRNNNPKWPNGEALDKYLTAIIEMYTEKNKDNRRETIARSLEHAKRQLLDAVHFDGMVQLEDGASQSAAVSNAPSVTVTPVVEKRQTVQTKAPTEKTKEASTPLRCTGGIIYCLSIFIFAINRGRSDSNGDCRANQCG

SEQ ID NO: 142765 - protein, 117 aa, Heterodera glycines
  Coding regions on vcDNA: vcDNA=SeqID_69188; Strand=+; Position=1 -98,365-502,555-672
MSEKSHHLLNCFIGLLAMMLFISGGKAQEQTTPIRLTGGDTSMFSIPIATVDQCMPHEEWNTFGIEFRLPKQGGHCDEGMLICYPSTLAYHDVNTVHTVDEFAVRSELYNLRNMVNK

SEQ ID NO: 142766 - protein, 137 aa, Heterodera glycines
  Coding regions on vcDNA: vcDNA=SeqID_69189; Strand=-; Position=1 -32,480-601,802-1061
MKIRPMEKQWNAYTFPSLCSLLRYHNTIPIRQQLLLPQFQFVNSFDEFQGHLTLPGRIERRAGRRAQWAGAVATKTDATGAATTTTNAATNTDATGAATTAKTTTTTDGAAATTTTNANNNTTHGNATRSASNSDSD

SEQ ID NO: 142767 - protein, 76 aa, Heterodera glycines
  Coding regions on vcDNA: vcDNA=SeqID_69190; Strand=+; Position=1 -114,190-306
MVRATTARTRASAARARSIKINRRNAKKARAAIGRAGHTRNAMAREKCMMCLGKVSSMTRVTMGCVHEFHRRWRRG

SEQ ID NO: 142768 - protein, 362 aa, Heterodera glycines
  Coding regions on vcDNA: vcDNA=SeqID_69191; Strand=-; Position=1 -51,1070-1249,1619-2476
  Homolog annotation: Hit_ID=AAK58434.1; Match level="QueryCoverage =42%, HitCoverage=97%, E-value=4e-21, Identity=41%"; Hit description =glycoprotein gp2 [Equine herpesvirus 4]
MAVRKRPPYENGGTKTALRIPASVFCIPIRLQFGRNDCGHRHAGHHPNSDQDKDEEDCFTPSRVNSSAFGEPSLALVLAPASVPLFCCNYFRVSFYALPAVVQRARRRQQGASTNNRRTAPVRGRSSARARVSAAVRRASRRQGNNNDGDGTRTRKKRGSAMRRPLKLKPLLGRPKGSRKSRAAPRTAGQKRGRGRPRTVKKGRARRGKNAAQQQTTTTADAATNTDATGAATVTTDAATTATTPPTTTTADGATVTNANEPGATTATNTEAPAATTPATTTNADGATVTNANEPGATTTTMAATTNTEATAATTTTAIADGAVATNTDPTGAATTPTTNAATNTEAPAATTPATTADVALD

SEQ ID NO: 142769 - protein, 17 aa, Heterodera glycines
  Coding regions on vcDNA: vcDNA=SeqID_69192; Strand=+; Position=1-52
MEKACKIWRDYIDFSAL

SEQ ID NO: 142770 - protein, 49 aa, Heterodera glycines
  Coding regions on vcDNA: vcDNA=SeqID_69193; Strand=-; Position=1-534
LNLKKCQRLLFLKFFKILTFSLLIYYFAKLIHKYFFRTCSETHQMLIKS

SEQ ID NO: 142771 - protein, 15 aa, Heterodera glycines
  Coding regions on vcDNA: vcDNA=SeqID_69194; Strand=+; Position=1-49
LKAIHCLPVLGTAKH

SEQ ID NO: 142772 - protein, 77 aa, Heterodera glycines
  Coding regions on vcDNA: vcDNA=SeqID_69195; Strand=-; Position=1-235
FEYPKRTLEKIDFFVFGAVPPNRCAQIYGETESFGSSFPIACTLILRWIFAPHNCLSTPNGHLKNRFFCFRGSPPET

SEQ ID NO: 142773 - protein, 71 aa, Heterodera glycines
  Coding regions on vcDNA: vcDNA=SeqID_69196; Strand=+; Position=1-480
KNRFIFVFGAVPPNRCAQIYGETESFGNSFPIACTLILRWIFAPHKCLSTPNGHLKKSIFLFHKYFFQKVL

SEQ ID NO: 142774 - protein, 53 aa, Heterodera glycines
  Coding regions on vcDNA: vcDNA=SeqID_69197; Strand=+; Position=1 -58,196-299
MVMIHVLIQNHDLRVNLRSFIIHVSIYGLNHVSIHAHYSHVNLRVKSRVNSRS

SEQ ID NO: 142775 - protein, 33 aa, Heterodera glycines
  Coding regions on vcDNA: vcDNA=SeqID_69198; Strand=-; Position=1-101
CAKCMGHKFNLAKETEQYGKEDEEEEEEEEQED

SEQ ID NO: 142776 - protein, 80 aa, Heterodera glycines
  Coding regions on vcDNA: vcDNA=SeqID_69199; Strand=-; Position=1 -103,203-342
MRNALRNNAQNRWTTEKDETDGKFVIPYRITGNFTQKELAVIFGAMEEIERNTCIKFRTKRSSGGGDKDFVDIQNEYGEG

SEQ ID NO: 142777 - protein, 130 aa, Heterodera glycines
  Coding regions on vcDNA: vcDNA=SeqID_69200; Strand=-; Position=1 -246,309-455
  Homolog annotation: Hit_ID=CAE62352.1; Match level="QueryCoverage =83%, HitCoverage=44%, E-value=2e-10, Identity=32%"; Hit description =Hypothetical protein CBG06429 [Caenorhabditis briggsae]
MDQRDFGTFMPKVTKLMLKELPADLAALLPSKVVADINALLANKSLDCAQKLEKIDELMKTVPDEVMEKLPMPPHLAQLPEEVQAQIKKLCLETKHKSVEEKKEAFKAYAGTLPAEQRAIICKEKPSCGK

SEQ ID NO: 142778 - protein, 74 aa, Heterodera glycines
  Coding regions on vcDNA: vcDNA=SeqID_69201; Strand=+; Position=1 -77,225-372
MNPSLRHSFSIENILTKSVNFETFSEPLLPHHFLGRCFDKVPTFVLEPPPKAFPTEFSSAFFERNNGEREGVRS

SEQ ID NO: 142779 - protein, 198 aa, Heterodera glycines
  Coding regions on vcDNA: vcDNA=SeqID_69202; Strand=+; Position=1-596
MASQAEMANLFRQLTDALQNIATQTNPNPNKQNSDLFTTINSQLSEFVYNPETDSTFDIWHDRFGAFIEKDGQQMPDDMKTRLLLGKMSSQDYARYSESILPQKPTSRTKNVAIKFEAIVEECRTILSLRSAAAALEQPGQSFNANAIALKPQQAKERHSRHQKFSPSSRRENSGNQSRSPSLNIRRSSNSRPPFPCK

SEQ ID NO: 142780 - protein, 245 aa, Heterodera glycines
  Coding regions on vcDNA: vcDNA=SeqID_69203; Strand=-; Position=1 -358,403-783
  Homolog annotation: Hit_ID=AAG21334.2; Match level="QueryCoverage =58%, HitCoverage=36%, E-value=2e-15, Identity=27%"; Hit description =hypothetical esophageal gland cell secretory protein 4 [Heterodera glycines]
LRTARSDRVALRKRRFIGDLIDIGKFAFDTGCKLFHTVICDLGKKRKREAAYGKDEPAPNPAAVNEFKVLQSTPIDELVEKVKKQLREVAEKPGFKDLSPVDQEDTLLDAISADDQFMKDLVRESIDDSVVQLRKVTDDFVTYSHANLEGRKAMKKVFDAYENTYKTPKQKLDKVKQLQAEMSDELRNSLKMTTDPEVLKEASFAFGDVPTFTGITKRVSALPPKYLSIKGHEQCVDKYVVYGWH

SEQ ID NO: 142781 - protein, 80 aa, Heterodera glycines
  Coding regions on vcDNA: vcDNA=SeqID_69204; Strand=-; Position=1 -71,389-560
MAKLILLALAFLSMFGIVCSLEEPSVCCHQCGKEFLECQSTCKPEDRAGNVECPEYCNFGLEDCSRDKCRKPCPRPKEEH

SEQ ID NO: 142782 - protein, 142 aa, Heterodera glycines
  Coding regions on vcDNA: vcDNA=SeqID_69205; Strand=+; Position=1 -120,371-519,967-1126
MPTVLIYPIDAHQKLDEQVKCLLKRASGDVSSTTKKLKAQIFARFRRDEAGRAFSAAAQLELSDTAMPSSFASVWKHWANFLGNLYLANQLNELITDVQQRRGNAMAEILKRVGLLQPQEVFCALRVELGPSHVGRYIQQCS

SEQ ID NO: 142783 - protein, 32 aa, Heterodera glycines
  Coding regions on vcDNA: vcDNA=SeqID_69206; Strand=-; Position=1-154
KPKLFGLFKKELKIFKNFIHLPFDKKASESLI

SEQ ID NO: 142784 - protein, 23 aa, Heterodera glycines
  Coding regions on vcDNA: vcDNA=SeqID_69207; Strand=-; Position=1-72
KKELKIFKNFIHLPLIEKASESL

SEQ ID NO: 142785 - protein, 465 aa, Heterodera glycines
  Coding regions on vcDNA: vcDNA=SeqID_69208; Strand=-; Position=1-1397
MTQFLNDGLAATYLAYLATISQRKVVVVDPMVWSNGLDRVMPYKNMTFGYDPNVPAEVILLPVHFPGHWTLIVHDVQCGTHFADSLPTQYGRLDVQLTDKIRKIISDILPSTLLTGIVDVQNLTAQHDGNSCGYFVCLYAESWLMNNRTFVLPDLSINYEKKRILWHINELYGSDNVPYHPREGVPTPYPIVYRHADEAQSTSKAAEPMEIDEEDDIMIIGPQMSGQAVNAILTQAQVAGENQADTLGLVSESCAPQEPIAQADDAIFVRPKTPPRRSSRIGRRQSASISRSPSPAPRRSLLAKAVEKVTAFTQRCYLAHKGWCCAAAAAKHYPGYSNSGKLGDKKCSHCGALLFPHEDSRVCCRQGRVVLPKLNPHPKELEELIVCDKQPREGKEFVRNMSRYNNLLQFASVSAGNKPCPAGGPMAVILNGEFHRRISSMQAGTTQIVPIVLLERTASVLVKSA

SEQ ID NO: 142786 - protein, 25 aa, Heterodera glycines
  Coding regions on vcDNA: vcDNA=SeqID_69209; Strand=-; Position=1-75
TCTCGVVVKLSIFHNFSPGFNSPLG

SEQ ID NO: 142787 - protein, 372 aa, Heterodera glycines
  Coding regions on vcDNA: vcDNA=SeqID_69210; Strand=-; Position=1 -171,331-359,407-493,999-1184,1230-1293,1787-1949,1993-2122,2178 -2311,2479-2500
  Homolog annotation: Hit_ID=NP_509879.2; Match level="QueryCoverage =98%, HitCoverage=65%, E-value=1e-76, Identity=43%"; Hit description =amino acid/polyamine transporter, family II (54.0 kD) (XL883) [Caenorhabditis elegans] emb|CAA97776.2| Hy
FLTKQNVIPIHILPFSYVCATFIFESMAIAFRRAPPREQLQEGAFVVEDDVPSNFEIERRIEISEMAHLSEMAHLFLGQSGTILSYLLLTIYLFGDLAVYSSTVPKSLMNVICSSLNVSAVSISPFSPCHSHPNDLFHSLSRFAVYRICIFAFLLCLPMILMGITRTKWLILMGITRTKWLQLATTLSRWTAFLLMIVLAIAQLAHNGPKGSPAPVNFHGFGSLFGVAVYAFMCHHSLPALITPIRNKHHLSAKLTSVYSLVNKHHLSAKLTSVYSLVFLFYCALSLSGAFTFAHVQDIYTINFLHDEQTGGLLRLTDYFHDEQTGGLLRLTDYFLALFPVFMLTSSYVIVAITLCNNIRVLGTLLCPPKLA

SEQ ID NO: 142788 - protein, 104 aa, Heterodera glycines
  Coding regions on vcDNA: vcDNA=SeqID_69211; Strand=-; Position=1-315
GHHVQPSAHQRFGAVLSPTPPPSAYPSAGVVISSKVPSFFRSVPPASPFVCPAPPSVVLSQPPPMGSPLPQRAQLSREQLLSRHSRDVEARKVTVKLYHLQRTI

SEQ ID NO: 142789 - protein, 39 aa, Heterodera glycines
  Coding regions on vcDNA: vcDNA=SeqID_69212; Strand=-; Position=1-132
DLPFPLFLQVFCLKTAKIWSFLMKKCSCYPAVEKKLLVK

SEQ ID NO: 142790 - protein, 228 aa, Heterodera glycines
  Coding regions on vcDNA: vcDNA=SeqID_69213; Strand=+; Position=1-687
MKVCLLISSFAFLITILISNNYVGSEKKKMEQKTFDEIFGEKWEEKRNEEQKKREIIGKFNKIKEKIKQKGRKYARKEWSKIEGKIAKKLGTNRQYIYEWIKELGLNQKNCYKSKTEEEKIEIINKFIEMQNEFKQKRKYSRKEWNKNYEEICKKIGVSLFIIKKWMKQFGISRKITEKEKMEKMKIYWHIKKEKPKMSDKEIGKMLKIHQNTIGNWKKQFVHGLMED

SEQ ID NO: 142791 - protein, 346 aa, Heterodera glycines
  Coding regions on vcDNA: vcDNA=SeqID_69214; Strand=+; Position=1-1040
  Homolog annotation: Hit_ID=NP_851596.1; Match level="QueryCoverage =98%, HitCoverage=25%, E-value=2e-15, Identity=31%"; Hit description =sperm protein 3111 [Rattus norvegicus] gb|AAP13530.1| sperm protein SSP3111 [Rattus norvegicus]
MHQGTPNVPTVSNNGTSFGRIAPPGISDGTMHQGIPNVPTVSNNGTSFGRVAPPGISDGTMNQGIPNVPTVSNNGTSFGRITPQGISDGIMHQGTPNVPTVSNNGTSFGRITPQGISDGIMHQGTPNVPTVSNNGTSFGRVAPPGISDGTMNQGIPNVPTVSNNGTSFGRITPQGISDGIMHQGTPNVPTVSNNGTSFGRVAPQGISDGTMHQGTPNVPTLSNNGTSFGRITPQGISDGIMHQGIPNVPTLSNNGTSFGRITPQGISHGIMHQGIPNVPTVSNNGTSFGRVAPPGISDGTMNQGIPNVPTLSNNGTSFGRVAPPGISDGTMNQGTPNVPTLSNNGT

SEQ ID NO: 142792 - protein, 27 aa, Heterodera glycines
  Coding regions on vcDNA: vcDNA=SeqID_69215; Strand=-; Position=1-82
MNQGIPNVPTLSNNGTSFGRVAPPGIS

SEQ ID NO: 142793 - protein, 59 aa, Heterodera glycines
  Coding regions on vcDNA: vcDNA=SeqID_69216; Strand=+; Position=1 -67,440-552
MCTYQRMYLEKGKQKPKTETKQYGRQPLSFCINLEISLSIFLTVLERDREFSVRVPPLS

SEQ ID NO: 142794 - protein, 54 aa, Heterodera glycines
  Coding regions on vcDNA: vcDNA=SeqID_69217; Strand=+; Position=1 -154,345-355
MSSTNSNNNGRAVQQQQQNNGRESAGGAIKQRDGAAKEPTAQLQQQQQKIIRIL

SEQ ID NO: 142795 - protein, 130 aa, Heterodera glycines
  Coding regions on vcDNA: vcDNA=SeqID_69218; Strand=-; Position=1 -89,211-304,722-930
ALTLPITVEQLRIFANSPIDVAEEERLDQEKSRKVLELYRGKTVKQLEALLFQQQQQNGNGGAAINCNCANELTNGENGTGAVTVNQHHHHQPNCAAIATTKTSPTVATEAVVVETLAQAVHRLTQRHEE

SEQ ID NO: 142796 - protein, 23 aa, Heterodera glycines
  Coding regions on vcDNA: vcDNA=SeqID_69219; Strand=+; Position=1 -30,219-260
MRNCSTVMGKNKVTKFVGKTPSM

SEQ ID NO: 142797 - protein, 32 aa, Heterodera glycines
  Coding regions on vcDNA: vcDNA=SeqID_69220; Strand=-; Position=1 -1,329-426
GQVSPVPGSMPIKFGTILLLIERARAEENFLI

SEQ ID NO: 142798 - protein, 223 aa, Heterodera glycines
  Coding regions on vcDNA: vcDNA=SeqID_69221; Strand=+; Position=1 -71,111-478,537-701,793-860
MGAKKIGHHLKRVFLFGKIFAYFCEWSKGEKYEESHEKLWKIFVNNLSDLNKNSNEKQLNFIKMMENLLNYLRNQSPQISADAQRNSKELLANCVNQFLLLCESNAEFFENFRELSKSRAVFKEILDFASKGMEEMLPNRLMNWFNDHNKNQKDLENFGVGRSFADRIFEKSNIKKSYDECPKENMTNKELIRADQKAQSNDPEAYYLMTSYIDFLQTSADDR

SEQ ID NO: 142799 - protein, 132 aa, Heterodera glycines
  Coding regions on vcDNA: vcDNA=SeqID_69222; Strand=+; Position=1 -96,135-252,468-652
MPKQNEIVLKYSFLDLTWFLDIEAVFYAISKTKKCLVVKTIFHISLHNFVSSARIETGIRPLKRAARALQEVKKLFEFLQFCFHNFRKLFGIIMPKQNEIVLKYSFLDLTWFLDIEAVFYAISKTVIPNPRL

SEQ ID NO: 142800 - protein, 102 aa, Heterodera glycines
  Coding regions on vcDNA: vcDNA=SeqID_69223; Strand=+; Position=1 -110,457-550,664-770
KVINDNDKAEGSTGPSAANHQQNVSEQYLTKLELEKRLLKAELKQREMMEELKELKDANIEQQKKENAFIGQIQELKDEQQKCLDKYEALEKELARKYSKLF

SEQ ID NO: 142801 - protein, 62 aa, Heterodera glycines
  Coding regions on vcDNA: vcDNA=SeqID_69224; Strand=+; Position=1 -88,161-261
MLIKKGSNTKLIRSLLHGDLISPFWLGTREHKILYNIQKTACLYDLYRLRYGQAPIRILMEY

SEQ ID NO: 142802 - protein, 60 aa, Heterodera glycines
  Coding regions on vcDNA: vcDNA=SeqID_69225; Strand=-; Position=1-517
KPNRYSHFLKYKNLVDNKLLYIIIFFGCCRWSIEMDKIAHCLLVCCLLIIFFRLYGLWRK

SEQ ID NO: 142803 - protein, 17 aa, Heterodera glycines
  Coding regions on vcDNA: vcDNA=SeqID_69226; Strand=+; Position=1-74
HKHLFDLFYHIHNLIKI

SEQ ID NO: 142804 - protein, 204 aa, Heterodera glycines
  Coding regions on vcDNA: vcDNA=SeqID_69227; Strand=+; Position=1 -57,479-574,641-866,923-1158
MTEKGINSKKLKKNTKQAQRLLAFKEADMNYLLATILIQQFIILVCGANEKEIITLYKFMCKELTENDEANLYRNTKDWQHIKTIIHNEQIMDKFETLIEWQIRYSSIERWFNYCEKLKTYINSKNVNGEALLMSISLKPKFTLPNGNGILPIAKAMANIVEAYKNIFMGNCEKIFRNCYKKIIKQEENSSEMNFENKEDSIKV

SEQ ID NO: 142805 - protein, 208 aa, Heterodera glycines
  Coding regions on vcDNA: vcDNA=SeqID_69228; Strand=+; Position=1 -363,475-645,744-836
  Homolog annotation: Hit_ID=CAE62113.1; Match level="QueryCoverage =71%, HitCoverage=22%, E-value=4e-22, Identity=42%"; Hit description =Hypothetical protein CBG06151 [Caenorhabditis briggsae]
MDYGLGRIRRRLSNYGAMSPTKSVQEVQPVALSWDRLTVRQFLGKPVGVVSSMSKIVSTFLDYVSGKADTDQLVALMGDGGVGKTTLLNTLLNRNLKNLSMEDQVLINAHSLGQFINYVIKYVQHDDLFMGTLTMKEHLMAQAQLRMVGHTQRTMRRRVNEVGFGGWTEAVANWKSFKDKKGIFGVVRRRPFAVRFRTYEQSANHFCR

SEQ ID NO: 142806 - protein, 455 aa, Heterodera glycines
  Coding regions on vcDNA: vcDNA=SeqID_69229; Strand=+; Position=1 -363,475-594,646-702,745-843,1305-1482,1537-1715,1840-2029,2084-2262
  Homolog annotation: Hit_ID=NP_502164.1; Match level="QueryCoverage =97%, HitCoverage=30%, E-value=5e-38, Identity=47%"; Hit description =white family member (67.1 kD) (4M237) [Caenorhabditis elegans] emb|CAB05682.3| Hypothetical protein C10C6
MDYGLGRIRRRLSNYGAMSPTKSVQEVQPVALSWDRLTVWQFLGKPVGVVSSMSKIVSTFLDYVSGKADTDQLVALMGDGGVGKTTLLNTLLNRNLKNLSMEDQVLINAHSLGQFINYVIKYVQHDDLFMGTLTMKEHLMAQAQLRMVGHTQRTMRRRVNEVIDEFGLQECRHEPVGFSGDKKGISGGEARRLLFASELMNNPQIIFADEPNKLKHSASDALTMDYGLGRKRRRQSNYGAMSPTKSVQEVQPVALSWDGLTVVHAKSGRKILDNVSGMVDAGQLVALMGASGAGKTTLLNTLLNRNLKSLSVEGQVLINGHSFGRFITYVSGYVQQDDMFMGSLTVEHFMAQDWMVGDTQRTKRTRAKNVLEVQPVALSWHGLTAVHAKSGRKIPDAVSGLTDAGQLVALTGASGVDRTTLFNTLLNRNLKSLSVEGQLLINAHSLGQFINYASG

SEQ ID NO: 142807 - protein, 53 aa, Heterodera glycines
  Coding regions on vcDNA: vcDNA=SeqID_69230; Strand=+; Position=1 -63,103-199
MRNLFKLPKPAIFKTSISSQICNKINSNMVSIRLFLLLLGIRRRLREIRNLFV

SEQ ID NO: 142808 - protein, 77 aa, Heterodera glycines
  Coding regions on vcDNA: vcDNA=SeqID_69231; Strand=+; Position=1 -45,564-678,837-907
MAAFDANNNSRLSPEEQFRAVLNLRRTAQRLTVENSRLDRMNAMLVVLFQRLTAFAVPPVVPVVPVNANNNNRHSYN

SEQ ID NO: 142809 - protein, 38 aa, Heterodera glycines
  Coding regions on vcDNA: vcDNA=SeqID_69232; Strand=+; Position=1 -36,114-194
MSTPTRREFSNRLLMLIFRIWTRTKRNSSADDLSLYSF

SEQ ID NO: 142810 - protein, 199 aa, Heterodera glycines
  Coding regions on vcDNA: vcDNA=SeqID_69233; Strand=-; Position=1 -192,330-542,939-1133
MLTKGKVFGVGHSRWMLLPCSPSRGVKVRCFCHPRAQIAALLACLSILWTVKSIKSTSIAFPIMTIHQLHKIAWSGTQHSGHFRTSDVRIGDKLCPEWEKVGGLMDGLVTRIRAAVANDDDDTFMKNAIKYHVEFNLSFVLPKNKWKDYEDTINKATIKSDENPHPAPTAALIFLRGLSIIMRRAKTSKETNIYFKIKK

SEQ ID NO: 142811 - protein, 138 aa, Heterodera glycines
  misc_feature (68)..(68): Xaa can be any naturally occurring amino acid
  misc_feature (73)..(73): Xaa can be any naturally occurring amino acid
  misc_feature (81)..(81): Xaa can be any naturally occurring amino acid
  Coding regions on vcDNA: vcDNA=SeqID_69234; Strand=-; Position=1 -138,376-651
  Homolog annotation: Hit_ID=NP_523931.1; Match level="QueryCoverage =91%, HitCoverage=24%, E-value=7e-33, Identity=57%"; Hit description =CG4659-PA [Drosophila melanogaster] gb|AAF50806.1| CG4659-PA [Drosophila melanogaster] gb|AAD46831.1| BcD
FTISFRSSVHVSVDPGVTPFQPVKGRPNVVMFVGLQGAGKTTTCTKFSLQFATLCLCSLFICLFAIRXWHHYXKNNNIFSXISGHYSSYTEVDPVIIAANGVDKFKNDGFEMIVVDTSGRHKQEVALFEEMLQVLNAV

SEQ ID NO: 142812 - protein, 42 aa, Heterodera glycines
  Coding regions on vcDNA: vcDNA=SeqID_69235; Strand=-; Position=1 -81,504-548
  Homolog annotation: Hit_ID=NP_501507.1; Match level="QueryCoverage =100%, HitCoverage=8%, E-value=1e-13, Identity=88%"; Hit description =signal recognition particle 54kDa (55.0 kD) (4J508) [Caenorhabditis elegans] emb|CAA92301.1| Hypothetical
MIVVDTSGRHKQEVALFEEMLQVSNAVKPDNVVFVMDASIGQ

SEQ ID NO: 142813 - protein, 147 aa, Heterodera glycines
  Coding regions on vcDNA: vcDNA=SeqID_69236; Strand=+; Position=1 -97,461-804
MEYAEKGDPEMHKQLQNLIGAFHTLSGMNRFRKPFWDEQQYNSIHKLVMGSANYFQHRFGINLADFSQNPTQFGDMNSKIVPLINLVRNRLLIEDGPKQQKKAKDGEKQQKNKKDGQKRTMPKEGANDAKDDGVNGHFRKLAKWRPT

SEQ ID NO: 142814 - protein, 24 aa, Heterodera glycines
  Coding regions on vcDNA: vcDNA=SeqID_69237; Strand=+; Position=1 -52,429-451
MEKACKIRRDYIDFSALELLELAS

SEQ ID NO: 142815 - protein, 22 aa, Heterodera glycines
  Coding regions on vcDNA: vcDNA=SeqID_69238; Strand=+; Position=1-83
DRKASESLIIFKLTFGAFQSTF

SEQ ID NO: 142816 - protein, 39 aa, Heterodera glycines
  Coding regions on vcDNA: vcDNA=SeqID_69239; Strand=-; Position=1-152
KFLKILFISLLIEKASESLIYLLINIWCVSEHVLKNIYE

SEQ ID NO: 142817 - protein, 29 aa, Heterodera glycines
  Coding regions on vcDNA: vcDNA=SeqID_69240; Strand=+; Position=1-145
LFGLFKKELKIFKNFIHLPLIEKASESLI

SEQ ID NO: 142818 - protein, 19 aa, Heterodera glycines
  Coding regions on vcDNA: vcDNA=SeqID_69241; Strand=-; Position=1-59
TFAFSSLALPNTHTIFEML

SEQ ID NO: 142819 - protein, 19 aa, Heterodera glycines
  Coding regions on vcDNA: vcDNA=SeqID_69242; Strand=-; Position=1-59
TFAFSSLALPNTHTIFEML

SEQ ID NO: 142820 - protein, 19 aa, Heterodera glycines
  Coding regions on vcDNA: vcDNA=SeqID_69243; Strand=-; Position=1-59
TFSFSSLALPNTHTIFEML

SEQ ID NO: 142821 - protein, 19 aa, Heterodera glycines
  Coding regions on vcDNA: vcDNA=SeqID_69244; Strand=-; Position=1-59
TFAFSSLALPNTHTIFEML

SEQ ID NO: 142822 - protein, 19 aa, Heterodera glycines
  Coding regions on vcDNA: vcDNA=SeqID_69245; Strand=-; Position=1-59
TFSFSSLALPNTHTIFEML

SEQ ID NO: 142823 - protein, 19 aa, Heterodera glycines
  Coding regions on vcDNA: vcDNA=SeqID_69246; Strand=-; Position=1-59
TFSFSSLALPNTHTIFEML

SEQ ID NO: 142824 - protein, 46 aa, Heterodera glycines
  Coding regions on vcDNA: vcDNA=SeqID_69247; Strand=-; Position=1-295
FEIFVIFSRLIEPVKSFRMISRLFDSVNNFKSYIDSKLAQTELARS

SEQ ID NO: 142825 - protein, 196 aa, Heterodera glycines
  misc_feature (51)..(51): Xaa can be any naturally occurring amino acid
  misc_feature (67)..(67): Xaa can be any naturally occurring amino acid
  misc_feature (133)..(133): Xaa can be any naturally occurring amino acid
  misc_feature (190)..(190): Xaa can be any naturally occurring amino acid
  Coding regions on vcDNA: vcDNA=SeqID_69248; Strand=+; Position=1-601
  Homolog annotation: Hit_ID=BAB33421.1; Match level="QueryCoverage =100%, HitCoverage=70%, E-value=9e-59, Identity=65%"; Hit description= putative senescence-associated protein [Pisum sativum]
GEFCFAMIGRADLQGSKSDVAMDAWPPQASYPCGNFSDTSCWKLYTLKDRXATLSRSVFVLKIRIKXAFAFLLYERFPSSLSSLGHLRYALTDVPPQSNSPPDTVIGAGRRARVARLNTKMDTRRTPVLPIKXGIDESSGISLAPCGSHLCYTSHDSSQSQTRVKLNRVFFPAKFAKPVPLAVVSLDSRXGQWESR

SEQ ID NO: 142826 - protein, 50 aa, Heterodera glycines
  Coding regions on vcDNA: vcDNA=SeqID_69249; Strand=+; Position=1 -32,699-819
MCPPIQMCTLVNPISQKAVNDITTVIFGSHEFVGPNDGIGLSNIFLVNKK

SEQ ID NO: 142827 - protein, 105 aa, Heterodera glycines
  Coding regions on vcDNA: vcDNA=SeqID_69250; Strand=-; Position=1 -210,662-769
MRIVLSSLTLIIFLCIFTVSGQSAENATKSVPHSVPNGKEKPNYSICARFGANKQRACRIMVHNLFETRNEFPLRLLSAQSMGKVMGRHCAWNTECSVMSNGTDS

SEQ ID NO: 142828 - protein, 123 aa, Heterodera glycines
  Coding regions on vcDNA: vcDNA=SeqID_69251; Strand=-; Position=1-372
MQRDGVPSSASSSSIACSEPSVIVRSTVPVLSNENKNAEKIRENYQSDDNENGESSCDACEADEEDDVEENMQNEESGDSGSEDSHDNDSDGHYSDNNQAESSDEKRKETYKEHSDGHSRGSI

SEQ ID NO: 142829 - protein, 348 aa, Heterodera glycines
  Coding regions on vcDNA: vcDNA=SeqID_69252; Strand=-; Position=1-1047
MSEKLAFFLKSTQEKQSSPKLRTKLNTPMAQKTKAPTKAAKNQAIPKNQKHTASSDRQKKVTEKKAVSLGNDKFRRRRRAITPIDSSTIHALLIALAILCITVLAFSSDLNPWAIVAIVFLTLNSQQANNRPNQIAKVIANVANRIYGTTDRHTEREPLLNSDDEPHRNVPQTHGLQAFHRGSYTERDRHGNAQQATPGLLKQQLSTPEFEFKLDYYPPTNRNNNKNSRTAGEASHQSRPAAPIATMALARSGNNQQIERSASNKSTARSERSGKKMESGECCDEDGECGGGDGECCDEDGECAGVSRTSSWNNDPNESAASNKLTAKSERSSEKKERNDDSVGTSAY

SEQ ID NO: 142830 - protein, 968 aa, Heterodera glycines
  Coding regions on vcDNA: vcDNA=SeqID_69253; Strand=+; Position=1-2907
  Homolog annotation: Hit_ID=NP_498959.1; Match level="QueryCoverage =52%, HitCoverage=22%, E-value=2e-93, Identity=37%"; Hit description =zn-finger, CCHC type and RNA-directed DNA polymerase  and Integrase, catalytic domain containing protein
MIRNQPTPATNANTVPLNAPNRTQNQNFRPYGSNAIVVTEKNEDDSPVISVAHFEQKETRDYEKFFNALSTHSTEFPTNNPALVKTSKCLDITLSVVEKEAKGLMDSGAEANIANPEFLYQISVEKGINLTDWGFCPNSGPTKLPFSVASFNGGNISVIGVINVPIRKGNIESVISCLISLKPFSYDFVLGPNALDALGYYIGNTITNEILNFTSKFPTKNALLNTVYVSSFKSIPPFSSCFVESFVKTQNNCQKRSQFLIENSMSEQDLLDYESETERDENVMELCGEEEEKMLKKFGILDEKPKIVRSKSAPETDDVKVPINNLMVVERAIVGSKRGKFKILIHNKSNERIFLEPGMKVAQAEVIERVFDPFSELMPKSFDQLLLPQIFIRNLSKIDSKNRINDLFSILDPKTGPLSESEKEQMHEVWCEFNEILALDESELTQTGLIKHHINTENSNPIKSPPRPIPFGVRAKVTEMINDYLNRGVIQPSSSPWASPIVLVTKKDGTVRFCVDYRKLNAVTVKDSYPLPNIEQILMYLGNRKFFSVLDLISGYWQVKVNPEDVPKTAFTMPEGLYEFLVLPFGLCNAPATFQRFMNNILGEFVNDFVYLDDILIASKTFDEHIIHLKKVFQKLKDFEVKVKAKKCGFAQSNLPYLGHILTRQGLAKDPEKYKPILDFPQPKTIKQLQRFLGMTGWHRKFIKDYAKIAAPLTKIFKKNPTNKSWEWDEGAEKAFTNLKESIVKEVVLKYPDFELAQKDPKYKFHIFCDASKEGLGAVLCQRDKSGKLRPICYASRKCNKAESNYGPTVLECLGIKFSVQKFKQFIAWLPTIVVTDHKALPGMFRSKNSVGNPKVDRWIMELGAPFQLEVVYSPGKENYVADALSRAFPNDALFQFGDNEENENVTISVMVIQKNNSLPKNSSKEEWLKEVKNSELGFIFEFLDHKILPSDQKLRQKVIGFPWKIYC

SEQ ID NO: 142831 - protein, 51 aa, Heterodera glycines
  Coding regions on vcDNA: vcDNA=SeqID_69254; Strand=-; Position=1 -70,455-540
MNIKKGKPFIGTECPLNATFVDNGQLMKNDATNSLYFCYPTVRSDLAQMTA

SEQ ID NO: 142832 - protein, 141 aa, Heterodera glycines
  Coding regions on vcDNA: vcDNA=SeqID_69255; Strand=+; Position=1 -101,150-342,735-826,868-905
  Homolog annotation: Hit_ID=NP_492222.2; Match level="QueryCoverage =100%, HitCoverage=5%, E-value=1e-32, Identity=51%"; Hit description =j-domain containing protein, required for endocytosis, Receptor Mediated Endocytosis RME-8 (259.2 kD) (rm
MREIAIEFVVVDLQLARDSLSLDDFMLTRLGLCSKDEQLASYVEFNVQKFTAKCASGASSEARQNALSTRRLLCLSESCIIERDPISYAVICARSLRTIVCLVRDINDPQKFTIVYECGVERTFSSNERDSLLAALLDGIR

SEQ ID NO: 142833 - protein, 83 aa, Heterodera glycines
  Coding regions on vcDNA: vcDNA=SeqID_69256; Strand=-; Position=1 -124,183-310
EQKRKKQSAFLKKALRLKIGALWKQYRSERAKVVEEYTAAIAILGPQENVWSSPDPDPKVPSTSAAWEHNYVPISPDYAATLM

SEQ ID NO: 142834 - protein, 154 aa, Heterodera glycines
  Coding regions on vcDNA: vcDNA=SeqID_69257; Strand=-; Position=1-462
MKLFLFFFLIVLFLIIQIEIGAEKKKLEQKTFEEIFGEKWEEKENEQKKREIVQKFNKIKEKIKQKERKYSTKEWNKIKDKILKKLGTNRTKIYKWIKELNLQEIKSYKSKTDEQKIEIVQKFMAMKNEYKQKGRKYSTKEWHQNYAEIVKKIG

SEQ ID NO: 142835 - protein, 40 aa, Heterodera glycines
  Coding regions on vcDNA: vcDNA=SeqID_69258; Strand=+; Position=1-145
IFYRFLNGLDFFLAYQNFIEPGSFYSLSIAPNFFDSLTRP

SEQ ID NO: 142836 - protein, 78 aa, Heterodera glycines
  Coding regions on vcDNA: vcDNA=SeqID_69259; Strand=+; Position=1 -43,358-551
MAFEAVMVKQNFPQETLSQNLQEWYRQPNRQFTSTSLNPIMTCRHLTQNQWKYCRTATRKRQGGTSETITTAQWFAGS

SEQ ID NO: 142837 - protein, 188 aa, Heterodera glycines
  Coding regions on vcDNA: vcDNA=SeqID_69260; Strand=+; Position=1 -96,135-252,468-628,667-784,825-898
MPKQNEIVLKYSFLDLTWFLDIEAVFYAISKTKKCLVVKTIFHISLHNFVSSARIETGIRPLERAARALQEVKKLFEFLQFCFHNFRKLFGIIMPKQNEIVLKYSFLDLTWFLDIEAVFYAISKTKKCLVVKTIFHISLHNFVSSARIETGIRPLERAARALQEEIRINSPCGPNFRPPATAPCFSQV

SEQ ID NO: 142838 - protein, 219 aa, Heterodera glycines
  Coding regions on vcDNA: vcDNA=SeqID_69261; Strand=-; Position=1 -153,210-348,397-764
  Homolog annotation: Hit_ID=NP_502244.1; Match level="QueryCoverage =52%, HitCoverage=18%, E-value=1e-12, Identity=34%"; Hit description =BTB domain containing (67.7 kD) (4M616C) [Caenorhabditis elegans] emb|CAB01179.1| Hypothetical protein F3
DFAHHCFRYICQNAFELFESDEFLQIDQNLLCELFERDQLLINDEYELWQAALRWADEKCRQKGNVCSAKKRRALLGPALFKIRFPLISPEEFTKNIVPSGVLTNDEIVSIYQFHSHPNLRGVPGLKTLKFPWHGRISDWNTAKGNRGTLALEIEKFSEFAREEVGSRRFSDYEIRINGFGWKILAEIKTKEKSTDEKCLGFFLSCTASGKGEVKIKIF

SEQ ID NO: 142839 - protein, 141 aa, Heterodera glycines
  Coding regions on vcDNA: vcDNA=SeqID_69262; Strand=-; Position=1 -107,163-252,1474-1564,1616-1753
  Homolog annotation: Hit_ID=NP_500801.2; Match level="QueryCoverage =44%, HitCoverage=14%, E-value=7e-15, Identity=52%"; Hit description =brg1 brm-associated factor 53A (48.4 kD) (4G161) [Caenorhabditis elegans] gb|AAF60947.2| Hypothetical pro
VVKSPVGGDFVVDQCRKMLVKEGVDIVPYYKVASKKEVKEGDAPIWTPRANLPAVTQSYENFMGSLFRAHKHILTLSSDVFEAMFRFDAQNAKSGGPSADQSSLVKVPDVEAAAFKVMLSFIYADDLSELDGENAMAVLYA

SEQ ID NO: 142840 - protein, 37 aa, Heterodera glycines
  Coding regions on vcDNA: vcDNA=SeqID_69263; Strand=+; Position=1-112
LKLNSAAWVQCSITLRANWSIRRMFSRFLSKFDDITM

SEQ ID NO: 142841 - protein, 307 aa, Heterodera glycines
  Coding regions on vcDNA: vcDNA=SeqID_69264; Strand=+; Position=1-938
  Homolog annotation: Hit_ID=NP_510671.1; Match level="QueryCoverage =94%, HitCoverage=30%, E-value=3e-60, Identity=40%"; Hit description =predicted CDS, endonuclease/exonuclease/phosphatase family and RNA -directed DNA polymerase (XR69) [Caenor
RNQKIDIIYLDLQKAFDQVPHDLLIYKLKKTGITDNLLNWLRDFLLGRTFKVRIIKNSNEFPVKSGVPQGSVLGPILFLIFINDLPEEIPKEISIKLFADDTKIYHCYSNESQRSFSSVFNWAETWGLNFSVKKSSVLYLGKNNKKIPYTIKNSTFPESKIIRDLGILIDNKLKFNGHVSTILQKAYLKSRILFKKIKTKSTKTWITVYKSYIRPLLEYATEIWNPRTKKEINRLEKFQKNFTKNVFRKCCLPYISYSERLKFLKLSKLETRRKYLDIITAFQIIKNTTHLNPKNLYNFSNRKRSPF

SEQ ID NO: 142842 - protein, 240 aa, Heterodera glycines
  Coding regions on vcDNA: vcDNA=SeqID_69265; Strand=+; Position=1-720
  Homolog annotation: Hit_ID=AAD25621.1; Match level="QueryCoverage =97%, HitCoverage=20%, E-value=1e-23, Identity=30%"; Hit description =Hypothetical   protein [Arabidopsis thaliana] pir||A96586 hypothetical protein F20D21.24 [imported] - Arab
MLHNTVIEVIDRVCKEMAIRQHKDLLFGGKTVIFSGDFKQSLPVVPHEGLTAQVTACFQTSPLFGQFTTMKLTINQRLGKGQQAYLQMCRQIGLGETGEHFWIPPQFIVKSKEELIDYVYPNFQQLLGNDKELLNRLILAPHIDTCDEVNEIMMANVPGQVREYLSTDKPLDDRPLDIDEIESEVAALNRRTDSGMPPHSLRLKVRCVVVLLINKSDKEGLINGTRIVQEELGDDRLIGR

SEQ ID NO: 142843 - protein, 30 aa, Heterodera glycines
  Coding regions on vcDNA: vcDNA=SeqID_69266; Strand=-; Position=1-90
MTEIEKEMKAIETLLGEISHHMADWIEEKL

SEQ ID NO: 142844 - protein, 95 aa, Heterodera glycines
  Coding regions on vcDNA: vcDNA=SeqID_69267; Strand=+; Position=1 -98,305-494
MFEFLLPFSKGLVVQNRQNVKVQHGAIHFPQLRDGFCPYLNFYYGIFYESASNNEYRNIIYNLYSWHNRSVKFVIYVRTPVQAQCAIYEALFQYE

SEQ ID NO: 142845 - protein, 201 aa, Heterodera glycines
  Coding regions on vcDNA: vcDNA=SeqID_69268; Strand=-; Position=1 -184,232-306,1125-1469
MPVASNLLKTVSREGLKAGNRVLEDISQGKALRESIQAHAKHGMENLVEKLRQCGMGAAKTDDLLIIIDEKNLSESFIKKAHHLNMDKPVKVELTDGSLMVFKPKQRERDSKIIPTQIVNDEGLDETGSIPTLEDPYTTAEESDAEPTTSTPKTRPLIRPMRVGTTKFRQKQKSFVVKKKVINNDPEKFGVGSRGHILRAD

SEQ ID NO: 142846 - protein, 128 aa, Heterodera glycines
  Coding regions on vcDNA: vcDNA=SeqID_69269; Strand=-; Position=1-387
QQIDRAKQLLEYRRKRFAALEFEAKKRDEQQQQSSPFSSPISAALTAGEALKERIGAAQVKETEKSDQDNNNSMEKPKTHAEVLKEKIQQQQQQEITTATPTELQMTVAKRQQTKNPCQASKGEDRTK

SEQ ID NO: 142847 - protein, 188 aa, Heterodera glycines
  misc_feature (162)..(162): Xaa can be any naturally occurring amino acid
  Coding regions on vcDNA: vcDNA=SeqID_69270; Strand=+; Position=1 -100,299-466,526-805
  Homolog annotation: Hit_ID=XP_426685.1; Match level="QueryCoverage =93%, HitCoverage=14%, E-value=3e-57, Identity=59%"; Hit description =PREDICTED: similar to SPRY domain-containing SOCS box 4; SPRY domain- containing SOCS box protein SSB-4 [G
PEDRSLNLYVNPPEVLTMHRHPVAHLNGMRGKVGYTRGFHVWQLNWPVNQRGTHAVVGVATKDAPLHAPGYVSLIGADAEGFGWNIGGNKCYHDANKCYHDAQNTKPWSFPYEQPFVAPEKLFCVLDMDEGQLAFATDSKYLGVAFRGLKGKKLYPVVSAVXRHCEITLRYLGGLDRKSTRIRIIGKK

SEQ ID NO: 142848 - protein, 32 aa, Heterodera glycines
  Coding regions on vcDNA: vcDNA=SeqID_69271; Strand=+; Position=1 -55,88-131
MQMLYSLAQKMDSYLLETCFNLTILFARFGIV

SEQ ID NO: 142849 - protein, 93 aa, Heterodera glycines
  Coding regions on vcDNA: vcDNA=SeqID_69272; Strand=+; Position=1 -176,228-333
MRSGSPPLTNFCSNNGNPPSLPPRPNFGTVQQQSQQQLFVGQQPAFVPYNASGMYNYNFYQQSAAPFTNPWPAIHSKNNFLLAAEGFDNIRII

SEQ ID NO: 142850 - protein, 75 aa, Heterodera glycines
  Coding regions on vcDNA: vcDNA=SeqID_69273; Strand=+; Position=1 -48,333-512
MATIQFLKSLGKCMAKKPICCNLAKSDEYNFIKKRITLINHNDPPLSQVMDTLIVTLMSLKKAMESGKKQIIFLF

SEQ ID NO: 142851 - protein, 264 aa, Heterodera glycines
  Coding regions on vcDNA: vcDNA=SeqID_69274; Strand=+; Position=1 -501,795-1088
  Homolog annotation: Hit_ID=CAE69665.1; Match level="QueryCoverage =87%, HitCoverage=91%, E-value=9e-35, Identity=34%"; Hit description =Hypothetical protein CBG15913 [Caenorhabditis briggsae]
MGTTIEKILTHVYYDLRSPASYAGVQKILLEAIKKNSNIKLKDVQNFLEKQRTYTLFKPKRNKFKRLKTVPSGLHTDWQCDLCVMDTLKDQNDGFRYILVCIDVLSRMLYVSPTLSKKGDHMIEAFEKIFKKSGVLPNKMYSDSGVEFQSKQMLNYCKEKDIIKKCNKKEKFSKGYYPNYTDELFKIERVNNTNPVTYRLSDLKGEEIKGIFYNQELVKTTEQTTHRAEILKTRITKGVKEHFVRWIGHSEKQNSWIPDSNLIH

SEQ ID NO: 142852 - protein, 74 aa, Heterodera glycines
  Coding regions on vcDNA: vcDNA=SeqID_69275; Strand=-; Position=1 -57,411-467,662-774
SVNRLLEKYICNLSTILRKSVHRLLEKYICNLSTILRKSVNRLLEKYICNLSTILRSELEMIIFTIQTNFRCSN

SEQ ID NO: 142853 - protein, 176 aa, Heterodera glycines
  Coding regions on vcDNA: vcDNA=SeqID_69276; Strand=+; Position=1 -120,170-344,444-679
MTISLHQTKGDVIDQLVDALKKCCDKILTATEEYKYPVKTNVIFGISAAFADRDISHLLPNLFVDALYSTPTSPHGDGIRKRTLSIEGRKLSQLQVSTAGLAALQEQFGHEYALTSFQAPPAEKQTQKEEGAKEETPKTNPAEDEEEKKTKTNSQSAEEQEKSTKTKTEEEREGGQ

SEQ ID NO: 142854 - protein, 44 aa, Heterodera glycines
  Coding regions on vcDNA: vcDNA=SeqID_69277; Strand=+; Position=1-132
  Homolog annotation: Hit_ID=CAE65012.1; Match level="QueryCoverage =97%, HitCoverage=23%, E-value=7e-09, Identity=67%"; Hit description =Hypothetical protein CBG09850 [Caenorhabditis briggsae]
MTLRNDTPMPPDEELRVPHEISLSSPWLRAVAVYMGIACEKEAK

SEQ ID NO: 142855 - protein, 133 aa, Heterodera glycines
  Coding regions on vcDNA: vcDNA=SeqID_69278; Strand=+; Position=1 -269,382-511
MAPQSVVSPPLPSRPSPPWLGPSPAEEVTEELNIVTTPKVISNNSGSYTGGRPNFGTPPMPLHHISLPSPQEMAPVTRQIPPEMERETNRWRQYAAAVLVHGRKGMPPKSLDEYENEEDDEEFRGRRMTVTYR

SEQ ID NO: 142856 - protein, 162 aa, Heterodera glycines
  Coding regions on vcDNA: vcDNA=SeqID_69279; Strand=-; Position=1 -451,489-526
MKLFPLLLVIILFLIVKIGSEKKKLQQKSFGEIFGEKWQEKEEEKRNELKKREIIGKYYKIKEKIKQKGRKYSRKEWDKINSKIAKKLGTNSCYIQKWIKEFGLQKKKSYKSKSDEQKLEIVQKFIEMKNEYKQKGKYSEKEWDQNYAGIYGRNNLAFAVKE

SEQ ID NO: 142857 - protein, 65 aa, Heterodera glycines; identical to SEQ ID NO: 126374
  Coding regions on vcDNA: vcDNA=SeqID_69280; Strand=-; Position=1 -30,83-250

SEQ ID NO: 142858 - protein, 68 aa, Heterodera glycines; identical to SEQ ID NO: 127362
  Coding regions on vcDNA: vcDNA=SeqID_69281; Strand=+; Position=1-519

SEQ ID NO: 142859 - protein, 34 aa, Heterodera glycines
  Coding regions on vcDNA: vcDNA=SeqID_69282; Strand=+; Position=1-104
HPIPSTIAFIHPIMNAKIIRVPKIACDLSPSKNG

SEQ ID NO: 142860 - protein, 86 aa, Heterodera glycines
  Coding regions on vcDNA: vcDNA=SeqID_69283; Strand=+; Position=1-389
FFLSFEIIVKNIRKLFSVLIMLYNAFKPRREAGQFQNFVPHFTVESPSTLLDNYVSMSTVAFGQLWNGKMGISDGVRSFLKIPLFV

SEQ ID NO: 142861 - protein, 75 aa, Heterodera glycines; identical to SEQ ID NO: 124542
  Coding regions on vcDNA: vcDNA=SeqID_69284; Strand=+; Position=1-225

SEQ ID NO: 142862 - protein, 94 aa, Heterodera glycines
  Coding regions on vcDNA: vcDNA=SeqID_69285; Strand=-; Position=1 -54,309-371,596-763
MRGADQPTIFYGKKGGEYAFSETRAEERGLMNPLLPFANEIPVRWNSALAMISRLLEQKDAIYQYAFENRSFDLTLAEEEWKLIEELISLLQPI

SEQ ID NO: 142863 - protein, 96 aa, Heterodera glycines
  Coding regions on vcDNA: vcDNA=SeqID_69286; Strand=+; Position=1 -68,265-484
  Homolog annotation: Hit_ID=EAL30279.1; Match level="QueryCoverage =90%, HitCoverage=40%, E-value=5e-36, Identity=82%"; Hit description =GA20236-PA [Drosophila pseudoobscura]
IELQIALKNYDPQKDKRFSGTVRLKHIPRPKTKVCILGDQKHCDEANANGIPCMTADDLKKLNKDKKLIKKLSKSYDAFLASESLIKFVKWVKDLG

SEQ ID NO: 142864 - protein, 104 aa, Heterodera glycines
  Coding regions on vcDNA: vcDNA=SeqID_69287; Strand=-; Position=1 -115,186-385
MDIAAQLSRIPPKHYRSVDLMNRIIDDEDTEEMGAEDEELAESVINDQRSPSDSPALRKSPTDSPIGQRVFSISPAEGASSNSVLTSTVQQHSPDDDEVFETAS

SEQ ID NO: 142865 - protein, 131 aa, Heterodera glycines
  Coding regions on vcDNA: vcDNA=SeqID_69288; Strand=-; Position=1-395
NELIEEVPSYLTDFSPIERAEKEIKILAEQNAKNGHIEIEKVLQILAKLILKFDLDILINEFNAKLSKTNNVNVLNRIGHKFTEEWHSICAKIVSENSEYSGIEKELEQKMKNLLIMEHEISTIKFANIME

SEQ ID NO: 142866 - protein, 51 aa, Heterodera glycines
  Coding regions on vcDNA: vcDNA=SeqID_69289; Strand=-; Position=1 -121,205-239
MTKLVAVSCAKGMFCDGYRYYKHKKTKNKIWWKFELNHYGYREGTVDFIFA

SEQ ID NO: 142867 - protein, 207 aa, Heterodera glycines
  Coding regions on vcDNA: vcDNA=SeqID_69290; Strand=-; Position=1 -88,578-624,793-895,952-1183,1244-1397
  Homolog annotation: Hit_ID=XP_318657.1; Match level="QueryCoverage =51%, HitCoverage=21%, E-value=7e-15, Identity=41%"; Hit description =ENSANGP00000010224 [Anopheles gambiae]
MTLMKKKFEAQLMDLLKLDPNTPLNSHEADFVNGSSVTMKSLFTLLLKTQFLAQWDEFVRCYSDCNVIVIGATNRVLDLDETVFCRFSLKVHVPLPDEESREKLLRMLLAQENVDVGFDYAEVVEVTKKLTSSELKEVIRFAFLLRYHHVALSRLNAPASLLAVGAQLDNQIKLSSEDVIQAFHSFKNYAMAPFSESVVTEEIVEVD

SEQ ID NO: 142868 - protein, 128 aa, Heterodera glycines; identical to SEQ ID NO: 125618
  Coding regions on vcDNA: vcDNA=SeqID_69291; Strand=-; Position=1-387

SEQ ID NO: 142869 - protein, 48 aa, Heterodera glycines
  misc_feature (42)..(42): Xaa can be any naturally occurring amino acid
  Coding regions on vcDNA: vcDNA=SeqID_69292; Strand=-; Position=1-327
  Homolog annotation: Hit_ID=XP_485323.1; Match level="QueryCoverage =72%, HitCoverage=23%, E-value=1e-09, Identity=82%"; Hit description =similar to putative senescence-associated protein [Mus musculus]
CLPTPGSKNIAILPRRDSDLEAFSHNPSDGSFAPLVYRPSTXTKCLNL

SEQ ID NO: 142870 - protein, 77 aa, Heterodera glycines
  Coding regions on vcDNA: vcDNA=SeqID_69293; Strand=+; Position=1 -84,175-324
MMVFKYRPSTDRTTDGSGGSATENSGQQHQLRHEQQIVVALVGVLHGRGPGRGARGGHSRGNHCAKFDADREQLGQS

SEQ ID NO: 142871 - protein, 17 aa, Heterodera glycines
  Coding regions on vcDNA: vcDNA=SeqID_69294; Strand=-; Position=1-51
MTTFHVLLLLLFVGMFV

SEQ ID NO: 142872 - protein, 479 aa, Heterodera glycines
  Coding regions on vcDNA: vcDNA=SeqID_69295; Strand=+; Position=1 -82,145-195,255-390,442-577,628-655,749-775,832-922,981-1225,1436 -1673,1731-1784,1834-1971
  Homolog annotation: Hit_ID=NP_497181.2; Match level="QueryCoverage =98%, HitCoverage=82%, E-value=1e-119, Identity=51%"; Hit description= protein kinase (3A877) [Caenorhabditis elegans] gb|AAF59648.4| Hypothetical protein Y50D7A.3a [Caenorhab
HSKNNRWLFWAGQQPSGFYRTYEPKEVIGRVIGRGLASVVRRCVEKGSRKEYAVSRKEYAVKIVDLSTERQSEREAKRLSEETFSEVRLLKLLSGHPSIICLHECLHEFFITPTFVFAIFELARCELFEALNKSVTFSEKRTRLVMRQLFDGVHYLHSQLFDGVHYLHSKKSIVHRDLKLENILCVDDKRVVILENILCVDDKRVVISDFGFAKQLEPGQKLKDLFGLFGTPGYLAPETLRCQMYENAEGYGLEVDEWALGVIMYTLLAGYAPFYHRQQLRMMRLVQEGRYEFDKEHWENISEEAKDLIRRLLMVNPSVRISSCDCLSHVWMAAWVGVPSPARMVEPTPFKRSPEQIRRLFRVAQFSVCFMVRLRNFKQFKLKFDRAALRTRPYRSREALRTRPYRSREIRHEAESASFAIYGHWVNRGFFYSASFAIYGHWVNRGFFYSRDMLFANKPRPRYVKMNNGSRDSKSPQKT

SEQ ID NO: 142873 - protein, 29 aa, Heterodera glycines
  Coding regions on vcDNA: vcDNA=SeqID_69296; Strand=+; Position=1-87
FLKALRYFIQIFTRHEKRCRAKSIKVVFN

SEQ ID NO: 142874 - protein, 609 aa, Heterodera glycines
  Coding regions on vcDNA: vcDNA=SeqID_69297; Strand=-; Position=1 -455,669-1017,1065-1395,1567-1881,1937-2045,2096-2270
  Homolog annotation: Hit_ID=NP_499292.2; Match level="QueryCoverage =97%, HitCoverage=64%, E-value=1e-82, Identity=35%"; Hit description =RUN domain and RabGAP/TBC domain containing protein (3L461) [Caenorhabditis elegans] emb|CAA84706.2| Hypo
IHLSDLLVNGFTLTHFRSRGFNNKWPVNQVTHRIRVPVSIKFETVSHSHFASKTVRVRAKNVSSINRSLPSEGTLSSSIVLIDSDGVQQFCFSFSLEQHCFSFLKTLEGALSPLFKIDPPLIPLKSNAVPRSSTNWNSVLLFHLFSFSRSSTQESAKCEGQQPKISLRLAEHLMDFLLSLISFDYVLSFNFSESLSNATKAMQSQILARAFLGWLTYSQHLRKIRLNLASIVTIERFIPNSDGMEMPVNEAFWRICRSEKTIVLFKQFLTRVYFCGIEIVLFKQFLTRVYFCGIEPLRAKVWPYLLRLIEWHEDFGRRELDAIDETYRNDLKEWTEMDAKLIADNEQRNGVDEEEEGLIRNYFFTSSHQQHSPTLSTHQSEEDISREFANNLLRIKKDVDRCDRTTKFYSCHDNLDILHRIICTYIFRRLKLDLEDGYVQGMCDLVAPLLVVFRHEALTLACFERLMLRLRRNFPQSSQNNGGMEENLNNFRSLVEVMDPELYCQLSNIDYFRSLVEVMDPELYCQLSNIDYSFVVYRWLLLDFKRELVYKELVYKEVFQLWEVIWAAEMSCSRHFELFFGLALLSQYRQMENKGKTIADQINNYLEMF

SEQ ID NO: 142875 - protein, 170 aa, Heterodera glycines
  Coding regions on vcDNA: vcDNA=SeqID_69298; Strand=-; Position=1 -105,380-533,824-1077
MENPRQKPSKVLAEIRANTKDETFVSMGTDLALVALLDVLKRARKISVDGTFKVSPAAWTQCFVIGAFVNRRLALCVLLVNLDHVYDFLAAILDDVDKQVDIARSARVFPYKRRIKYILKEQLIGDALDEAEYNADEDVMNILSLLSLQMQGYVGGLRAKGAQHEHEDRE

SEQ ID NO: 142876 - protein, 19 aa, Heterodera glycines
  Coding regions on vcDNA: vcDNA=SeqID_69299; Strand=+; Position=1-60
EPVNSCIGCKCRRCCTPNS

SEQ ID NO: 142877 - protein, 100 aa, Heterodera glycines
  Coding regions on vcDNA: vcDNA=SeqID_69300; Strand=+; Position=1-303
MWTEEQMKRMMKRRQRRWLTNEAIDDDEVDDDDYDCCYYYMMRQSDDDDDAAAVAETFAADANERTLGKEARMMPEAVMRTNGGQPQANRADFETSVPTL

SEQ ID NO: 142878 - protein, 83 aa, Heterodera glycines
  Coding regions on vcDNA: vcDNA=SeqID_69301; Strand=-; Position=1-249
KIIRVPKIACDLSLAKNGVSKNRNYAQKASQTILAHPIPSTIAFIHPIMNAKIIRVPKIACDLSLAKNGVSKNRNYAQKASQT

SEQ ID NO: 142879 - protein, 56 aa, Heterodera glycines
  Coding regions on vcDNA: vcDNA=SeqID_69302; Strand=+; Position=1 -149,484-505
MKPKFVYKKQNEIEGPLIIAVNCLIKISKFYFKSSSNEYYEDQLKRSIRRKNKKFL

SEQ ID NO: 142880 - protein, 94 aa, Heterodera glycines
  Coding regions on vcDNA: vcDNA=SeqID_69303; Strand=+; Position=1 -141,367-510
MGRMELDLDQMVKGRPNLVEEEAAYGQRKREITASIANMFEQYIDSLNRLRPLSVKCVLADDELKRLKRRRRVMGMDDDDIGEQLNAVKVGTFK

SEQ ID NO: 142881 - protein, 127 aa, Heterodera glycines
  Coding regions on vcDNA: vcDNA=SeqID_69304; Strand=-; Position=1 -107,336-440,504-675
MPEQSVYEKFDDLQNRGYTVTFRNTLQNARVWTSVIFTVVANSTQDENLRNLSSLYGANRQHSNTLISPIFIELNKVQPWYYGLLVYRIGMTGNDGNEIQSEYFVPYKDGISAVKAVIREFIIIEVG

SEQ ID NO: 142882 - protein, 58 aa, Heterodera glycines
  Coding regions on vcDNA: vcDNA=SeqID_69305; Strand=+; Position=1 -157,234-253
MSSFTTFSSADEFSPLQRKYFAILKNGDPYFNFFFSAQNQFIGFSSDDILKITFKNAK

SEQ ID NO: 142883 - protein, 71 aa, Heterodera glycines
  Coding regions on vcDNA: vcDNA=SeqID_69306; Strand=+; Position=1 -167,229-277
LRLHRPALLQLLFCAGQTLHQPNGRTASAEPQFVVMLKKVPGKQNANKSAQKADKVLKVITAEQQIEYQPK

SEQ ID NO: 142884 - protein, 385 aa, Heterodera glycines
  Coding regions on vcDNA: vcDNA=SeqID_69307; Strand=+; Position=1 -156,243-523,577-904,1097-1231,1278-1498,1572-1608
  Homolog annotation: Hit_ID=AAQ97969.1; Match level="QueryCoverage =70%, HitCoverage=39%, E-value=1e-14, Identity=26%"; Hit description =transketolase [Danio rerio] gb|AAH56536.1| Tkt protein [Danio rerio]
MDSKKFLPLELIYELVNALPINHHWAAQRVSSEFDNLVFERQADLIKIILQKANVSTAQSYITTMVQLANADERIVFLTEYAILRTILGGNLFFHCHSVRFTPSQHEFCSEAVTLGNRLFNCAETKQSIVDHSVVMTFCGRMPHVCLDVSSFSQMSPQQFALADGASANVQFVGCYSGGQLLINDLALFGGLQNSVVLCPSDAFSAERATQLAMTHNGITYIRISPYPTPAIYGSSDHDKFEIGLFIVRLFNYRTNRHQSHKDKVVLVGIGAAVNLCEQAYRQLLNEKIPVTVLDMFSLKLTREFAVLSLVSILNVGRVVTVEEGVTPFCLPLASSILSFISEKKLQVRVIHKKVNLPCNLNYSGFCAKSLHLRVILFKISEDEN

SEQ ID NO: 142885 - protein, 65 aa, Heterodera glycines
  misc_feature (38)..(38): Xaa can be any naturally occurring amino acid
  Coding regions on vcDNA: vcDNA=SeqID_69308; Strand=-; Position=1-243
VPWKKRSQNLLQLKIEFTTISLLCPQLFHPTYSNGSGXKDAADQIYEGSDQNQHDQKSDDADSPI

SEQ ID NO: 142886 - protein, 70 aa, Heterodera glycines
  Coding regions on vcDNA: vcDNA=SeqID_69309; Strand=-; Position=1 -131,183-262
MLRPPHFPLLLTAIVVVICLLSGTANGDKNLLDELRDLDIFQLKSGVSACPLLVGERCPESSPLYYFKMC

SEQ ID NO: 142887 - protein, 125 aa, Heterodera glycines
  Coding regions on vcDNA: vcDNA=SeqID_69310; Strand=-; Position=1 -298,449-528
MRAFLLIKMFAKVLTIPFTSSNHSFIFVQMDSSSSEEGEIHEPVPQIQAVQPNPQIPPPPANLQPNEKIFFVSETTQRREILLADGFEYSFEALSRIADVTVNLIHTYGITKFTFDWTPQNAFGQ

SEQ ID NO: 142888 - protein, 20 aa, Heterodera glycines
  Coding regions on vcDNA: vcDNA=SeqID_69311; Strand=-; Position=1-60
MRRNDEETEGNEMNEQQEDS

SEQ ID NO: 142889 - protein, 113 aa, Heterodera glycines
  Coding regions on vcDNA: vcDNA=SeqID_69312; Strand=-; Position=1 -103,284-472,674-723
  Homolog annotation: Hit_ID=CAE74507.1; Match level="QueryCoverage =92%, HitCoverage=19%, E-value=6e-37, Identity=63%"; Hit description =Hypothetical protein CBG22259 [Caenorhabditis briggsae]
VKHYKIRPLDNGSGFFITARKTFGTVRDLIEYYSKESGGLCYHLTYPAPKIAPVRPDLSYDTAKNWEIPRDELLLDRKLGEGNFGEVWLGRWRGVIEVAVKNVKKFSIQFFFQ

SEQ ID NO: 142890 - protein, 337 aa, Heterodera glycines
  Coding regions on vcDNA: vcDNA=SeqID_69313; Strand=-; Position=1 -104,337-426,475-706,839-963,1006-1335
  Homolog annotation: Hit_ID=CAE69972.1; Match level="QueryCoverage =97%, HitCoverage=61%, E-value=4e-77, Identity=51%"; Hit description =Hypothetical protein CBG16369 [Caenorhabditis briggsae]
HELSTLRDINSDLRRLEDAYETIRELSSKRTKDKIDQGAQIDDTSMIEHIHQLQQELIESHTKKADLENTARELKNRVQELESAADLENTARELKNRVQELESANKRLKEYPPDGGVAAIQEELIQVKMREAEASLSLKEMRQRLAEVEQHWTRCVGLHIVQPCQSPTQQTTNQQNTHAQQCQNPSAQSARARIAKLTATLMGGGTAEALEGWSQRELEDQFIGLKLMGGGTAEALEGWSQRELEDQFIGLKIREADTMAELKEMRQKVMEMETQNHVCTNQLKRQDEEIRRLREERETFVRSNRVEENEGIKETGGRRGKEKERARYRHLLSPTPP

SEQ ID NO: 142891 - protein, 45 aa, Heterodera glycines
  Coding regions on vcDNA: vcDNA=SeqID_69314; Strand=-; Position=1-196
GIMRTRPIWQVKQRLLTSQKVRCRDETNQHCLPRGTRHGPPKEWI

SEQ ID NO: 142892 - protein, 89 aa, Heterodera glycines
  Coding regions on vcDNA: vcDNA=SeqID_69315; Strand=+; Position=1 -87,140-322
MMFNSISKIPFIIFIANHFLNPFSNAIPLGEDNMLIAIMKAISKFKSVNIHCKNMRQTLALCFLCSKMEVTKFVRNLMLTFRNLSKDLR

SEQ ID NO: 142893 - protein, 188 aa, Heterodera glycines
  Coding regions on vcDNA: vcDNA=SeqID_69316; Strand=+; Position=1-565
MPCSSSSSSSAASFSSVFPVPFPASHPWNPFASAAPFVIAIGSGSVCVKNGECRQYNQLKRHHHESAPVAAEVPSVDEGMNATDKRRKKRGPSALATLSALLLLGVALIVSLAFVAWTIHRMVNEKKRPNDARESGKIELQNEQHKECAEAMTTQAERIEVLESAVTKQKRTEEKETEEPNDNGKESH

SEQ ID NO: 142894 - protein, 55 aa, Heterodera glycines
  Coding regions on vcDNA: vcDNA=SeqID_69317; Strand=-; Position=1-169
NSSLECQKWNNNLRLVRINNLMNVSETWYVYANSVTDQKCVDQVFMVNEFISDKW

SEQ ID NO: 142895 - protein, 64 aa, Heterodera glycines
  Coding regions on vcDNA: vcDNA=SeqID_69318; Strand=-; Position=1 -6,156-344
MGHFCSYYVHILQFFRPYYNPYYGFFCPYKSGFCRIILFTISFVWQPFAVAIANCKIISLIGTF

SEQ ID NO: 142896 - protein, 263 aa, Heterodera glycines
  Coding regions on vcDNA: vcDNA=SeqID_69319; Strand=+; Position=1 -72,140-217,725-914,1454-1515,1664-1795,2611-2618,2806-3057
  Homolog annotation: Hit_ID=CAE69474.1; Match level="QueryCoverage =82%, HitCoverage=51%, E-value=1e-19, Identity=30%"; Hit description =Hypothetical protein CBG15672 [Caenorhabditis briggsae]
IMINLIFPLFIYGITMLSELADHENDFPTSLDLRYTRRGERRIPYPQNQEHCGACWAFSAALVHSAAVFESRVGERDRLVLYSAQYLVDCTIRKKKKKPSEACNGIAVMKALNRLSTDGVPLDALYPYLSGKTGEVALVRTKKQGLLYKAEPGQFGFVRGLTAQMTYLTTYRLPLAAPLTTYKSKEVYDPSPEECKAAEEDPDNSMHIISIVGYGEEGGKPFWLIVNSYGQEWGDNGEAKFVRGNNACCIEDYGYYVKSVEHY

SEQ ID NO: 142897 - protein, 65 aa, Heterodera glycines
  Coding regions on vcDNA: vcDNA=SeqID_69320; Strand=+; Position=1-195
MLTANEAVQRDQDEKEVEEEESWAKRFPPYSAETEIEQLDEFSLLHQQIVAGRVVPCCVNLPEIT

SEQ ID NO: 142898 - protein, 70 aa, Heterodera glycines
  Coding regions on vcDNA: vcDNA=SeqID_69321; Strand=+; Position=1-213
MVGSQQQQQYHLLPTQQLNHNRNKQYTTQQQQQQQFTSPYATSNYGYHELTHPPAYSMSMVGGGGTGQRR

SEQ ID NO: 142899 - protein, 77 aa, Heterodera glycines
  Coding regions on vcDNA: vcDNA=SeqID_69322; Strand=+; Position=1 -69,135-184,717-831
MTTSLADLDVEWETYKTEFEKAEAEHGAYNARQRANVNKFLERGELSDDDKRGLEALKTQAEQMHINLSDLWREEVF

SEQ ID NO: 142900 - protein, 180 aa, Heterodera glycines
  Coding regions on vcDNA: vcDNA=SeqID_69323; Strand=+; Position=1-540
VVIEARDTDGLVGHAVVLVQALAADHLPSKAAFSSPSSSAARASLFGSGQVPVIADHQPFPLSSSAFVPPLAKAVGVGIPPASPPSAQMSSSLSQNVPPAAGSQQMMSSALIASSAGGYWQPISNGGNNKANSNQKPNPFWRVDPTTTLATPAAAVKLNPMLIPFATTTTAVPPPPNQFT

SEQ ID NO: 142901 - protein, 123 aa, Heterodera glycines
  Coding regions on vcDNA: vcDNA=SeqID_69324; Strand=-; Position=1-369
MTGFYTENAQLRARAGPNWLLVRVARDRHRPPARVNTDPKPLHNSPRVNSTPPIRVPDPERLASRPSSRSYSEHLSALRLQMPHSPLNRRTANPSLEASRPTYSNKRVNADPDTPALSVSTSS

SEQ ID NO: 142902 - protein, 28 aa, Heterodera glycines
  Coding regions on vcDNA: vcDNA=SeqID_69325; Strand=-; Position=1-86
ELTRKIYAKCAIWRYEQFCLTLARTHSA

SEQ ID NO: 142903 - protein, 72 aa, Heterodera glycines
  Coding regions on vcDNA: vcDNA=SeqID_69326; Strand=-; Position=1 -97,164-282
MIPNDTFILLLLLSTVSVFVQFAEAQWKQEGAAGKKHSKTATAVRKMTANNNSEQQQHGHGVERVRNRHSNK

SEQ ID NO: 142904 - protein, 40 aa, Heterodera glycines
  Coding regions on vcDNA: vcDNA=SeqID_69327; Strand=-; Position=1-128
LVILDFVIKYIRKLYRLFLYFYPQMVIRSFSSQFLPNLHI

SEQ ID NO: 142905 - protein, 464 aa, Heterodera glycines
  misc_feature (11)..(11): Xaa can be any naturally occurring amino acid
  Coding regions on vcDNA: vcDNA=SeqID_69328; Strand=-; Position=1 -188,245-349,414-564,610-658,710-790,850-932,984-1126,1297-1613,1892 -1983
  Homolog annotation: Hit_ID=NP_504943.2; Match level="QueryCoverage =96%, HitCoverage=57%, E-value=2e-85, Identity=41%"; Hit description =Na/H eXchanger, associated to intracellular granules or organelles in the main epidermal cell syncytium h
AILAYYHPQLXLLLLIALPSLFISIVACGIAMKQYVKGNMSHDANSSVKYFVKMLAQSSETVIFMFLGLSIFMFLGLSSIASKHHWDTLFVACTVLICFVYRVIGVLVQCAFLNRFVLVQCAFLNRFRKIKFSATDQFVLSYGGLRGAIAFGLVVSLPAIIEAKRMFVTTCIFVTTCIAVIYFTVFLQGITIRPLLSLLKVGITIRPLLSLLKVEKQEEYEEMMVEKVYNKYFDVYNKYFDYTMAGIEDIVGQRGKHFFRDAFERFNAKILKPLLMRNMTRKTFAFERFNAKILKPLLMRNMTRKTFDATDIVRAYNKITLQEALKIAHIGRTERNNDNTKQRNGIGTSGRRKAINSLIILLIKYMSNRDNAELLYAMFSRLLDRKIEEMQRRKETRNRSEDDDIKAGEKGGRKLIKAMNYYMDILNTSSASQKRRKRKKGGEEEEKERKKEKPSPGKGENWHI

SEQ ID NO: 142906 - protein, 103 aa, Heterodera glycines
  Coding regions on vcDNA: vcDNA=SeqID_69329; Strand=+; Position=1 -113,431-629
MDIFPFFDHAQLSLKLALLSPCFDALVDKHFQWQNELTKCATTLGGLFPSFDHAQLGLKLALLSPQFDALADKHFDGPTNFCINSASFFWVFFLFFWSWPQKS

SEQ ID NO: 142907 - protein, 41 aa, Heterodera glycines
  Coding regions on vcDNA: vcDNA=SeqID_69330; Strand=-; Position=1-125
PDGADGTTTFVVPFLQMGLFNVNQEVELLSKLFSSCTTTSG

SEQ ID NO: 142908 - protein, 79 aa, Heterodera glycines
  Coding regions on vcDNA: vcDNA=SeqID_69331; Strand=-; Position=1 -88,706-857
MRENAFQLYEKPNNDTGKDEASIAADTGAGEKKLPDAEQKQTTDTKERKSPIMVDKVWPFIHHLATLSPHSLLPFRECK

SEQ ID NO: 142909 - protein, 47 aa, Heterodera glycines
  Coding regions on vcDNA: vcDNA=SeqID_69332; Strand=-; Position=1-143
MTLCPTAKPCRTLPFAKAANNIGFAESKTVGTIDQRRGDGKAVQSPF

SEQ ID NO: 142910 - protein, 228 aa, Heterodera glycines
  Coding regions on vcDNA: vcDNA=SeqID_69333; Strand=-; Position=1-687
MKLFPLLLLIILFLIVKIGSEKKKLQQKSFGEIFGEKWQEKEEEKRNELKKREIIQKYYKIKEKIKQKGRKYSRKEWNKINSKIAKKLGTNQTYIQKWIKELGLNQRMQKSYKSKTDEQKIEIVQKFIAMKNEFKQKRKYSRKEWQQNHKEICKKIGVGYDTIRKWKKQFGICCKKITEKEKMEKMKVYWQTKKEYPKMNDKEIAKIMKINHFNVYRWKQIIGEGINE

SEQ ID NO: 142911 - protein, 65 aa, Heterodera glycines
  Coding regions on vcDNA: vcDNA=SeqID_69334; Strand=-; Position=1 -133,406-470
MLRTVYQYKQRHPELGQEKIVKKLLPISLGTFKKWKKSLTLDADENSIDDLQDDIEEEPKHMGIE

SEQ ID NO: 142912 - protein, 102 aa, Heterodera glycines
  Coding regions on vcDNA: vcDNA=SeqID_69335; Strand=-; Position=1-307
YEDEKQFEKKISSIKEEHLDEDNFVKQELINIDNGPISIKQETITIKNEPINGIDEQLRIGNDKIKIEQNENEESEMDDSESFESHSSDQSISTDDQDSDEM

SEQ ID NO: 142913 - protein, 61 aa, Heterodera glycines
  Coding regions on vcDNA: vcDNA=SeqID_69336; Strand=+; Position=1 -35,101-251
MDKKANLAMDKNFWLELLKNLIKFFEIWQANNAIQGLSYDTKIVCNLVVSEKSFELIYSKI

SEQ ID NO: 142914 - protein, 101 aa, Heterodera glycines
  Coding regions on vcDNA: vcDNA=SeqID_69337; Strand=+; Position=1 -152,522-675
MDVTPMAQCAFECFVFKVSAVRTNYRSWLRSSSIHEPSDPPIRLEFILQQNTERYTTAPTYGSTPKAWLVRQLPRNVGQRPQVSSNDLCPSADGGIWWCQR

SEQ ID NO: 142915 - protein, 59 aa, Heterodera glycines
  Coding regions on vcDNA: vcDNA=SeqID_69338; Strand=+; Position=1-177
  Homolog annotation: Hit_ID=NP_885509.1; Match level="QueryCoverage =100%, HitCoverage=9%, E-value=2e-24, Identity=94%"; Hit description =putative branched-chain amino acid transport system protein [Bordetella parapertussis 12822] ref|NP_89032
LLLLDEPAAGLRYKEKQDLARVLEQLRAEGMSILLVEHDMDFVMRLTNHLVVMDFGTKL

SEQ ID NO: 142916 - protein, 70 aa, Heterodera glycines
  Coding regions on vcDNA: vcDNA=SeqID_69339; Strand=+; Position=1-213
MYKFGFFLLLLVLFLIVVKSRSEEPRAENVRPKFVKCEKGNGQQNEEEAGPNQTQKLCRHTQNDDVFAVP

SEQ ID NO: 142917 - protein, 98 aa, Heterodera glycines
  Coding regions on vcDNA: vcDNA=SeqID_69340; Strand=-; Position=1 -77,120-394
  Homolog annotation: Hit_ID=NP_492323.1; Match level="QueryCoverage =89%, HitCoverage=51%, E-value=1e-14, Identity=45%"; Hit description =putative protein, with at least 2 transmembrane domains, of bilaterial origin (19.0 kD) (1J169) [Caenorha
MKTERNERNQLVDAGLDLNDPNAFGEYCKDIVILSVSAQLLSLIWTGFFFVLLSIPFFTLYKLWTNILGPWFFRPTLDDDEKEDKKKQKKPKFVHVRR

SEQ ID NO: 142918 - protein, 213 aa, Heterodera glycines
  Coding regions on vcDNA: vcDNA=SeqID_69341; Strand=-; Position=1 -372,438-707
MDLYLDLDDLHYDNNGIFQPIWNFFAGEIWPIFAPNIRHLTGHHLGDLRRQISPTIFTDCNQLNSIDSDNLLPASIADDGPNATSRQALTNWLHTPTKNGHPPKQLSCCDYTSESNEWFNNFKKEFLRANSSASYIIQFKTYTTIAQFELVNERTKEKLTLKAEDDYDVYTHINFVLERCQIVATIQWRQDKKTDNLNNVDITIMCVMFLLKH

SEQ ID NO: 142919 - protein, 37 aa, Heterodera glycines; identical to SEQ ID NO: 131299
  Coding regions on vcDNA: vcDNA=SeqID_69342; Strand=-; Position=1 -63,119-169

SEQ ID NO: 142920 - protein, 48 aa, Heterodera glycines
  Coding regions on vcDNA: vcDNA=SeqID_69343; Strand=-; Position=1 -50,550-646
MLFTGFDRLIVLIFGEITEYRKAFRDQFPIIFKQNLNVIQVSPQQNGS

SEQ ID NO: 142921 - protein, 30 aa, Heterodera glycines
  Coding regions on vcDNA: vcDNA=SeqID_69344; Strand=+; Position=1 -8,244-328
MLRAIETLLNGVLKVCKMIEKAAKKHVFAP

SEQ ID NO: 142922 - protein, 51 aa, Heterodera glycines
  Coding regions on vcDNA: vcDNA=SeqID_69345; Strand=+; Position=1 -38,91-208
MTIAPMRFDEDDWNVFMGKNSSLGHACFSTQRDYCKQMQKTLCPAVSNCVR

SEQ ID NO: 142923 - protein, 68 aa, Heterodera glycines
  Coding regions on vcDNA: vcDNA=SeqID_69346; Strand=-; Position=1-207
AIANYAGHMSFNLVTQKVDERRMAPQAPLFNKFNGHNLKQQDTMFFAFVCSSPFALKSMRDPTMSSCP

SEQ ID NO: 142924 - protein, 113 aa, Heterodera glycines
  Coding regions on vcDNA: vcDNA=SeqID_69347; Strand=-; Position=1-344
FCYNAEILRKATLTDVRRMRKDLFDNDLPKKLDVIECFVKQNSEFQRNNNKNLFYQMKDELILYRTVFFNEQFEIHLESIKQFGENYGRRIHEIAKLLEEIREARNQIEQQQM

SEQ ID NO: 142925 - protein, 86 aa, Heterodera glycines
  Coding regions on vcDNA: vcDNA=SeqID_69348; Strand=-; Position=1-261
MNSIRLLLQLVLPGTVIISDEWPAYLKMSNSSQKTTGGGFSKIITLPNGTEFNVNTNKCEGMFCCILIIILMINLVKSNKIHIKIA

SEQ ID NO: 142926 - protein, 493 aa, Heterodera glycines
  Coding regions on vcDNA: vcDNA=SeqID_69349; Strand=-; Position=1 -223,302-413,468-533,590-653,705-864,939-996,1064-1123,1225-1365,1430- 1474,1555-1753,1878-1975
  Homolog annotation: Hit_ID=CAE67718.1; Match level="QueryCoverage =98%, HitCoverage=82%, E-value=1e-123, Identity=49%"; Hit description= Hypothetical protein CBG13293 [Caenorhabditis briggsae]
FLIISSVLGVSILGDVRQTHALFCVSEGKDSKKVLSEAHIERIHQGKRAANDICAWGGHLAECQLADGTAESIRLATSALSDLATSALSDHSIEVPLEKPLRPKKFPLVVCVAPMYTYTEWQIMVTGIEVYTEWQIMVTGIEVWLALGASKMVFPIQSASADTIQVFPIQSASADTIQILTEYQRIGIVHLRVWPKWPVLSIVHLRVWPKWPVLSDANPNGLVLSRGIEESHVNCLHFVKPFAEMVVITDIDDMLMPLDPMKVRPGINVDILKDLFHQHPNAGSLLFEDLFHQHPNAGSLLFEHRDVQFFVLPDPSTQNTLRSFNFEFLAHSKWKTSCKVWRMKTRVAVNASRVDTVNMHESGIHRFGFVNMHESGIHRFGFVQVRVPCRQAHFYVRVPCRQAHFYHLRHSYKTLPSTSPIDMSKLRQMLNERWHFRAESNFSSEMQSKMLARSSVESFEDFDKCMSAINEEHWRLRVSRCLTPHVCFSRLAK

SEQ ID NO: 142927 - protein, 96 aa, Heterodera glycines
  Coding regions on vcDNA: vcDNA=SeqID_69350; Strand=-; Position=1 -57,120-353
  Homolog annotation: Hit_ID=NP_502156.1; Match level="QueryCoverage =91%, HitCoverage=12%, E-value=2e-31, Identity=75%"; Hit description =aminotransferase (79.3 kD) (4M177) [Caenorhabditis elegans] emb|CAA92735.1| Hypothetical protein F22B3.4
MVDKDKCIVMVICNDNVYKRSLNALQQVKARDGCPIVIADESVPSSELADVEHVLRVPRTVDCLQNILTVIPLQLLAYHVAELNGFNVPVLIFGLF

SEQ ID NO: 142928 - protein, 41 aa, Heterodera glycines
  Coding regions on vcDNA: vcDNA=SeqID_69351; Strand=-; Position=1-124
  Homolog annotation: Hit_ID=AAR09171.1; Match level="QueryCoverage =100%, HitCoverage=11%, E-value=2e-15, Identity=100%"; Hit description=aldolase [Heterodera glycines]
MAEVGNSYRPPLSEEKQNELRAIAQKILQPGKGILAADEST

SEQ ID NO: 142929 - protein, 35 aa, Heterodera glycines
  Coding regions on vcDNA: vcDNA=SeqID_69352; Strand=-; Position=1 -56,118-169
MTSTIRNFGRFAGHANVDSFNLRNDWGNLIIIDYK

SEQ ID NO: 142930 - protein, 33 aa, Heterodera glycines
  Coding regions on vcDNA: vcDNA=SeqID_69353; Strand=-; Position=1 -47,258-312
MQDLSLAMSFKQWRSMYPNRSKTRGYALMWLKC

SEQ ID NO: 142931 - protein, 52 aa, Heterodera glycines
  Coding regions on vcDNA: vcDNA=SeqID_69354; Strand=-; Position=1 -69,125-214
MREFVTRNASLMKRKVQLYFSDSELKYLGILVASYSYMLKLSRIHCDIYALL

SEQ ID NO: 142932 - protein, 74 aa, Heterodera glycines
  Coding regions on vcDNA: vcDNA=SeqID_69355; Strand=+; Position=1 -54,301-389,519-600
MKKWMMDLSHSVVNKLRSWHKSPVLIAFRIVYSERQQMVLIIAFERICLPRRWAVRVRPLVARVACGLPRQIVR

SEQ ID NO: 142933 - protein, 63 aa, Heterodera glycines
  Coding regions on vcDNA: vcDNA=SeqID_69356; Strand=+; Position=1 -86,187-292
MRLHMVAIAFNRAHAVLFPFNFAQKVTKRFQRLSIPESRNFSGFLGLSSRTVSRGHFPVLNFP

SEQ ID NO: 142934 - protein, 80 aa, Heterodera glycines
  Coding regions on vcDNA: vcDNA=SeqID_69357; Strand=+; Position=1-645
LFEYPKRTLEKIDFFVFGAVPPNRCAQIYGETESFRSSFPIACTLILRWIFAPHKCLSTPNGHLKKSIFLFHKYFFQKVL

SEQ ID NO: 142935 - protein, 22 aa, Heterodera glycines
  Coding regions on vcDNA: vcDNA=SeqID_69358; Strand=+; Position=1 -61,708-715
MRRIISWSSFKCEFRRQKVTAS

SEQ ID NO: 142936 - protein, 40 aa, Heterodera glycines
  Coding regions on vcDNA: vcDNA=SeqID_69359; Strand=+; Position=1 -97,1057-1082
MCYRMIHEIFIWLQMNQVMNLCLTFFVFLSLGEKNTCIFI

SEQ ID NO: 142937 - protein, 42 aa, Heterodera glycines
  Coding regions on vcDNA: vcDNA=SeqID_69360; Strand=-; Position=1 -82,531-577
MDRKNKLTLPTNGNSRDSLNCWPHFPRVPYIRIIYPSFKLKN

SEQ ID NO: 142938 - protein, 82 aa, Heterodera glycines
  Coding regions on vcDNA: vcDNA=SeqID_69361; Strand=+; Position=1 -94,140-292
KLADDAFQILPLPDIDPSVTSTPAVVNNLIEAVESLDSRMPLAFQEQQQILKMQSEMLQLGVSCKEHYKKIHEQSVMRYNLE

SEQ ID NO: 142939 - protein, 52 aa, Heterodera glycines
  Coding regions on vcDNA: vcDNA=SeqID_69362; Strand=-; Position=1 -42,818-934
MATEACSKSTLQYQKKILNSLLKSHFGKITYYKNPQFFALPNKFYLAFLSHF

SEQ ID NO: 142940 - protein, 126 aa, Heterodera glycines
  Coding regions on vcDNA: vcDNA=SeqID_69363; Strand=-; Position=1 -24,163-519
  Homolog annotation: Hit_ID=NP_490886.2; Match level="QueryCoverage =60%, HitCoverage=2%, E-value=4e-15, Identity=51%"; Hit description =talin (279.1 kD) (1C213) [Caenorhabditis elegans] gb|AAK73909.2| Hypothetical protein Y71G12B.11a [Caenorh
MSVDKKTKYRVAFRRLLQDFGDYQDGYYSVQTTEGGKIKSLLAEFVDVIIWKKKLVDPFGLEGDEGAIMIEDFVLRARSVPVTFDDVVEEEEATPIMSKSHPAALSTPTILGPKERIVHRHDSTTN

SEQ ID NO: 142941 - protein, 27 aa, Heterodera glycines
  Coding regions on vcDNA: vcDNA=SeqID_69364; Strand=-; Position=1-83
NSALVLIWQKIKPFFLRTHWCSIHLTK

SEQ ID NO: 142942 - protein, 65 aa, Heterodera glycines
  Coding regions on vcDNA: vcDNA=SeqID_69365; Strand=+; Position=1-194
PGLKCPAQAKNFFYFREKIEIFPKKLPIDRARKTMFWKWSSFLWEKSLKNPKIQKPENRFLGLTR

SEQ ID NO: 142943 - protein, 19 aa, Heterodera glycines
  Coding regions on vcDNA: vcDNA=SeqID_69366; Strand=+; Position=1 -16,170-213
MKNRKEIFWNQWVRVQCFD

SEQ ID NO: 142944 - protein, 473 aa, Heterodera glycines
  misc_feature (120)..(120): Xaa can be any naturally occurring amino acid
  misc_feature (333)..(333): Xaa can be any naturally occurring amino acid
  Coding regions on vcDNA: vcDNA=SeqID_69367; Strand=-; Position=1 -256,308-505,560-1483
  Homolog annotation: Hit_ID=NP_500227.1; Match level="QueryCoverage =99%, HitCoverage=43%, E-value=4e-62, Identity=30%"; Hit description =predicted CDS, reverse transcriptase like family member (4D351) [Caenorhabditis elegans] gb|AAK68554.1| H
SPTRGKNFLDLLFTNNIISNVLVGPPFNCDHNSISCEIKLKTSKKILKKGFDFRRANYLAINSVLYSINWNFFFSDCTEIDSTLVQSNLVQSNFEPKLPEHIQKLIIGNYFGKTLKKKEXGKYVEISKKITFETSKFYKNKENKLLNSTSATVFKNDKNSKVAFTNKDKSVFKNDKNSKVAFTNKDKSDALAKQFFSVFTSQNIEPEPTGSKKSLEKSMDFFTITHAEIYFSLCKLKDKNNTSIDGIPSILLKNCKETLIAPLFHLFCFSLMCGKIPTIWKKSIVCPIPKIPNPANPIDFRPISLLCTMSKILEENIARNIRDFVETNKILPXCQHGFRKNRSVITQLLEVVDDFSQALEEKKAIDSIYFDLAKAFDTVPHNRLISKLKNIGINDSLLKWISDYLSNRTFYVKVGSSFSDEYNCLSGVPQGSILGPLLFNIYIHDITDFCPEKVEIKLFADDKEAYLQLPKID

SEQ ID NO: 142945 - protein, 238 aa, Heterodera glycines
  Coding regions on vcDNA: vcDNA=SeqID_69368; Strand=+; Position=1 -559,629-786
MNLLYLIFIIIFFIFVIDSDKIRPNFDEIFGNGWDKKESEQTVKIEQNERNENSQSAAVDQMGEEMGNDRNDQMKNDHKKREIILKFEAIKEKLREKGKYKWKDQGKIETKIGNLLGIGRHKIYKWKNELNLNKNKIKKEFYEMKKSEFIKRFDEFKDLYGQGKQKEFAKELGISNDTFWKWKKRIEQFTNEDKLKKMKQYFKIKEANPKIIDEIIAKKLGIGSATLKKWKKRMLSSI

SEQ ID NO: 142946 - protein, 111 aa, Heterodera glycines
  Coding regions on vcDNA: vcDNA=SeqID_69369; Strand=+; Position=1 -232,550-650
  Homolog annotation: Hit_ID=AAG23159.1; Match level="QueryCoverage =69%, HitCoverage=33%, E-value=2e-28, Identity=77%"; Hit description =polyprotein [Heterodera glycines]
MSNGQVERFFDTFKRAFRKLKGEGKPNKEIIDTFLITYRTTPNDTLPDLKCPAELLLRRRPRTTIDLLRPPPHQPFERLNQLEDEAAIPIQDNLAAPIEDVPIQRRFCSLR

SEQ ID NO: 142947 - protein, 170 aa, Heterodera glycines
  Coding regions on vcDNA: vcDNA=SeqID_69370; Strand=-; Position=1 -256,597-853
MPLFNFLLPLALCCSAILAIGIPNDGQIVEHDKKLLPKWEQTPSPSAGTDVAQMRRKLKAFSEGTDLRQNSRRNGNGKDVQNGQIVPIPDKKKGLLRWQNMSPSASPTVTNMRQMLAAWVDKTNSRRNSRRNASEREQQSLYGYSNYLDLSANSSPAASDFALTPQHRWE

SEQ ID NO: 142948 - protein, 91 aa, Heterodera glycines
  Coding regions on vcDNA: vcDNA=SeqID_69371; Strand=-; Position=1 -163,289-401
MALLCAAEPDCMVPIGQTIKCVYMPTPPNLTCHRQDQSLMEILRYNMEYRQQIEDPSFVTQLEPCPSAQFEPTVAIDGDQRIFQIGPSSKF

SEQ ID NO: 142949 - protein, 229 aa, Heterodera glycines
  Coding regions on vcDNA: vcDNA=SeqID_69372; Strand=-; Position=1 -340,433-782
  Homolog annotation: Hit_ID=NP_502797.1; Match level="QueryCoverage =96%, HitCoverage=70%, E-value=5e-22, Identity=28%"; Hit description =HASI (4P602) [Caenorhabditis elegans] emb|CAB16520.1| Hypothetical protein Y57G11C.19 [Caenorhabditis ele
SFAPQSGSSVPVVAVDVLSKRLFVVPLRNKRAEEMLEAFKQLIDQMPMAPHRVFSDKGTEFKNRLLKDFFEEREIEKHEPVHSTVKASIAERAIRNVKQRLYRYFAEKETLNWKRMYRPQSFDRKTPRFHKDKFVRMSRDKGQLEKGYLQNYGDEILEIDEVLEAVHPIRYKLLDEHGEKFKESFYEQELARVRKDAETSYRIEKVFRKRKRDDGSTEMLVKFIGYPNR

SEQ ID NO: 142950 - protein, 133 aa, Heterodera glycines
  Coding regions on vcDNA: vcDNA=SeqID_69373; Strand=-; Position=1-8,87- 313,568-734
  Homolog annotation: Hit_ID=AAV34698.1; Match level="QueryCoverage =90%, HitCoverage=41%, E-value=9e-12, Identity=37%"; Hit description =IC5 [Globodera pallida]
MKHIAFIGLAEKQHQISFDETIHCGTAIYEYASGGYLWISGSSRKSNAKYSFGVGDIVGCGVNLAIRQIFFTKNGHLLASSKLFVPPPPPASSSSSSSSVFDLPLVPFISLFSFDDRIEANFGPNFKFDFSIL

SEQ ID NO: 142951 - protein, 125 aa, Heterodera glycines
  Coding regions on vcDNA: vcDNA=SeqID_69374; Strand=+; Position=1 -130,395-487,543-591,1164-1269
  Homolog annotation: Hit_ID=CAE63753.1; Match level="QueryCoverage =36%, HitCoverage=10%, E-value=2e-18, Identity=82%"; Hit description =Hypothetical protein CBG08288 [Caenorhabditis briggsae]
MSNSESVPPSPTSSSAGGGDPLTYSAPVNQRSMARISASTQAANYMLPPYLQCPSGHLVCGNCRPKVTACPTCRGPIPSIRNLGMEKIAARQSGQSYQMFYAVVQLIGTKKEAENFVYKYSYLLG

SEQ ID NO: 142952 - protein, 426 aa, Heterodera glycines
  Coding regions on vcDNA: vcDNA=SeqID_69375; Strand=-; Position=1 -132,414-573,618-830,898-1152,1208-1237,1281-1456,1501-1617,1668 -1763,1814-1915
  Homolog annotation: Hit_ID=XP_473492.1; Match level="QueryCoverage =94%, HitCoverage=54%, E-value=1e-92, Identity=44%"; Hit description =OSJNBa0084K11.14 [Oryza sativa (japonica cultivar-group)] emb|CAE01849.2| OSJNBa0084K11.14 [Oryza sativa
CVQPGDGEFIEEDKQRKLERAWPVDGDKLLVCYLEDVMHSTRSRCAILPEEKNIFFVTAQIGNDPTKQLFYMDTKGQAINGPIPLVPLFNKSDAKYQVMDSDEHSALILTNHNAPMFKLVRVKLGEHGVVNSNDQWQVVIEEDKQRNLGWACPVDGDKLLICYLEDVKNALYVHSLDGRELYKLPLPIGSVGGVFAEKSKSKIFIGFESFLVPFILFHGDFSKCPSRESPLQLTETRRVNVPGLDCDAFDSKQVFYPRDDGTKIPMFIVHRKGVKLDGSNPVILNGYGGFNIAQTPYFSVTRLMLAKHFGIVSVIANIRGGSEYGEKWHEAGMLGRKQNVFDDFIAAAEFLISEKYTNNKKLAIHGGSNGGLLTAVCSQQRPDLFGAVVTRVGVLDMLRFNKFTVGAAWATEYGDPDKPDDFSFIY

SEQ ID NO: 142953 - protein, 70 aa, Heterodera glycines
  Coding regions on vcDNA: vcDNA=SeqID_69376; Strand=-; Position=1-210
NTLYVHSLDGRELYKLPLPIGSVGGVFAEKSKSKIFVGFESFLVPFILFHGDFSKCPSRESPLQLTETRR

SEQ ID NO: 142954 - protein, 255 aa, Heterodera glycines
  Coding regions on vcDNA: vcDNA=SeqID_69377; Strand=-; Position=1 -281,335-634,681-867
MISGKRWIDKGQPSGERNAEQSTANWRSPNPQTSQHHHQRGHFNNKPHRSSSGYSQHQQSRPYQNQYNNNNQTPYKNTGSRASNYEANASHNMKNKSDVTNEPRVTTPSGPIAKPFAEPVVAANSGCPSQQVQLHREEQQTPQQIPPDPEIMGKEVKSEKGSEGTENNQKEETALIIEEKIKVKEGSENGEQQKEKFKMNPAAAPFIPKSKDLNTSSAVVTANTSPLMSNPIPPFIQLPASIPTQVLNFVHQMSV

SEQ ID NO: 142955 - protein, 40 aa, Heterodera glycines
  Coding regions on vcDNA: vcDNA=SeqID_69378; Strand=-; Position=1-121
QQHSTVCSVCATRFSHILGCERKLGEAFDKEMIVQSTATG

SEQ ID NO: 142956 - protein, 80 aa, Heterodera glycines
  Coding regions on vcDNA: vcDNA=SeqID_69379; Strand=-; Position=1 -94,143-291
MRISIIFAIFFCIFSVALRDSSILAMQNIHGTECKRHIHCPDKLFCLEGFCVSAQELANELHLFSFSVAQPRNDRMRRRK

SEQ ID NO: 142957 - protein, 76 aa, Heterodera glycines
  misc_feature (73)..(74): Xaa can be any naturally occurring amino acid
  Coding regions on vcDNA: vcDNA=SeqID_69380; Strand=-; Position=1-257
KIGNILPKNKIFNKYCLALLSLIHAAFSTSFLSSFSMKNSMENVFGSRFCAFRQSVHIFHDLFQLVLNDFPCXXVI

SEQ ID NO: 142958 - protein, 287 aa, Heterodera glycines
  Coding regions on vcDNA: vcDNA=SeqID_69381; Strand=-; Position=1 -425,879-958,1342-1701
PFSSFSPSLPLLLLCCFFSALLLGSVPSLCHLVGRADGDSDDDPRLSLPFLLAAITTCFFSLNLLSPVYGDRAEIESHIREGRKVFEHQNETELEPMSQRMGDVFEAFGFLDLAESLLLLEASLKNVGRDNGQQQGMARLKIHSPCDVSRAEFALKWLKQMRKEISKRYELNEAKMKHLLTEKSRDLEGLINRTESERKETRERLGKAFTRRMEKTRDKSARNEAANSHLGQLGTVDKTHGETSQRFGEAMQNGDEIGRIIGEMGGTGDWVVTVVRAQIKLSLAINE

SEQ ID NO: 142959 - protein, 86 aa, Heterodera glycines
  misc_feature (2)..(2): Xaa can be any naturally occurring amino acid
  Coding regions on vcDNA: vcDNA=SeqID_69382; Strand=-; Position=1 -101,144-302
QXSSSDAPAAFGRAFALCWRANTNSKNSQTRNCRSYRWECSKSKEVEECDPSADGRNSSLFALHIVKQISYLLFYNNLNRIKRKSA

SEQ ID NO: 142960 - protein, 142 aa, Heterodera glycines
  Coding regions on vcDNA: vcDNA=SeqID_69383; Strand=-; Position=1 -113,176-268,618-696,741-891
  Homolog annotation: Hit_ID=NP_492810.1; Match level="QueryCoverage =60%, HitCoverage=28%, E-value=1e-15, Identity=45%"; Hit description =ribosomal protein L9 (1L310) [Caenorhabditis elegans] gb|AAK66018.1| Hypothetical protein B0205.11 [Caeno
MLPLTPAKRFVSKKHCVDSIRWLSLQRTTFAKTIPPGPLLFSHVYLPERTPDGQPQRKPSEHPDFMKYDFMADPEFEKPPPPVELFLLEDIKDLGEKFDIVKVSAEVARWDLLLKRRAVYASPFNLKYYEGKRKATNCGGTL

SEQ ID NO: 142961 - protein, 72 aa, Heterodera glycines
  Coding regions on vcDNA: vcDNA=SeqID_69384; Strand=-; Position=1-216
QTIVFIIFKEQIKSVAPKSPIEKSVQFVLLSNISTGRHLGPSVRFLHGVLSTFCCVPSSFQSSIDHVYSRNI

SEQ ID NO: 142962 - protein, 64 aa, Heterodera glycines
  Coding regions on vcDNA: vcDNA=SeqID_69385; Strand=-; Position=1 -126,525-590
MTSAETVKEEPGREFMSAVKGRREQDRKEWAAYWNIRWKEVEICLFEAEEQFRLDKLVEQYIRD

SEQ ID NO: 142963 - protein, 244 aa, Heterodera glycines
  misc_feature (231)..(231): Xaa can be any naturally occurring amino acid
  Coding regions on vcDNA: vcDNA=SeqID_69386; Strand=-; Position=1 -156,219-337,382-556,617-766
  Homolog annotation: Hit_ID=NP_498047.1; Match level="QueryCoverage =94%, HitCoverage=15%, E-value=2e-83, Identity=70%"; Hit description =RNA polymerase II subunit (3G33) [Caenorhabditis elegans] gb|AAA21158.1| Hypothetical protein C26E6.4 [Ca
LSANKGEIGDATPFNDTVNVQKISALLEGYGYQLRGNEIMYNGFTGQKLSTQVFLGPTYYQRLKHMVEVFLGPTYYQRLKHMVEDKIHSRARGPVQGMNRQPMEGRARDGGLRFGEMERDCQISHGAAQGRARDGGLRFGEMERDCQISHGAAQFLRERLFEVSDPYTVYVCNQCGLVVIFNQRTNTFECKACQACQNKTQVSAVRIPYACKLLFQELMSMSIAPRMMTKXSLFLFVHFFIFEL

SEQ ID NO: 142964 - protein, 317 aa, Heterodera glycines
  Coding regions on vcDNA: vcDNA=SeqID_69387; Strand=+; Position=1 -85,152-317,457-571,614-729,781-833,885-1041,1081-1124
  Homolog annotation: Hit_ID=NP_494721.1; Match level="QueryCoverage =95%, HitCoverage=48%, E-value=5e-79, Identity=51%"; Hit description =glycerol kinase (55.2 kD) (2E383) [Caenorhabditis elegans] gb|AAA79749.1| Hypothetical protein R11F4.1 [C
LGAIDQGTQSSFLIFDPKNGNLVASHQLEVQQQFLEVQQQFPNPGFVEMCPEQIFKTTVRCIKSTCEELNRRGIAKKEIKAIGITNQRETTIVWDRETGCHLSNAIVWLDCRTHELCDEYIQRTSTRDKNHFKAKTGLPIDKNHFKAKTGLPIHPYFCALKLRWLLNNVPEVKKSLQNGTLMFGTVDSWLMWKLIGTLMFGTVDSWLMWKLIGIHATDVTNASRTLLMDLQNRKWSIHATDVTNASRTLLMDLQNRKWSTEMCTFFDIPINVLPEIRSSAEIYGYLQKGPLEGIPLAGCLGDQPLEGIPLAGCLGDQ

SEQ ID NO: 142965 - protein, 139 aa, Heterodera glycines
  Coding regions on vcDNA: vcDNA=SeqID_69388; Strand=-; Position=1-419
  Homolog annotation: Hit_ID=NP_996669.1; Match level="QueryCoverage =100%, HitCoverage=82%, E-value=3e-15, Identity=34%"; Hit description= similar to Hypothetical protein CBG21647 [Homo sapiens]
GTTVIKRGTTVIKRGTTVIRRGTKVIKRGTKVIKRGTTVIKRGTTVIRRGTKVIKRGTTVIKRGTKVIRRGTTVIKRGRTVIRRGTTVIKRGTTVIKRGTIVIKRGRTVIRRGTTVIKRGTKVIKDTKVIRRGTKVIRR

SEQ ID NO: 142966 - protein, 67 aa, Heterodera glycines
  Coding regions on vcDNA: vcDNA=SeqID_69389; Strand=-; Position=1 -41,1360-1422,1719-1818
MTRQLKTFIGRKLRVLIKCLFCWLATNATWHINGRASFCQLHLAKNLVLFKKIHTPWALSFCLIPRM

SEQ ID NO: 142967 - protein, 36 aa, Heterodera glycines
  Coding regions on vcDNA: vcDNA=SeqID_69390; Strand=+; Position=1 -58,250-302
MNEFLAKSDFRHFIGHKLNIIQKIAPGYLGLCSKRN

SEQ ID NO: 142968 - protein, 32 aa, Heterodera glycines
  Coding regions on vcDNA: vcDNA=SeqID_69391; Strand=+; Position=1-96
MQSFLLLVNILLCSIVLLHLLSNENGLVNAMP

SEQ ID NO: 142969 - protein, 42 aa, Heterodera glycines
  Coding regions on vcDNA: vcDNA=SeqID_69392; Strand=+; Position=1-128
PQTWYQQLPSFVWPYQTILRYLKRKQKKFLTKKWLSLFSHFF

SEQ ID NO: 142970 - protein, 25 aa, Heterodera glycines
  Coding regions on vcDNA: vcDNA=SeqID_69393; Strand=-; Position=1-77
REWEEVERALDELIEQRRQRGVLPE

SEQ ID NO: 142971 - protein, 30 aa, Heterodera glycines
  Coding regions on vcDNA: vcDNA=SeqID_69394; Strand=-; Position=1-92
MSNDNDKRDASSIPTNALVNKEESPDGNEE

SEQ ID NO: 142972 - protein, 77 aa, Heterodera glycines
  Coding regions on vcDNA: vcDNA=SeqID_69395; Strand=+; Position=1 -93,326-466
MANLMPQCITTTMPTFTIPHALLNMRAPIRLPIITPKFKKAARRGATLTTIATVISLFINNSQHLMQISAIRPFLIP

SEQ ID NO: 142973 - protein, 96 aa, Heterodera glycines
  Coding regions on vcDNA: vcDNA=SeqID_69396; Strand=-; Position=1 -52,260-498
MASSKSRDRDMEGPRIYVTFCPPFAHNMHSSSHTDCLPTDCEFGVAVGNGDGSGPCPCKIGLALWTQRHNVAAKRLRRRARRCSAGAPWEIFRENV

SEQ ID NO: 142974 - protein, 145 aa, Heterodera glycines
  Coding regions on vcDNA: vcDNA=SeqID_69397; Strand=+; Position=1-569
  Homolog annotation: Hit_ID=NP_493879.1; Match level="QueryCoverage =93%, HitCoverage=33%, E-value=1e-26, Identity=43%"; Hit description =transposase family member (2B289) [Caenorhabditis elegans]
FRAESSKRKRLEGGGRKVPNRNFEEAVFQWVSELRQKKVRVTRNMIAAQAIKMSAAYEDIENFAASNGWLEKFMHHHKFSLRRPTTVAQKEPDAYKNIIINIILYIQQLIHKNNYTHVYAADETAVWLDPGGGTCVAEKGSKTVT

SEQ ID NO: 142975 - protein, 64 aa, Heterodera glycines
  Coding regions on vcDNA: vcDNA=SeqID_69398; Strand=-; Position=1-7,56- 168,899-974
KQFERFMRYKGDELLLKIGEHQTLLNSIFDRQSVSFDQQLFAATAAILVLVPTNAGSAKNLAMR

SEQ ID NO: 142976 - protein, 265 aa, Heterodera glycines
  Coding regions on vcDNA: vcDNA=SeqID_69399; Strand=-; Position=1 -286,444-850,898-1002
MAFICAWMGHMGPASVFPCALCRIPYKALGNTIIGTRTAKSIVGGAAIFSYRTADTGKHTTRDSISCGSQKALPLFFVAPTNVIPSPFHTLHSAGRDQMKRLILASTEIRSIGTPFSMDIADLLDEIRELHIFGRADLMTQEQIDNFSNKCSSIHGYFKAKILFFCFSHFPLFKKLWETHPAKFDTNNAAGFTPKLHWLLAHGPDFAKRWGWFAWISEQGIEHLHHVLNKQSDRFKRYKGDELLLKIGEHQTLLNSIFDRHIGFL

SEQ ID NO: 142977 - protein, 144 aa, Heterodera glycines
  Coding regions on vcDNA: vcDNA=SeqID_69400; Strand=-; Position=1 -124,179-265,312-535
MVSTRSKTDKFKKMGNSSTEAKRKRSEWRRKSGRKGGSTPKSQLQTKEAPLTTGEGTSTDTMPSTFNAEPRQRPSPRPLSTTPIRRHVRTRPTTTDQTTDTDFRATVKSTQTVLETVETATQTETGRNAELRHWNASYRREQKR

SEQ ID NO: 142978 - protein, 136 aa, Heterodera glycines
  Coding regions on vcDNA: vcDNA=SeqID_69401; Strand=-; Position=1-408
  Homolog annotation: Hit_ID=AAM50139.1; Match level="QueryCoverage =83%, HitCoverage=24%, E-value=2e-18, Identity=42%"; Hit description =GH07623p [Drosophila melanogaster]
VPPPMQMTRQQSVTLCGCKDDPVQTVPPPPLPAVLPPPPPPNFPPPPPPNFPPPPPPNFPPPPPPAASEACPPPPSAVSGVQPVPPSAVSEANPARPSAVSGVNSAPPPQQVNVVNSTTSNVPFAVNNKDTADQNE

SEQ ID NO: 142979 - protein, 68 aa, Heterodera glycines
  Coding regions on vcDNA: vcDNA=SeqID_69402; Strand=-; Position=1 -85,223-344
MNLIYNVALLFILGLCLVLYPMPSADGMPLNEQNNSPTAGGRSQRKEQITKVRRRRPPNSEQKGGPNK

SEQ ID NO: 142980 - protein, 201 aa, Heterodera glycines
  Coding regions on vcDNA: vcDNA=SeqID_69403; Strand=+; Position=1 -93,439-951
FFGVFLIPKFRAENLYFKAFSTKKQILSTLVLPKKSKVSKKAAKFVAKVAEIWELEFWAIVLIRIATKDSGALVMLYDALYVLSVMLTLGKNGEYITKMPTELSPRSAERLLADCESTIRAQFYEEHTANMLRFYENGMLAHDGGNSFSNFLAKCQLDGCDHKFRVRIFYANGEKMANDHYDKMVTKYPKLKQMLRIGSYF

SEQ ID NO: 142981 - protein, 82 aa, Heterodera glycines
  Coding regions on vcDNA: vcDNA=SeqID_69404; Strand=+; Position=1 -220,300-328
MEAIPMKEIDQNEHRLLSDLFEKKNELFGEKIAPKYSKNPCDREKHLKFLFNLHEIAMNKLMEVKDAFTKRLEAYESRHHFL

SEQ ID NO: 142982 - protein, 79 aa, Heterodera glycines
  Coding regions on vcDNA: vcDNA=SeqID_69405; Strand=-; Position=1 -130,201-310
MLFGLLLNIPFSAVNCVVNGDDNKDDGGEFDDDVFCSEMLAFKSTNVEILLNHHKLFVQVGFYQFECLSFVVFIFIIQA

SEQ ID NO: 142983 - protein, 270 aa, Heterodera glycines
  Coding regions on vcDNA: vcDNA=SeqID_69406; Strand=+; Position=1 -205,954-1561
MEFEDLDENDCKDARYLQSYFDVLLSSANYTLTVNVFSVMQLLDHSPQFVQFVNDNCIQFGAIGANENSSLHEEEIFNLYITYFETNDIEKMHKYEAIIGLKFMLNNVRLIEAELIPKLKKEGDEKAQMAKFRAEMLAMLKMFDFCMESVDQLIRMSCPLIEYKALFSKFYLKSAAAPLAEWQPPFDCLTKSFGQILSDFRNSVASQHFQFMQMALNKDRKGKLAQILREKEDTFMRLENLIGEEMFKYLWNKSENRQKLFNQKCMFKTR

SEQ ID NO: 142984 - protein, 74 aa, Heterodera glycines
  Coding regions on vcDNA: vcDNA=SeqID_69407; Strand=+; Position=1 -35,111-300
MLSSANCAQIISASIRSAKTWPFERVVVQSITARALTVPTNGVRDVLRRKARRKAVMEENEGDEEEEEDGQQQP

SEQ ID NO: 142985 - protein, 362 aa, Heterodera glycines
  misc_feature (2)..(2): Xaa can be any naturally occurring amino acid
  misc_feature (63)..(63): Xaa can be any naturally occurring amino acid
  misc_feature (275)..(275): Xaa can be any naturally occurring amino acid
  Coding regions on vcDNA: vcDNA=SeqID_69408; Strand=-; Position=1 -100,151-263,331-471,543-645,694-826,912-1129,1173-1296
  Homolog annotation: Hit_ID=NP_499001.1; Match level="QueryCoverage =97%, HitCoverage=97%, E-value=4e-42, Identity=34%"; Hit description =putative cytoplasmic protein of ancient origin (3K134) [Caenorhabditis elegans] emb|CAA78469.2| Hypotheti
PXQLKRLFPVLGKHLRKGDCGKSGVIGGSPDYTGAPYFASITPMKIGAPYFASITPMKIGADXAFVYAHSDAAPVIKSYSPELIVYPSTDFATNRHSIVYPSTDFATNRHSIERLDVLVFGPGLGRQKHTQNLLADGVNFVRSKQLCLLCLVIDADGLFFVKECSQLFKGCTDKVIITPNHRDFVRVYTQMFPNQFVRVYTQMFPNQQKGEDTDELKIQCEMAELGKDLEVPVMRKGRSPTVTPPKRELSKETSMRRCGGHGDILSGATALFVFXARKASDADIYSSEHLLDGAEAASLLVRNASLRTFRSVGRSMNAAHVSVGRSMNAAHVIDHIVPVVRDIDSGLSQKLRQLQHVDLCTK

SEQ ID NO: 142986 - protein, 63 aa, Heterodera glycines
  Coding regions on vcDNA: vcDNA=SeqID_69409; Strand=+; Position=1 -41,84-234
MTSIKRRTFNVIRKLEIQSAKHSLRSLDINNNNQLEFVHAQIFQGFVQLRSVDLSHNDLIVRN

SEQ ID NO: 142987 - protein, 47 aa, Heterodera glycines; identical to SEQ ID NO: 139606
  Coding regions on vcDNA: vcDNA=SeqID_69410; Strand=+; Position=1-141

SEQ ID NO: 142988 - protein, 182 aa, Heterodera glycines; identical to SEQ ID NO: 137942
  misc_feature (12)..(12): Xaa can be any naturally occurring amino acid
  misc_feature (50)..(50): Xaa can be any naturally occurring amino acid
  misc_feature (108)..(108): Xaa can be any naturally occurring amino acid
  Coding regions on vcDNA: vcDNA=SeqID_69411; Strand=-; Position=1-804
  Homolog annotation: Hit_ID=T02995; Match level="QueryCoverage=78%, HitCoverage=28%, E-value=1e-27, Identity=49%"; Hit description =unspecific monooxygenase (EC 1.14.14.1) - common tobacco dbj|BAA10929.1| cytochrome P450 like_TBP [Nicotiana t

SEQ ID NO: 142989 - protein, 162 aa, Heterodera glycines
  misc_feature (44)..(44): Xaa can be any naturally occurring amino acid
  misc_feature (77)..(77): Xaa can be any naturally occurring amino acid
  Coding regions on vcDNA: vcDNA=SeqID_69412; Strand=+; Position=1 -72,493-920
  Homolog annotation: Hit_ID=NP_671477.1; Match level="QueryCoverage =85%, HitCoverage=47%, E-value=2e-28, Identity=55%"; Hit description =rRNA promoter binding protein [Rattus norvegicus] gb|AAK21974.1| rRNA promoter binding protein [Rattus no
LMGLSTTLPGRAISRQRARIGATRATARLTRPLEPILFPKLRIXFADFPYLHYSRLEAVHLGDLLRISVRSGRRFKXLPSHFQGPCGAHETPQEPRCFTGATSLSQAEPLPGTHTLNEKRTLARTPHDVCEFICVTAQNSSCEPSFPAWRDGNPLSSTGWTN

SEQ ID NO: 142990 - protein, 39 aa, Heterodera glycines
  Coding regions on vcDNA: vcDNA=SeqID_69413; Strand=-; Position=1 -83,502-538
MALSLTEAVTRRFFEGEERRIEAMSKIRLIEFLSASEQC

SEQ ID NO: 142991 - protein, 78 aa, Heterodera glycines
  Coding regions on vcDNA: vcDNA=SeqID_69414; Strand=-; Position=1-237
MHGFKASRKSCTGHPPLPFTNCQPQKKGRGGWVTGAELSTDEDEDDNHHRQRKSGGTTTSRSSTTKRPKRRRRAVQQQ

SEQ ID NO: 142992 - protein, 516 aa, Heterodera glycines
  Coding regions on vcDNA: vcDNA=SeqID_69415; Strand=+; Position=1-1549
  Homolog annotation: Hit_ID=CAA52142.1; Match level="QueryCoverage =98%, HitCoverage=19%, E-value=1e-15, Identity=25%"; Hit description =Tb-292 membrane associated protein [Trypanosoma brucei] pir||B53435 vesicular transport-associated repeat
MQRIAGAPEANVALKALERLEERLKAAQMEEEAKLQAIFKTGAPKSETSQTLKMAREEVAKLRTEATREELLTFLATLMAPEEFEAAKTLQKMASKSTASTVAKAPTELEAESKAELARPEEALGVSVEKPERREAKEERRMRLERQEMAFQLVQQLLSAGRSEASLSEKQRAMVSEQFKQFGLEEMSTSIVLEQLEEVAGRPEAKVALKAWKSLEEGLRVLAVMEERVGFEATWTTGETESGAEKTVQLARVEAAQKRVEEAQEQLRTFLTVLVGPEQFEEAKLLQKIPWHTSAEYRGPESREEWTKIGQQLAKMEAIGLVGVVKPLPVVGKAEASRRIEGREQAFDLVRKVLSEEKGQQTLSEAQKLSVFEQFRELGMEETAATVALQQIQQIGGMPEAKVALRDWTKLEEHLKAKEAFEEEAKLQAALKTGAPDAETSRTLQIAQEQAAQLRVCQLKEELLTFLATLMAPEEWEAAMTLQKFDVAPKAEETLRLKIEEQQQITELVAAALKRE

SEQ ID NO: 142993 - protein, 121 aa, Heterodera glycines
  Coding regions on vcDNA: vcDNA=SeqID_69416; Strand=-; Position=1 -72,265-558
  Homolog annotation: Hit_ID=NP_500081.1; Match level="QueryCoverage =94%, HitCoverage=17%, E-value=2e-20, Identity=39%"; Hit description =CaLPain family member (clp-6) [Caenorhabditis elegans] gb|AAF36079.1| Calpain family protein 6 [Caenorhab
MENVLDVVGEEILERIQNNEFERDRDGLFEDPEFPVESIQLYFTGEPVAVRWRRPGELAEHPQFINQGPIAGDVRQGSIGNWWALAAASVLAQYGPLFYRVVPPDQGFGHNYAGKFKINDN

SEQ ID NO: 142994 - protein, 64 aa, Heterodera glycines
  Coding regions on vcDNA: vcDNA=SeqID_69417; Strand=-; Position=1 -58,347-481
  Homolog annotation: Hit_ID=CAE61909.1; Match level="QueryCoverage =93%, HitCoverage=6%, E-value=7e-20, Identity=76%"; Hit description =Hypothetical protein CBG05905 [Caenorhabditis briggsae]
STYKDSAGNEKILASTQFESTYARSAFPCWDEPTYKAQFDIKLEVDKHMTALSNMNVVAEEEAA

SEQ ID NO: 142995 - protein, 78 aa, Heterodera glycines
  Coding regions on vcDNA: vcDNA=SeqID_69418; Strand=-; Position=1 -126,572-656,821-846
MANGSDKFSKLPQLASPSLYQIMLSVDMETCKFKGNEIIHLEITKPTNFLTLHAGALEVEKASLKLEDGTGPEKFINL

SEQ ID NO: 142996 - protein, 37 aa, Heterodera glycines
  Coding regions on vcDNA: vcDNA=SeqID_69419; Strand=+; Position=1 -20,1010-1103
MFSFLHSNRVITRRWLAKIMMTKLCTPLRGITIPTKY

SEQ ID NO: 142997 - protein, 34 aa, Heterodera glycines
  Coding regions on vcDNA: vcDNA=SeqID_69420; Strand=-; Position=1 -9,361-456
MKMHQNYLLSIKHENTNLSKNQHEKDGLRSLKLS

SEQ ID NO: 142998 - protein, 51 aa, Heterodera glycines
  Coding regions on vcDNA: vcDNA=SeqID_69421; Strand=-; Position=1 -40,252-367
MSELVKELEREEQLADELVQNSNRQMQNYAPSREASVGQPLPAQNDGTRRS

SEQ ID NO: 142999 - protein, 25 aa, Heterodera glycines
  Coding regions on vcDNA: vcDNA=SeqID_69422; Strand=+; Position=1-78
KCSERTKFYLHASLGTLMLFYRKGR

SEQ ID NO: 143000 - protein, 88 aa, Heterodera glycines; identical to SEQ ID NO: 124691
  Coding regions on vcDNA: vcDNA=SeqID_69423; Strand=-; Position=1 -96,135-305

SEQ ID NO: 143001 - protein, 71 aa, Heterodera glycines
  Coding regions on vcDNA: vcDNA=SeqID_69424; Strand=-; Position=1-325
CWCGKCEELCSSRQKILRKFISICRVLSSFPAKFGELLISLERWVINEKNNYRKNNTCVVSVNNCVPSGRK

SEQ ID NO: 143002 - protein, 68 aa, Heterodera glycines
  Coding regions on vcDNA: vcDNA=SeqID_69425; Strand=-; Position=1-267
NYFFHFITQRSRLIRSSPNFAGKLLRTLQMLINFLRIFCLEEHSSSHLPNQHYFFKIIFFILSPNVLD

SEQ ID NO: 143003 - protein, 85 aa, Heterodera glycines
  Coding regions on vcDNA: vcDNA=SeqID_69426; Strand=+; Position=1 -213,463-507
MCQDLIDRLDLMYRARFKKKILNKTDVKKFAQNIVGGPQFRDQLNDEWEKGEQQQQRRRQNANGEDEDIKPLELSQINDMGILKR

SEQ ID NO: 143004 - protein, 292 aa, Heterodera glycines
  Coding regions on vcDNA: vcDNA=SeqID_69427; Strand=+; Position=1 -123,376-795,835-955,2108-2322
MRRKVTVALYEDHVKVFKLLFWARFYALAIALQRIPVEVKEAKPGQRKELFLQIPFHILFFNLNFHGFIEKTCPSDMLKNSGLSIKDAVPQKITKDEGAKLFGYNDYADVQKEEENANATTKELAATFRIDVPRNAWPDETRRRTEELRKKFEQDMDILEEYLLANFNHQMLYNGQSRFYQLSLKSKKDPNGLYQIFEKILPMNWRRWPPVRSPDRCPWSFVNKEDEDYSLKTVHFTKANVQLFKKGNNGTEKLKGIEKWLQKIFNWLDGLVDKCHKKSLTKRNRMQRFLFE

SEQ ID NO: 143005 - protein, 227 aa, Heterodera glycines
  Coding regions on vcDNA: vcDNA=SeqID_69428; Strand=+; Position=1 -197,570-712,1273-1383,1675-1908
DIFNVKSSKEKTGYKHKKHRLESKKAMFGLLMEVDSAVEDNKNIREKWRRKGDQIWEENRENEMEKIWAEQIEAVKMDKTNELSNDAFKQVTSMLKEGTDMPKWMINTPKDSKSSSNKNAGTSSRVESSNTRRRGKRRVIRNATTPADKSEIRTPFTEETLVRKKRKGGFGAGHAAGHAMSRSFSHAHYSAPYYPHGGSYCMGYHYHSSTYYYYSPYHMSHKQVKEL

SEQ ID NO: 143006 - protein, 16 aa, Heterodera glycines
  Coding regions on vcDNA: vcDNA=SeqID_69429; Strand=+; Position=1-49
CDLERYQWTQTLGELE

SEQ ID NO: 143007 - protein, 259 aa, Heterodera glycines
  Coding regions on vcDNA: vcDNA=SeqID_69430; Strand=-; Position=1-780
  Homolog annotation: Hit_ID=NP_502799.1; Match level="QueryCoverage =93%, HitCoverage=34%, E-value=3e-09, Identity=24%"; Hit description =putative nuclear protein, with 2 coiled coil-4 domains (4P607) [Caenorhabditis elegans] emb|CAB16521.1| H
MVEMGTEIQTSRNELKSFQEEVDKAKNITLEHVEKNDLKKAKKSADVAKGIARQAKTKYTSTLEGYNDKSEKGFSGIVNRLNEALGEHIKRKDIENRQVSEAEKGLQKRERLANEDVQFQYDSIDQKFIVYLSSAVTHIDLSKHLAYVLGFKNTRLFHAEEATYMPDLTGGVRQLYIYAPNLIENTIIGNQMAPLLRIVNVVDDPGSISEVIYSTEYFHRLQSKRISEITIEIHTPFGEFVKFHWGSCILTLHFKKSIF

SEQ ID NO: 143008 - protein, 84 aa, Heterodera glycines
  Coding regions on vcDNA: vcDNA=SeqID_69431; Strand=+; Position=1 -106,711-859
MVALIGDNVPFFTRKRHVLVKESAIVRPACIPSMAHGKRQKIKMLFEQVENVGGKMNNWKTPNLLKRSNPHKFSFESSGIFPRP

SEQ ID NO: 143009 - protein, 50 aa, Heterodera glycines
  Coding regions on vcDNA: vcDNA=SeqID_69432; Strand=+; Position=1 -25,87-214
MSCHLREFGSGFIHFLFFTKFENGFFYSFRSCKNDLNIAGKYLDMRTFYM

SEQ ID NO: 143010 - protein, 30 aa, Heterodera glycines
  Coding regions on vcDNA: vcDNA=SeqID_69433; Strand=+; Position=1-92
MAMEAQQQLAINGAILGMPKNEASFKNNIV

SEQ ID NO: 143011 - protein, 102 aa, Heterodera glycines
  Coding regions on vcDNA: vcDNA=SeqID_69434; Strand=+; Position=1-309
MPKIKSKSASFREWIRRIGGTDFYSTTGKIIYCQLCEQQVTATIRRTTTTTNTKFTDSLHAIRVSQTTQRNGKAQGKIGTEQWRTQQQFLTTLHNIPNPLHP

SEQ ID NO: 143012 - protein, 28 aa, Heterodera glycines
  Coding regions on vcDNA: vcDNA=SeqID_69435; Strand=-; Position=1-87
NTILAFCHYFFTISTFFGKFLNKNAIRT

SEQ ID NO: 143013 - protein, 24 aa, Heterodera glycines
  Coding regions on vcDNA: vcDNA=SeqID_69436; Strand=-; Position=1 -52,295-317
MEKACKIWRDYIDFSALELLELAS

SEQ ID NO: 143014 - protein, 64 aa, Heterodera glycines
  Coding regions on vcDNA: vcDNA=SeqID_69437; Strand=+; Position=1 -98,593-689
  Homolog annotation: Hit_ID=EAL33299.1; Match level="QueryCoverage =78%, HitCoverage=18%, E-value=2e-09, Identity=60%"; Hit description =GA20659-PA [Drosophila pseudoobscura]
MREAPYKADAKPRKFWLGVESTGALRAENIVLSGIQVLKKKLIDMQEQLTIERSAMEQQPTTYY

SEQ ID NO: 143015 - protein, 89 aa, Heterodera glycines
  Coding regions on vcDNA: vcDNA=SeqID_69438; Strand=+; Position=1-269
MLVLLLSLDRSRLLRSLYFFQFSSEWALRLSAVFFSIRPNFFVPKVINMLPGKFPSALQPRFFDLCEQLTKQIVPTLEPFLRELIAVDQ

SEQ ID NO: 143016 - protein, 140 aa, Heterodera glycines
  Coding regions on vcDNA: vcDNA=SeqID_69439; Strand=-; Position=1 -164,665-923
MNGVISRESRGLNHGLPLDTVPFHNGMVNLKNKTHSTANGRKCANGFRPSATFCRNSWVEINSFSHKFYPLSIVNARVERRRRNRNADGVRRHSSAECLCRVGDDAKSAKQKGQQMLGRDGQSGDNSKNGNEMYYLQLGF

SEQ ID NO: 143017 - protein, 82 aa, Heterodera glycines
  Coding regions on vcDNA: vcDNA=SeqID_69440; Strand=+; Position=1 -172,594-668
  Homolog annotation: Hit_ID=NP_872058.1; Match level="QueryCoverage =98%, HitCoverage=23%, E-value=3e-22, Identity=62%"; Hit description =RhoGAP domain containing protein (37.9 kD) (2P555) [Caenorhabditis elegans] emb|CAD59137.1| Hypothetical
IVTALPVPSQHLLALLFGTFRVITDSAQTFGTRMTPDAIGISVAPSPFHTCIHDGQRAKLEDIMRFKLASQVISKIIQSFGA

SEQ ID NO: 143018 - protein, 284 aa, Heterodera glycines
  misc_feature (278)..(278): Xaa can be any naturally occurring amino acid
  Coding regions on vcDNA: vcDNA=SeqID_69441; Strand=+; Position=1 -239,291-488,613-774,832-1029
  Homolog annotation: Hit_ID=NP_505980.1; Match level="QueryCoverage =89%, HitCoverage=45%, E-value=1e-50, Identity=43%"; Hit description =ABC transporter (58.0 kD) (5M309) [Caenorhabditis elegans] emb|CAB02876.1| Hypothetical protein D2023.6 [
PMILRNCFLDSQRIWPISELMFSHLPLFQICRLLGALYSEMIFRRGYVHSDPHPGNVLVRRSANTGREEIVLLDHGLYCTLPDELRIDYTLPDELRIDYAKLWLALMKPDQDEIRRVCERMNIGQNYGLFACIVTMRSWKSVTAGIARTEIDDRERSHIKEYATGLIPQISVVLDSIPRQMLLILKTNDLLRSIAFKLKTEHRLDSFSEMTKHCTRAVMTKHCTRAVYHHSIAATQSLLSKLRLYLAMYVLLVKINIFEVFLIVNGLLTARQRHLTLXQMLFLL

SEQ ID NO: 143019 - protein, 101 aa, Heterodera glycines
  Coding regions on vcDNA: vcDNA=SeqID_69442; Strand=-; Position=1 -145,271-414,669-685
MIGKLVRLSPENWNDGELSPSDWNAGKLSRSDWNVTELSPDDCDAEGPVIGMLVRLSPGNWNNGELSPSDWNAGKLSPSDWNVTELSPDDCDAEGPVKFKF

SEQ ID NO: 143020 - protein, 102 aa, Heterodera glycines
  Coding regions on vcDNA: vcDNA=SeqID_69443; Strand=-; Position=1 -282,429-455
AIFIAEVFHRREVPTQFRSKRRLLGKYTLVPPNTAGGSNNDYQLETDGPPSPPPPGGTAPNRNNNHFQLDTVRVADDGLRHGRPEAGSNYNNNRSFFYWIVP

SEQ ID NO: 143021 - protein, 86 aa, Heterodera glycines
  Coding regions on vcDNA: vcDNA=SeqID_69444; Strand=+; Position=1 -129,674-802
DGADEVLINPNMLENERHKLNVERRKKKDHYNPYEEEVDEFGQEEMIAFRRPKNKGREKHAEQKGIESRRFGDGNDGRNGGRKKDT

SEQ ID NO: 143022 - protein, 197 aa, Heterodera glycines
  Coding regions on vcDNA: vcDNA=SeqID_69445; Strand=-; Position=1 -108,162-219,294-469,830-1026
  Homolog annotation: Hit_ID=NP_498583.1; Match level="QueryCoverage =87%, HitCoverage=25%, E-value=4e-43, Identity=50%"; Hit description =TOllisH, Tolloid and BMP-1 family member (67.3 kD) (toh-2) [Caenorhabditis elegans] gb|AAK29859.1| Tollis
DGIGQRTNERFISRVMPFHSLQIRNSTDFANTGMRYCCFGTPESPIVSYCCFGTPESPIVSDTRDMLVLFRSFYRGVLFRSFYRGGKGFQARARAVATTGRWAWSEWSECSASCGACGVRRRVRECAPRGDAVTELSQTEVCARRPCASLCARSFSEEAPCEGILSLLKGLRCRTERTRMEPCRWMCCAGYTQRWTR

SEQ ID NO: 143023 - protein, 85 aa, Heterodera glycines
  Coding regions on vcDNA: vcDNA=SeqID_69446; Strand=+; Position=1 -10,82-329
MLYALESLNLFSTGISLCTFRPPHSQKTIAETYAVGQKLCTYPCSLGQIGPIGSKCQMIGRIAGGCNWRSECSGRGPKTGTIKLN

SEQ ID NO: 143024 - protein, 98 aa, Heterodera glycines
  Coding regions on vcDNA: vcDNA=SeqID_69447; Strand=-; Position=1 -112,167-349
MNKANILKLNSSDEFKYFMRFCPNVNLQKRTCTVVTFGVGHTVRAERELIKIYPECHLIAADPSAEINANLTQSVGGTFVQGPIGAETANQQPVISWE

SEQ ID NO: 143025 - protein, 22 aa, Heterodera glycines
  Coding regions on vcDNA: vcDNA=SeqID_69448; Strand=-; Position=1-66
MPFTGFSAVKSDIYRVNPLYSL

SEQ ID NO: 143026 - protein, 62 aa, Heterodera glycines
  Coding regions on vcDNA: vcDNA=SeqID_69449; Strand=+; Position=1-186
MERKVLNGLQNPFRYGFVRLRMVSKYHADIREWEVQKTIHKKDADKKESLRVLREQNEWIMK

SEQ ID NO: 143027 - protein, 108 aa, Heterodera glycines
  Coding regions on vcDNA: vcDNA=SeqID_69450; Strand=-; Position=1 -61,111-233,306-446
DGFGALLVSCGRSVVKMSKKGNVLQCFTAPEGVNYSALFVSQSGRLLILNRAQRILYLVDKDSNAPIARLHHCDGAVGSASLWIWTHFGVDQQNGTLFILEYISNRVE

SEQ ID NO: 143028 - protein, 78 aa, Heterodera glycines
  Coding regions on vcDNA: vcDNA=SeqID_69451; Strand=+; Position=1 -31,131-336
MLEHVFVRTIGLNIILSSISNRHKIENAKLGRRFQLNATCQTLDKQMKDVPMNQIDLLGNEYSDGEVDGPKFLIEFVP

SEQ ID NO: 143029 - protein, 18 aa, Heterodera glycines
  Coding regions on vcDNA: vcDNA=SeqID_69452; Strand=-; Position=1-55
MKRQILEARGPCRNKMEI

SEQ ID NO: 143030 - protein, 28 aa, Heterodera glycines
  Coding regions on vcDNA: vcDNA=SeqID_69453; Strand=-; Position=1-84
MATVSNEKVGGSTLIGEEDGRDQRKVGE

SEQ ID NO: 143031 - protein, 204 aa, Heterodera glycines
  Coding regions on vcDNA: vcDNA=SeqID_69454; Strand=+; Position=1-612
  Homolog annotation: Hit_ID=NP_694762.1; Match level="QueryCoverage =98%, HitCoverage=15%, E-value=2e-61, Identity=59%"; Hit description =5-oxoprolinase (ATP-hydrolysing) [Mus musculus] gb|AAH34522.1| 5 -oxoprolinase (ATP-hydrolysing) [Mus musc
IDHIGKSNFRRGDVILSNSPRAGGSHLPDLTLITPVFFSDQSGAPDFFVANRGHHSDIGGLVPGSMPPHSTTLAQEGAVFHSFKIIDGGVFKESELVEQLMAPQRVAGCSGTRNLRDNLADLNAQIAANQKGIGLLHELVREYSLPIVKAYMKHIQRNAVEAVRQLLKNVAEESQQKGQKVLRAKDWMDDGTEIKLEVEIDRDS

SEQ ID NO: 143032 - protein, 158 aa, Heterodera glycines
  Coding regions on vcDNA: vcDNA=SeqID_69455; Strand=-; Position=1 -153,194-519
NSGKKAAENLKQNNVQQAKNGESKRSKLQEMIGQAKKTVENALGSSHGSLESHQNSIDLRQEVAEINSKCADLANLLNALEQRLRAVEELTEGVIIIQNCQFVIVMPTIFRLPKRSATAADECLSERSLSGQSPEDDFDDDPVQHHQSDLFASVTFDF

SEQ ID NO: 143033 - protein, 161 aa, Heterodera glycines
  Coding regions on vcDNA: vcDNA=SeqID_69456; Strand=-; Position=1-484
MSSSSGGAAGPSVVDEETADEVKVFRSNNAEDDPTDMAGSSADLDADKQELAMEADIEMQSNIGESKKGRGNYAGKTIELSSISGQSFNPMANPLSGPLPWPSPGSNFLFSQILAAASLSPVYGPAFQKVATAMAAQHFATAAALVVRNSPNYMNLGPSFG

SEQ ID NO: 143034 - protein, 96 aa, Heterodera glycines
  Coding regions on vcDNA: vcDNA=SeqID_69457; Strand=-; Position=1 -105,362-457,505-594
MHCLFSIVYTILTIFMVAHTLSKGTVGGQPMKTERVLLDDEKLREYLSWFRFFDNDKDAQLQHKQFKDILWALGRLPYFEEQPKFERVLDVVDPNR

SEQ ID NO: 143035 - protein, 48 aa, Heterodera glycines; identical to SEQ ID NO: 130859
  Coding regions on vcDNA: vcDNA=SeqID_69458; Strand=-; Position=1-144

SEQ ID NO: 143036 - protein, 38 aa, Heterodera glycines
  Coding regions on vcDNA: vcDNA=SeqID_69459; Strand=-; Position=1 -37,139-218
MYFADLLHHSVEAFPINDFDLIRLLVTRSEVDLAEIKV

SEQ ID NO: 143037 - protein, 60 aa, Heterodera glycines
  Coding regions on vcDNA: vcDNA=SeqID_69460; Strand=-; Position=1 -74,127-232
  Homolog annotation: Hit_ID=NP_499648.2; Match level="QueryCoverage =93%, HitCoverage=6%, E-value=2e-09, Identity=50%"; Hit description=g- protein beta WD-40 repeat (3N775) [Caenorhabditis elegans]
LDFFFEIARPQTHGHPINCLTSVDRNLFVSGGEEKIFRVFQATSSFAENLANLSDSSTKT

SEQ ID NO: 143038 - protein, 196 aa, Heterodera glycines
  Coding regions on vcDNA: vcDNA=SeqID_69461; Strand=-; Position=1 -237,297-378,810-980,1523-1623
MAAYAGDTDDVLLAILQFDHIDVQFLNMDGDDDQIGAAVSSLKFGSAIPSTFELSHICGAVVMAVGLSNGLIDIFVSETNSYSIQKKLSLDLCGSNKSWTRALAFNVSEDGQCHNLSLAAATDGLIKIWQFVGGGDQITVTPLANDDDDHQQLKMNQQTFCIQNGVAHPISVTLESVLHAQTGPIYALGNVPYNAK

SEQ ID NO: 143039 - protein, 175 aa, Heterodera glycines
  Coding regions on vcDNA: vcDNA=SeqID_69462; Strand=-; Position=1 -91,153-355,502-564,690-857
MTEDERAAANWLDNHAWPPAEAFKDKFFEKVWKNAKGRSGYAAHWRKEFMHSHTERTSRAARAAAEGRFEKCGDLEYTRMSERVNPNELTLEDALREEDTDVNSPDLLDEFCKTKAPNMAADAKEAKKCYKKVLKQKKDQLKERADALASTNAENEELKLENNLLRERIGALESM

SEQ ID NO: 143040 - protein, 52 aa, Heterodera glycines
  Coding regions on vcDNA: vcDNA=SeqID_69463; Strand=-; Position=1-156
MGNCKPADATESENASSVETVEVEVPPDPLVNPFWKMQKAFEKKLRNLLKRE

SEQ ID NO: 143041 - protein, 52 aa, Heterodera glycines
  Coding regions on vcDNA: vcDNA=SeqID_69464; Strand=-; Position=1 -93,143-208
MKKVVLQKPGWRPVGWRPVDPHPRESTLGFRAFRVLWSQILGVHPFRTPSGP

SEQ ID NO: 143042 - protein, 224 aa, Heterodera glycines
  Coding regions on vcDNA: vcDNA=SeqID_69465; Strand=-; Position=1 -53,293-451,504-963
  Homolog annotation: Hit_ID=AAC84151.1; Match level="QueryCoverage =97%, HitCoverage=14%, E-value=1e-32, Identity=38%"; Hit description =G7A [Mus musculus] gb|AAL14460.1| valyl-tRNA-synthetase G7a/Bat6 [Mus musculus] gb|AAL14452.1| valyl-tRNA-
MGLYRDTKENPMQLRICSRSKDIIEPIIKSQWYVRSSEMAKRAKAAVVDGRLRLIPEYHVNTWNAWLNDIRDSVHLLVSFGGVTKSRPLLSPLTAIILRHRRETMKSVDDEESYWVSGRTEAEAKTKAAKRFNVSEQSVTLEAGYLNFNRFKNGIISTPSIFARRGRAGHVVLRRHRGPFSVDGLGPKQNGGQAPLFSPALWLETGHDISFFWVARMVVIVAGT

SEQ ID NO: 143043 - protein, 484 aa, Heterodera glycines
  Coding regions on vcDNA: vcDNA=SeqID_69466; Strand=+; Position=1 -1383,1487-1558
  Homolog annotation: Hit_ID=NP_498959.1; Match level="QueryCoverage =94%, HitCoverage=20%, E-value=3e-54, Identity=32%"; Hit description =zn-finger, CCHC type and RNA-directed DNA polymerase  and Integrase, catalytic domain containing protein
MAEIRYLGFLLSEKGVRMDPKQVEAVQNFKPPKSLTELKSLLGALTYFRRFIKNFAHIARPLQTLTQDKFEGKIPENWGNEQNEALQTLKKMLTSAPVLQSPRFGKLFIIECDASRRAIGAVLLQETGPVAFSSRALNKHEANYPSIEREALALVYAVKEFSPYIIGSGTTKIITDCSALTGMMRAKELKGRLEKYQVTLQGYDLEIVYRPGKKNKAADFLSRYNIPGIEDETETNLTEKKNKKENKAQKILSTENSENKIENQDNSNKITLKEIIEEQRQVKELAKIFYILKTGKYPNEILKWKKVNSEYCLINGAIYYQKGTENSENPKLIIPHSLRKRIFCEIHDKGHFGFDKTWTEIKSRFYWVGMKEDVKLLIDACDGCQRRKVQPGQSNFSPSVPIKATEYPFQRVHCDLMGPLKKTDRGNLYIFLTIDSFSKWITAKAISDQKAETVSEVFVETHTMSTAYHQQSNGQAEGSIENCS

SEQ ID NO: 143044 - protein, 646 aa, Heterodera glycines
  Coding regions on vcDNA: vcDNA=SeqID_69467; Strand=+; Position=1-1941
  Homolog annotation: Hit_ID=EAL51907.1; Match level="QueryCoverage =88%, HitCoverage=50%, E-value=4e-14, Identity=23%"; Hit description =Viral A-type inclusion protein repeat, putative [Entamoeba histolytica HM-1:IMSS]
MYNGPVVLPLREADEPLNWEKFVNDPNLELEEKTEEESSDEEEKNTEIEKLNKEKMHKKGAEFKKSLTKFGFESSEEEQESQIAFVRNVNENEGENELEILINENLIEEWEDPCTITEIFIDGEAKFAYTSWPEANLISLTSLMPIDLVQDHWEVFTNDFGKDYVIGNLLGTNFELFINEEVDKIVLGIQIQFLLNDEWDSKMENEKETYWEKLGELNGQILELQRIPDINIAYKENLQKNKNRENNEQINGQIQINVIKNKTTKVGEKEENLEIILSNDLNNNKNNERNNLENLGKNVDYLAMQSPNLPPVKVFEDDLDENERKLREQIDKLKEELEKTEEKKKEIEKRRMEQMKLATVDEVVLEDEEEEEEEEPTSKKSRLNPTATKEIVQKIINEKWVANDLVMIDPRGINDRNGPEDVIESRRIEDGIRAKNRSVNEKAMREFVMTKTSLDHAKEIRTRAMNEVKYAEKPTDPSRLLRGEIRAAEMDICEKQTKAIPPEGKRLAINQLETPEEEAKRKQFCARTPPPFQNLMAQQWAQKREKAENEVISPEKLEGILQKIEEMKGKMNVICEEVKALVNQSSVSSDGEPGTSNFNRWEDNQWRNRGHRGRWSATPRWRGRARQQFGNDWNSQGNGFGTDGYS

SEQ ID NO: 143045 - protein, 115 aa, Heterodera glycines
  Coding regions on vcDNA: vcDNA=SeqID_69468; Strand=-; Position=1 -49,158-456
MFRGPFTLILSGATGSGLIGEGVETFNGIPDMNKIKEQEKPLLLILDDLMLNMQNNFLDLLFTRGSHNWNVSVIFVTQSLYGRDIKTARANAHYLVLMRNPSGQLQVRTLGLISM

SEQ ID NO: 143046 - protein, 236 aa, Heterodera glycines
  Coding regions on vcDNA: vcDNA=SeqID_69469; Strand=-; Position=1 -96,149-361,426-543,603-766,816-935
  Homolog annotation: Hit_ID=AAR85527.1; Match level="QueryCoverage =92%, HitCoverage=87%, E-value=2e-55, Identity=49%"; Hit description =14-3-3b protein [Meloidogyne incognita]
MTDKSKRNTHLLFARFAEETGRFGDMAQSMKQVVELDAKLNESERKSLAVAYRKAVAGQRYAWRAITSILEKGNDATERQLEMTKELLNKIERDVEEKCREIVDLLDRLLLKEAANDEAKVFYLKLKADHFRYLAETRAENADVVEKSKQAYQEAFDMAKDKLSPLHPTRLTVALNFAILLFEVQNLPAEACQLATQAYEDAFNEKKAKPEAACPDSVTIMELLQDNLEYWGAAAD

SEQ ID NO: 143047 - protein, 41 aa, Heterodera glycines; identical to SEQ ID NO: 130306
  Coding regions on vcDNA: vcDNA=SeqID_69470; Strand=-; Position=1-711

SEQ ID NO: 143048 - protein, 78 aa, Heterodera glycines
  Coding regions on vcDNA: vcDNA=SeqID_69471; Strand=-; Position=1 -70,175-339
MSKNTSTMLLFSLLANRIFLVTSVNDLTEAIGSMKEKLFTIYQKYDTDFTPNIPSILETERQEFFNKLNEITNKQFQT

SEQ ID NO: 143049 - protein, 168 aa, Heterodera glycines
  Coding regions on vcDNA: vcDNA=SeqID_69472; Strand=-; Position=1 -187,240-329,639-761,947-1053
  Homolog annotation: Hit_ID=NP_508386.1; Match level="QueryCoverage =84%, HitCoverage=44%, E-value=3e-27, Identity=39%"; Hit description =COLlagen structural gene (38.6 kD) (col-164) [Caenorhabditis elegans] gb|AAA81693.1| Collagen protein 164
MKAHSPWIGHQGDIGEAGLRGPPGEDAIGYARGATGPQGELGTPGPVGEEGPPGERGDDSPPGQPGESGPQGPPGEPGKDGFPGASGPIGAQGADAEYCPCPERSDGQLYEQSKRTHAEPSAAAAAIGTDGIGANPHAEFAANVPEGYEGYYSYSKMAHANTLRRRHL

SEQ ID NO: 143050 - protein, 241 aa, Heterodera glycines
  Coding regions on vcDNA: vcDNA=SeqID_69473; Strand=+; Position=1 -63,113-775
MSAKIIRVPKIACDLSLAKNGRIQFPSTIAFIHPIMSAKIIRVPKIACDLSLAKNDVSKNRNYAQKASQTILALPIPSTIAFIHPIMSAKIIRVPKIACDLSLAKNGVSKNRNYAQKASQTILALPIPSTIAFIHPIMSAKIIRVPKIACDLSLAKNGVSKNRNYAQKAPQTILALPIPSTIAFIHPIMSAKIIRVPKIACDLSLEKNGVSKNRNYAQKASQTILASNSFYNRLYTSHYER

SEQ ID NO: 143051 - protein, 234 aa, Heterodera glycines
  Coding regions on vcDNA: vcDNA=SeqID_69474; Strand=+; Position=1-705
  Homolog annotation: Hit_ID=S60004; Match level="QueryCoverage=97%, HitCoverage=16%, E-value=4e-23, Identity=32%"; Hit description =hypothetical protein - common roundworm retrotransposon R4 (fragment) gb|AAA97394.1| reverse transcriptase cod
NGEVRKSAALLVKNGVLQGDTLSPLLFCLSVAVVSSSVRKLFDFEVLIPGRGVMQRQNHLFYMDDFKGFAPSEESLNRMLVTMERTASAVGLKVNKRKCALVSTREAAGEASGNEIPTLGAHDTYKYLGVEERIDIVFEDAWERVCAKMNERVRSLLRSEPTFGELRKAIRVTVTPVARYLFLNVIAGGPSWGSVLANAQDFDTRVRGLLRERVSDEPGWRFKHCNADRLYLRP

SEQ ID NO: 143052 - protein, 115 aa, Heterodera glycines
  Coding regions on vcDNA: vcDNA=SeqID_69475; Strand=-; Position=1 -117,180-407
FVGSRYRSQPTTTEGQLAKGTTPPIPQTSQQQQIQQVEGPMTISKPNQHHNANTGGHRANASLSPALGSSGFGSSASSNASAQVERDLIDLFDEKCSIGPPLKWTPSPPPLQQHQ

SEQ ID NO: 143053 - protein, 50 aa, Heterodera glycines
  Coding regions on vcDNA: vcDNA=SeqID_69476; Strand=-; Position=1-312
MKNPRLSSRTRAKRPSKSPVCFLSYFPFLPIDRNSSLNNPTFTGAQNCAV

SEQ ID NO: 143054 - protein, 38 aa, Heterodera glycines
  Coding regions on vcDNA: vcDNA=SeqID_69477; Strand=-; Position=1 -4,770-882
MAPATLTESERLFSTAGLIVTDLRKRLLPQNVDKLLFL

SEQ ID NO: 143055 - protein, 24 aa, Heterodera glycines
  Coding regions on vcDNA: vcDNA=SeqID_69478; Strand=+; Position=1-73
IGFLAIIGIGDLIGIGFCLARHIP

SEQ ID NO: 143056 - protein, 45 aa, Heterodera glycines
  Coding regions on vcDNA: vcDNA=SeqID_69479; Strand=-; Position=1-135
MLYLTMAPNLPCQNGFPPRPSPTPPPARHPPSASVVPFCAGNGDH

SEQ ID NO: 143057 - protein, 49 aa, Heterodera glycines
  Coding regions on vcDNA: vcDNA=SeqID_69480; Strand=+; Position=1 -69,117-197
MISPITINGIPTPWQLLAFLANYVLENGCILQKPGSNFNTGTLNLSACY

SEQ ID NO: 143058 - protein, 135 aa, Heterodera glycines
  Coding regions on vcDNA: vcDNA=SeqID_69481; Strand=-; Position=1 -136,1195-1466
MVFVKCLLFPSIFAVLLRLCIISVLLEHGHGYGQFGGGRPGQFNTDGFFLNMWACSPFGPENKAKCEKEGPDGANQIRADVEATTKMRAPTATDWKCTCHFGAKDKSMDNEQFVAPAPPVVKQKKGTDRMPKLKL

SEQ ID NO: 143059 - protein, 332 aa, Heterodera glycines
  Coding regions on vcDNA: vcDNA=SeqID_69482; Strand=-; Position=1 -19,678-788,1122-1265,1331-2055
MCLRCAAAFERFFVACDIPATMVPKYASRFVKERIHPALMKDLDEPMLVDSNSSSSFKAPDREDIYHIKMPIGTLPKTRKILEKNRSLRDRGVLKRGVSGVRRSGIELNKPLNTISTRSKVIGRKAITLQVRTFCDGLCSNVFKGHRHHFLDGICPFGVNAKRFDLYENDRCGRQHWQLETVGFVNPIAQFVCFSVSLANRFASLSGAAPNIRFQLGKVVSPSVQLIPSRRPLVRYSSDIDDFSTTAEPFSELTTEMVRKVRKNNSVTFQPPAFRAPITERIQIVGRSRRSRPVISTTRGIKMVAVGGNSGRLGQPTLGKRTSILDRITVTK

SEQ ID NO: 143060 - protein, 95 aa, Heterodera glycines; identical to SEQ ID NO: 125597
  Coding regions on vcDNA: vcDNA=SeqID_69483; Strand=+; Position=1-416

SEQ ID NO: 143061 - protein, 54 aa, Heterodera glycines
  Coding regions on vcDNA: vcDNA=SeqID_69484; Strand=-; Position=1-385
TFLVLFESIRKMLLACKFSKIVIYAQKNQSKKSSNYWVFEFLLDITFLKLNQNF

SEQ ID NO: 143062 - protein, 44 aa, Heterodera glycines
  Coding regions on vcDNA: vcDNA=SeqID_69485; Strand=+; Position=1-149
FAFRIFWRFAFRFLARNATFTPLRIGLNSHKIFQNFTYKLANFQ

SEQ ID NO: 143063 - protein, 68 aa, Heterodera glycines; identical to SEQ ID NO: 127362
  Coding regions on vcDNA: vcDNA=SeqID_69486; Strand=-; Position=1-497

SEQ ID NO: 143064 - protein, 639 aa, Heterodera glycines
  Coding regions on vcDNA: vcDNA=SeqID_69487; Strand=+; Position=1 -37,87-527,586-665,929-1329,1373-1913,1959-2145,2198-2343,2390-2476
MAKTTQAHLAKKTAPQPNPNAETPQQDEVGPSTSAAPAEEAMEPPPPTPGPVPTPEMDEEILEFGFSLPSASVTPIGDLVPFSTTPTAPMDTGETTPPPLAIDERSERIEQLEKQLKDRDDTIKFLHEQVRNREALISDLRRQLDQHMAPPMAPPTTSKTPPNRGRPKKRLEELQRSARRGIVDQINFFIRPIFFWVIKIKRRICSALKYDVISTPGGPGYVCSDIAGALRFRLSTAKDNLISLIPAHGLPLKVSGDHGQGFTKITISLAHALRPNSPSNNFVAAVFPAKDSRTNLKNFCGSLWEQIEHLNEIDGREVKWFLGGDLCFLWAIIGHCGSAMTAFPSPVCNCRRDHLISSAKCQIRTVQELERQADQFQQLTHGGDKATAEARALTKGIVCASLLPSISFEQMLLAPFHVFQGLGNALIKELEAGENAEIAQQFFRRIGARREAFRKRDLTGNSIRKILVHADQMEALFETEWAKTICKTMAHLGKIQIFTKAQPLSPGDLDGLETAVYQFKAFLDEQPMVRTLLSKKTKAHLLLHHFVPFARQHGFLGLLDEQGDEALHSVWRRLEQLWKTMPDSEQMRQQLEHHFVSNWLLDTGRLDELKLREEEQREQAEEDKTNEESDQDADVDIVD

SEQ ID NO: 143065 - protein, 234 aa, Heterodera glycines
  misc_feature (33)..(33): Xaa can be any naturally occurring amino acid
  misc_feature (207)..(207): Xaa can be any naturally occurring amino acid
  Coding regions on vcDNA: vcDNA=SeqID_69488; Strand=-; Position=1-716
  Homolog annotation: Hit_ID=AAL31950.1; Match level="QueryCoverage =95%, HitCoverage=50%, E-value=2e-37, Identity=48%"; Hit description =CDH1-D [Gallus gallus]
CWAASTSHLERPVPISGRGHLVVPTLAQQDSRXVVNRNHLGNDPAAGSPTATLLRLLPVQATAIKSSSLHTDRSRNTNRPRISRNGSVPGSDGRCVQRAGTYSERVDDSPLQGIPRSRTIIAMSDPNHGKFSPVYQPLSGKDKHADFASRACSRTSGHHRPVIAQFRAAEHRKIPLRSLPTEAMSQLFSARVSLVIGINQTNRSTNXERPCTTIHRIMKKLSICQSLRCPGRVS

SEQ ID NO: 143066 - protein, 40 aa, Heterodera glycines
  Coding regions on vcDNA: vcDNA=SeqID_69489; Strand=+; Position=1-121
MLLGCFHTLELWYTAQCCTCESLCMAAAWQCVGGGPPRLA

SEQ ID NO: 143067 - protein, 59 aa, Heterodera glycines
  Coding regions on vcDNA: vcDNA=SeqID_69490; Strand=-; Position=1 -135,458-502
MPTSNHGKYEMGQQSVLRCHNPQQKVLNTEVMTNVQQIERRTKQTGALIERNLGIWQII

SEQ ID NO: 143068 - protein, 147 aa, Heterodera glycines
  Coding regions on vcDNA: vcDNA=SeqID_69491; Strand=-; Position=1 -313,496-561,616-678
NRITTPSLYQHMLNTYSHTIRRRWPCPNRCVRRRRPFQCPALAPQSTTTSAPKCGHTTHLDSNAVSDPTDSRWPPHQLTKPPNCGVAAATRTSWSVHLDEFRNFLNTYSVPGNKWVWDCAFTNDSSHMVTASSDGILRMWELNACKV

SEQ ID NO: 143069 - protein, 43 aa, Heterodera glycines
  Coding regions on vcDNA: vcDNA=SeqID_69492; Strand=-; Position=1 -96,330-365
VKLVLYRGSMPIKFGTILLLIERARTEENFFNVKLVLYRGVCL

SEQ ID NO: 143070 - protein, 42 aa, Heterodera glycines
  Coding regions on vcDNA: vcDNA=SeqID_69493; Strand=+; Position=1 -45,566-649
MHSGQLQIPDNTVKKNAFFSVSRQSNQNFLAFDIFREHNFNI

SEQ ID NO: 143071 - protein, 100 aa, Heterodera glycines
  Coding regions on vcDNA: vcDNA=SeqID_69494; Strand=+; Position=1 -23,322-601
MNRRLRKIWICGDVWMDILPSFERAELGLKIALLSYRYDALVDKHFDGKKELTIWRTIEICEGIGPEPKLSVQIDDKFVAFPLPERPLPNKIRFNFLWIK

SEQ ID NO: 143072 - protein, 78 aa, Heterodera glycines
  Coding regions on vcDNA: vcDNA=SeqID_69495; Strand=+; Position=1 -155,214-295
MSRYDGGGGDLLLKRCPISEKASADQWENDQNLDANLNFVQFNLCAGKSSTGPYGHQRTKKKKRVKASKYRRIARKTN

SEQ ID NO: 143073 - protein, 87 aa, Heterodera glycines; identical to SEQ ID NO: 129152
  Coding regions on vcDNA: vcDNA=SeqID_69496; Strand=-; Position=1-824

SEQ ID NO: 143074 - protein, 84 aa, Heterodera glycines
  Coding regions on vcDNA: vcDNA=SeqID_69497; Strand=-; Position=1 -33,183-404
MLAENCLRTVQRQYVKLGSNLAKIRDNEQVLAITPWESATDASDSAEITAPANADEHPQSWHGGRHFVEVQTTKSCTLNAEDGR

SEQ ID NO: 143075 - protein, 250 aa, Heterodera glycines
  Coding regions on vcDNA: vcDNA=SeqID_69498; Strand=+; Position=1 -46,101-167,226-329,383-449,507-574,624-710,772-855
  Homolog annotation: Hit_ID=CAE59285.1; Match level="QueryCoverage =99%, HitCoverage=45%, E-value=1e-59, Identity=53%"; Hit description =Hypothetical protein CBG02618 [Caenorhabditis briggsae]
HESTLGHVFETAFGEIAVNICYGRHHPQNWMMIAVNICYGRHHPQNWMMYALNGADIIFNPSATVSGLSEADIIFNPSATVSGLSEALWPIEARNAAIANHVFTVAINVAINRVGTESFPNEFTSGNGRAAHKHKEFGHFYGSSYVTAPDGSRTPGLSRTRDGVLIVELDLNLCRQTKDGLSRTRDGVLIVELDLNLCRQTKDSWGFRMTQRLEMYAQSLSAMTQRLEMYAQSLSAAAASEYRPNVVKEK

SEQ ID NO: 143076 - protein, 55 aa, Heterodera glycines
  Coding regions on vcDNA: vcDNA=SeqID_69499; Strand=-; Position=1 -81,129-170,645-689
  Homolog annotation: Hit_ID=NP_741442.1; Match level="QueryCoverage =74%, HitCoverage=2%, E-value=5e-12, Identity=78%"; Hit description =voltage-gated Calcium Channel Alpha subunit, putative L-type calcium channel alpha 1 subunit, EGg Laying d
MICGNCIALAVYQPYPAQDSDMKNTVLENLENLFIVVFTAESDQHSAFPDQHPGI

SEQ ID NO: 143077 - protein, 130 aa, Heterodera glycines
  Coding regions on vcDNA: vcDNA=SeqID_69500; Strand=-; Position=1 -115,600-717,912-989,1749-1831
KQKVHTKCTSCAWSSDGFFYAVGFFDGTVSVRSASGPTSHRSDKQLDYDPTAVHLFNNGCFFLTIGSNRMLNLHTVGGIDLGAMAQLDAWPWSMVLFKQQFLVVLSAGDHQSAFDPVPEQALDMLRPEGH

SEQ ID NO: 143078 - protein, 46 aa, Heterodera glycines
  Coding regions on vcDNA: vcDNA=SeqID_69501; Strand=+; Position=1-206
LCSAEPNDASLRLNRSQVTHRLSHFCWFCLFLSPQVHPISKNSVLS

SEQ ID NO: 143079 - protein, 84 aa, Heterodera glycines
  Coding regions on vcDNA: vcDNA=SeqID_69502; Strand=+; Position=1 -64,114-225,306-384
  Homolog annotation: Hit_ID=CAE73644.1; Match level="QueryCoverage =84%, HitCoverage=15%, E-value=4e-24, Identity=70%"; Hit description =Hypothetical protein CBG21144 [Caenorhabditis briggsae]
MSEEVDRHIVERYEIQKRLGKGAYGIVWKAIDRKTNDTIALKKIFDAFRNATDAQRTFREIMFLQEFRTAPKHHQTVQHSQSGQ

SEQ ID NO: 143080 - protein, 25 aa, Heterodera glycines
  Coding regions on vcDNA: vcDNA=SeqID_69503; Strand=-; Position=1 -52,205-230
MEKACKIWRDYIDFSALEQFLKKYL

SEQ ID NO: 143081 - protein, 27 aa, Heterodera glycines
  Coding regions on vcDNA: vcDNA=SeqID_69504; Strand=+; Position=1-85
NCSETHQILFASYFRHSDAFTIKKGDE

SEQ ID NO: 143082 - protein, 80 aa, Heterodera glycines
  Coding regions on vcDNA: vcDNA=SeqID_69505; Strand=-; Position=1 -193,308-357
MRLNNRNRQFIEETRISVKENYCILANFVLNLLEKANVVEYLQKNDENIEYFFIRYSTDCAQRNDLPTRTFDENIVGRQI

SEQ ID NO: 143083 - protein, 86 aa, Heterodera glycines
  Coding regions on vcDNA: vcDNA=SeqID_69506; Strand=+; Position=1 -114,162-245,652-716
VANTLVPDFHKLAFALLSGLPNEVSFGLNILTVLSHPGPFVLNFANCPQLIALLVALCGVCVNVEGFCCFASIVGGICCVKLPMIH

SEQ ID NO: 143084 - protein, 54 aa, Heterodera glycines
  Coding regions on vcDNA: vcDNA=SeqID_69507; Strand=+; Position=1 -101,533-596
MADTATANRQGFAVVGPFATTLRALCGPSQLICNAHSAQHLSPFRRRTSQTPHA

SEQ ID NO: 143085 - protein, 18 aa, Heterodera glycines
  Coding regions on vcDNA: vcDNA=SeqID_69508; Strand=-; Position=1-56
EAIPEGFGLPINLGASVR

SEQ ID NO: 143086 - protein, 96 aa, Heterodera glycines
  Coding regions on vcDNA: vcDNA=SeqID_69509; Strand=+; Position=1 -96,149-255,298-391
  Homolog annotation: Hit_ID=CAE72855.1; Match level="QueryCoverage =98%, HitCoverage=27%, E-value=2e-22, Identity=46%"; Hit description =Hypothetical protein CBG20154 [Caenorhabditis briggsae]
FILSWTVFTSSIFYVWRRVNQPAISGSTPRLVYKYFLFMHKLSYIFGIVGYFSLVFTVIGINSVFGISSNLSLDFGVHLLFYCLYYGVLGRDLAHS

SEQ ID NO: 143087 - protein, 75 aa, Heterodera glycines
  Coding regions on vcDNA: vcDNA=SeqID_69510; Strand=-; Position=1 -80,129-403
YLKVPENHSYTKTCLNFVIGSMAFDRFFELLNFPFPKGRRRKLPTFIPIVKDCTYSNVPPNVHNCTIATSKSRAK

SEQ ID NO: 143088 - protein, 34 aa, Heterodera glycines
  Coding regions on vcDNA: vcDNA=SeqID_69511; Strand=+; Position=1-107
SVSGYSNNYRGAKIQRRIKVQAIGKLFRKDSVSP

SEQ ID NO: 143089 - protein, 167 aa, Heterodera glycines
  Coding regions on vcDNA: vcDNA=SeqID_69512; Strand=-; Position=1 -61,107-136,184-240,307-366,419-463,605-855
  Homolog annotation: Hit_ID=AAP30775.1; Match level="QueryCoverage =100%, HitCoverage=100%, E-value=3e-74, Identity=79%"; Hit description=putative gland protein G32E03 [Heterodera glycines]
MRAILFLAMVCLVMAVILETANSKAVKNKKGTVATPAKGKAAPKGAAKGGIKKDAKSKGKGKKDAKGKKDKKAKPAKGKGVPKNVKPMAAVKAVPKAAENAQKGPSSAEVVAEENNLDTEAVDDLGAEESDFDQLAEDELLEDDAMDGEADEWEGMGDELVDSQMAL

SEQ ID NO: 143090 - protein, 83 aa, Heterodera glycines
  Coding regions on vcDNA: vcDNA=SeqID_69513; Strand=+; Position=1 -105,998-1144
MSNGPREEQNFHLIRVGFDDTLQGELINAATINYKASSCSPTIATRSTRSRPTPARPCWPACCASVVASALEERRIAVAWPPC

SEQ ID NO: 143091 - protein, 35 aa, Heterodera glycines
  Coding regions on vcDNA: vcDNA=SeqID_69514; Strand=+; Position=1-148
ISPLRLKLFRPYFANFLPLFRSLNWNFSPLKIRTL

SEQ ID NO: 143092 - protein, 53 aa, Heterodera glycines
  Coding regions on vcDNA: vcDNA=SeqID_69515; Strand=-; Position=1-386
LFSFSTKLNILGIIRKHSKNAISLQIFKNFYLCTKKSEQKKVRITGFLSSFWP

SEQ ID NO: 143093 - protein, 22 aa, Heterodera glycines
  Coding regions on vcDNA: vcDNA=SeqID_69516; Strand=+; Position=1-67
MLSLLTSLFVPRPATVCPPFSE

SEQ ID NO: 143094 - protein, 260 aa, Heterodera glycines
  misc_feature (6)..(6): Xaa can be any naturally occurring amino acid
  Coding regions on vcDNA: vcDNA=SeqID_69517; Strand=+; Position=1 -220,268-469,523-654,734-837
  Homolog annotation: Hit_ID=NP_498583.1; Match level="QueryCoverage =97%, HitCoverage=35%, E-value=1e-30, Identity=33%"; Hit description =TOllisH, Tolloid and BMP-1 family member (67.3 kD) (toh-2) [Caenorhabditis elegans] gb|AAK29859.1| Tollis
KRSFFXSQRNEILIYEAVKLWNDNTCLNIVESDKVSPRIQFTNIVGRGCKANVGMQSSKAYQEVDLEYPDCYELGLIAHELGLIAHEIGHSLGFFHQHERYDRDSFVWFYPDNVDPENHYAFQKETTESTDNYKVPYDLGSVMHYSAKAFSINGQYTLVPRAGASYINTIKAFSINGQYTLVPRAGASYINTIGQRFGPSISDYIVINKHYCGLACRVTMNCDNDGCRVTMNCDNDGFQNPDTCSTCICPQGYIGAKCQD

SEQ ID NO: 143095 - protein, 286 aa, Heterodera glycines
  Coding regions on vcDNA: vcDNA=SeqID_69518; Strand=+; Position=1 -175,602-775,1590-1824,3051-3325
  Homolog annotation: Hit_ID=NP_650854.1; Match level="QueryCoverage =97%, HitCoverage=33%, E-value=3e-09, Identity=25%"; Hit description =CG12254-PA [Drosophila melanogaster] gb|AAF55729.1| CG12254-PA [Drosophila melanogaster] gb|AAL39515.1| L
ATSVAPSANLLAQQLAGQSAAAATAKFGTTPQRQQQQQLPAKQQQQRQKQQHQQPGQAAHFGIGGAQQQQVPVLILPDQSLLERYVQHKRDALDQLHNSDDDDHDAAGDAAAAVDEALHTATTPSAPALFVPRTAAAAAVVSASLPGSKRNSQMLAAVPSGAELPQPLTGSFHSAIEATAADLRAAAAAAQPRLRRAQQQQQQIPILSTQTFEKPKSLFEEQMQRQAIQLRQRGAVARHSLHDDDAEAAPAAKTVQNQQRQHKQAAQAVPATQPQQRRQRSGDATA

SEQ ID NO: 143096 - protein, 93 aa, Heterodera glycines
  Coding regions on vcDNA: vcDNA=SeqID_69519; Strand=+; Position=1 -43,407-519,595-719
  Homolog annotation: Hit_ID=NP_493381.1; Match level="QueryCoverage =92%, HitCoverage=50%, E-value=2e-36, Identity=83%"; Hit description =ubiquitin conjugating enzyme (19.1 kD) (ubc-14) [Caenorhabditis elegans] emb|CAB60431.1| Hypothetical pro
FHPNIYADGKVCISILHTPGDDPTGYETSAERWSPVQSVEKILISVVSMLAEPNDESAANVNAAKMWRDNRAQFERIAHKLVRTTLVKQGKTC

SEQ ID NO: 143097 - protein, 142 aa, Heterodera glycines
  Coding regions on vcDNA: vcDNA=SeqID_69520; Strand=-; Position=1-429
AFIELTHRGCGNTIPELNDYGLLILKSINENNAEVICSCDFTNRAFGKRNFFVISQSQDADLVMSKKSGLTGWITEQPSVLDMLVGITQKKNLAKLILLIKINKKNEDELKKWNSLKLAKFVNRNLIKEKMPIKLDEDKMIF

SEQ ID NO: 143098 - protein, 166 aa, Heterodera glycines
  Coding regions on vcDNA: vcDNA=SeqID_69521; Strand=+; Position=1-501
  Homolog annotation: Hit_ID=NP_507780.1; Match level="QueryCoverage =91%, HitCoverage=10%, E-value=2e-09, Identity=33%"; Hit description =predicted CDS, DNA polymerase type B, organellar and viral family member (5T899) [Caenorhabditis elegans]
MQKVVRTPGCQLLYTDTDSLIFVHPIGMCPLKTGPHLGQFTDEYPEHEIVEFCSGGAKQYGLALRRKNGQADAEMEYVLKLRGLTLNYDVINNQGLRYETFKQQVKRYAQTGEIEPINVMYPNFIRPNIRDGGSVISSSMQKCYQPYVGKGIVGADYNVLNFGHTL

SEQ ID NO: 143099 - protein, 116 aa, Heterodera glycines; identical to SEQ ID NO: 127487
  Coding regions on vcDNA: vcDNA=SeqID_69522; Strand=+; Position=1-351

SEQ ID NO: 143100 - protein, 66 aa, Heterodera glycines
  Coding regions on vcDNA: vcDNA=SeqID_69523; Strand=-; Position=1-200
MNTVRRTKWWQFTGVKKHSELYRRPTGPADGWSSALRSTIAETAPSPPVVVAVVAGVVVENEMPKK

SEQ ID NO: 143101 - protein, 36 aa, Heterodera glycines
  Coding regions on vcDNA: vcDNA=SeqID_69524; Strand=-; Position=1 -48,192-254
MPKDVLKNVRKLEALQQGTSKSNDELRIRFGFRHSK

SEQ ID NO: 143102 - protein, 92 aa, Heterodera glycines
  Coding regions on vcDNA: vcDNA=SeqID_69525; Strand=+; Position=1-280
FISADCWLCVYDLLPASQLGLGIALISHRFDFYVDEHFKTRRWTLRSMAIKSKSKSDGTVGMDIVNYAGKALPIPQNPLPKKVVGFKAISMK

SEQ ID NO: 143103 - protein, 107 aa, Heterodera glycines
  Coding regions on vcDNA: vcDNA=SeqID_69526; Strand=+; Position=1-325
  Homolog annotation: Hit_ID=NP_504753.1; Match level="QueryCoverage =98%, HitCoverage=2%, E-value=7e-36, Identity=72%"; Hit description =UNCoordinated locomotion UNC-68, Ketamine Response Abnormal KRA-1, ryanodine receptor (unc-68) [Caenorhabd
DDIQAACYKILDSLYMVSRLANSCASRQSIQIEVEKHRSALGQCLSAFSACFPVAFLEAEFNANNKLSVLAKSRDQSVQVQEMLQNLSQHIPMLDKLLQEIEQSAAK

SEQ ID NO: 143104 - protein, 140 aa, Heterodera glycines
  Coding regions on vcDNA: vcDNA=SeqID_69527; Strand=+; Position=1-420
  Homolog annotation: Hit_ID=NP_702063.1; Match level="QueryCoverage =92%, HitCoverage=3%, E-value=2e-12, Identity=25%"; Hit description =hypothetical protein PF14_0175 [Plasmodium falciparum 3D7] gb|AAN36787.1| hypothetical protein [Plasmodium
FVTYWSNTTQSTNIPINGTQSSSISISGTQPSSIQSLGLNPPTFQSTGLNPPAFQSVGLNPPTFQSTGLNPPTFQSTGLNPPAFQSVGLNPPTFQSPGLNPPAFQSVGLNPPAFQSVGLNPPTFQSTGLKRNLYPPAFQS

SEQ ID NO: 143105 - protein, 92 aa, Heterodera glycines; identical to SEQ ID NO: 125147
  Coding regions on vcDNA: vcDNA=SeqID_69528; Strand=-; Position=1-304

SEQ ID NO: 143106 - protein, 24 aa, Heterodera glycines
  Coding regions on vcDNA: vcDNA=SeqID_69529; Strand=+; Position=1-76
ITGVSIIAVLFLVFLMPSQNLVRF

SEQ ID NO: 143107 - protein, 150 aa, Heterodera glycines
  Coding regions on vcDNA: vcDNA=SeqID_69530; Strand=-; Position=1 -186,339-459,614-759
  Homolog annotation: Hit_ID=CAE57685.1; Match level="QueryCoverage =62%, HitCoverage=8%, E-value=4e-18, Identity=46%"; Hit description =Hypothetical protein CBG00683 [Caenorhabditis briggsae]
MEYYYCFNYSQVKHYMALVDTQQYEACHQEAVTRCHATDNWHENTNKLPGQDQKVVVDPGPQADPLGKECALYVRQVLRERAARVNLLPDIEENCCDALSEYCFQIVMLDNYCSPKVDIESEGKTVHSFLVHSQEKDEGKVETTYPIRSA

SEQ ID NO: 143108 - protein, 212 aa, Heterodera glycines
  Coding regions on vcDNA: vcDNA=SeqID_69531; Strand=+; Position=1-638
  Homolog annotation: Hit_ID=BAA95789.1; Match level="QueryCoverage =97%, HitCoverage=83%, E-value=1e-12, Identity=29%"; Hit description =KED [Nicotiana tabacum]
KLVELKKKEVSRKRKRLIETEKVEGNKVPTNVKEVQETEDGEKKDEKELKGIGNERDLKEVNEEEKEKKDKKGKEEAKKKEIVLIDSEEDWKKVSQHEDEVSLGPEEEDDEERILFPTPKGAELQNLSFWESCHNKAKSRGEMEEKSREKEKRETNALRLARAEIRSAELSIIEKRDEEIPPEGKRIRNELDINCETEEEERNRKKYRAHTP

SEQ ID NO: 143109 - protein, 86 aa, Heterodera glycines; identical to SEQ ID NO: 125661
  Coding regions on vcDNA: vcDNA=SeqID_69532; Strand=+; Position=1 -151,194-303

SEQ ID NO: 143110 - protein, 84 aa, Heterodera glycines
  Coding regions on vcDNA: vcDNA=SeqID_69533; Strand=-; Position=1 -182,669-1003
YPKIFFWVFGAALLNRCAQIYGETESFRNSFTIACTLILRWIFAPHNCLSTPNGHLKKSIYFCFRGSPPEPMRPDLWGDRILRE

SEQ ID NO: 143111 - protein, 23 aa, Heterodera glycines
  Coding regions on vcDNA: vcDNA=SeqID_69534; Strand=+; Position=1 -39,428-460
MTTSAGEWKNKQKANRGLLGALK

SEQ ID NO: 143112 - protein, 95 aa, Heterodera glycines
  Coding regions on vcDNA: vcDNA=SeqID_69535; Strand=-; Position=1 -164,336-432,1110-1136
MRHERRTVECQRRVTQLKRRAVETWKAPATILAQVLQNTTTPMLAAFPNKAATKRLLVFARSSTSQWTCIMKNVYADGTFSRRHLFQILPQLRKK

SEQ ID NO: 143113 - protein, 153 aa, Heterodera glycines
  Coding regions on vcDNA: vcDNA=SeqID_69536; Strand=+; Position=1 -146,191-506
MPEIDEFDGQAEYGAYGYVDRFIRNWIQQSANQNRAALFPMELWNMCDRVEGDLCRTNNSVEAWHINLNALFRSPSPRLSIFLRKVRQEESHWRQQVEDFANNPANGIRGKGMKRKQTYVDQDMNLNELYVTRNNRHPLQYLRAISHRMAEPL

SEQ ID NO: 143114 - protein, 371 aa, Heterodera glycines
  Coding regions on vcDNA: vcDNA=SeqID_69537; Strand=+; Position=1-1113
  Homolog annotation: Hit_ID=NP_920291.1; Match level="QueryCoverage =92%, HitCoverage=22%, E-value=8e-26, Identity=28%"; Hit description =putative helicase [Oryza sativa (japonica cultivar-group)] gb|AAP52578.1| putative helicase [Oryza sativa
MDLRISTPKNLLQYLVNQYNRQQARQNPNAQQKTVDDIGSVVRLSEHNVNSLQYWKKMYEDCNTVFARCHDAKKARLFITFTNNREWPEFKENIYKNGQVFTDRFDMWMRVWSSKIAEFREELYDKKFFGTILGYGESMEFQGRGGPHAHIVAQTDLDAVPYVIQEYIWAHIPSLPDKDDDTPIAKMHREIRETMHMQLHRCSDSWCGPSDPIYGRCKKGFPAPYSKCTILRPDRPAMYFRPSPSDGGAQLEVNGLIYDNSHVVPYNPYILLRYRVHHNVLFAYGNKANIKYALKYPFKGPGHCYVECKEESGNKIGIDEPAQYAKMNFRGATEAYAIVHSMPFARLSHHVVKLAIHLPNQQPIVYRAFQL

SEQ ID NO: 143115 - protein, 349 aa, Heterodera glycines
  Coding regions on vcDNA: vcDNA=SeqID_69538; Strand=+; Position=1-1048
  Homolog annotation: Hit_ID=NP_920291.1; Match level="QueryCoverage =99%, HitCoverage=23%, E-value=4e-71, Identity=42%"; Hit description =putative helicase [Oryza sativa (japonica cultivar-group)] gb|AAP52578.1| putative helicase [Oryza sativa
MTIVRRFGKPDLFVTMTCNPKWEEIQENLYKEQDPSDRPDIIDRVFNLKIKALLRDVTNQVFGFCIAWMYPVEFQLRGLPHIHLLITLAQKDKLHDGEDVDKRGISAKIPNKNQDPQLYELVKKHMIHGPCGILNPNSPCMEEITDKNNVKIKRCSKGYPKSFQEKTIVLENGFTIYARPNDGNFVEVKIFDGKVYKLDNRWVVPHMPYLLKKFSCHINVEKVNSLSSVKYLHKYIHKGPDRTGVKLVEKIDFDEVKQFTDARFVSPTDAVWRILENPICDRSHAIKTLPVHLSGEQIYYFEENMEEEELRDKINRNTELMAYFELNKNDELAKNKYYHEIPEFFVFGK

SEQ ID NO: 143116 - protein, 65 aa, Heterodera glycines
  Coding regions on vcDNA: vcDNA=SeqID_69539; Strand=+; Position=1 -70,683-810
MRTEMNGSFLEINSAEEKRRTFRGPGLDPGPEEPGFFLDLDFCPGNQGPGPTWNPSPGFFQNVDL

SEQ ID NO: 143117 - protein, 125 aa, Heterodera glycines
  Coding regions on vcDNA: vcDNA=SeqID_69540; Strand=+; Position=1-378
MDRCKKEKKQWIIICGGSAYYFEDATIALGMKFLKNCNENVQLFLTPNATILITKRNVKDVIPIGETPEVERLSKKSLSPIRYAMISQLFTERLAAIIVVKMISVANTLPTLLQDSLTMRNSAKK

SEQ ID NO: 143118 - protein, 30 aa, Heterodera glycines
  Coding regions on vcDNA: vcDNA=SeqID_69541; Strand=-; Position=1-93
TQECTLKALRRHGEHSKMDCDTCTELTLTC

SEQ ID NO: 143119 - protein, 163 aa, Heterodera glycines
  Coding regions on vcDNA: vcDNA=SeqID_69542; Strand=+; Position=1 -271,542-608,658-811
  Homolog annotation: Hit_ID=CAE62987.1; Match level="QueryCoverage =41%, HitCoverage=9%, E-value=1e-10, Identity=45%"; Hit description =Hypothetical protein CBG07214 [Caenorhabditis briggsae]
MQQQYDHRWVNHRMYFVDPNDPRVHTQGIEATWRALKNGLRHLHGTNSDMFVTNLSLSVYVPSVPWKCKNFPKYSGRNSISISTIIVALHCGIAPAMLFTGIDRLIAIAFSEFHDSLKKRLYLALLTVISVAYGVCFSATVYQNEIVDGDQMTTGSYLDFIKV

SEQ ID NO: 143120 - protein, 67 aa, Heterodera glycines
  Coding regions on vcDNA: vcDNA=SeqID_69543; Strand=+; Position=1 -124,177-256
MVSTRSKTDKFKKMGNSSTEANRKRKEWRQERARKGGSTPKTLKQTEAETTGELSMSHFCDQSNLTG

SEQ ID NO: 143121 - protein, 59 aa, Heterodera glycines
  Coding regions on vcDNA: vcDNA=SeqID_69544; Strand=+; Position=1 -93,141-227
MPDEEQMRQLLEHHFVSNWLLETGKLDEMKRDREEQQEQIGGRESDEESDVEEEQFDFE

SEQ ID NO: 143122 - protein, 240 aa, Heterodera glycines
  Coding regions on vcDNA: vcDNA=SeqID_69545; Strand=-; Position=1 -51,323-424,562-671,783-862,1245-1482,1589-1730
  Homolog annotation: Hit_ID=NP_495913.1; Match level="QueryCoverage =95%, HitCoverage=21%, E-value=8e-26, Identity=34%"; Hit description =protein tyrosine phosphatase (2J270) [Caenorhabditis elegans] emb|CAA93856.1| Hypothetical protein C18E9.
MPAPVQSVRVIRSYTDEYFQASVLLGFGLPPKADSAHFQLYEVHIAWSPGKKVVGRQQVVFRGEHIQKTGGKSAEGRVNITGLEPARLYTFAVRNVSRELAAKCSAPLGVRLITPPVITSTIYAGQISTHSININFGESDPSHPFDQYELHFDSSSGAEAAEGDGETAPKSGKKLENGDETPNTLIRRLAKNDTKSFTFNKLVPGKTYTFALFTLLHGVRSRPVDVNITTCEEQKKDRKK

SEQ ID NO: 143123 - protein, 95 aa, Heterodera glycines; identical to SEQ ID NO: 125597
  Coding regions on vcDNA: vcDNA=SeqID_69546; Strand=+; Position=1-808

SEQ ID NO: 143124 - protein, 61 aa, Heterodera glycines
  Coding regions on vcDNA: vcDNA=SeqID_69547; Strand=-; Position=1-187
VILCYQDELFGANKSSIWKVARRFRLNDLSNLQNTNCAKYEKEIQVSIQNGTFSIGTEHFK

SEQ ID NO: 143125 - protein, 315 aa, Heterodera glycines
  Coding regions on vcDNA: vcDNA=SeqID_69548; Strand=-; Position=1 -77,147-320,426-538,587-656,709-881,938-982,1026-1083,1235-1322
  Homolog annotation: Hit_ID=CAE69909.1; Match level="QueryCoverage =96%, HitCoverage=25%, E-value=7e-62, Identity=33%"; Hit description =Hypothetical protein CBG16264 [Caenorhabditis briggsae]
KAFSDVCGGEAPLMQPKCSASDPCPPTGYGCRQGRCCPSKGVCPAGSPLGGITQCSNERGNPCPNNFQCVTNNGHQYCCPSPDHVCGLPKDPGIPCQARGVPALSRFYFDGSTGSCRSFQFSQCGGNANNFDSLEFSQCGGNANNFDSLEQCEGFCFETQCPQGGSLRAGPAQCPQGGSLRAGPALATCVPGDALSNAHDSCPSQYGCSQPRFGSNFVCCSNPEEVCREPVSAGNACFGGFVTEPVSAGNACFGGFVTINRWSYNPEINRWSYNPEKSQCEPFQYYGCGGSGNNFLTKSDCESICQPSIRSGKSM

SEQ ID NO: 143126 - protein, 123 aa, Heterodera glycines
  Coding regions on vcDNA: vcDNA=SeqID_69549; Strand=+; Position=1 -213,533-690
NTIRRPASTSAVPPVPLKMEEDERRGEVGTDTRRRRHDGGHSGGKKKGTDRSPTSRANVLDMEQLQDGGNQQQQQSMNNTQMRGGGIAQQQAAGNHSQQMLASGSGTGLPQDPEKPQQQPFKL

SEQ ID NO: 143127 - protein, 31 aa, Heterodera glycines
  Coding regions on vcDNA: vcDNA=SeqID_69550; Strand=+; Position=1 -39,344-400
MEKSLGYLFILSVGGYVELLLIPRLINWLSV

SEQ ID NO: 143128 - protein, 410 aa, Heterodera glycines
  Coding regions on vcDNA: vcDNA=SeqID_69551; Strand=+; Position=1 -229,348-557,606-845,1307-1627,1680-1912
  Homolog annotation: Hit_ID=CAE71190.1; Match level="QueryCoverage =82%, HitCoverage=61%, E-value=6e-36, Identity=30%"; Hit description =Hypothetical protein CBG18047 [Caenorhabditis briggsae]
MWDVVSGNPPPVEKTNWTRAQRVIRHFPNDADGQTLRQGIAKMPFANYDIWTNDNDEVFTERTLQLFTEILTTACSALHRSSQLFSALNSSSSAPAFDVAIAEWFDFSSLALFHRLGIPTTLITSALPLDSVLARYLGIPMPAYVPIVNKASPEGTKMDIWRRFVNYIDKRRNTQLDQIINTVANSVFGENFPSPQELALRASFLLLNTNEMLDLARPTSNKIKHIGGFLLDSDYPKNAVAKRMAKDPSMPSASAPSVFVSFGSVADPNKMPPQMLRAFLHTFASFPELDFVWRFPTQKGTDDEARCHNGTLFGNKIPANVRLVQWVDQHAILAHPNTRAFVSHCGLNSLNEAATAGVPLLCVPLFGDQNYNAAIVQNHQNGIVLLKKHLNKERLQSALKELVADEKANR

SEQ ID NO: 143129 - protein, 97 aa, Heterodera glycines
  Coding regions on vcDNA: vcDNA=SeqID_69552; Strand=-; Position=1 -110,244-427
MVIVPFAVFSEIHFHHPGIEFWKPMEYSTRFVGGMHRNYRPISYGGKEIFTQKTFGQIVSVVNNLKTIFNPSTYKLLSRNCLLFLRTLVRQLTGKNG

SEQ ID NO: 143130 - protein, 154 aa, Heterodera glycines
  Coding regions on vcDNA: vcDNA=SeqID_69553; Strand=+; Position=1 -235,428-461,504-579,630-748
  Homolog annotation: Hit_ID=CAE65006.1; Match level="QueryCoverage =44%, HitCoverage=25%, E-value=1e-24, Identity=75%"; Hit description =Hypothetical protein CBG09844 [Caenorhabditis briggsae]
MRPIPLNAVLIKDWRYYQKLEEEPDFDKPNYPKKWNEMAKAAKEAKDQLKMANNGTNENNKNGGTNGNGAANGNAKNGKKGHRAMIIKEYRLVLPMTVDEYQIGQLFSVAEASRQETGGGEGVQVLRNEPFEGESLFNGQFSSGQYTHKIYHFD

SEQ ID NO: 143131 - protein, 240 aa, Heterodera glycines
  Coding regions on vcDNA: vcDNA=SeqID_69554; Strand=+; Position=1 -94,401-499,540-632,681-740,807-1023
  Homolog annotation: Hit_ID=CAE65715.1; Match level="QueryCoverage =99%, HitCoverage=46%, E-value=4e-42, Identity=45%"; Hit description =Hypothetical protein CBG10794 [Caenorhabditis briggsae]
SPPLFLPISFFPSPVGHFPRVPAFAPIFALIVEMSVDTMAITALPLDCWLKERLKNWVQLSGHEGTIVPASNHTLWKKQPRGNRAELSGHEGTIVPASNHTLWKKQPRGNRAEAHAYEEIMRDSELCGITPKFYKEISELCGITPKFYKEIAHNNETFIEIQDLLAQFPFIEIQDLLAQFPNTKSRAIMDIKIGTRTFMESEVSNDTKRVDLYQKMATLSPDDPDEKERPEGQVTKLRYM

SEQ ID NO: 143132 - protein, 43 aa, Heterodera glycines
  Coding regions on vcDNA: vcDNA=SeqID_69555; Strand=-; Position=1-505
CFAVPRTGRQWMAFNLQEIRLAICGCKKLLGIELFFEVSQTPY

SEQ ID NO: 143133 - protein, 307 aa, Heterodera glycines
  Coding regions on vcDNA: vcDNA=SeqID_69556; Strand=+; Position=1-926
KWEEKEEERRNELKKREIIQKYYKIKEKIKQKGRKYSTKEWNKIEQKIAKKLGTNNCYIKKWIKEFGLQKQIKKSYKSKTDEEKRQIIQKFIEMTNEFKQKGKYSLKEWNKNYAEICKKIGVSKGTIIKWKKQFGISLKRITEKEKMAKMKIYWQIKRENPKISEQKIAKMTNTRRRTFGNGKPNLEKRNNEEEMKAKKEDKEILEILENSENYILCDFCFCSLTGLQKICKCIKNTFFFFVFAYKSRDFYLHILALSAYFMHILPFFVKYFPIFCIFCHFSSNIFQFFAYFAIFRQIFSDSNISIF

SEQ ID NO: 143134 - protein, 96 aa, Heterodera glycines
  Coding regions on vcDNA: vcDNA=SeqID_69557; Strand=-; Position=1 -58,103-235,315-412
MESIENGIPIIAKGRENGIDAKQVIKPVAGPAEATDISTKQQRMPRMQVAATPPTEKPKTRKRKADLSFDGMRETDAESEKGQSEKRARNFIRKES

SEQ ID NO: 143135 - protein, 304 aa, Heterodera glycines
  Coding regions on vcDNA: vcDNA=SeqID_69558; Strand=-; Position=1-915
  Homolog annotation: Hit_ID=NP_508646.1; Match level="QueryCoverage =91%, HitCoverage=13%, E-value=2e-41, Identity=38%"; Hit description =predicted CDS, RNA-directed DNA polymerase  and Integrase, catalytic domain containing protein family mem
MDDSSTLIDRDEVMKNFKENLSFVNNKYQIALPWNDRVAQLPTNYHQAKARLISLIRKLRTINLVDEYQAILDEQQQNSIIELVNSDHSCGPVHYLPHRAVIRTDKSTTKIRIVMDASAKPKSTPSAPSLNECLHTGPLLLKDLTGILLRFRRMEKVILADIEKAFLQLGVREQDRDATRFLWLANPKEANLEQLKREDFRVFRFCRVSFGLTVSPFLLNATIREHLALHDTDVAQRISDNLYVDNIMVEVKPSENSNQLVTEAKIIFESAGMRIREFFGSHIDGLKELLTHPNWPKTSKTQRC

SEQ ID NO: 143136 - protein, 834 aa, Heterodera glycines
  Coding regions on vcDNA: vcDNA=SeqID_69559; Strand=+; Position=1 -988,1124-2637
  Homolog annotation: Hit_ID=NP_507780.1; Match level="QueryCoverage =65%, HitCoverage=37%, E-value=1e-40, Identity=26%"; Hit description =predicted CDS, DNA polymerase type B, organellar and viral family member (5T899) [Caenorhabditis elegans]
MSLEDHNYCGEMGGNEETPTKRRKRNDDDREQKFQKNCIRTLSADKQYNQNFKVQSVKSTFVIENLPANPESMLRALFAHCMSTALDESQQNGITPDQLGATISSDLLNPSIWIPIRRISDNTADSIMNRFLEVAQSKSREGSLWGSPFTVTITTLDVAQLPQRQQVRGSGKRTANSVQHIVKESALLRINNNDDAYCLFYALETSRKYHIKEMSRQTFSKYINRQNGRRLEDVFGLMSSANIRTDLREYDAVVYVPIVVDYWNRKYATANQRFKVFIFGATGSYRPKFQYGPDNYNVEIPLYHHNGHFDGIRSGVGKAVFGRDYYCFSSCGKDFMSQDCFSHHLSSNVCRQFKKCKQCGVVWNVKQNRRKGRSGHVCGEKFCYTCKCYHKPERGCFIQQLKARRPTKYRLIAFDCETTQNTRIEGDRRLHSVNFISCYVVCTKCINENLWRNSLQAPCGICGRQRTVTFSHRAYERTQTDAQFITPCPMAAFAQWLLSEFDPRYPTMLFAHFGGRFDNIMLFRQFFLNGFCPQMIRRGNKLYEMKIARGEKNPEIIVRDSWNLMPVPLGALPGAFGLNVQDKEFFPHLANVEANYGHILQSLPPKADYLYGGMTPDRQRRFDQWYAEHRHQQFDLCEQLAAYCTNDTRILIEALVAFRTEFLTISDPLERHGCLDDDNDDEEEEEQDDDNAFEVIGGGIDITWEPMTIASASMRHFRLNHLKRDQLAIVPECGYDTTNTQSLVALKFMDWYAKKNGVSIQTAHSPGGEKKIGQYTVDGYIASTDTVIEVNGCHWHAHDHPRHRFQPQTVMANGKTAQRIREDDARRMAFITSQ

SEQ ID NO: 143137 - protein, 224 aa, Heterodera glycines
  Coding regions on vcDNA: vcDNA=SeqID_69560; Strand=+; Position=1-672
  Homolog annotation: Hit_ID=NP_415531.1; Match level="QueryCoverage =100%, HitCoverage=91%, E-value=1e-128, Identity=100%"; Hit description=hypothetical isochorismatase family protein [Escherichia coli K12] gb|AAC74096.1| hypothetical isochor
MPRPSTCADSGGGMMTTLTARPEAITFDPQQSALIVVDMQNAYATPGGYLDLAGFDVSTTRPVIANIQTAVTAARAAGMLIIWFQNGWDEQYVEAGGPGSPNFHKSNALKTMRKQPQLQGKLLAKGSWDYQLVDELVPQPGDIVLPKPRYSGFFNTPLDSILRSRGIRHLVFTGIATNVCVESTLRDGFFLEYFGVVLEDATHQAGPKFAQKAALFNIETFFGW

SEQ ID NO: 143138 - protein, 102 aa, Heterodera glycines
  Coding regions on vcDNA: vcDNA=SeqID_69561; Strand=-; Position=1 -174,391-525
  Homolog annotation: Hit_ID=CAE59845.1; Match level="QueryCoverage =87%, HitCoverage=11%, E-value=1e-32, Identity=70%"; Hit description =Hypothetical protein CBG03318 [Caenorhabditis briggsae]
MIKNIAPGIFDLRHLTALYLGNNLLQRIPPEIAKLSNLSLLDLSHNKLRSLPSEIGDMISLCHLYLNSNQLRVLPYELGKLFRLQTFGLREYSMALIGNLFV

SEQ ID NO: 143139 - protein, 84 aa, Heterodera glycines
  Coding regions on vcDNA: vcDNA=SeqID_69562; Strand=-; Position=1 -104,147-294
MEIFDEFIIIGEKAIGKFAITGKSSHWEMIEFVELEFTSVTTDFNQALEIADIGNASSNPSDLEPLAQIVRWHWNQNGTQQISE

SEQ ID NO: 143140 - protein, 105 aa, Heterodera glycines
  Coding regions on vcDNA: vcDNA=SeqID_69563; Strand=+; Position=1-330
PGLKCPAQAKKFFYFREKIEIFPKKIPVDRARKTMFWKWSPFFWENSLKNPKIQKPKNRFLGLARKILKIFEILKSEKIELIELYNKSAGHPALRSNPNELFAWY

SEQ ID NO: 143141 - protein, 276 aa, Heterodera glycines
  misc_feature (36)..(36): Xaa can be any naturally occurring amino acid
  misc_feature (48)..(48): Xaa can be any naturally occurring amino acid
  misc_feature (58)..(59): Xaa can be any naturally occurring amino acid
  misc_feature (135)..(135): Xaa can be any naturally occurring amino acid
  misc_feature (151)..(151): Xaa can be any naturally occurring amino acid
  misc_feature (216)..(216): Xaa can be any naturally occurring amino acid
  misc_feature (270)..(270): Xaa can be any naturally occurring amino acid
  Coding regions on vcDNA: vcDNA=SeqID_69564; Strand=-; Position=1-856
  Homolog annotation: Hit_ID=BAB33421.1; Match level="QueryCoverage =96%, HitCoverage=96%, E-value=2e-86, Identity=67%"; Hit description =putative senescence-associated protein [Pisum sativum]
SKNIAILPRRDSDLEAFSHNPSDGSFAPLVYRPSTXTKCLNLRFLSYXAGLLLATGLXXGKTNLSHDGLNPAHVPYWWVNNPTLGEFCFAMIGRADIEGSKSDVAMDAWPPQASYPCGNFSDTSCWKLYTLKDRXATLSRSVFVLKIRIKXAFAFLLYERFPSSLSSLGHLRYALTDVPPQSNSPPDTVIRGSPGHRVARLNTKMDRRTPVLPIKXGIDESSGISLAPCGSHLCYTSHDSSQSQTRVKLNRVFFPAFAKPPLLGSLDSRXGQWESR

SEQ ID NO: 143142 - protein, 143 aa, Heterodera glycines
  Coding regions on vcDNA: vcDNA=SeqID_69565; Strand=-; Position=1 -407,2203-2227
  Homolog annotation: Hit_ID=XP_307651.1; Match level="QueryCoverage =93%, HitCoverage=70%, E-value=4e-30, Identity=48%"; Hit description =ENSANGP00000025299 [Anopheles gambiae]
MDTDIETIVRGCSQCQQAAKQSPKQEPLQPWPATTSVFERIHIDLAGPCSDGNIYLVVIDTFSKWPEVFLLRQSSSQAIIDQLQWLFDRVGIPKTIVSDNGPQFLSQNFKNFCTRNSIKHIFSSPYHPQSNGAAERCICVMIY

SEQ ID NO: 143143 - protein, 20 aa, Heterodera glycines
  Coding regions on vcDNA: vcDNA=SeqID_69566; Strand=+; Position=1 -56,819-825
MIEALEKVFKKAGMMRNKLF

SEQ ID NO: 143144 - protein, 103 aa, Heterodera glycines
  Coding regions on vcDNA: vcDNA=SeqID_69567; Strand=+; Position=1 -36,163-438
MFNFLKLLFYETVTDGVNHATTNLSVEVLDVNDNGPQFVQPYIEIERSMDVPIGHILTKVEAIDGDMSKHNSQIRYTLESAAAFQNLSTADLDWLSCGQNNGN

SEQ ID NO: 143145 - protein, 18 aa, Heterodera glycines
  Coding regions on vcDNA: vcDNA=SeqID_69568; Strand=+; Position=1-56
YREAIPEGFGLPINLGAS

SEQ ID NO: 143146 - protein, 95 aa, Heterodera glycines
  Coding regions on vcDNA: vcDNA=SeqID_69569; Strand=+; Position=1-659
LFEYPKRTLEKIDFFVFGAVPPNRCAQIYGETESFRNSFPIVCTLILRWIFAPHNCLSTPNGHLKKSIFLFSGQSPRTDAPRFMGRPNPSGIASL

SEQ ID NO: 143147 - protein, 52 aa, Heterodera glycines
  Coding regions on vcDNA: vcDNA=SeqID_69570; Strand=-; Position=1-157
LHNFGDPRHYGHLQQSVAARCVLGVHICAAGQSAQKTANVTAFDAVNSVDRM

SEQ ID NO: 143148 - protein, 73 aa, Heterodera glycines
  Coding regions on vcDNA: vcDNA=SeqID_69571; Strand=+; Position=1 -96,203-326
  Homolog annotation: Hit_ID=O01409; Match level="QueryCoverage=87%, HitCoverage=9%, E-value=5e-12, Identity=50%"; Hit description=T-box containing protein 2 (AS-T2) dbj|BAA19689.1| As-T2 [Halocynthia roretzi]
MHKYQPVVSLFRLVDRQAMHLCSFEPPETQFIAVTAYQCEAITRLKVEHNPFAKGFREGSSRKRTLSPSPIFA

SEQ ID NO: 143149 - protein, 159 aa, Heterodera glycines
  Coding regions on vcDNA: vcDNA=SeqID_69572; Strand=-; Position=1 -174,341-566,684-763
MHKYVSPTVLFDWRRNFFQISATGFARESDHLQQFAGLGRHVYWYNWAGTRLAPMGRPSFTRAVGPVKYMVLASFDVNYTRREQMVNIRTEEKLTLSSDVHQRPDGGFVSSVKILRCPAVFTEANVMSWLRLPHRCLRTEEPIGLRTEKDNCGSTTAEP

SEQ ID NO: 143150 - protein, 21 aa, Heterodera glycines
  Coding regions on vcDNA: vcDNA=SeqID_69573; Strand=+; Position=1-79
KSAVVTQQWKKSYWLNSKKKK

SEQ ID NO: 143151 - protein, 33 aa, Heterodera glycines
  Coding regions on vcDNA: vcDNA=SeqID_69574; Strand=+; Position=1 -3,303-401
MVPWHYTVPIGHRPIPLRMCEQRNGVDDHHPQQ

SEQ ID NO: 143152 - protein, 89 aa, Heterodera glycines
  Coding regions on vcDNA: vcDNA=SeqID_69575; Strand=-; Position=1 -41,281-509
MGITIIKCNYWIINVLSCPALHEHELSWPMTAYGQTAQVACPPGTYGHAEWHCSAKTKRWNTEEGPNMAKCTSEWARDLRREHKDDETG

SEQ ID NO: 143153 - protein, 360 aa, Heterodera glycines
  Coding regions on vcDNA: vcDNA=SeqID_69576; Strand=+; Position=1 -69,121-241,405-465,512-596,663-736,812-1013,1067-1168,1225-1298,1342- 1378
  Homolog annotation: Hit_ID=CAE62853.1; Match level="QueryCoverage =95%, HitCoverage=60%, E-value=6e-87, Identity=51%"; Hit description =Hypothetical protein CBG07032 [Caenorhabditis briggsae]
IFQTMLGTGLLSFKLAFKYSGIWLGLFLLICVCCILGLFLLICVCCICTFTCRQLVNCSQFFCQRKGREMMDYANVMRSAIECGPPWISERGYFFKQLVNSTMFICQLGFCCVYFVFMFFKQLVNSTMFICQLGFCCVYFVFMADNVKQFFDETSQIHISQFFDETSQIHISQAGWIALLLIPTMALCLCTIRQLKVLAPLALVANLVYLGAVLIILEYMITHLDSIDELPAVGNLSDLPLFFGTVIFAFEGIAVVLPIENQMDQPHHFISPVLPIENQMDQPHHFISPNGVLNTSCLLVLCIYGTMGFYMGFYGYLAFGKNVKDTVTLNLPSTPFYQTIKNMLVSQPFYQTIKNMLVSQ

SEQ ID NO: 143154 - protein, 335 aa, Heterodera glycines
  Coding regions on vcDNA: vcDNA=SeqID_69577; Strand=-; Position=1 -51,108-304,346-487,537-935,982-1198
  Homolog annotation: Hit_ID=NP_495921.1; Match level="QueryCoverage =32%, HitCoverage=27%, E-value=1e-12, Identity=38%"; Hit description =TAR DNA binding protein like (45.4 kD) (2J289) [Caenorhabditis elegans] emb|CAA90120.1| Hypothetical prot
SHIIGDRECQVKVPFSKNALSSKIFVGRLQEGVTPIELKKRFMEEAQRIDPDSSVTDVYIPRPFRSFAFVTFSTPIVAKELIKIGQVDFKDTSVSISSAHSTRPQDSTVHSVHHHSSFIPPHPHNFVPEDDSYSTSELYSNYGTNTKWEFDEMASMAMPKHQLITSTPGIQQSRTAGPMFSGRLSFLSNRIDWSTLGSEITHFILHFYPLISGSVQQHLNQPFSAHNQQHPPIAAGSQMLNQLETLNLNNIGMPQEVVNAAIKAIVAAAASSAAHSHGDPSHSQRASSSHLSQQQFVRYQSLSPPQPAVPASSAPMSRSPMYSQQMTYRQQNGRG

SEQ ID NO: 143155 - protein, 120 aa, Heterodera glycines
  Coding regions on vcDNA: vcDNA=SeqID_69578; Strand=-; Position=1 -267,441-533
  Homolog annotation: Hit_ID=NP_726373.1; Match level="QueryCoverage =64%, HitCoverage=14%, E-value=7e-09, Identity=40%"; Hit description =CG10327-PD, isoform D [Drosophila melanogaster] ref|NP_599145.1| CG10327-PC, isoform C [Drosophila melano
MDRRSGAKNEAMRSGVTKRQQGATKQKRMMGKEAPVGTPSAVGTAQREREEEDTTGRIVDLLVMGLPFELSEEQLRAHFESFGKVVHCEIKTQKGHLSNRGFGFIQMADLEAQKRVLKHK

SEQ ID NO: 143156 - protein, 130 aa, Heterodera glycines
  Coding regions on vcDNA: vcDNA=SeqID_69579; Strand=+; Position=1 -166,374-433,804-968
  Homolog annotation: Hit_ID=XP_420227.1; Match level="QueryCoverage =97%, HitCoverage=12%, E-value=4e-30, Identity=53%"; Hit description =PREDICTED: similar to RIKEN cDNA 6330505F04 [Gallus gallus]
RSLPARSAHPVVLFRCDRAEPMFNPEFPLDKYELDSTSPLVQNMLSRREPNLCWQVFVEGSFKQPGIGLPFGYLKVSSSSTVNLLVMPYNYPDLLTLLAQAKEGPEMIASVPFQQRFDKYLNTVPPYYYT

SEQ ID NO: 143157 - protein, 55 aa, Heterodera glycines
  Coding regions on vcDNA: vcDNA=SeqID_69580; Strand=+; Position=1 -125,282-326
RKFTLISDPEKLVVIFVDGPAETSDDLPEDWIHLWNEAALKSPELGFGTVTGCWI

SEQ ID NO: 143158 - protein, 141 aa, Heterodera glycines
  Coding regions on vcDNA: vcDNA=SeqID_69581; Strand=+; Position=1 -177,234-371,428-535
MEKEPQVFNFFKQNWWKLKKVEPNANAAGVSDSFSKDAEEEEDKDKEEAVKEMPGQPKKNWWKLKKAEPNANAAGVSDSFSKDANEEEDKDKEEAAQEMPGQPKKNWWKLKKAEPNANAAGVSDSFSKDAEEEEDKDKEEA

SEQ ID NO: 143159 - protein, 154 aa, Heterodera glycines
  Coding regions on vcDNA: vcDNA=SeqID_69582; Strand=-; Position=1 -330,388-522
  Homolog annotation: Hit_ID=NP_700900.1; Match level="QueryCoverage =70%, HitCoverage=69%, E-value=9e-10, Identity=32%"; Hit description =hypothetical protein PF11_0035 [Plasmodium falciparum 3D7] gb|AAN35624.1| hypothetical protein [Plasmodiu
MSGRKCPKMALKKWAANVRGANVGPQKTDRNCRFWLVAANVVTRNQQQKKETAKGEEKEEKMGGKERKREEKKEQQLKKRKKKIAAEHHQKQQHQQKQEHWKEERRKRKRLNTSRNNNISRSKNIGRRRDGREREKNGGEKGAATEEEEKENCS

SEQ ID NO: 143160 - protein, 257 aa, Heterodera glycines
  Coding regions on vcDNA: vcDNA=SeqID_69583; Strand=-; Position=1 -287,336-533,711-873,942-1029
  Homolog annotation: Hit_ID=EAL31509.1; Match level="QueryCoverage =97%, HitCoverage=53%, E-value=6e-55, Identity=46%"; Hit description =GA17119-PA [Drosophila pseudoobscura]
ITIPCHQTVNANGEQFTAYSIHMAGRHLGSRRYSEFLQLNKLLKEEFPDFPFPKLPRKWPFRHSEQQLDSRRRMLEQYLEKVCAVKVIAESDTVQFLMEDSGGFLMEDSGGALSAPFVDVSLLIVCGNTLSLNIKRHSDTREVFGRVCEELKLGTEAAHFCALFEVIEDSFARKLHDRECPHNIYIQNYSSAASSCLAMRKFCFDVEKEKQLCEKDKLFRSIFYQAVEDYQAVEDVNNGIIKGGERLYQLKHCKGTT

SEQ ID NO: 143161 - protein, 18 aa, Heterodera glycines
  Coding regions on vcDNA: vcDNA=SeqID_69584; Strand=+; Position=1 -42,140-154
MELVLKITKLELKNKGLQ

SEQ ID NO: 143162 - protein, 145 aa, Heterodera glycines
  Coding regions on vcDNA: vcDNA=SeqID_69585; Strand=-; Position=1 -153,224-508
LNSIDSYGLLPEAIAIGDDLAHTEKRWPTQAIVLHTFERQVYFDWVNNFKKQFLRANAISSVSYQIHFTVHAPSIVTFELVNEWTKEKLTLAKAKELDNRWIMKRCKIGEAVTVQQQKNDENWDNNWCSFCFLVALIVLGSSENP

SEQ ID NO: 143163 - protein, 64 aa, Heterodera glycines; identical to SEQ ID NO: 129150
  Coding regions on vcDNA: vcDNA=SeqID_69586; Strand=-; Position=1-789

SEQ ID NO: 143164 - protein, 155 aa, Heterodera glycines
  Coding regions on vcDNA: vcDNA=SeqID_69587; Strand=+; Position=1 -40,867-1072,1154-1375
MAFLHFLTPCGHFVLTCLFVSLGLVFVPKLLFIYHWPELTKEEQQQSTQRQLLEVSAPNRSEQLRYQQLLKENAEIKRQIELRNLRIQECRRILEGHITLINPLNKAKNSTVRRRQKQQQNNNNNNANLGNNKNANNNNDNYKNGSERGKRSDKK

SEQ ID NO: 143165 - protein, 160 aa, Heterodera glycines
  Coding regions on vcDNA: vcDNA=SeqID_69588; Strand=+; Position=1-483
MDPTTTITLLEPTTTASGGEEFDEAPPNYTTEESEGGGIAGENVVEFASPPRIGKGNAGGEQRAIARHADRPPVEAEEERERGGRAATRGGEDTGGTKIGGKWNGKMGQKCLFVIPGVCSDYEEEEDEADGEGSGEKVELMSTESDDANWPNGDEEEILL

SEQ ID NO: 143166 - protein, 71 aa, Heterodera glycines
  Coding regions on vcDNA: vcDNA=SeqID_69589; Strand=-; Position=1 -149,518-584
MLSPMLLLLLPLLLLSLMPNILSEARPQWLFGSGSYADAMTSGTILDNLCVLVVFRKLLFDLCYGQLRKAK

SEQ ID NO: 143167 - protein, 229 aa, Heterodera glycines
  Coding regions on vcDNA: vcDNA=SeqID_69590; Strand=+; Position=1 -111,153-251,301-367,484-616,948-1137
  Homolog annotation: Hit_ID=NP_508234.1; Match level="QueryCoverage =97%, HitCoverage=42%, E-value=7e-61, Identity=54%"; Hit description =neuropeptide F receptor (XB868) [Caenorhabditis elegans] gb|AAA82357.1| Hypothetical protein C25G6.5 [Cae
GDQQQQNCEQLVTLFEGMNKFFREEAIIQGSEHSSVLFGILILSAYILVIAFGAVGFGILILSAYILVIAFGAVGNILTIFVVLRNKQMRSVRNFFILNRSVRNFFILNLAMSDFFVCTVTAPTTLYTVLYVFWPFGTTLCKIAGSLQGFNIFLSTFSITAIALDRYFLVIFPTRHQCQQRLSLLFFSMIWLASVLLAAPLFLAADLRPVFQQKSCQIELNLCSEQNER

SEQ ID NO: 143168 - protein, 19 aa, Heterodera glycines
  Coding regions on vcDNA: vcDNA=SeqID_69591; Strand=-; Position=1-58
FSNFVGLGRALRDRFLNLF

SEQ ID NO: 143169 - protein, 45 aa, Heterodera glycines
  Coding regions on vcDNA: vcDNA=SeqID_69592; Strand=-; Position=1-136
MHIAPLELHPLARLVQGRYHKMHCLCVASWDHVLVRVLTLLAQLG

SEQ ID NO: 143170 - protein, 23 aa, Heterodera glycines
  Coding regions on vcDNA: vcDNA=SeqID_69593; Strand=+; Position=1-68
CYDFCPVQATAIKSVPVCIPTEA

SEQ ID NO: 143171 - protein, 193 aa, Heterodera glycines
  Coding regions on vcDNA: vcDNA=SeqID_69594; Strand=-; Position=1 -178,244-647
MVQEVWNSDRRGRKGFAEPAKVRLLLGKLSDEEYNKYRDSIRPTQPDTVNWKESIDKLKAKSDHHDMRQKCLKMLEEAEKSGARISLGQIEEELKTMQLIKDSALALLSPPISTNAIQLCPQQWIEPKSKKGNYNSGKTTANQHTTGGKANQRNPTYPCGACGNSDHWRSDCKQSGRTLVERRTESRSNSFSL

SEQ ID NO: 143172 - protein, 70 aa, Heterodera glycines
  Coding regions on vcDNA: vcDNA=SeqID_69595; Strand=-; Position=1-211
MLPNSSSILLLHNLRKQSVNALPLGRQAVHNDVQFPNFDAYRNELTKDPAQPSHVTEDRRKGVSSFIFYG

SEQ ID NO: 143173 - protein, 144 aa, Heterodera glycines
  Coding regions on vcDNA: vcDNA=SeqID_69596; Strand=-; Position=1 -98,150-486
MPKSSLSFSHCRITMPALALLIPLSLIAVSNARVFTSMADLLDEQHHQQLHLPLWRSASGLAPSFSPFRSPPAAALSAEPTDDEAEETEEDSPISVPATASGEAKQKRRLVVRVPFAQNPDNLHLSRKWSKENPIQLAKWLTGY

SEQ ID NO: 143174 - protein, 18 aa, Heterodera glycines
  Coding regions on vcDNA: vcDNA=SeqID_69597; Strand=+; Position=1-56
YREAIPEGFGLPINLGAS

SEQ ID NO: 143175 - protein, 148 aa, Heterodera glycines
  Coding regions on vcDNA: vcDNA=SeqID_69598; Strand=+; Position=1 -134,176-223,413-439,1461-1696
MMRAKKVGARISIMIINNHENDQESKGIAKVSDLLIESTRIIARGDKLPNGVKLPNLDSGNEDGSATTEERSVALPPAHFQRGARRPRLQPCQVHTHGHAVRPTVGPRTDPLAHPPGTKRRNSELHAVRLARDNFSALHADQSGARRS

SEQ ID NO: 143176 - protein, 58 aa, Heterodera glycines
  Coding regions on vcDNA: vcDNA=SeqID_69599; Strand=-; Position=1-437
SKPRKNGLSKNRNYAQKASQTILTLPIPSTIAFIHPIMSAKIIRVPKIACDLSLEKMV

SEQ ID NO: 143177 - protein, 79 aa, Heterodera glycines
  Coding regions on vcDNA: vcDNA=SeqID_69600; Strand=-; Position=1 -132,202-254,943-1010
  Homolog annotation: Hit_ID=NP_503119.1; Match level="QueryCoverage =89%, HitCoverage=13%, E-value=1e-23, Identity=67%"; Hit description =glucocerebrosidase (4S421) [Caenorhabditis elegans] emb|CAB02924.1| Hypothetical protein F11E6.1a [Caenor
MKFLSTKVLLGDWSRGRAYARDILNDLRNWVVGWTDWNMCLDLEGGPNLARNFVDSPIIVNARAGEFYKQPMFYAMGHF

SEQ ID NO: 143178 - protein, 94 aa, Heterodera glycines
  Coding regions on vcDNA: vcDNA=SeqID_69601; Strand=+; Position=1 -123,182-343
MEKRKYPNNLMNYCWGRGPKNKTKINNKKEVVSSKVEKKGKQSDHSEERETLGEWKEKDNDGCVATKLANYDAPKSKGYDLVKNVNLLANDFGA

SEQ ID NO: 143179 - protein, 30 aa, Heterodera glycines
  Coding regions on vcDNA: vcDNA=SeqID_69602; Strand=+; Position=1-94
KTTDDQQQQQMDTALTMMRGNCGSQTIGRM

SEQ ID NO: 143180 - protein, 80 aa, Heterodera glycines
  Coding regions on vcDNA: vcDNA=SeqID_69603; Strand=-; Position=1-242
KGSVRFVSAKRRSQPPVDGRASEGPWNFARQFRREIGAAVEMIGQIEGRKSDEAKDGPTKDPFINCVQFLSKVLINFIII

SEQ ID NO: 143181 - protein, 86 aa, Heterodera glycines
  Coding regions on vcDNA: vcDNA=SeqID_69604; Strand=-; Position=1 -8,165-417
MPRLILVLKEEERIAQDKVRTYELDPTSGLNLQPRRRTYYNNDVAIRTLVTRFDALANPEPDQIVHHLRALQYRLASNGFDNLIHE

SEQ ID NO: 143182 - protein, 95 aa, Heterodera glycines
  Coding regions on vcDNA: vcDNA=SeqID_69605; Strand=+; Position=1 -67,484-704
MIPTQDEFRVEDLFKKIASYMDQTVRKCPSANVRPQMSVRKCPSAKVRPQMSVRKCPSANVRPQMSVRKSPSANVRPQMSVRKCLVAKKRDAVFR

SEQ ID NO: 143183 - protein, 86 aa, Heterodera glycines; identical to SEQ ID NO: 143181
  Coding regions on vcDNA: vcDNA=SeqID_69606; Strand=-; Position=1 -8,165-417

SEQ ID NO: 143184 - protein, 87 aa, Heterodera glycines
  Coding regions on vcDNA: vcDNA=SeqID_69607; Strand=-; Position=1-310
PGLKCPAQAKNFFYFREKIEIFPKKIPVDRARKTVAWKWSSFFWEKSLKNPKIQKPENRFLGLARKILKIFEIFKNRKNRAPSSSSQ

SEQ ID NO: 143185 - protein, 78 aa, Heterodera glycines
  Coding regions on vcDNA: vcDNA=SeqID_69608; Strand=+; Position=1 -131,556-661
  Homolog annotation: Hit_ID=NP_496468.1; Match level="QueryCoverage =97%, HitCoverage=38%, E-value=1e-18, Identity=42%"; Hit description =DNaJ domain (prokaryotic heat shock protein) (36.3 kD) (dnj-13C) [Caenorhabditis elegans] emb|CAA91334.1|
MGKDYYKILGLSKGASEDDIKKAYRKMALKYHPDKNKEAGAENRGDPMQMFAQAFGGPNGMFSEFTFGGGGGGPEVEK

SEQ ID NO: 143186 - protein, 38 aa, Heterodera glycines
  Coding regions on vcDNA: vcDNA=SeqID_69609; Strand=-; Position=1 -18,428-526
MAMTFVNTLFARFIFPLLNFDAFAIGFFVIQLVEVRRD

SEQ ID NO: 143187 - protein, 84 aa, Heterodera glycines
  Coding regions on vcDNA: vcDNA=SeqID_69610; Strand=-; Position=1 -78,128-304
  Homolog annotation: Hit_ID=XP_414409.1; Match level="QueryCoverage =84%, HitCoverage=20%, E-value=5e-12, Identity=50%"; Hit description =PREDICTED: similar to Bis(5-adenosyl)-triphosphatase (Diadenosine 5,5-P1,P3-triphosphate hydrolase) (Dinu
MLTNIYGTDSFTQAVQDGPHAGQTVEHVHVHVVPRKASDFGGDMDRFYTELQGHENERTARSATEMATEAKTYRQWLAENSGKE

SEQ ID NO: 143188 - protein, 49 aa, Heterodera glycines
  Coding regions on vcDNA: vcDNA=SeqID_69611; Strand=+; Position=1 -10,76-212
MREFQPPVLWPKLCWAPLVINSSPAHSLFHWVAPVVMCPFLCSSDAKMA

SEQ ID NO: 143189 - protein, 69 aa, Heterodera glycines
  Coding regions on vcDNA: vcDNA=SeqID_69612; Strand=+; Position=1 -178,217-248
MCQFVCPPERRPVQPFDGQIVWTLLAQVVRHFFLNAQNVPGLQCRLNELAKNGDRNGRHWRNRGKVANK

SEQ ID NO: 143190 - protein, 51 aa, Heterodera glycines
  Coding regions on vcDNA: vcDNA=SeqID_69613; Strand=-; Position=1-155
MSPVAISVLGEFVQPALKSWDVLSVQEEMAYDLSQQSPYDLTIEGLYRAAF

SEQ ID NO: 143191 - protein, 28 aa, Heterodera glycines
  Coding regions on vcDNA: vcDNA=SeqID_69614; Strand=+; Position=1-83
NCWPGHRTDTRRFHCPSEDSDCGRCEKG

SEQ ID NO: 143192 - protein, 93 aa, Heterodera glycines
  Coding regions on vcDNA: vcDNA=SeqID_69615; Strand=-; Position=1 -114,481-646
  Homolog annotation: Hit_ID=NP_495785.1; Match level="QueryCoverage =82%, HitCoverage=14%, E-value=2e-18, Identity=55%"; Hit description =phenylalanyl (F) tRNA Synthetase (66.1 kD) (frs-2) [Caenorhabditis elegans] emb|CAA90360.1| Hypothetical
MPTISVKKRLLDKHLRVSLSQQQVDDLCFQYGLEVDDVVSAVRPFVVGAILRDVHFDADAYASFIDLQDKLHQNIGRKRTLASMGTHDLDTIK

SEQ ID NO: 143193 - protein, 332 aa, Heterodera glycines
  Coding regions on vcDNA: vcDNA=SeqID_69616; Strand=-; Position=1 -184,588-699,753-804,894-1176,1281-1370,1464-1591,1693-1843
  Homolog annotation: Hit_ID=NP_871943.1; Match level="QueryCoverage =96%, HitCoverage=49%, E-value=1e-71, Identity=48%"; Hit description =3'5'-cyclic nucleotide phosphodiesterase family member (2P237) [Caenorhabditis elegans] emb|CAD59146.1| H
PSKDGRQHGAGGDVPTVYKAVNGTTFDRAELERDPALGQIQEWSFPIFRLAEKHKRTVLSRLTYAIFKEADLFRTFKISYTKFFNFFHALESGYWDIPYHNRIHAADVLHGTYYLTYHSSELEDEDELEEDEEANNDTATDAAYSTEQPLTNHNGQPTTSTTNGGGRHVLRQQQSNTATGATHRNCEAHPQQQTFDSAAVALAQSMSPLELMALYTAAAMHDYDHPGRTNAFLVASEDRKAILYNDRSVLENHHAAESWRLLNSHAQFQFIENLDSAETKRFRYLVLEYILATDLKQHFDIIMQFNERVPDMDLNSESDRVLISLMLINLRT

SEQ ID NO: 143194 - protein, 144 aa, Heterodera glycines
  Coding regions on vcDNA: vcDNA=SeqID_69617; Strand=-; Position=1 -64,662-710,1616-1937
MLFPAFAEVDEYDRKGEKADENCKASCLQYYFFHGHFSCWKPSHAHTIQNHGGHHGGGIATNFSNSLPQRINLYEYEDELHGEQQQHVEQIAPNDMAWKEQQHNEVGDQHKQQQRRRSQRLVNNNEDGGEPSGQAVQQQQQQQR

SEQ ID NO: 143195 - protein, 283 aa, Heterodera glycines
  Coding regions on vcDNA: vcDNA=SeqID_69618; Strand=+; Position=1 -113,901-1076,1316-1469,1847-1952,2101-2334,2534-2602
MKAMGMTTRGKNGSWQMNLGIYLSEHLLSPYRKKRTVSITVPNSLVMVLELGEESLKHRLNRLKIEWKKHGNLDVINSDIKSIFIQMVIALRDLHRFAIHLALKSENWLYVNRNGEKMLALIDFQTSALIQTNGTIDNSSKIKRKELRSFICKTFVGRTHLPRTRRFASPEHNKFCESHGKNKLDVQTDIWSLGISLLEILAYTPQIDAVFDFEFSVEEKRKFKILRNSFVEENENKNKQFAEKAKMAVSEYFPNFSVLIKQMLTTDPKNRPTVDELLNEFLD

SEQ ID NO: 143196 - protein, 57 aa, Heterodera glycines
  Coding regions on vcDNA: vcDNA=SeqID_69619; Strand=-; Position=1 -133,543-583
MGHNSEVSRTMFEIGTSGSKNQIFGSKTVLFYNLFNQKIKYYASSHSLPILTLLEKL

SEQ ID NO: 143197 - protein, 21 aa, Heterodera glycines
  Coding regions on vcDNA: vcDNA=SeqID_69620; Strand=-; Position=1 -54,580-591
MRTRPIWQVKQRLLTSQKKGF

SEQ ID NO: 143198 - protein, 53 aa, Heterodera glycines
  Coding regions on vcDNA: vcDNA=SeqID_69621; Strand=+; Position=1-163
FLRQCGRCAIGHRGETAERSGKSFRFERQRSENARTDHTSGDQSGEAEEVIGN

SEQ ID NO: 143199 - protein, 77 aa, Heterodera glycines
  Coding regions on vcDNA: vcDNA=SeqID_69622; Strand=-; Position=1 -135,188-284
MGRTKGAEGAVSGEEQQVGQWQQQQQHHRRARLWPNGRRDLGILSSENNNTAARPSKSKSFPFLFSYRSNLGEQIKK

SEQ ID NO: 143200 - protein, 258 aa, Heterodera glycines
  misc_feature (250)..(250): Xaa can be any naturally occurring amino acid
  Coding regions on vcDNA: vcDNA=SeqID_69623; Strand=-; Position=1 -218,263-341,391-417,459-565,627-669,733-858
  Homolog annotation: Hit_ID=CAE71873.1; Match level="QueryCoverage =90%, HitCoverage=36%, E-value=8e-44, Identity=43%"; Hit description =Hypothetical protein CBG18928 [Caenorhabditis briggsae]
SFNASSFLSSSSSKLSPRVASECFYRGAFYHFFEGGPRSPLFPGRSDGKTFKDGDRCVEAGRYCKRSPELDFWYPCKERAESANASAFEGCYFGRGFWYPCKERAESANASAFEGCYFGRGPLQLSWNYNYGQLSWNYNYGQFRHFLRTEGVEVDLLQQPFRHFLRTEGVEVDLLQQPNQLLTRLDPPLAMLSALWFFYNTPQPPKPSMHEIMTGQWIMTGQWVPSKRNRRIATKDQCLGKWQLKGENKXAFRTDLDQ

SEQ ID NO: 143201 - protein, 64 aa, Heterodera glycines
  Coding regions on vcDNA: vcDNA=SeqID_69624; Strand=+; Position=1 -39,106-258
MSSSINDLANETMSLIFQYLPPNERVRIERVCRRWCFVSRELSWYNQKTLLLDGQELAQNFDLT

SEQ ID NO: 143202 - protein, 91 aa, Heterodera glycines
  Coding regions on vcDNA: vcDNA=SeqID_69625; Strand=+; Position=1 -147,1196-1324
MGDKPMVKGGNEQQTEHNAKRKEGTDQRGDGAKPKVEQRLRTEKRLLKGVVDERIPENSLTNGRPFALHFPRQKRTNYERPKSRAPKEKPH

SEQ ID NO: 143203 - protein, 96 aa, Heterodera glycines
  Coding regions on vcDNA: vcDNA=SeqID_69626; Strand=+; Position=1-291
MEEKGGEVKKEEEKNGGRGRKREKRGTEGKRRERKRREGREEVKIKEEGEKKKRKGIKSAENGWRGEGKKREVTGREGMGGEERKGKKEENQEERK

SEQ ID NO: 143204 - protein, 43 aa, Heterodera glycines
  Coding regions on vcDNA: vcDNA=SeqID_69627; Strand=+; Position=1-505
CFAVPRTGRQWMAFNLQEIRLAISGCKKLLCKELFFEVSQTPY

SEQ ID NO: 143205 - protein, 123 aa, Heterodera glycines
  Coding regions on vcDNA: vcDNA=SeqID_69628; Strand=-; Position=1 -257,700-811
MGNDDAVVQEFLTSMKPEESEKGEGLERKLSQQSAALSSFSETKEAKSKGTTQPEKEAEEKQQNGETKGKGLIEKEALFTGKVKYRVFASYSLHEKMLRSILRSPIAFFDITPLGRILNRFSK

SEQ ID NO: 143206 - protein, 94 aa, Heterodera glycines
  Coding regions on vcDNA: vcDNA=SeqID_69629; Strand=-; Position=1-285
MSATVAKLTIRRLGQLIRINYRFARLIPRVFDLVMFVRGQWLRFALFVQRFDPEFVVALVLQSFELQRRFARPDLANRHKFATAINILGKNIFK

SEQ ID NO: 143207 - protein, 71 aa, Heterodera glycines
  Coding regions on vcDNA: vcDNA=SeqID_69630; Strand=+; Position=1-216
  Homolog annotation: Hit_ID=CAA33463.1; Match level="QueryCoverage =92%, HitCoverage=30%, E-value=3e-20, Identity=53%"; Hit description =twitchin [Caenorhabditis elegans]
DVDGGGKFVPVGQVGPGETSLQLKGLKDKGNYKFRVKALNKEGESEPLATDKHYQIKNPWDEPGKPVINSN

SEQ ID NO: 143208 - protein, 67 aa, Heterodera glycines
  Coding regions on vcDNA: vcDNA=SeqID_69631; Strand=+; Position=1 -33,76-246
MANLSNSGNDTFYLAFKDVHPSWSLIGCALTYGTIALIGTIFNFSVIFVTIKTKYEMILFVRNYNFL

SEQ ID NO: 143209 - protein, 71 aa, Heterodera glycines
  Coding regions on vcDNA: vcDNA=SeqID_69632; Strand=-; Position=1 -73,2502-2644
MRWHTDNDRNVSSAITQIIRAIQTNLVKYKIGPIDAAPMFKGIEIITWQNQCVIGEEIMGSKSKNTIVVNQ

SEQ ID NO: 143210 - protein, 63 aa, Heterodera glycines
  Coding regions on vcDNA: vcDNA=SeqID_69633; Strand=+; Position=1 -148,466-509
MEDKAYNQNTDFLRPPARGDRTPKVVKKPVSATMLSNDVLICGWITGDQTPNRCPVVLCEDEE

SEQ ID NO: 143211 - protein, 110 aa, Heterodera glycines
  Coding regions on vcDNA: vcDNA=SeqID_69634; Strand=-; Position=1 -154,204-382
MADHDHRSVPDQDHHLSRPVVSSSLISLFILLSLSLLLGRLLSYFFIPFITGPILIGILFTNLVSFRSLFHYFPHYQLSTLIYEIAFLLIIIRSAFGIDQSTVRQFYVGF

SEQ ID NO: 143212 - protein, 39 aa, Heterodera glycines
  Coding regions on vcDNA: vcDNA=SeqID_69635; Strand=-; Position=1-121
LIFLNIGIFKEFNLLNKSRSLGIRPDNINGIQIPVLSGS

SEQ ID NO: 143213 - protein, 92 aa, Heterodera glycines; identical to SEQ ID NO: 125147
  Coding regions on vcDNA: vcDNA=SeqID_69636; Strand=-; Position=1-304

SEQ ID NO: 143214 - protein, 92 aa, Heterodera glycines
  Coding regions on vcDNA: vcDNA=SeqID_69637; Strand=-; Position=1-278
MIGRAVRNRPFIFEGIFKFILYPRKMAISFFEKFYTSQKRLRMRRRAVHNRHFISQRIFIFRGYPRKMAISFFDKFYTHTNTIEHDREGGAQ

SEQ ID NO: 143215 - protein, 48 aa, Heterodera glycines
  Coding regions on vcDNA: vcDNA=SeqID_69638; Strand=+; Position=1 -38,198-306
MPAEYRIWQDEKRRYRSLCQLLNDFTTRAAFESNSDLKFKWACFSLLK

SEQ ID NO: 143216 - protein, 335 aa, Heterodera glycines
  Coding regions on vcDNA: vcDNA=SeqID_69639; Strand=+; Position=1 -106,333-601,1026-1136,1222-1591,2120-2269
  Homolog annotation: Hit_ID=CAE72884.1; Match level="QueryCoverage =57%, HitCoverage=20%, E-value=4e-23, Identity=37%"; Hit description =Hypothetical protein CBG20197 [Caenorhabditis briggsae]
MLDPEYVKSQIKKLGGASPVFEQQTKKRKRSASSASSIATISHSVSSANHRNSTGAAKKQSTMDKWLVPKSKLVAAAAAFTKRSIGGVGGQGIGGGCGANAKLTKSAIDASGIGTEIGAVDEAQMKKRVRKSPRISPATIDQKVETKRRNVKPIGKVTWLDQPSTSHEDSSHSLMPSSSAKFPSKSDVQWVPNSSGQNMPNSDVQLVPDSDVQFVPKSDGQQVVPPTTGGEQPMGTATSAVALLLNEAPEPSTSKARRDRLLREVFGHRKFRSSMQMQAINAVIGKTVDVFVSFPTGAGKSLCYQLPACFHSGLTIVFSPLLALIQDQLSALRAR

SEQ ID NO: 143217 - protein, 58 aa, Heterodera glycines; identical to SEQ ID NO: 128482
  Coding regions on vcDNA: vcDNA=SeqID_69640; Strand=+; Position=1-321

SEQ ID NO: 143218 - protein, 168 aa, Heterodera glycines
  Coding regions on vcDNA: vcDNA=SeqID_69641; Strand=+; Position=1 -107,585-710,764-1035
  Homolog annotation: Hit_ID=NP_490808.1; Match level="QueryCoverage =72%, HitCoverage=25%, E-value=3e-17, Identity=40%"; Hit description =mitochondrial ribosomal protein L38 (48.1 kD) (1B494) [Caenorhabditis elegans] gb|AAK29884.1| Hypothetica
MQMVRPAVERMDEQVKNTRKSQLFLANHIDQTSESGTSIYAKLQVKYSRRAKFTPRVARPWRQRVIAWAGPDAFSRDRFYELDSWYKARIQRPELLPKLHIIDPDLIVDNYESKIQRKTRGREGYIHLYFEGRKERTLDIGFRKNEAAPAKVTEEAMQKLEELSAMNQ

SEQ ID NO: 143219 - protein, 155 aa, Heterodera glycines
  Coding regions on vcDNA: vcDNA=SeqID_69642; Strand=-; Position=1 -83,165-287,339-475,528-651
MIFALNCGLMAMFCAAFDRLFAVVSPFKHSSIFTKYKLPYLLSHLLICVIYGAFTLNYVLAFAFENAGNPTTGVVAETFLGPVGHKFFAGTLIISFCSTYCYVAIFVIIRCKKGVTQQTNTRVLRSLVIILSINIGGYLTNLAIYQLLYAFGSIL

SEQ ID NO: 143220 - protein, 60 aa, Heterodera glycines
  Coding regions on vcDNA: vcDNA=SeqID_69643; Strand=-; Position=1 -33,128-277
MASINTSSNDPLYLAYRFAGPSADLIVPAVALYLVVLVGIVLNGTVLVVTVKSRQMPWHF

SEQ ID NO: 143221 - protein, 33 aa, Heterodera glycines
  Coding regions on vcDNA: vcDNA=SeqID_69644; Strand=-; Position=1-101
LVDPTKTKPCFDKFSAYVKDWLSCVDAKLVKES

SEQ ID NO: 143222 - protein, 123 aa, Heterodera glycines
  Coding regions on vcDNA: vcDNA=SeqID_69645; Strand=-; Position=1 -67,103-407
MKRTGGRPVQILVHLENPDPKPVNLILASSFLWDPGNPSVDNPLTDNPSVKDNPSLRDNPSTDNPSLRDNPSLDNPSTDNPSVKEKPSLRDNPSVDNPSTDNPSVKDRQSIIKGQSVSRQFIK

SEQ ID NO: 143223 - protein, 39 aa, Heterodera glycines
  Coding regions on vcDNA: vcDNA=SeqID_69646; Strand=+; Position=1-118
MTNGKKGAEVIVRPLANRATNAMGTENANGTMALGDGAT

SEQ ID NO: 143224 - protein, 56 aa, Heterodera glycines
  Coding regions on vcDNA: vcDNA=SeqID_69647; Strand=+; Position=1 -102,161-235
QKALKNVMCPKKRTQNKCGDTKGIVRKSNERDRRRLSSEIAALQRPLSASAALSPT

SEQ ID NO: 143225 - protein, 79 aa, Heterodera glycines
  Coding regions on vcDNA: vcDNA=SeqID_69648; Strand=+; Position=1 -90,333-479
MDSAAYSYLLEQHLGGVCPEDIQDINTYSQHALMRPVQVDEEEEEEEEELVEDHDVERRQHHYQQQQQRKYWVGQQQQK

SEQ ID NO: 143226 - protein, 45 aa, Heterodera glycines
  Coding regions on vcDNA: vcDNA=SeqID_69649; Strand=+; Position=1 -38,339-438
MFASVLLSEKRIRMDHDAGYPEPCKCPAQQCIMAPASSKLLLFFG

SEQ ID NO: 143227 - protein, 146 aa, Heterodera glycines
  Coding regions on vcDNA: vcDNA=SeqID_69650; Strand=-; Position=1-438
KCVSKNRNYAQKASQTILALPIPSTIAFIHPIMSAKIIRVPKIACDLSLAKNGVSKNRNYAQKASQTILTLPIPSTIAFIHPIMNAKIIRVPKIACDLSLAKNGVSKNRNYAQKASQTILTLPIPSTIAFIHPIMSAKIIRVPKIA

SEQ ID NO: 143228 - protein, 240 aa, Heterodera glycines
  Coding regions on vcDNA: vcDNA=SeqID_69651; Strand=-; Position=1 -34,77-228,570-775,840-1168
MATACKLEMSLDEIIKANKSKTNQASINGRKTQMTGKRLIRGNIAKGKPFIRKQINGQNQTKRFIANSARRVRTIMLNKVSPRSRVITRQRQRIVAVQPQQQPVFVQRVVRGRGPIRYASDAALVPQTMKMVPKRRFRINPMQQQQPVLLVQNQSPKRRFPSFSSMSVRQHVNALRRATTVQQLQTQFVNQQLPIRQQFRGRQAITTPVMPNRSRGKQQFILDQPVQAGPQFMVRVCRDV

SEQ ID NO: 143229 - protein, 63 aa, Heterodera glycines
  Coding regions on vcDNA: vcDNA=SeqID_69652; Strand=+; Position=1 -65,247-373
MTTIRACALEPLFDAYCVSARQILSNIKVKRKLWVNIQTDELKTNECETKTPNKGLSNDPNAY

SEQ ID NO: 143230 - protein, 97 aa, Heterodera glycines
  Coding regions on vcDNA: vcDNA=SeqID_69653; Strand=+; Position=1 -105,194-382
MDVECHAPTPSTSASNLNEPEILANLAAFESNFVSVISEQLGTDILPSSSSAVALHVSSLIRNVLRLARKFQRSARRKWLSSEDVEAALAYYGHTVI

SEQ ID NO: 143231 - protein, 168 aa, Heterodera glycines
  Coding regions on vcDNA: vcDNA=SeqID_69654; Strand=+; Position=1-507
  Homolog annotation: Hit_ID=CAD22154.1; Match level="QueryCoverage =65%, HitCoverage=51%, E-value=3e-27, Identity=52%"; Hit description =pherophorin-dz1 protein [Volvox carteri f. nagariensis]
MPRRFSRAAPGPPPDMPPPPMSAAVAPVLRPPSAASMWGAIPDPPSAPLPPPRSTLLSEFAVDARVGDPPVPPPPPPPQPEPPPPPEPPQPEPPQPPPPPPPPPPTPPPPPHPGIETACANSDSHPKQSFIFFKKKYGYGYQKFGGPPTYALPPPQTAATHFLNIFSE

SEQ ID NO: 143232 - protein, 92 aa, Heterodera glycines; identical to SEQ ID NO: 125147
  Coding regions on vcDNA: vcDNA=SeqID_69655; Strand=+; Position=1-304

SEQ ID NO: 143233 - protein, 92 aa, Heterodera glycines
  Coding regions on vcDNA: vcDNA=SeqID_69656; Strand=+; Position=1-304
MIGRAVRNSPFILEGIFKFILYPRKMAISFFEKFYTSQKRLRMRRRAVHNRHFISQRIFIFRGYPRKMAISFFDKFYTHTNALEHDREGGAQ

SEQ ID NO: 143234 - protein, 86 aa, Heterodera glycines
  Coding regions on vcDNA: vcDNA=SeqID_69657; Strand=+; Position=1 -205,420-473
AQPTAQLQPPSVVAPRSRNCILAHVLMLRAVLRLHHCFFFICVIVPLVLFRLRLVVVVDQLLHQSRVRLGEEQRKERKCQRADGQT

SEQ ID NO: 143235 - protein, 105 aa, Heterodera glycines
  Coding regions on vcDNA: vcDNA=SeqID_69658; Strand=+; Position=1 -51,151-417
MAFHSPSGQCAEGVQMLAFASASSPVNFIVSICIPLPFADSVLLFDLTNGFTHEQLTLTWMNDIGRFLLIRRPIVRDESKWAKWEKDAIGWQFYDQWNRIDIWVS

SEQ ID NO: 143236 - protein, 186 aa, Heterodera glycines
  Coding regions on vcDNA: vcDNA=SeqID_69659; Strand=+; Position=1 -165,260-655
SSAGGYESDEHSLGSCSAEVAAINAADQQRRRRHNQQQQQQAKKKAPAAPALQQKAVATVAATASAVSSKAAPQHQQQQQLYAKQANVNGTAADRPMLPQIVAAPSCATSRPQPFRPQPQLGVLPPALIAAAASTSGYGDQQQMLQKVPSIEQLRLMRSSQERAGSQVKQQISGGVINLGQIYVID

SEQ ID NO: 143237 - protein, 25 aa, Heterodera glycines
  Coding regions on vcDNA: vcDNA=SeqID_69660; Strand=-; Position=1-77
SKSSLTTAQKNMFFVRFRPRGSQEK

SEQ ID NO: 143238 - protein, 203 aa, Heterodera glycines
  Coding regions on vcDNA: vcDNA=SeqID_69661; Strand=+; Position=1 -259,753-1102
MASSVHSQDGFRPAASCLSTLSLQRIGLMGGSSGSGAFHSYTPTTAQQKQSSVPFQPQPQQHQLKGSIQSLPDSALCTAAAAAGLKGYGAAVYSRQQPSSFGTGTTVMAQQQQQKQPVNGITTNHRQFATLARMDSSNSRPKQGAGGGSSTATKAAATSNCLRPTAQRLLPTAVTTTATTAPADHASAIDALVAELELNTADT

SEQ ID NO: 143239 - protein, 203 aa, Heterodera glycines
  Coding regions on vcDNA: vcDNA=SeqID_69662; Strand=+; Position=1 -98,308-821
MQTEVATRTKAAKIGGTTVVTRQQLPSHNFTNRPAQQENGSSNRSKPLEKLNELISMDDESSTTRRHRTAQQQQQQSADSSAPAPSAGGNRPFETINQEKLNPSKVDAMARMFNGKQQQQSATTAATSTKPFTSGGSAGNNATSDHQGWATRRAATIGGRAAAPAVPSWSVGSTTARAWRQCAAIAYKWTPRATGDGHDGTAA

SEQ ID NO: 143240 - protein, 61 aa, Heterodera glycines
  Coding regions on vcDNA: vcDNA=SeqID_69663; Strand=+; Position=1 -77,264-372
MPIDRFPKSEKFLDLRTGANRKSSDRQATSPPQQQPQQNGGIGNRLKQTIFGSAIRRRVPT

SEQ ID NO: 143241 - protein, 163 aa, Heterodera glycines
  Coding regions on vcDNA: vcDNA=SeqID_69664; Strand=+; Position=1 -55,99-533
MFLNLLLLLSLSCICQAEVLNSMKMMELARLAVPFANNANPNKHLFMEWIDKYAFRLLCQKNFLEINAKNYFVSELSGWYELGKIQSNFCEAFAKGEISKVTEENWEKMTIKFANYFDETQKNEENIRKNIQKINDKFVKFFGKETDNILDNVFDALKVIADI

SEQ ID NO: 143242 - protein, 175 aa, Heterodera glycines
  Coding regions on vcDNA: vcDNA=SeqID_69665; Strand=-; Position=1 -68,485-687,1004-1260
MSRHREQQMAGEDAAAFAAIHSKNDAQQQHIGKWLFYALLMLLLLFSGYTLYGDRRLRLAGNKTQQQQSVEEIVPQIHGKPDREQLLKLKPSDELHQTHLAQPGTPKKDIVMDQPELHLTQSLHPSPPPPRGEVPIVDEISAQPQFIYHTTTPYSFYEHFDRAGQSVWELIRITF

SEQ ID NO: 143243 - protein, 19 aa, Heterodera glycines
  Coding regions on vcDNA: vcDNA=SeqID_69666; Strand=-; Position=1-59
TFAFSSLALPNTHTIFEML

SEQ ID NO: 143244 - protein, 19 aa, Heterodera glycines
  Coding regions on vcDNA: vcDNA=SeqID_69667; Strand=-; Position=1-59
TFAFSSLALPNTHTIFEML

SEQ ID NO: 143245 - protein, 19 aa, Heterodera glycines
  Coding regions on vcDNA: vcDNA=SeqID_69668; Strand=-; Position=1-59
TFAFSSLALPNTHTIFEML

SEQ ID NO: 143246 - protein, 19 aa, Heterodera glycines
  Coding regions on vcDNA: vcDNA=SeqID_69669; Strand=-; Position=1-59
TFSFSSLALPNTHTIFEML

SEQ ID NO: 143247 - protein, 19 aa, Heterodera glycines
  Coding regions on vcDNA: vcDNA=SeqID_69670; Strand=-; Position=1-59
TFSFSSLALPNTHTIFEML

SEQ ID NO: 143248 - protein, 19 aa, Heterodera glycines
  Coding regions on vcDNA: vcDNA=SeqID_69671; Strand=-; Position=1-59
TFAFSSLALPNTHTIFEML

SEQ ID NO: 143249 - protein, 19 aa, Heterodera glycines
  Coding regions on vcDNA: vcDNA=SeqID_69672; Strand=-; Position=1-59
TFAFSSLALPNTHTIFEML

SEQ ID NO: 143250 - protein, 19 aa, Heterodera glycines
  Coding regions on vcDNA: vcDNA=SeqID_69673; Strand=-; Position=1-59
TFPFSSLALPNTHTIFEML

SEQ ID NO: 143251 - protein, 220 aa, Heterodera glycines
  Coding regions on vcDNA: vcDNA=SeqID_69674; Strand=-; Position=1 -40,211-275,328-885
  Homolog annotation: Hit_ID=CAE70527.1; Match level="QueryCoverage =71%, HitCoverage=68%, E-value=4e-09, Identity=24%"; Hit description =Hypothetical protein CBG17156 [Caenorhabditis briggsae]
MPNFLMMKYQWCSEHLWSELLDSNAIKKLRVLLTEEINYLTPPEFLSSSSSEKELFWETQNEFEGEREESCAKNGQTVKNEQSAETQNGQIAKTESEIWQMIKSTEKNLANEKKNDQRKRKKVYKKSQKNEQNSMKIEKDGEKEFKQTPKQKKDKVSTGQNVTNGTVKNGKIKGEEAENGQKNKTNLMEIKEENSEEMSKEEKGTKEALERIGIERIFGK

SEQ ID NO: 143252 - protein, 212 aa, Heterodera glycines
  Coding regions on vcDNA: vcDNA=SeqID_69675; Strand=-; Position=1 -137,196-369,455-608,1666-1836
  Homolog annotation: Hit_ID=XP_395780.1; Match level="QueryCoverage =58%, HitCoverage=35%, E-value=9e-28, Identity=47%"; Hit description =similar to CG1697-PB [Apis mellifera]
MYTHSVSADSEPVLKMANLAILYIQSVFAVSIEAQLFAFLVFVHVGFVHLLTNLVVQILLGVPLELVHKYGRVGFLYLAGVMSGALLFFVTDREVYLAGASGGVYTLLSAHIANVIINWSEMQFNWVRASILSTLVTADVVIAVYQRYFSDMPNRVLGVGINGKVVECEHRTDGKKFALKILRDIPKAKREAELHFVASGHANIVNVYDIYE

SEQ ID NO: 143253 - protein, 136 aa, Heterodera glycines
  Coding regions on vcDNA: vcDNA=SeqID_69676; Strand=-; Position=1 -147,197-277,605-787
MATVSSSSNNTCKPSESYSASKIPQCAETIKKMFHELGIKEYEPQLVLQLCDISYSLTKEILVDARSVSEFSGKKQMEERPRQNGSSKFNAINNFDPESVSNLLMTDKNATQRKRPYTNGEMQKHTQEEDYDDEYD

SEQ ID NO: 143254 - protein, 107 aa, Heterodera glycines
  Coding regions on vcDNA: vcDNA=SeqID_69677; Strand=-; Position=1-324
MTKNGAEFGPARYWDALLEREAFELNRPPANISEAADANEQVLQSHLVADDDFEEMDDDDDGEEDEQDETEVEGGGELADFDVCYFCCVHLSATFCLGHFARLRDRL

SEQ ID NO: 143255 - protein, 47 aa, Heterodera glycines
  Coding regions on vcDNA: vcDNA=SeqID_69678; Strand=-; Position=1-144
AMADQIIHRIDEMTQRVDSLEKNITEMMASDSALVASTSGTVDEDNQ

SEQ ID NO: 143256 - protein, 71 aa, Heterodera glycines
  Coding regions on vcDNA: vcDNA=SeqID_69679; Strand=-; Position=1 -67,125-273
MMFASAVFGSMFRFDDKNSKTKTSADCPHVIEVPDVEAEAFKAMLSFIYAEDLSELNGQNAMAVLYAGENV

SEQ ID NO: 143257 - protein, 137 aa, Heterodera glycines
  Coding regions on vcDNA: vcDNA=SeqID_69680; Strand=+; Position=1 -130,209-435,744-800
MTKALYRKATSTKESHPTYKEPSEWEKRSETVTKGAKKHRKCQCPKSFSAPGGSPGAVRSVTPAMLLPPLPSPPPSSPPPPRVRRPASARALTERPAKVNESAFPPKCSSHFTSSRTAEANRGNIGLSNDSKKVGFG

SEQ ID NO: 143258 - protein, 203 aa, Heterodera glycines
  Coding regions on vcDNA: vcDNA=SeqID_69681; Strand=-; Position=1 -45,134-309,430-480,524-584,638-828
  Homolog annotation: Hit_ID=XP_318820.1; Match level="QueryCoverage =99%, HitCoverage=20%, E-value=1e-40, Identity=43%"; Hit description =ENSANGP00000010112 [Anopheles gambiae]
YRTGRLFGGLMADIRRKLPWFPSDFSDFFRGRLSQSLAATILLFFANLSNIITFGAIMERSFHHQIASIENTFGGALSGLLFGLFSGQPLNVLSATGPTLIFEKILFDFCTPLNVLSATGPTLIFEKILFDFCTTNHWETNHWEFLPFRFYVGLWMSFYLIILVATDASALVALITRFTEEAFATLISIVFIIQAFEKLFEIT

SEQ ID NO: 143259 - protein, 123 aa, Heterodera glycines
  Coding regions on vcDNA: vcDNA=SeqID_69682; Strand=-; Position=1-370
MLLLLRSSNPISEIIHLSAKHIKKRKAMCPINCDGQSTIGTDDADGVVVGTAAVAAADSAAVPSKRHPTPRVCAARHAPGPPQSSHCAASRTSTRRSRTASSPPVVMGEWQCVKKVRKDEVGA

SEQ ID NO: 143260 - protein, 63 aa, Heterodera glycines
  Coding regions on vcDNA: vcDNA=SeqID_69683; Strand=-; Position=1 -37,479-633
MAPAPNAGSAGVDSNRKCQLFKEIFESSANEDGVLNVKRTDAEQQVKGTSTSNNLNVASSDDE

SEQ ID NO: 143261 - protein, 44 aa, Heterodera glycines
  Coding regions on vcDNA: vcDNA=SeqID_69684; Strand=-; Position=1-133
ETGNFKFADPVAGLEFKIFYRTGSGRINPANPAILHLKSAGSCA

SEQ ID NO: 143262 - protein, 26 aa, Heterodera glycines
  Coding regions on vcDNA: vcDNA=SeqID_69685; Strand=-; Position=1-140
QNEFINIFSETALKRTKFYLQVILGT

SEQ ID NO: 143263 - protein, 136 aa, Heterodera glycines
  Coding regions on vcDNA: vcDNA=SeqID_69686; Strand=+; Position=1 -59,109-275,329-399
  Homolog annotation: Hit_ID=AAR07614.1; Match level="QueryCoverage =80%, HitCoverage=16%, E-value=2e-33, Identity=61%"; Hit description =UNC-18 [Haemonchus contortus]
KLEIKHFPFLAGRQISQPYRAPTSARYGQWHKDQRAPTSARYGQWHKDQRYSQMRSGPRLIIFIVGGVTFSELRSAYEVTRTQKTWEVVIGSDQIITPERFLVNLRELSKKSGSDQIITPERFLVNLRELSKKSHD

SEQ ID NO: 143264 - protein, 18 aa, Heterodera glycines
  Coding regions on vcDNA: vcDNA=SeqID_69687; Strand=-; Position=1 -30,170-196
MNDKKRIDWNKRVFFLAF

SEQ ID NO: 143265 - protein, 144 aa, Heterodera glycines
  Coding regions on vcDNA: vcDNA=SeqID_69688; Strand=-; Position=1 -223,269-478
LLLVSEADCAEPTEVPSKFDGRLMVWHRMTFSFGNAKNCSEAVAQLKQQQNLWWQIWKGTNFLPHRDVPYMAQFDFLIANRKLINELKSFQFNVGILETGMGDFSMSILRAFPTIKKFVGSQSISPTISQWKYFGYDKIVGAMP

SEQ ID NO: 143266 - protein, 36 aa, Heterodera glycines
  Coding regions on vcDNA: vcDNA=SeqID_69689; Strand=-; Position=1-178
KRRDKKTGERERKRKRNARCASEASASALVDIKNLI

SEQ ID NO: 143267 - protein, 53 aa, Heterodera glycines
  Coding regions on vcDNA: vcDNA=SeqID_69690; Strand=-; Position=1 -34,78-205
MTPNHRTNNAKEIREAIFATIDPKRIAENLRQFTKEPHVAGTEANKRVNEQKR

SEQ ID NO: 143268 - protein, 33 aa, Heterodera glycines
  Coding regions on vcDNA: vcDNA=SeqID_69691; Strand=+; Position=1 -53,110-158
MAIPLNISAASNFLYFTSTEYRQAFRDKFPTKF

SEQ ID NO: 143269 - protein, 189 aa, Heterodera glycines
  Coding regions on vcDNA: vcDNA=SeqID_69692; Strand=-; Position=1 -30,85-198,512-715,785-1006
MLVANEAAKEFENYLTSNVFKNIYVQQNFYRIKMEGALQQIVTVVEKWSNGLAQLLISGSLLLHSHTIGSDVNLVCLTPGEKLKVSDFMGDDRKSKCEENKCTDEANSSLFCQICAHKSTTNLIKIESDSLLIVRFQFDGIEFDISLVAIPKIEQLEKINAEMLQKLAEKFNDSIFEQKNMGRTLASKI

SEQ ID NO: 143270 - protein, 53 aa, Heterodera glycines
  Coding regions on vcDNA: vcDNA=SeqID_69693; Strand=+; Position=1 -27,105-239
MTEKSDDRARPSASVVVLPGRRCSAVRPSLVPVVPIAFAPIAAGHYHLAQLNG

SEQ ID NO: 143271 - protein, 473 aa, Heterodera glycines
  Coding regions on vcDNA: vcDNA=SeqID_69694; Strand=-; Position=1 -173,269-358,645-679,1266-1420,1709-1766,1977-2584,2638-2937
MIASFRPLAEIGSMLGRSWMWPVPASPSFSWSSPTCSAWKLDEKQCKLYFKTHLPYSSENTTPQTYLQYILFKQPHGQDNLNVIASFYELLKMLLPQLRKKQLDASKPLDKTLALLAVIANSYSNNREVFEEHVSSAVFRILGQSIVHQQQIANPGTRGKFGTTFVEHGIGFIGAAQLSPPKHCLWLEVEHRNAFPFSLPSHIYGHFSTALFHVPQVLEALVRSPISTAPCPSSNTLQLCALLEQTIQRFVQCTWPQDLLNFSQLLMGKTLPNPLMAMPEYYRLFLLAVFRAVKLLGADHLQFSSQDLGQRWPLSELRWFPPNIIRSIVPNDSDLPQLEQMQSAQQAQEMVELQNISFQEAQRLMHLDAEFFGLDSPPCHPTSPSLLVSIFRCLHEFTNFHPQLPPGKQSHQSAPNFPALCYKLLSLQSNRDVHRSTNALVDYLVWKCQGDASQAPSGMLTDESLSLQQIDLR

SEQ ID NO: 143272 - protein, 16 aa, Heterodera glycines
  Coding regions on vcDNA: vcDNA=SeqID_69695; Strand=-; Position=1-49
EAIPEGFGLPINLGAS

SEQ ID NO: 143273 - protein, 108 aa, Heterodera glycines
  Coding regions on vcDNA: vcDNA=SeqID_69696; Strand=+; Position=1-327
MNRQIDTKRQKSKITHEGHLYTFDKASADGMTKFWRCEFKDICKGSIWTNLADQFIRLATAHRCPANASSVEVQKVKTAIKRRALATYEPPAVIRSEALQNVPSPAGL

SEQ ID NO: 143274 - protein, 57 aa, Heterodera glycines
  Coding regions on vcDNA: vcDNA=SeqID_69697; Strand=+; Position=1 -77,422-518
MKECFGDGTFSLAPPMFYQIYTILASAIALIQCLQKQMELGHSQQSHQNSGTSTLAH

SEQ ID NO: 143275 - protein, 45 aa, Heterodera glycines
  Coding regions on vcDNA: vcDNA=SeqID_69698; Strand=+; Position=1 -115,257-279
MRAVTVGGIVLIGVLLCCLIICLVTMVASLTFSCWWTLVNFFTNY

SEQ ID NO: 143276 - protein, 17 aa, Heterodera glycines
  Coding regions on vcDNA: vcDNA=SeqID_69699; Strand=+; Position=1-53
IESHPLPADARHSKALI

SEQ ID NO: 143277 - protein, 167 aa, Heterodera glycines
  Coding regions on vcDNA: vcDNA=SeqID_69700; Strand=+; Position=1 -229,287-561
  Homolog annotation: Hit_ID=XP_326403.1; Match level="QueryCoverage =78%, HitCoverage=10%, E-value=1e-19, Identity=38%"; Hit description =predicted protein [Neurospora crassa] gb|EAA33019.1| predicted protein [Neurospora crassa]
MTEFIECCIYNWHYLNPKQAKEIDWVIPARFCTGRYDSKKIRHRIEVQLGEESKEERLEAGESQTKWPNAYVIPSKDGHKVRIIDAPGIGDTKGVNEDKINFDKTLNFISTLPELHAVCILLRPNTTRATPAITYCIKGLLTYLHKNAAKVLYSSSIMDNTDYNTPF

SEQ ID NO: 143278 - protein, 23 aa, Heterodera glycines
  Coding regions on vcDNA: vcDNA=SeqID_69701; Strand=+; Position=1 -8,967-1030
MHWHINFEDIFKIYHTRFQLTYK

SEQ ID NO: 143279 - protein, 758 aa, Heterodera glycines
  Coding regions on vcDNA: vcDNA=SeqID_69702; Strand=+; Position=1 -103,208-341,993-1216,1485-1800,2890-3121,3305-3480,3726-3797,4101 -4234,4283-4376,4452-4488,4631-4827,4999-5268,5578-5730,5794-5926
  Homolog annotation: Hit_ID=CAE73479.1; Match level="QueryCoverage =17%, HitCoverage=62%, E-value=3e-09, Identity=33%"; Hit description =Hypothetical protein CBG20931 [Caenorhabditis briggsae]
MVVTLMIGMKNGVEKLFKQRPLTIDQLDEQYIDKEVLVQNWKPNVVYLVQFPHTDSAPSLSPAAIQLETWLRIKEIPFYTVSDGVLFRALFADDKVPFVEYNGQKIFGTSEEIIDTLKQEALSKGTLSELLGLGQKSDENEQEMRNLIDNVLYSILLHDRFQNLASSEAETHLAKNIDFQRIVLPSVLKEAKRNWFKIQPLPKPFWDEYFAKGKTVAYGSKSWNGYGISEKEWKKFVDKLSTEHIPKAMTKFVKHLKKQLDSVLFGILSQFTNTNTIYNGHYANSISAKLNRNPNDPLKIYFGHMKDIFMGQNNTEQNQWQINADWKFEKKANKYNGPFILRFDVLKLDYEQRKRFTNDERKTFSPLFNNGNAENSDEISGTLFSERKFLAVYPKVVTFIVHQLLSLFNLERFAIEMAERMKLGRALIHLMASYLCEGKIGQNDCETEHDEKAKKYLGRICKISEKYFAELSVIVRSLVYQMMYTINVEYQTKESLKMFGAALLDFDEEQTIKYEAKRLRNAIRHLEKFESEKIEYLRTKVQQLGILMQKSQQTDSKDPQTIADGQKSNEEIKKLQKELSVWVLRSFIVSEMRALVDALDDDDKFSREKVTFNDIEPSRNHWLNLNVLVEKCEKEDRTCKMNREQMKQGFQMITERKKKHIFKELWAKTVDQAESVFTVQKYHEVLSYRLGQLRKLYELRKSQLPRDEAVNIKKIDEQYVKVKAELFQRLGDSEVTTTEDNDEGAEVVEVLAEVTFTS

SEQ ID NO: 143280 - protein, 159 aa, Heterodera glycines
  Coding regions on vcDNA: vcDNA=SeqID_69703; Strand=+; Position=1 -184,252-410,677-814
GELFILLRAKVEEDGTNFDEEEIAKGFKYVKGHNSMHRAHKLRAFLFDWAGKVAKEKKFVKKLAWRMGQLSKLYMLRKEKIDEKDIKSWASKQEELSGEMEKRWTELKTIMEKMADKIIENATGKTDKAPLAAANVYAEDGKPGTMPLEEIQIEDKREL

SEQ ID NO: 143281 - protein, 200 aa, Heterodera glycines
  Coding regions on vcDNA: vcDNA=SeqID_69704; Strand=+; Position=1 -108,157-651
MDVDVIVKKFKLVFWPAQEFRNVPEDFDEKTRKFVEDALSCKYLIETLKLQIGVETAQRMGEEEYDARVEYSLNLEISEGKNAHLMTKADEESIRQNNHLLYMLNFFIVFINERVKLTEHAFTCALMLNTKEFFDVQFWYSCTKCSSVLNQFALVRLTWRFPRNAFHSSVWLTVTNHLFIELFNLLRILTESWIVSTIAQ

SEQ ID NO: 143282 - protein, 70 aa, Heterodera glycines
  Coding regions on vcDNA: vcDNA=SeqID_69705; Strand=-; Position=1 -62,332-479
  Homolog annotation: Hit_ID=EAK91396.1; Match level="QueryCoverage =98%, HitCoverage=33%, E-value=2e-09, Identity=45%"; Hit description =potential centromere-specific histone H3 variant [Candida albicans SC5314]
MKKKINKKEEQRRKRYRPGEKALKEIRRYQKSTDNLMPRQPFRRLIREVISEITWNSHPVETQAATALQE

SEQ ID NO: 143283 - protein, 83 aa, Heterodera glycines
  Coding regions on vcDNA: vcDNA=SeqID_69706; Strand=+; Position=1 -60,585-776
MCEEVNESSVFRVQFDLERRVTLDVLEQVLAEIDKRLDCLHPSLIYDWIFKRVNRSADAMRQIHDENTKEGYVRIRKVRLISF

SEQ ID NO: 143284 - protein, 169 aa, Heterodera glycines
  Coding regions on vcDNA: vcDNA=SeqID_69707; Strand=+; Position=1 -213,514-615,663-857
  Homolog annotation: Hit_ID=CAE57375.1; Match level="QueryCoverage =76%, HitCoverage=10%, E-value=9e-20, Identity=34%"; Hit description =Hypothetical protein CBG00321 [Caenorhabditis briggsae]
MEAVDFPKTGVPPKPLTTKWETVNPENEDAPAKPTAIPPERAERSPDFMEKNNEPMHVSVYLTNNLLVKIQNILDCYGIKTEGELFSGHFTALRNRISEKDSDDMSFYNTTNAIEQQLFSVFGKFRRQFFELLLEGQQNRYEEVTVPVYRYVRTNGAKVLGVWLFGYYD

SEQ ID NO: 143285 - protein, 24 aa, Heterodera glycines
  Coding regions on vcDNA: vcDNA=SeqID_69708; Strand=+; Position=1-76
ITGVSIIAVLFLVFLMLSQNLVRF

SEQ ID NO: 143286 - protein, 48 aa, Heterodera glycines
  Coding regions on vcDNA: vcDNA=SeqID_69709; Strand=+; Position=1 -46,328-428
MTFYASLVGYTGRNNKILSVKSAFGILMSKSVTVNDILCFSCWIHGKK

SEQ ID NO: 143287 - protein, 48 aa, Heterodera glycines
  Coding regions on vcDNA: vcDNA=SeqID_69710; Strand=+; Position=1 -46,200-300
MTFYASLVGYTGRNNKILSVQSAFGILMSKSGTVNDILCFSCWIHGKR

SEQ ID NO: 143288 - protein, 60 aa, Heterodera glycines
  Coding regions on vcDNA: vcDNA=SeqID_69711; Strand=+; Position=1 -64,582-669,869-899
MGCAFKTGKYQDKEEHNDKDNGILMGKGLSYKERSVESSWRKKMFDSPSNYIFIQKGCHR

SEQ ID NO: 143289 - protein, 185 aa, Heterodera glycines
  Coding regions on vcDNA: vcDNA=SeqID_69712; Strand=+; Position=1 -197,286-415,588-818
  Homolog annotation: Hit_ID=ZP_00281826.1; Match level="QueryCoverage =94%, HitCoverage=48%, E-value=2e-32, Identity=44%"; Hit description =COG0438: Glycosyltransferase [Burkholderia fungorum LB400]
MGRMAPEKGVDIAIEFALWSGIKLKIAAQLVDEHKHSYWHKQIEPLINANQHLVEYVGEIGGDERDSFLGNALAFLFTPKWDEPFGLSMIEAMATGTPAIANRRGAVPEIVQIGRNGYTFDYKDRLGVEQVANFVHLINQAAKLDRATVRQTVEEKWSLDKMAENYEKVYRRMLNKNFIANCYDH

SEQ ID NO: 143290 - protein, 71 aa, Heterodera glycines
  Coding regions on vcDNA: vcDNA=SeqID_69713; Strand=-; Position=1-216
MPYNKKRMDKKRRIKTEPAEAYDQNYGANRQQSNGKWAKLAAVKEEAITLINDDVGHLEQQKKLNMAKIVP

SEQ ID NO: 143291 - protein, 181 aa, Heterodera glycines
  Coding regions on vcDNA: vcDNA=SeqID_69714; Strand=-; Position=1 -294,401-652
  Homolog annotation: Hit_ID=NP_275477.1; Match level="QueryCoverage =60%, HitCoverage=30%, E-value=4e-12, Identity=39%"; Hit description =perosamine synthetase [Methanothermobacter thermautotrophicus str. Delta H] gb|AAB84840.1| perosamine syn
YVNPFNTVCYPSYGTPPALFRHSLQLRSKLPPRLAHFLPEPEPHICAHNSQIIRVVEPYIPPGAIQNVNDALMSKQISSAGTWPKQLAAKLCAIYDFPVAVPCCNGFTSLVLALRSANIGAGADVLMPSITFVAVSNAVLNVGANPVFVDSADEWDYNPSWSLLLRAATQKTRHEKILEKF

SEQ ID NO: 143292 - protein, 68 aa, Heterodera glycines
  Coding regions on vcDNA: vcDNA=SeqID_69715; Strand=-; Position=1 -184,324-346
MPHCTDDPIWPAWAFHTSVVLNFVLVLVLFVLSVLLVGRCNRPVPVKTVGHCDQCHRRLTDLNELVLC

SEQ ID NO: 143293 - protein, 60 aa, Heterodera glycines
  Coding regions on vcDNA: vcDNA=SeqID_69716; Strand=-; Position=1-383
IHSFGGPCRVPRGKQCWFVSSRHRTFWLVSNRCLTCQIGRVRMIPLFQAPHQKQNDITKI

SEQ ID NO: 143294 - protein, 222 aa, Heterodera glycines
  Coding regions on vcDNA: vcDNA=SeqID_69717; Strand=-; Position=1 -65,1229-1832
MPGPEKPGLVRVLIFKPAQGVRITPKLGLGTNSDALLNVEPAGVRNEQQRQNEAVVDENLEPQRGGLRLCFQNLGFNVGREEWLVRNENFDGHRITHTLSPRIVPRTSTPIENRITPELLVQHVPAQNAQKTQNVMQNNARTGVNGGGAAIQQQAMHSLARPQPLPAQQPIIVQQAIPQPAVTQPTIQQGFPGPIWGFPGQIPYYQYQPPGSKMGRLSLQMG

SEQ ID NO: 143295 - protein, 55 aa, Heterodera glycines
  Coding regions on vcDNA: vcDNA=SeqID_69718; Strand=-; Position=1-261
FGPRGRLGPNPKIEKCAFLKIKILKTKPEGSLATWHKLGLITFAHFLLIPNPIIF

SEQ ID NO: 143296 - protein, 96 aa, Heterodera glycines
  Coding regions on vcDNA: vcDNA=SeqID_69719; Strand=+; Position=1-291
MTNEYKQKRKYSKKEWEKNYAEICKKIGVSRDIINKWKKQFGIRCKITENEKMEKMKIYWQIKSENPKMTDKEIAKIVNTSQQNIFNWKKQFGEEI

SEQ ID NO: 143297 - protein, 21 aa, Heterodera glycines
  Coding regions on vcDNA: vcDNA=SeqID_69720; Strand=-; Position=1-90
MNGHLFIREMIFILINWIFLN

SEQ ID NO: 143298 - protein, 115 aa, Heterodera glycines
  Coding regions on vcDNA: vcDNA=SeqID_69721; Strand=+; Position=1 -91,178-414,748-769
  Homolog annotation: Hit_ID=CAC21848.1; Match level="QueryCoverage =76%, HitCoverage=43%, E-value=7e-09, Identity=39%"; Hit description =hypothetical protein [Globodera rostochiensis]
LAKYPILLNKNSSDIFYFEILVTKIKNERNLVSFGFAVKQQARLDDGILLEKGTYAYGSAGWIWINGGVKEAEYSYGVGDTVGIGVNSATRQIIFTKNGLRLDRKINKMCKIMST

SEQ ID NO: 143299 - protein, 210 aa, Heterodera glycines
  Coding regions on vcDNA: vcDNA=SeqID_69722; Strand=-; Position=1 -101,491-1019
AWIQCESEETAADVKNKLADIIRRETEKKQCALLALGNIAKGGGSSPSFSNGTASQQRHHQHHHHALPGTSTTYAAPLTTTAAAVAGAGVPASGTACSGGQMAAASVANGQPAQHSVAANGGGFSHQNRPPPELETISEDEKQQLEQQQQQQFAGAEQRSPATSVSSSSNGAGGAGSGPQQQKRHNHHGHHHLSQSAREKRLELRECKAK

SEQ ID NO: 143300 - protein, 120 aa, Heterodera glycines
  Coding regions on vcDNA: vcDNA=SeqID_69723; Strand=-; Position=1 -114,501-749
MSIIRLYISFNWMDLSQFIVCINKRSYLLRSGFKYRYEKNLSIRDGNEQFLENGNVLVIEDETEIFEHDIDDVLSEHNYAKRARCLTDVNVASQASLNSDIGVAGPSRMSDSQFGRKEKK

SEQ ID NO: 143301 - protein, 57 aa, Heterodera glycines
  Coding regions on vcDNA: vcDNA=SeqID_69724; Strand=+; Position=1 -63,107-234
LSFSGTTMNNWKTILLGTLGESTRTIISSHFDGAEERRLRQFATNTNKEQKINWIII

SEQ ID NO: 143302 - protein, 540 aa, Heterodera glycines
  misc_feature (38)..(38): Xaa can be any naturally occurring amino acid
  Coding regions on vcDNA: vcDNA=SeqID_69725; Strand=+; Position=1 -120,811-1035,1227-1463,1506-1619,1676-1709,1842-1933,1985-2188,2239 -2284,2340-2508,2557-2714
  Homolog annotation: Hit_ID=NP_504501.2; Match level="QueryCoverage =97%, HitCoverage=97%, E-value=1e-121, Identity=45%"; Hit description= pellino, Drosophila Pelle associated protein homolog (51.8 kD) (5G191) [Caenorhabditis elegans] gb|AAB37
DNTESELVSILPSLGPYSSFGILSDCCYGQLILLGFVXMAATDSSGRKHFVKMFFKRRKEPNGIRKGSAMTLSTNEAPAVKDATRHTVSYSYGKSGTVLVEYLPDSSRDMFQVGRSSEDQIDFTIVDTWLAIGSSNVSSPAGNSARHLRDDVNGQKSISSTISRYACRILADRDRPNKAFIFAAGFNSSKNIFLGEKATKWQKANGEFDGLTTNGVNIFLGEKATKWQKANGEFDGLTTNGVLILHPNLCNKSADKVFNERLLKVFNERLLWREVSVDGDIYNLRETRSSMQKGTLAMNETNELQDGTLIDGTLIDLCGATLLWRSAEGLRRCPSREALERRLDELNAGKPQCPVNLNTLVVPRRKHPKNSSSRQPYVYFGCGHVQGKHTWGVQPYVYFGCGHVQGKHTWGVNKCGSINKCGSITTFRCPICMVDSKGVAKLVMGMESVFHLDSDCLKYAFNPCGHVASFRTVSFWSRIPLPHGTSSFFWSRIPLPHGTSSFFPVCPFCTSLLSAEKPFVRLIFQDNCGDDCMVPSPSFP

SEQ ID NO: 143303 - protein, 167 aa, Heterodera glycines
  Coding regions on vcDNA: vcDNA=SeqID_69726; Strand=-; Position=1 -86,138-201,257-395,438-577,772-846
  Homolog annotation: Hit_ID=NP_505657.1; Match level="QueryCoverage =100%, HitCoverage=50%, E-value=5e-69, Identity=65%"; Hit description= actin like protein 2, Actin Related protein 2/3 compleX component ARX- 2 (44.8 kD) (arx-2) [Caenorhabditi
LLLLRGYAFNHSADFETVRQLKEKHCYVAYDVEQEQRLALETTVLTESYTLPDGRMIKLGSERFEAPEVLFQPHLVNVEKLGLSELLFNVIQSADIDTRLEFYKHIVLSGGTTMYPGFPSRLERELKQLYLERVLKGNTDSFQEFWVTRREWEENGLSYCMKKLSFK

SEQ ID NO: 143304 - protein, 48 aa, Heterodera glycines
  Coding regions on vcDNA: vcDNA=SeqID_69727; Strand=-; Position=1 -82,137-199
NKNDINRRTWAIETEHFGRAVHKSIRTYNRSEIAFIGGQGIRQFPTLP

SEQ ID NO: 143305 - protein, 170 aa, Heterodera glycines
  Coding regions on vcDNA: vcDNA=SeqID_69728; Strand=-; Position=1 -172,215-387,565-663,745-813
MAFFENGNFWTNWNKNVKKMIMANLLKEDNEEKIILSIEKLEKYLILFKKLNEQIQIDEHLFNKYRNELNKYVDEKVRKSFVDSEKWTLPDEVAKNWQEINFEENLKEKSEQIIEIKNCLTTNGYLSEEEMRKKGQIIGELTKIIKEWYEIPLDNPASPEVKFAGISAGL

SEQ ID NO: 143306 - protein, 39 aa, Heterodera glycines
  Coding regions on vcDNA: vcDNA=SeqID_69729; Strand=-; Position=1 -18,233-334
MCNFELKCIKFPTICSMFFIQNNCFKHAFKMFSLSNYVS

SEQ ID NO: 143307 - protein, 50 aa, Heterodera glycines
  Coding regions on vcDNA: vcDNA=SeqID_69730; Strand=+; Position=1-150
MRKNIPTELLFEIIGAIPFDRKWAQIHVSQVFNHFLFNRMGSWLSQIKNL

SEQ ID NO: 143308 - protein, 236 aa, Heterodera glycines
  misc_feature (1)..(1): Xaa can be any naturally occurring amino acid
  misc_feature (235)..(235): Xaa can be any naturally occurring amino acid
  Coding regions on vcDNA: vcDNA=SeqID_69731; Strand=+; Position=1-711
  Homolog annotation: Hit_ID=NP_502797.1; Match level="QueryCoverage =92%, HitCoverage=62%, E-value=1e-37, Identity=37%"; Hit description =HASI (4P602) [Caenorhabditis elegans] emb|CAB16520.1| Hypothetical protein Y57G11C.19 [Caenorhabditis ele
XYKLLEQVYYDLRSPASYAGIQKVLAEAQRRNPSITLRDVDKFLHKQRTYTLFKPRKNRFRRLKTVPSGLHTDWQCDLCIMDALKEHNDGFRYILVCIDVLSRKIFTAEAESKKSEHMIAAFEKIFKKAGVLPNKLYSDAGLEFQAKKMMDYWKQKEIIKHVMYSPHLHAGVVERANRTLKERLYKYFSEKNTKRWVDVLDSIVRNLNSSANRTTGLRPTDVNIKNASATESPIXA

SEQ ID NO: 143309 - protein, 68 aa, Heterodera glycines
  Coding regions on vcDNA: vcDNA=SeqID_69732; Strand=-; Position=1 -75,392-523
  Homolog annotation: Hit_ID=CAE62638.1; Match level="QueryCoverage =100%, HitCoverage=10%, E-value=3e-19, Identity=52%"; Hit description= Hypothetical protein CBG06769 [Caenorhabditis briggsae]
MERTVVIKRLGLPDQKVKVRIWNDTPNTIVGSAAFNLFMIIAICVSAVPPTEIRRQKHLDVFFVTATW

SEQ ID NO: 143310 - protein, 15 aa, Heterodera glycines
  Coding regions on vcDNA: vcDNA=SeqID_69733; Strand=+; Position=1 -22,286-311
MTSQKDTKFFGIKWL

SEQ ID NO: 143311 - protein, 16 aa, Heterodera glycines
  Coding regions on vcDNA: vcDNA=SeqID_69734; Strand=-; Position=1-49
EAIPEGFGLPINLGAS

SEQ ID NO: 143312 - protein, 45 aa, Heterodera glycines
  Coding regions on vcDNA: vcDNA=SeqID_69735; Strand=+; Position=1 -33,80-184
MANLDNFDNDTFYLAFKDANPSWSLIGCALIYGIITTFGIIFIFL

SEQ ID NO: 143313 - protein, 401 aa, Heterodera glycines
  misc_feature (162)..(162): Xaa can be any naturally occurring amino acid
  misc_feature (309)..(309): Xaa can be any naturally occurring amino acid
  Coding regions on vcDNA: vcDNA=SeqID_69736; Strand=-; Position=1 -163,512-695,1112-1231,1617-1871,1930-2137,2466-2624,2785-2849
  Homolog annotation: Hit_ID=NP_500339.1; Match level="QueryCoverage =85%, HitCoverage=100%, E-value=1e-54, Identity=35%"; Hit description= putative protein, with 2 coiled coil-4 domains, of eukaryotic origin (4E162) [Caenorhabditis elegans] gb
MTKKSNIAKLVSEKPKHQRNFQKVKHCNSSFLKAKTSKNFPIKTPNNTISFPKRVVLTLLQKAHVRLNPKYLYQADGHAIRELLPVLRMLYESVKEQNGATEPRGAEERQRRTGERQELHQIIKLATELPKTAASLYELLREEIFAKVRNQGILSWVHSVAXVETELRERIQTTEQRIEEVKERLQNIESDEQELGRKIERRRREMDQLQKRLAKLQAFRPPYLDEYERYEAQLRVRYAVYVILFRNLHALQSRLVQSYVILFRNLHALQSRLVQSEHAEREQALEAERSMREMVGKMRMESEQAAPLXALNEISGPNNLANHSIGLLRVFGNMTGLGLSDDDEEDEEEDEDGLEVDESLKWRMMKNDDDDDDDNDDYMKNVDEEETDEEAADEDNSGDNF

SEQ ID NO: 143314 - protein, 87 aa, Heterodera glycines
  Coding regions on vcDNA: vcDNA=SeqID_69737; Strand=+; Position=1-599
FFLNFCGVGPKGHTFLKLAKFFAIKKRNAKLNISPDPTQAQQKDNIFSIVGRQALNRPAFPDTPFWRFVLPKNIGPFYGLPINFFSL

SEQ ID NO: 143315 - protein, 23 aa, Heterodera glycines
  Coding regions on vcDNA: vcDNA=SeqID_69738; Strand=+; Position=1-98
NPKLFGLFKKELKIFKNFIHLPF

SEQ ID NO: 143316 - protein, 42 aa, Heterodera glycines
  Coding regions on vcDNA: vcDNA=SeqID_69739; Strand=-; Position=1 -46,434-516
MNYHICTDFINSLAYANPEISFAIGTLRISMEEAYPFGFYDD

SEQ ID NO: 143317 - protein, 65 aa, Heterodera glycines
  Coding regions on vcDNA: vcDNA=SeqID_69740; Strand=-; Position=1 -33,282-446
MSNLESPLRTINAWVLDSVVRLLGSERDKFKKKTKGSNQTDQKKEDKDRKKTSNIKMNIDKKKKE

SEQ ID NO: 143318 - protein, 82 aa, Heterodera glycines
  Coding regions on vcDNA: vcDNA=SeqID_69741; Strand=-; Position=1 -63,260-400,447-491
  Homolog annotation: Hit_ID=NP_490913.2; Match level="QueryCoverage =75%, HitCoverage=7%, E-value=9e-22, Identity=85%"; Hit description =tubby protein (97.1 kD) (1C357) [Caenorhabditis elegans] gb|AAK31566.2| Hypothetical protein Y71G12A.3 [Ca
MRRKRRIWPWKRRRSVARNGKLDFNGRVTQESAKNFQIEHQSRQVLQFGRIENGAYTLDFREPFSAIQAFAVALASITQRLK

SEQ ID NO: 143319 - protein, 188 aa, Heterodera glycines
  Coding regions on vcDNA: vcDNA=SeqID_69742; Strand=-; Position=1-565
MNLWLLIVIIIFCLFYGIKSGKIQPNFDEIFGDKWDKNESEEKIIKMEQNENSEFNINQNSGKNGNRPNDQQKIETIEKFDAIKEKLREKGKYENEKRNKIEWKIAKLLGANRKKIYKWKNELNLNKIKFNKMKKSFYEEKKSEFIERIDEFKSLYGQGKHKEFVKELGISKKTFRKWKKELLPNCYK

SEQ ID NO: 143320 - protein, 70 aa, Heterodera glycines
  Coding regions on vcDNA: vcDNA=SeqID_69743; Strand=+; Position=1 -12,108-308
MNPLISGGSKLAINRMSWTVYFLATVENEFQTMGYGCTASLISPQFVLLAAHCFDNLKENGQFSLGNFFY

SEQ ID NO: 143321 - protein, 38 aa, Heterodera glycines
  Coding regions on vcDNA: vcDNA=SeqID_69744; Strand=+; Position=1-115
MDKKVKLSPKMYPVCVHCGPTEKFKNGKAFIAGWGNLK

SEQ ID NO: 143322 - protein, 84 aa, Heterodera glycines
  Coding regions on vcDNA: vcDNA=SeqID_69745; Strand=-; Position=1 -183,358-429
MALARRENNGTTTTATARRYGVETKQAAAKTTAKHSAEDDDDDDQQQQLLMNSTYIPEVAKNGNLVPMFPEYGILVIGMAFLCR

SEQ ID NO: 143323 - protein, 124 aa, Heterodera glycines
  Coding regions on vcDNA: vcDNA=SeqID_69746; Strand=+; Position=1-375
MARQLTDGTGGATTKRGSASSLLNLVSAHHRGGEKRSFRHPSVVQSTSANSTAAALLDAQPAVTAAGSSAKKRSGGSGTGAGGSVNNALERLARAGGGGSVNNALIERMARAGGGGTAGNSKKA

SEQ ID NO: 143324 - protein, 85 aa, Heterodera glycines
  Coding regions on vcDNA: vcDNA=SeqID_69747; Strand=-; Position=1-258
NESLPPDLGCESPKQPDSKTRKEWNRHRQLDRSCHLLWSPGRRENLNKRANPSSRSIRYTSQPRGAAIRALDSSQFTRRYYGNPR

SEQ ID NO: 143325 - protein, 47 aa, Heterodera glycines
  Coding regions on vcDNA: vcDNA=SeqID_69748; Strand=-; Position=1-141
MAPKCLPLELLFEIVPFIPAENATPNALSSSRLLYNFLLPRVIKWKE

SEQ ID NO: 143326 - protein, 26 aa, Heterodera glycines
  Coding regions on vcDNA: vcDNA=SeqID_69749; Strand=+; Position=1 -49,306-337
MGPALDGQRKLFSLFCAFLVKNINVE

SEQ ID NO: 143327 - protein, 80 aa, Heterodera glycines
  Coding regions on vcDNA: vcDNA=SeqID_69750; Strand=-; Position=1-636
LFEYPKRTLEKIDYFVFGAVPPNRCAQIYGETESFRNSFPIACTLILRWIFAPHKCLSTPNGHLKKSIFLFHKYFFQKVL

SEQ ID NO: 143328 - protein, 144 aa, Heterodera glycines
  misc_feature (23)..(23): Xaa can be any naturally occurring amino acid
  misc_feature (112)..(112): Xaa can be any naturally occurring amino acid
  Coding regions on vcDNA: vcDNA=SeqID_69751; Strand=+; Position=1 -66,211-343,685-842,1183-1267
  Homolog annotation: Hit_ID=CAE60451.1; Match level="QueryCoverage =88%, HitCoverage=25%, E-value=7e-27, Identity=50%"; Hit description =Hypothetical protein CBG04059 [Caenorhabditis briggsae]
KNLNNFFIRKPRPSFSSALIPVXTCNKCSASIEEYNLGQVGYYLDEENNWALDMDELERALKEVGYEHDVKAIVVINPGNPTGQVLSRANIESIIQFAHKHRLYIFADEVSXSHETRPGIIKSFKKILEIVYRNFKKNFKKKVL

SEQ ID NO: 143329 - protein, 19 aa, Heterodera glycines
  Coding regions on vcDNA: vcDNA=SeqID_69752; Strand=+; Position=1-60
EPVNSCIGCKCRRCCTPNS

SEQ ID NO: 143330 - protein, 153 aa, Heterodera glycines
  Coding regions on vcDNA: vcDNA=SeqID_69753; Strand=-; Position=1 -129,1069-1401
MPNFLIKKCRKSVPLANLMFDEQKWDQHQQAPVVDHLNYENALNSVPSLAYTVHSRPSSAMPKIALTVLFVDLSDCVQFAARHLGEFPLHTFGHKRQPFARLQLAHKCEQSTPGGFQVGEQARHGGGRVEDKLRKGTAKWDGEKTWIIMDHGH

SEQ ID NO: 143331 - protein, 472 aa, Heterodera glycines
  misc_feature (366)..(366): Xaa can be any naturally occurring amino acid
  Coding regions on vcDNA: vcDNA=SeqID_69754; Strand=+; Position=1 -74,138-312,666-793,863-900,1163-1302,1365-1421,1830-1901,2382 -2555,3334-3578,3951-4077,4369-4457
  Homolog annotation: Hit_ID=NP_500910.2; Match level="QueryCoverage =99%, HitCoverage=44%, E-value=1e-107, Identity=45%"; Hit description= solute carrier family 12 member, possibly N-myristoylated (4G837) [Caenorhabditis elegans] gb|AAF39883.2
YDGTRGSIHRFLAALIWSADSFPDHLSSTRPPLSGLFTDLELSSTRPPLSGLFTDLESTRRGLLAFVGQLKAGKGLTLVAECVEGKFAQWRAANWTQSNLHDEVKASRIRGFCDVLVADQYIQGVSHLIQTSGLGGLRHNSVVCAWPQNWSASDVVCAWPQNWSASDPMLEANRFAELVRTIAAAGCAVLVPKYASAFPSHGDRLTGTIDIYWVVHDGGVVHDGGLLMLIPFLLIKHKTWKNTTVRLFTFAQPEDNTLQMKRDLERFLYHLRIEAQVFVLEIDSTEIEPYVYQRTLKIEERVKLLREMGTKSNERVADIQSRIWCKFKANTLWAVHEESEEEGKQQQRAAEEHRAKPSGENGTSEXRRRQWHKWEQSALHRQFSGGEKAHKDTAEHRPKKRSTVARMHTAMKLNQHMRELSADAQLLIVNLPGPPDGQHDAYYMEFIEALTEGIRRVLLVRGTGSEVVTIYS

SEQ ID NO: 143332 - protein, 200 aa, Heterodera glycines
  Coding regions on vcDNA: vcDNA=SeqID_69755; Strand=+; Position=1 -97,137-640
  Homolog annotation: Hit_ID=NP_917837.1; Match level="QueryCoverage =100%, HitCoverage=10%, E-value=3e-26, Identity=33%"; Hit description= B1158C05.18 [Oryza sativa (japonica cultivar-group)]
MTPRFALDAIDKKLRELTKCNLLFGGKTIILAVRSEIVDLTIKKSVLWNNFEQLKLTINIRAKDIIFAKQILDIGDGVSPNSFIQLPPECILSNESDLIDEVYGDIFLKHNFNELKNHIILTPYNDLTDNYNEIALDKFPGKCVTYLSIDEVETSNNFPITPEIMNSFNSPGFPLHELKLKQNCKVMLMRNISIENGLCN

SEQ ID NO: 143333 - protein, 170 aa, Heterodera glycines
  Coding regions on vcDNA: vcDNA=SeqID_69756; Strand=+; Position=1-513
MEEQQYAVVVDEPDHYRIEQHFDEPMPEEYGDGGTIVHHEHVVEWEQHRSDESPPSDAVSAPAAEEAMQKSGTTTVTTVTTVTDSWSSSNGRGAEAETEGEEEKRLAHAQLAEQQHEEEEAEHKGGAGGTASTNGGHGRADEVGTPVPTEEDHHGHDDGHWHEQAEDRRD

SEQ ID NO: 143334 - protein, 66 aa, Heterodera glycines
  Coding regions on vcDNA: vcDNA=SeqID_69757; Strand=-; Position=1 -71,444-573
MAPPQKQRHFALRAPNAKIWTALFLFASSSLRYTIHQFKQNVKIANFTVEIRTRTLNGHLIKLVIF

SEQ ID NO: 143335 - protein, 49 aa, Heterodera glycines
  Coding regions on vcDNA: vcDNA=SeqID_69758; Strand=+; Position=1 -31,291-409
MSENPENIRIDVKPRICDLSAKEGGGKEASAERTERTMCECQQKLLLNL

SEQ ID NO: 143336 - protein, 106 aa, Heterodera glycines
  Coding regions on vcDNA: vcDNA=SeqID_69759; Strand=-; Position=1 -48,298-569
  Homolog annotation: Hit_ID=CAA33463.1; Match level="QueryCoverage =100%, HitCoverage=69%, E-value=3e-33, Identity=40%"; Hit description= twitchin [Caenorhabditis elegans]
ENWERLSSFVRNTNTLVSGLVENERYKFRVLAENQYGLSDPLELPEPIVAKYQFSVPSQPDKPVVRDFDRTWAELEWEPPASNGGSKILGYNLQYRDQHSHKWVSI

SEQ ID NO: 143337 - protein, 106 aa, Heterodera glycines
  Coding regions on vcDNA: vcDNA=SeqID_69760; Strand=+; Position=1-321
MIKLEIQYMQLKRMCDRHMNNCPCPETTTTTTTPMTTTTMSTTTTEQCEPAQPCQDDSPMICAHYAKLNQCNKPGVCVLIKRVFLPDPIRGKIANFVTVDTPNRMF

SEQ ID NO: 143338 - protein, 190 aa, Heterodera glycines
  Coding regions on vcDNA: vcDNA=SeqID_69761; Strand=+; Position=1-657
VFGAVPLNRCAQIYGETESFGNSFPIVCTLILRWSFAPHNCLSTPNGHLKKSIFFVFGAVPPNRCAQIYGETESFGNSFPIACTLILRWIFAPHNCLSTPNGHLKKSIFFVFGAVPPNRCAQIYGETESFGSSFPIACTLILRWIFAPHNCLSTPNGHLKKSIFLFSGQSPRTDAPRFMGRPNPSGVASL

SEQ ID NO: 143339 - protein, 64 aa, Heterodera glycines
  Coding regions on vcDNA: vcDNA=SeqID_69762; Strand=+; Position=1 -12,43-203,825-846
MSTFQNHNAEVVQQQQQQSQMAHLLATTPQQLQLNTFQLVFKSLKQRDEWRDVLWKAISLKKLA

SEQ ID NO: 143340 - protein, 22 aa, Heterodera glycines
  Coding regions on vcDNA: vcDNA=SeqID_69763; Strand=-; Position=1 -53,172-187
MCTPSSRRTRDACHDYSLMFLD

SEQ ID NO: 143341 - protein, 70 aa, Heterodera glycines
  Coding regions on vcDNA: vcDNA=SeqID_69764; Strand=-; Position=1-213
MCFTEPSTLIERAYFCTSALHRTRNVPSAVPYSNRRDSARSMTPKYHGCSTTFGLFLWKSTIALGKMPEN

SEQ ID NO: 143342 - protein, 142 aa, Heterodera glycines
  Coding regions on vcDNA: vcDNA=SeqID_69765; Strand=+; Position=1 -219,664-747,808-931
  Homolog annotation: Hit_ID=NP_509554.1; Match level="QueryCoverage =92%, HitCoverage=16%, E-value=3e-17, Identity=31%"; Hit description =mammalian VAV oncogene related VAV-1 (vav-1) [Caenorhabditis elegans]
AIVDFHKNNPNVVEQPWYFGVMDRAESRRLLYGTADGTFLVRWSAEVQKYALSISVDGSVKHMRLEYNAEMKNEAIHGLDVVLRGTPLKGTLYRAVAPFERTNGRAGYITLRPGDLVTLLDTADDDKGWWRGSVSNANGGTR

SEQ ID NO: 143343 - protein, 20 aa, Heterodera glycines
  Coding regions on vcDNA: vcDNA=SeqID_69766; Strand=-; Position=1 -39,408-431
MIIRFKLTVLSLLIKSDLKT

SEQ ID NO: 143344 - protein, 135 aa, Heterodera glycines
  Coding regions on vcDNA: vcDNA=SeqID_69767; Strand=+; Position=1 -168,367-500,774-882
  Homolog annotation: Hit_ID=CAE57918.1; Match level="QueryCoverage =85%, HitCoverage=22%, E-value=2e-37, Identity=68%"; Hit description =Hypothetical protein CBG00970 [Caenorhabditis briggsae]
FYFLFFLIFRRPQIVGTNSHCRHISTSAYRNNAKIFESAADAVRDIPSGATLLVGGFGLCGIPEHLIDAVAGSGVRELTCVSNNAGIDGVGLGILLRNGQVRKMISSYVGENAEFARQYLGGELELEFTPQGALN

SEQ ID NO: 143345 - protein, 57 aa, Heterodera glycines
  Coding regions on vcDNA: vcDNA=SeqID_69768; Strand=-; Position=1 -148,214-239
MPSPTPSMPALLLTQVNSRTPLPATASIRCSGMPQSPKPKKERILLMEMRPGRTRPT

SEQ ID NO: 143346 - protein, 23 aa, Heterodera glycines
  Coding regions on vcDNA: vcDNA=SeqID_69769; Strand=-; Position=1 -5,136-202
MNELEALSSDYEFDQIKYTLYFI

SEQ ID NO: 143347 - protein, 149 aa, Heterodera glycines; identical to SEQ ID NO: 136434
  misc_feature (138)..(138): Xaa can be any naturally occurring amino acid
  Coding regions on vcDNA: vcDNA=SeqID_69770; Strand=-; Position=1-454
  Homolog annotation: Hit_ID=AAP92584.1; Match level="QueryCoverage =80%, HitCoverage=24%, E-value=5e-34, Identity=63%"; Hit description =Ab2-057 [Rattus norvegicus] gb|AAP85373.1| Aa1262 [Rattus norvegicus] gb|AAP85367.1| Aa1011 [Rattus norveg

SEQ ID NO: 143348 - protein, 21 aa, Heterodera glycines
  Coding regions on vcDNA: vcDNA=SeqID_69771; Strand=+; Position=1 -54,579-590
MRTRPIWQVKQRLLTSQKKGF

SEQ ID NO: 143349 - protein, 151 aa, Heterodera glycines
  Coding regions on vcDNA: vcDNA=SeqID_69772; Strand=-; Position=1-677
LFEYPKRTLEKIDFFVFGAVSPNRCAQIYGETESFRNSFPIACTLILRWIFAPHNCLSTPNGHSLEKIDFFVFGAVPPNRCAQIYGETESFGNSFPIACTLILRWIFAPHNCLSTPNGHLKKSIFLFSGQSPRTDAPRFMGRPNPSGVASL

SEQ ID NO: 143350 - protein, 39 aa, Heterodera glycines
  Coding regions on vcDNA: vcDNA=SeqID_69773; Strand=+; Position=1 -48,348-419
MEKMKIYWQTKKENPKSFSELVIYFLKLLNLIALFDSAN

SEQ ID NO: 143351 - protein, 44 aa, Heterodera glycines
  Coding regions on vcDNA: vcDNA=SeqID_69774; Strand=+; Position=1-133
MVHYKLYYFDLTARGEPIRYLLHYAGQPFEDIRIKAEDWQTEKP

SEQ ID NO: 143352 - protein, 247 aa, Heterodera glycines
  Coding regions on vcDNA: vcDNA=SeqID_69775; Strand=+; Position=1 -86,349-731,787-949,993-1104
  Homolog annotation: Hit_ID=CAE67294.1; Match level="QueryCoverage =88%, HitCoverage=34%, E-value=2e-87, Identity=73%"; Hit description =Hypothetical protein CBG12746 [Caenorhabditis briggsae]
DDREEIEKQMEEEDKILQSVTQTSALATEMKLPRPIIAIMKEKKIVCPTVIQMQGIPVALSGRDMIGIASTGSGKTLTFVLPVIMFVMEQEIALRFKRGEGPYGLIIVPSRELAKQIYDVIMWISGALPSPDYPELRVGLCIGGFPIKDQAREFERGVHIAVATPGRLSDMLNKKIFNLQVCRYLVLDEADRMLDMGFEEELRSIFSYFKGQRQTLLFSATMPKKIQNFAKSTLVKAVVVNVGRAGA

SEQ ID NO: 143353 - protein, 26 aa, Heterodera glycines
  Coding regions on vcDNA: vcDNA=SeqID_69776; Strand=+; Position=1-77
TSRPRSIQWYIAYMHFPTHSSECSLV

SEQ ID NO: 143354 - protein, 980 aa, Heterodera glycines
  Coding regions on vcDNA: vcDNA=SeqID_69777; Strand=-; Position=1 -43,192-268,321-470,730-802,836-973,1032-1107,1161-1292,1344 -1399,1464-1530,1578-1869,1936-2234,2281-2362,2469-2559,2605 -3020,3068-3204,3257-3320,3373-3449,3492-3510
  Homolog annotation: Hit_ID=NP_741329.1; Match level="QueryCoverage =100%, HitCoverage=100%, E-value=0.0, Identity=59%"; Hit description =EGg Laying defective EGL-4, ODoRant response abnormal ODR-9, Cyclic GMP-dependent Kinase (84.5 kD) (egl-4
VYNAQKHHKIPIYNNSLAFQVQIGSRVYDAQELQKLIPQMEDQLEKKDRQLRQNQKEMEDQLEKKDRQLRQNQKEMDAQQKRIGELEVEVKGLSSECDKLRSVLNQKAESAATSASQKRSGEPHRDEAGCDLQKAALLPEFGQGGTEVRAKKIAVSAGCDLQKAALLPEFGQGGTEVRAKKIAVSAEPTNLDQHKATLQHHTKSAGSSKQLIRDAVQKNDFLRQLAKEQIIELVECMFEMRARAGQWVIQLVECMFEMRARAGQWVIQEGEPGDRLFVIAEGQLQVSREGQSLGVLNPGVAMGELAILYNCVLNPGVAMGELAILYNCARTASIQAITDCVLFCLDRTASIQAITDCVLFCLDRSVFQMITMRLGMERHAQLMNFLHKITMRLGMERHAQLMNFLHKVEIFAALPEDRLSKMADVMDQDYYAAEHYIIREGEKGDTFFVINSGQVRITQSIEGELEPREVRILKQGEFFGEKALLGEEVRTANVIAMAPGVEVLTLDRESFLKLIGDLEPLLKQQRTYREEDIKRRSARTEKDSSRVSPTKTVPALEDEFSQILLRHLKRIATLGVGGFGRVELVCIIGVCIIGDKGRTFALKALKKKHIIDTRQQEHEHIFAERNIMMETRTDWIVRLYKTFRDSKYVYMLLEACLGGELWTTLYMLLEACLGGELWTTLRDRGHFDDYTARFYVACVLEGLEHLHRRNIVYRDLKPENCLLTTSGYLKLVDFGFAKKLASGRKTWTFCGTPEYVSPEIILNKGHDQAADYWALGIYICELMLGRPPFQASDPMKTYTLILKGIDALEIPNRRIGKTATALVKKLLKGIDALEIPNRRIGKTATALVKKLCRDNPGERLGSGSGGVNDIRKHRWFMGFDWDGLRSRTLKPPIWFMGFDWDGLRSRTLKPPIIPKVSNPADVSNFDNYPPDQDIPIPKVSNPADVSNFDNYPPDQDIPPDEFSGWDDGFPDEFSGWDDGF

SEQ ID NO: 143355 - protein, 74 aa, Heterodera glycines
  Coding regions on vcDNA: vcDNA=SeqID_69778; Strand=-; Position=1-348
ELETGNFKFADPVAGLEFKIFYRTGSGRINPANPAILHVKSAGSCAGLRILGNFKKFCINKKVFQSIKKYSNIF

SEQ ID NO: 143356 - protein, 51 aa, Heterodera glycines
  Coding regions on vcDNA: vcDNA=SeqID_69779; Strand=-; Position=1-238
ARGNIKGIFVFSDPENPKNPKLDSFCFYKFWTFRGFLLFWTFRGLDTLWGC

SEQ ID NO: 143357 - protein, 78 aa, Heterodera glycines
  Coding regions on vcDNA: vcDNA=SeqID_69780; Strand=+; Position=1 -93,286-429
MSCANVINPVPTVVRPESPGKGGNGAKTESRASGEEPANRAKMEGRVKAKLRKTAEKNTFLGENGTTGKTGKVMEEKG

SEQ ID NO: 143358 - protein, 87 aa, Heterodera glycines; identical to SEQ ID NO: 129152
  Coding regions on vcDNA: vcDNA=SeqID_69781; Strand=-; Position=1-810

SEQ ID NO: 143359 - protein, 210 aa, Heterodera glycines
  Coding regions on vcDNA: vcDNA=SeqID_69782; Strand=+; Position=1 -127,1260-1573,1957-2145
IHKQQKWLISPSAATADGVRPLGTAEPSANLQQCLQQCCARPDVYNLSLTDLILSLFLNWNLIISLPLDCSAISFSGFLPLSSDSGNSSTNGDDDTSSSASSSAANCALFECPAGANSECALTDATDAADQEGLLSVRLRRKDTQPPPTSSPTSNNNTSSAEQQDDEEDDGQSAENGGDQRHILSLGNDGTSTEDGTGGGTTAEQQHQQQ

SEQ ID NO: 143360 - protein, 96 aa, Heterodera glycines
  Coding regions on vcDNA: vcDNA=SeqID_69783; Strand=+; Position=1 -120,207-377
MEMEGQWQREEKRKRGREWDGERQTDDGLGRDGETASAHSILDEELGLKLSMLGLNGAKSAGAQLDPGVYFVENHSDGSLGEITGQIAVNRITEHE

SEQ ID NO: 143361 - protein, 16 aa, Heterodera glycines
  Coding regions on vcDNA: vcDNA=SeqID_69784; Strand=-; Position=1-49
EAIPEGFGLPINLGAS

SEQ ID NO: 143362 - protein, 62 aa, Heterodera glycines
  Coding regions on vcDNA: vcDNA=SeqID_69785; Strand=-; Position=1-190
  Homolog annotation: Hit_ID=BAB31776.1; Match level="QueryCoverage =64%, HitCoverage=8%, E-value=6e-14, Identity=68%"; Hit description =unnamed protein product [Mus musculus]
CCYQQTCCVSTVTTCRTCAVSYGGGGYGGGGYGGGGYGGGGYGGGGYGGGGYGGGCGGYGKK

SEQ ID NO: 143363 - protein, 105 aa, Heterodera glycines
  Coding regions on vcDNA: vcDNA=SeqID_69786; Strand=+; Position=1 -201,261-374
MDPQLLIREATFNKIAQKQAAAKYLATKKRREKDEQRMREFVRRAVTPPDFGQMDADAMVKLSDFMPAVPAQFDRSFRYETLTVPVKIASDGVYSSDDILIIGAQ

SEQ ID NO: 143364 - protein, 103 aa, Heterodera glycines
  Coding regions on vcDNA: vcDNA=SeqID_69787; Strand=+; Position=1 -93,481-549,1267-1360,1714-1769
MAHKNCVQSAFSHRCWPPPLGEKMVPAPAAATLFIAIICSNFNMNFPSRTRTQLLDEILRCAGVGVRLLVEAESVSDYSLSNLRGALFAIYYSAVYYMPTTDD

SEQ ID NO: 143365 - protein, 37 aa, Heterodera glycines
  Coding regions on vcDNA: vcDNA=SeqID_69788; Strand=-; Position=1-112
IKVNVEASNQVENALFMLNISKVVRRKKRHLPQNAVS

SEQ ID NO: 143366 - protein, 350 aa, Heterodera glycines
  Coding regions on vcDNA: vcDNA=SeqID_69789; Strand=+; Position=1 -65,111-195,231-423,467-582,727-1320
MLKQHVEDVVKAEQYAAWHVNKVKFELKRKMALKEEIHKMVGMLHQVKHSNSLDRDIEKAEKSFGNFYSDLANAPWLPEKREIQREFKKYDDELAKFREQIAEYINAISKIKSEAELHAKLPFKTFVYTLANYSKQSGKVCQLLKKEQKKAKQEQDTAIVEAAIESHGQRMEQESRNETIGEQRREDDKRNEANAIQQPQQFDMDTQNDIVVVGQQKLQRIVEVEENSPSDAEQMPQQLLMDRESQQHVFATPLPPVSAPRGCDDGDQQALFDFFGGEGGADQSATEGSFNFGSFMTTLAGPGAKKGPQKPQADGPGDSQSDFNFNAFLGKPDEFSKEVTEGGALFDFNF

SEQ ID NO: 143367 - protein, 74 aa, Heterodera glycines
  Coding regions on vcDNA: vcDNA=SeqID_69790; Strand=-; Position=1 -71,307-397,442-504
AFADNTDEIVFENYCFNAFLRTSASACTAQAHCSAHNPCCVVVDSGSVSHWSHPHSFTHIVPFVGGQIVREGIV

SEQ ID NO: 143368 - protein, 38 aa, Heterodera glycines
  Coding regions on vcDNA: vcDNA=SeqID_69791; Strand=+; Position=1 -57,416-475
MDLPDNALAHNLSPNKWHNAMKKHKFSSPDVRRKALKQ

SEQ ID NO: 143369 - protein, 31 aa, Heterodera glycines
  Coding regions on vcDNA: vcDNA=SeqID_69792; Strand=-; Position=1-93
MFAVVLGVNQATRVHFRTRPAQGKQRAVVEP

SEQ ID NO: 143370 - protein, 76 aa, Heterodera glycines
  Coding regions on vcDNA: vcDNA=SeqID_69793; Strand=+; Position=1 -57,301-471
  Homolog annotation: Hit_ID=NP_505666.1; Match level="QueryCoverage =98%, HitCoverage=7%, E-value=5e-13, Identity=46%"; Hit description =udp-glucuronosyltransferase family member (5K853) [Caenorhabditis elegans] emb|CAA94866.1| Hypothetical pr
MVNIGGIGMDKLDKNAKLEEPFKSEMSKGKEGVVFVSMGTIIRSSDLPAKFRQNLLETFAKFSDYHFIMRIEKGDN

SEQ ID NO: 143371 - protein, 149 aa, Heterodera glycines
  Coding regions on vcDNA: vcDNA=SeqID_69794; Strand=-; Position=1 -108,595-936
MVQTIQAMNSFAFSVDPLDDDEQAAMAQAFQTDIQDAVERMNSDAGMAAMAVAMFEAQQRGQHDELFLGASASGGGQPQQQQAVHGTAAGGADRHDITTTSTTAQRQQQQNSEQEEEEIRRRRQQMVSIGKPGAAARRKKDMVIQTDRQ

SEQ ID NO: 143372 - protein, 76 aa, Heterodera glycines
  Coding regions on vcDNA: vcDNA=SeqID_69795; Strand=+; Position=1 -73,128-285
  Homolog annotation: Hit_ID=NP_498785.1; Match level="QueryCoverage =98%, HitCoverage=3%, E-value=3e-29, Identity=74%"; Hit description =yeast splicing factor PRP related (prp-8) [Caenorhabditis elegans] gb|AAA27977.1| Yeast prp (splicing fact
MLLSDRFLGYFMVPSAGVWNYNFMGVRHDANMQYDVCLSAPKEFYHEDHRPLHFHNFNVFEDPLGVSTADREDIFE

SEQ ID NO: 143373 - protein, 85 aa, Heterodera glycines
  Coding regions on vcDNA: vcDNA=SeqID_69796; Strand=+; Position=1 -30,90-315
  Homolog annotation: Hit_ID=EAL25833.1; Match level="QueryCoverage =94%, HitCoverage=11%, E-value=4e-17, Identity=52%"; Hit description =GA21511-PA [Drosophila pseudoobscura]
MQPQSKRKIQVSFLIRNGSVESKHRGFVNALQFDPTTRSLFSAGSDSVIRQWDTSAPSGSAAFLRSLEHHCDWVNDIVLCSDGTR

SEQ ID NO: 143374 - protein, 35 aa, Heterodera glycines
  Coding regions on vcDNA: vcDNA=SeqID_69797; Strand=+; Position=1-106
WLARHTLCVLRVDKHAPFLRVCHTLTMVSEEAEIT

SEQ ID NO: 143375 - protein, 533 aa, Heterodera glycines
  misc_feature (502)..(502): Xaa can be any naturally occurring amino acid
  misc_feature (519)..(519): Xaa can be any naturally occurring amino acid
  Coding regions on vcDNA: vcDNA=SeqID_69798; Strand=+; Position=1 -40,88-542,659-869,950-1043,1095-1221,1292-1394,1441-1529,1598 -1666,1712-1784,1840-1929
  Homolog annotation: Hit_ID=NP_497931.2; Match level="QueryCoverage =100%, HitCoverage=67%, E-value=1e-101, Identity=39%"; Hit description=WD repeat endosomal protein (76.3 kD) (3F671) [Caenorhabditis elegans] emb|CAA86338.2| Hypothetical pro
NIRAISVNRDGTCLSGSSDGTVKCLSGSSDGTVKLWSIGQQRCIGTIRCHSDSVWALQTDSVFATVFSGGRDHRVFRTPLRNLNDSELLFTEGKPVQKLLMVDTDQPKHLWTATWDSSIRRWPIDGKETERTEEGPRVREADMTLQGEKGAAGNCPMGGGDNKRKNFEKKDFLLPGAPSIRKYAVLNDKRQIVTRDSDGNVELWDVMQCGRVNTFPMGTNMEEVIKDNVRKVWIPSWFGVDAKCGVLEITLDESDAFSAWVSARDAGFTDKANDAKVNYGGLLLRSLFNYGGLLLRSLFEHWPAYVGDDEDSPLQGFYSLPLHTPILIRDDIARPLFRTTVHDTASQADSAMLRDVLPSWVLQVVELNHFPKFVVELNHFPKFNKIPFYLQPHCSFIPKFPVKDRLSATEMLQLRKVMEHDRLSATEMLQLRKVMEHVWEKILAAHSLATQLQENIEERIELAAHSLATQLQENIEERIELFCNEQKLDSEMDLRTVKHLIXKKLDSEMDLRTVKHLIXKQGGDLLIFYRPEK

SEQ ID NO: 143376 - protein, 200 aa, Heterodera glycines
  misc_feature (84)..(84): Xaa can be any naturally occurring amino acid
  misc_feature (143)..(143): Xaa can be any naturally occurring amino acid
  misc_feature (174)..(174): Xaa can be any naturally occurring amino acid
  misc_feature (188)..(188): Xaa can be any naturally occurring amino acid
  Coding regions on vcDNA: vcDNA=SeqID_69799; Strand=-; Position=1-621
  Homolog annotation: Hit_ID=EAA16792.1; Match level="QueryCoverage =100%, HitCoverage=17%, E-value=2e-31, Identity=42%"; Hit description= ookinete protein-related [Plasmodium yoelii yoelii]
GNGRRTGGGEMESKGNGGSGGGLNGTTNGEWHGSRGGLNGGQPMGNGGNRGGLNGGQPMGNGGSRGGLNGGQPMGNGTGTEEGXMGDKGNGTSRGGLNGTTNGEWHGSRGGLNGGQPMGNGTGAEEGNGGQPMGNGTGTEEGXMGDNNGEWHGSRGGLNGGQPMGNGTGTEEGXKGDKGNGTGAEEGXGGQPMGNGTGTE

SEQ ID NO: 143377 - protein, 200 aa, Heterodera glycines
  Coding regions on vcDNA: vcDNA=SeqID_69800; Strand=+; Position=1-602
  Homolog annotation: Hit_ID=XP_354882.2; Match level="QueryCoverage =91%, HitCoverage=22%, E-value=4e-19, Identity=35%"; Hit description =similar to hypothetical protein DKFZp434J0113 [Mus musculus]
MGLNPTAFQSLGLNPPTFQSLVLNPPTFQSLGLNSPTFQSLGLNPTAFQSLGLNPTAFQSLVLNPPTFQSLGLNPPAFQSLGLNPPTFQSLGLNPPAFQSLGLNPPTFQSLGLNPPAFQSLELNPPTFQSLGLNPPTFQSLVLNPPAFQSLALNSPAFQSLGLNPPAFQSLGLNPTAFPITGTQPTSIPNHWDSTQHHFN

SEQ ID NO: 143378 - protein, 80 aa, Heterodera glycines
  Coding regions on vcDNA: vcDNA=SeqID_69801; Strand=+; Position=1 -73,467-546,1198-1285
GGNDYEIFEHSDTVGHTVTSPDNCRRLRSKYKEGPTLLNLPDRTGWRTFNVDVSVPSTKKAQRCLTCQIGRDGVLSTWYG

SEQ ID NO: 143379 - protein, 35 aa, Heterodera glycines
  Coding regions on vcDNA: vcDNA=SeqID_69802; Strand=+; Position=1-107
MIGRAVRNRPFIFEGIFIFRLYPRKMAISFFEKFY

SEQ ID NO: 143380 - protein, 97 aa, Heterodera glycines
  Coding regions on vcDNA: vcDNA=SeqID_69803; Strand=+; Position=1-304
MIGRAVRNRPFIFEGIFKFILYPRKMAISFFEKFYTSQKRLRMRRRAVHNRHFISQRIFIFRGYPRKMAISFFDKFYTHTNALEHDREGGAQFTFYF

SEQ ID NO: 143381 - protein, 55 aa, Heterodera glycines
  Coding regions on vcDNA: vcDNA=SeqID_69804; Strand=+; Position=1-255
IYLLSQKNGYFFFEKFYPSQKRLRMRRRGCAQSAFYFTEDFYIKRLSQKNGYLFF

SEQ ID NO: 143382 - protein, 97 aa, Heterodera glycines
  Coding regions on vcDNA: vcDNA=SeqID_69805; Strand=-; Position=1 -133,178-338
  Homolog annotation: Hit_ID=NP_503721.1; Match level="QueryCoverage =82%, HitCoverage=15%, E-value=8e-13, Identity=40%"; Hit description =transposase family member (5D107) [Caenorhabditis elegans] ref|NP _503720.1| transposase family member (5D
MSNEAEKEFTSAGNPKAPALHVTLDWIHRSWQEISKEVIIKAFKVCGLTTPLDGTEDEKIACFKPEGAIGPIEILREFRGNETMKDGRNDQEEGRPI

SEQ ID NO: 143383 - protein, 26 aa, Heterodera glycines
  Coding regions on vcDNA: vcDNA=SeqID_69806; Strand=-; Position=1 -78,209-211
MRNAKRQKMQIMRKAKCEKRNLGPSL

SEQ ID NO: 143384 - protein, 54 aa, Heterodera glycines
  Coding regions on vcDNA: vcDNA=SeqID_69807; Strand=-; Position=1 -45,288-407
MTNSTHFVVKISKIKLHGTGNFDKNRDRDLPVQKSQDRDLDFRPGLGPTGNFHK

SEQ ID NO: 143385 - protein, 43 aa, Heterodera glycines
  Coding regions on vcDNA: vcDNA=SeqID_69808; Strand=-; Position=1 -12,89-208
MGVWHLFICISGQVAKPSDFIISRLGSIPHLDRIFFIFSLPLF

SEQ ID NO: 143386 - protein, 97 aa, Heterodera glycines
  Coding regions on vcDNA: vcDNA=SeqID_69809; Strand=+; Position=1 -93,155-355
MQQQKQDAQMARRELEVYKQMARRELEDSERDRDALGKQLRTLNTEMESLKNELKKEQEQSQRMEFEMRKVRGENSTLRQRVEDEREEKEAEIAMEK

SEQ ID NO: 143387 - protein, 120 aa, Heterodera glycines
  Coding regions on vcDNA: vcDNA=SeqID_69810; Strand=+; Position=1 -257,469-574
  Homolog annotation: Hit_ID=CAE59383.1; Match level="QueryCoverage =58%, HitCoverage=35%, E-value=1e-09, Identity=44%"; Hit description =Hypothetical protein CBG02739 [Caenorhabditis briggsae]
MRRSIKICKSDNTYRERKRWTPLKRETERKRERETDRHTDRDRKRANKRKKKRQTDKEGERKRETYRKTEMAKIGRRDERRTERHHFTELSSTKFFLKKSSAKKRCENKKVNSYVIPSFY

SEQ ID NO: 143388 - protein, 24 aa, Heterodera glycines
  Coding regions on vcDNA: vcDNA=SeqID_69811; Strand=+; Position=1-80
RTLSTAVRQRSSKIYSMPQILWAG

SEQ ID NO: 143389 - protein, 72 aa, Heterodera glycines
  Coding regions on vcDNA: vcDNA=SeqID_69812; Strand=-; Position=1 -30,310-498
MRAVHTEWVQRLSAAVPLNLPSVAVSLPFCRVANAPIRGPMFELSTKKCPAKHWTKLRPFLSVVSPHQKGAL

SEQ ID NO: 143390 - protein, 58 aa, Heterodera glycines
  Coding regions on vcDNA: vcDNA=SeqID_69813; Strand=+; Position=1 -76,379-479
MFSSLTKLTTSDEAIINEFLAFDNIRSTGDNSSGYVNDPQLSTSTVENIFEVFLSKLI

SEQ ID NO: 143391 - protein, 162 aa, Heterodera glycines
  Coding regions on vcDNA: vcDNA=SeqID_69814; Strand=+; Position=1 -143,387-459,589-861
  Homolog annotation: Hit_ID=CAE67311.1; Match level="QueryCoverage =82%, HitCoverage=37%, E-value=3e-18, Identity=38%"; Hit description =Hypothetical protein CBG12766 [Caenorhabditis briggsae]
MDEEAREQKIKELIAMTEETHRKRAERKRQRNEEEAEERRRLNRVRARMGLEPIPSSEDEEEEQKGAAEATELDVSAIPLPPSSPEAKTTKEPEQKKQRFGVREWDRGKIGCMRWAEEQRDEREDEFAPPSFYYGEENDARGEEETQKLKLKRMNGPFGKII

SEQ ID NO: 143392 - protein, 174 aa, Heterodera glycines
  Coding regions on vcDNA: vcDNA=SeqID_69815; Strand=+; Position=1 -120,178-582
MPFTSFYIFCCRSFTYCLGKNFSKELFILIVSPINCQNGKPIWDVVISEIWPIFATSICQLRFAGGDYLDKLRRHISPTLLTDLDQLNSIDSCGLCPDEIADDGPNATSGQALSKWLHIPTKNGQPKRFRCLDYYSQPGMNWINNFMIIMYFMKKNRNYMWVYLNKFGVTLQEF

SEQ ID NO: 143393 - protein, 23 aa, Heterodera glycines
  Coding regions on vcDNA: vcDNA=SeqID_69816; Strand=-; Position=1-71
IIMYFMKKNRNYMWVYLNKFGVT

SEQ ID NO: 143394 - protein, 64 aa, Heterodera glycines
  Coding regions on vcDNA: vcDNA=SeqID_69817; Strand=-; Position=1 -34,753-913
MTDFYRISRENELNFIQQIELLHSYEFYSKRKESVANGQAYVFSLADQQPKQKRTSEITVIELC

SEQ ID NO: 143395 - protein, 21 aa, Heterodera glycines
  Coding regions on vcDNA: vcDNA=SeqID_69818; Strand=-; Position=1 -29,74-110
MGTRGAVSAEYFLRQGYNVIL

SEQ ID NO: 143396 - protein, 21 aa, Heterodera glycines
  Coding regions on vcDNA: vcDNA=SeqID_69819; Strand=-; Position=1 -16,82-131
MSARRGTMIHFPKINNKNTKT

SEQ ID NO: 143397 - protein, 104 aa, Heterodera glycines
  Coding regions on vcDNA: vcDNA=SeqID_69820; Strand=-; Position=1 -105,160-369
MATAKQMAAAANARRVKNAKLAAKKSRAAVGRAGNVVKAQARPKCAKCEKGGRKRLRKKSRADMCSTAGASSVTLPQQFAAQHATKGLWRNSSKGKNESDDQKM

SEQ ID NO: 143398 - protein, 79 aa, Heterodera glycines
  Coding regions on vcDNA: vcDNA=SeqID_69821; Strand=+; Position=1 -101,164-300
MRDLEDQEEQAKVRLGDRVVRRSVHFQIDFHPINIIIAGDACYASVDLHYINMITKIFGQNESSLCGVAVHVISIAAGK

SEQ ID NO: 143399 - protein, 32 aa, Heterodera glycines
  Coding regions on vcDNA: vcDNA=SeqID_69822; Strand=-; Position=1 -66,136-165
IGRDNNMRRVKSICAPRKGTKPILCHFIVVEN

SEQ ID NO: 143400 - protein, 98 aa, Heterodera glycines
  Coding regions on vcDNA: vcDNA=SeqID_69823; Strand=+; Position=1 -161,328-463
  Homolog annotation: Hit_ID=XP_392534.1; Match level="QueryCoverage =96%, HitCoverage=43%, E-value=1e-12, Identity=36%"; Hit description =similar to ENSANGP00000020529 [Apis mellifera]
AIFITFGLSGFPIGCTPGKYLLGLRVISCLDVQPIVGSSDRVMVTCMPSVGFRSSLTRAVIKNMLTTFLFPLSTAFYLFNHNRAIYDLAAKTMVISLV

SEQ ID NO: 143401 - protein, 115 aa, Heterodera glycines
  Coding regions on vcDNA: vcDNA=SeqID_69824; Strand=+; Position=1 -241,590-696
MALLEMGCGQQLQPPLGPADGEGAAEEEAAAGTGGVATTSATMALFGFYHPPATAPQQLTTTVPPPTALQHNANQHQHHYGIFGSDSAAIFGLIVKRFSPMQILLFLNGNKITNK

SEQ ID NO: 143402 - protein, 120 aa, Heterodera glycines
  Coding regions on vcDNA: vcDNA=SeqID_69825; Strand=-; Position=1-363
MDSNLRHSKHWDSLNPPTFNDIPISGTQPTTFQSLRLNYLTFQSLGLNPPAFHWTQSTNIPITGTQSTNISITGTQSTNIPFNGTQPTNIPITGTQPTSISISGTQISGIPNNGLKSPAF

SEQ ID NO: 143403 - protein, 75 aa, Heterodera glycines
  Coding regions on vcDNA: vcDNA=SeqID_69826; Strand=+; Position=1 -150,454-531
  Homolog annotation: Hit_ID=CAG11079.1; Match level="QueryCoverage =65%, HitCoverage=6%, E-value=5e-09, Identity=59%"; Hit description =unnamed protein product [Tetraodon nigroviridis]
DRVVPLHTLKYVAQLYHLLRTEASEWQRRPVLARIETKAGHGAGKPTTKTATMGTITKALIELYNNTKKNTRDSD

SEQ ID NO: 143404 - protein, 95 aa, Heterodera glycines
  Coding regions on vcDNA: vcDNA=SeqID_69827; Strand=-; Position=1-308
NKEKDTHFHINRITFCTTSQNQITPLSIQVRAPAAKNSTNRQVRRSEQKAAQRVSVACFPKRILRYRFGGWLAGSVPRLCLNARQHRPPLPFACL

SEQ ID NO: 143405 - protein, 122 aa, Heterodera glycines
  Coding regions on vcDNA: vcDNA=SeqID_69828; Strand=+; Position=1 -141,777-1001
  Homolog annotation: Hit_ID=CAE64963.1; Match level="QueryCoverage =72%, HitCoverage=15%, E-value=4e-20, Identity=51%"; Hit description =Hypothetical protein CBG09797 [Caenorhabditis briggsae]
MAQRAQLHPLALMLPTTLACSFAFVLPVGTPPNALAIGSGLLRVSDLMLSGLAVSAASALLTIAYLSTFAPLILPIDCFPEWAAVTTATAFDANGTTLIAEGAAEEMGGIAALGRLIMAEEA

SEQ ID NO: 143406 - protein, 45 aa, Heterodera glycines; identical to SEQ ID NO: 124527
  Coding regions on vcDNA: vcDNA=SeqID_69829; Strand=+; Position=1-138

SEQ ID NO: 143407 - protein, 76 aa, Heterodera glycines
  Coding regions on vcDNA: vcDNA=SeqID_69830; Strand=-; Position=1-230
MAAPKWPRQNGRAKMDAPKWTRQNGRAKMAAPKKLAPKKLAPKWADCEISTKKSRDDCEINRDITKKRTNRTVLID

SEQ ID NO: 143408 - protein, 245 aa, Heterodera glycines
  Coding regions on vcDNA: vcDNA=SeqID_69831; Strand=+; Position=1 -336,487-582,1210-1398,1690-1806
MDNNSNNGGGGNNGGRKPPPSRGRKRLHESSSNNSGSSSSNSANNFVDGDSSSTVRASNRPQQPQQQQQHNYNDLELLLIPGIDDVNSSALQPQQTQMVQRPIATGNGRQMVAVNSASHGTPVEGTLQNVDGGGGGGGVLSQRNCSIRRQQKQHSLVMQIDDDDEGEEQQDEQSRGSGGSDDGPAANFALSSAGTDAPRTETGASSTPWLSATRPPTPPPPRMDHRRRPTGGAPVMWTFPPRLLF

SEQ ID NO: 143409 - protein, 74 aa, Heterodera glycines
  Coding regions on vcDNA: vcDNA=SeqID_69832; Strand=+; Position=1-8,74- 153,402-538
MIRQAAHQIQKQNRRNTVISREPIFKLNKYRQIALSLSHYDNSTANDAQIAEAMDKAWQEQADAELARRLADQL

SEQ ID NO: 143410 - protein, 101 aa, Heterodera glycines
  Coding regions on vcDNA: vcDNA=SeqID_69833; Strand=+; Position=1-306
MGMELEQEQQQQEEQEEEEEGDQMMALTIDHSDDEGEEEEKPEKERDSNVEEADTNSAKFDDNNGTIAADNGTNGNNNPLRLLISAVEEQQRQQQRDNNDL

SEQ ID NO: 143411 - protein, 127 aa, Heterodera glycines
  Coding regions on vcDNA: vcDNA=SeqID_69834; Strand=-; Position=1-612
  Homolog annotation: Hit_ID=A39652; Match level="QueryCoverage=71%, HitCoverage=16%, E-value=2e-10, Identity=36%"; Hit description=Hobo element transposase HFL1 - fruit fly (Drosophila melanogaster)
IIGQLENKRRTSVCFCNRFCSKHAKGKKKLIPTQSEIKAFTEVDENFNKILPFSDPFEWWKKHGPKLPMLSKLAMKYLSAPATSVPSEQTFKVARDVYDYRRSRLKPKTAEMLIFLNKAIPMLDYKY

SEQ ID NO: 143412 - protein, 63 aa, Heterodera glycines
  Coding regions on vcDNA: vcDNA=SeqID_69835; Strand=+; Position=1 -21,579-749
MAPISDKGCLRNVRAGPLPPLIFHSLQKVPRMADAMAQAHLTHFELQHHENVVPSGCQSSNVW

SEQ ID NO: 143413 - protein, 243 aa, Heterodera glycines
  Coding regions on vcDNA: vcDNA=SeqID_69836; Strand=-; Position=1 -51,95-356,405-723,768-864
  Homolog annotation: Hit_ID=NP_507780.1; Match level="QueryCoverage =98%, HitCoverage=18%, E-value=1e-27, Identity=31%"; Hit description =predicted CDS, DNA polymerase type B, organellar and viral family member (5T899) [Caenorhabditis elegans]
MPIEEKEKKDVYRIVVWDSETSQDTIYKGDQKEHVINYISVRVTCTECCDDKNRTNCKICGEERIKDWSEAEGHEPTKDFVEWILTAFTNYDTYIFAHNAGRFDGHFVFNYLCRTGKNPLPLINGLKIYEFKVQNSKKHSKLIWRDSCLLMPVKLESLKATFNLDCEDKPFFPYYYNKKENYGIRLEHLPPMEDYSPGSMNKDKFIKFEKWYNENKETPFYLDEELRNYCRNDTEILLLSLLE

SEQ ID NO: 143414 - protein, 106 aa, Heterodera glycines
  Coding regions on vcDNA: vcDNA=SeqID_69837; Strand=+; Position=1 -193,247-374
  Homolog annotation: Hit_ID=CAE59092.1; Match level="QueryCoverage =78%, HitCoverage=31%, E-value=3e-21, Identity=54%"; Hit description =Hypothetical protein CBG02384 [Caenorhabditis briggsae]
MSNVALFSVLGELALPGGMLNKGEPPTEAAVREFSEEAMGGHRREDKLEHFWKKGKTVYQGYVDDHRNTDNAWGETTAVNFHDTDGLLEDIELEVEQTHFRDKDTD

SEQ ID NO: 143415 - protein, 76 aa, Heterodera glycines
  Coding regions on vcDNA: vcDNA=SeqID_69838; Strand=+; Position=1-230
MPPISLFEWTFDADGKQTYDVSYVDGANVPISVRVLNCPGVNFNKKLGNSLDTLVDQLPDAMKMDVFGVRFIGTIR

SEQ ID NO: 143416 - protein, 203 aa, Heterodera glycines
  Coding regions on vcDNA: vcDNA=SeqID_69839; Strand=+; Position=1 -57,115-302,316-682
MSVLANRSAVFWAQPTLTTINSVDRSVGSEFADDFDQSNPSFVHLSITVVLTHPVALTFFVDFLNEVGGQNYIDFYLAIEVCSASHLVVSTGFQRVHGASVEGVGLGRHFGQRRAGDNSRSGSLHVPSVSVTGSEPLNKFGLQKTKMTQAITRVPLSEAIVNKFLARLRNDEPSDGWFEQIQEQANKPSPKRNPMPILIMNTP

SEQ ID NO: 143417 - protein, 130 aa, Heterodera glycines
  Coding regions on vcDNA: vcDNA=SeqID_69840; Strand=-; Position=1 -121,169-321,369-502
  Homolog annotation: Hit_ID=CAE57463.1; Match level="QueryCoverage =59%, HitCoverage=8%, E-value=2e-21, Identity=62%"; Hit description =Hypothetical protein CBG00428 [Caenorhabditis briggsae]
GFNVSMEHQLRGLASGDTLDSDARETIREAALFMYHQYLSQEVNLRVPLSEAIVNKFLARLRNDEPSDGWFEQIQEQANKPSPKRNPMPILIMNTPFKRHALYGRMLDQLGITTGGSEVAAESAESGAAQ

SEQ ID NO: 143418 - protein, 88 aa, Heterodera glycines
  Coding regions on vcDNA: vcDNA=SeqID_69841; Strand=+; Position=1-793
NDQPVFSRISCQYFPIRNDTVNSFASLIFIRALLRISLKISGRQFYILAIFYFISDRKFLHTSHFLFYCDQAYLSSYFWDFFQNVVIE

SEQ ID NO: 143419 - protein, 77 aa, Heterodera glycines
  Coding regions on vcDNA: vcDNA=SeqID_69842; Strand=-; Position=1-234
MTPTRSYCLPFLHKLLTIKSINKVTHVPVERAELGFGLPSLRIPIIVMRGSWGDQSHFPPKSNSMLGMALFQEKHGK

SEQ ID NO: 143420 - protein, 177 aa, Heterodera glycines
  Coding regions on vcDNA: vcDNA=SeqID_69843; Strand=+; Position=1 -27,605-694,747-887,932-1060
  Homolog annotation: Hit_ID=CAE63705.1; Match level="QueryCoverage =95%, HitCoverage=19%, E-value=6e-34, Identity=44%"; Hit description =Hypothetical protein CBG08220 [Caenorhabditis briggsae]
ATAIGLGNKYAIPYAQLLLEPVFVCFSDTDSRVRYFACEALYNIVKIIKMAALDHFALYNIVKIIKMAALDHFDQLFDILWKLSSDPDQNVRNGSELLDRLVKEIVVSKNDFELETLIEIVVSKNDFELETLILLIRERIYSVNSSNRRFIISWVITNTSSEFLLNCNFCLGANFQK

SEQ ID NO: 143421 - protein, 187 aa, Heterodera glycines
  Coding regions on vcDNA: vcDNA=SeqID_69844; Strand=+; Position=1 -301,344-498,737-844
  Homolog annotation: Hit_ID=XP_316911.1; Match level="QueryCoverage =78%, HitCoverage=13%, E-value=7e-17, Identity=34%"; Hit description =ENSANGP00000006552 [Anopheles gambiae]
MEELLAVFQFHCHPNLRGAPGQYPMAFPCHGRISDQKEGTLSMQIEKLSEFAREEVNSRRLSKHFYTKGLPWKILAKIKTKENSTEKWLGFYLLCTAPKQDGNWSCKWSCKCSATLRIASQDSVTEDLIRKYDHVFNNEVDKWGFSNFIAFTQLMDPSKGFYDKNEDKVTLAIDLTVEEEKGELADE

SEQ ID NO: 143422 - protein, 177 aa, Heterodera glycines
  Coding regions on vcDNA: vcDNA=SeqID_69845; Strand=+; Position=1 -268,314-423,535-690
  Homolog annotation: Hit_ID=CAF99808.1; Match level="QueryCoverage =73%, HitCoverage=26%, E-value=2e-13, Identity=34%"; Hit description =unnamed protein product [Tetraodon nigroviridis]
MFLDPGLRTTGKWSHKSIIKKINQILLIILISFQLTLLIAIIISQLASANCPVEVTDVEVAAFKVMLSFIYTGDLAKLNGYNAMAVLYAAKKYNIPGLVDASLQVPISSLRNVFLAYAQAGLFELENFANDCLAYIDRNADDLFKSDAFLQIDQKLLCEILGHDELQSMEKFSFGKQ

SEQ ID NO: 143423 - protein, 140 aa, Heterodera glycines
  Coding regions on vcDNA: vcDNA=SeqID_69846; Strand=+; Position=1 -181,230-369,420-521
  Homolog annotation: Hit_ID=AAQ74888.1; Match level="QueryCoverage =90%, HitCoverage=11%, E-value=6e-11, Identity=34%"; Hit description =UBP [Gallus gallus] ref|NP_989802.1| UBP [Gallus gallus]
MEIEKVSEFSREIFLSERKSKTVHINGLPWKIWTKIEKKNESTGNEKCFGFYLWCDAPKEENWSCKCSAIFRIVSQKSDVADFRRVFDAHVFDSKKNSWGYCFISFAELMDPSKVLYNKEEDKVTLAIDVTVKEAKTEDK

SEQ ID NO: 143424 - protein, 16 aa, Heterodera glycines
  Coding regions on vcDNA: vcDNA=SeqID_69847; Strand=-; Position=1-49
EAIPEGFGLPINLGAS

SEQ ID NO: 143425 - protein, 71 aa, Heterodera glycines
  Coding regions on vcDNA: vcDNA=SeqID_69848; Strand=-; Position=1-213
MNGEGTDGGETAERVKTKKKVRRVKMDFAEQINKLVQNEGEQQLKKKKKRKIVEENGEEKKSKKMKKKKSK

SEQ ID NO: 143426 - protein, 112 aa, Heterodera glycines
  Coding regions on vcDNA: vcDNA=SeqID_69849; Strand=-; Position=1 -139,349-548
MVTSGGQRVLDVVGGGVQKGLIARVPSAAFHPSRLLHSAEHLEKKDLILNTQFCVQHLCCLDTGQHTLLLQVVHLHRVRVLQQQQPRASIENVVDGTRVFNLDQLVINIRFK

SEQ ID NO: 143427 - protein, 78 aa, Heterodera glycines
  Coding regions on vcDNA: vcDNA=SeqID_69850; Strand=+; Position=1 -71,980-1143
  Homolog annotation: Hit_ID=NP_001003882.1; Match level="QueryCoverage= 57%, HitCoverage=8%, E-value=6e-11, Identity=68%"; Hit description =seryl-tRNA synthetase [Danio rerio] gb|AAH81608.1| Seryl-tRNA synthetase [Danio rerio] gb|AAT68157.1| s
MASALILAGLGIAAAGFTGRYMISNNLLFRITKMVLNIDLFREEKGGDPEQIRKSQVGRFADVSLVDKVISADSEWRK

SEQ ID NO: 143428 - protein, 350 aa, Heterodera glycines
  Coding regions on vcDNA: vcDNA=SeqID_69851; Strand=-; Position=1-1052
  Homolog annotation: Hit_ID=NP_920205.1; Match level="QueryCoverage =91%, HitCoverage=21%, E-value=3e-35, Identity=32%"; Hit description =putative DNA helicase homolog [Oryza sativa (japonica cultivar -group)] gb|AAP52492.1| putative DNA helica
MHREIRETMHMQLHRCSDSWCGPSDPIYGRCKKGFPAPYSKCTVLRPDRPAMYFRPSPSDGGAQLEVNGLIYDNSHVVPYNPYVLLRYRVHHNVLFAYGNKANIKYALKYPFKGPGHCYVECKEESGNKIGIDEPAQYAKMNFRGATEAYAIVHSMPFARLSHHVVKLAIHLPNQQPIVYRAFQLVSKAQQIQQGELPETHCSAYWKQWQNEWKNDPKFKDILFEKVPEQFRWAKDKWVLYKRQQIKRPPIGRIVPVPPSDPERFALYSLMRHFPGDPDHLKMVNGLLCTSFTEAAIMHGLLEDGKIWDKTLAEAALSRWPDQMRWLFVSIMVYGQPSNAIELWNKYKDQ

SEQ ID NO: 143429 - protein, 116 aa, Heterodera glycines; identical to SEQ ID NO: 127487
  Coding regions on vcDNA: vcDNA=SeqID_69852; Strand=+; Position=1-351

SEQ ID NO: 143430 - protein, 53 aa, Heterodera glycines
  misc_feature (28)..(28): Xaa can be any naturally occurring amino acid
  Coding regions on vcDNA: vcDNA=SeqID_69853; Strand=-; Position=1-160
SREGARPVQLAVPTHLYVSGVGCLGSQXKSGGKLHLRLNTATSPIANKYREGK

SEQ ID NO: 143431 - protein, 175 aa, Heterodera glycines
  Coding regions on vcDNA: vcDNA=SeqID_69854; Strand=+; Position=1-529
  Homolog annotation: Hit_ID=CAC84371.1; Match level="QueryCoverage =97%, HitCoverage=49%, E-value=4e-21, Identity=34%"; Hit description =hypothetical protein [Saimiriine herpesvirus 2]
GTEAVTESGRGTESGRESGRGTESGRGTVRESGRGTERGRGIESGRETESGRESGTENGRESGTENGRGTESGRRSGRATDVEEKVEEEQKVEEKVEEEQKVEEEVEDEQKVEEEVEEEQKVEEEQKVEEKVEEKQKVEEKVEEEQKVEEEQKKQQRERGRNKKRREQEKARVMK

SEQ ID NO: 143432 - protein, 63 aa, Heterodera glycines
  Coding regions on vcDNA: vcDNA=SeqID_69855; Strand=-; Position=1 -120,382-767
FLADLKLSIACRFSAQQSTNTVFDSLQKNNSLPKSFLQPLIANLISCRFKAIHCLPVLGTAKH

SEQ ID NO: 143433 - protein, 897 aa, Heterodera glycines
  Coding regions on vcDNA: vcDNA=SeqID_69856; Strand=+; Position=1-2693
  Homolog annotation: Hit_ID=CAA82797.1; Match level="QueryCoverage =62%, HitCoverage=75%, E-value=4e-43, Identity=26%"; Hit description =gag protein [Ascaris lumbricoides]
MAAPIQQKLGAALKVLSRSRTAAELNIQADQAASNLENALNFEIQLEKVQKDAKTMDIFLDDVREALTAWADLLRKLPALERDPAEADFNKFEKKERINDKVDEAALKLRDLRDLIGTLTFQARLFRSKADKEERDAQAAYAQATQHTAQQQTTKTPSFTPPFYQFQPIQLDKFFGNKRKWPEFYESFKSAIGTHALSKAEKFNLLRNLLGGEARELVAGFRLEDNNYDTALQLLKDTYGAPDEHIRALHFELANLKPCKNLRDTKEFLLQLERLTRELNNSGEDIEGPPTFLMLEKKLTPGFLRTILTKKGENPAHWNTTKFRDVLNEAVRKETQIQEVMGEYGHSQQQRPPPQKPNFSASKFRDRAPIPQQRERTFITSAVDDNHKRLYGRQPQYRPQQQRPRAPQTQQRNSRTFNNRTQIPAQQANATFNQRKPPSPCIFCGNDHWNEECRKFSTIQQRREVLRTKALCFKCLKNNHQAGNCPQPKRCFKCKQPHPTALCHGDSKPPNQITAAMFGQPQQNVPSTSQAESNEPAASTSQMCNAVNGSDTRALLMTATSTVFNPAQPHLSMTAAIFIDPGSHRSFISAKAAQLLDLPVVHTEECHLTSFGEREPKRYISDLVKLGFLCTSGEKLIFNLNAMKFLVNDMPMIQLSELDKTELRQQKLNPPHEQRQPDIMLGIDVWHELQVQPIEKLPSGFTLCRSKIGKILSGSGRIEMHQTPNVTFVMSVHGTDQEGANQSVTFESTKEDKEVFTSEDDVKKDEQLNNFFGLNLIGMDDTSTPTDQDQVMVYFKKNLTFVNNRYQVALPWNDRVDALPSNIHQAKARLVSLIKKLRSLNLIDEYQTILDEQSRQSVIEYIGPPESPSSAWRTAFLPHRAVIRADKATTKIRIVMD

SEQ ID NO: 143434 - protein, 1206 aa, Heterodera glycines
  Coding regions on vcDNA: vcDNA=SeqID_69857; Strand=+; Position=1-3618
  Homolog annotation: Hit_ID=EAL39930.1; Match level="QueryCoverage =50%, HitCoverage=37%, E-value=3e-74, Identity=32%"; Hit description =ENSANGP00000029091 [Anopheles gambiae str. PEST]
MWTDSQCSVERLRENKRQDRFVVNRLQKIREANFQVRHVRTDSNPADMASRGADPQCLRSSLLWHFGPVWLSKADKWPKSNVIYRPGDEFKEVEEPPIIELTTPVHVEEQFKPSIHFERFSNWNRLKATAAHAMRFIKKLRTIENGTISEPHQNNKPLTMAQLQQAENWILKEAQRLHPPSNDQIRELQLFRQEGIWRCGGRLEEAPDLPYDSKHPIFLPPHAWITKLIIRHYDKQLKHCGPRILLSTLREKFWIPRGRKTVQQLLNSPQHGCLECRRERVKPYIYPEASDLPRGRVSEARPFDKTGVDYFGPLKVKQSNDVVKIYVALFTCLAIRALHLEVAEDYSAEAFLRAFRRFTARRGIPSLIMSDQGTNFVAGAKVIKENWTDTLMPEDMQQQMAQSGIRWIFNTAHAPWKGGIWERLVGITKNALRRTVGRNLLTLDEFGTMLCEIEAIINNRPLTFESDQEPIKVLRPINFLIPYSKANNNFPIINDDTDDPTYEPNPTNRDKMVTTLSHVNARLNKFWEIWKSDYLLSLREHDRPNATTGLQTPNNGDIVIVEDDQMPRSLWNLARVEKVLIGKDGRARSALIKINGKLRDRAINQLYNLELSPKVPEQPIQQVHCLIASIMEDSVSLAGSDDEEQRPRNTEDFKIPKRRSALLRPIGEQQSPLQGQHKRRKQLHDSGLLKLFHAIADQQGSSKATIQAIAENREVRKAPQHEQIEHEQQMVQKAQKEAKRHLRTEQHEREMPQPQKEEQQREAERQQIERQQNDEQRATNQQAHSKAWQELAQQFDYDLMDQPDPTEKHAEETDQSTKSKQQSAKDKELERHRIGRKKTIDMQEKRQRSRDEWPEENETLLSYVQRIYGPENWTSAWQRGRVLRELHELEDQGRWMIHHKTDRLQLSVSRLYGGKRPFAEFRFVDGGYYSHMVPEDVIFLQAVPTEEPEIITLDDTPTTEKTATDNAKQPNQPKTSAPTIEEYRMADPKPNNFNEFNLFEPCDDSHTTCAKTATYGSIASNRFQLEEFNNCRATNFFQALIFNWLTRNMNLPADEIWAAHDNYTQLNVVTEEIAKKFHQQQVVSKRRQIGRDQHFTEVINVWRNSCDRFGELYNQPAHKQVKFRPIIPEKEQPSDYEEWIERLNNRTAEILTKARAKVQHPTFLNYNCTTILIGDNVAEVFKPLFYDAKWFTHFPADEFRLIPGPK

SEQ ID NO: 143435 - protein, 1233 aa, Heterodera glycines
  Coding regions on vcDNA: vcDNA=SeqID_69858; Strand=+; Position=1-3702
  Homolog annotation: Hit_ID=NP_610437.1; Match level="QueryCoverage =11%, HitCoverage=17%, E-value=2e-12, Identity=38%"; Hit description =CG8181-PA [Drosophila melanogaster] gb|AAF59007.1| CG8181-PA [Drosophila melanogaster]
MIHHKTDRLQLSVSRLYGGKRPFDEFRFVDGGYYSHMVPEDVIFLQAVPTEEPKIITLDDTPTTEKTATDNAKQPNQPKTSAPTIEEYRMADPKPNNFNEFNLFEPCDDSHTTCAKTATYGSIASNRFQMEEFNNCRATNFFQALIFNWLTRNMNLPADEIWAAHDNYTQLNVVTEEIAKKFHQQQVVSKRRQIGRDQHLTEVINVWRNSCDRFGELYNQPAHKQVKFRPIIPEKEQPSDYEEWIERLNNRTAEILTKARAKVQHPTFLNYNCTTILIGDNVAEVFKPLFYDAKWFTHFPADEFRLIPGPKVKHMIFAYQATADNMAAQIAPMLHRFLRSDIEITLIVAKDDNAQWINNKKYLIDITRELKAGFFVFNREMGEARQIANRIRQAIPEPMDLEQELGPSSSTNTSRQGPSTSRQVISSLMLISMFCLLFTGTAQGLPSRQKRITQVKAWHGGHVSNFLNIFTERDRRASTKYSPYVQRYIDKVLALNRSLSQSTNPPTSTTPPWTTTQPTTTTSRPRTTTTTATTTTTRTTNWPTRSTTRPTARTTTTSPMPWSMDHRTTTVSRVRQQQRPRPGIKLIRWPKSTITTEKGRDVFWCSNHGSTLWELKGPENSPFCRPPPALTAQWTPLTITLYTKIHRPEPIATAWHCSIKTTTENYYTNIVGDKFVEINKEFPLVSKRLCQRMAHQQECPLAKTEMHHDDNNRIWATNDQLQVDFPGPITGLFKGKQTSSATNCFAQPATLFVKWHSLQLLSPIHRADHCNYASEYCQLQDNNSLIWTSACPNDNCFMCDFQEAEEIHGEFTKLNGQTTAFWISEDRQKALTFTETHAVQACDGRQIVLSEQNFGIPKEQYDIIMSNHTRERRNVQPEQLASQLSAAQLATTMALSQLYLKECQRNVRVSNPTLQTRKLLKRDNLQARWISETTIEVFPCVPISLSNISYRTTKDCYKFIPVTIHLPNATRDAFLDPEMRILSLISKIASCSPFRYHHLQVQQNPTLWVRIDSRNGNVQRLSQTVIHELYETILNKTDNDLDLHPLIFHQWQLDNDTDFASLPHIDEFEDSEEFKNKLEQQTTQRAQALGALPGGIEGWTIKWFQERLQETIQWWIRLASAYSTFLLFRDVILPCLIAYFLNPIRITLMTLIGFRPKNQPTPQIQPQYEDMPLREMPSTPIRRKRRQLPEQSTPPIRLDTTTGTASFRTRARAHSATEDTPFGRLRPMKLADD

SEQ ID NO: 143436 - protein, 153 aa, Heterodera glycines
  Coding regions on vcDNA: vcDNA=SeqID_69859; Strand=+; Position=1 -105,161-517
MSGTDRLPSISANESFSIDSDVARRFCQENREIVQICALLAYNKTYIELLDELIAKADEAVRHNRDAQKVVKDKLLRPDNKPGKRRRRKDFGLHYRYPYFRDASGMVPAQNMESLELSRVCSFNPLTEEEKKCQFIKKLIIVFAGLNLLLHLN

SEQ ID NO: 143437 - protein, 189 aa, Heterodera glycines
  Coding regions on vcDNA: vcDNA=SeqID_69860; Strand=+; Position=1 -105,161-625
MSGTDRLPSISANESFSIDSDVARRFCQENREIVQICALLAYNKTYIELLDELIAKADEAVRHNRDAQKVVKDKLLRPDNKPGKRRRRKDFGLHYRYPYFRDASGMVPAQNMESLELSRVCSFNPLTEEEKKCQFIKKLIIVFAGPVRAQLIVTLKLINFKGTEKELRGLREAVAQSLNEQQIIKLDAK

SEQ ID NO: 143438 - protein, 175 aa, Heterodera glycines
  Coding regions on vcDNA: vcDNA=SeqID_69861; Strand=+; Position=1 -184,593-747,799-987
MNPKKDVVFRHFAKNYLCCKSRRTSVVDKFQRYLETEQQSQKNQLLSRLGLGTYMVDFADYTDVKKERAEKFGQWTVKGSGRWVRALMKNPNEYNSEDLMEELDKLPEEKREEAIEWLHKSDERLEQERQMEETIPEDPVEAKDFYERMYPKERLKELSEFVGKLLKPTQKYGCK

SEQ ID NO: 143439 - protein, 42 aa, Heterodera glycines
  Coding regions on vcDNA: vcDNA=SeqID_69862; Strand=+; Position=1 -93,225-260
MSSILFFRMRDQYLNLNPNFAQLLVSVERMLYFLLLIPYFVY

SEQ ID NO: 143440 - protein, 37 aa, Heterodera glycines
  Coding regions on vcDNA: vcDNA=SeqID_69863; Strand=+; Position=1-112
LVLHCLLSAPSGWEEPYRRDKMWGGGRVKAISGPGLT

SEQ ID NO: 143441 - protein, 491 aa, Heterodera glycines
  Coding regions on vcDNA: vcDNA=SeqID_69864; Strand=-; Position=1 -59,125-211,275-461,522-582,610-730,776-879,930-1017,1068-1118,1160 -1195,1252-1504
  Homolog annotation: Hit_ID=CAE68204.1; Match level="QueryCoverage =83%, HitCoverage=53%, E-value=4e-70, Identity=40%"; Hit description =Hypothetical protein CBG13872 [Caenorhabditis briggsae]
FVTCLVCLITIANVLMGCELDLNVVLTSVKLDLNVVLTSVKRPVAPAIGFFTQFIIMPLLLGYTIALFLFSDDNRRTHLLALGLFVTGCSPGGGASNYWTVLLNGNANLSVTMTFLSTIGALVAMPFWINVLGSRILKSIYAMPFWINVLGSRILKSIYLSRSVFIPYAKIVASLLMLVIPLLIGLTIAKLSRSVFIPYAKIVASLLMLVIPLLIGLTIAKYKPGMATKAKKLMRPFIIFVLVFIILMRPFIIFVLVFIIIFGISINLWLFAQITWTVLLAGLLLPWCGFMFGCFSSIILAQAPAGLLLPWCGFMFGCFSSIILAQAPADVTAIAIETGVQNTGIAIMLLKAIETGVQNTGIAIMLLKLSFPGADSDLASLSFPGADSDLASLLPISVACFTPGPLLLLLPISVACFTPGPLLLGYAIPSAIKRIRAPRHDDSVQFACRPTVTRCSSTLCQQPQKIVSLFGRNTKEEPHELLTSHRSVDLR

SEQ ID NO: 143442 - protein, 378 aa, Heterodera glycines
  Coding regions on vcDNA: vcDNA=SeqID_69865; Strand=+; Position=1 -51,1453-1665,1737-1924,1979-2099,2170-2276,2326-2404,2533-2636,2695 -2817
  Homolog annotation: Hit_ID=NP_727486.1; Match level="QueryCoverage =99%, HitCoverage=77%, E-value=4e-62, Identity=38%"; Hit description =CG2061-PC, isoform C [Drosophila melanogaster] ref|NP_727485.1| CG2061-PB, isoform B [Drosophila melanoga
NARRNRRMTSRSRKRHRYLTGTLGFLTVRTVVDFHLSNGADIASLSAHFRNLLPIVLRPGYQQIGDDEMLNGRAGFLASLLELRWVRDEIRSVLDAMVDEIRSVLDAMVSRQKMVSSGRKYSKKHKSPAKLMFEWYNTEYLGAAHGVSGIYQMMLRSDWFCSFWDLLDAFCSFWDLLDASAKSDLKQSVDWLLSTQFSDGNFPSSSDRIAKGLSEEKGLSEELVHWCHGASGVLHLLIVASLVFKEDKYLESAERCVNLIWARGISAERCVNLIWARGILRKGPGICHGVAGNGYAFLLLFRLTKNDKFLQMAHWFAFVMMAPSFEASARVPDCPSSASARVPDCPSSLFEGWAGALCFLADLLEPTTAQFPLLPIPF

SEQ ID NO: 143443 - protein, 98 aa, Heterodera glycines
  Coding regions on vcDNA: vcDNA=SeqID_69866; Strand=-; Position=1-481
LNSVTSANNFEMSACICPLCDTSLAAGLAKLAKCQHIGHGPCLSAHVSKHGFCPFFNCAMPTTEDEVLLITHTEGKQSNNFAGLVWHSFEKRGNPLIY

SEQ ID NO: 143444 - protein, 107 aa, Heterodera glycines
  Coding regions on vcDNA: vcDNA=SeqID_69867; Strand=-; Position=1 -49,107-381
MRLLKFNFVHYSTIRQRHFVFVFRILTRNTNIFIYWHDWGGGKTECCELHERLAKLKVYERLDKTKVAKKKKKPKPNNFKQLDADFGKAMMTKGPVFVEDFIKAILL

SEQ ID NO: 143445 - protein, 73 aa, Heterodera glycines
  Coding regions on vcDNA: vcDNA=SeqID_69868; Strand=-; Position=1-220
MPSCLAPFVGKCEPCVPEQCNMKSIELHYANKSLPRQPGDNGGGNKKKDNSGGHAEGVAVTAIIGIALLTLFG

SEQ ID NO: 143446 - protein, 115 aa, Heterodera glycines
  Coding regions on vcDNA: vcDNA=SeqID_69869; Strand=+; Position=1 -8,504-843
MPSQILKFNFSKGAKVEKLRIRVECKSENSNREVRIDLRVIYGINGKVSGKTQMNINCAEEFGIYLNKKVDKDRFKFNFDIFTKPFDNEIVPSNESSENPQTEGEEQQIVDDILR

SEQ ID NO: 143447 - protein, 185 aa, Heterodera glycines
  Coding regions on vcDNA: vcDNA=SeqID_69870; Strand=+; Position=1 -86,144-615
MFYYKAHLGLNRSNFRYVRCANKRPNMKRVIKWQFISKFKSGTFPPIFESSAETFSNFHMNSIGELFRIGREDENEFLRTQAKHQIQAIVDQLNNSAKNYKNFLSNTNLKHLVPFLEQKFFEIGTDGFVETEIVRQIRNLLENFINEQQQKGGKEDIAIARYLLKLASASKIAPKFARRITQLKS

SEQ ID NO: 143448 - protein, 15 aa, Heterodera glycines
  Coding regions on vcDNA: vcDNA=SeqID_69871; Strand=+; Position=1 -16,677-708
MTKPRRGMKSKGKMK

SEQ ID NO: 143449 - protein, 67 aa, Heterodera glycines
  Coding regions on vcDNA: vcDNA=SeqID_69872; Strand=-; Position=1 -126,245-319
MRPPQQWATVLLLFRLSPSALFLYHFAHRRHGGGGGHLLKARWLQQCHPSYGVDADLSAKRFLEEKK

SEQ ID NO: 143450 - protein, 83 aa, Heterodera glycines
  Coding regions on vcDNA: vcDNA=SeqID_69873; Strand=-; Position=1-442
RQRTWLMIDHTLIRSAEKAVASIIFQLFSSLINPFFVSMSNKSCILCQNTLNFRLWHKMTKAFCSPSLNYLKMFLVHTKPNDH

SEQ ID NO: 143451 - protein, 36 aa, Heterodera glycines
  Coding regions on vcDNA: vcDNA=SeqID_69874; Strand=-; Position=1 -63,133-180
MEMAQDGLKKAKAVNDGHKKEADKSHASPKLDAIGV

SEQ ID NO: 143452 - protein, 96 aa, Heterodera glycines
  Coding regions on vcDNA: vcDNA=SeqID_69875; Strand=-; Position=1-288
MPTAGEIVHEERQQEKMKKTNFEEAKEEKGRKGTIKGGGRRSKRKRCQRNRTASCSSEKEKQTQQFDGIGGATPPRQKRHFPQAAVVDNGARRVTK

SEQ ID NO: 143453 - protein, 31 aa, Heterodera glycines
  Coding regions on vcDNA: vcDNA=SeqID_69876; Strand=-; Position=1 -23,534-606
MIIVNIVESQRSHKKNIFFLKIFPFFINYKL

SEQ ID NO: 143454 - protein, 71 aa, Heterodera glycines
  Coding regions on vcDNA: vcDNA=SeqID_69877; Strand=-; Position=1 -72,134-277
  Homolog annotation: Hit_ID=CAE64381.1; Match level="QueryCoverage =92%, HitCoverage=14%, E-value=1e-15, Identity=57%"; Hit description =Hypothetical protein CBG09068 [Caenorhabditis briggsae]
MDFAGCKTDQILDMDMFLYDTQPATLSGLNEEFISGARLDNLVSTYTAIKGLVESLEDTDALDADPNVRNQ

SEQ ID NO: 143455 - protein, 112 aa, Heterodera glycines
  Coding regions on vcDNA: vcDNA=SeqID_69878; Strand=+; Position=1 -41,104-401
MSKERATAIVVFCCLLLIAAAIGLVLLTLYLLQRRQRKALAAKLNALQQHAFDPVNAESSMSLNAEHGVEVPDSLRSGDSDEDDDEDYDAPPVISSRAKAAPPPVNEKAKKG

SEQ ID NO: 143456 - protein, 194 aa, Heterodera glycines
  Coding regions on vcDNA: vcDNA=SeqID_69879; Strand=-; Position=1-585
MNLWHLLFIIFFFIFVIKSGKIQPNFEEIFGQRWDKNESEEIVIIKIEQNDQKEQNETTGIDQIGGENGTDPNDQQKRQIILKFEAIKEKLKQKGKYKRKDQGKIERKIAKLLGANLQLIQKWKNELNLNKNKIKKQLYDEKKREFIERFDEFKELYGQGKQKEFAKELGISEDTFRKWKKELAPKYHKSQSRI

SEQ ID NO: 143457 - protein, 98 aa, Heterodera glycines
  Coding regions on vcDNA: vcDNA=SeqID_69880; Strand=-; Position=1 -153,360-503
MGQKRREEKVIKIELNERNENSQSAVDQMGEEMGNDPNDQTRNYTDRTFLKEFYEMKKSEFIERFDEFKEFYGKGKQKEFVKELGISDIDKMEKRIVA

SEQ ID NO: 143458 - protein, 54 aa, Heterodera glycines
  Coding regions on vcDNA: vcDNA=SeqID_69881; Strand=-; Position=1-164
MCQELAEEAKQSIEIANNYRQEIGHIYRTAYSQPDLGIGDLANKLKETMRENQI

SEQ ID NO: 143459 - protein, 120 aa, Heterodera glycines
  Coding regions on vcDNA: vcDNA=SeqID_69882; Strand=-; Position=1 -102,143-286,329-445
MQRIAEIKNFEIIEGGRVFIVRVRIENVVHVEYRACVLCRKGVCSCGVEKALTPYLKVSVADDTGILENVAFFDVRGKKNGMEELRGLSGAVCTMKIGARVKEFGGKKGIYYSLIDIVSL

SEQ ID NO: 143460 - protein, 19 aa, Heterodera glycines
  Coding regions on vcDNA: vcDNA=SeqID_69883; Strand=-; Position=1-59
TFAFSSLALPNTHTIFEML

SEQ ID NO: 143461 - protein, 19 aa, Heterodera glycines
  Coding regions on vcDNA: vcDNA=SeqID_69884; Strand=-; Position=1-59
TFSFSSLALPNTHTIFEML

SEQ ID NO: 143462 - protein, 19 aa, Heterodera glycines
  Coding regions on vcDNA: vcDNA=SeqID_69885; Strand=-; Position=1-59
TFAFSSLALPNTHTIFEML

SEQ ID NO: 143463 - protein, 19 aa, Heterodera glycines
  Coding regions on vcDNA: vcDNA=SeqID_69886; Strand=-; Position=1-59
TFSFSSLALPNTHTIFEML

SEQ ID NO: 143464 - protein, 19 aa, Heterodera glycines
  Coding regions on vcDNA: vcDNA=SeqID_69887; Strand=-; Position=1-59
TFSFSSLALPNTHTIFEML

SEQ ID NO: 143465 - protein, 19 aa, Heterodera glycines
  Coding regions on vcDNA: vcDNA=SeqID_69888; Strand=-; Position=1-59
TFAFSSLALPNTHTIFEML

SEQ ID NO: 143466 - protein, 19 aa, Heterodera glycines
  misc_feature (16)..(16): Xaa can be any naturally occurring amino acid
  Coding regions on vcDNA: vcDNA=SeqID_69889; Strand=-; Position=1-59
TFAFSSLALPNTHTIXEML

SEQ ID NO: 143467 - protein, 82 aa, Heterodera glycines
  Coding regions on vcDNA: vcDNA=SeqID_69890; Strand=+; Position=1 -53,142-337
MLDLRKFVSFAYDKSPSGDEKPPPKKYLKTEKAPVAKKERNAKTAKPAKNRIESDSEEEEVSLSSESDASVSIDDGDDDDYD

SEQ ID NO: 143468 - protein, 60 aa, Heterodera glycines
  Coding regions on vcDNA: vcDNA=SeqID_69891; Strand=-; Position=1 -15,402-569
MRRIKLQGRRGAEQLKRREERKAQTEKARQAYLAKKSMFFNGFLGPKIFQTNFSSPIATN

SEQ ID NO: 143469 - protein, 46 aa, Heterodera glycines
  Coding regions on vcDNA: vcDNA=SeqID_69892; Strand=-; Position=1-139
LRRFSKCHKRTQRFLLICNSCRNGAAVVGGGKFFPFFDGCHSENNN

SEQ ID NO: 143470 - protein, 45 aa, Heterodera glycines; identical to SEQ ID NO: 124527
  Coding regions on vcDNA: vcDNA=SeqID_69893; Strand=+; Position=1-138

SEQ ID NO: 143471 - protein, 142 aa, Heterodera glycines
  Coding regions on vcDNA: vcDNA=SeqID_69894; Strand=+; Position=1 -95,307-640
MLAPSVLIILLFGLSFSIKVEKKKEGIIVTGHPSQSPKMSPTNVLVAPASTQPLTPSLVTIASPTTVSSGFDVGIIILLFCILIIVVIVMCLLCRLFYRTRQQQFVPSNIVPSPTVSSPRMPSASVLLPITSSVPMPILIGC

SEQ ID NO: 143472 - protein, 280 aa, Heterodera glycines
  misc_feature (198)..(198): Xaa can be any naturally occurring amino acid
  Coding regions on vcDNA: vcDNA=SeqID_69895; Strand=+; Position=1 -153,227-293,390-464,587-756,810-861,1061-1322
  Homolog annotation: Hit_ID=CAA74206.1; Match level="QueryCoverage =94%, HitCoverage=70%, E-value=6e-53, Identity=42%"; Hit description =serine proteinase [Heterodera glycines]
LLKIYIAIFLQIVFNNLFLSCHPNSDYSECGISDFEPLLANVPKMEIGTYNVYLGQAVEVYLGQAVENDNSLPWMASLIKGVKCSATIIGPNHILTAMHCVKGRDFEKLRISYGNEYVSSQPYKSAVVSIQLYPNAKYYRIYDNFGDETSRADLILHDIAIIKIKNPIKFTSNVRPIIKNPIKFTSNVRPICLFGFQXKNKTLDSTRAKFLVRNSKSETTKFIIAGWGMTRPQCAKDQNKTRNDQLNYGKMRMISTQKCREMANEKIGVVRFTSFLILNY

SEQ ID NO: 143473 - protein, 110 aa, Heterodera glycines
  Coding regions on vcDNA: vcDNA=SeqID_69896; Strand=-; Position=1 -180,498-650
MARHGQLAMVPGGHGKAKRNNLEQSFADDGGQKHMALKVVAKTVVRYAEMGQKFELELGTTVLNGQQPMRIGIGTELVIGNSTLAEGIRGEETVGDGTMFDGTNCCCRVR

SEQ ID NO: 143474 - protein, 189 aa, Heterodera glycines
  Coding regions on vcDNA: vcDNA=SeqID_69897; Strand=+; Position=1 -45,94-166,355-549,596-720,821-952
  Homolog annotation: Hit_ID=CAA74206.1; Match level="QueryCoverage =97%, HitCoverage=53%, E-value=4e-46, Identity=50%"; Hit description =serine proteinase [Heterodera glycines]
MPKATLLLHDIAIIKLKKTIEFAPNVRPICLFGFGGDFESSSDEKFLEDNSKIKNSQFIIAGWGLTWPQCAKDQNKTRNDQLNYGKTRMISTQKCREMANEQKNSFEWSAGDDDAIESIESLLNEFETYGLDDKICVVPEPSIGEPGDSGSPLMLKIGTNNWIQLGVATKTSCNSKDPTSTEGLFGKCI

SEQ ID NO: 143475 - protein, 231 aa, Heterodera glycines
  Coding regions on vcDNA: vcDNA=SeqID_69898; Strand=-; Position=1-696
MKRTNASNITPPRAKRSMAPAQDLDPNAVALAEQERQRTLVFIGLPESNAIRPSERVQEDREAATKILDHLEVEAQPTAVFRLGRYDPQRTTPRPLKVVMPTTTHQHMALGGWKRERARLRSLQNLNRLFVRPALTKEQLKEEYEARFRKRQQNPAPVAPAMQPRQTNVPTPVKENAPNQKEASDDIYKPLEVFDQTILVCYEALKSLPPNDKIVHQIQSLEKQYPRLFNK

SEQ ID NO: 143476 - protein, 155 aa, Heterodera glycines
  Coding regions on vcDNA: vcDNA=SeqID_69899; Strand=-; Position=1-467
MDSFGTVAWILRPTAQTTGTAVGSMEYEEEENGTGKLVHSVTATVTTPTTAEFRLEKEAPSSEKDGDEEGSGGHGTLLFIESDDGEEEEEEDEDIEDTPVATDSPSATTATVVDDSSDTVKGVEQRSSEHSDVTDGAEGGGGSEGAKLLGVRRKR

SEQ ID NO: 143477 - protein, 24 aa, Heterodera glycines
  Coding regions on vcDNA: vcDNA=SeqID_69900; Strand=+; Position=1 -47,466-493
MSRSSEHFGASECHPCHHLPFLLC

SEQ ID NO: 143478 - protein, 101 aa, Heterodera glycines
  Coding regions on vcDNA: vcDNA=SeqID_69901; Strand=-; Position=1 -60,276-519
MATYLFIAAAGGALLGGAATLAGQRLLAAAAAPPPPQVAAAAALAAAAAAPGSSGGQKGAQEDGEERRRRQQEGQALEEGRAQHAQEEGQEGQDEGQEGVA

SEQ ID NO: 143479 - protein, 23 aa, Heterodera glycines
  Coding regions on vcDNA: vcDNA=SeqID_69902; Strand=+; Position=1-70
SNQRTASVCNATLWPLTYSSLLL

SEQ ID NO: 143480 - protein, 56 aa, Heterodera glycines
  Coding regions on vcDNA: vcDNA=SeqID_69903; Strand=+; Position=1-192
HFLWCVQSNAQKHEKLAHILRPNQSRPNWLANARRRRWKVARSVFSWSTWSCSCCT

SEQ ID NO: 143481 - protein, 28 aa, Heterodera glycines
  Coding regions on vcDNA: vcDNA=SeqID_69904; Strand=+; Position=1-85
IFFVCVSNIVRLFDRARQEKATVGTKFA

SEQ ID NO: 143482 - protein, 18 aa, Heterodera glycines
  Coding regions on vcDNA: vcDNA=SeqID_69905; Strand=+; Position=1-56
YREAIPEGFGLPINMSAS

SEQ ID NO: 143483 - protein, 41 aa, Heterodera glycines
  Coding regions on vcDNA: vcDNA=SeqID_69906; Strand=+; Position=1-377
ILYRFLNVWIFFWLTKTSSNLALSILIQIAPNFFYSLTRPY

SEQ ID NO: 143484 - protein, 205 aa, Heterodera glycines
  misc_feature (10)..(10): Xaa can be any naturally occurring amino acid
  misc_feature (188)..(188): Xaa can be any naturally occurring amino acid
  misc_feature (198)..(198): Xaa can be any naturally occurring amino acid
  Coding regions on vcDNA: vcDNA=SeqID_69907; Strand=-; Position=1 -115,380-553,606-888
  Homolog annotation: Hit_ID=AAG40111.1; Match level="QueryCoverage =80%, HitCoverage=8%, E-value=2e-39, Identity=50%"; Hit description =chitin synthase [Meloidogyne artiellia]
NSKKFLNFFXALSRPPGRWLPLLLLLDISALLAQFTVLYARHSAVYSMPGLAFVCAVCVSSAWWQNFVHPRSFLAPIRLLSVVGARLRECHSKTYVLVSPWKCVLFILCMLHLVSPWKCVLFILCMLHFVPPHVPLHALLQRDPFAEQLITISADHLNDSQIRAFQERMQDYERGAGAWRKIIHIYTXNTITVFIELXSPPPELE

SEQ ID NO: 143485 - protein, 74 aa, Heterodera glycines
  Coding regions on vcDNA: vcDNA=SeqID_69908; Strand=-; Position=1 -99,148-272
MGDGFDGIRLLFNTWQTDLADRVRKLGLEPRQNKNRLSEMQQHFEQYVDVKIVAAHLGVSAQIVGQIYNYWVSK

SEQ ID NO: 143486 - protein, 321 aa, Heterodera glycines
  Coding regions on vcDNA: vcDNA=SeqID_69909; Strand=+; Position=1 -183,815-956,1065-1705
MFKPSQIVGLVWTGALHSLALRVKVCLFLAAGVAVPSPNVPCLRAALVQRENNRDWLARRTAPSPPPERGNRTARKEPSISKELDPEQFEGEGFSCLAAAQAEAGRFKVFSLAFRFIGQFLLSLSLTGVFPEEILRNIFTMCLAYAAEGAESMKLAADHFIFLLTSKHMDYEIAIHLKKLDHTATDKILSRFEMVDQSNKSKERPSIRDEPFVIDITAIESKGAKPKKAGKGRRDLNVIYRIADGATYGLHNADNLCLFRAFEFLRMKFVLPRQRFAEYKKDERRQLENVQALCRACNIDMNLPFYCVVEYGDRIQAKLKK

SEQ ID NO: 143487 - protein, 80 aa, Heterodera glycines
  Coding regions on vcDNA: vcDNA=SeqID_69910; Strand=-; Position=1 -52,165-221,270-403
MEKLKQQTVVPSANFDDAEICWISWLGYEPPSNLEGADKWDNWHALNNGWPTEETDEQKERVKIWVFGIFILFCIFNWFN

SEQ ID NO: 143488 - protein, 18 aa, Heterodera glycines
  Coding regions on vcDNA: vcDNA=SeqID_69911; Strand=+; Position=1-54
MSMRCKMMELTRRYAMTK

SEQ ID NO: 143489 - protein, 187 aa, Heterodera glycines
  Coding regions on vcDNA: vcDNA=SeqID_69912; Strand=+; Position=1-707
VFGAVPPNRCAQIYGETESFGNSFPIACTLILRWIFAPHNCLSTPNGHLKKLIFFVFGAVPPNRCAQIYGETESFGNSFPIACTLILRWIFAPHNCLSTPNGHLKKSIFFVFGAVSPNRCAQIYGETKSFGNSFPIACTLILRWIFAPHNCLSTPNGHLKKSIFLFSGQSPRTDAHPDLWGDRILRE

SEQ ID NO: 143490 - protein, 20 aa, Heterodera glycines
  Coding regions on vcDNA: vcDNA=SeqID_69913; Strand=+; Position=1-60
MCVIYPTDSLSWARQVWAGT

SEQ ID NO: 143491 - protein, 351 aa, Heterodera glycines
  Coding regions on vcDNA: vcDNA=SeqID_69914; Strand=-; Position=1 -201,247-466,514-694,738-903,1380-1667
MGSDNALSCMMRRQKRKILGNVDCTDPLAFVIPDKLRLKNGEDIVLYDSRTVRIGEKDVVLVFGSERTLDILSKNSATWHLDGTFKAAPNMWEQCFVVGASVNHRMCIGVWGLLPGKHRRYYEEVLNFLCNRISPVAPRKVICDFEKAEMNAVSAVFPATNILCCMFHYGQNLFRKMKGLKLVQMYGEQSVRGEAVRHSFRNVLSLPLLPPTYVRRAFSVIVGTAPMEMEQFLLYFARTYIGMTQQQLLDGDNAFGKGLCHHPALSDFISEVSGSIDRQVDAARSARNFIHKRHKRYVLQDAVIMRILADATYNDDAEIHDVMTALGLQVEGYAGKLKDYENTEDSIMNFA

SEQ ID NO: 143492 - protein, 77 aa, Heterodera glycines
  Coding regions on vcDNA: vcDNA=SeqID_69915; Strand=-; Position=1-234
MDRNKIEILQKSRKRKFLDTNDNENETTSEHHEPNDENNDRDDDFEEEHAIVNFELGKTQKGGVCLWSEGGKFARKG

SEQ ID NO: 143493 - protein, 241 aa, Heterodera glycines
  Coding regions on vcDNA: vcDNA=SeqID_69916; Strand=-; Position=1 -184,277-497,558-878
  Homolog annotation: Hit_ID=AAO19577.2; Match level="QueryCoverage =98%, HitCoverage=87%, E-value=1e-129, Identity=98%"; Hit description= chorismate mutase [Heterodera glycines]
MAGEGQCNEAEEVILRSSDYAFMKKTETAFEFVVGMNGQTEDKTAPGANANGAFLCCKATQGTATLFIVGVANKRLMLAKDVVNYKFHQNISIDDFEREKQVLESVSAQGQKAGIGDNYGEKFFQDQMDANKMIQKGYVKLWTANKSLPPQNVPDLQKDTRPKVTAATEEMILALKVFQQFRNNKNCWASVEKELLKSQSFLSLAEPNGKDAMRKAAVRLCAEMEAKIEAQIDETAKKLLA

SEQ ID NO: 143494 - protein, 95 aa, Heterodera glycines
  Coding regions on vcDNA: vcDNA=SeqID_69917; Strand=-; Position=1 -115,198-281,462-550
MFKIDFENKSVKINGQETENVTEQKIMNNTTPIIDMLNNDEVDNSASEYDTSSTSFRSKELTKNSSKLKKVRSYKKEGKSRVLINFLLFMFLLGL

SEQ ID NO: 143495 - protein, 23 aa, Heterodera glycines
  Coding regions on vcDNA: vcDNA=SeqID_69918; Strand=-; Position=1 -44,100-127
MRLTPKWLCQNYPSRELSHFIEL

SEQ ID NO: 143496 - protein, 141 aa, Heterodera glycines
  Coding regions on vcDNA: vcDNA=SeqID_69919; Strand=+; Position=1 -235,1405-1595
MAQSSANNTVGGTPKLQAQPNANTMGGTPTLQAQPNTNTMGGIPTLQAQPNAMGGMPTYYAVQQQQPYAQLQFVSQQACYCVCCLAYVPIADGPSNAQRGNEGKAAAIAHIERIGHRHGAVHGFFGGNFDQCSSVPDFAKS

SEQ ID NO: 143497 - protein, 76 aa, Heterodera glycines
  Coding regions on vcDNA: vcDNA=SeqID_69920; Strand=+; Position=1 -195,253-288
MKMPNVSQLFCILIVFSTFIEKTIGVTKKGTASPLEKAEQKDDEPKLGKEDKKLVNNKKELLKKEGKIANANGPTS

SEQ ID NO: 143498 - protein, 17 aa, Heterodera glycines
  Coding regions on vcDNA: vcDNA=SeqID_69921; Strand=+; Position=1 -39,295-309
MEKACKIWRDYIDNYWS

SEQ ID NO: 143499 - protein, 24 aa, Heterodera glycines
  Coding regions on vcDNA: vcDNA=SeqID_69922; Strand=-; Position=1 -52,292-314
MEKACKIWRDYIDFSALELLELAS

SEQ ID NO: 143500 - protein, 147 aa, Heterodera glycines
  Coding regions on vcDNA: vcDNA=SeqID_69923; Strand=-; Position=1 -112,330-490,529-699
MPVGENNISHSLHNFVSSARIETGIRPLERAARALQEVKKLFEFLQFCFHNFRKLFGIIMPKQNEIVLKYSFLDLTWFLDIEAVFYAISKTKKCLVVKTIFHISLHNFVSSARIETGIRPLERAARALQEGMERKNSYFWDFFRNQN

SEQ ID NO: 143501 - protein, 44 aa, Heterodera glycines
  Coding regions on vcDNA: vcDNA=SeqID_69924; Strand=+; Position=1-132
MKKTCKPQHFFLSEICPPPSQNITLFANVSKAPEGMQLCGAGAV

SEQ ID NO: 143502 - protein, 88 aa, Heterodera glycines
  Coding regions on vcDNA: vcDNA=SeqID_69925; Strand=+; Position=1 -96,135-305
MPLQNEIVLKYSFLDLTWFLDIEAVFYAISKTKKCLVVKTIFHISLHNFVSSARIETGIRPLERAARALQERMERKNSYFWDFFRNQN

SEQ ID NO: 143503 - protein, 44 aa, Heterodera glycines
  Coding regions on vcDNA: vcDNA=SeqID_69926; Strand=+; Position=1 -87,864-911
MENRQAFRDEFPLIFKRNVNVIQVSPQQNKINRVLAIWKRLSSV

SEQ ID NO: 143504 - protein, 128 aa, Heterodera glycines
  Coding regions on vcDNA: vcDNA=SeqID_69927; Strand=+; Position=1 -64,116-291,415-446,560-674
MNVFQIVWCFAAILSMSNTAPNIKAKDLITKNESNSQHAETSDKTASSSQKNKSDENCSICLDSIANDDNSSLKTLLNCKHSFHHSCIDQWSSSPSLIWNLKKLNSMISPLVFILQFFQNSDNLIFFA

SEQ ID NO: 143505 - protein, 51 aa, Heterodera glycines
  Coding regions on vcDNA: vcDNA=SeqID_69928; Strand=-; Position=1 -76,122-201
MCMVKWVVVFLVIVFILALITTIPPRNLITILTIKTIKSCHFWTKSIKKAH

SEQ ID NO: 143506 - protein, 185 aa, Heterodera glycines
  Coding regions on vcDNA: vcDNA=SeqID_69929; Strand=+; Position=1 -189,257-519,581-683
  Homolog annotation: Hit_ID=CAE67008.1; Match level="QueryCoverage =97%, HitCoverage=6%, E-value=4e-81, Identity=78%"; Hit description =Hypothetical protein CBG12408 [Caenorhabditis briggsae]
MVTLIQEMKRIQPEGPYRLIGYSYGACVGFEMATQLQRSDGNESVEKLILLDGSHLYMQTYRNVYRVAFGVTGDTLVNNPLFESEIMCAMTLRFANVDYKRFRVEMLQLPSFKERLQRVVDTVMGTGLFQRSDTIAFAVDAMRHKFVMADKYKPKETFKGHITLVRAEQGAAREEDVGKDYGIGQ

SEQ ID NO: 143507 - protein, 21 aa, Heterodera glycines
  Coding regions on vcDNA: vcDNA=SeqID_69930; Strand=+; Position=1-65
VYNIKIILKEQLVKMHIIRND

SEQ ID NO: 143508 - protein, 74 aa, Heterodera glycines
  Coding regions on vcDNA: vcDNA=SeqID_69931; Strand=-; Position=1-224
FSWIEWGPTTQRMDRNRDKQRPNRDSTAYPSPGSAGKVGKHRPSRSYPPHSRQRQSSRHTSSRTDEPSAMGNPI

SEQ ID NO: 143509 - protein, 93 aa, Heterodera glycines
  misc_feature (49)..(49): Xaa can be any naturally occurring amino acid
  misc_feature (57)..(57): Xaa can be any naturally occurring amino acid
  misc_feature (74)..(74): Xaa can be any naturally occurring amino acid
  misc_feature (79)..(79): Xaa can be any naturally occurring amino acid
  Coding regions on vcDNA: vcDNA=SeqID_69932; Strand=-; Position=1-280
QVKCPAGTTKFKLKGGLAFIPKQQQFGFSQRDPASGHIEPGSTFTLTWXNLGDLTPXHFLRLLSTGQWWLIAVXLGIIXLGGAFRLHQISPPL

SEQ ID NO: 143510 - protein, 34 aa, Heterodera glycines
  Coding regions on vcDNA: vcDNA=SeqID_69933; Strand=+; Position=1 -38,179-245
MINDHQPPIHIHSWTKPVKNEANYNKKNNLKFPY

SEQ ID NO: 143511 - protein, 24 aa, Heterodera glycines
  Coding regions on vcDNA: vcDNA=SeqID_69934; Strand=+; Position=1 -52,297-319
MEKACKIWRDYIDFSALELLELAS

SEQ ID NO: 143512 - protein, 56 aa, Heterodera glycines
  Coding regions on vcDNA: vcDNA=SeqID_69935; Strand=-; Position=1-168
MHSFSAQSSSVSSSLDSAKEEWLISNFDHANPSQRVMVLPRPASLHNDDYEEETAK

SEQ ID NO: 143513 - protein, 119 aa, Heterodera glycines
  Coding regions on vcDNA: vcDNA=SeqID_69936; Strand=-; Position=1 -109,689-938
MPTNGSKGDDQQQRMVLSRHLASEGTANRPNAGTSTDWLSITYPMGNLSSSLRRSMPSVNSSADGTGAGAEHLVQRVGTARHSSFSTEDGAAMCQKEKQQNSVGIADSETKCEQLTLID

SEQ ID NO: 143514 - protein, 138 aa, Heterodera glycines
  Coding regions on vcDNA: vcDNA=SeqID_69937; Strand=-; Position=1 -85,245-441,623-757
MNPNWMEQRFISSKEEGEEHGEKDGETKVEKEGTLSATANFSSTYVQYSVDGTNNGTSRPIGVPTIDEQTQIAAQYGLLTVEDEDEEDNDGQKKQSMEETNGANGKRYHLLMVEEEEDEEEEEIGDEERKSLEDTVDF

SEQ ID NO: 143515 - protein, 92 aa, Heterodera glycines
  Coding regions on vcDNA: vcDNA=SeqID_69938; Strand=-; Position=1 -138,228-368
MIYPSLTQMGQDNGEDLSLYRYKFATRQANGIDNDTQIALEPEKAKMVDLYHAYLVRNKTDKQEIALQVEAFAMSLQMIHVNELTGSDQSDG

SEQ ID NO: 143516 - protein, 74 aa, Heterodera glycines
  Coding regions on vcDNA: vcDNA=SeqID_69939; Strand=-; Position=1 -150,377-451
MSFLQNAWPIWHILLEFTKSKQQIMHSVSMEIMCIKWTQNRRDTVKWRQQGSDSSLDSKSVETGDKWFDREISK

SEQ ID NO: 143517 - protein, 259 aa, Heterodera glycines
  misc_feature (44)..(44): Xaa can be any naturally occurring amino acid
  Coding regions on vcDNA: vcDNA=SeqID_69940; Strand=+; Position=1 -162,284-502,549-698,745-914
  Homolog annotation: Hit_ID=CAE73111.1; Match level="QueryCoverage =96%, HitCoverage=61%, E-value=9e-61, Identity=49%"; Hit description =Hypothetical protein CBG20492 [Caenorhabditis briggsae]
SVQKQLARLLQLPPPIGHVVGMALDPQNRLVLFHRSGRIWDEQXVGKTTNNNDSLGAIPNATIAVVDRSGLLLESHGQNLFYMPHGLTIDSEGNLWLTDVGSHQVHKLDKFFRPTMSLGKKLTPGSDAEHFCKPTDIAVSTNSDAEHFCKPTDIAVSTNGDFFVADGYCNSRIMKFDRNGKLISQFGHQNCDPKSGEFFVPHSIPKSGEFFVPHSIALIEDLNLVCVADRENERIQCFSVGLEGTTHKPKGRMCPGTFV

SEQ ID NO: 143518 - protein, 45 aa, Heterodera glycines
  Coding regions on vcDNA: vcDNA=SeqID_69941; Strand=-; Position=1 -96,459-500
MTNGSGLNYIFPHNYTVDKIVFFLLLRMLIIKNFLYEYVIFNLTS

SEQ ID NO: 143519 - protein, 87 aa, Heterodera glycines
  Coding regions on vcDNA: vcDNA=SeqID_69942; Strand=+; Position=1 -90,181-262,690-781
  Homolog annotation: Hit_ID=CAE62837.1; Match level="QueryCoverage =67%, HitCoverage=31%, E-value=6e-10, Identity=49%"; Hit description =Hypothetical protein CBG07016 [Caenorhabditis briggsae]
MAQPPASVPPPTEYRRENSNLNLAPKGATKDKIAGDGYSYTDDNVCVFNNVVTSRGPGTAFEFALQLVEMLVSEEKAKEISNSLLVH

SEQ ID NO: 143520 - protein, 95 aa, Heterodera glycines; identical to SEQ ID NO: 136988
  Coding regions on vcDNA: vcDNA=SeqID_69943; Strand=-; Position=1 -669,840-1102

SEQ ID NO: 143521 - protein, 71 aa, Heterodera glycines
  Coding regions on vcDNA: vcDNA=SeqID_69944; Strand=+; Position=1 -24,241-432
MAGRDTTMRYNHGRFEKDNIDWKDNTLVCKCTTMARRGTIAGGTSITMSVTGTTIVRWKSCYRGIKRHNHG

SEQ ID NO: 143522 - protein, 51 aa, Heterodera glycines
  Coding regions on vcDNA: vcDNA=SeqID_69945; Strand=+; Position=1 -107,320-368
MVRRNTTTGGRGATMVQKGTIMVREVQPWLEEVPCLTNLIGQLFFAKIINE

SEQ ID NO: 143523 - protein, 58 aa, Heterodera glycines
  Coding regions on vcDNA: vcDNA=SeqID_69946; Strand=-; Position=1 -85,518-609
MANLITKNFLLATIFIIAEATLEDDASTGETSTKCHASKNDGTSLFREDNQEDICNFF

SEQ ID NO: 143524 - protein, 70 aa, Heterodera glycines; identical to SEQ ID NO: 129101
  Coding regions on vcDNA: vcDNA=SeqID_69947; Strand=-; Position=1 -13,154-353

SEQ ID NO: 143525 - protein, 16 aa, Heterodera glycines
  Coding regions on vcDNA: vcDNA=SeqID_69948; Strand=-; Position=1-49
EAIPEGFGLPINLGAS

SEQ ID NO: 143526 - protein, 495 aa, Heterodera glycines
  Coding regions on vcDNA: vcDNA=SeqID_69949; Strand=-; Position=1 -321,370-446,496-599,740-855,1264-1467,1509-2171
  Homolog annotation: Hit_ID=CAE60153.1; Match level="QueryCoverage =23%, HitCoverage=11%, E-value=9e-12, Identity=38%"; Hit description =Hypothetical protein CBG03703 [Caenorhabditis briggsae]
MPLFSGLRAFNRKICYELLIIAYEKTGQFGMKPDEKGRMGEIVYDSKATMYSSMPFHLECPKIEITHEEIVDDYVRDHTAMDSFLVTITPNHQKPVLDISDYRQYYSKKSLFDEDRTVRTFLEMCLSQFSINRDIYSPVGAGKLYEVSPEERVSAGNGIILRPGVAKVKVSPFYESNGLVPTIFAIMNNRMPQMNDWNHIRRVLVDANTVPPNERMDKILQCAFKMNVFNVDNPVLSAFGITVDQTSNRVVIGVRSSPRILYAKNQIINPCPDNTEWTKLGAQAQYLQTNELVNWIILTEERHLRPDKQSKEGLVKVFASKLIDKARKRGLELTNPIFMVFSRSGIQGWVEMLERCLNSNIEFIMLVVAKGIIFILMFNRLVDYKTEDSHGLLKYYEARYHVPTQHVSVEKVTEIVHKGKTQTLENIINKLNCKNFGLNYMPLVERSAERFALEKGNVLVIGYDVAHPAPTTPQERRMLHVKGATCDSFDPSTVG

SEQ ID NO: 143527 - protein, 121 aa, Heterodera glycines
  Coding regions on vcDNA: vcDNA=SeqID_69950; Strand=+; Position=1 -189,667-840
  Homolog annotation: Hit_ID=CAE60450.1; Match level="QueryCoverage =48%, HitCoverage=8%, E-value=4e-12, Identity=61%"; Hit description =Hypothetical protein CBG04058 [Caenorhabditis briggsae]
MATTDWGQFDANGTDYDAIYDGTDDEAGTTDNGQGGNVLNHLLTQVEHSRQLLFLFIIEIPFQLTFIAEQVSHHPPISAFYAEHPASGVCCTSYIYTESYVAGLSSLGVRNIGRATVVLGN

SEQ ID NO: 143528 - protein, 386 aa, Heterodera glycines
  Coding regions on vcDNA: vcDNA=SeqID_69951; Strand=+; Position=1 -35,138-342,406-586,641-720,777-1010,1063-1165,1221-1303,2202-2264
  Homolog annotation: Hit_ID=CAE60450.1; Match level="QueryCoverage =99%, HitCoverage=47%, E-value=2e-74, Identity=42%"; Hit description =Hypothetical protein CBG04058 [Caenorhabditis briggsae]
FFGKPHRIFGFNTLNSTLNSFFNRFLAVLKYYLTSFARKSGVAKKPYNPILGETFRCRWTLPDVPLNTEQTTRGPFPGSASNQLTFIAEQVSHHPPILTFIAEQVSHHPPISAFYAEHPASGVCCTSYIYTESYVAGLSSIGVRNIGRATVVLGNVSDETYTATFPDAVARNCETYTATFPDAVARNCHATPWFELTGKVEVRCAQTKYVVEVRCAQTKYVAKIDFLAKPLVFGQAHQIVGQIFRPERKVPLMTLKGEWNGEIMLRPARGSFHLFTNVRAKPDVRKECVPVMEQEDNESRKECVPVMEQEDNESRKLWRHLTAALYTNNTQMATQIKQKQHFQQRQRDEEAERKRQGRPWSARHFHRTRTAPKWTYEMKQHTRNMN

SEQ ID NO: 143529 - protein, 25 aa, Heterodera glycines
  Coding regions on vcDNA: vcDNA=SeqID_69952; Strand=+; Position=1 -56,394-415
MTAISAIPHPPPVPLNKVRGQREIA

SEQ ID NO: 143530 - protein, 489 aa, Heterodera glycines
  Coding regions on vcDNA: vcDNA=SeqID_69953; Strand=-; Position=1 -168,222-389,446-776,820-1032,1713-1884,2127-2308,2465-2700
  Homolog annotation: Hit_ID=CAE57913.1; Match level="QueryCoverage =39%, HitCoverage=38%, E-value=4e-36, Identity=41%"; Hit description =Hypothetical protein CBG00964 [Caenorhabditis briggsae]
IDLLLAQPGLVTSIVTLLKSDSIRALTGALRTVGNIITGTDEQTTTILDFGVLDDFKMLVDSDIHQVSRECLWILSNVAAGTAEHVTRLFSVDGLSDSVFRLCRDPSPRKRKEAYWVLVNAMMGAPMPLYDHLLSGGLANIVAQLLRENPDAALLERTLNTIRASLEDRPQSNRHFTMALFHHVGIVGQLLCVARGATTNNSAPSLMNALSVGRNLHNNKVLGSILAFRLMTVPAATTKRTRGARQFKCESKGPNRRRATQMKRDDMPFLIDYNVHICWQSYCIIPTFHMAVRFAPLYQTRSQFECLDGKKSIPFEQVNDDYCDCADGSDEPGQNRTQRNYLTLFRGTGGGDKPALSFPKDCCDGSDEWDSGTECPNVCDSLGAKAREDAKQQAEVQTAGYAKRKELAKEGGKMLSEKKSEVEKKQKELDELAELKKGTEEAKKAAEELEKEAKDREEKEWEEAKKERTEAEAKQMFDKMEKDGDGKCV

SEQ ID NO: 143531 - protein, 104 aa, Heterodera glycines
  Coding regions on vcDNA: vcDNA=SeqID_69954; Strand=-; Position=1 -79,454-550,673-811
MYLITTLLPTHGSVPQNGNAQQQQQNVSFTWIFKKTVFVYGKTPYNKNLLQFHGKHAKNANFCKGLFLLGHHIAWPLCASLSNMEQIGHGRQQLDGGGPVLISA

SEQ ID NO: 143532 - protein, 84 aa, Heterodera glycines
  Coding regions on vcDNA: vcDNA=SeqID_69955; Strand=-; Position=1 -242,928-940
MPLPSTSTISSVAVQNIAAYVADDNGAMVCLRAVYAMDRTAHFDHTVRHDGILWDLRFANPDHPPERPISEQPLGRYRAPSLLF

SEQ ID NO: 143533 - protein, 59 aa, Heterodera glycines
  Coding regions on vcDNA: vcDNA=SeqID_69956; Strand=+; Position=1 -98,375-456
MNQTDEWNAYMNEQKIRGMDCAKKCKIIVSMIHESRPVVQALAIKSENYFDTNPNNPTG

SEQ ID NO: 143534 - protein, 47 aa, Heterodera glycines
  Coding regions on vcDNA: vcDNA=SeqID_69957; Strand=-; Position=1-145
IYFASAADDPLRMTNGISQINPWDCLDLCQNNFPILSLELGPPAGFR

SEQ ID NO: 143535 - protein, 223 aa, Heterodera glycines
  misc_feature (7)..(7): Xaa can be any naturally occurring amino acid
  Coding regions on vcDNA: vcDNA=SeqID_69958; Strand=+; Position=1 -76,703-795,1043-1061,1116-1274,1322-1418,1502-1615
  Homolog annotation: Hit_ID=NP_492020.1; Match level="QueryCoverage =94%, HitCoverage=62%, E-value=9e-85, Identity=39%"; Hit description =tissue factor pathway inhibitor precursor family member (100.0 kD) (1H712) [Caenorhabditis elegans] emb|C
ISKSIVXGAVCAPKVTRWYYDSTQRTCQTFSFNGCDGNSNNFATQQDCKDYCRVESCPDGGEVWKEPNGAVRPVWKEPNGAVRPCTTNRQCPSTHYCTPVTVFSGTVYQTKSLCCPSKNFVCSQPKDQGVRCSSTRITRHFFNADTKTCPKDQGVRCSSTRITRHFFNADTKTCQPFEYNGCEGNRNRNNFATQKSCQNYCLSEACSPGTVVARDSDRWIREP

SEQ ID NO: 143536 - protein, 258 aa, Heterodera glycines
  Coding regions on vcDNA: vcDNA=SeqID_69959; Strand=+; Position=1-774
  Homolog annotation: Hit_ID=BAC82601.1; Match level="QueryCoverage =81%, HitCoverage=13%, E-value=3e-12, Identity=27%"; Hit description =reverse transcriptase [Ciona intestinalis]
MQGGQPPAMNMDQHYEHLGVPTGFQRAQSADHVIQQMSDHVDNIDRSLLAPWQKFDAVNTFVLPSIAFHLKNGEVRKAPLNALDKKIVRVAKRWLNLPQRAGIEPLYLSNAMGGLALTPLNTLADLSQLVHGLRLLTSRDLAATTMDLLCTVVAKRLRRAPRQHELARYLNGSMDGDMNNESTDISSTWTRLRMATRRLRTKIGVEWSVNDGSMQLLLNGCQIQPKSAEFCLRSAIRDFYHRRLLSKPDQGKTHSVTS

SEQ ID NO: 143537 - protein, 91 aa, Heterodera glycines
  Coding regions on vcDNA: vcDNA=SeqID_69960; Strand=-; Position=1-276
MSASIPRRSSQDSLAEKVKSKELIYEARMKIQERLKELGFPVQNTTVKGPSGSERFRETVLKPEETSAFTQLHMENIKRLNEVFEHNLCNY

SEQ ID NO: 143538 - protein, 126 aa, Heterodera glycines
  Coding regions on vcDNA: vcDNA=SeqID_69961; Strand=-; Position=1 -174,736-808,859-989
MDVKDSVGPSKIAVNCTICVPVWFGFVRVEADGESVQIEDNLSLKTTQFKLPTNGDDKNLRFAPREKSEGSETIRIAISNRKNQCRKGPPNHFGLFERRDLEFRDGDEGRIGHGASGGGQLGGGAE

SEQ ID NO: 143539 - protein, 21 aa, Heterodera glycines
  Coding regions on vcDNA: vcDNA=SeqID_69962; Strand=-; Position=1 -54,344-355
MRTRPIWQVKQRLLTSQKKLL

SEQ ID NO: 143540 - protein, 91 aa, Heterodera glycines; identical to SEQ ID NO: 138859
  Coding regions on vcDNA: vcDNA=SeqID_69963; Strand=+; Position=1-757

SEQ ID NO: 143541 - protein, 240 aa, Heterodera glycines
  Coding regions on vcDNA: vcDNA=SeqID_69964; Strand=+; Position=1 -523,1722-1919
MVLLSVFCAELLNCRVQQLRDRLNHPEDRTYIFNSLKGRKVTTTYKDRNGMTKTFFIGGLSEKGAALTMAYGRLSSPFNVNIAAHFYARHRIKLHHPYMHCVVERFTAGKEDRFYPMELLELADDNPMWRRWAGPMFTERMSTPPTRPDVQFNLGYCDDDDDDDDELIGDGRDQFSMAFSKIAANAIAIDLGTTYSCVGEFQRGKVEIIANDQGGAKRRKFDDPAVQSDMKRWPFKLVQE

SEQ ID NO: 143542 - protein, 89 aa, Heterodera glycines
  Coding regions on vcDNA: vcDNA=SeqID_69965; Strand=-; Position=1-270
RHPIVGELSPKATVMARMLIRALQVLTKPFPPFNQNTVVVVEYCTIPSPPFLQLLLWAGERSVLGKREREKRLQQIYGTTGGPNNFGIF

SEQ ID NO: 143543 - protein, 66 aa, Heterodera glycines
  Coding regions on vcDNA: vcDNA=SeqID_69966; Strand=+; Position=1 -96,135-239
MPKQNEIVLKYSFLDLTWFLDIEAVFYAISKTKKCLVVKTIFHISLHNFVSSARIETGIRPLERAA

SEQ ID NO: 143544 - protein, 102 aa, Heterodera glycines
  Coding regions on vcDNA: vcDNA=SeqID_69967; Strand=-; Position=1 -188,647-764
MATTAPAPSSAVTAAVAPFLPEAKCAANHHHHRHKANAIIVNVNNINRSSHHRKKVAAPKRKRTNNNNNNSGLVAAVAIGNAQNDGQPLVPPPPLQCHKCKK

SEQ ID NO: 143545 - protein, 58 aa, Heterodera glycines
  Coding regions on vcDNA: vcDNA=SeqID_69968; Strand=+; Position=1 -47,122-248
MELTEHVVFLDTALKDISEFDSQQKQVNGVNVHSEDQSKLYILFNNSFVVFYDITSDE

SEQ ID NO: 143546 - protein, 87 aa, Heterodera glycines
  Coding regions on vcDNA: vcDNA=SeqID_69969; Strand=-; Position=1 -99,526-690
MIRYYIQKRLKIFTLKFSDIGQSEADEQEEEDEDDEQQQKQHFSAAQLDLLERLFEKTKFIDFSTRSEVAKLVGITPEQVKVRGIFN

SEQ ID NO: 143547 - protein, 42 aa, Heterodera glycines
  Coding regions on vcDNA: vcDNA=SeqID_69970; Strand=+; Position=1 -80,357-405
MAQFVIFNALEGPLPNISGNRLRASRPIFLLLIKGSASEIFK

SEQ ID NO: 143548 - protein, 128 aa, Heterodera glycines; identical to SEQ ID NO: 125618
  Coding regions on vcDNA: vcDNA=SeqID_69971; Strand=+; Position=1-387

SEQ ID NO: 143549 - protein, 74 aa, Heterodera glycines
  Coding regions on vcDNA: vcDNA=SeqID_69972; Strand=-; Position=1-247
RLFQGRYHKMHCLCVASWDHVLVRVLTLLAQLGCGVLVCWRELVVLIRVLRTVTQAHQCFACCGGVPGLLAFLL

SEQ ID NO: 143550 - protein, 366 aa, Heterodera glycines
  Coding regions on vcDNA: vcDNA=SeqID_69973; Strand=-; Position=1 -261,533-977,1295-1370,1470-1573,1626-1702,1755-1892
  Homolog annotation: Hit_ID=CAE62810.1; Match level="QueryCoverage =95%, HitCoverage=95%, E-value=3e-95, Identity=50%"; Hit description =Hypothetical protein CBG06986 [Caenorhabditis briggsae]
MTKLDRRPLGNDDNELQQDDPKSALRESAQLRRSAFIGVAIGTAAMLTAVIAVPMLYNYMQYVQSSLQEELAFCHHRTQGLWDEYAKVQHLTGNERAKRSSYARAGGTGGGGGGYAQAGGSSGGGSGGYARAGGSSGGGYASSGGGGGSSGGSGGGSAGYSKFGGYASSSSATSGGGQQCTCTTGPPGPPGQPGTDGQPGNDGQPGGPGQPGADGQAPPQEYGGSCTPECPPGPPGPPGPGGPKGPPGNPGAPGSTPEGGYGASPPGPPGPSGPPGPPGGSGTPGPPGPPGQITGGGAPPGPPGPPGPPGQPGQAGQLGSPGNAQPGPPGPPGDAGPPGSPGNPGAPGGPGQAGSAGSGGGCVRTF

SEQ ID NO: 143551 - protein, 78 aa, Heterodera glycines
  Coding regions on vcDNA: vcDNA=SeqID_69974; Strand=-; Position=1 -82,189-265,612-689
MTKNDFAIVGENILALFWRTRQIGPRGDFPFSGLWSIFFIEHSLFVPKFKIQKDLCPYVGIIYMFYVNFLDFSKNRYY

SEQ ID NO: 143552 - protein, 33 aa, Heterodera glycines
  Coding regions on vcDNA: vcDNA=SeqID_69975; Strand=-; Position=1 -90,198-211
DCVENVLALANRYLLESVENRCVDFLMTKKKNS

SEQ ID NO: 143553 - protein, 124 aa, Heterodera glycines
  Coding regions on vcDNA: vcDNA=SeqID_69976; Strand=+; Position=1 -78,426-575,631-777
  Homolog annotation: Hit_ID=CAE62132.1; Match level="QueryCoverage =89%, HitCoverage=18%, E-value=3e-18, Identity=38%"; Hit description =Hypothetical protein CBG06176 [Caenorhabditis briggsae]
MLVPTSQFPFANVFLAFNHARHFEEKEFALRCLDHIDQNAYSLLKSDAFLKIGTNYLCEILARDQLQAEEITIWNAALRWADEQCRQMGKECSAENRRAMLGPALFQIRFPLIQLEEFPRNIGN

SEQ ID NO: 143554 - protein, 19 aa, Heterodera glycines
  Coding regions on vcDNA: vcDNA=SeqID_69977; Strand=+; Position=1-58
AIEEAIPEGFGLPINLGAS

SEQ ID NO: 143555 - protein, 52 aa, Heterodera glycines
  Coding regions on vcDNA: vcDNA=SeqID_69978; Strand=-; Position=1-157
FMKLLSLCFSSVCSSIWSMNWSKMSKKVPSPLYPSALFLNSTRLSISLSKNL

SEQ ID NO: 143556 - protein, 35 aa, Heterodera glycines
  Coding regions on vcDNA: vcDNA=SeqID_69979; Strand=+; Position=1-107
MRRMCFKWGANANPKTATAKAFATTWAIVTALRDT

SEQ ID NO: 143557 - protein, 54 aa, Heterodera glycines
  Coding regions on vcDNA: vcDNA=SeqID_69980; Strand=+; Position=1-162
PVAPIRHTPDLHFPLFLQVFCLKTAKIWSFLVKKSSCYPAREKKLLDKFAKKKK

SEQ ID NO: 143558 - protein, 44 aa, Heterodera glycines
  Coding regions on vcDNA: vcDNA=SeqID_69981; Strand=-; Position=1-133
MKNEYKQKGRKYSRKEWHQNYAEISKKIGISRRIIDEWKKQFGM

SEQ ID NO: 143559 - protein, 95 aa, Heterodera glycines
  Coding regions on vcDNA: vcDNA=SeqID_69982; Strand=-; Position=1 -119,178-348
  Homolog annotation: Hit_ID=AAP94888.1; Match level="QueryCoverage =69%, HitCoverage=19%, E-value=1e-09, Identity=43%"; Hit description =P34 [Ascaris suum]
RARQKIKRQKKQPEAVRRQAIADLLSGCPNEFGQVLKYIDDMKYTDKPDYDWIIATLRSSLSNAGVQEFPYDWETGKRNAAPGAGGGGGGDSYFN

SEQ ID NO: 143560 - protein, 532 aa, Heterodera glycines
  Coding regions on vcDNA: vcDNA=SeqID_69983; Strand=-; Position=1 -177,239-342,394-516,595-845,964-1008,1054-1138,1279-1470,1645 -1766,2346-2454,2690-2765,3038-3129,3267-3392,3472-3569
  Homolog annotation: Hit_ID=CAE59898.1; Match level="QueryCoverage =92%, HitCoverage=56%, E-value=2e-97, Identity=41%"; Hit description =Hypothetical protein CBG03382 [Caenorhabditis briggsae]
DESNGDCMLICPECFCISEEHMKNERDELNSQQFYPVPHDEFGHHLWSNAVLVIGLLLRERLIHPSDIDPIYRHLPASQRPRNMPVMPSSAFHGRMKGFPVVQVALISESAQLQMMLSTYGITTQTPHEVEPVQIWPSWRMVKLYERLGRDEKLGLGGRPLRPLGPLNTSKIFRICGNTVVIYPLIFELKDFYTNADSSTLIEDIKAIELGKRVLDKKPTFCMILREENVAGEYFSNMLDLLVSLKNGFVNGVRVRLGRIHIDMVNPDDVEFDVDVLEEIDAKEALLRARTKLRKVPPEKLEGLLSEQQLSGMGDHELVGGAFIIIAVLQMRYPGTFVVQGGCPKASTSKIMTSIGLRNSSRPNGTYTDAIDMLLCFVMEDLKNRQKLNNGTAASPIKTNDLFAFANEKIERGTEPSTDKFVRQSLEESMMSDIANPENRQLIVELFCIVATIMERNPLLSQAFNMFCEERRVKDRVNMTPFYAIDDDPSAPSTSSYLIRIVVDKLLKDTNTKHTISLRNNLLQKAEEECSI

SEQ ID NO: 143561 - protein, 177 aa, Heterodera glycines
  Coding regions on vcDNA: vcDNA=SeqID_69984; Strand=-; Position=1 -216,269-585
  Homolog annotation: Hit_ID=CAE59898.1; Match level="QueryCoverage =100%, HitCoverage=12%, E-value=1e-62, Identity=66%"; Hit description= Hypothetical protein CBG03382 [Caenorhabditis briggsae]
MDLIALFILVLVEMTVAGAQIIYTPHEVAFLQNLVFYIERTYRTPDFGIWERGTRYNRGNPELHSSSLGFVKAALESVNGFNAYGHKGTSDSVIYVGQSFIYCVIANCDAYFLFYKITDIDGHNRNRTTFETLLPRESNSKNTDASLILTIGWASFATHDDQKFETTLSKCLRHLEG

SEQ ID NO: 143562 - protein, 136 aa, Heterodera glycines
  Coding regions on vcDNA: vcDNA=SeqID_69985; Strand=-; Position=1 -143,188-455
  Homolog annotation: Hit_ID=NP_490905.1; Match level="QueryCoverage =100%, HitCoverage=100%, E-value=1e-45, Identity=64%"; Hit description=ribosomal Protein, Large subunit (15.7 kD) (rpl-27) [Caenorhabditis elegans] gb|AAK68266.1| Ribosomal p
MVKIMKPGRVVIVLSGRYAGRKAVVVKSYDEGSSERPYGHALIAGIDKYPLKVTKKMGKKQVEKRIRIKPFLKVTSLQHLLPTRCIFEADLDKSLVNKEWIKEPRKKKNAIISVKKEFETSYKAGKSKWLFTKLRF

SEQ ID NO: 143563 - protein, 320 aa, Heterodera glycines
  misc_feature (316)..(317): Xaa can be any naturally occurring amino acid
  Coding regions on vcDNA: vcDNA=SeqID_69986; Strand=-; Position=1 -196,239-478,531-616,663-990
  Homolog annotation: Hit_ID=XP_422548.1; Match level="QueryCoverage =96%, HitCoverage=60%, E-value=6e-85, Identity=53%"; Hit description =PREDICTED: similar to Rab geranylgeranyltransferase, beta subunit [Gallus gallus]
SGIYWCLAALKVLGENINDEEKLADLIKENQNEDGGFAAADGHDSHILHTLSAIQVAVIIGRLDIINLDATVEFIKSINLDATVEFIKSLQQNDGSFAGDHGGEIDTRFSFCAAASLYFLNRLGSIDVHKAVEFVINCYNFDGGFGTRPGSESHAGQVYCCLGTLSVCGCLEVYCCLGTLSVCGCLELIDVERTATWLAERQCPSGGLCGRQCPSGGLCGRPEKLPDVCYSWWVLASLAIIKRLHWIDGESLTHFIIASQDDEKGGIADRPGDESDPFHTVFGLYGLSLLGHKGLEAVDPVFCMTKKSLVNFAFAXXYAS

SEQ ID NO: 143564 - protein, 43 aa, Heterodera glycines
  Coding regions on vcDNA: vcDNA=SeqID_69987; Strand=-; Position=1 -63,113-181
MAFFTNFLSIGVIFLANFVPQASPCTNVIGYVPGCCHDIVSLT

SEQ ID NO: 143565 - protein, 94 aa, Heterodera glycines
  Coding regions on vcDNA: vcDNA=SeqID_69988; Strand=+; Position=1 -153,344-473
MNPKIIPNELLFEIIAFIRFNRKWAKCRVCFSFDQFLIRRQADWLKLIFTVVKNCKSLVRSLVNRIKQIPVNYEVHMDGVPQSAARHHAELTYI

SEQ ID NO: 143566 - protein, 67 aa, Heterodera glycines
  Coding regions on vcDNA: vcDNA=SeqID_69989; Strand=+; Position=1 -52,164-315
MSSFTTSSSADEFSPLQPIFPNLSTSEEMSVLIARIAELNRAKTMEPSIASSEVFGQDGYGREFKHN

SEQ ID NO: 143567 - protein, 101 aa, Heterodera glycines
  Coding regions on vcDNA: vcDNA=SeqID_69990; Strand=-; Position=1 -31,154-299,377-439,1583-1648
MPWHNSSATSLPGRSPSSLKRASLPPASAMFTPPSTLMPMPEQRIQLSGQCQACRLELSDQHKGIQCTAISQGCNRVFHWIYVLFLYYMMIFSCAELFNNI

SEQ ID NO: 143568 - protein, 49 aa, Heterodera glycines
  Coding regions on vcDNA: vcDNA=SeqID_69991; Strand=+; Position=1-147
MVGELGLTVSWRAIEWVGALAPGQSDSGQSDRGGQSDSEDNPTEMDNRT

SEQ ID NO: 143569 - protein, 19 aa, Heterodera glycines
  Coding regions on vcDNA: vcDNA=SeqID_69992; Strand=+; Position=1-60
KNSNFNLYQVKIIQNYLVF

SEQ ID NO: 143570 - protein, 36 aa, Heterodera glycines
  Coding regions on vcDNA: vcDNA=SeqID_69993; Strand=-; Position=1-196
NFLKYKPKLFGLFKKELKIFKIFIHLPFDRKNIREP

SEQ ID NO: 143571 - protein, 52 aa, Heterodera glycines
  Coding regions on vcDNA: vcDNA=SeqID_69994; Strand=-; Position=1-306
FINIFSQTALKRTKFYLQVILGTQMLSLSKREMNKKSKNIELLFKYAKNFRL

SEQ ID NO: 143572 - protein, 37 aa, Heterodera glycines
  Coding regions on vcDNA: vcDNA=SeqID_69995; Strand=-; Position=1 -51,176-238
MFFCVKYILRDVWLFELRNSAIVIMTQLFISIRDNHL

SEQ ID NO: 143573 - protein, 174 aa, Heterodera glycines
  Coding regions on vcDNA: vcDNA=SeqID_69996; Strand=-; Position=1 -437,772-859
MAAEALVKSELEKKEEEEPKKAEEAKKQKEKKLKELEKQAVELRVMLAEVENGGKTGKNPGKGDSPGRAKWGRKRGNSPLGQPERGRTGRRRHLIIGGGGGAIAAPSGGNVGNFVANERAGGGRSGNLVFNADGMARELSEDEENESDISIWPFAFIIFPLFSLFPRQFVPFGV

SEQ ID NO: 143574 - protein, 18 aa, Heterodera glycines
  Coding regions on vcDNA: vcDNA=SeqID_69997; Strand=+; Position=1-57
TIRASEELSNDTKIVGFG

SEQ ID NO: 143575 - protein, 24 aa, Heterodera glycines
  Coding regions on vcDNA: vcDNA=SeqID_69998; Strand=-; Position=1-132
KFLDFLFISLFDSESIREPYLTFN

SEQ ID NO: 143576 - protein, 47 aa, Heterodera glycines
  Coding regions on vcDNA: vcDNA=SeqID_69999; Strand=-; Position=1-165
RLSVKQSLPPQQFDVNGNLVTADRPTAEEETNNEASGFITENPLNLN

SEQ ID NO: 143577 - protein, 159 aa, Heterodera glycines
  Coding regions on vcDNA: vcDNA=SeqID_70000; Strand=+; Position=1-480
MPPLPQPTERDAKMEKHFNRRFGTRPQQFVSNKPIWARHRLSQNWSAGTICECTGVIYKVKFPDGSTNRFHANQLRNRENTANGHEPLNVLNEAFHLPITAPNVGNVGQDLEPRPEPINDELQDEIEPEQARRSPTPPQQQVPRRSGRNRRAPDRYSPG

SEQ ID NO: 143578 - protein, 124 aa, Heterodera glycines
  Coding regions on vcDNA: vcDNA=SeqID_70001; Strand=+; Position=1 -87,147-345,393-481
NCSEEANPCDIIKEGFPKKCCRPRTKKTTNNSTERDPHDITEERNAKKRCSQKIKEIFESETTQPQPDNLRYPINEYISTNEFAHEDIILELPISEFTMEYIREYGLVRPLLFKEQPENLGMRS

SEQ ID NO: 143579 - protein, 32 aa, Heterodera glycines
  Coding regions on vcDNA: vcDNA=SeqID_70002; Strand=+; Position=1-96
RCLISRNKCINTEISGVPVSFCCCNTEDLCNG

SEQ ID NO: 143580 - protein, 142 aa, Heterodera glycines
  Coding regions on vcDNA: vcDNA=SeqID_70003; Strand=-; Position=1-431
  Homolog annotation: Hit_ID=XP_526239.1; Match level="QueryCoverage =97%, HitCoverage=68%, E-value=7e-17, Identity=34%"; Hit description =PREDICTED: similar to putative protein (2F299) [Pan troglodytes]
WGPILRVLGPILRVFGPILRVLGPILRVFGPILRVLGPILRVFGPILRVLGPILRVLGPILRVFGPILRVLGPILRVLGPILRVFGPILRVFGQILRVLGPILRVLGPILRLGSVIRVFGPILRVLGPILRLGSVLSFLGTN

SEQ ID NO: 143581 - protein, 451 aa, Heterodera glycines
  Coding regions on vcDNA: vcDNA=SeqID_70004; Strand=+; Position=1-1356
  Homolog annotation: Hit_ID=NP_001004509.1; Match level="QueryCoverage= 85%, HitCoverage=25%, E-value=2e-45, Identity=31%"; Hit description =si:busm1-180o5.3 [Danio rerio] emb|CAD60788.1| novel protein similar to DNA polymerases [Danio rerio]
MKYYDVRSLYPHTNAVTAYPVGHPTRVNIIGEAEQAVDWRRADQVPVRGILKVFVVPPHHVDVPVLPVKFDQRLLFPLCRTCALQHPHGAVNEDYECTHREDDERGWVSTVTSIELEEALRNGYRCTAYYRSVEWDDTRWSDRVFRGYVAEFMAMKTHASGFPDEIGTTEEDQQQFIEECEDKFGIRIEREKMVHNKAKRTIAKLCNNSLWGRFSLRNGLSKMIVTDSPAELRALLDNPAVEVSSVDQLTDECVLVTYAAGNEWVEEHECSNIVLSLWTTSVARLHLLRLMQTVVRAPNSVLIYTDTDSVCFANREADGCPLETGPHLGDLSDEWPDHELVEFVSGGCKQYALRMRHHQSGEEKTVLKVRGITLSADACQLLHFDTFKRSVLHYAMCPMCHSNDDDDDDDDDDDDDDDDDDDDDDDDDDDDDDEDICSILIEYPNFLRPQH

SEQ ID NO: 143582 - protein, 402 aa, Heterodera glycines
  Coding regions on vcDNA: vcDNA=SeqID_70005; Strand=+; Position=1-1209
  Homolog annotation: Hit_ID=NP_920205.1; Match level="QueryCoverage =80%, HitCoverage=21%, E-value=2e-36, Identity=32%"; Hit description =putative DNA helicase homolog [Oryza sativa (japonica cultivar -group)] gb|AAP52492.1| putative DNA helica
MHREIRETMHMQLHRCSDSWCGPSDPIYGRCKKGFPAPYSKCTILRPDRPAMYFRPSPSDGGAQLEVNGLIYDNSHVVPYNPYILLRYRVHHNVLFAYGNKANIKYALKYPFKGPGHCYVECKEESGNKIGIDEPAQYAKMNFRGATEAYAIVHSMPFARLSHHVVKLAIHLPNQQPIVYRAFQLVSKAQQIQQGELPETQCSAYWKQWQNEWKNDPKFKDILFEKVPERFRWAKDKWVLYKRQQIKRPPIGRIVPVPPSDPERFALYSLMRHFPGDPDHLKMVNGLLCTSFTEAAIMHGLLEDNKIWDKTLAEAALSRWPDQMRWLFVSILVYGQPSNAIELWNKYKDQMYNPQGIITPAQHKVAELEALADIDWRLHSCFNLSCVHFSLPDPPTSIAKNT

SEQ ID NO: 143583 - protein, 126 aa, Heterodera glycines
  Coding regions on vcDNA: vcDNA=SeqID_70006; Strand=-; Position=1-380
  Homolog annotation: Hit_ID=CAG90597.1; Match level="QueryCoverage =83%, HitCoverage=22%, E-value=3e-36, Identity=64%"; Hit description =unnamed protein product [Debaryomyces hansenii CBS767] ref|XP _462111.1| unnamed protein product [Debaryomy
DFVYPPPSPLRCTHQRSEGSVEGEVVDLAPVEADHPIGGFGKTISHVNCVLKTTKGSRELRLDPTIYDSLLKQKVTPGDIIYIEAGSGTVKRMGRSDIFANEFDLDADEFVPMPKGDVHKQKEIVQ

SEQ ID NO: 143584 - protein, 355 aa, Heterodera glycines
  Coding regions on vcDNA: vcDNA=SeqID_70007; Strand=-; Position=1 -137,191-245,291-395,440-566,622-725,780-910,1060-1139,1184-1254
  Homolog annotation: Hit_ID=NP_506228.1; Match level="QueryCoverage =85%, HitCoverage=15%, E-value=7e-71, Identity=46%"; Hit description =NIDogen, basement membrane protein (174.4 kD) (nid-1) [Caenorhabditis elegans] emb|CAB01972.1| Hypothetic
SKSPTNRCPLAMAPNARGDGTESLLIGRGMAIIQRNAEPNVNGKQLVVLPHQIVVDILVVLPHQIVVDIEFDCHSERFFWSDISGHSIRSAFLNRFFWSDISGHSIRSAFLNGTGLSSNFSEVLRSPEGIAIDWPSRIAIDWPSRNIYYVDSIKNELGVLSIDGRFQKALLTEGLNNPRALVIDLESALVIDLESRHLYYSDWSREGPKIGRVSLDGSANEIFISDDVHLPNGMVLLFISDDVHLPNGMVLLQQRRWLCWVDAGIQQLSCIGLDGTGRRVIYAPLEYPFGLTVNGAEERFYWTDWEDMKIHSVDVFAEGYTQFLPGGTDWEDMKIHSVDVFAEGYTQFLPGGGGK

SEQ ID NO: 143585 - protein, 91 aa, Heterodera glycines
  Coding regions on vcDNA: vcDNA=SeqID_70008; Strand=+; Position=1 -121,659-813
MGLTLLATIPASSCLQSEQRELYIDNFTLMFFDSLMVQFNGTSTNCHRQQSIDFEDDEHEQQQQNQQHQFEPEELQFVERLSDGQFGSVYK

SEQ ID NO: 143586 - protein, 124 aa, Heterodera glycines
  Coding regions on vcDNA: vcDNA=SeqID_70009; Strand=+; Position=1 -216,365-523
MRPTKFLASGFRVEKSLGFLVASTLGLTFFISQLTYRALDTRNDRMMAVKCIAVDGTSGTRQSLLNEIAILKETEAIKMLEICPINFISLFILLSRGVPMRTLSNSMRHFLWTINCSFAWSSKY

SEQ ID NO: 143587 - protein, 106 aa, Heterodera glycines
  Coding regions on vcDNA: vcDNA=SeqID_70010; Strand=+; Position=1 -164,659-815
MALGRFPFGPGSAVMVPNLFTIESLISRPETIATVIRQPELSAVGYGFDRLIAGCLSLNPKERLRPEQIYQHDFLAAHRPMDQSLVAKFIAEKRQNSQFCGNNGII

SEQ ID NO: 143588 - protein, 44 aa, Heterodera glycines; identical to SEQ ID NO: 129045
  Coding regions on vcDNA: vcDNA=SeqID_70011; Strand=+; Position=1-135

SEQ ID NO: 143589 - protein, 43 aa, Heterodera glycines; identical to SEQ ID NO: 131356
  Coding regions on vcDNA: vcDNA=SeqID_70012; Strand=-; Position=1-505

SEQ ID NO: 143590 - protein, 84 aa, Heterodera glycines
  Coding regions on vcDNA: vcDNA=SeqID_70013; Strand=+; Position=1 -85,158-250,329-405
KKTEAPPLSPPKSTQGKAEEPPSDVFSSDNNMDYGTLKDFDPNRFGAPPLKTQQNMEKNAPPLKVPEKRATAKKGRIKMDQLEI

SEQ ID NO: 143591 - protein, 25 aa, Heterodera glycines
  Coding regions on vcDNA: vcDNA=SeqID_70014; Strand=-; Position=1-75
MWSYVSLPMHRQIECGDLAFYNFQL

SEQ ID NO: 143592 - protein, 121 aa, Heterodera glycines
  Coding regions on vcDNA: vcDNA=SeqID_70015; Strand=+; Position=1 -207,253-408
MDVHDEEVEIIGTRSNERQMDRAHRQEQQQEKFYSQQQMSEESEEALFCISKHDVKEISQVVKAMAFRDHCTLNVSNEGIRLAVDDQHNQQGSAYFRSEHFQDFNFRTQTCSIKIPMRPLM

SEQ ID NO: 143593 - protein, 44 aa, Heterodera glycines
  Coding regions on vcDNA: vcDNA=SeqID_70016; Strand=-; Position=1 -45,141-230
MSGSEPVSNEILNKSKILGLDDVKIYIRYKALINFYNITQAWIA

SEQ ID NO: 143594 - protein, 58 aa, Heterodera glycines
  Coding regions on vcDNA: vcDNA=SeqID_70017; Strand=+; Position=1 -144,458-490
MLNFLQSLNQTFAQQQQKAPDDEAEEGEEMKEQLAEPTIDALVEERMKNYFLMRNKNN

SEQ ID NO: 143595 - protein, 85 aa, Heterodera glycines
  Coding regions on vcDNA: vcDNA=SeqID_70018; Strand=-; Position=1 -99,141-299
  Homolog annotation: Hit_ID=AAD09400.1; Match level="QueryCoverage =60%, HitCoverage=8%, E-value=1e-12, Identity=64%"; Hit description =gamma-glutamyl transpeptidase precursor [Brugia malayi]
METGRLFFNLVQRGYIIGDRQINGDWHIKRANTPLLKDLEVKFGQKFKPTTGFEGIVQGIVVGEDGFVHVNGDYRRRTNMHPEGF

SEQ ID NO: 143596 - protein, 492 aa, Heterodera glycines
  misc_feature (281)..(281): Xaa can be any naturally occurring amino acid
  misc_feature (488)..(488): Xaa can be any naturally occurring amino acid
  Coding regions on vcDNA: vcDNA=SeqID_70019; Strand=+; Position=1 -103,211-311,626-846,898-1041,1090-1380,1575-1642,1706-1813,1866 -2043,3746-3827
  Homolog annotation: Hit_ID=CAE63039.1; Match level="QueryCoverage =100%, HitCoverage=46%, E-value=6e-98, Identity=40%"; Hit description= Hypothetical protein CBG07306 [Caenorhabditis briggsae]
FTLFSALKANANVLRIWGGGFYELDEFYEQADELGLLIWQDFMFACSLYPIDPHFLRSVEAEIEEQVNRLRHHPSVLCWAGNNENELAVRSQWYPSWDYPEEAQARDYVKLYKKHIQTLAVKLDPTRPFLLSSPSNGIETEREGGVSKNPGDPAYGDVHFYSEGGVSKNPGDPAYGDVHFYSESVNLWKPSNFPVPRCSSEFGVQSMPLRGTMARWIGPSDWNYKSGTMARWIGPSDWNYKSGTLVSRQHHPGGVLNLPAIVSQHFNVFVVPPFSIPFSFXAPLLHSSLSLSAPFFIDKFAFLSQIHQAIALQAQIEHYRRFRSHLDEAGLGHTMCAMYWQLNDVWAAPTWSTVVWAAPTWSTVDFDLRWKVGHHFVRRSFSPLIVSMVLLDSNGIFRLWTVSDLSLLDSNGIFRLWTVSDLSLSVQNAIVRLSLFPLRNGLSPLFTANVSVPNISPLSSQEIPLPKKFGKIPFLTSFSQMTYLTLSXGSKI

SEQ ID NO: 143597 - protein, 249 aa, Heterodera glycines
  misc_feature (6)..(6): Xaa can be any naturally occurring amino acid
  misc_feature (8)..(9): Xaa can be any naturally occurring amino acid
  Coding regions on vcDNA: vcDNA=SeqID_70020; Strand=-; Position=1 -303,351-553,836-1075
  Homolog annotation: Hit_ID=CAE64089.1; Match level="QueryCoverage =96%, HitCoverage=46%, E-value=1e-37, Identity=36%"; Hit description =Hypothetical protein CBG08694 [Caenorhabditis briggsae]
RLINNXHXXKKLNEKLRSILDNSRSGTVLFSFGTVANTRTLGESLRRMLLRTFSQFPDFEFIWKLDGESAENESELIKATPNVHTFEWVPQNAILRHPKLRAHPKLRAFVTHCGQNSLAEAAKIGVPIVAIPLFADQLYNAVLAKHRGMAVHVDIRQLITDKTGKVLGTVLHDASFRANAKLIRKKIALSPFGAKEQLVRWVEFAAEFPHLNELNLPTDAELGWVAYYSIDAILFSIGAIFLAILALFL

SEQ ID NO: 143598 - protein, 25 aa, Heterodera glycines
  Coding regions on vcDNA: vcDNA=SeqID_70021; Strand=+; Position=1-77
GVFIGHGSKCGQCVPIGNRPNRTLE

SEQ ID NO: 143599 - protein, 81 aa, Heterodera glycines
  Coding regions on vcDNA: vcDNA=SeqID_70022; Strand=+; Position=1 -36,94-252,472-522
MAKENEKELNPELDKPNPEEMPLLENTPINDLVKKIDRSVGHTSKSDFSKQFSWLLKCALCIILPFMKPNTFSWPLTRTSF

SEQ ID NO: 143600 - protein, 66 aa, Heterodera glycines
  Coding regions on vcDNA: vcDNA=SeqID_70023; Strand=+; Position=1-342
HADGGQTNAMTTWGEGEASPGQFESLDQIPSRDTEILIKLNLKFKPNEIYLLLLFVFSFFKYQKYF

SEQ ID NO: 143601 - protein, 372 aa, Heterodera glycines
  Coding regions on vcDNA: vcDNA=SeqID_70024; Strand=-; Position=1 -148,1612-1862,2123-2227,2504-2558,2605-2746,2882-2949,2994-3120,3176- 3221,3434-3610
MVNVLGFPALTAPTSKSWVTGMPLGVQLIAAPFNEALLIAAAKELERGFETGHSEKVCAPLKDKDKGFYDECLKSEVVKQKGFIPKHLRPPWLALDIFGDNRAEKVDSNCYACYKGSMASGGKFDEEEYCACHYENKAPDIKFGNLFGSIQLSDKLDSCVDNFYKVALVHFYKNDPASEPEGAEFKRTLLLLDGCVSGVKTACKGKVKVEFTEPGTGFFSGNCYEEAKTALENDFELSKGNDLSGFSEKDENGTITEQADDSTVFTLPVLLQHRKCSGLGSATMDNTFKDITLTISGGDCESQSFKLKDVDASKGRVQEMRGLELRMSDGTAKQWTDDSGNYQYTKKDQLMLKPMENIDKIDEFGKFKNPSY

SEQ ID NO: 143602 - protein, 28 aa, Heterodera glycines
  Coding regions on vcDNA: vcDNA=SeqID_70025; Strand=+; Position=1 -33,709-762
MKGEEGKVLGTKLTFMFEPVHNDYFLML

SEQ ID NO: 143603 - protein, 63 aa, Heterodera glycines
  Coding regions on vcDNA: vcDNA=SeqID_70026; Strand=+; Position=1-190
MQWKPEVRTKVIRRGAKVIRRGTTVIKGGTKVIKGGTKVIKRGTKMIRRGTTVIKGGTKMIKR

SEQ ID NO: 143604 - protein, 47 aa, Heterodera glycines; identical to SEQ ID NO: 138137
  Coding regions on vcDNA: vcDNA=SeqID_70027; Strand=-; Position=1-436

SEQ ID NO: 143605 - protein, 50 aa, Heterodera glycines; identical to SEQ ID NO: 125301
  Coding regions on vcDNA: vcDNA=SeqID_70028; Strand=+; Position=1-331

SEQ ID NO: 143606 - protein, 21 aa, Heterodera glycines
  Coding regions on vcDNA: vcDNA=SeqID_70029; Strand=-; Position=1-116
FLKILFISLLIEKHQRALFNF

SEQ ID NO: 143607 - protein, 117 aa, Heterodera glycines
  Coding regions on vcDNA: vcDNA=SeqID_70030; Strand=-; Position=1 -287,334-399
SFAEAVVPVQFMVLSTLPFRFNHTVQLANEITQERLALTSRTRVDAAGEVQTIVMVLRSSMEFDDTQLKEWLNTTRINAAFHDNLVHIGFNDNEIGELPSPSADAESASRTRTTSRS

SEQ ID NO: 143608 - protein, 192 aa, Heterodera glycines
  Coding regions on vcDNA: vcDNA=SeqID_70031; Strand=-; Position=1 -258,315-401,646-879
MLSEYKSNEIRPFRSSHTFIHSFPYFRLPLASTTQQQQQQTETIDAELCTTTDVICLLLNTGHISQSSPSSSAAAKAEDNKTHGPKPTQRLRLDGNIGVARSCRSGHEAGAGQHPVHQRGRHQISAPDSPSVRRGHRTGILHSAHGVSQLASDCATCLATVTGRDQHIGVPEEVRFGHAAQTRVADRAVRLP

SEQ ID NO: 143609 - protein, 47 aa, Heterodera glycines
  Coding regions on vcDNA: vcDNA=SeqID_70032; Strand=-; Position=1 -97,462-508
MTAEEMASEEMKKVREQLTKETILEHQMSVQEGRCPLPKHWTVLGIG

SEQ ID NO: 143610 - protein, 22 aa, Heterodera glycines
  Coding regions on vcDNA: vcDNA=SeqID_70033; Strand=+; Position=1-65
SPLKALSPIMSPFLRMLKNNRP

SEQ ID NO: 143611 - protein, 77 aa, Heterodera glycines
  Coding regions on vcDNA: vcDNA=SeqID_70034; Strand=-; Position=1 -106,305-432
MFEMFWFPGLGQLFGQFMVLRKVLGLGVNKSRSEKVVAKMRSEWRWARPSQVNANAHAKKSKTVAMDKMTQQRMCQP

SEQ ID NO: 143612 - protein, 20 aa, Heterodera glycines
  Coding regions on vcDNA: vcDNA=SeqID_70035; Strand=-; Position=1 -24,517-555
MYLYKFAQLIFLQMYLYKFA

SEQ ID NO: 143613 - protein, 45 aa, Heterodera glycines
  misc_feature (40)..(40): Xaa can be any naturally occurring amino acid
  Coding regions on vcDNA: vcDNA=SeqID_70036; Strand=-; Position=1-135
CLSTPNGHLKKSIFLFSGQSPRTDAPRFMGRTNPSGVASXIALYF

SEQ ID NO: 143614 - protein, 88 aa, Heterodera glycines
  Coding regions on vcDNA: vcDNA=SeqID_70037; Strand=-; Position=1 -96,135-305
MPKQNEIVLKYSFLDLTWFLDIEAVFYAISKTKKCLVVKTIFHISLHNFVSSARIETGIRPLERAARALQEGMERKNSHFWDFFRNQN

SEQ ID NO: 143615 - protein, 119 aa, Heterodera glycines
  Coding regions on vcDNA: vcDNA=SeqID_70038; Strand=-; Position=1 -141,189-460
SAESLLFVLSFSATTIAIALRPPQLAKKDVSLPFHFGAFPSPKCPSVFAFAVLWPFGKVRSKAPPNCVANVSAISDGTFSADRGAARPPGPPIVPRFALHRLSIRSGGRRSVRRQSRHC

SEQ ID NO: 143616 - protein, 93 aa, Heterodera glycines
  Coding regions on vcDNA: vcDNA=SeqID_70039; Strand=-; Position=1 -137,200-299,625-666
MSTPPKADDKKKEVGGIMNIGNTCYMGAALQALANVTALSNFLMENENRLPNNKLVMEYVQMIKSILVLRQPAAPFELKHWRNEVLAPKKGSV

SEQ ID NO: 143617 - protein, 67 aa, Heterodera glycines
  Coding regions on vcDNA: vcDNA=SeqID_70040; Strand=+; Position=1 -44,166-325
MRIRMNQLLFTQTSRYCITDWDFIWGMSNCPFDSNMLILCHILKKVYYHLNQSTGLTTFESGKQNQT

SEQ ID NO: 143618 - protein, 20 aa, Heterodera glycines
  Coding regions on vcDNA: vcDNA=SeqID_70041; Strand=+; Position=1-63
VKLVLYNGEGLQNLERLYRF

SEQ ID NO: 143619 - protein, 36 aa, Heterodera glycines
  Coding regions on vcDNA: vcDNA=SeqID_70042; Strand=+; Position=1-142
KPKLFGLFKKELKIFKNFIHLPFDRKSIREPYLNVN

SEQ ID NO: 143620 - protein, 241 aa, Heterodera glycines
  Coding regions on vcDNA: vcDNA=SeqID_70043; Strand=+; Position=1 -104,402-1020
  Homolog annotation: Hit_ID=CAE69590.1; Match level="QueryCoverage =75%, HitCoverage=9%, E-value=2e-21, Identity=31%"; Hit description =Hypothetical protein CBG15812 [Caenorhabditis briggsae]
MSASIIKNGVLGFVRVLALWSRTLLEAISSGRDRDVFLWSGGLIEPSECLFRSGLINPNTGVFNDRANVQQPVPLYHALRRGFIKLPSMATGIALTLTDCVEWFFIDDNTGKFSDRFSDDQFSLFDAIHQPRPLVKSNVREIIDMANNRRLTVAEAVRANVLCQDTGRFINVHGHAESLRDAYQLKLVQKPQTLAEVIDSGSLDNDGRFIDGVKPRTLLEAICSGMLDPDVAHIRAGPGDE

SEQ ID NO: 143621 - protein, 50 aa, Heterodera glycines; identical to SEQ ID NO: 135818
  Coding regions on vcDNA: vcDNA=SeqID_70044; Strand=-; Position=1-154

SEQ ID NO: 143622 - protein, 96 aa, Heterodera glycines
  Coding regions on vcDNA: vcDNA=SeqID_70045; Strand=-; Position=1 -90,345-437,550-657
MVRTFFHDNEAGFTKKYYFCELQFFAINELPWDIAVLKFYAETMGNIWDPLFTYLDEVITSLENGDMPAYITESSPKNSANSLEDLPSVEAPQSDD

SEQ ID NO: 143623 - protein, 18 aa, Heterodera glycines
  Coding regions on vcDNA: vcDNA=SeqID_70046; Strand=+; Position=1-56
YREAIPEGFGLPINLGAS

SEQ ID NO: 143624 - protein, 167 aa, Heterodera glycines
  Coding regions on vcDNA: vcDNA=SeqID_70047; Strand=-; Position=1-504
MNGQKDENTKSGTFQDQTIRSVRAVGVGPMIAGSPGPAQLGDQQQSCASTQQQFLAPVEIRQFPQNARLWTEQRPIGDGGAATQMDAQFHPTGTQSIMVPQHGQSTGRSLPTLSDAKWRRIGGISAAAAAQWQFPIAVQRNAIVHATNDVRLKAHSNEWKQRSFICI

SEQ ID NO: 143625 - protein, 18 aa, Heterodera glycines
  Coding regions on vcDNA: vcDNA=SeqID_70048; Strand=+; Position=1-56
ILFDRARQEKATVGTKFA

SEQ ID NO: 143626 - protein, 210 aa, Heterodera glycines
  Coding regions on vcDNA: vcDNA=SeqID_70049; Strand=-; Position=1-633
MIGFMSTNAQNPPQMQNAYNPQLQQPYLPQGNHQFGMINQAHIPQVVQPISQPQQQQINAAQNLARQNFENRPIENVIERGREPGMDQVAYALIISQIPALKVNEGAEKFREFFKRFDSNTGEWTNAKRISSLESKVFGRAERAFRSACSTVPFRYELIKREMLRQLEETDAREWNAFDQKVPLINPNRTTQIRNAHKIRNREIFSGKII

SEQ ID NO: 143627 - protein, 536 aa, Heterodera glycines
  Coding regions on vcDNA: vcDNA=SeqID_70050; Strand=-; Position=1-1611
  Homolog annotation: Hit_ID=XP_318550.1; Match level="QueryCoverage =97%, HitCoverage=53%, E-value=1e-122, Identity=44%"; Hit description= ENSANGP00000020240 [Anopheles gambiae]
MPPPHEKTTLRSFLGALNYYGRFIKEMRQIRTPLDQLLKKDENWKWEAEQQQAFEKAKEIMTSELLLTHYDPSLPIVVAADASKDGIGATISHIFPDKREKVIEHASCTLSSAQRNYSQIEKEALALVFAVQKFHKMVFGRKFTLLTDHKPLLAIFGSKKGIPIYAASRLQRWALILSNYEFDIKYVNTAAFGQADVLSRLIANYPRPEEDILIANICTETECFINSVFQVQIDQLPLTAAEIADATAKDEILSELLRLPKNGWPNKCNDPNIAPFFPKRDEIVEVEGCLLYQQRVIIPGILRGRALKALHLSHPGIVRMKALGRRHIYWPGLDSEIEKTVKSCEECQNAQKNPTKSTLAPWTPTSKVSERVHIDFAGPCDDGFVYLIMVDSYSKWPEVCQMKSINSQATVGFLRSIIYRLGVPEEIVSDNGTQFRSADFAKFCTEFGIKHTFTPPYHPQSNGQAERFVDTFKRAMKKCSKNDKDWAEKALLSYRTTPNATSNGYSPDQLFFGRKLRTKMSLVHPRGEPIENIDHD

SEQ ID NO: 143628 - protein, 103 aa, Heterodera glycines
  Coding regions on vcDNA: vcDNA=SeqID_70051; Strand=-; Position=1-309
MNAAKLEQILNAVLTQSETRMQQLLGNAVPANNNLSNANLASSIDARISKFYYDAESANTFEQWFKRFGTLIEDDGKDLPEATKVRLLLGKLSDEDYNKYRDS

SEQ ID NO: 143629 - protein, 81 aa, Heterodera glycines
  Coding regions on vcDNA: vcDNA=SeqID_70052; Strand=+; Position=1 -165,669-748
MAEETSKTSENIAEDNGIKVLDSLFAAVAHASKCLAFAAGTPNFCLATPAFLAVMPVAVLFRSYRRDGNAFTVQAAYNVIL

SEQ ID NO: 143630 - protein, 28 aa, Heterodera glycines
  Coding regions on vcDNA: vcDNA=SeqID_70053; Strand=+; Position=1-85
IFFVCVSNIVRLFDRARQEKATVGTKFA

SEQ ID NO: 143631 - protein, 178 aa, Heterodera glycines
  Coding regions on vcDNA: vcDNA=SeqID_70054; Strand=+; Position=1 -104,163-334,539-799
MADPLNTRGSTLFQAISPECYANSGTFAHITGLMPNHEYRFRLAAMTATGDVLYSEPISARTRHEQAPVVYNSKERRELDGTHHQQQHNDNRQKNVQQKPIAPQLSAEEQPEETTATSRAMLPKAPNCSAPTFSALTSESARVAWKLVKSAEDGGTKELSPKVEKQRKTAKARRRHQH

SEQ ID NO: 143632 - protein, 113 aa, Heterodera glycines
  Coding regions on vcDNA: vcDNA=SeqID_70055; Strand=+; Position=1 -127,209-423
MGTEFKGLYEEHKKSEKARKKYLKNQPKQPIRAAVANEFSRHKIGYGPDPYTDFYGSIVRIFFGRYGFFTDNSFPWFLVRNPYRYQVRNTDTDPYFRKIPISIDYQRNLFKNA

SEQ ID NO: 143633 - protein, 40 aa, Heterodera glycines
  Coding regions on vcDNA: vcDNA=SeqID_70056; Strand=+; Position=1 -46,562-638
MQMTKRRTALSTPKQDVIVRGIGIIIVVKFILKIVTVYIK

SEQ ID NO: 143634 - protein, 66 aa, Heterodera glycines
  Coding regions on vcDNA: vcDNA=SeqID_70057; Strand=-; Position=1 -7,318-511
MTIVTPLWVGAMDGHFEVCQALVKHGADVDLGAPQFAMSPLMAACNINARLDTGLFFISKHTQNLN

SEQ ID NO: 143635 - protein, 17 aa, Heterodera glycines
  Coding regions on vcDNA: vcDNA=SeqID_70058; Strand=-; Position=1-51
EYEADALKSDGELEREE

SEQ ID NO: 143636 - protein, 274 aa, Heterodera glycines
  misc_feature (74)..(74): Xaa can be any naturally occurring amino acid
  Coding regions on vcDNA: vcDNA=SeqID_70059; Strand=+; Position=1 -697,736-824
  Homolog annotation: Hit_ID=NP_502797.1; Match level="QueryCoverage =89%, HitCoverage=71%, E-value=3e-46, Identity=38%"; Hit description =HASI (4P602) [Caenorhabditis elegans] emb|CAB16520.1| Hypothetical protein Y57G11C.19 [Caenorhabditis ele
VEKILSKIYFNLKSPASFAGIQKILNAAKKIDPKITTDDVNKFLEKQKTYTIHKPIRKRFPRLKTIPSGFHTDXQCDLCIFDQLKKHNDGYKYLLVCIDVLSRMIFSAPAKSKKSEDMIEAFDRVFEKSKIIPMKIYSDSGLEFQAGKIKNILRKNFIKNVMYSPDLHAGVVERANRTIKERLYRYFTKKDTLRWVDVIDKIITNINNSVNRTLGAKPSSINLKMPVRSGKNKFKIGDIVRITRKNKFKIGDIVRITRKRENFKGIPPNFTEEL

SEQ ID NO: 143637 - protein, 18 aa, Heterodera glycines
  Coding regions on vcDNA: vcDNA=SeqID_70060; Strand=+; Position=1-56
YREAIPEGFGLPINLGAS

SEQ ID NO: 143638 - protein, 118 aa, Heterodera glycines
  Coding regions on vcDNA: vcDNA=SeqID_70061; Strand=-; Position=1 -122,540-774
MAHQMARAAINKGARVLSVLEKVKLVCWFEETHSFAQVARRYRAEFGMEPPQMDQVKKLHQRFLNTGSILNGTTTPQTMATALSAGIDDVVVNQSQQMSVVCDAGALDAEEQLRMARM

SEQ ID NO: 143639 - protein, 278 aa, Heterodera glycines
  Coding regions on vcDNA: vcDNA=SeqID_70062; Strand=+; Position=1 -321,374-673,840-1053
  Homolog annotation: Hit_ID=BAD67848.1; Match level="QueryCoverage =28%, HitCoverage=24%, E-value=3e-19, Identity=55%"; Hit description =putative serine/threonine protein phosphatase PP1 [Oryza sativa (japonica cultivar-group)]
RAEEALGAETTPLGAELEKLCANAERIAVQQEKLMEKMELYKQKLSSGLAHGTAMLVASKVVGERTPFGEALQKTAQTLAALDAARRQLSKSDVKLGGTTTTISAIRKQLALLQTKRLDLDVFKAKFRRASTTEEKNAVRMFFVVVAAEFTIFQSFSDSAPIATSTERVHAPSNTAEGARLGLPEEYAEHEEEPAGVRGGPNQIPHDVSSGEIQQLCAAATDAFKRQPSLVEILPPVMVCGDVHGQFPDLMRIFNCLGTPPEKKYLFLGDYVDRGAPI

SEQ ID NO: 143640 - protein, 53 aa, Heterodera glycines
  Coding regions on vcDNA: vcDNA=SeqID_70063; Strand=+; Position=1 -43,678-796
MDKQKKRTTENYEKELIINIIEFLWRGGVKKSFAICKGRDWHNPRLTAYAPIS

SEQ ID NO: 143641 - protein, 75 aa, Heterodera glycines
  Coding regions on vcDNA: vcDNA=SeqID_70064; Strand=+; Position=1 -224,426-429
MMTTAAAMTTSTTPQLQHHHHHHQQQQQSIFARLSATIGHHSQSEQKLARMRAAYSGANEGGGGASANAKIQKAG

SEQ ID NO: 143642 - protein, 21 aa, Heterodera glycines
  Coding regions on vcDNA: vcDNA=SeqID_70065; Strand=+; Position=1 -54,576-587
MRTRPIWQVKQRLLTSQKKGF

SEQ ID NO: 143643 - protein, 149 aa, Heterodera glycines
  Coding regions on vcDNA: vcDNA=SeqID_70066; Strand=+; Position=1-450
MEEWERSFQVAAKRWKNDGQGVPQHNRRPMGRVATPVMSYLDGIFQRRAKVPSVASMRVTNTAREWINRNRDEMGAFPPATAHRPALMQPKIEKHQAHVNDDYRERQTYPIRRHARDEGEHDRKHGRDEITGMTTFETVRLQPPIPFCV

SEQ ID NO: 143644 - protein, 295 aa, Heterodera glycines
  Coding regions on vcDNA: vcDNA=SeqID_70067; Strand=-; Position=1-888
  Homolog annotation: Hit_ID=NP_506644.1; Match level="QueryCoverage =61%, HitCoverage=22%, E-value=2e-20, Identity=35%"; Hit description =predicted CDS, RNA-directed DNA polymerase family member (5P241) [Caenorhabditis elegans] emb|CAB60585.1|
MRTITQTTQPQLLIGIRKFWDFVTGFRKTERGTYIVDTVFGPIVCGERFQVSSGATPAPSVFMTLPCGEDERDQMPPIRAVEQFWSLEAIWIRDDPTDDADAQAVIQFERSVRQLNDGRYSIRLPWRECHPALPTNFSMAYRRLTTMLQRLQKTPEVLKQYTTVITDQLNAAIIEETTIGAGKHEHFIPHQAVITPKKLRVVYDASAHTRGAPSLDGCLLRGPVWLPDLADMLIRFRACRVPVIADVEKAGDIPISTPRIWAHAKPLLSRRRCTTPPAQIRLQLRGGTHSGHIRG

SEQ ID NO: 143645 - protein, 609 aa, Heterodera glycines
  Coding regions on vcDNA: vcDNA=SeqID_70068; Strand=-; Position=1-1830
  Homolog annotation: Hit_ID=CAA82797.1; Match level="QueryCoverage =37%, HitCoverage=35%, E-value=2e-11, Identity=26%"; Hit description =gag protein [Ascaris lumbricoides]
MRRALEDEEEAIARSRLSGSFGTNNSHPVGDDPPPLENRNMEEWERSFQVAAKRWKNDGQGVPQHNRRPMGRVATPVMSYLDGIFQRRAKVPSVASMRVTNTAREWINRNRDEMGAFPPATAHRLALMQPKIEKHQAHVNDDYRERQTYPIRRHARDEGEHDRKHGRDEITGMTTFETVRLQPAIFSGKPEDWTTFWAYFKRAVDDKPIPGFEKQLHLLRCLKEGSPARRAVEVYPPSDGNYPVVVQLLKERFGDTDDLQRAIRARLLHLAPAKDNVNSLTTMIDEFERCVCQLEQLGANVDDDSFGPLLEAKLPVRLLTELRIRESMMGSKWSVRDFRRAVSAQVRCMRSAESALAAMKDPEVRTDHRTERDHTGRGGKAGREPFKEHLWYGTANKTRAQPNGTRKEEQCGTSARFTGRTVARGNENGHTGGGGNGPRFAQNGLPPSFGRGNCSFCLESGHRPSECRAYPTPQERRKRLIEQKRCLRCLGSDHTFEQCQRTVRCDACRKDDHHWLMCWKNQPGNQSRLSGEPERKENNHAMLISGMDQPTHVTTARDEPNSRDISETNAGEQRAFTAFGSRVPAQQMIRRVTAAAEEGEERVPNNIAV

SEQ ID NO: 143646 - protein, 94 aa, Heterodera glycines
  Coding regions on vcDNA: vcDNA=SeqID_70069; Strand=+; Position=1-354
SVHLNNFYPKNFFGDFGADPLNRCAQIYGETESFRNRFPIACTLILRWIFAPHNCLSTPNGHLKKSIFLLSGQTPRTDAPRFMGRPNPSGTASL

SEQ ID NO: 143647 - protein, 228 aa, Heterodera glycines
  Coding regions on vcDNA: vcDNA=SeqID_70070; Strand=-; Position=1 -156,243-445,672-999
  Homolog annotation: Hit_ID=NP_491134.1; Match level="QueryCoverage =85%, HitCoverage=37%, E-value=4e-39, Identity=47%"; Hit description =SAR DNA-binding like (54.6 kD) (1D835) [Caenorhabditis elegans] gb|AAK21475.1| Hypothetical protein W01B1
MALAKCPASTVQILGAEKALFRALKTKKDTPKYGIIYHAQLVTQAGQKSKGKIARKLAAKVSLATRVDALCDESLGNGQGIEARVYIEQAIKEADARGGAKKQRFSGVKQAPKGAYTFKKGEVHHYDAKFDMTLKKGTEQAEEPQQEEQQSGKAKKGTKRMRSEGETEGGEEETEEHQQKEKEQKKVKLEETEGEEGEATRKKAREETEEPSGGEQQKGQKKKKKSKG

SEQ ID NO: 143648 - protein, 115 aa, Heterodera glycines
  Coding regions on vcDNA: vcDNA=SeqID_70071; Strand=+; Position=1-348
  Homolog annotation: Hit_ID=XP_528877.1; Match level="QueryCoverage =100%, HitCoverage=47%, E-value=4e-09, Identity=34%"; Hit description= PREDICTED: similar to endoplasmic reticulum membrane protein family member with at least 5 transmembrane
MGLNPPAFQSLGLNPPAFQSLGLNPPAFQSLGLNPPAFQSLGLNPPAFQSLGLNPPAFQSLGLNPWDSTPQHFNHWDSHPQNFNHWDSHPQHFNHCDSHPQHFNHWDSHPQHFNL

SEQ ID NO: 143649 - protein, 40 aa, Heterodera glycines
  Coding regions on vcDNA: vcDNA=SeqID_70072; Strand=+; Position=1-120
MCDRLTQIQDLVNDLANHMCNSVGVLQASAGPCEFGTAPE

SEQ ID NO: 143650 - protein, 302 aa, Heterodera glycines
  Coding regions on vcDNA: vcDNA=SeqID_70073; Strand=-; Position=1-906
MKQFCLSLFSIGVSVWLLTIFLLLMIMPSSIDGIQITVKADAMLTKESNQTTVVVQGSTTVKELKELIKKEAWRIQSEKKTFGIKNPDDGTVTVLQDSDTMADNKIEEGAVILVFVNFEIKVTAEENIFNEQSPIKTKIITVRVNGTEKVEDLKQKIIGKMEMETKTKIGTELTKISLQYGPEDDYVFLNDEKKIYYYQFQKSGIIRLSIGEFQIVVREEIENEVKNYPIWVKSNETVAILKKKIKSLVEIEPEEQTLSWTLNGQTFDDNKTLKFNLIENALEYYGTENNTTITLSREFKIT

SEQ ID NO: 143651 - protein, 219 aa, Heterodera glycines
  Coding regions on vcDNA: vcDNA=SeqID_70074; Strand=+; Position=1 -212,260-293,407-645,693-753,797-908
  Homolog annotation: Hit_ID=NP_035395.2; Match level="QueryCoverage =96%, HitCoverage=26%, E-value=3e-36, Identity=40%"; Hit description =regulatory factor X, 3 (influences HLA class II expression) [Mus musculus] gb|AAH17598.1| Regulatory fact
MRPFAKNLCASMAKALGAAAPSALRELKLAGVRLLSNAITRLSSVAHLAVTAREVLQSDEQMAQMHADFARLDFAVLHEQVEWCCDWSSGWLRSLEEQFGAGLSQRRRLEEWADWLDCLAARVLQTPAPLTPARSPQDTPPTAPEAQFVRGKQLLLAWTFWSSLVLRDFTLRSAASFGQFHLIRLLFDDYLSISVERRLAQLSGQPAIALMAPEAKSRQ

SEQ ID NO: 143652 - protein, 179 aa, Heterodera glycines
  Coding regions on vcDNA: vcDNA=SeqID_70075; Strand=-; Position=1 -280,427-684
MFPIGEKGQPKRAASFISLKGNDAEREEKQQKCQNGEMAQSRKRISFNLPIEEEGQQQQIKRRSENALGIVQQLRRWSTRDGEGGKRSKETDGVKNDTILEKGQARRTNSNASLLTIQKQQFKGIRRHGTIARILCRWNGQKQAERETAIDDSAQQKKTDDQNKTDDQTDQNENGGWAY

SEQ ID NO: 143653 - protein, 111 aa, Heterodera glycines
  Coding regions on vcDNA: vcDNA=SeqID_70076; Strand=-; Position=1-336
  Homolog annotation: Hit_ID=NP_990561.1; Match level="QueryCoverage =99%, HitCoverage=9%, E-value=7e-33, Identity=64%"; Hit description =SCII [Gallus gallus] emb|CAA56767.1| chicken SCII [Gallus gallus] sp|Q90988|SMC2_CHICK Structural maintena
MRIKKIEIEGFKSYSQHEAVRDLDPEFNAITGLNGSGKSNILDAICFLLGITNLAQVRVHSLNELVYKQGQAGISRATVTITFDNDVPPDKQPAGYNKYKEIVVRRQVIVT

SEQ ID NO: 143654 - protein, 216 aa, Heterodera glycines
  Coding regions on vcDNA: vcDNA=SeqID_70077; Strand=-; Position=1-650
  Homolog annotation: Hit_ID=XP_319741.1; Match level="QueryCoverage =98%, HitCoverage=51%, E-value=4e-18, Identity=28%"; Hit description =ENSANGP00000006515 [Anopheles gambiae]
MNKLSENAFSEYNKFYLPKKVTDFNYDEAVKNLEKLFAKPQSIFIDRFECLTAEKWENEDFCQFINMHKQLLNNFKFVNLKEEQFKGLMLLTALKSSRDTVLRQCILSKLASYGESVKYDEVVEDCINFMTTITEAKMIEYSTSKLVVNAMKQNVNKREKGSNPKFQQGHTSAHTPKCWRCGKLYHSYKDCLHKSAKCHKCNQVGHLERQCDKVQE

SEQ ID NO: 143655 - protein, 219 aa, Heterodera glycines
  Coding regions on vcDNA: vcDNA=SeqID_70078; Strand=-; Position=1 -164,477-550,598-767,1177-1428
MCYKSVLSGEENFPWKVSRRFRFFSYLLDKSGKCGKKVRIAMNGTQFSMGRECFNITPHSKIEIQFDANKCSAQINLNETNKPLLDFGKEFSDQFNFGPFLDDYAGLWLLGLDILPKFGPKTTEISMEKPKNCQLEMVGGVEIDIKTVPWTVLFQGLVKRNEQNKMKIFQNCASTFISPEFVLLAAHCFDKTKEGKYFHLGKKQKQFKCSLNALLITLL

SEQ ID NO: 143656 - protein, 178 aa, Heterodera glycines
  Coding regions on vcDNA: vcDNA=SeqID_70079; Strand=-; Position=1 -36,93-251,298-394,480-576,698-767
  Homolog annotation: Hit_ID=NP_492020.1; Match level="QueryCoverage =97%, HitCoverage=39%, E-value=6e-68, Identity=46%"; Hit description =tissue factor pathway inhibitor precursor family member (100.0 kD) (1H712) [Caenorhabditis elegans] emb|C
YYFLFSCPDGGEVWKEPNGVWKEPNGAVRPCTTNRQCPSTHYCTPVTVFSGTVYQTKSLCCPSKNFVCSQPKDQGVRCSSTRITRHFFNADDQGVRCSSTRITRHFFNADTKTCQPFEYNGCEGNRNNFATQKSCQNYCLSEACSPGTVVARDSDSIRLIQCTNPGGTGRDGYSCFSS

SEQ ID NO: 143657 - protein, 95 aa, Heterodera glycines
  Coding regions on vcDNA: vcDNA=SeqID_70080; Strand=-; Position=1 -63,157-268,362-473
VSPLLRDSQSKHPPPSLMDLASALKSPAEEQNEERRLLDDEVVQFIIKNKLTLINTLIKDCYYFLIEMGDEWKTAIRIPLPLAFVSRYLWATDKL

SEQ ID NO: 143658 - protein, 19 aa, Heterodera glycines
  Coding regions on vcDNA: vcDNA=SeqID_70081; Strand=+; Position=1-60
EPMNSCIGCKCRRCCTPNS

SEQ ID NO: 143659 - protein, 80 aa, Heterodera glycines
  Coding regions on vcDNA: vcDNA=SeqID_70082; Strand=+; Position=1-240
LMPALRCVAVERRALSRPFGRRTDENVHIGTIDALRLFRCPGTSEDGPILCLSGARDRQITLRKCQCGEMPASVSSPNDN

SEQ ID NO: 143660 - protein, 95 aa, Heterodera glycines; identical to SEQ ID NO: 136988
  Coding regions on vcDNA: vcDNA=SeqID_70083; Strand=-; Position=1-700

SEQ ID NO: 143661 - protein, 80 aa, Heterodera glycines; identical to SEQ ID NO: 142591
  Coding regions on vcDNA: vcDNA=SeqID_70084; Strand=+; Position=1-323

SEQ ID NO: 143662 - protein, 111 aa, Heterodera glycines
  Coding regions on vcDNA: vcDNA=SeqID_70085; Strand=+; Position=1 -90,421-666
MTITSTTKKNSTNNTSPACQQVTKVKRTKKEQFLGRNCPGRNACRNITEVSLIKSIISDGVIGILFLGGMRDWVMPLDFGHADAEAKHLIHIVANCHREEYSPITTHCERE

SEQ ID NO: 143663 - protein, 191 aa, Heterodera glycines
  Coding regions on vcDNA: vcDNA=SeqID_70086; Strand=+; Position=1 -67,116-624
MRTVGIRGQGQMPGGQEAEVQRVTNWGHFALYKQQQPQCIYDKAVMAIDAAHAHANAAQRARHVAAGVPEHGRAAAGAHHCVRQHFGRPTNGRGGGPADVRDWQGAEPGSAGVLLQNDEDHVQLAEAGRDANVGKFKIWHSQLAEFSAKHVKSSLKLLENAVDEQQLRTSGKWQFEQLYNNAQREGVCFAK

SEQ ID NO: 143664 - protein, 24 aa, Heterodera glycines
  Coding regions on vcDNA: vcDNA=SeqID_70087; Strand=-; Position=1-80
RTLSTAVRQRSSKIYSMPQILWAG

SEQ ID NO: 143665 - protein, 48 aa, Heterodera glycines
  Coding regions on vcDNA: vcDNA=SeqID_70088; Strand=+; Position=1 -46,200-300
MTFYASLVGYTGRNNKILSVKSAFGILMSKSGTVNEILCFSCWIHGKK

SEQ ID NO: 143666 - protein, 48 aa, Heterodera glycines
  Coding regions on vcDNA: vcDNA=SeqID_70089; Strand=+; Position=1 -46,200-300
MTFYASLVGYRGRNNKILSVKSAFGILMSKSGTVNEILCFSCWIHGKK

SEQ ID NO: 143667 - protein, 48 aa, Heterodera glycines
  Coding regions on vcDNA: vcDNA=SeqID_70090; Strand=+; Position=1 -46,456-556
MKFYASLVGYTGRNNKILSVISAFGILMSKSVTVNDILCFSCWIHGKK

SEQ ID NO: 143668 - protein, 1120 aa, Heterodera glycines
  Coding regions on vcDNA: vcDNA=SeqID_70091; Strand=+; Position=1-3361
  Homolog annotation: Hit_ID=NP_508324.1; Match level="QueryCoverage =100%, HitCoverage=46%, E-value=5e-66, Identity=27%"; Hit description= predicted CDS, peptidase family A16 and RNA-directed DNA polymerase and Integrase, catalytic domain and
MSGFIRSKIPLLNRVLRKEIQSTKTKIEENKFEFDQNNLDECTRVFNKTKEIIQKIEPNFEKLKTLHKKWQNLMRRMDKEEWNTEWKIQKIFREKHDYLKTIKETDEILDTLKDINLEVKRRLKVIKAKPSSDTDQEDESNDDEEENEDEEIEEEDEEEKEYDSDQEDDSPELTSNDQTNRKQTPFVNYRSRIKLPPQTLTHFSGKFSQWPSFWDDFKSSVHNDPNLENIQKLKYLRGLLHDEPYRIVSPYPLTNKNYPIIIKLLKSRYGNPQLIRENLHSELRNLRKPNESTSELRRFILFIDRIILQLQSQGEEINHPQIKQSIETKLPFNIRLKLREKFKLYSTKELMNFLNSHTQAREDIERMEDSNRQIRNFTPHRPPQNRPQRQSYPNYSQPQLKANHRNHQNMPLSPYPITSALTTKSKPVRLAEFKPKPSQPKPQTKIKFCRFCERDNHLSKECKIYSTTEKRSNRARELKLCLNCLKKGHHLKECKSPFSCFNCKSKHNTLLCTRKTNQFNQREQFTNVNVTQNPEEFEETQNFMSLDCDQTDEILQNDEEELLMTTEAPVLNPDQNRTQNEVIFFDNGSQKSYITDECADSLQLPTIDEKLLAISTFNQNKPKIISSRLVKIGIKTLNGEIEYVTLQTVEKITDVTKMVNRETVDIRKRKIPINHACPQILIGIDHYWHFMLPNSQIQILPSGFYSIDTKLGKILSGKGTIEDTNINLVKEKRKKDETNEILQKFWELENIGITDSPHLTDEDTALIHFDKNVIFEENRYYIRWPYKRETPNLPTNFGLCLGRLRNVVKQLIKNKQLENYNKILQEQMDTDVNEIADFKSKNLIHYLPHHPVIKESSNTTKIRPVFDASAKLRGSNSLNDEIHQGPKLLPDLCGMILRFRLKNFVLIGDLEKAFLRVGLNEIDRDTTRFLWVNQSYLDEINQKYREIEMRDVELRRFTRIPFGVNASPFLLTAVVNLHLSKTDEMFEKFKTLQIDEELCLSGKEKQFKELCTELKENAYVDNFVMMCDDEKEIKFKHYWSKEIFKLASMNLREFVSNHEQSNKEIQKMEGSEIPKITKMLGIKWNVDTDELELQIKIPLMSRDTTKRQILTMIAKNFDPM

SEQ ID NO: 143669 - protein, 88 aa, Heterodera glycines
  Coding regions on vcDNA: vcDNA=SeqID_70092; Strand=+; Position=1 -198,1278-1346
  Homolog annotation: Hit_ID=CAC83611.1; Match level="QueryCoverage =63%, HitCoverage=20%, E-value=2e-14, Identity=69%"; Hit description =EXPB1 protein [Globodera rostochiensis]
MNAFLSLFGILLGLQFHAQIVSATVTASLKTATTWNGGGQYMVNFKNNDGSKTVCSVKFSLTPKSGECAVDHLLLAVAAAILLHVPLA

SEQ ID NO: 143670 - protein, 37 aa, Heterodera glycines
  Coding regions on vcDNA: vcDNA=SeqID_70093; Strand=+; Position=1-111
IKVNIEASNQVENVLFMLNISKQVRRKKGICLKMRSL

SEQ ID NO: 143671 - protein, 22 aa, Heterodera glycines
  Coding regions on vcDNA: vcDNA=SeqID_70094; Strand=-; Position=1-68
MNWSNGRWQAVWLVVSEEGKEL

SEQ ID NO: 143672 - protein, 57 aa, Heterodera glycines
  Coding regions on vcDNA: vcDNA=SeqID_70095; Strand=-; Position=1 -11,891-1053
MHPCLLGWKWADKVDDEADENESTRSNGTFACKWGGEAGDDEEEDESENECIRFNDD

SEQ ID NO: 143673 - protein, 45 aa, Heterodera glycines; identical to SEQ ID NO: 124527
  Coding regions on vcDNA: vcDNA=SeqID_70096; Strand=+; Position=1-138

SEQ ID NO: 143674 - protein, 104 aa, Heterodera glycines
  Coding regions on vcDNA: vcDNA=SeqID_70097; Strand=-; Position=1-597
FCVGFLLPSLFEYPKRTLEKIDSFVFGAVPPSRCAQIYGETESFRNSFPIACTLILRWIFAPHNCLSTPNGHLKKSIFLFSGQSPRTDAPRFMGRPNPSGIASL

SEQ ID NO: 143675 - protein, 22 aa, Heterodera glycines
  Coding regions on vcDNA: vcDNA=SeqID_70098; Strand=+; Position=1-67
EEIEKSIVSSRWQTEGYIGAMD

SEQ ID NO: 143676 - protein, 22 aa, Heterodera glycines
  Coding regions on vcDNA: vcDNA=SeqID_70099; Strand=+; Position=1-68
MARKDFRFPTFLGSEFRLPKIF

SEQ ID NO: 143677 - protein, 101 aa, Heterodera glycines
  Coding regions on vcDNA: vcDNA=SeqID_70100; Strand=-; Position=1 -229,279-352
MDLSDLAVELEDSLNLRHDGAVSEEDWLFGPEDGIDTSAAVKTTEEKQNLDKWLRGAVEKVDFRTRSALSRRLEKKKRKADKEKRLKCSNNAENSLSMIEE

SEQ ID NO: 143678 - protein, 110 aa, Heterodera glycines
  Coding regions on vcDNA: vcDNA=SeqID_70101; Strand=-; Position=1 -3,282-611
MVDQWRRRNVRPYKEEFEEAKRHSIHTMSGFIRFQTLEKSKLSIYPTNFLKSVAQKHIGDDVVNNRTIETVVGALVDLAALQSNHSLVKWMPHFQCPIPCEHRYTVWRNL

SEQ ID NO: 143679 - protein, 32 aa, Heterodera glycines
  Coding regions on vcDNA: vcDNA=SeqID_70102; Strand=-; Position=1 -95,349-352
MFRFLLQFFAFLSVTIAQNFETGDNSTVHGCS

SEQ ID NO: 143680 - protein, 21 aa, Heterodera glycines
  Coding regions on vcDNA: vcDNA=SeqID_70103; Strand=+; Position=1 -54,583-594
MRTRPIWQVKQRLLTSQKKML

SEQ ID NO: 143681 - protein, 70 aa, Heterodera glycines
  misc_feature (47)..(47): Xaa can be any naturally occurring amino acid
  Coding regions on vcDNA: vcDNA=SeqID_70104; Strand=-; Position=1-213
FEYPKRTLEKIDFFVFGAVPPNRCAQIYGETESFGNSFPIACTLILXWIFAPHKCLSTPNGHLKNRFFWF

SEQ ID NO: 143682 - protein, 24 aa, Heterodera glycines
  Coding regions on vcDNA: vcDNA=SeqID_70105; Strand=-; Position=1-80
RTLSTAVRQRSSKIYSMPQILWAG

SEQ ID NO: 143683 - protein, 30 aa, Heterodera glycines
  Coding regions on vcDNA: vcDNA=SeqID_70106; Strand=-; Position=1-93
KESRRRRALSIKNVLSRCTKKLSVGDPQKT

SEQ ID NO: 143684 - protein, 258 aa, Heterodera glycines
  Coding regions on vcDNA: vcDNA=SeqID_70107; Strand=-; Position=1 -15,60-136,183-361,408-683,832-1061
  Homolog annotation: Hit_ID=NP_493917.1; Match level="QueryCoverage =68%, HitCoverage=72%, E-value=2e-25, Identity=38%"; Hit description =spliced leader protein like (2B412) [Caenorhabditis elegans] pir||T32462 hypothetical protein T13B5.8 - C
MSSKKLSPTEELEKQYRDYKAQFEEWKEKNRDSVGTEAYINYVKQFELWEKDVEKRRAALRQKTENERLATAEREAAKLKREAEEKKKAEEAAARAYAEEQAQYMAMHQRALQDEQLQKQRVRQQQSVPAQQHQSPMKQSLSTTQLDLLSSPVSDCKASPTQQPQQKTIPTNGKPDEDTSGADMLSAMQQMFSIVMGTNMAPSTNEKTVFENSSEMEENAAAAQGTSPQKLQQTQLEQTQPPQLWGTDGTTFTNSVGH

SEQ ID NO: 143685 - protein, 63 aa, Heterodera glycines
  Coding regions on vcDNA: vcDNA=SeqID_70108; Strand=+; Position=1-191
MSLAQELLADLEEDGDEEMQDLEVKKEEEQDEDYIDEVTEEKSFPNLSKYDRITDVAKLTSSA

SEQ ID NO: 143686 - protein, 95 aa, Heterodera glycines; identical to SEQ ID NO: 124528
  Coding regions on vcDNA: vcDNA=SeqID_70109; Strand=-; Position=1 -578,743-1132

SEQ ID NO: 143687 - protein, 124 aa, Heterodera glycines
  Coding regions on vcDNA: vcDNA=SeqID_70110; Strand=-; Position=1 -43,165-321,426-600
MTQDTANDLGIDIRSRSNLRRKKDGTIETSDLCCLAPKCKNNVSKEMGYSILNCGHKCHWEEEYAKWVSGGQFKRCPNQRCKKNTIIKCSCCKKNIGYGLFECGCYCTKTAQDMDMHADKLEKM

SEQ ID NO: 143688 - protein, 68 aa, Heterodera glycines
  Coding regions on vcDNA: vcDNA=SeqID_70111; Strand=+; Position=1 -73,674-807
MVEPFAVNDPVEQIRERLVEEFLDQEIFKTLKKKYAKRNSGISFPYANFYAKLEAVLITMNRVTNHTT

SEQ ID NO: 143689 - protein, 307 aa, Heterodera glycines
  Coding regions on vcDNA: vcDNA=SeqID_70112; Strand=-; Position=1-921
MFLSGKDDESSISAIDRKLWQGKTTIKISDLEKAQNDIGKLEDGVNRAFRYMNRSLNQKVNWVKDVVANTNANFETLKVQYETLTERVEMLEQDSDGTNSGGTVSITNQNRASRAPFVTPMGNAQPNQVVPNQVPIHQLLSEDEDDGPTLFGLNMLSSGPTVGSGLEMFCEESVFAFDDWAERFKDYLSVSGKAYTEQEKVTRLKLALRDTPRALFKELLPAQTDTLDSALSELRQKLDSPQRREIAKRTLSLCKQREDETVAQFLRRLTPVVDATNSSLTGDIRKEKICEEFLDRWKPNISFLIRL

SEQ ID NO: 143690 - protein, 35 aa, Heterodera glycines
  Coding regions on vcDNA: vcDNA=SeqID_70113; Strand=+; Position=1 -48,154-213
MARLVNQFEKGAKCQKKNLKLFQVKRLIQVLKSIQ

SEQ ID NO: 143691 - protein, 447 aa, Heterodera glycines
  Coding regions on vcDNA: vcDNA=SeqID_70114; Strand=-; Position=1-1344
  Homolog annotation: Hit_ID=AAM51225.1; Match level="QueryCoverage =66%, HitCoverage=88%, E-value=2e-10, Identity=27%"; Hit description =polyubiquitin [Chlorarachnion CCMP621]
MNHFGLSQFSIVTMLTLMMPLSADNMIIEVLYDIYTYPVLVNKKDTVATLKAKIQEIDKFGNIPIQNQVLFSGISDNVLADDKTMDEYGIGEETIYMEVVAYAGSNFHIHVNYRRNRISVLAKSTDTVKDLKKKIANIDELGNIPIQKQTLSKKITCTFWIELADDETIDKYGIGEGKELFLSSDEFQFLVEYKEKMNSIKVKAMTTLKEVKEKMTEITGIPSEKQTLYHFKFGQCNDKARVIDFVKEDMPFLTMSDGSGITVRWQDHWEFFVINVNSTDTVATVKRKIRAINKQRHKSKLNGVIKLSKCDFDCKYAKALRGGKTMDEYGIREGNTIFMEVVTCDESSRQWSFAAFEDGSNFHIHVEYGSRRVIVWVTGTDTVKDLKDKVRPFMEADWNKKFGDISLSKQHPSRADIDQLVDNAKTMDEYGIKEGDTIESLDAEELG

SEQ ID NO: 143692 - protein, 84 aa, Heterodera glycines
  Coding regions on vcDNA: vcDNA=SeqID_70115; Strand=-; Position=1 -126,473-601
MSAGERRRILILVLLKLGFDSRNSYSYLIICKMATIFSLNKSHINLFSKTTKNIIVFVKLDFVRVRVRASELGEMDLKKYFKKF

SEQ ID NO: 143693 - protein, 38 aa, Heterodera glycines
  Coding regions on vcDNA: vcDNA=SeqID_70116; Strand=+; Position=1-438
MRIERARFDEVLVSQKKSKYLKIYKKFKNENSCEIFWK

SEQ ID NO: 143694 - protein, 26 aa, Heterodera glycines
  Coding regions on vcDNA: vcDNA=SeqID_70117; Strand=-; Position=1-81
KSVKNLKMRIHARFSGNNLNWALLSC

SEQ ID NO: 143695 - protein, 151 aa, Heterodera glycines
  Coding regions on vcDNA: vcDNA=SeqID_70118; Strand=-; Position=1-458
  Homolog annotation: Hit_ID=EAK89729.1; Match level="QueryCoverage =96%, HitCoverage=33%, E-value=5e-15, Identity=27%"; Hit description =uncharacterized glycine-rich low complexity protein [Cryptosporidium parvum]
FQSLGLNPPTFQSTGLNPTAFQSLGLNSPAFQSLGLNSPAFQSLGLNSPAFQSLALNPTAFQSLGLNPTAFQSLGLNSPAFQSLGLNSPAFQSLALNPTAFQSLGLNPPTFQSTGLNSSAFQSLGLNSSVFQSLGLNPPTFQSTGLNSPEF

SEQ ID NO: 143696 - protein, 90 aa, Heterodera glycines
  Coding regions on vcDNA: vcDNA=SeqID_70119; Strand=-; Position=1 -195,406-480
MAGTLDNKLYSWGMHKWAAEGQQPKENDGGADQSAKAAEDGAGGTSDCSYLSSTATSLTNSDGNMATPVEQPKQQKERKKRKKSKSTKTT

SEQ ID NO: 143697 - protein, 75 aa, Heterodera glycines
  Coding regions on vcDNA: vcDNA=SeqID_70120; Strand=+; Position=1-228
MDAVALVDANCHAIVQMVEQGEAKSEAEDGEDQQQQTLVTKLKTLNQAQREMIYDKENFKKIFKTENFEKNLRIL

SEQ ID NO: 143698 - protein, 40 aa, Heterodera glycines
  Coding regions on vcDNA: vcDNA=SeqID_70121; Strand=+; Position=1 -102,359-379
MPTKTNLILHAGGQKDAQIDGIANDAQAKLDGENLKIFAL

SEQ ID NO: 143699 - protein, 212 aa, Heterodera glycines
  Coding regions on vcDNA: vcDNA=SeqID_70122; Strand=-; Position=1 -57,135-351,412-465,713-1021
DARKAYETRLKNATNGNNQADCRIKNLEKELKVLKRQLSALGDLLDQFLDTSLAMRERTRRMEDELGRRLERLDAQMRANLEAMGRQTHKNGNNEQRNEAEQTIETIHLDELSIADEVPLEQNIQQQPQPSNVSNCPANDEGGGGDGIGDELAHFLAGLTPVDEMGQLVLNKFKYSCEFAQLLYTGGGHVDSVFCNIFSGYPPTFFEELVEA

SEQ ID NO: 143700 - protein, 34 aa, Heterodera glycines
  Coding regions on vcDNA: vcDNA=SeqID_70123; Strand=-; Position=1 -52,144-196
MGFDLWRKAQPESAKRPKRVLKRTKFIYKLNKAL

SEQ ID NO: 143701 - protein, 95 aa, Heterodera glycines
  Coding regions on vcDNA: vcDNA=SeqID_70124; Strand=+; Position=1 -276,804-815
MAEVKNDFKTQKIWASVDETTDSKGRYVANLIIGILDGKLHNPHLVAVKFLDKTNHETVARFVNDNLRELILADDLWLLVTDAARYMVKAAQVWT

SEQ ID NO: 143702 - protein, 16 aa, Heterodera glycines
  Coding regions on vcDNA: vcDNA=SeqID_70125; Strand=-; Position=1-49
EAIPEGFGLPINLGAS

SEQ ID NO: 143703 - protein, 22 aa, Heterodera glycines
  Coding regions on vcDNA: vcDNA=SeqID_70126; Strand=-; Position=1-67
MTPALIALVLYALLPLVRGVVV

SEQ ID NO: 143704 - protein, 89 aa, Heterodera glycines
  Coding regions on vcDNA: vcDNA=SeqID_70127; Strand=+; Position=1 -127,759-900
  Homolog annotation: Hit_ID=CAE57685.1; Match level="QueryCoverage =100%, HitCoverage=7%, E-value=2e-29, Identity=65%"; Hit description =Hypothetical protein CBG00683 [Caenorhabditis briggsae]
GAIIRCLSNIVFEHRVLGEHKDLSKDCKKQLRVAYLQQEQVDFDDKQHMDDADPQLMKKCAADLQRYNCMAQQRFEDVVECLRVNFDNL

SEQ ID NO: 143705 - protein, 79 aa, Heterodera glycines
  Coding regions on vcDNA: vcDNA=SeqID_70128; Strand=+; Position=1 -36,119-190,298-339,578-667
  Homolog annotation: Hit_ID=NP_495773.1; Match level="QueryCoverage =86%, HitCoverage=5%, E-value=1e-17, Identity=58%"; Hit description =golgi apparatus protein 1 (131.7 kD) (2I714) [Caenorhabditis elegans] emb|CAA91405.1| Hypothetical protein
MDKFTTGLGREKNSCKYDIGKYCGNQKGDKVLDCLMNTKIVRLLQKRCLKVVKERMLERVKDDRLNPSLLETCQKEAEQ

SEQ ID NO: 143706 - protein, 274 aa, Heterodera glycines
  Coding regions on vcDNA: vcDNA=SeqID_70129; Strand=+; Position=1 -89,239-377,859-1053,1491-1608,1880-2022,2427-2567
  Homolog annotation: Hit_ID=NP_495773.1; Match level="QueryCoverage =100%, HitCoverage=23%, E-value=1e-86, Identity=55%"; Hit description= golgi apparatus protein 1 (131.7 kD) (2I714) [Caenorhabditis elegans] emb|CAA91405.1| Hypothetical prote
VVKERMLERVKDDRLNPSLLETCQKEAEQYCADDYKKINNPQYSQQQLGPIIATCLRTQFAKFGSGVHLSMGCKDELSKLILESEFDIQLDPALYKACRSTINKHCANAIIARGGNYDTVLECLKADFYANQIPDRDCAQQLARRTQESLIDIHLDPGLHEACSVDIQRVCRDVPPGQSRIIMCLVDAARNGQVHLSAACQTKLTDRNKLWQMAHDEYRMALPETWSEAYSIIVNHPKRTSILSYLGIGLLVLLLLGCCLGRLSKRTYNELKNR

SEQ ID NO: 143707 - protein, 38 aa, Heterodera glycines; identical to SEQ ID NO: 130615
  Coding regions on vcDNA: vcDNA=SeqID_70130; Strand=-; Position=1 -52,124-188

SEQ ID NO: 143708 - protein, 154 aa, Heterodera glycines
  Coding regions on vcDNA: vcDNA=SeqID_70131; Strand=+; Position=1-467
  Homolog annotation: Hit_ID=CAF91175.1; Match level="QueryCoverage =53%, HitCoverage=11%, E-value=5e-13, Identity=41%"; Hit description =unnamed protein product [Tetraodon nigroviridis]
ELNVEADDPLQSYKERFERSYIEGTEQFYKCRTAQLLEHDGVLNYMVYVDGKLAEEEERAKRYLDSSSPESIAKANIGHFVDSFKRLVGGPMRSSAGDRISRPTFGRWSDSDQKQRGKQAEDALPTDQSDTRRNSQFAQRLAQTHHGRRTRRHA

SEQ ID NO: 143709 - protein, 74 aa, Heterodera glycines
  Coding regions on vcDNA: vcDNA=SeqID_70132; Strand=+; Position=1 -105,169-288
  Homolog annotation: Hit_ID=CAE62358.1; Match level="QueryCoverage =97%, HitCoverage=11%, E-value=1e-14, Identity=56%"; Hit description =Hypothetical protein CBG06438 [Caenorhabditis briggsae]
LFLEPIVAAQDFDVFVPMMMRKNIELQLQALKMIEHLNGLLPNSLKLGQEEADMWNSLTDEDDSERFIMISVLK

SEQ ID NO: 143710 - protein, 160 aa, Heterodera glycines
  misc_feature (5)..(5): Xaa can be any naturally occurring amino acid
  misc_feature (149)..(149): Xaa can be any naturally occurring amino acid
  Coding regions on vcDNA: vcDNA=SeqID_70133; Strand=-; Position=1 -44,114-554
  Homolog annotation: Hit_ID=AAP92584.1; Match level="QueryCoverage =79%, HitCoverage=25%, E-value=5e-35, Identity=62%"; Hit description =Ab2-057 [Rattus norvegicus] gb|AAP85373.1| Aa1262 [Rattus norvegicus] gb|AAP85367.1| Aa1011 [Rattus norveg
EPAAXFDSTRGNLTVFLVRGAICLVYSDNERDSSLLNSWLIASGHNFLEGFSVFSRTKLSNNRSVMPLDVRGCTRATLAKSACLPSPKGVGKPVKICRDWDRTLQLLSVNEEFLVGASHQLALNTSLPFVHTARRCPGLSHFEKFGDGXCSGRSVCRLEP

SEQ ID NO: 143711 - protein, 228 aa, Heterodera glycines
  Coding regions on vcDNA: vcDNA=SeqID_70134; Strand=-; Position=1 -291,511-735,804-854,925-1041
  Homolog annotation: Hit_ID=XP_310190.1; Match level="QueryCoverage =75%, HitCoverage=44%, E-value=2e-48, Identity=56%"; Hit description =ENSANGP00000010898 [Anopheles gambiae]
MESGKCVRRFRTHTDFVNGCHPARRGPSLVVSGCDGGKIIVPLPWASITYAFVQVHDVRRRGPVATFESVNNYQVTSVTFNDTAEQIISGGIDNVLKIWDIRRLGLLHILPGHTDTVTGLSLSPDGNHVLSNSMDCTARIWDIRPYASSQRCVKTLTGHQHNFEKVQLTVKMRPSPLFFGHQTDTEFHVDRVTVSCTFGTLVPETLLTSCPAIMAQLMQQIFTLRNQL

SEQ ID NO: 143712 - protein, 70 aa, Heterodera glycines
  Coding regions on vcDNA: vcDNA=SeqID_70135; Strand=-; Position=1 -82,198-281,603-648
PCTSAMANSPKPSRAPSANGGLSNKQQSKLTIRRRPVPFRDALVVRSAAKKMVVNMTEVFKRPALPLVPA

SEQ ID NO: 143713 - protein, 24 aa, Heterodera glycines
  Coding regions on vcDNA: vcDNA=SeqID_70136; Strand=-; Position=1-91
LTHRPLRRKNQLNCTWSPKLNRRV

SEQ ID NO: 143714 - protein, 228 aa, Heterodera glycines
  misc_feature (25)..(25): Xaa can be any naturally occurring amino acid
  misc_feature (195)..(195): Xaa can be any naturally occurring amino acid
  misc_feature (225)..(225): Xaa can be any naturally occurring amino acid
  Coding regions on vcDNA: vcDNA=SeqID_70137; Strand=-; Position=1 -212,353-488,698-777,827-1110
  Homolog annotation: Hit_ID=CAE68493.1; Match level="QueryCoverage =78%, HitCoverage=51%, E-value=2e-47, Identity=53%"; Hit description =Hypothetical protein CBG14299 [Caenorhabditis briggsae]
LWREERIYCIECFLEVSHKSNIKDXLCKCFKLRNFVKIYCATCDRRIDPFVWVRRAREFFYHLACFKCEHCKRQLGTGDQYSLDDSRLLCQMHYTELVLGEQSESSSKQKTKRVRTTFGEDQLNILQQYFKSDSNPSDSNPDGADLERIAHLTGLSKRVTQVWFQVDLLRDPKATKRVNGNAYKRQHILQNKLVXSKPRPNLSNCTSSHDTQLKGSIFEIISTIXFMY

SEQ ID NO: 143715 - protein, 75 aa, Heterodera glycines
  Coding regions on vcDNA: vcDNA=SeqID_70138; Strand=+; Position=1 -126,293-394
MYFPEDVDFTARIRSIVGSLPKEIGDFKAITLKEWEGGSDPQAKIELLRSIEADLKAERKLREERNEIKKKSKGK

SEQ ID NO: 143716 - protein, 100 aa, Heterodera glycines
  Coding regions on vcDNA: vcDNA=SeqID_70139; Strand=+; Position=1 -38,272-501,662-698
  Homolog annotation: Hit_ID=NP_508537.1; Match level="QueryCoverage =90%, HitCoverage=3%, E-value=3e-26, Identity=61%"; Hit description =spectrin (spc-1) [Caenorhabditis elegans] gb|AAB53876.1| Spectrin protein 1 [Caenorhabditis elegans] pir||
FKIQTKIVFPPLVQAHSNAITKLDKTGNDMIQHDHYEKETIRKRLDRLHDLWDRLFAMLENKGIKLQQTLKLLQFVRKCDEMLYWIKDKSTARIAGRGFE

SEQ ID NO: 143717 - protein, 56 aa, Heterodera glycines
  Coding regions on vcDNA: vcDNA=SeqID_70140; Strand=-; Position=1 -132,182-220
MREAKPAELEDVVSEMGIYGSLIGDQSNGRILHNAFDGHTIRSKAKGYFFLSSPWP

SEQ ID NO: 143718 - protein, 129 aa, Heterodera glycines
  Coding regions on vcDNA: vcDNA=SeqID_70141; Strand=+; Position=1-390
MASDAMTRRRTISGLEYEDFSQNEGKMLLEEEDEGGEGGGELLGGVVGRRNVVQVEHEHHLLEGSARLKGQRKGKSDGRSTDGQWHRLPIRYLQGAFPAQCDAFLNCRERKFDVILRLDRSQHPLTKSG

SEQ ID NO: 143719 - protein, 216 aa, Heterodera glycines
  Coding regions on vcDNA: vcDNA=SeqID_70142; Strand=-; Position=1 -122,166-237,289-379,690-784,860-1064
  Homolog annotation: Hit_ID=CAE56992.1; Match level="QueryCoverage =98%, HitCoverage=49%, E-value=8e-59, Identity=56%"; Hit description =Hypothetical protein CBG24859 [Caenorhabditis briggsae]
QHQINDLRQILDMKQEVDEAYLLRWLRSKEGKFDEAADGIRKDLVFRKAWGIRKDLVFRKAWGLDKIVNWEAPEILEKYCGYGFLILEKYCGYGFLSDHDGNPILMSLLGNTDVEGMLRSVQSKDYIKFSLAAIEKGITLCRERALQTTGRPFEQMMLVFDLDHISSAHYSSKQFASSFTTLVLLFQEHFPLVLRKILVFEPEMVRRLVIASLAIF

SEQ ID NO: 143720 - protein, 88 aa, Heterodera glycines
  Coding regions on vcDNA: vcDNA=SeqID_70143; Strand=-; Position=1 -207,606-665
MDQKSRNMAIKYGPKIAKYGHKMAKISKYGHKWQKCQNMDINFSKLSAKFLQIYWLKLHMRYISKFFDSASHSPGKKYGFPCNSIPYL

SEQ ID NO: 143721 - protein, 48 aa, Heterodera glycines
  Coding regions on vcDNA: vcDNA=SeqID_70144; Strand=+; Position=1-145
LQIYWLKLHMRYISKFFDSVRRSDKDGFRFAISRSTFGNWSRIFSAIT

SEQ ID NO: 143722 - protein, 20 aa, Heterodera glycines
  Coding regions on vcDNA: vcDNA=SeqID_70145; Strand=+; Position=1 -18,541-585
MFWFFKNDNVYTIFINYDNL

SEQ ID NO: 143723 - protein, 129 aa, Heterodera glycines
  Coding regions on vcDNA: vcDNA=SeqID_70146; Strand=+; Position=1 -449,615-696
KNRFIFVFGAVPLNRCAQIYGETESFGNSFPIACTLILRWIFAPHNCLSTPNGHLKKSIFLSFGADPPNRCAPIYGETESFRRIFPIYCTLILRWIFAPPNCLSTPNRHLKKSIFFFSGQAPPIDVPRF

SEQ ID NO: 143724 - protein, 22 aa, Heterodera glycines
  Coding regions on vcDNA: vcDNA=SeqID_70147; Strand=-; Position=1-67
MVAEWTGSEVFSTEESVQLCPK

SEQ ID NO: 143725 - protein, 15 aa, Heterodera glycines
  Coding regions on vcDNA: vcDNA=SeqID_70148; Strand=+; Position=1-47
MTANLAWPLDESSKP

SEQ ID NO: 143726 - protein, 58 aa, Heterodera glycines
  Coding regions on vcDNA: vcDNA=SeqID_70149; Strand=+; Position=1-176
YFADEFTEHNHCRNIDLTIYTPNPKLSNASAHLFLGYDEQIAKGPWCYVEKVYGSNLF

SEQ ID NO: 143727 - protein, 78 aa, Heterodera glycines
  Coding regions on vcDNA: vcDNA=SeqID_70150; Strand=-; Position=1 -81,162-317
MVFERTFQGEIVVKCQRRFEGERLFALPFSGYPRPRATFNPLPNMKSCDSGEGVMSLLKVQKWAIPRNVQKSKIKFFL

SEQ ID NO: 143728 - protein, 30 aa, Heterodera glycines
  Coding regions on vcDNA: vcDNA=SeqID_70151; Strand=-; Position=1 -79,550-563
MRRDVASVGPGETDQNWGPILEWTGAYNKM

SEQ ID NO: 143729 - protein, 103 aa, Heterodera glycines
  Coding regions on vcDNA: vcDNA=SeqID_70152; Strand=-; Position=1-312
MHLALGLSRTNNSLEGWHAIWNAHLKGNQRLSGFVRKMIEEDDMWSQRIIDYQIAPADGIRGPHAARKGKYVRQDNNLNALLQDIGNRDPLEYLRACAYHLHF

SEQ ID NO: 143730 - protein, 76 aa, Heterodera glycines
  Coding regions on vcDNA: vcDNA=SeqID_70153; Strand=+; Position=1 -94,646-782
EASSSSFLSFLPVSDRLVSNQRFFSFTPSYSSMAEQTAPTKTAAWLERLKSSPIDVLPIVGAVHWASRDRTKPPTR

SEQ ID NO: 143731 - protein, 117 aa, Heterodera glycines
  Coding regions on vcDNA: vcDNA=SeqID_70154; Strand=+; Position=1 -117,195-431
MLSNFFCGEIKKLPVPTAASLILLLVLLSVIALVVIVTLTRRTKAVSSNKSETPEVPSDLADEAAESSDSDEGRGGVSTAPPDMESVVADEAAEFLDFDEGRGGVSTAPPDLESGRK

SEQ ID NO: 143732 - protein, 53 aa, Heterodera glycines
  Coding regions on vcDNA: vcDNA=SeqID_70155; Strand=+; Position=1 -54,189-296
MSANNGTLFDNQLTIQKVLIIGLSVVGIVILIAIAVLLCWLILIIRRKCRILN

SEQ ID NO: 143733 - protein, 284 aa, Heterodera glycines
  Coding regions on vcDNA: vcDNA=SeqID_70156; Strand=-; Position=1-861
  Homolog annotation: Hit_ID=NP_001003179.1; Match level="QueryCoverage= 99%, HitCoverage=34%, E-value=8e-37, Identity=30%"; Hit description =ribosome receptor [Canis familiaris] sp|Q28298|RRB1_CANFA Ribosome -binding protein 1 (180 kDa ribosome
NTGTQMCGILNTGTQICGIPNTGTQISGIPNTGTQICGILNTGTQICGIPNTGTQISGIPNTGTQISGIPNTGTQISGIPNTGTQICGILNTGTQICGIPNTGTQISGIPNTGTQICGILNTGTQICGIPNTGTQISGIPNTGTQISGIPNTGTQISGIPNTGTQICGILNTGTQICGIPNTGTQISGIPNTGTQICGILNIGTQPTSISISGTQFSGIPNTGTQISGIPITGTQISGIPNTATQISGIPNTGTQICGILNTGTQPPNIQSLGLNPPAFQSLGL

SEQ ID NO: 143734 - protein, 208 aa, Heterodera glycines
  Coding regions on vcDNA: vcDNA=SeqID_70157; Strand=+; Position=1 -87,747-869,951-1089,1140-1417
  Homolog annotation: Hit_ID=XP_418200.1; Match level="QueryCoverage =57%, HitCoverage=13%, E-value=1e-09, Identity=31%"; Hit description =PREDICTED: similar to BTB (POZ) domain containing 2 [Gallus gallus]
MLSFIYADDVSGLNGDNAMAVLYAGEKFRNFAHQCLRYICQNAGQLFESEEFLQIDQNLLCELFENDQLVALRWADEKCRQNAIECSAGNQRCQLGPALFKIRFPLIPAIDFTTSIVPSGVLTNDELVSVYQFHSHPNLRDVPGLRPLEFPWHERIEGNRGILAMEIEKFSKFARERVGSSRFSDAVQTKGFEWKILAMLICKRNEKQ

SEQ ID NO: 143735 - protein, 81 aa, Heterodera glycines
  Coding regions on vcDNA: vcDNA=SeqID_70158; Strand=+; Position=1 -146,1324-1423
MEIGVANVLSLIELFPKRSERRICRSKNVTMFLTRKRTTGALQLSFFLRCFWVTDYEYGIHFVIFKKLWKRIQTGSENAKF

SEQ ID NO: 143736 - protein, 125 aa, Heterodera glycines
  Coding regions on vcDNA: vcDNA=SeqID_70159; Strand=-; Position=1 -118,178-437
MTKAVIRVSFAFYFANILEFFFPQNFIRWHFDGTFHRPKAFQIENSLLITKGVRSNNIQSKSNQFAKIPQIRIIGRHFDNVTQTFIGQISLVAHFLCLFNAFAIFSAFLGANFALFCSKERNLNH

SEQ ID NO: 143737 - protein, 51 aa, Heterodera glycines
  Coding regions on vcDNA: vcDNA=SeqID_70160; Strand=+; Position=1 -15,144-256,383-410
MQSLKAIKQIHRPIVRKIVKLILIGFILKKFSFSTDEKCKAQKQSYKSTGQ

SEQ ID NO: 143738 - protein, 83 aa, Heterodera glycines
  Coding regions on vcDNA: vcDNA=SeqID_70161; Strand=+; Position=1 -22,149-378
MKNAKPKSNHTNPQANSTENCKINILIGLIKKTVSQPMKNAKPKNEKNEKLLLYFKKTDMFHLHRFRSAGRVFRQFLCNFYFD

SEQ ID NO: 143739 - protein, 259 aa, Heterodera glycines
  Coding regions on vcDNA: vcDNA=SeqID_70162; Strand=-; Position=1 -145,838-1469
  Homolog annotation: Hit_ID=AAO52611.2; Match level="QueryCoverage =94%, HitCoverage=60%, E-value=4e-17, Identity=21%"; Hit description =similar to Plasmodium falciparum (isolate 3D7). Hypothetical protein [Dictyostelium discoideum]
MQLASELVPKEPKDKTGKNYQKLKSLIVKFKKSKSENFNQNNQQENFEGRKSNNQTQQENTKFNLKSPIESKKTNFNKDVHNGEVSQIGNINVHKREEKKTGNINVAQQNDDVGQNTGRQNTNTQPNDDVGQNTGRQNTNVHNVEQTKNDTGRQNTYVHNVEQTKNENTNLAQPNDDVGHNTESQITNTQPNDDVGQNTESQITNTQPNDDVGQNTGRQNTNVHNVEQTKNDTGRQNTYVHNVEQTKNENTNLAQPNDD

SEQ ID NO: 143740 - protein, 53 aa, Heterodera glycines
  Coding regions on vcDNA: vcDNA=SeqID_70163; Strand=-; Position=1-159
PPDNKNSVQTLQQLIASQKDPNAFVFGTNMAGRVGQWLTKRSFEKTMDTELRS

SEQ ID NO: 143741 - protein, 75 aa, Heterodera glycines
  Coding regions on vcDNA: vcDNA=SeqID_70164; Strand=-; Position=1 -90,290-424
  Homolog annotation: Hit_ID=CAE64075.1; Match level="QueryCoverage =80%, HitCoverage=17%, E-value=9e-12, Identity=50%"; Hit description =Hypothetical protein CBG08678 [Caenorhabditis briggsae]
DGHADADILANADVVIMNNVFTFFADHAEQVSCWQHLRAHLRPGTLLLHSPSLELVTAHLCPSALGFAFDDWLQA

SEQ ID NO: 143742 - protein, 93 aa, Heterodera glycines
  Coding regions on vcDNA: vcDNA=SeqID_70165; Strand=-; Position=1-282
MNDANGKLEAAQKQFEAILASFSPTADGNEQSQQQKEQFLRWVRQRLRRENAMPTKDTLQHSDKRHPTDLSVRKQLGRIAKRLRELVHMSMCL

SEQ ID NO: 143743 - protein, 70 aa, Heterodera glycines
  Coding regions on vcDNA: vcDNA=SeqID_70166; Strand=-; Position=1 -108,454-558
  Homolog annotation: Hit_ID=CAE69217.1; Match level="QueryCoverage =97%, HitCoverage=94%, E-value=1e-15, Identity=54%"; Hit description =Hypothetical protein CBG15257 [Caenorhabditis briggsae]
MVNVKKGTVIRCDPAMRQFLKHLDETRALGRPFIVKDLDEFCLFVERDIVPMLEQRMDALMDALTPDTQT

SEQ ID NO: 143744 - protein, 104 aa, Heterodera glycines
  Coding regions on vcDNA: vcDNA=SeqID_70167; Strand=-; Position=1 -68,425-554,663-776
  Homolog annotation: Hit_ID=EAL19761.1; Match level="QueryCoverage =66%, HitCoverage=4%, E-value=4e-13, Identity=49%"; Hit description =hypothetical protein CNBG3890 [Cryptococcus neoformans var. neoformans B-3501A]
MCRAMLRNVQIVVLDEATANVDIQTDERIQQSIRKEFADRTVLVITHRLTNVVTGLGRVLSMADGKLSDDNITTTTNHRPTSTTSTELPKIVVDEAPPPPSSPS

SEQ ID NO: 143745 - protein, 84 aa, Heterodera glycines
  Coding regions on vcDNA: vcDNA=SeqID_70168; Strand=-; Position=1 -111,426-569
MFYFIATYIYLIFFSSFDKSIRKIENFVIILVCPDRELGAGRVGHSGTAVLAAQLAMEYAAQADGDQCAKCCAGGGQKSRTDRR

SEQ ID NO: 143746 - protein, 233 aa, Heterodera glycines
  Coding regions on vcDNA: vcDNA=SeqID_70169; Strand=+; Position=1 -547,589-743
MDLWLLIFIIFCLFYGSKFGKIRSNFDEIFGNGWEKNENEKKMIKMEQIDHNESSAADQIGGENLNGRIDQQKRETIQKFEAIKERLKQKGKYEWKKNNKIEQKIAKLLGTNRDKIYKWKKELNLNKNKIFYEQKKKEFIERIDEFKYLYGQGKQKEFVKELGISNMTFRKWKKELMPNCHKTKNKYSNDDKLKKMKQYFKIKEGNPKISDEIIAKKLGIERATLIRWKKKFA

SEQ ID NO: 143747 - protein, 27 aa, Heterodera glycines
  Coding regions on vcDNA: vcDNA=SeqID_70170; Strand=-; Position=1-81
MHRIIAAVKKLVVGSVLAVRCTLCVLL

SEQ ID NO: 143748 - protein, 95 aa, Heterodera glycines
  misc_feature (2)..(2): Xaa can be any naturally occurring amino acid
  Coding regions on vcDNA: vcDNA=SeqID_70171; Strand=-; Position=1-657
LXEYPKRTLEKIDFFVFGAVPPNRCAQIYGETESFRNSFPIACTLILRWIFAPHNCLSTPNGHLKKSIFLFSGQSPRTDAPRFMGRPNPSGVASL

SEQ ID NO: 143749 - protein, 85 aa, Heterodera glycines
  Coding regions on vcDNA: vcDNA=SeqID_70172; Strand=-; Position=1 -135,348-470
MAFVGFFRLLIGHVLIIERFIATMRSNSYETVPKCVFICTWLSITMIVIIGYYNRRIYNHQIEKAAANNYHIGQRYQENIKCLKN

SEQ ID NO: 143750 - protein, 135 aa, Heterodera glycines
  Coding regions on vcDNA: vcDNA=SeqID_70173; Strand=-; Position=1 -86,243-564
MPRTRDVASLAYRLLAIFFGLLVLAFWFLYNSKKLINCENLLTDFVQMTFPSVTVDVFAYIFSFFELFTYGIVLAIAFLNLAVICPTKILHINMKSILISHSVALIVYLFGRAGIIAEKFLSNNQFVSTNVVLKV

SEQ ID NO: 143751 - protein, 39 aa, Heterodera glycines
  Coding regions on vcDNA: vcDNA=SeqID_70174; Strand=+; Position=1-117
CPFGVLNIPWEQKSNAELSTGYREAIPEGFGLPINLGAS

SEQ ID NO: 143752 - protein, 75 aa, Heterodera glycines
  Coding regions on vcDNA: vcDNA=SeqID_70175; Strand=-; Position=1-227
MPSSPGVSTRCCTSRPSCPTGCSPPSTWASRHRPGCTRCPPLWTNGPAHWHPNIWVPRCWRKQSRRPTAQRKCGD

SEQ ID NO: 143753 - protein, 32 aa, Heterodera glycines
  Coding regions on vcDNA: vcDNA=SeqID_70176; Strand=+; Position=1-98
VPSNATNDAFLCLDQPSSLLTDLDDVSCDPQQ

SEQ ID NO: 143754 - protein, 109 aa, Heterodera glycines
  Coding regions on vcDNA: vcDNA=SeqID_70177; Strand=-; Position=1-327
  Homolog annotation: Hit_ID=XP_345184.1; Match level="QueryCoverage =97%, HitCoverage=54%, E-value=4e-11, Identity=40%"; Hit description =similar to CG14852-PA [Rattus norvegicus]
MIRRSATVIKRGATMIRRSATVIKRGTTVIRRGTTVIKRGTTVIRRGTTVIKRGTTVIRRGTTVIKRGTTVIRRGATMIRRSATVIKRGTTVIRRGTTVIKRGTTVIEE

SEQ ID NO: 143755 - protein, 286 aa, Heterodera glycines
  Coding regions on vcDNA: vcDNA=SeqID_70178; Strand=-; Position=1 -145,242-352,446-537,954-1071,1122-1241,1705-1828,2058-2207
  Homolog annotation: Hit_ID=NP_509669.2; Match level="QueryCoverage =90%, HitCoverage=36%, E-value=4e-15, Identity=28%"; Hit description =metalloprotease precursor family member (85.2 kD) (XK564) [Caenorhabditis elegans] emb|CAB01675.2| Hypoth
KDTCITFMLDTNKTAEEGIEVIVDGRKSWSKIGKTLAKWQELSLGWNSNGTAAHELLHALAIYHEHQRDDAFYFIKVNPICRMDGNYQPFNKTDNFGFPYDFDSVMQYPAHIDKQGYYYLITMGRFYQRTIGQDKRLSFKDSAIINHMYCKGVVTITVMERKTSAKMEATQVQNNAMNAFVQKVMLVHIATSWHRPKKGEKAIIKLINLDEKALSCAGICGTNHVEINYRKDKRARGALLCCANGILQQNISRNWIEAEEADVDIIISARFATTDATELFALTYET

SEQ ID NO: 143756 - protein, 42 aa, Heterodera glycines
  Coding regions on vcDNA: vcDNA=SeqID_70179; Strand=+; Position=1-129
ANREKAGILNGIKNVKFDCQLSNVMPCFVEKFVKIGGFYETT

SEQ ID NO: 143757 - protein, 92 aa, Heterodera glycines; identical to SEQ ID NO: 125147
  Coding regions on vcDNA: vcDNA=SeqID_70180; Strand=-; Position=1-304

SEQ ID NO: 143758 - protein, 30 aa, Heterodera glycines
  Coding regions on vcDNA: vcDNA=SeqID_70181; Strand=-; Position=1 -42,481-531
MKKYCEMCEGNTVGHFLYIFLISLHITRPL

SEQ ID NO: 143759 - protein, 105 aa, Heterodera glycines
  Coding regions on vcDNA: vcDNA=SeqID_70182; Strand=+; Position=1 -166,265-335,650-730
MNNGYNQYSNGYNPYSNGYNGGYNPMNNAYNQYSNGYNPYSNGYLNNNGYNQNSNDCFTASMVQDQRACSAMQGQCSNPLIAQTCRQTCCNMQFASGVAFPQFGG

SEQ ID NO: 143760 - protein, 21 aa, Heterodera glycines
  Coding regions on vcDNA: vcDNA=SeqID_70183; Strand=+; Position=1 -54,382-393
MRTRPIWQVKQRLLTSQKKML

SEQ ID NO: 143761 - protein, 76 aa, Heterodera glycines
  Coding regions on vcDNA: vcDNA=SeqID_70184; Strand=-; Position=1-440
YQKGRWRKIFLKIFPYILVISFCFWWGAWNSGIMRTRPIWQVKQRLLTSQKVRCRDETNQHCLPRGTRHGPPKEWI

SEQ ID NO: 143762 - protein, 75 aa, Heterodera glycines
  Coding regions on vcDNA: vcDNA=SeqID_70185; Strand=+; Position=1-322
HTSIIFFNYFFHFITQRSRLIRSSPNFAGKLLRTLQMLINFLRIFCLEEHSSSHLAHQHYFFLIIFFILSPNVLD

SEQ ID NO: 143763 - protein, 16 aa, Heterodera glycines
  Coding regions on vcDNA: vcDNA=SeqID_70186; Strand=-; Position=1-49
EAIPEGFGLPINLGAS

SEQ ID NO: 143764 - protein, 88 aa, Heterodera glycines
  Coding regions on vcDNA: vcDNA=SeqID_70187; Strand=-; Position=1 -92,167-341
MFYSNYFQSVHNLNNIYHQIFRIIYRKMFKWTRKTKYNVIFLLALFFIIFQFMSNNLPPHGNDFAPEQTKSKLQYVLITAIYNRKSRL

SEQ ID NO: 143765 - protein, 29 aa, Heterodera glycines
  Coding regions on vcDNA: vcDNA=SeqID_70188; Strand=-; Position=1 -25,197-261
MAKKKNGEIKKLITRIHVFLIKFFLFLNK

SEQ ID NO: 143766 - protein, 122 aa, Heterodera glycines
  Coding regions on vcDNA: vcDNA=SeqID_70189; Strand=+; Position=1 -313,937-991
QIDHPSPNVQSNFIVKMLDPYKQQPNFFLPHPNHYDHPDQHRQRNHRQHGSAAVAGRHAVGPPMPPPPPQRVPSPNCCSSSAATSSVVSEPISLDLATEQYFGGAAQIMMRLTVPMMNITMK

SEQ ID NO: 143767 - protein, 81 aa, Heterodera glycines
  Coding regions on vcDNA: vcDNA=SeqID_70190; Strand=-; Position=1-246
MIRSSALLLISDKIVRFISLIDYPPKYCSVARSRLIGSDTTDDVAADDEQQFGDGTRWGGGGGIGGPTACRPATAADPCCR

SEQ ID NO: 143768 - protein, 63 aa, Heterodera glycines
  Coding regions on vcDNA: vcDNA=SeqID_70191; Strand=-; Position=1 -40,94-199,613-658
MHLAQLITLLIFGVIFTSSVVRPSQKLVRQCSFTDEMSNFYASWHTNCRHWHSPRRKPKFNLT

SEQ ID NO: 143769 - protein, 96 aa, Heterodera glycines
  Coding regions on vcDNA: vcDNA=SeqID_70192; Strand=-; Position=1-290
IGMSVCARLDFPTAVESLYAQYACAMDWCTVVLSSWLLLWASSSFRQHLVDDFVPKWAKKWLLTNSTIANDNRIVAANGATIILVRPKNAKVVPTA

SEQ ID NO: 143770 - protein, 44 aa, Heterodera glycines
  Coding regions on vcDNA: vcDNA=SeqID_70193; Strand=+; Position=1-133
MQPESVRMPKEGADNVTKQIAILEQCLKGTKEAEGLKRKWEKSD

SEQ ID NO: 143771 - protein, 57 aa, Heterodera glycines
  Coding regions on vcDNA: vcDNA=SeqID_70194; Strand=+; Position=1 -135,181-219
MASGAAPCSDQRNSAKAADKAPPPSQGHRSRKWATDGGAAAHCENCVVCGDRACNHQ

SEQ ID NO: 143772 - protein, 106 aa, Heterodera glycines
  Coding regions on vcDNA: vcDNA=SeqID_70195; Strand=-; Position=1 -107,694-788,849-965
  Homolog annotation: Hit_ID=NP_501970.1; Match level="QueryCoverage =98%, HitCoverage=2%, E-value=6e-38, Identity=64%"; Hit description =EGF motif related, Lin-12 and Glp-1 X-hybridizing, abnormal EPIthelia EPI-1 (407.8 kD) (epi-1) [Caenorhabd
MVVPLEQYTDKVLRPLPLELANEFVDKCSDDNFHNRPSNTSNYCRQKIFSLTTDFNAAALACDCNTQGSLDFACAEYGGQCKCKPNVIGRKCDRCAAGYYNFPKGI

SEQ ID NO: 143773 - protein, 88 aa, Heterodera glycines; identical to SEQ ID NO: 124691
  Coding regions on vcDNA: vcDNA=SeqID_70196; Strand=-; Position=1 -96,135-305

SEQ ID NO: 143774 - protein, 73 aa, Heterodera glycines
  Coding regions on vcDNA: vcDNA=SeqID_70197; Strand=+; Position=1 -190,675-706
MGNEVNCFYSTDQAQQQFAGFDPLAQQQQHYQQNQQQHFYFGGQTQQQPQQQQFYFGGGDNETELIGLKSTFQ

SEQ ID NO: 143775 - protein, 226 aa, Heterodera glycines
  Coding regions on vcDNA: vcDNA=SeqID_70198; Strand=-; Position=1 -249,316-414,461-530,885-936,981-1191
AVIEKLKLDTHSIIVFFVDPLRLGRVLSSSNKVTPVFMVKLISVFACVQVNVAINCSAFVYRSQLRSIEYMASSKHGRDMSQLSFEQFEEKRSKEISGMTFREEQNHNYNAEQVNKKNAIYSILSKAHNPWPFILFGPPATMAYNRNKRLDCISYLAKEAKNRFFGIPDRHNLKMFRVIISTLSTSSYLVSAGGLRGFFTHLIVDEASQATEADTWIPIGWRNSDT

SEQ ID NO: 143776 - protein, 308 aa, Heterodera glycines
  Coding regions on vcDNA: vcDNA=SeqID_70199; Strand=-; Position=1 -18,62-160,205-255,308-508,663-910,952-1177,1218-1298
MHESRREFNFSDSELLSMMAILHVGPKVDTKGLRNAFFIQIKEHHSDKGGTVQKSQEITRAYRILKQYIDAAILLPGSKNENTFGKKDKGQNAGPSTSRSGCRPTAQGAQRPPDEFEDFGDFEDAGGKRRRRRGGGSRYNNNGHRDEQANDRGNGEPSDETNDANATGKASPAQKFINNYTYAPEDFSTYNDPMERRDRQKDGVRKLRGGLLLYKDFQRGQTLPPEFQEMGTVYSEDDLVDNPIFEHILVKLQIPLANANSMHAFVEKMRTFVHICWAFDGGASQDARIVLQKAQIVQVSQDDDSIYE

SEQ ID NO: 143777 - protein, 68 aa, Heterodera glycines
  Coding regions on vcDNA: vcDNA=SeqID_70200; Strand=+; Position=1 -25,289-470
MCNNWESGDFHPNAANVLEAAVAIVFLGSGIGLLAALMIGIAYHFQSLFFITLRGWLLKRIQFSKQQK

SEQ ID NO: 143778 - protein, 46 aa, Heterodera glycines
  Coding regions on vcDNA: vcDNA=SeqID_70201; Strand=+; Position=1-140
KKRSSANDGTSPQLKNIVGPAAAEKGTDGQKEPCICERDQALVVCR

SEQ ID NO: 143779 - protein, 31 aa, Heterodera glycines
  Coding regions on vcDNA: vcDNA=SeqID_70202; Strand=-; Position=1 -72,182-205
MKRFTSLVPKWFPKRNGMSTLWKKSAARYYV

SEQ ID NO: 143780 - protein, 81 aa, Heterodera glycines; identical to SEQ ID NO: 128717
  Coding regions on vcDNA: vcDNA=SeqID_70203; Strand=+; Position=1-484

SEQ ID NO: 143781 - protein, 81 aa, Heterodera glycines
  Coding regions on vcDNA: vcDNA=SeqID_70204; Strand=+; Position=1-484
FFAYQIFAINAHLFKKYSILLKCSVFCYILRIAVHLKESVIEQISQISRKVQAVAVKIVYIKTMAIRISALGPFSKLMCFY

SEQ ID NO: 143782 - protein, 200 aa, Heterodera glycines
  Coding regions on vcDNA: vcDNA=SeqID_70205; Strand=+; Position=1-601
MKQQQSKEQPLRHQQVPPVFEHPFSMCVSGCPGSGKTKWVLRMLSNLDTLAGPAHLSGVLYCYGEVNEDVLRLQQLETETGEEEEEEYKGGQPRRRWVRPCHALPDEEAVKRAAKACGGRLLLVLDDLMVGMRNKILDLLFHRGSLHLGRHVVVLITQHLFTRDLNIQNNVAQSLVLLRIPAATLHGSENPQIYSFFIKC

SEQ ID NO: 143783 - protein, 274 aa, Heterodera glycines
  Coding regions on vcDNA: vcDNA=SeqID_70206; Strand=+; Position=1 -109,154-290,505-738,797-1036
  Homolog annotation: Hit_ID=NP_501998.1; Match level="QueryCoverage =95%, HitCoverage=46%, E-value=8e-87, Identity=62%"; Hit description =6-phosphogluconate dehydrogenase (53.2 kD) (4L541) [Caenorhabditis elegans] emb|CAA94380.1| Hypothetical
SKPKKGSQRDIRQKGTGKWTGIAALEYGIPVTLIAEAVFARCLSALKKQRMDASKLLPKAEAVFARCLSALKKQRMDASKLLPKPSKKASDLVKDSKKFLNSIGSALYASKVVSYAQGFMLMAEASREFDWNLNYGAIALMWRGGCIIRSRFLDRIQNAFEKNPSLVNLLLDDFFMKAIGDAQDSWREVISTAVDSWREVISTAVQLGIPMPAFSSALAFFDGYRTEALPANLIQAQRDYFGAHTYELLAQPGVAVHTNWTGRGGKVTSNAYSA

SEQ ID NO: 143784 - protein, 189 aa, Heterodera glycines
  Coding regions on vcDNA: vcDNA=SeqID_70207; Strand=-; Position=1-568
  Homolog annotation: Hit_ID=NP_921821.1; Match level="QueryCoverage =76%, HitCoverage=9%, E-value=1e-23, Identity=41%"; Hit description =putative helicase [Oryza sativa (japonica cultivar-group)] gb|AAP54108.1| putative helicase [Oryza sativa
MQKGSKLIAYFNFFKEYPNAPKFKYIEMPTFCTYDNKTKKWKWPRKKTHKVIGRIYTVNPKNRELCYLRYLLLHKQATSFDDLKIVNGIKYTNYAEACLALGLTRDDSEWDKCLNEASQFKFPRGLRNLFVNILINCEPKYPSLLWNEYKDALSDDLKKNYPKDIAYQMVLSLLNQGLLKFEKSLKDFE

SEQ ID NO: 143785 - protein, 204 aa, Heterodera glycines
  misc_feature (170)..(170): Xaa can be any naturally occurring amino acid
  misc_feature (192)..(192): Xaa can be any naturally occurring amino acid
  misc_feature (200)..(200): Xaa can be any naturally occurring amino acid
  Coding regions on vcDNA: vcDNA=SeqID_70208; Strand=+; Position=1 -99,411-515,570-688,1218-1376,1546-1658
  Homolog annotation: Hit_ID=CAC80545.1; Match level="QueryCoverage =88%, HitCoverage=16%, E-value=1e-76, Identity=81%"; Hit description =putative Na-K-Cl cotransporter [Meloidogyne incognita]
FLCFFIMFASCWYYALIACFLTMSIYKYVEWKGAKQEWGDGLRGLALTTAQYSLMKVEDKDMHPKNWRPQLLILVPQLLILVDGKYSKEMIDLRSLNLLNLAGQLKAGKGLAITVAFVRCSSTRSNVQENRKKADEIKDRVQQDMGQARLRGFGKALLYTESQAQCQISXLAKVNIIGGIKRSLKSRGFCVXLNSELHSXKFIL

SEQ ID NO: 143786 - protein, 73 aa, Heterodera glycines
  Coding regions on vcDNA: vcDNA=SeqID_70209; Strand=-; Position=1-220
MQSIVLERMEAEQRQRSVAAAAAAHHHGMHQQTPPHQPMGCTSVPPPSHHPLAAAAMMQAGGAGGGMPPPQGM

SEQ ID NO: 143787 - protein, 227 aa, Heterodera glycines
  Coding regions on vcDNA: vcDNA=SeqID_70210; Strand=-; Position=1 -267,625-909,2398-2527
  Homolog annotation: Hit_ID=NP_197410.1; Match level="QueryCoverage =71%, HitCoverage=29%, E-value=1e-14, Identity=38%"; Hit description =heavy-metal-associated domain-containing protein [Arabidopsis thaliana]
MELNSVPGMAMCTASAGGAMDAGQMLGMHPHHHHMGGGGGGGGLPNGTPCNAGPGPPPHQQGMIMDDGGGGGPSAGMAPPYGQPGAPHQGPPPDFFYQQGPPGGAGPPMGPNFGPPMFGGGPPPMSAHHQQQQQMLMQHQQPGTAGLGGPQMVGGGGGPPAQYQQQQNDADQQQQQQHQVLQMGSSPESHEQWWEAFAQEFFDESGRMSITLPEFSPEQGGHIRRDF

SEQ ID NO: 143788 - protein, 72 aa, Heterodera glycines
  Coding regions on vcDNA: vcDNA=SeqID_70211; Strand=-; Position=1-216
MPTKKTIETEEKRPKLGTNWRKKQSKLLIMLRPTNEMAKGTENESKKTKSTDEPMAKRVAQVPWTLLKAQKQ

SEQ ID NO: 143789 - protein, 19 aa, Heterodera glycines
  Coding regions on vcDNA: vcDNA=SeqID_70212; Strand=-; Position=1-60
EPVNSCIGCKCRRCCTPNS

SEQ ID NO: 143790 - protein, 219 aa, Heterodera glycines
  Coding regions on vcDNA: vcDNA=SeqID_70213; Strand=+; Position=1 -153,243-355,395-590,848-968
  Homolog annotation: Hit_ID=NP_510563.1; Match level="QueryCoverage =96%, HitCoverage=41%, E-value=9e-55, Identity=47%"; Hit description =csup drome catecholamines up protein (XQ126) [Caenorhabditis elegans] emb|CAB17070.1| Hypothetical protei
AIDHHQHGHLHDDGHGHHHDCGGHQHSHGERHETDGKRAASTLPKIGRATGYLAFLNDPKIRLWTYAVGSTVLISAVPCFLLLLIPIKENTAEDSPLLRTLLAFGAGGLLGDAFKENTAEDSPLLRTLLAFGAGGLLGDAFLHLIPHATPSGHSHSHSHAGEGHAHGPHDLSVGSWVLVGFMTFFIVEKSVRIIRGNDPPGHGHSHGDEKRKKKQAKFS

SEQ ID NO: 143791 - protein, 34 aa, Heterodera glycines
  Coding regions on vcDNA: vcDNA=SeqID_70214; Strand=-; Position=1-104
EDISCRLKWDKNVNSLDELDFDYNTGTQVIRWES

SEQ ID NO: 143792 - protein, 136 aa, Heterodera glycines
  Coding regions on vcDNA: vcDNA=SeqID_70215; Strand=-; Position=1 -178,232-464
MDAQIAAVLARFDAELCATASGTLCRNALKPTLLGFDMIAYKCVRVGSPSLSLHYVPEETTDAKQMFNKLMFMDDLDTEDGPSHDINGEEIDGQNAEEITFARTCEGELLIRVREKSFNFLKKEWVPSPNGDNAEL

SEQ ID NO: 143793 - protein, 105 aa, Heterodera glycines
  Coding regions on vcDNA: vcDNA=SeqID_70216; Strand=+; Position=1-362
HLAYAFVPHRHPRFRENWRSFLGLQRNSRRSLWRHILLPSSHATPYSLNAASAFDEEQQRLVTVKTDIGNGHSTTQQQEGTPLIADSPQSSTETNNSADGNILMI

SEQ ID NO: 143794 - protein, 160 aa, Heterodera glycines
  Coding regions on vcDNA: vcDNA=SeqID_70217; Strand=+; Position=1 -211,256-380,426-570
MLCKCGECFECEDEKRRLKRNRELNTRKEQIKNCTGNHLAPAMMELKRRNMELFKKAYRPVKGVINKITGGPWNVECEVCHETFTYFMVEWENSRTDFSWGPGRTMVEADNINQKEILAHYVGQNDLLQNEVDYYQNLGNNPPLNVSPMGEDAIMLTRDD

SEQ ID NO: 143795 - protein, 118 aa, Heterodera glycines
  Coding regions on vcDNA: vcDNA=SeqID_70218; Strand=+; Position=1 -32,117-226,579-793
MSECTVVTFLIALLAIICYANFCAAVSKQWTLLDLDDMEGMRKDTQHGKWRNKRDGTAVKEYNAKNINYTEFYARVVANKCLLTVNKTQEEVERAEEEEEENVANGKVGILSLTNEKK

SEQ ID NO: 143796 - protein, 150 aa, Heterodera glycines
  misc_feature (37)..(37): Xaa can be any naturally occurring amino acid
  Coding regions on vcDNA: vcDNA=SeqID_70219; Strand=-; Position=1-1236
  Homolog annotation: Hit_ID=NP_690845.1; Match level="QueryCoverage =48%, HitCoverage=58%, E-value=8e-10, Identity=49%"; Hit description =Mitochondrial protein of unknown function, overexpression suppresses an rpo41 mutation affecting mitochon
TERRTANPSLEASSPTYSNKRVNADQIRQLCPFPPHXFTSSLTLSSKCFATFPHGTCSLSDSWPYLVLDEVYHLIWAAIPNNPTPRHVKMGRHRQLDRSCTFSGAPVKGNLNKRANPSSRSIRYTSQPQRSCDSALDSSQFTRRYYGNPR

SEQ ID NO: 143797 - protein, 43 aa, Heterodera glycines
  Coding regions on vcDNA: vcDNA=SeqID_70220; Strand=+; Position=1-133
TLPKFESVRRIAPVESTNSAIGENGATAAAEHGNGIVVKWQFQ

SEQ ID NO: 143798 - protein, 44 aa, Heterodera glycines; identical to SEQ ID NO: 141399
  Coding regions on vcDNA: vcDNA=SeqID_70221; Strand=+; Position=1 -67,417-484

SEQ ID NO: 143799 - protein, 71 aa, Heterodera glycines
  Coding regions on vcDNA: vcDNA=SeqID_70222; Strand=+; Position=1-630
  Homolog annotation: Hit_ID=NP_510124.2; Match level="QueryCoverage =69%, HitCoverage=28%, E-value=4e-15, Identity=83%"; Hit description =regulator of G protein Signaling RGS-2, regulator of G protein (19.6 kD) (rgs-2) [Caenorhabditis elegans]
CFVQFKARIIYEDFISILSPKEVSLDSRVREIINRNMVSPSAHTFDEAQNQASGAIIGFWMDPSISFFGIL

SEQ ID NO: 143800 - protein, 195 aa, Heterodera glycines
  misc_feature (182)..(182): Xaa can be any naturally occurring amino acid
  misc_feature (188)..(188): Xaa can be any naturally occurring amino acid
  Coding regions on vcDNA: vcDNA=SeqID_70223; Strand=-; Position=1 -215,270-324,928-1014,1087-1255
  Homolog annotation: Hit_ID=NP_510124.2; Match level="QueryCoverage =96%, HitCoverage=95%, E-value=5e-38, Identity=49%"; Hit description =regulator of G protein Signaling RGS-2, regulator of G protein (19.6 kD) (rgs-2) [Caenorhabditis elegans]
CHLFRIICLQPGTMATALLSIDNYSTVFSGPFEEVAAWGVNFDRLMKNKNGQKYFAEFLKSEYSDENILFWQACEELKRERNTEKIEEQACEELKRERNTEKIEEKARIIYEDFISILSPKEVSLDSRVREIINRNMVSPNMVSPSAHTFDEAQNQASGAIIGFGWIHQSAFSGFCDNRVYXFRIGQXGVKNQNV

SEQ ID NO: 143801 - protein, 167 aa, Heterodera glycines
  Coding regions on vcDNA: vcDNA=SeqID_70224; Strand=+; Position=1-595
KRSGSPSASSSCRTTSGDSNRTTVTSSNSNNNNSSRSATNGATHGRNTTPTAAAQIGGPNAAETVALQLFVHRKWRVSRVGGGRSTVYSRVSTPPLEKGLPLFGVVVQLKGIKIRVGRRAGPMDGEESGIGKEIPRPKFCREWLEKFKNGAPQNVVGRNVVGRLFEP

SEQ ID NO: 143802 - protein, 70 aa, Heterodera glycines
  Coding regions on vcDNA: vcDNA=SeqID_70225; Strand=-; Position=1-210
VLHDASFRANAKLIQKKIALSPFGAKEQLVRWVEFAAEFPHLNELNMPTDAELGWVAYYSIDAILFTISA

SEQ ID NO: 143803 - protein, 24 aa, Heterodera glycines
  Coding regions on vcDNA: vcDNA=SeqID_70226; Strand=+; Position=1-76
ITGVSIIAVLFLVFLMPSQNLVRF

SEQ ID NO: 143804 - protein, 27 aa, Heterodera glycines
  Coding regions on vcDNA: vcDNA=SeqID_70227; Strand=-; Position=1-81
MHRIIAAVKKLVVGSVLAVRCTLCVLL

SEQ ID NO: 143805 - protein, 46 aa, Heterodera glycines
  Coding regions on vcDNA: vcDNA=SeqID_70228; Strand=-; Position=1 -43,121-218
MCENRLGLSFHRCKEFIFILLILVIKMFLKLNGSPDLIECKKPEFE

SEQ ID NO: 143806 - protein, 244 aa, Heterodera glycines
  Coding regions on vcDNA: vcDNA=SeqID_70229; Strand=-; Position=1 -11,77-352,403-849
  Homolog annotation: Hit_ID=AAL78214.1; Match level="QueryCoverage =75%, HitCoverage=94%, E-value=7e-12, Identity=28%"; Hit description =putative esophageal gland cell protein Hgg-20 [Heterodera glycines]
MNRRWICNDVWMDIFPSFDRPQLGLKLALLSPRFNALVDKHFDGKSELTIWRPIEISKDKGPEPKLSVRMDDKFVPFPLPDRPLPSKIRFKWLRIDYIDHSVIAFLRSNQQIFDKRGTNLYLWIPSSHSTNGQPILDIFGREIWPIFSANIRHLCFPHGDHLDNLLRRISPTILTDLNQLNSIHSFDLLPAAIGDGFDGPNSTTSAGQALSKWLHSPRKDGQPKRLRCDNYNAQANTDWINISR

SEQ ID NO: 143807 - protein, 158 aa, Heterodera glycines
  Coding regions on vcDNA: vcDNA=SeqID_70230; Strand=+; Position=1-477
  Homolog annotation: Hit_ID=AAG00552.1; Match level="QueryCoverage =99%, HitCoverage=79%, E-value=3e-20, Identity=33%"; Hit description =retinitis pigmentosa GTPase regulator [Mus musculus]
MKIALGKEERRKRKRGKGKIRSKEGEKEEEKDEIAVGKEERRKRKRGKGKIRRKKEGEKEEEKDENSIGEGGETEEKERKRKNSKQEGGEKEEEKDENSSGEGGETEEKERKRKNSKKEGEKEEEKDENSSGEGGETEEKERKRKNSKQGGGERRGKG

SEQ ID NO: 143808 - protein, 35 aa, Heterodera glycines
  Coding regions on vcDNA: vcDNA=SeqID_70231; Strand=+; Position=1 -3,395-499
  Homolog annotation: Hit_ID=AAO85456.1; Match level="QueryCoverage =88%, HitCoverage=23%, E-value=3e-10, Identity=100%"; Hit description= putative gland protein G18H08 [Heterodera glycines]
MDMTKLTTAIEKAEGCKCNLVEKIEKELDDVEGIK

SEQ ID NO: 143809 - protein, 152 aa, Heterodera glycines
  Coding regions on vcDNA: vcDNA=SeqID_70232; Strand=+; Position=1 -165,298-471,745-864
MLYNAFKPRREAGQFQNFVPHFTVESPSTLLDNYVSMSTVAFGQLWNGKMEISDGLLIMLYNAFKPRREAGQFQNFVPHFTVESPSTLLDNYVSMSTVAFGQLWNGKMGISDGLLIIQYNAFKPRREAGQFQILYHILLWKVQVPYSDTTCQ

SEQ ID NO: 143810 - protein, 97 aa, Heterodera glycines
  Coding regions on vcDNA: vcDNA=SeqID_70233; Strand=-; Position=1-389
GGTVPKFCTTFYCGKSKYLIGQLRVNEHSRLWPVVERKNGNIRWGALFSKNSSFRLTIPPFCALFRFKIESFFWSFEINCEKYTKIILAFNYAVQCF

SEQ ID NO: 143811 - protein, 49 aa, Heterodera glycines
  misc_feature (44)..(44): Xaa can be any naturally occurring amino acid
  Coding regions on vcDNA: vcDNA=SeqID_70234; Strand=-; Position=1 -136,278-347
IVKNIRKLFSLLIMLYNAFKPRREAGQFQILYHILLWKVQVPYXDTTCQ

SEQ ID NO: 143812 - protein, 120 aa, Heterodera glycines
  Coding regions on vcDNA: vcDNA=SeqID_70235; Strand=+; Position=1 -87,169-234,313-522
MSISTDSTNSVEFSSDDCGESFIDQQKLKQIGEKFAKMELVLKNTKLELKNKGLQEKLKQQETKALLAKIEAENGKMKREIEKMPEKMDEKEEQYMDKLEELQKNVIFAIFLFLPFEIEL

SEQ ID NO: 143813 - protein, 30 aa, Heterodera glycines
  Coding regions on vcDNA: vcDNA=SeqID_70236; Strand=-; Position=1-90
MKQQQRLCGLKLTNRTKQLCGDCVPVNMSQ

SEQ ID NO: 143814 - protein, 280 aa, Heterodera glycines
  Coding regions on vcDNA: vcDNA=SeqID_70237; Strand=+; Position=1 -552,644-934
MQIPQNPLPKKVVGFEDITKREANDFWVFPLCKTIPSSFYRYINDNVITFLHCFRPLFAACQINFAIDDTLTIFNSTLEPILRNIWAVIATNVCAIQLSAEVFRRLRQFVPSILDDCPSLRVFNAYYFGFFTQFPCDDSATASNGQAVAKWLFTPRPDNVPKVFKCWLQWDDGHLASSIEDFKRFLIVFLILGIYHASSPVNFIAVIRFPPTFADSVLLFDLTNGFTHEQLTLTWMNDIGRFLLIRRPIVRDENKWAKWEKEAIGWQFYDQWNRIDIRSS

SEQ ID NO: 143815 - protein, 319 aa, Heterodera glycines
  Coding regions on vcDNA: vcDNA=SeqID_70238; Strand=+; Position=1 -239,299-574,637-1081
  Homolog annotation: Hit_ID=AAL78214.1; Match level="QueryCoverage =47%, HitCoverage=77%, E-value=3e-10, Identity=28%"; Hit description =putative esophageal gland cell protein Hgg-20 [Heterodera glycines]
MFVICCAILLKYWDRFKKPPKQQRGHRKIEKVPETVLTIEKVPETVLTIEKVPETVLTICLDEMSSDNQNEAEEKMTKAIFISADCWLCVFHLLPPRQLGLGISMISHRFDFYVDEHFKTRKWTLDFVRIWRKFEADGTQEMEILNCRWKSMQIPQNPLPKKVVGFEDITIRYINDNVITFLHCFRPLFAACQINFAIDDTLTIFNSTLEPILRNIWPMIATNVCAIQLSAEVFRRLRHFEPSILNDCPSLRVFNAYYFGFFTQFPCDDSAAASDGQSVAKWLFTPRPDDVPKVFKCWLQWDDGHLASSIEDFKRVIIV

SEQ ID NO: 143816 - protein, 125 aa, Heterodera glycines
  Coding regions on vcDNA: vcDNA=SeqID_70239; Strand=-; Position=1-378
MLGKNIHGIELTATFFSLLRQFAPSILNDCPSLRVFNAYYFGFFTQFPCDDNAAASDGQSVAKWLFTPRQDNVPKVFNCYLGKDDEANLTFKVEVLIDLALLWALGFSDKNFGMPLNGDVFLYIL

SEQ ID NO: 143817 - protein, 129 aa, Heterodera glycines
  Coding regions on vcDNA: vcDNA=SeqID_70240; Strand=-; Position=1-390
MNQQLYENAPGNTERYRPLRVERPVVAENQHHLVRQNPPPHAYAHNDDYYAQRFKAQNSQQAPQFQNHNQNVPIRENHPNQFEQYQQPVHPGLVFDGMMAQAIRSLDSFSYTMTLNSIPNLDGPADQTQ

SEQ ID NO: 143818 - protein, 19 aa, Heterodera glycines
  Coding regions on vcDNA: vcDNA=SeqID_70241; Strand=-; Position=1-58
GLLGSWVRVPPGELPFMFY

SEQ ID NO: 143819 - protein, 103 aa, Heterodera glycines
  Coding regions on vcDNA: vcDNA=SeqID_70242; Strand=-; Position=1-312
MELSANDEQLEYEEMDADNEQNANGVVLQQNLRENMGSQVWGEQIGGVVEVGTVNANANDGPIFSTPHDSRDFGLLQRDLRLHFSENLSLILDRNQRRDMNVK

SEQ ID NO: 143820 - protein, 55 aa, Heterodera glycines
  Coding regions on vcDNA: vcDNA=SeqID_70243; Strand=+; Position=1 -77,270-360
MALNGTYLLNLACTAPTPCMKFELYSPNFALFNHYFSGSVSLLFFFKSAIKNTYL

SEQ ID NO: 143821 - protein, 234 aa, Heterodera glycines
  Coding regions on vcDNA: vcDNA=SeqID_70244; Strand=+; Position=1 -53,110-257,300-480,521-703,754-893
MLSCFEDIIAIPCGTLLASATGVITKVMESEKKVSVVLVCGSGENFVVTEFKQNSANALQKYLSVGNVLKLQSVKAQRFNEKFDGQKFFQTPFPFEFVVTKHSKICLVKTEVLAAEKFTQLVAGRFYKIKCVLTTPFSLIGEMFAAVVGDLCGKRADLFISGEKLPEMFGQLDSKDQLELKRCFVKIEDECMQLNVLASDVNVCGCKVTIGDKLVTPVKRKSDEAILSPQSAKK

SEQ ID NO: 143822 - protein, 183 aa, Heterodera glycines
  Coding regions on vcDNA: vcDNA=SeqID_70245; Strand=-; Position=1-554
LNHQHFNHWDSTHQHSNHWDSILLHFNHWHSTHQHFNHWNSLNPPAFQSLGLNSAFQSLALNPTAFQSLGLNSPAFQSLALNPPTFQSLELNPPAFQSLGLNSAFQSLALNPPAFQSLGLNSPAFQSLGLNPPAFQSPGLNPPESITETQFSGISSNATQIKQFSDILPVSQSPDKKLCQIHH

SEQ ID NO: 143823 - protein, 217 aa, Heterodera glycines
  Coding regions on vcDNA: vcDNA=SeqID_70246; Strand=+; Position=1 -212,273-546,591-760
VTGRSPMVRRHQTQNQHIPPPNHQKVISALASSRLQCQNQQPLSNSTQQQTMPKSNASGSRPGSLKVSYRGERPYGSAADKIHRHGNQATTSTFSPADVDTVPSSAVGPPVEPFLRRVGSTKHRIQRPPPVPDEDGFVRMSPRSIKHKQPQEKPQKNVEDEAIHSRLEQSNSLSVTAQQQQPQQSKRIASGKKDLHAFSFLIFCNISDKRQCHQSQW

SEQ ID NO: 143824 - protein, 179 aa, Heterodera glycines
  Coding regions on vcDNA: vcDNA=SeqID_70247; Strand=+; Position=1 -41,420-604,691-818,915-1090
  Homolog annotation: Hit_ID=CAE69174.1; Match level="QueryCoverage =95%, HitCoverage=25%, E-value=1e-35, Identity=48%"; Hit description =Hypothetical protein CBG15206 [Caenorhabditis briggsae]
VQNVSKQRPEWMELELANRYLGFSVAVYGWPFYVLTNCACCSWCLLCRHLCTLSKGIVSEEIVVVADNCCACHQSAFMLRLDSHCRLCFLSFRNRLFEVPFAVLVDNKTRAIVVTIRGSASSASFMDLITDLSLSDELLECSVDVDSDPILCNDKELDGRGEVRVHKGMLRGARRVPPK

SEQ ID NO: 143825 - protein, 283 aa, Heterodera glycines
  Coding regions on vcDNA: vcDNA=SeqID_70248; Strand=+; Position=1 -119,160-280,342-373,420-603,653-802,852-899,974-1168
  Homolog annotation: Hit_ID=XP_392806.1; Match level="QueryCoverage =74%, HitCoverage=49%, E-value=1e-61, Identity=59%"; Hit description =similar to ENSANGP00000025193 [Apis mellifera]
WFNTSASARVVSSADEAFTPSFEQSALSPPLSQTHMNSISSQGLAEPSVMNNSNTNLQTFREVLFNETVLKLLRRYEFVGSIGSGAQGLVICCKDLLTNQRVAIKRLTRPFANVIHAKRGRSKLRLCFSIVVHLIHLAYREFEIMNLVNHRNIIKLLNAYTPQSSLDEFSDIYLVMECMDANLCSVVQMGLDHERLSFLLYQMLCGINHLHKAGIIHRDLKPSNIVVDMNCQLKILDFGLARNSGESMLMTPYVRRERPYAPKGSASIGIFMMRSKGVATGAR

SEQ ID NO: 143826 - protein, 122 aa, Heterodera glycines
  Coding regions on vcDNA: vcDNA=SeqID_70249; Strand=+; Position=1-369
MNDLTDLFNAQSSSQDILRERQRKNMENWRKRKNELPEAELNAFKEKERKNVENFRKRQRNKETRLYLAANNPNKAVFYALSPFEIKCKECKAVHFIEENSINSCQKNKIFTVVVKMENLRH

SEQ ID NO: 143827 - protein, 93 aa, Heterodera glycines
  Coding regions on vcDNA: vcDNA=SeqID_70250; Strand=-; Position=1-307
LRSKSSSNNFSASNSFYNRFIHPIMNAKIIRVPKIACDLRLEKNGVSKNRNYAQKASQPILAHPIPSTIAFIHPIMNAKIIRVPKIACDLSLA

SEQ ID NO: 143828 - protein, 43 aa, Heterodera glycines
  Coding regions on vcDNA: vcDNA=SeqID_70251; Strand=+; Position=1-132
ENVFFLLTFFSEEGYEQSLIRLMLGDKGIGKKNISTISRETVQ

SEQ ID NO: 143829 - protein, 111 aa, Heterodera glycines
  Coding regions on vcDNA: vcDNA=SeqID_70252; Strand=+; Position=1 -258,309-386
MVVVSIEAQNGEQQRTLTIMPHRKQCFVEVYCNIANTDGTSTVLAFGTGQKEAGTAQIHLSLFDGEKANKCFEQNIHVKIFDENKEQNFIFNSSEFFNVSKQITIDLTKPN

SEQ ID NO: 143830 - protein, 183 aa, Heterodera glycines
  Coding regions on vcDNA: vcDNA=SeqID_70253; Strand=+; Position=1 -279,330-601
  Homolog annotation: Hit_ID=AAL78214.1; Match level="QueryCoverage =81%, HitCoverage=75%, E-value=5e-13, Identity=30%"; Hit description =putative esophageal gland cell protein Hgg-20 [Heterodera glycines]
WICNDVWMDIFPSFDRPQLGLKLALLSPRFNALVDKHFNGKSELTIWRTIEIRRKDKGPEPKLSVLMDDKIVEFPLPDYPLPWKIRFKRLQMWYIDHSVIAFLRSNHQIFDKRGTNLYLWIPSSHSTNGQPIWDIFVREIWPIFSENIRHLRFYDGDHLDNLLRRTSPTILTDLNQLTSIYSC

SEQ ID NO: 143831 - protein, 54 aa, Heterodera glycines
  Coding regions on vcDNA: vcDNA=SeqID_70254; Strand=+; Position=1 -45,226-333,576-587
MLLDRKELERPKTRISQQCQDLIKYLSSQTDSPNDFAKKLESAPPVKELGDLNF

SEQ ID NO: 143832 - protein, 45 aa, Heterodera glycines
  Coding regions on vcDNA: vcDNA=SeqID_70255; Strand=-; Position=1 -21,60-176
MKLLAAQIVHLKLQSAVLVASRPFFALGIILSIGIEFRKNCQSRE

SEQ ID NO: 143833 - protein, 376 aa, Heterodera glycines
  misc_feature (266)..(266): Xaa can be any naturally occurring amino acid
  Coding regions on vcDNA: vcDNA=SeqID_70256; Strand=+; Position=1-1141
  Homolog annotation: Hit_ID=S08405; Match level="QueryCoverage=98%, HitCoverage=40%, E-value=8e-69, Identity=34%"; Hit description =hypothetical protein 2 - silkworm transposon mag
GPTDIEHVQRMEAVFSRLQQNDLRIKKEKCSFLKDKLIYLGHVIDKTGISPSPEKVKAIKEMPEPKTIEFESFLGMVNYYSKFVKDLAECVEPQTSPEGVEWDWSDEQTKAFNLVKEKLTSDKVLVHYDPKNNLFLATDASITELEFNYFGIEKFKQYLYGRKFVLQTDHEPLKKFTANRRPVVAARRLHRWGLILIETQKDTLLKLVKKFVKEGWPNKVKEFRPFYIARNSLEIQSGCLMLGIRTVIPATFRPEIFQLIHSAHPXIVRMKSLARQKVWWPGLDKAIEEIRKSCRPCQINASEERKVPLHPWEEPERPWQRLHVDFCGPFWGFMWFVMVDAKTKWPEVIKMKTTNTNTTIYEMRRIFAIHGLPKRV

SEQ ID NO: 143834 - protein, 18 aa, Heterodera glycines
  Coding regions on vcDNA: vcDNA=SeqID_70257; Strand=-; Position=1 -10,54-100
MVCVFRDLKQKTFFDVQI

SEQ ID NO: 143835 - protein, 127 aa, Heterodera glycines; identical to SEQ ID NO: 138408
  Coding regions on vcDNA: vcDNA=SeqID_70258; Strand=-; Position=1-381

SEQ ID NO: 143836 - protein, 88 aa, Heterodera glycines; identical to SEQ ID NO: 124691
  Coding regions on vcDNA: vcDNA=SeqID_70259; Strand=-; Position=1 -96,135-305

SEQ ID NO: 143837 - protein, 18 aa, Heterodera glycines
  Coding regions on vcDNA: vcDNA=SeqID_70260; Strand=+; Position=1-58
PVNSCIGCKCRRCCTPNS

SEQ ID NO: 143838 - protein, 25 aa, Heterodera glycines
  Coding regions on vcDNA: vcDNA=SeqID_70261; Strand=-; Position=1-80
AFIPGSINKFPWTWTSSVTSSTTSI

SEQ ID NO: 143839 - protein, 45 aa, Heterodera glycines
  Coding regions on vcDNA: vcDNA=SeqID_70262; Strand=-; Position=1-135
NVSKKDWHDMFTTNNRIASWVVNGCEKLLLELGLELLDHVTDAAN

SEQ ID NO: 143840 - protein, 231 aa, Heterodera glycines
  misc_feature (6)..(6): Xaa can be any naturally occurring amino acid
  Coding regions on vcDNA: vcDNA=SeqID_70263; Strand=+; Position=1 -108,421-706,1079-1263,1462-1575
  Homolog annotation: Hit_ID=NP_036606.2; Match level="QueryCoverage =94%, HitCoverage=85%, E-value=2e-46, Identity=49%"; Hit description =uridine-cytidine kinase 2 [Homo sapiens] gb|AAH02906.2| Uridine -cytidine kinase 2 [Homo sapiens] emb|CAH7
LKFCRXFTMSNILTVSQYLMPNCFVIGVAGGTASGKSSVCGRIMERLELHGSHKRVVIVAQDSFYRDLTSADEIAKARRGDFNFDHPNAFEHQLMLNTLRQLRQGKSVVIPKYDLKEQRRCVFHRKTIQKNLVPKFNKNMKTFYEKNKQNANIWSGFENAFLTIFSCPVERDTTELGRPLDQVLHQYLSLVKPAYEDFCLPTKKYADVIIPRGAENDVAIDLIVQHIQEIL

SEQ ID NO: 143841 - protein, 92 aa, Heterodera glycines; identical to SEQ ID NO: 127421
  Coding regions on vcDNA: vcDNA=SeqID_70264; Strand=+; Position=1-304

SEQ ID NO: 143842 - protein, 96 aa, Heterodera glycines
  Coding regions on vcDNA: vcDNA=SeqID_70265; Strand=+; Position=1-352
PPPTLGSASPVLSSPQHLCLRPHLHKSINSPNFFNTQTSCMFIHFDSCQSLEKLRPRQRWHPSSSHHRSMPSTSASKHLNPDGRAPHSEIASFFQP

SEQ ID NO: 143843 - protein, 356 aa, Heterodera glycines
  Coding regions on vcDNA: vcDNA=SeqID_70266; Strand=-; Position=1 -80,152-326,644-756,851-1551
  Homolog annotation: Hit_ID=AAK31375.1; Match level="QueryCoverage =67%, HitCoverage=35%, E-value=5e-12, Identity=32%"; Hit description =ppg3 [Leishmania major]
MMRLSRDYDCIKEGTELNGFKQRGPDVYFAKRDIAGSPDAAQPILLMKPEGHKVMFMIAHPDVDTNCDLLRINNGTCSSTGNQKGKDARLLVKHGTPAHNLMKCVAGSGGLPGWAWALIVTAILLLIALLLAITCFMVLKRRKNQLRQPPRSYWSNPSAGRGGGQSLWARTTGNISRLLIIRGRGRKAAAAPAVAGGRGGGGIEALSKKRSDWFGGSTARSGYAAEHGIETPQSTQESLSNGKDKRASRGSSKPTSRGSAPTSHGSSKPTSRGSAPTSHGSSKPTSHGSAPTSHGSAPGASKPTSHGSSKPTSRGSAPTSHGSSKPTSHGSAPMTTPSGGFKGMMARLMGQKTGTS

SEQ ID NO: 143844 - protein, 93 aa, Heterodera glycines
  Coding regions on vcDNA: vcDNA=SeqID_70267; Strand=-; Position=1 -188,773-863
  Homolog annotation: Hit_ID=AAQ84516.1; Match level="QueryCoverage =67%, HitCoverage=1%, E-value=7e-12, Identity=55%"; Hit description =BWF1 [Mus musculus] ref|NP_766470.2| WD repeat and FYVE domain containing 3 [Mus musculus]
MNSHILHLVFTLAGTVDDGSAEQVLIPDLLTFEDLLCDLDVWRKASRDVWKLLLEHFFELLTEFASVFCAYEEPIAEHSLHNVKPLKLANEQS

SEQ ID NO: 143845 - protein, 146 aa, Heterodera glycines
  Coding regions on vcDNA: vcDNA=SeqID_70268; Strand=+; Position=1-439
NGLSKNRNYAQKASQTILTLPIPSTIAFIHPIMSAKIIRVPKIACDLSLEKNGLSKNRNYAQKASQTILALPIPSTIAFIHPIMSAKIIRVPKIACDLSLEKNGLSKNRNYAQKASQTILALPIPSTIAFIHPIMSAKIIRVPKIA

SEQ ID NO: 143846 - protein, 45 aa, Heterodera glycines
  Coding regions on vcDNA: vcDNA=SeqID_70269; Strand=+; Position=1-137
MVFPKNYDFYNTPLADLRNSLAFPTTKNIKSALTLITKNVQQIFL

SEQ ID NO: 143847 - protein, 148 aa, Heterodera glycines
  Coding regions on vcDNA: vcDNA=SeqID_70270; Strand=+; Position=1 -195,245-340,393-443,490-591
  Homolog annotation: Hit_ID=NP_501671.1; Match level="QueryCoverage =97%, HitCoverage=14%, E-value=1e-54, Identity=69%"; Hit description =g-protein beta WD-40 repeat and Coatomer WD associated region (111.1 kD) (4K227) [Caenorhabditis elegans]
LGYLSKENRVFACDKDHNIVSFKLLLSVLEYQTAVMCKDFDTADQILKIIPENLHTRVAQFLEKQGFKKQALAISKDPQHRFELALSLGDLPAAYEMAKQADSEEKWKQLAHAATIKSELRLAGECLAKANDFGGLLLLASCAGSNRL

SEQ ID NO: 143848 - protein, 62 aa, Heterodera glycines
  Coding regions on vcDNA: vcDNA=SeqID_70271; Strand=+; Position=1-387
LLITLYNAFKPRREAGQFQNFVPHFTVESPSTLLDNYVSMSTVAFGQLWNGKMEISDGGALF

SEQ ID NO: 143849 - protein, 123 aa, Heterodera glycines
  Coding regions on vcDNA: vcDNA=SeqID_70272; Strand=-; Position=1 -46,225-550
MILISDRSGEWSVSETNISIKLTCPKRPPTIRSLDIRLTVFDPIRGQNFAFEKQIYGFELPTVGENGREQSVEIGRIKAKNAGTRGNGTAREEADQLITYALLSGNECAFQYLNGFRKLGTKF

SEQ ID NO: 143850 - protein, 791 aa, Heterodera glycines
  Coding regions on vcDNA: vcDNA=SeqID_70273; Strand=-; Position=1-2373
  Homolog annotation: Hit_ID=NP_920205.1; Match level="QueryCoverage =89%, HitCoverage=46%, E-value=1e-76, Identity=31%"; Hit description =putative DNA helicase homolog [Oryza sativa (japonica cultivar -group)] gb|AAP52492.1| putative DNA helica
MDLRISTPKNLLQYLVNQYNRQQARQNPNAQQKTVDDIGSVVRLSEHNVNSLQYWKKMYEDCNTVFARCHDAKKARLFITFTNNREWPEFKENLHKNGQVFTDRFDMWMRVWSSKIAEFREELYDKKFFGTILGYGESMEFQGRGGPHAHIVAQTDLDAVPYVIQEYIWAHIPSLPDKDDDTPIAKMHREIRETMHMQLHRCSDSWCGPSDPIYGRCKKGFPAPYSKCTILRPDRPAMYFRPSPTDGGAQLEVNGLIYDNSHVVPYNPYILLRYRVHHNVLFAYGNKANIKYALKYPFKGPGHCYVECKEESGNKIKIDEPAQYAKMNFRGATEAYAIVHSMPFARLSHHVVKLAIHLPNQQPIVYRAFQLVSKAQQIQQGELPETQCSAYWKQWQNEWKNDPKFKDILFEKVPERFRWAKDKWVLYKRQQIKRPPIGRIVPVPPSDPERFALYSLMRHFPGDPDHLKMVNGLLCTSFTEAAIMHGLLEDDKIWDKTLAEAALSRWPDQMRWLFVSILVYGQPSNAIELWNKYKDQMYNPQGIITLAQHKVAELEALADIDWRLHSCFNLSCVHFSLPDPPTSIAKNTDAAIEEFFFGDDDLNLPPGQPNPRPQPNTPPPLNSDQQKVFDAVLLAIQSNPRDSTVPRRFFIYGDGGTGKTFLFGQIIRRLRKAPYTYKVLATASTGCAAILLPYGKTAHSTFRLGREVSLDKLPSIPLESFFARRIREAQLIIIDEITMLHNTVIEVIDRVCKEMAIRQHKDLLFGGKTVIFSGDFKQSLPVVPHEGLTAQ

SEQ ID NO: 143851 - protein, 21 aa, Heterodera glycines
  Coding regions on vcDNA: vcDNA=SeqID_70274; Strand=+; Position=1-64
MKPLRRECATIAASCPCGYGG

SEQ ID NO: 143852 - protein, 105 aa, Heterodera glycines
  Coding regions on vcDNA: vcDNA=SeqID_70275; Strand=+; Position=1 -45,117-224,280-366,646-672
  Homolog annotation: Hit_ID=AAQ12016.1; Match level="QueryCoverage =99%, HitCoverage=30%, E-value=3e-34, Identity=79%"; Hit description =tropomyosin [Heterodera glycines]
MDAIKKKMQAMKIEKDNAIDDNAIDRADAAEEKCRQTQERLERVEEELRDTQKKMMATENELDKAQEATENELDKAQEDLTAANNLLEEKEKKVQEAAEKVHNLL

SEQ ID NO: 143853 - protein, 37 aa, Heterodera glycines
  Coding regions on vcDNA: vcDNA=SeqID_70276; Strand=+; Position=1-114
KTGASRPFFNFVETLGRFAASGRALRARFLILWGTFG

SEQ ID NO: 143854 - protein, 141 aa, Heterodera glycines
  Coding regions on vcDNA: vcDNA=SeqID_70277; Strand=+; Position=1 -61,454-521,577-640,941-1173
  Homolog annotation: Hit_ID=NP_492127.1; Match level="QueryCoverage =98%, HitCoverage=82%, E-value=4e-56, Identity=38%"; Hit description =EGF motif related, Low-density lipoprotein Receptor Related (lrp-1) [Caenorhabditis elegans] emb|CAA98124
MEWKCDGSGDCRNGEDEKDCPHPGCKADQWQCDKYEWHSVSCIHEYQRCDNITDCSDGSDERDCPASPVNCEVNDGSVFSCADGRQCFPIARKCDGNYDCRDLSDEKDSCATNHTVGDRFRGCWDVSQKPSNGNFLTENYS

SEQ ID NO: 143855 - protein, 429 aa, Heterodera glycines
  Coding regions on vcDNA: vcDNA=SeqID_70278; Strand=+; Position=1 -120,455-702,1306-1472,1709-1754,1910-2072,2475-2528,2683-2800,2964 -3032,3452-3502,3558-3759,3902-3951
  Homolog annotation: Hit_ID=NP_492127.1; Match level="QueryCoverage =99%, HitCoverage=88%, E-value=0.0, Identity=30%"; Hit description =EGF motif related, Low-density lipoprotein Receptor Related (lrp-1) [Caenorhabditis elegans] emb|CAA98124.1
NNLWSTLGCQSGCVASPGGGVCTCPQGYKLDERFQRTCSDINECAEFGYCDQTCQNHRPSFTCGCLGSCFRLQMVHGPGNSNMSLRGYCVSNEAEKMRLFVARREGLYRVNPANKDEQAVKIASGEFIYGVDFDYEQKKMFWTDRMAHSLFRADITPTGDIEKIKKLDLKSLIYPRNLAVDWITKNVYVIESGSRRIDVVTYEGDKRTVLLADALTLPLDIALDPLRGDMFFSNQLRLETAHMDGTNRRVLIESHTHQVGVVVDIAAKRVYWSDPKVDRVESIDYSGNDRRQIASGRDFAPHPFGLAMFDQFLYWTDWTRLGIMRVEKFGALSEVIWSMKDSNVFPSMKDSNVFPMGIAAYHPNAQPGPKQSECFQQTIENPCAKSDCEGMCLLSKDSVGFGVGFRCACPIGQGMANGQTGSSAIDEWT

SEQ ID NO: 143856 - protein, 65 aa, Heterodera glycines
  Coding regions on vcDNA: vcDNA=SeqID_70279; Strand=-; Position=1-425
FGHFSEMANPIATKKQKVKLSYEGHLYTFAKMSSDGMTKFWRCEFKKSISHYFWSFSGEFLTTIE

SEQ ID NO: 143857 - protein, 25 aa, Heterodera glycines
  Coding regions on vcDNA: vcDNA=SeqID_70280; Strand=+; Position=1 -38,130-169
MGEGPPRGREAAEKGSETHQILFTC

SEQ ID NO: 143858 - protein, 90 aa, Heterodera glycines; identical to SEQ ID NO: 137676
  Coding regions on vcDNA: vcDNA=SeqID_70281; Strand=-; Position=1-704

SEQ ID NO: 143859 - protein, 100 aa, Heterodera glycines
  Coding regions on vcDNA: vcDNA=SeqID_70282; Strand=-; Position=1 -103,582-781
  Homolog annotation: Hit_ID=NP_872170.1; Match level="QueryCoverage =74%, HitCoverage=7%, E-value=1e-13, Identity=48%"; Hit description =ankyrin and patatin family member (5V188) [Caenorhabditis elegans] emb|CAD54162.1| Hypothetical protein W0
MSLLQLKHKELDLNVRNKAGLYAGYISFVMREDLGMVMCLLSYGAGLDEQADSGKMTALHFAVSKRNLQITRLLLCLGADPNVANAHGDSPRHLAAKLNE

SEQ ID NO: 143860 - protein, 112 aa, Heterodera glycines
  Coding regions on vcDNA: vcDNA=SeqID_70283; Strand=-; Position=1 -14,335-629,986-1015
MSKRSSLIGATNNFRIAETIDLVKTLQNFTPKDELKALMKIKILDLNEKVKFHLLLTFAIRLCVQIEPKYFNVEHFVEKLLKRNEVEIPSFIEKKKRIMYKQKIYSKLLVNY

SEQ ID NO: 143861 - protein, 120 aa, Heterodera glycines
  Coding regions on vcDNA: vcDNA=SeqID_70284; Strand=-; Position=1 -138,282-494,1521-1532
MSRKQPNNFANFAELSSLCERLRSERLLIDCEQIVLRNLNSKVFTLGILRQLINSDLSVSPDNCCQLISNLNSSNFVEAHKILNQHAAELSHVFKLLMGAPRAVAAFINAAEKIPTQKGF

SEQ ID NO: 143862 - protein, 27 aa, Heterodera glycines
  Coding regions on vcDNA: vcDNA=SeqID_70285; Strand=+; Position=1 -28,132-187
MIFLFDYVKAHDFVNLFFLSLITDQWL

SEQ ID NO: 143863 - protein, 149 aa, Heterodera glycines
  Coding regions on vcDNA: vcDNA=SeqID_70286; Strand=+; Position=1-450
MHELMATDNPSDYLVEQFESKKKSAKGEHLEDPDKKSGAKKGSKKNKSANEQRKDNYNKIMKLLMQQKLHPFDFLAGTAQTEQGAEQFQIGGIQYIISGQIANKKKWEKKVKGKLKTQSEMDKANDTCGRLAKLVANTLYDNNTDPQVL

SEQ ID NO: 143864 - protein, 19 aa, Heterodera glycines
  Coding regions on vcDNA: vcDNA=SeqID_70287; Strand=-; Position=1-59
TFAFSSLALPNTHTIFEML

SEQ ID NO: 143865 - protein, 19 aa, Heterodera glycines
  Coding regions on vcDNA: vcDNA=SeqID_70288; Strand=-; Position=1-59
TFSFSSLALPNTHTIFEML

SEQ ID NO: 143866 - protein, 19 aa, Heterodera glycines
  Coding regions on vcDNA: vcDNA=SeqID_70289; Strand=-; Position=1-59
TFAFSSLALPNTHTIFEML

SEQ ID NO: 143867 - protein, 19 aa, Heterodera glycines
  Coding regions on vcDNA: vcDNA=SeqID_70290; Strand=-; Position=1-59
TFAFSSLALPNTHTIFEML

SEQ ID NO: 143868 - protein, 221 aa, Heterodera glycines
  Coding regions on vcDNA: vcDNA=SeqID_70291; Strand=+; Position=1 -115,464-859,1277-1428
MTSSEKGNHYAIPEPKTTRTTTTTSVGGNNSNATDYYEARGRSSSSAMPTIGALLAEFDDELAKRAQMALPSPSQAANAIEYEALLLDKLAKKGPLQSEREIRRSPRINDRGGGGDQKSFWPLQNAKMLMEMDEQQQFNEMIVSEKEGRQHMAMAKGEDNDSEQSITAGGENPCDNNSEMTHRIWLAVENARLASAAGTERMPQKAAKTPRECVRVCTNLL

SEQ ID NO: 143869 - protein, 22 aa, Heterodera glycines
  Coding regions on vcDNA: vcDNA=SeqID_70292; Strand=+; Position=1 -36,99-131
MVASNRPEKSQKRQVKWAPCEG

SEQ ID NO: 143870 - protein, 39 aa, Heterodera glycines
  Coding regions on vcDNA: vcDNA=SeqID_70293; Strand=-; Position=1 -27,144-236
MKRRKFYLYKLIRSAPNFAGILKGREITYFKYYLVSSFK

SEQ ID NO: 143871 - protein, 52 aa, Heterodera glycines
  Coding regions on vcDNA: vcDNA=SeqID_70294; Strand=-; Position=1 -36,591-713
MPILVGLIYYANNLLMLPPISRSLFGANCAEFVHTFTPHNLLFRSVRNFNIF

SEQ ID NO: 143872 - protein, 24 aa, Heterodera glycines
  Coding regions on vcDNA: vcDNA=SeqID_70295; Strand=-; Position=1-72
MGKDGAEQRPNDQPLGCQVPKLRS

SEQ ID NO: 143873 - protein, 168 aa, Heterodera glycines
  Coding regions on vcDNA: vcDNA=SeqID_70296; Strand=+; Position=1-506
MGIPDTLVSAERRLQMGDTVVVSKFEWKEGFERLSYDLNPVDSLRSWFVQGRINVQAVAIKVEVIKLVIGSFQPGFVTDLKRYRGGDFRSATVISAQMLRPQTIYARQLTEISPGRIMLNQLLYLNLAKITSPQEWWMGENYILPLVTPFLKGNEIRSHGKTVVIGAK

SEQ ID NO: 143874 - protein, 357 aa, Heterodera glycines
  Coding regions on vcDNA: vcDNA=SeqID_70297; Strand=-; Position=1-1074
METALAVEKVIETDKTRGISAGLEEEFERGMELGEGQSVERNTENIEIETIQDFTATQFSNVSWSEPRAIASPVPMSSNEEHGAEGGVLKYLVCQTDVKSVVGGKMSGQGPFFMGIPDTLVSAERRLQMGDTVVVSKFEWKEGFERLSYDLNPVDSLRSWFVQGRINVQAVAIKVEVIKLVIGSFQPGFVTDLKRYRGGDFRSATVISAQMLRPQTIYARQLTEISPGRIMLNQLLYLNLAKITSPQEWWMGENYILPLVTPFLKGNEIRSHGKTVVIGAKESLDSFCFPLNQFSVRLMGAAAAVQRSFEMEKLAKQTVNVQLVWQRPEVRPDEVQTNLKKAQRVSFEWLINNKSAG

SEQ ID NO: 143875 - protein, 83 aa, Heterodera glycines
  Coding regions on vcDNA: vcDNA=SeqID_70298; Strand=+; Position=1 -7,444-688
MKEFHFRVTFFRPILKKSWILIPFYIYLGPNSFCPRNLISEFHVYFLSLPICPKIIGISFPSFTFLLSNPILSRNFGVSFPSA

SEQ ID NO: 143876 - protein, 18 aa, Heterodera glycines
  Coding regions on vcDNA: vcDNA=SeqID_70299; Strand=-; Position=1 -50,404-410
MLLITTFVGQQFFINLKH

SEQ ID NO: 143877 - protein, 118 aa, Heterodera glycines
  Coding regions on vcDNA: vcDNA=SeqID_70300; Strand=+; Position=1-355
MSEPIRTALGIMVENLIGRLNELLPIVRAQQRNEEGLNKLREDRIFLTDLLERIEQKNREWDTYIREIGEEAQNEENERYRLFTHNGRHFYEWAERGREMVSRINIILANEDGESLAE

SEQ ID NO: 143878 - protein, 572 aa, Heterodera glycines
  Coding regions on vcDNA: vcDNA=SeqID_70301; Strand=+; Position=1 -1366,1599-1787,1840-2002
  Homolog annotation: Hit_ID=XP_315603.1; Match level="QueryCoverage =78%, HitCoverage=57%, E-value=3e-53, Identity=29%"; Hit description =ENSANGP00000017599 [Anopheles gambiae]
ASKDAYATCVYLRSEEKETEIQLLYSRSRLRPRKMKISIPRMELLGVLIGTRAIKFVKTEIGITIDGMYLWCDSKPVLSWVNSNCDQPRFVANRLSEIKLNYGLEFGYVSTEQNPADVASRGCTPKELKTHPLWWTGPEWLKKAQLHWPNEMNFKIIQSGDPQDNCQGCQKSFGVIEDREPEMELINFKNYKEWHKLVKIFARMLKIVNKWVQLIKKQTNLKVSEGEYITPMDYEISEKILLKLGQKGWKEYVGKNNQIRWEKDIDGLIRLKTRIERSATPKSFHNPIVFPKGSKILEILILRAHKNVMHERVDATLNNFLSEFWAPGVRNAIKQVLKNCVICRKNRGPPFALPPMPPHPKYRVRRSNPFEFVSLDYLGPSVIKSKNKGEPSGKYWIVLITCLTTRAVYLEPVFDLTAETFLHVLRRFASRRGKPKSIMSDNAQTFKLAAKAGEIPITHVSIEPDGERALRPIDFINPGAELGIFLSKNGNENDQDYRTGQASLEERLKERWKRTIRANRNQWDSQGPKITKIIGKQNWAKWGWLKMIYIQGILGRWDEMLKSNGIPGVIRS

SEQ ID NO: 143879 - protein, 20 aa, Heterodera glycines
  Coding regions on vcDNA: vcDNA=SeqID_70302; Strand=-; Position=1-60
MNQIKVDQEESTKLWDWPLQ

SEQ ID NO: 143880 - protein, 156 aa, Heterodera glycines
  Coding regions on vcDNA: vcDNA=SeqID_70303; Strand=-; Position=1 -64,158-561
MTVVMNTLNWKLTFLFFILSKNLFVYVYGLLDSVSWHNGINSAIFEGQMSNERAEKQAFGIMCSMKYEKKIPAKFEKLRQNFCEQIENGISIERTLENVHEMVTNLLQNVAINQLISENGQQLTKNEFLTDKNQANVDKIYEHFKLEMVQFFGALM

SEQ ID NO: 143881 - protein, 21 aa, Heterodera glycines
  Coding regions on vcDNA: vcDNA=SeqID_70304; Strand=+; Position=1-65
MAISFFSWGFDRKLGTNICLL

SEQ ID NO: 143882 - protein, 19 aa, Heterodera glycines
  Coding regions on vcDNA: vcDNA=SeqID_70305; Strand=+; Position=1-59
PLSFSSLALPNTHTIFEML

SEQ ID NO: 143883 - protein, 19 aa, Heterodera glycines
  Coding regions on vcDNA: vcDNA=SeqID_70306; Strand=+; Position=1-59
TFAFSSLALPNTHTIFEML

SEQ ID NO: 143884 - protein, 19 aa, Heterodera glycines
  Coding regions on vcDNA: vcDNA=SeqID_70307; Strand=+; Position=1-59
TFAFSSLALPNTHTIFEML

SEQ ID NO: 143885 - protein, 276 aa, Heterodera glycines
  Coding regions on vcDNA: vcDNA=SeqID_70308; Strand=-; Position=1-828
MTAKIIRVPKIACDLRLEKNGVSKNRNYAQKAPQPILAHPIPSTIAFIHPIMNAKIIRVPKIACDLSLEKNGVSKNRNYAQKASQTILTLPIPSTIAFIHPIMSAKIIRVPKIACDLSLAKNGVSKNRNYAQKASQTILAHPIPSTIAFIHPIMNAKIIRVPKIACDLSLAKNGVSKNRNYAQKAPQTILALPIPSTIAFIHPIMNAKIIRVPKIACDLRLEKNGVSKNRNYAQKASQPILAHPIPSTIAFIHPIMNAKIIRVPKIACDLSLAKNG

SEQ ID NO: 143886 - protein, 67 aa, Heterodera glycines
  Coding regions on vcDNA: vcDNA=SeqID_70309; Strand=-; Position=1-202
MDFHQQQQQQQQLLLAAALWPPQRAAALATMLRSNNGTTEHNNGTNGITSNNNNGTDGVTANVADSS

SEQ ID NO: 143887 - protein, 137 aa, Heterodera glycines
  misc_feature (18)..(18): Xaa can be any naturally occurring amino acid
  Coding regions on vcDNA: vcDNA=SeqID_70310; Strand=-; Position=1 -170,388-518,572-667
  Homolog annotation: Hit_ID=AAR21856.1; Match level="QueryCoverage =81%, HitCoverage=24%, E-value=3e-32, Identity=61%"; Hit description =GluCl beta [Cooperia oncophora]
SKLCKIATTNSAATEAKXKQIAQQLARDQQILGQLLRNYDRRVRPPIEAGANETGAVRVSVNILVRMLSNIDVVDMEYSLQITFREQWVDRRLAYAQLGSPSPPKFSPSPPKFLTVPHEARIWLPDTFFPTEKDAHR

SEQ ID NO: 143888 - protein, 20 aa, Heterodera glycines
  Coding regions on vcDNA: vcDNA=SeqID_70311; Strand=-; Position=1 -34,284-312
MTIGQWHKVPTDQFIYLFVG

SEQ ID NO: 143889 - protein, 40 aa, Heterodera glycines
  Coding regions on vcDNA: vcDNA=SeqID_70312; Strand=+; Position=1 -27,166-261
MNFGVQFVKNQGANTCFLAAFSIIFQTVIVVAVVPICWDE

SEQ ID NO: 143890 - protein, 51 aa, Heterodera glycines
  Coding regions on vcDNA: vcDNA=SeqID_70313; Strand=+; Position=1-158
THPISLVSLHGPTYWQPQKGGPGWQSDPSDGAQAGAGGSESDRLVNRWETI

SEQ ID NO: 143891 - protein, 24 aa, Heterodera glycines
  Coding regions on vcDNA: vcDNA=SeqID_70314; Strand=-; Position=1 -50,160-184
MGCLIDDGLDGSITRSVPILQNYS

SEQ ID NO: 143892 - protein, 66 aa, Heterodera glycines
  Coding regions on vcDNA: vcDNA=SeqID_70315; Strand=+; Position=1 -41,280-439
MKLKSIWITDEKKGEHVGLAEERKCVRDVVNAIGSADEAQMGGRNGKNTPNNENEQHNRNEEQKHL

SEQ ID NO: 143893 - protein, 87 aa, Heterodera glycines; identical to SEQ ID NO: 142730
  Coding regions on vcDNA: vcDNA=SeqID_70316; Strand=-; Position=1-687

SEQ ID NO: 143894 - protein, 88 aa, Heterodera glycines
  Coding regions on vcDNA: vcDNA=SeqID_70317; Strand=+; Position=1 -107,1419-1578
MCRADGGVCPLAILCQKLAFNVRQVGANWRRNNLFCYIDLCMVHYAKDAFKNVSNTCSNNRSDREEVYSVLEHYMGQWGVNGATFGDL

SEQ ID NO: 143895 - protein, 140 aa, Heterodera glycines
  Coding regions on vcDNA: vcDNA=SeqID_70318; Strand=+; Position=1-423
MIGMLWAYYGTAPPPLKVKQLSLCFLMQRAPHVGAVIVEQTDDLFLTKNGRPRRVMSCQQLRKLLNGLVASVCNNSDHLDEADEHYDYDDIPPKSQEHQQLRVGTALTKKGGMSRKIGAFKMSGDFQSDTAREYKNEDDD

SEQ ID NO: 143896 - protein, 111 aa, Heterodera glycines
  Coding regions on vcDNA: vcDNA=SeqID_70319; Strand=+; Position=1 -303,674-706
MEVKYGNVDKNLKYGKLKTINIRMIPILKITDEQKSYGHSHLKLYETPLYELLSTHFWCHVKEWMDDKMKMMTEKKGRSGGEAGTKEGKGATNNRLRHFPVGLRDQPMESS

SEQ ID NO: 143897 - protein, 254 aa, Heterodera glycines
  Coding regions on vcDNA: vcDNA=SeqID_70320; Strand=-; Position=1 -78,261-411,2360-2491,3515-3624,4119-4271,4383-4521
  Homolog annotation: Hit_ID=CAF92976.1; Match level="QueryCoverage =69%, HitCoverage=36%, E-value=3e-25, Identity=36%"; Hit description =unnamed protein product [Tetraodon nigroviridis]
FLDIRLPSSAAAAADQQRQPIFGLSPQQLRRSEQKANPRTDQGNSQIPKDIVDKMTNFMSISTAILCYLRAIPLILASAESAVVKVPDIEVGAFKVMLSFIYAEDSNGLNGHNAMAVLYAAKKYNISLLDNACLVFPISQLNNVFLAYDQACLLNENNFALRCLDYIDRTAETLFRSDAFLQIDQNLLSKILERDQLNISGELSIWNAALRWADEKCRQNGTECSAENRRAALGPALFKIRFPLFAKEQFSEKI

SEQ ID NO: 143898 - protein, 23 aa, Heterodera glycines
  Coding regions on vcDNA: vcDNA=SeqID_70321; Strand=+; Position=1-69
MSMGPPSFTMFGDALLSLHRSAP

SEQ ID NO: 143899 - protein, 29 aa, Heterodera glycines
  Coding regions on vcDNA: vcDNA=SeqID_70322; Strand=+; Position=1-88
PTDAIEAWAELVEMMFSNVRDGLSHFSFD

SEQ ID NO: 143900 - protein, 42 aa, Heterodera glycines
  Coding regions on vcDNA: vcDNA=SeqID_70323; Strand=-; Position=1-141
AKIKKMSHNRDLYLLMYCTFVCIYHLLCIITLFPSVFRNKLN

SEQ ID NO: 143901 - protein, 29 aa, Heterodera glycines
  Coding regions on vcDNA: vcDNA=SeqID_70324; Strand=+; Position=1-87
MWHPSVDNPSVKDNPSVKDNPSVMDNPSV

SEQ ID NO: 143902 - protein, 146 aa, Heterodera glycines
  misc_feature (135)..(135): Xaa can be any naturally occurring amino acid
  Coding regions on vcDNA: vcDNA=SeqID_70325; Strand=-; Position=1-445
  Homolog annotation: Hit_ID=AAP92584.1; Match level="QueryCoverage =82%, HitCoverage=24%, E-value=5e-34, Identity=63%"; Hit description =Ab2-057 [Rattus norvegicus] gb|AAP85373.1| Aa1262 [Rattus norvegicus] gb|AAP85367.1| Aa1011 [Rattus norveg
PFLVRGAICLVYSDNERDSSLLNSWLIASGHNFLEGFSVFSRTKLSNNRSVMPLDVRGCTRATLAKSACLPSPKGVGKPVKICRDWDRTLQLLSVNEEFLVGASHQLALNTSLPFVHTARRCPGLSHFEKFGDGXCSGRSVCRLEP

SEQ ID NO: 143903 - protein, 221 aa, Heterodera glycines
  Coding regions on vcDNA: vcDNA=SeqID_70326; Strand=+; Position=1 -522,848-991
MSAKIIRVPKIACDLSLAKNGVSKNRNYAQKAPQTILALPIPSTIAFIHPIMSAKIIRVPKIACDLSLAKNGVSKNRNYAQKASQTILAHPIPSTIAFIHPIMSAKIIRVPKIACDLSLAKNGVSKNRNYAQKASQTILAHPIPSTIAFIHPIMSAKIIRVPKIACDLSLAKNGCWWSSGAEWRHGDWWFDSAWVQQFLLFLLIILKYQKVVKNKFKARNN

SEQ ID NO: 143904 - protein, 18 aa, Heterodera glycines
  Coding regions on vcDNA: vcDNA=SeqID_70327; Strand=-; Position=1-56
AGGQVVQNGAMVTGGSTP

SEQ ID NO: 143905 - protein, 103 aa, Heterodera glycines
  Coding regions on vcDNA: vcDNA=SeqID_70328; Strand=+; Position=1 -52,102-358
MVPNLYPFSELQFARFPSHPIPSTIAFIHPIMNAKIIRVPKIACDLSLAKNGESKNRNYAQKAPQTILALPIPSTIAFIHPIMSAKIIRVPKIACDLSLAKNG

SEQ ID NO: 143906 - protein, 221 aa, Heterodera glycines
  Coding regions on vcDNA: vcDNA=SeqID_70329; Strand=+; Position=1-668
  Homolog annotation: Hit_ID=NP_702063.1; Match level="QueryCoverage =98%, HitCoverage=5%, E-value=2e-23, Identity=20%"; Hit description =hypothetical protein PF14_0175 [Plasmodium falciparum 3D7] gb|AAN36787.1| hypothetical protein [Plasmodium
FQSLALNSPTFQSLGLNPPTFQSLGLNPPTFQSLGLNPPTFQSLGLNPPTFQSLGLNPTGFQSLGLNPPAFQSLGLNSPTFQSLGLNPPTFQSLGLNPPTFQSGLNPPTFQSLGLNPPTFQSLGLNPTAFQSLGLNPPTFQSLGLNPPTFQSLGLNPTTFQSLVLNPPAFQSLGLNPPTFQSDSTHQHFNHWDSTHQHFNHWDSTHQHFNHWDSTHQHFNH

SEQ ID NO: 143907 - protein, 80 aa, Heterodera glycines
  Coding regions on vcDNA: vcDNA=SeqID_70330; Strand=-; Position=1-408
KNRFIFVFGAVPPNRCAQIYGETESFGNSFPIVCTLILRWIFAPHNCLSTPNGHLKKSIFLFHKYFFRKCSETHQILFTC

SEQ ID NO: 143908 - protein, 155 aa, Heterodera glycines
  Coding regions on vcDNA: vcDNA=SeqID_70331; Strand=-; Position=1 -66,175-425,471-622
  Homolog annotation: Hit_ID=CAE67685.1; Match level="QueryCoverage =100%, HitCoverage=36%, E-value=6e-57, Identity=60%"; Hit description= Hypothetical protein CBG13252 [Caenorhabditis briggsae]
WSYFDVEENNVKPYKTPAMSGGLLAVSRDYFREIGEYDMGMEIWGAENIEFSIRVWLCGGEVLVAPCSRVGHVFRMRRPYRGKPGVDSSLYNSLRTARVWLDDFEKKYTAIRPAAKRTDPGDLAERLKLKEKLNCKPFEWFIENVEPKLKPSHDE

SEQ ID NO: 143909 - protein, 65 aa, Heterodera glycines
  Coding regions on vcDNA: vcDNA=SeqID_70332; Strand=-; Position=1 -150,392-436
MGERQNRTDEKVGQNGTSEVSNEGQTDETNGYLLENNLEISQKVHNVFEKINSIFNESPAHLLTE

SEQ ID NO: 143910 - protein, 254 aa, Heterodera glycines
  Coding regions on vcDNA: vcDNA=SeqID_70333; Strand=-; Position=1 -205,258-817
  Homolog annotation: Hit_ID=NP_497799.1; Match level="QueryCoverage =31%, HitCoverage=24%, E-value=5e-13, Identity=54%"; Hit description =MaSashi, fly neural family, RNA-binding protein involved in male mating behaviour (35.5 kD) (msi-1) [Caen
AQPKEVMLPVQLNKTRAAAARNLYGLAPEQLLAYASYMPRMPPFYGPTVSSHGHHHGLLTAYPTVNPGMFGNGFPHPPHQPGTITGTNAFGMATSGRSSSNNNGTTGLNARDFAAAQLVAQQQAVYEAAMVGIHVGSEPKINPSYCQVYANQLSSLAGGGAGGEFGGGPSTASPFGGRGGHHQHMPQPHQQTAFVTSAPQQSHAHHHHFASLPPSVLAAPPVHFHHHQQQHLPPPPPGGTPSGGVVPLNFGKSS

SEQ ID NO: 143911 - protein, 221 aa, Heterodera glycines
  Coding regions on vcDNA: vcDNA=SeqID_70334; Strand=-; Position=1 -174,348-522,737-786,993-1259
  Homolog annotation: Hit_ID=NP_497799.1; Match level="QueryCoverage =46%, HitCoverage=31%, E-value=6e-39, Identity=75%"; Hit description =MaSashi, fly neural family, RNA-binding protein involved in male mating behaviour (35.5 kD) (msi-1) [Caen
MSEDGGEKNGEEANRRKDNERGANENEETEGEEKDEEGREESDQQDDNLTVQQRLQHQPNSVPKKQSAKECLDDKTNNKQKTPSAERKLGGGSSSSAPLTEATDAESQATTTNVDEKGLRDYFCKFGEVNECMVMRDPTTKRARGFGFITFADPTAVEKVLANDCHELDGKRIDPKVAFPKKQQPKMVVKTKKVFIGGLSSNSTLDDIKAYFAQYGKVTKD

SEQ ID NO: 143912 - protein, 18 aa, Heterodera glycines
  Coding regions on vcDNA: vcDNA=SeqID_70335; Strand=-; Position=1-56
YREAIPEGFGLPINLDAS

SEQ ID NO: 143913 - protein, 30 aa, Heterodera glycines
  Coding regions on vcDNA: vcDNA=SeqID_70336; Strand=-; Position=1 -39,100-153
MAHYNRRAAGNALRGMQIHGTAPFPGFVPK

SEQ ID NO: 143914 - protein, 21 aa, Heterodera glycines
  Coding regions on vcDNA: vcDNA=SeqID_70337; Strand=+; Position=1-63
MRKKMFDRARQEKATVGTKFA

SEQ ID NO: 143915 - protein, 41 aa, Heterodera glycines
  Coding regions on vcDNA: vcDNA=SeqID_70338; Strand=-; Position=1-232
FLKLHYFIFLAKLIHKYFFTNCSETHQKLFTSYFRHSRCFH

SEQ ID NO: 143916 - protein, 48 aa, Heterodera glycines
  Coding regions on vcDNA: vcDNA=SeqID_70339; Strand=+; Position=1-146
AWAYHTARHAQSFKSADCVSDLLSKIFPDSKIAANYGSKQNKCAAIIT

SEQ ID NO: 143917 - protein, 117 aa, Heterodera glycines
  Coding regions on vcDNA: vcDNA=SeqID_70340; Strand=-; Position=1 -240,554-609,961-1017
MDSNQITRILTSSEITSRKFLGCFSCDQLPEPMAIRFPASLIVNLDPHQFPGSHWVAIFVNGLNKKVDYFDSLSLPINELKVSTDFWNIYLQFINNFEKKCQQTFGKIYLQFINNFE

SEQ ID NO: 143918 - protein, 33 aa, Heterodera glycines
  Coding regions on vcDNA: vcDNA=SeqID_70341; Strand=-; Position=1 -90,1216-1227
MFGKFLPCLNISKICNVLELFPGLIVSEYYIYS

SEQ ID NO: 143919 - protein, 26 aa, Heterodera glycines
  Coding regions on vcDNA: vcDNA=SeqID_70342; Strand=-; Position=1-78
MSSISQNISPEEMDKIQTLREMVKDQ

SEQ ID NO: 143920 - protein, 60 aa, Heterodera glycines
  misc_feature (42)..(42): Xaa can be any naturally occurring amino acid
  Coding regions on vcDNA: vcDNA=SeqID_70343; Strand=+; Position=1-449
PEKMPTLVVFKIFRNSDFFINYLFFAKLILQYFFRRVLKRTXFYLHVSLGTMMLFLSKRE

SEQ ID NO: 143921 - protein, 18 aa, Heterodera glycines
  Coding regions on vcDNA: vcDNA=SeqID_70344; Strand=-; Position=1-54
MRTRPIWQVKQRLLTSQK

SEQ ID NO: 143922 - protein, 53 aa, Heterodera glycines
  Coding regions on vcDNA: vcDNA=SeqID_70345; Strand=+; Position=1-174
STGYREAIPEGFGLPINLGASVRGDCRENKNKSIFSSVLKGTQTIMGSKNPTQ

SEQ ID NO: 143923 - protein, 197 aa, Heterodera glycines
  Coding regions on vcDNA: vcDNA=SeqID_70346; Strand=+; Position=1 -183,249-657
RKERNVFCEKHFPTNANAVFAVADNEPLETHPKTPTAAPGGMTPQPNGRVSPVACNIIQKGSVKAKDWDRIVKITQTPLSLRKSMGDSSKCPLRQQRSFERARTILFPCETTPQTTGKKIVTRSVTKKLDRKKEDEGQTTPTRKKTDEDRPNEKCTPPTTNVDRPTALPLSILKSDRKRSRLPTDSLCISGPRTIRI

SEQ ID NO: 143924 - protein, 202 aa, Heterodera glycines
  Coding regions on vcDNA: vcDNA=SeqID_70347; Strand=-; Position=1 -100,145-245,288-386,539-847
MEHQSFPSKKLPSELVSELIMCLPMMRLFDGIAEKNRWSSKIDPVNWKFEILRQSREKEYNKFKNRLSVINAKFNSACEVRKLNFEQDYLDSAYFPVNEQCAAVSKLCGRVIEYVVGSSNPFSVRKRISLGTMQPTDLPACLKQPARVMVRGGIHPQIRSDENEVYHLYNSNLMKKVGYISMFYHVRIGDCVWLSIDLVLYY

SEQ ID NO: 143925 - protein, 77 aa, Heterodera glycines
  Coding regions on vcDNA: vcDNA=SeqID_70348; Strand=-; Position=1 -100,258-391
MIGLATKEMPLYGRVGTYPNSYGHRSDGLFWVNDSVDFVALFPSEDGPLFTCVTLHDSEDKIEANFGPEFNFNLNTL

SEQ ID NO: 143926 - protein, 236 aa, Heterodera glycines
  Coding regions on vcDNA: vcDNA=SeqID_70349; Strand=+; Position=1 -58,154-260,502-582,681-795,882-971,1102-1185,1397-1452,1499-1618
MSSNLMGSPSCFFHPTAEQAVAAEEVDKYEVFSWHGDLSDQLAAQFLVTDQQLLKECREKLANSELRETKLLCKNGELNAENKALKAELEKQKLMTEHSQIKAKVDKMEQENQQQLDKKYVSFDVFNALVERIKRLENQQLKQNKEEDKKAEEKQQKESVGQQKLDGKYAVVDKNNVLVTSSGDQSPPAVVSAKVAKEVPNSKKQNDWDAKVCHKDIEIIGEKQLTINCKGNRFGN

SEQ ID NO: 143927 - protein, 421 aa, Heterodera glycines
  Coding regions on vcDNA: vcDNA=SeqID_70350; Strand=-; Position=1-1263
MKNHYDKHPKVTADKFKIGERVMVIFPGVNTRAAHRKLLWNQFGPYKILDISDSSAKLVPVDKPNFEPISVPIERLVKVPEGVPDISTLPRGKNPFKNQLNALLSVVCLVYREMDIETCEENGQFTQTKSVKFGNGTIKMDEFQKTENMGQLFIGQLRTIANSADGEVRVKDNADHPLVWEMQCGGLGTEHRNCVQLTAADLDPVLEKAGLGLKVIGREEKMENVEGKVGFKVIGTPMKALLSNFLLKSGAVSSVAGGQKLTQLVISAPVGFELIAYSGGREDLVKNGFFPTENDIESAFTAWVERCAVTREKLMKTGYTPIEVPMPNVVAELPESEKMGWHEMLKKANFILEKVRATIIHRKQLLVETATVIIGDSSAKQLIKLWPKSQFIGAENGTITEVIRAFDGAILSSKVKVAIVM

SEQ ID NO: 143928 - protein, 157 aa, Heterodera glycines
  misc_feature (146)..(146): Xaa can be any naturally occurring amino acid
  Coding regions on vcDNA: vcDNA=SeqID_70351; Strand=+; Position=1 -26,262-711
  Homolog annotation: Hit_ID=AAP92584.1; Match level="QueryCoverage =80%, HitCoverage=25%, E-value=1e-36, Identity=63%"; Hit description =Ab2-057 [Rattus norvegicus] gb|AAP85373.1| Aa1262 [Rattus norvegicus] gb|AAP85367.1| Aa1011 [Rattus norveg
PSSDRKRCHAWPFLVRGAICLVYSDNERDSSLLNSWLIASGHNFLEGFSVFSRTKLSNNRSVMPLDVRGCTRATLAKSACLPSPKGVGKPVKICRDWDRTLQLLSVNEEFLVGASHQLALNTSLPFVHTARRCPGLSHFEKFGDGXCSGRSVCRLEP

SEQ ID NO: 143929 - protein, 34 aa, Heterodera glycines
  Coding regions on vcDNA: vcDNA=SeqID_70352; Strand=-; Position=1-103
LSKLRTHFLIREQMDGTTQMIFDLICTNDKFYSK

SEQ ID NO: 143930 - protein, 44 aa, Heterodera glycines
  Coding regions on vcDNA: vcDNA=SeqID_70353; Strand=-; Position=1-135
QMMELLAHANVNELRKTNEVTDFTHCGQQIESQTDESETESNSQ

SEQ ID NO: 143931 - protein, 311 aa, Heterodera glycines
  Coding regions on vcDNA: vcDNA=SeqID_70354; Strand=+; Position=1 -504,648-1078
  Homolog annotation: Hit_ID=NP_611195.1; Match level="QueryCoverage =36%, HitCoverage=25%, E-value=1e-09, Identity=35%"; Hit description =CG11395-PA [Drosophila melanogaster] gb|AAF57889.1| CG11395-PA [Drosophila melanogaster] gb|AAK92913.1| G
FQSLGLNSLAFQSPRLNPPAFQSLGLNSLAFQSLGLNPPAFQSLGLNSLAFQSPGLNPPAFQSLGLNSLAFQSLGLKTPAFQSPGLNSPGLQSLGLKTPAFQSPGLSFYAFQSPGPNLTWSFGIAIIETQFCEIPITGTQFCDIPITGTQPSSISITGTQFSCISITAFQSLGLNSLAFQSLGLNSLAFQSLGPNLTWSFGIPITGTQFCDIPITGTQFCDIPITGTQLTSIPITGTQFSIIPIPGTQSHQHSNHWDTILHFSRILRHRNHRELSSPTFQSLGLNSPPFQSPRLNPSLFQTMNSMLRIHRH

SEQ ID NO: 143932 - protein, 83 aa, Heterodera glycines
  Coding regions on vcDNA: vcDNA=SeqID_70355; Strand=-; Position=1 -199,865-917
MAIPVSNAFVERAFSLCGAQWTDKRNSLEVETVKSLVQVKVNFDQKCSEMFKFLFSRPELLKKIAGEIPTRKLMILSGLTLAW

SEQ ID NO: 143933 - protein, 121 aa, Heterodera glycines
  Coding regions on vcDNA: vcDNA=SeqID_70356; Strand=-; Position=1-364
DDGIGGVGENENDHLVDEIWRRVFCTKSQNLGKLKATQSDGKEAKARKVKEEQQQPDNEVQLGKIKIEPLVKQEDRMPQTNFQKKVPKTDAQFCDDNFENPMNKLHIPVECEQQKQNNICK

SEQ ID NO: 143934 - protein, 43 aa, Heterodera glycines
  Coding regions on vcDNA: vcDNA=SeqID_70357; Strand=-; Position=1-130
MRRLPLRAVTFARSTTKELAMCAATSLKGMASFCLGMMNIGTH

SEQ ID NO: 143935 - protein, 257 aa, Heterodera glycines
  Coding regions on vcDNA: vcDNA=SeqID_70358; Strand=-; Position=1 -214,274-597,691-926
  Homolog annotation: Hit_ID=AAC57158.1; Match level="QueryCoverage =71%, HitCoverage=17%, E-value=4e-10, Identity=25%"; Hit description =ORF 73; extensive acidic domains, potential leucine zipper; immediate early protein homolog [Human herpesv
MTTPLNFDSPDSPPPHQSPLLRQPPLAPQQQQDMGRRVVVYTPSEGTPSPQQQDLRQQVLARNAQVLAENQAGLRDSPLVQQAHDLELPNEFHTPQIVVQTPAPRRQLEQQPIFRNILQLTPQRMAQLMVLRQRAEDLRDREEDEEEERVSEEQVEEEDEEEERDEEEEGEERGEEAVTDESSDTESNASEQGAGVAVAKARNRVSSSTSSESSASASPSPPPSKRAKTSTASTSAAAASKQQPPKNKRKKTAVKVL

SEQ ID NO: 143936 - protein, 154 aa, Heterodera glycines
  Coding regions on vcDNA: vcDNA=SeqID_70359; Strand=+; Position=1 -321,375-501,755-771
MPIFFTLVMEVELLQIAESADDEDEEENKNHKEKLAKILNDLTQTNDIGQMLLAAHIKIYKNELDAKKALIDEISINLNQIKAIAGIFQQKFLKIRELMSFVEAESVEIKLKKLNELAEKTQKIVKQLKIVKKLAAVLSKKTTEDSLSKGLWIV

SEQ ID NO: 143937 - protein, 90 aa, Heterodera glycines
  Coding regions on vcDNA: vcDNA=SeqID_70360; Strand=-; Position=1-713
IIFIQKIFFWVFGAVPLNRCAQIYGETESFRNSFPIACTLILRWIFAPHNCLSTPNGHLKKSIFLFSGQSPRTDAPRFMGRPNPSGIASL

SEQ ID NO: 143938 - protein, 282 aa, Heterodera glycines
  Coding regions on vcDNA: vcDNA=SeqID_70361; Strand=-; Position=1-847
  Homolog annotation: Hit_ID=NP_702063.1; Match level="QueryCoverage =96%, HitCoverage=5%, E-value=2e-20, Identity=21%"; Hit description =hypothetical protein PF14_0175 [Plasmodium falciparum 3D7] gb|AAN36787.1| hypothetical protein [Plasmodium
IPITGTQSTNIPTAFQSLGLNPPTFQSTGLNPPAFQSLGLNPPAFQSLGLNPPTFQSTGLNPPAFQSVGLNPPTFQLTGLNPPAFQSLGLNPPTFQSTGLNPPTFQSLGLNPLTFQQHSNHWDSIHQHSNSISISGTQSTNIPINGTQSTSISINGTQSTSIPINGTQSTSISISGTQSTNIPINGTQSTSISITGTQSTNIPINRTQSTNIPTAFQSVGLNPPTFQSPGLNPPTFQQHSNHWDSIHQHSNQQDSTLLHYITGTQFFCISITVTQSTNIPIT

SEQ ID NO: 143939 - protein, 55 aa, Heterodera glycines
  Coding regions on vcDNA: vcDNA=SeqID_70362; Strand=+; Position=1-167
MFTEVLGQIGFRLSLVFGGSVLSQILGQMAYGIASASEVAFFSYIYARVEKSQYR

SEQ ID NO: 143940 - protein, 24 aa, Heterodera glycines
  Coding regions on vcDNA: vcDNA=SeqID_70363; Strand=+; Position=1 -52,295-317
MEKACKIWRDYIDFSALELLELAS

SEQ ID NO: 143941 - protein, 41 aa, Heterodera glycines
  Coding regions on vcDNA: vcDNA=SeqID_70364; Strand=-; Position=1-122
GDSIHTPATFQVIFHRIGHTKVKRRPSTEKSFDQTDQIRYP

SEQ ID NO: 143942 - protein, 80 aa, Heterodera glycines
  Coding regions on vcDNA: vcDNA=SeqID_70365; Strand=+; Position=1 -132,398-508
MSHEKISLIYLHACALRLTTELGILINELEEIGTEWTSADAIDEAPKPRKALFFLDLVFPAFLSGIHKIQVQIFQNAQLY

SEQ ID NO: 143943 - protein, 237 aa, Heterodera glycines
  Coding regions on vcDNA: vcDNA=SeqID_70366; Strand=+; Position=1 -256,711-1168
RVHGLSRRRSRISNTTNVVVKGEFSSGGGSTTAAAAGALKLSEKTTLVGGKSPLPQPPSFAAAQWAKQCCVNVNLDILAQRSRNEPINSSNTSASAINAGSSSTNFYTNKFCSTVADVARLVNQMHEQQLRNQRKAAEEEEEERRRKNGIGKAEQKHQQKQGRRRSTVMEACDDEEKNEEKKVDKKKDGHKICGHNDGMPILEKQQQQQLLEERQQLPQQQQQSIDDNKNITSNIVN

SEQ ID NO: 143944 - protein, 99 aa, Heterodera glycines
  Coding regions on vcDNA: vcDNA=SeqID_70367; Strand=-; Position=1 -83,124-244,297-389
  Homolog annotation: Hit_ID=NP_510427.1; Match level="QueryCoverage =87%, HitCoverage=11%, E-value=1e-09, Identity=40%"; Hit description =putative protein of eukaryotic origin (XP188) [Caenorhabditis elegans] emb|CAB01868.2| Hypothetical prote
YVDDIRVTVRLVSPAFTCNSQPKTASSQSKSYSFADRVIETLSLYVQSVEIFFESDSGTDFDFGGSISLYSLALESISPNWSEEKDVDTNLTRQSVPRR

SEQ ID NO: 143945 - protein, 83 aa, Heterodera glycines
  Coding regions on vcDNA: vcDNA=SeqID_70368; Strand=-; Position=1 -83,136-285,348-403
  Homolog annotation: Hit_ID=NP_510427.1; Match level="QueryCoverage =100%, HitCoverage=11%, E-value=5e-21, Identity=55%"; Hit description= putative protein of eukaryotic origin (XP188) [Caenorhabditis elegans] emb|CAB01868.2| Hypothetical prot
MTSILKNQIIKHLSAFARNLKPEQITMELLRGKGQLRDLELNEEVLAEKLELPPWLKIVSARCDRVSIKIPSWNKLRSAPIQL

SEQ ID NO: 143946 - protein, 78 aa, Heterodera glycines
  Coding regions on vcDNA: vcDNA=SeqID_70369; Strand=-; Position=1-468
PKNSYLFFLIFLPQTWYQQLPSFVWPYQTILRYLKRKQKKFLTKKWLSLFSHFFTANLVPTVAFSCLALSNNLTIFET

SEQ ID NO: 143947 - protein, 23 aa, Heterodera glycines
  Coding regions on vcDNA: vcDNA=SeqID_70370; Strand=-; Position=1-70
RKIGTNSCLLLSGPIKQSYDIET

SEQ ID NO: 143948 - protein, 69 aa, Heterodera glycines
  Coding regions on vcDNA: vcDNA=SeqID_70371; Strand=+; Position=1-207
MSPAEPFLESGESDLFAMAVKFQTDNGQPIELKAVYQVALSLFDGLFPTIPRTLTHRRKPFRRKGKADR

SEQ ID NO: 143949 - protein, 146 aa, Heterodera glycines
  Coding regions on vcDNA: vcDNA=SeqID_70372; Strand=+; Position=1 -319,595-716
MKNPFNMPKPIIANPNDVPKQKNAKKKASKNDGGQKKEKLVVSRPSSPNGVPIEFELEINEYTNGQLINKNTISGQWDKRNEKIIDEMLKNKKVGVTQLGPIQSKADILPLKPGQFETESHFFSDNHANSQQSTVASTSKNQVRNF

SEQ ID NO: 143950 - protein, 168 aa, Heterodera glycines
  Coding regions on vcDNA: vcDNA=SeqID_70373; Strand=+; Position=1 -92,165-350,415-643
MASQIPKILPTLLFIAAAFLLNFGCCQQNESQTTETLRARNASSSTETLPLNITTTKKETTVATPSTTEAGTEAATTDDTNDEQSLLFWILIGVIVAIVLFLVLLVCIVCCMRGGSQKDARETVNGKSGGAVTKLTMNGDNADSTCASQSASVPDEGWFAPESLRVIL

SEQ ID NO: 143951 - protein, 247 aa, Heterodera glycines
  Coding regions on vcDNA: vcDNA=SeqID_70374; Strand=+; Position=1-741
  Homolog annotation: Hit_ID=XP_345024.1; Match level="QueryCoverage =92%, HitCoverage=88%, E-value=1e-29, Identity=28%"; Hit description =similar to SPAC23A1.17 [Rattus norvegicus]
ISITGDSNHQPLKGSGLNPTAFQSLGLNPPAFQSLGLNPPAFQSLGLNPPAFQSLGLNPPAFQSLGLNPPAFQSLGLNPPAFQSLGLNPPAFQSLGLNPPAFQSLGLNPPAFQSLGLKPPAFQSLGLNPPAFQSLGLNPPAFQSLGLNPTAFQSLGLNPPAFQSLGLNPPAFQSLGLNPPAFQSLGLNPPAFQSLGLNPTAFQSLGLKPPAFQSLGLNPPAFQSLGLNPPTFQSLGLKPPAFQSLGL

SEQ ID NO: 143952 - protein, 79 aa, Heterodera glycines
  Coding regions on vcDNA: vcDNA=SeqID_70375; Strand=+; Position=1-240
MCSSSNGVATEAEVPLGFVSFKMTLFKESESDTAALRKRREDASTPRPRNTEEETDDWEECEGEADNEAKAADKANDGQ

SEQ ID NO: 143953 - protein, 66 aa, Heterodera glycines
  Coding regions on vcDNA: vcDNA=SeqID_70376; Strand=-; Position=1 -100,156-361
LGPLVTSESSTLLGSLSPKERIPLHQTKFAIEIGDKVKCLSYSEVRNTYKEELLQYFEERAKIDEE

SEQ ID NO: 143954 - protein, 21 aa, Heterodera glycines
  Coding regions on vcDNA: vcDNA=SeqID_70377; Strand=-; Position=1-64
MRFGISAMKPMFQSDETKPKY

SEQ ID NO: 143955 - protein, 47 aa, Heterodera glycines
  Coding regions on vcDNA: vcDNA=SeqID_70378; Strand=+; Position=1-239
QDSNVPLRPKFFSISGKKSKFFRKKYQSIELEKLCFGSGLRFSEKNR

SEQ ID NO: 143956 - protein, 44 aa, Heterodera glycines
  Coding regions on vcDNA: vcDNA=SeqID_70379; Strand=-; Position=1-136
SQFFDLLDWAELVKSAPPESANTVASRAALLVNAMYEQHGVFYV

SEQ ID NO: 143957 - protein, 216 aa, Heterodera glycines
  misc_feature (5)..(5): Xaa can be any naturally occurring amino acid
  Coding regions on vcDNA: vcDNA=SeqID_70380; Strand=+; Position=1 -147,217-329,526-666,815-887,961-1063,2787-2820
  Homolog annotation: Hit_ID=CAE65090.1; Match level="QueryCoverage =72%, HitCoverage=29%, E-value=2e-40, Identity=47%"; Hit description =Hypothetical protein CBG09949 [Caenorhabditis briggsae]
RAFNXQSVDKKSFKSFIIGNIEFLSTSLQFYLIAFQTKGQAQQADQSKLFCYDFDDKCRLFCYDFDDKCRWRNMEGFLMDDFDWYQGAGFLDENRLSMSNINFELSDGFYGITATDKIELSGAKGILVSDVIQCQTGNAELRFITPVENNDPGPAYIILPDLGGDPLQIFIIFIQAHNFVFNSAALQGGFAIIDNLEYYGEFCDNEGKKKIDKINK

SEQ ID NO: 143958 - protein, 52 aa, Heterodera glycines
  Coding regions on vcDNA: vcDNA=SeqID_70381; Strand=+; Position=1 -18,141-177,479-582
MQGYSPKRVLNRTKFLLQERVLKRTKFYLHVSLGTLMLFLSKREMNKIFKNF

SEQ ID NO: 143959 - protein, 21 aa, Heterodera glycines
  Coding regions on vcDNA: vcDNA=SeqID_70382; Strand=+; Position=1-65
MAVSFFSWGFDRKLGTNICLL

SEQ ID NO: 143960 - protein, 19 aa, Heterodera glycines
  Coding regions on vcDNA: vcDNA=SeqID_70383; Strand=+; Position=1-59
TFAFSSLALPNTHTIFEML

SEQ ID NO: 143961 - protein, 19 aa, Heterodera glycines
  Coding regions on vcDNA: vcDNA=SeqID_70384; Strand=+; Position=1-59
TFSFSSLALPNTHTIFEML

SEQ ID NO: 143962 - protein, 19 aa, Heterodera glycines
  Coding regions on vcDNA: vcDNA=SeqID_70385; Strand=+; Position=1-59
TFAFSSLALPNTHTIFEML

SEQ ID NO: 143963 - protein, 182 aa, Heterodera glycines
  misc_feature (2)..(2): Xaa can be any naturally occurring amino acid
  misc_feature (4)..(4): Xaa can be any naturally occurring amino acid
  Coding regions on vcDNA: vcDNA=SeqID_70386; Strand=+; Position=1 -102,155-218,285-463,782-935
  Homolog annotation: Hit_ID=CAE61530.1; Match level="QueryCoverage =97%, HitCoverage=24%, E-value=3e-32, Identity=39%"; Hit description =Hypothetical protein CBG05433 [Caenorhabditis briggsae]
FXIXKTCNINHASLPEMKPFKIKNKDGLSNDYTDFWVDYEPIRHCFWVDYEPIRHCTSDRPICESRFLFCDRSVFLFCDRSVWRCRSRIVLGGNCTGFAGTEICYGSVCIQARPKVNLAFDRIKFSAESLAHHEVVWAKSWLLEEGARPTSSGIAHVVVREEGAARERSAFVPRHTQYPELP

SEQ ID NO: 143964 - protein, 49 aa, Heterodera glycines
  Coding regions on vcDNA: vcDNA=SeqID_70387; Strand=+; Position=1 -25,258-382
MENKMAKNKLSLLDYRIDNSIRLYDEIKSFKNRQTSKQRRTDRSAIKFN

SEQ ID NO: 143965 - protein, 106 aa, Heterodera glycines
  Coding regions on vcDNA: vcDNA=SeqID_70388; Strand=-; Position=1-647
IIFIQKIFFWVFGAVPLNRCAQIYGETESFGNSFPIACTLILRWIFAPHNCLSTPNGHLKKSIFLFSGQSPRTDAPRFMGRPNPSGIAYYSLYFNSALDFSSGIIV

SEQ ID NO: 143966 - protein, 195 aa, Heterodera glycines
  Coding regions on vcDNA: vcDNA=SeqID_70389; Strand=-; Position=1 -35,522-813,883-1143
MAKLMKMVKRINLKKLSVFSAAKALDTALLGIEIAFCPFANVWHNAQGKHEGMANFVVQKFASLAFAILEIKKPAKDLIKETIKAIRKRFEESDKKHLTMAIEVVDQIENIISKILIFPRPENLQNSEMLVNLDFYINYFSQIMLICSPSAVAALTDSAPMFKKLHDKIQFFSFSLVTQFKGIAEKLRNGEKRGN

SEQ ID NO: 143967 - protein, 70 aa, Heterodera glycines
  Coding regions on vcDNA: vcDNA=SeqID_70390; Strand=+; Position=1-215
NAKTKPKDKTGNLDEKKEAKGRQREKQQKEGKADHRNAQFHEAQTVRGALLCVFKSKRQNENNGKDPEGK

SEQ ID NO: 143968 - protein, 58 aa, Heterodera glycines
  Coding regions on vcDNA: vcDNA=SeqID_70391; Strand=+; Position=1 -79,1082-1179
MSAFFAIFSPAFIFAIVATVVLGLITDDSGGAEKRVEESEEEKKVRRRTVTTYSRVQY

SEQ ID NO: 143969 - protein, 75 aa, Heterodera glycines
  Coding regions on vcDNA: vcDNA=SeqID_70392; Strand=+; Position=1 -38,151-295,638-682
  Homolog annotation: Hit_ID=S42886; Match level="QueryCoverage=73%, HitCoverage=53%, E-value=6e-11, Identity=54%"; Hit description =collagen - silkworm emb|CAA83002.1| Collagen [Bombyx mori]
MYIFAKVSQALKMVPPAVPGEAGEPGRPGNEGLPGAQGAPGAPGSAGSPGQPGESGQPGHQEFLKMNLPKKNFLI

SEQ ID NO: 143970 - protein, 129 aa, Heterodera glycines
  Coding regions on vcDNA: vcDNA=SeqID_70393; Strand=-; Position=1 -102,172-276,453-635
  Homolog annotation: Hit_ID=CAE59646.1; Match level="QueryCoverage =73%, HitCoverage=10%, E-value=3e-15, Identity=48%"; Hit description =Hypothetical protein CBG03060 [Caenorhabditis briggsae]
MERLGIRLNSVREFAFDLEHTLPNHKTQQTCLLQISTRREDFIIDILNPQVRNRMHLLKKAFENEGIMKVAHGQNDVHWMKRDFGILTVPLLDTFTVGLANGNNSIKKSIAPTFILNAIVLLQSNMSMV

SEQ ID NO: 143971 - protein, 232 aa, Heterodera glycines
  Coding regions on vcDNA: vcDNA=SeqID_70394; Strand=+; Position=1 -38,318-537,595-1033
MSILWNVSKKSRIKIKQFQNSDFPLANGSDGKDSSQFVAGCESSSVKQTVTEDCYIGTAYTEQELATLCHEHCLRAPPNGTIEGLKRVHLVCSYNSRPWLCPCLAEWVADTGALYMRGEHNEHPTEAKPTGEEEEKEKAENNENGKEEKERHRRGEGERKKWGKRTLKKERSSSREDEEQTEGQCTEERARGRREKNKRQNYGVKKERVKKERNEGTADNEQMGQHNDQQRN

SEQ ID NO: 143972 - protein, 81 aa, Heterodera glycines
  Coding regions on vcDNA: vcDNA=SeqID_70395; Strand=+; Position=1 -34,365-447,536-664
MDLLQLPSISDDELDYDLDVPADGVNATLKTQRASNNNEAGRLCLVSSVFQNSHKFVLISMVIRRFFNFISKPFRTMMARH

SEQ ID NO: 143973 - protein, 88 aa, Heterodera glycines; identical to SEQ ID NO: 124691
  Coding regions on vcDNA: vcDNA=SeqID_70396; Strand=-; Position=1 -96,135-305

SEQ ID NO: 143974 - protein, 93 aa, Heterodera glycines
  Coding regions on vcDNA: vcDNA=SeqID_70397; Strand=-; Position=1-853
VPPKRTLEKIDFFVFGAVPPNRCAQIYGETESFRNSFPIACTLILRWIFAPHNCLSTPNGHLKKSIFLFSGQSPRTDAPRFMGRPNPSGIASL

SEQ ID NO: 143975 - protein, 104 aa, Heterodera glycines
  Coding regions on vcDNA: vcDNA=SeqID_70398; Strand=+; Position=1 -81,335-568
MISSSYFEECNGTECLYALFSKPKLQNEDDLPYKIMEDKTFCQKASEKLKKVIKIKSENENAREMFDKVMKEMSEKAKKMYKEQKYIGTTYFTKFIWNSPFLQG

SEQ ID NO: 143976 - protein, 69 aa, Heterodera glycines
  Coding regions on vcDNA: vcDNA=SeqID_70399; Strand=-; Position=1 -111,288-386
  Homolog annotation: Hit_ID=CAG08282.1; Match level="QueryCoverage =97%, HitCoverage=5%, E-value=1e-15, Identity=62%"; Hit description =unnamed protein product [Tetraodon nigroviridis]
MTVIVFLIDTSASMMQKQYLGTTLLDFARLTVEQFLKQRQRDPASSGDRYMLMTFEEYPCNIKVICCHF

SEQ ID NO: 143977 - protein, 64 aa, Heterodera glycines
  Coding regions on vcDNA: vcDNA=SeqID_70400; Strand=-; Position=1 -39,92-247
MPSLIFYSLPFLMLANLAIFFGQALFRFIPHILFVFVSIFIVGMVNGACCNFFGKIHQQVKLSL

SEQ ID NO: 143978 - protein, 63 aa, Heterodera glycines
  Coding regions on vcDNA: vcDNA=SeqID_70401; Strand=-; Position=1 -18,187-324,411-446
MSDDKKSPKFYATVLDDIGSYLVRAVPLYIKKIADEPSPPADNENDTITRKRRFRRACCLMYL

SEQ ID NO: 143979 - protein, 79 aa, Heterodera glycines
  Coding regions on vcDNA: vcDNA=SeqID_70402; Strand=+; Position=1-240
MPIAPFELMNEVTNEKLTLIKGGAFRWLLKRCPIVGETAAVVQKQQKKDEKLDRLNGVYFCLYDAIFSTPGHIDQRKKK

SEQ ID NO: 143980 - protein, 225 aa, Heterodera glycines
  Coding regions on vcDNA: vcDNA=SeqID_70403; Strand=-; Position=1 -323,377-666,726-792
IWDVLAREIWPIFAKSIRHLGFRNSDALNNLRSRTSPTILTDLDQLVSIDSGALLPDGIADDGPNATAGQALAKWLHTPTKNGQPKQLHRNNYFGPPKLEWVNNFKETFRRATTSVSYTIQLYIIVEPMPIEPFELVNERTNEKLTLTKEIDEFDVNVCNWLLQRCPIGETATVPAIKWEESVNPSANLNNVTFDLWSFDKSIGPLSPPAEEKEEEADQSNENVV

SEQ ID NO: 143981 - protein, 287 aa, Heterodera glycines
  Coding regions on vcDNA: vcDNA=SeqID_70404; Strand=-; Position=1 -174,315-744,1112-1371
DVWMDILPSFNYAKLGLKMALLSDRFDVLVDKHFDGKSELTIWRRIRIRKDKGPKAKLYVDHSVLAFLRSNKQIWDRSGIKLDLFLPLYMTDVKLIWDVFTREIWPLFAKSIRHLSFHADNLENLRRRISPTLLTDLDQLYSIDSGALFPDGIADDGPNATAGQALSKWLHTPSKNGQPKQLHRNNYFGPPKLEWVNNFKETFLRATTSVAYNVRLELLVASQMNIVEPFELVNEMTQEKLTLTKDEEIWLLKRCPIVGETATVQWEKDENLDNLNGVIFHLYHDCI

SEQ ID NO: 143982 - protein, 78 aa, Heterodera glycines
  Coding regions on vcDNA: vcDNA=SeqID_70405; Strand=-; Position=1-237
MSFAKLLAESSSDDAEETSHSKSAVKAEPDESDDEIDTEYHKPSEVANKQSKKKAMADLLSKRRNKIQGNWRERRVGG

SEQ ID NO: 143983 - protein, 25 aa, Heterodera glycines
  Coding regions on vcDNA: vcDNA=SeqID_70406; Strand=-; Position=1-75
TCTCGVVVKLSTFHNFSPGFNSPLG

SEQ ID NO: 143984 - protein, 139 aa, Heterodera glycines
  Coding regions on vcDNA: vcDNA=SeqID_70407; Strand=+; Position=1 -93,127-453
MDRLDTVIASLLNCPARNLCDCLNHPDEIQKTTYKNQLDEYKDFEYGGITRESARKQMAYNGFKNVTVDQHFYVRHRICLRYSSNPCVIEKHKNGNERFYPLELVKVKDNDIIYLGQNFPKPLIRDDNMFIDDQQYLNW

SEQ ID NO: 143985 - protein, 112 aa, Heterodera glycines
  Coding regions on vcDNA: vcDNA=SeqID_70408; Strand=-; Position=1-422
KTLQTTYKNQLDEYKDFEYGGITRESARKQMAYNGFKNVTVDQHFYVRHRICLRYSSNPCVIEKHKNGNERFYPLELVKVKDNDIIYLGQNFPKPLIRDDNMFIDDQQYLNW

SEQ ID NO: 143986 - protein, 272 aa, Heterodera glycines
  Coding regions on vcDNA: vcDNA=SeqID_70409; Strand=+; Position=1-819
  Homolog annotation: Hit_ID=CAA82797.1; Match level="QueryCoverage =78%, HitCoverage=33%, E-value=4e-11, Identity=26%"; Hit description =gag protein [Ascaris lumbricoides]
MSGPIRMRINPSLRKLTERLVEIRPVIDAQQRDPEGIDLLRNSLVKIKRSVTFIDERIEQWRTYMTEIEVDERAAEEALFVNMNANQRHVTEWLEDAREAIDEIEIILVNEADDGSDTLSVELGAQGNQQRINQNENERNEQRIVNRERVEAPPVYYPKLPWPNFYGDTMSWPVFWQAFQANMGDKPIPEAQKCTYLLLSLKGKAARAMRGYQPTAENYNLVINALKRLYGNEKVIKEALQNELLNLPQANEAAISLRICLEDVAQECASIK

SEQ ID NO: 143987 - protein, 131 aa, Heterodera glycines
  Coding regions on vcDNA: vcDNA=SeqID_70410; Strand=+; Position=1 -39,152-288,721-940
MLSFRRVPKLFALEVTWPTISRAYAKNKIGTTAIVEGEAEYKKVAQRVKEKLDIIGQQKYFHTVIVFPNWSNAFQLAILAKQSHYFFLDGENEIKENKINVIVVRCETDRFGRAIQAGQWFTQTVENQMKT

SEQ ID NO: 143988 - protein, 182 aa, Heterodera glycines
  Coding regions on vcDNA: vcDNA=SeqID_70411; Strand=-; Position=1 -158,211-299,376-504,686-769,831-919
  Homolog annotation: Hit_ID=NP_509581.2; Match level="QueryCoverage =90%, HitCoverage=7%, E-value=3e-24, Identity=34%"; Hit description =Filamin/ABP280 repeat family member (XK45) [Caenorhabditis elegans] gb|AAN60532.1| Hypothetical protein C2
ACRDARRGRRTVGRCRAGGTPIIELNSLGNSKHQLLFTPPRAAKYKLYLYCSELVVPSAYPLLAIAEKNGQTAAEERDELSKVVLRGEGLTTARVKESAEFIIDASEMHEQVGKINAALLGERADGIYTPLMGGTYQLIVQIDSKNVPGSPSTVQVHYHQLPAELISVDAKPLKFGVINEDI

SEQ ID NO: 143989 - protein, 69 aa, Heterodera glycines
  Coding regions on vcDNA: vcDNA=SeqID_70412; Strand=-; Position=1 -56,382-468,783-849
MVFPVLFLFGCIFLVAFPIICLCPVLSVTSIFGVCTFLSKYVAFVSLIKLFLFLVCVIRKSNTEARRCR

SEQ ID NO: 143990 - protein, 38 aa, Heterodera glycines
  Coding regions on vcDNA: vcDNA=SeqID_70413; Strand=-; Position=1-117
EISQILPRPFGVCDDVDIPPLPKPLKHRNNGAHCKRQH

SEQ ID NO: 143991 - protein, 78 aa, Heterodera glycines
  Coding regions on vcDNA: vcDNA=SeqID_70414; Strand=-; Position=1 -75,244-405
MNRKADTKNHKYYVNSETFNQINRQFYLAFKDVHPSWSLIGCALIFGIIAVIGIIFNSSVIGVTFLTKCVISVDKFLE

SEQ ID NO: 143992 - protein, 33 aa, Heterodera glycines
  Coding regions on vcDNA: vcDNA=SeqID_70415; Strand=+; Position=1-102
RLIEPVKSFRMISRLFDSVNNFKSYIDSKLAQT

SEQ ID NO: 143993 - protein, 76 aa, Heterodera glycines
  Coding regions on vcDNA: vcDNA=SeqID_70416; Strand=+; Position=1 -102,255-383
MICSSFLLLVDTVADGESAKIVRHGCASKSLQKAIFSQLKKHLLSFLLKMSSLDERVQHSDALFVTFGLNQLNQQQ

SEQ ID NO: 143994 - protein, 231 aa, Heterodera glycines
  Coding regions on vcDNA: vcDNA=SeqID_70417; Strand=+; Position=1 -79,358-593,636-861,1866-2018
  Homolog annotation: Hit_ID=E87921; Match level="QueryCoverage=65%, HitCoverage=62%, E-value=3e-13, Identity=31%"; Hit description =protein F56G4.5 [imported] - Caenorhabditis elegans
MTMPSNRRFPPMQTLGCCLSVTFLQIGSCQQYAVRAMPTFVILLNGQEMGRVQGADPAGLEHLIASLANSPDIGKGSTTKKTLEAHVANSEERRWLERLVSQSQRMSIYEDEVSQTLALSLIPAEELREKATTNGEVNQYDLAKGLLGWFHGFFSWVNHPKCEKCGVEGKPGDRGVPIYLLVTPLNFFCYINNQIGKHFKKPKGMEIEENGKATSSEDSNMKWKTEEDNLS

SEQ ID NO: 143995 - protein, 120 aa, Heterodera glycines
  Coding regions on vcDNA: vcDNA=SeqID_70418; Strand=+; Position=1 -105,156-355,406-463
MGMNALLNAAGISGGQAFPNIGTFPVHQHQFDLQSLAAAAQPHHHQQQQQLSSALNLQALVGAGAVHQPPTPITSAAAPNNIPGISQELLFQATLLAAANLNNPGLITSNTTPQQQQRPK

SEQ ID NO: 143996 - protein, 37 aa, Heterodera glycines
  Coding regions on vcDNA: vcDNA=SeqID_70419; Strand=-; Position=1 -85,147-175
MPNNTLMGSKSYIYGFLNKRPAYVMADSGVLFLNFSV

SEQ ID NO: 143997 - protein, 236 aa, Heterodera glycines
  Coding regions on vcDNA: vcDNA=SeqID_70420; Strand=-; Position=1 -445,494-759
YIDHSVIAVLRSNHKMFDKSGTKLRMGMLYSDMADDRQPIWDVFVREIWPIFASNIRHLDFIDADHLDNLRRRTSPTILTDLNQLSSIDSVLLLPDAIGDNFDGPNATAGQALSKWLHSPRKYGQPKRFRFIDINEHVSLHLINNLKEEFMRATTISSVSYEIHFSVHVPTKPMVPFELVNERTQEKLTLAKSNELDNIWIMKRCKIGEAAAVQQQKKDENWNYVYFWLYSGTNCI

SEQ ID NO: 143998 - protein, 103 aa, Heterodera glycines
  Coding regions on vcDNA: vcDNA=SeqID_70421; Strand=-; Position=1-788
IIFIQKIFFWVFGAVPLNRCAQIYGETESFRNSFTIACTLILRWIFAPHNCLSTPNGHLKKSIYFCFRGSPPEPMRPDLWGDRILPDSFPIACTLILRWILLP

SEQ ID NO: 143999 - protein, 36 aa, Heterodera glycines
  Coding regions on vcDNA: vcDNA=SeqID_70422; Strand=-; Position=1-156
KPKLFGLFKKELKIFKNFIHLPFDRKSIREPYLTFN

SEQ ID NO: 144000 - protein, 50 aa, Heterodera glycines
  Coding regions on vcDNA: vcDNA=SeqID_70423; Strand=-; Position=1 -20,373-442,477-539
MTAQWERNKVTTPSNVRNANIWVTNQRIFANIGKMIFWRYEILVAYFCTD

SEQ ID NO: 144001 - protein, 44 aa, Heterodera glycines
  Coding regions on vcDNA: vcDNA=SeqID_70424; Strand=+; Position=1-132
MHLSIRLPDNRTVDNWTVDNRTVGQSDSEDNRTEVDNRTEDNPT

SEQ ID NO: 144002 - protein, 52 aa, Heterodera glycines
  Coding regions on vcDNA: vcDNA=SeqID_70425; Strand=-; Position=1 -38,808-928
MSLGFIIKALARNRSKRRFSMSSSSSSPSRRPVSTPELCQEKYVKRYTIQEF

SEQ ID NO: 144003 - protein, 16 aa, Heterodera glycines
  Coding regions on vcDNA: vcDNA=SeqID_70426; Strand=+; Position=1 -3,350-397
MCFIVQLMWGHAKLNK

SEQ ID NO: 144004 - protein, 296 aa, Heterodera glycines
  Coding regions on vcDNA: vcDNA=SeqID_70427; Strand=+; Position=1 -65,335-619,1132-1672
  Homolog annotation: Hit_ID=AAL78214.1; Match level="QueryCoverage =49%, HitCoverage=75%, E-value=9e-16, Identity=31%"; Hit description =putative esophageal gland cell protein Hgg-20 [Heterodera glycines]
MSDKPSAEDGEHEQQKKMKWEIPICADDWLAVFALLPPRQLGLEIALLSPRFDRMVDEHFKTRRWALKYFRIKSKIGENGTKEMRIKNFNRKVAPIVPIPRIPLPDKVVDFSGISIRYIDNDVITFLQRFQRLFASCAINLSIKTKSGRNLKSIERFIWPMIRQNICGIIFCKAKDFRRLRKNAPSILRHIFRIDDDKSPRKIPLQSVYFDKGELPKLPTAVESAHDNGNANAKVPLNESEALTKWLFSSRPENDLPPKVLRCRVYNSDIESWIARIEQYKTVMVNFGFKFVLFVV

SEQ ID NO: 144005 - protein, 105 aa, Heterodera glycines
  Coding regions on vcDNA: vcDNA=SeqID_70428; Strand=-; Position=1-440
NLYVSKNRNYAKKASQTILALPIPSTIAFIHPIMSAKIIRVPKIACDLSLAKNGVSKNRNYAQKASQTILALPIPSPIAFIHPIMSAKIIRVPKIACDLSLEKMV

SEQ ID NO: 144006 - protein, 46 aa, Heterodera glycines
  Coding regions on vcDNA: vcDNA=SeqID_70429; Strand=-; Position=1-138
MEKIYYLSVLFIFCFAFSAFSVISLFITAEALPYLKSSGFEADLYQ

SEQ ID NO: 144007 - protein, 77 aa, Heterodera glycines
  Coding regions on vcDNA: vcDNA=SeqID_70430; Strand=-; Position=1-235
TLNSPTNRLLAFNAALEIAHQSSYFTFLFLSLTGQTFIDYKLAVKIGTLSIIGYNGVFPAMLCTAIDRLFCVIFPYL

SEQ ID NO: 144008 - protein, 295 aa, Heterodera glycines
  Coding regions on vcDNA: vcDNA=SeqID_70431; Strand=-; Position=1 -806,983-1066
RDELRNEKETLSNLQTQRKKSDERQSQTDDEPKQRMTEQQIAEMVEQNVQLKTELNEREEELYRLRNDKVLAEITTSEGHSKVSQSGKTTEKNGGKGRGRGQTRHMEGTMPSEIIQSLLPAKFTLILTQTQRPPSDTDSATSNNDWERMGKEEIEVEGVSSSAGSEEKETAMANRRKKSSELSDFSTQTDEVSFSIRKTRIVKKIFLGMFKTQFGEDKSEERLNLLEEELDKANSKCEGMATELANANLRIGDAFKIKEQLEAEADLIGPRENGEVARRFAKTPRTLAHYGGAFL

SEQ ID NO: 144009 - protein, 830 aa, Heterodera glycines
  Coding regions on vcDNA: vcDNA=SeqID_70432; Strand=-; Position=1-2490
  Homolog annotation: Hit_ID=XP_479365.1; Match level="QueryCoverage =19%, HitCoverage=10%, E-value=2e-11, Identity=28%"; Hit description =helicase-like protein [Oryza sativa (japonica cultivar-group)] dbj|BAD32013.1| helicase-like protein [Ory
MPSKDRELKRRKQEEHLRRTEQSVIPGRSPIPNCPPQGNSNCPILDNPLSADGNGAASPRGFNTPNLSALQLSTPASSIGSKRRGRPPKTGAESITASQNSVSSIDTQITPATQNIGTSPCSKKGKVAEVNRPKFATEAIASTPVSTQKSRGRPSKRSGGPGRSKTDASISEGSSMDQSSEAGTNVAVLPNVAEKIDFNTVQINFATTRNFSCKIWKWAAIGLYERDGETPLAPRSGPRYIETCWNDLTQFLNDGFAATYLAYLATISQRKVVVVDPMVWSNGLDRVMPYKNMTFGYDPNVPAEVILLPVHFPGHWTLIVHDVQFGTHFADSLPTTYGRLDPQLTNKIKNIISDILPSTVLTGIFNAVNLTAQHDGNSCGYFVCLYAESWLMNNRTFVLPDLSINYEKRRILWHINELYGTDNVPYHPREGVPTPCPIVYRHADEVQSTSKAAELMEVDEHDDIMIIEPQTSGQAVDAILTQAQVAGENQADTLGLVSESCIPQEPIAQADDVIFIRPKTPPRRSMRVQKRHSASVSRSPSPAPKRPPPANSLGVATPITRRCSAFHKGWQCAAAAAKHFPEYCDSGKLGDKKCADCAAHLFSHEDSSICCRKGRVVLPMLNPHPDELKQLIVGNKQSREGKEFVRHMSRYNNLLQFASVSAGNKPSPAGGPMAVILNGEFHRRISSMQAGTTQIPGFGQLYILDPVEAMEQRRNNPRFTGEKITNEDEFVQGHQLNEQTLEILEQMIQLHHPAAQAYKQAREQLTELLQQQTPEELRFFRMTLLNERRAPAGLKDPKLHPHQIITPSTGEGMFAIHADPTGAPPPKGIW

SEQ ID NO: 144010 - protein, 151 aa, Heterodera glycines
  Coding regions on vcDNA: vcDNA=SeqID_70433; Strand=-; Position=1-456
MGLWSTTTCPLWDCGQQRPAPYGIVVNNDLPLMGLWSTTTCPLWDCGQQRPAPYGIVVNNDLPLMGLWSKRPAPYGIVVNNDLPLMGLWLITTCPLWDCGQQGPARYGIVVNKDLPVMGLWSTTTCLLWDCGQQRPAPYGIVVNKDLPLMG

SEQ ID NO: 144011 - protein, 80 aa, Heterodera glycines; identical to SEQ ID NO: 142591
  Coding regions on vcDNA: vcDNA=SeqID_70434; Strand=-; Position=1-323

SEQ ID NO: 144012 - protein, 22 aa, Heterodera glycines
  Coding regions on vcDNA: vcDNA=SeqID_70435; Strand=+; Position=1-66
MLFGLKHLIDDDDCGRGGSKRC

SEQ ID NO: 144013 - protein, 41 aa, Heterodera glycines
  Coding regions on vcDNA: vcDNA=SeqID_70436; Strand=+; Position=1-382
IFYRFLNVWIFFGLPKLHRTWFFLFSFKSPPNFFYSLTRPY

SEQ ID NO: 144014 - protein, 37 aa, Heterodera glycines; identical to SEQ ID NO: 132994
  Coding regions on vcDNA: vcDNA=SeqID_70437; Strand=+; Position=1-285

SEQ ID NO: 144015 - protein, 97 aa, Heterodera glycines
  Coding regions on vcDNA: vcDNA=SeqID_70438; Strand=+; Position=1 -209,758-842
MPIEPFELVNEVTNEKLTLTKDGTGEFNWLLERCPIIGETAAVQKQQQKKDENSDANLNKVFFRLYDDIGVTKLVLGLGFKVSGFYRGKKRTNTKHS

SEQ ID NO: 144016 - protein, 114 aa, Heterodera glycines
  Coding regions on vcDNA: vcDNA=SeqID_70439; Strand=+; Position=1-343
EMSLFTKCPDGFTNLQLIELFRLDWRRIRSEEDLLAHSDHLRDGPLGRGCLIGPTNSADCLHCFERLRRAIEQVEAVHWAFANLLNRFDCRLAKFGLASATQPFSPNTTCHNCA

SEQ ID NO: 144017 - protein, 55 aa, Heterodera glycines
  Coding regions on vcDNA: vcDNA=SeqID_70440; Strand=+; Position=1 -36,91-222
MKNFTKCINLKTSKVIFLISSQKEMNLINKHKFLNNNSTIYQLSVFIWKNLKNKL

SEQ ID NO: 144018 - protein, 74 aa, Heterodera glycines
  Coding regions on vcDNA: vcDNA=SeqID_70441; Strand=-; Position=1 -157,204-271
MNAAHVECQRLITGFKRRAAETCEAPVTIRAQVVQNTCTPVLAAFPSKIATKSDQTIKEVSRSRCTDSPTLLPL

SEQ ID NO: 144019 - protein, 37 aa, Heterodera glycines
  Coding regions on vcDNA: vcDNA=SeqID_70442; Strand=+; Position=1-111
MLAKTEELDESLRSIEKLLQQIKDTKRLLDKFEEHIV

SEQ ID NO: 144020 - protein, 178 aa, Heterodera glycines
  Coding regions on vcDNA: vcDNA=SeqID_70443; Strand=-; Position=1 -50,96-141,195-214,283-417,823-920,978-1035
  Homolog annotation: Hit_ID=NP_740940.1; Match level="QueryCoverage =89%, HitCoverage=16%, E-value=3e-41, Identity=52%"; Hit description =sodium potassium-transporting ATPase family member (1P30) [Caenorhabditis elegans] emb|CAD21662.1| Hypoth
YHWHWESATLTTSRGLELSASDQVRVRELSASDQVRVRRQAAAAWQVTLAWQVTLVMSQVFHLFVMSQVFHLFMCTTRRISIFQHGITNLVSIFAIIIEILLLNLFVYTPAFQYLMNIQSPPMFVWLFAPVVGLYLLIFNESRKYFIRNHPNNRIVRLLRKYFIRNHPNNRIVRLLKF

SEQ ID NO: 144021 - protein, 202 aa, Heterodera glycines
  Coding regions on vcDNA: vcDNA=SeqID_70444; Strand=-; Position=1 -269,316-653
MADAMQDGARWKKAKTAINVLGNLLLAESLDTTSATPLKNDVADIKKEEEATVAEEHKEDDDDQQKEDLGDIDKTLDDFFNSIKASTANIDKDICFKLPFGLIISGPSSSGKTQFLLKFIAESDHLITPKPVSMLYCFGEMNAAVPVLQKAGVDVYAGVPSEELIKRLPKPLLLVLDDLMLSVDERYLSDLFTRKAHHHQFC

SEQ ID NO: 144022 - protein, 81 aa, Heterodera glycines
  Coding regions on vcDNA: vcDNA=SeqID_70445; Strand=-; Position=1 -81,525-674,761-775
MASVSNDYRQMKTVPPPSSSISSRKPNPSNQTGQGKRIVDSLWDLRLDSILGDQQITEAVHQLIVAIIIIALISAVLYLEV

SEQ ID NO: 144023 - protein, 114 aa, Heterodera glycines
  Coding regions on vcDNA: vcDNA=SeqID_70446; Strand=+; Position=1 -32,364-676
MFGPQQTGLINQSAFLRQLDSRTANLDTFVLKSSTNVVPTAASVCAGDSGTTDGAMTSCTRDADKQQQEELTIDQIQYIMQNEHVSKEREQEVRRTTRSPSPVVSPDFFISNFC

SEQ ID NO: 144024 - protein, 130 aa, Heterodera glycines
  Coding regions on vcDNA: vcDNA=SeqID_70447; Strand=-; Position=1-393
MWSFFFAMIVLSLLCFLSLFGAEVKIRKYLPMVVQNSRLFRREDVSATKRKLIQIREIGKSFCQRHDSCQSRAVPFTPPASFSLNHCPTLIPLILCSPLIPFPRRCSAKPINYAANNKLTGTSMSQEGAV

SEQ ID NO: 144025 - protein, 223 aa, Heterodera glycines
  Coding regions on vcDNA: vcDNA=SeqID_70448; Strand=+; Position=1 -45,445-1071
  Homolog annotation: Hit_ID=XP_219511.2; Match level="QueryCoverage =92%, HitCoverage=49%, E-value=5e-29, Identity=34%"; Hit description =similar to retinitis pigmentosa GTPase regulator-like protein [Rattus norvegicus]
MNNHFIVLVYYPKIQKKKRRESKANRTDGERETNREKGKANVKKRDKGAKRGKVNAKKRDKRSKRGKANAKKRDKGAKRGKAKEKERDKQSKSGKANAKKRDKRSKRGKANAKKRDKGEKSGKAKEKERDKQSKSGKANAKKRDKRSKRGKANAKKRDKGEKSGKAKEKERDKGAKRGKAKEKERDKQSKSGKANAKKRDKGAKRGKAKEKERDKQSKSGKAL

SEQ ID NO: 144026 - protein, 82 aa, Heterodera glycines
  Coding regions on vcDNA: vcDNA=SeqID_70449; Strand=-; Position=1 -187,637-698
MPTFARQFGTGTEGGQRSGGARDSAARRHRQIGERVGGPETHDSANANAPINGGQIGEHRTEEPTIGATFHRSVGHVTARKV

SEQ ID NO: 144027 - protein, 38 aa, Heterodera glycines; identical to SEQ ID NO: 130624
  Coding regions on vcDNA: vcDNA=SeqID_70450; Strand=-; Position=1-344

SEQ ID NO: 144028 - protein, 38 aa, Heterodera glycines; identical to SEQ ID NO: 130624
  Coding regions on vcDNA: vcDNA=SeqID_70451; Strand=-; Position=1-150

SEQ ID NO: 144029 - protein, 51 aa, Heterodera glycines
  Coding regions on vcDNA: vcDNA=SeqID_70452; Strand=+; Position=1-156
FEYPKRTLEKIDFFVFRAVPPNRCAQIYEETESFRNSFTIACTLILRWIFA

SEQ ID NO: 144030 - protein, 23 aa, Heterodera glycines
  Coding regions on vcDNA: vcDNA=SeqID_70453; Strand=+; Position=1-69
FTNHVSNVPFATRRLRLALVRLS

SEQ ID NO: 144031 - protein, 90 aa, Heterodera glycines
  Coding regions on vcDNA: vcDNA=SeqID_70454; Strand=+; Position=1 -97,519-694
MGPKIVIYLLGIGVLWIFAVVQCLPVNGMSAYVVDDRPVHLSLKRAIGIYWNAIQYPGIEKRTAYPYPSPTDIKYIGFGRKRATFDGADK

SEQ ID NO: 144032 - protein, 49 aa, Heterodera glycines
  Coding regions on vcDNA: vcDNA=SeqID_70455; Strand=-; Position=1 -77,251-321
ALQLHEPCCSGLSQIAHLKHDLWIVSLSTTILSVGGTSFSHIWHNGLLK

SEQ ID NO: 144033 - protein, 76 aa, Heterodera glycines
  Coding regions on vcDNA: vcDNA=SeqID_70456; Strand=+; Position=1 -69,375-536
MSSQQQQLDVLIVIDGTNIDKPCAFGVSNCQSLNDVLREVDFRQILRNDFMLIQNLATFCFSYLTRQIEKFRLFLN

SEQ ID NO: 144034 - protein, 20 aa, Heterodera glycines
  Coding regions on vcDNA: vcDNA=SeqID_70457; Strand=-; Position=1-60
KVISTRPIWQVKQRFLRRQK

SEQ ID NO: 144035 - protein, 105 aa, Heterodera glycines
  Coding regions on vcDNA: vcDNA=SeqID_70458; Strand=+; Position=1-659
ILRWIFAPHNCLSTPNGHLKKSIYFVFGAVPPNRCAQIYGETESFGNSFPIACTLILRWIFAPHNCLSTPNGHLKKSIFLFSGQSPRTDAPRFMGRPNPSGIASL

SEQ ID NO: 144036 - protein, 142 aa, Heterodera glycines
  Coding regions on vcDNA: vcDNA=SeqID_70459; Strand=-; Position=1 -184,616-776,822-905
  Homolog annotation: Hit_ID=NP_386546.1; Match level="QueryCoverage =95%, HitCoverage=26%, E-value=2e-33, Identity=54%"; Hit description =PROBABLE MANNITOL 2-DEHYDROGENASE PROTEIN [Sinorhizobium meliloti 1021] emb|CAC47019.1| PROBABLE MANNITOL
ITDAMIDFLPIDNAEAIVAQLSDPAIRIVSMTVTEGGYFINSATGEFDPTHPAIVADSKDPANPRPVFGLIVPALSRRRANGPDPFTVLSCDNITKNGEMARNACVGMARALGQQELADWINERCGIPERNGRSDHSDDRGY

SEQ ID NO: 144037 - protein, 235 aa, Heterodera glycines
  Coding regions on vcDNA: vcDNA=SeqID_70460; Strand=-; Position=1 -145,197-520,571-807
  Homolog annotation: Hit_ID=NP_009670.1; Match level="QueryCoverage =90%, HitCoverage=25%, E-value=2e-09, Identity=26%"; Hit description =Cyc8p [Saccharomyces cerevisiae] emb|CAA46973.1| nuclear phosphoprotein [Saccharomyces cerevisiae] emb|CA
SDSGIMSDEGGACSHSNSPTEMGTRSVPLLHANAEAVAPARAAQFSANLFQFPRPTAQMPTLAQHHHRVQAVHSPAPTPAGHGHAQSQLSPLELVLQMQHQHNQQQQLQQQQQQHLHPFASLQQFSPIPKSDSVAAGVADEVNSAPAAASTPTLIMPNDAIGGAAANNNAFLPCELQQLLAIAALTQQHHQPQQQQPMVPVSAANGTNTNNNSNNNLPSFHSLPPPAAPDHNTMT

SEQ ID NO: 144038 - protein, 299 aa, Heterodera glycines
  misc_feature (268)..(268): Xaa can be any naturally occurring amino acid
  Coding regions on vcDNA: vcDNA=SeqID_70461; Strand=-; Position=1 -44,92-193,246-304,350-491,1104-1247,1316-1412,1454-1614
  Homolog annotation: Hit_ID=XP_313575.1; Match level="QueryCoverage =95%, HitCoverage=69%, E-value=4e-75, Identity=53%"; Hit description =ENSANGP00000013498 [Anopheles gambiae]
SLSDFFSRSTHTNNWALLVCALLVCSSRFWFNYRHVANVLSLYRSLKRLGMPDSNIILMLSDNIPCNANIILMLSDNIPCNARNPSPASIFNNAFAHQNLYLEDTEVSIFNNAFAHQNLYLEDTEVDYRGYEVTAESVVRILTGRTHTDTPRNKRLLSDSQSNVLIYLTGHGGDGFLKFQDAEELTNVDLADAIETMHQQNRYNELLLIADTCQSESMYQRVYSPRVLATSSSLVGEDSLSHHVDRVGEDSLSHHVDRSIGVYIIDRXPQPSGTLYFLIRYAYHMQQFLDTRVTGLNSN

SEQ ID NO: 144039 - protein, 243 aa, Heterodera glycines
  Coding regions on vcDNA: vcDNA=SeqID_70462; Strand=+; Position=1 -81,132-257,573-745,1266-1396,1447-1665
  Homolog annotation: Hit_ID=NP_082278.1; Match level="QueryCoverage =29%, HitCoverage=21%, E-value=2e-13, Identity=47%"; Hit description =protein similar to E.coli yhdg and R. capsulatus nifR3 [Mus musculus] dbj|BAB26724.1| unnamed protein pro
MVANGLLDNPAMFAGHSSTPKQCVRDWLNLELSECIPFDLFHQQLIFMLRSSLPKQQRNIFNALKSSAAALSVRDGKLFVQNRGFELHKNVHLVAFGKAAPAMVHGAERVLGEHILRGIASVPMKIDGPTMSQGGHVQTPIAILNDLEILDKVPIRLVDALRSAHLEKDQYDPSPTDALNVIIASNSILLDNLANQINDSLSISPFIVTNRLEGNATELGIRFSKLIKQSMVNGKLDRSIMIA

SEQ ID NO: 144040 - protein, 20 aa, Heterodera glycines
  Coding regions on vcDNA: vcDNA=SeqID_70463; Strand=+; Position=1 -31,560-591
MSKMNSHPEQESVVNTCNLV

SEQ ID NO: 144041 - protein, 186 aa, Heterodera glycines
  Coding regions on vcDNA: vcDNA=SeqID_70464; Strand=+; Position=1 -134,189-615
MEIRGKIGENGTEEMEIVNSDGKELPTPHYPLPNKVIGFKLILINFIDQNVLTFPGHFHRFFATSTTKLFIRTENIQILEFLMRNIWPMFKATIRLIYFHSIAFGQIRQFAPLMLNDCPSLHVVDFDGGILPEFPPDDSANASDGQAVAKWLFTPRPDNLTKVLSVKITFVEQLLATVEHIKAVIN

SEQ ID NO: 144042 - protein, 136 aa, Heterodera glycines
  Coding regions on vcDNA: vcDNA=SeqID_70465; Strand=+; Position=1-411
PGKKNIIADVLSRSGTGNEIEEGEQNSEEIAFIGKIRTTENDLENFGLMEERQEWVEQTKIGEMKPIYEFLERKVLPNDQRDQQRVIGKCHKFVVFKDLLYLSEKEGKMRLFVPQKFRNELVKNRHEGICAGHMSG

SEQ ID NO: 144043 - protein, 70 aa, Heterodera glycines
  Coding regions on vcDNA: vcDNA=SeqID_70466; Strand=-; Position=1-217
KPSSFSEASRLGFSAIGSTTPKRTWKCGCWLSCSLPMLRRRELGRPIENGQTNEGINHFILMCFQNKLPN

SEQ ID NO: 144044 - protein, 44 aa, Heterodera glycines
  Coding regions on vcDNA: vcDNA=SeqID_70467; Strand=+; Position=1-335
VSFFLFSLVNYLNFQFFSFFRKNFCLFSAGTASDNVFYLFRKIN

SEQ ID NO: 144045 - protein, 53 aa, Heterodera glycines
  Coding regions on vcDNA: vcDNA=SeqID_70468; Strand=+; Position=1-354
LFFEKFFVFFSAGTASDNVFYLFRKINFFFFLIYFNYISSLNFLINIFKLSPY

SEQ ID NO: 144046 - protein, 61 aa, Heterodera glycines
  Coding regions on vcDNA: vcDNA=SeqID_70469; Strand=+; Position=1 -123,1047-1109
  Homolog annotation: Hit_ID=NP_494570.1; Match level="QueryCoverage =67%, HitCoverage=3%, E-value=4e-13, Identity=80%"; Hit description =AdaPTin or adaptin-related protein (140.0 kD) (apt-5) [Caenorhabditis elegans] gb|AAB66112.2| Adaptin or a
MLGYDISWAAFNIIEVMSSTRYSEKRIGYLAAVQAFNDETDSKQQKLALNFAVICEGNLGD

SEQ ID NO: 144047 - protein, 58 aa, Heterodera glycines
  Coding regions on vcDNA: vcDNA=SeqID_70470; Strand=-; Position=1 -124,169-221
MGKRKLLPKIHGKNGVKERQKKREERKAQTAKATEARLVKKIFSRCPAQHRSRNGTTI

SEQ ID NO: 144048 - protein, 151 aa, Heterodera glycines
  Coding regions on vcDNA: vcDNA=SeqID_70471; Strand=-; Position=1 -156,223-456,716-781
MPLSNADAINLCFHPSFFSENRLANIKLVMEYVQMIKSILVLRQPAAPFELKEVISSRTNLFADSFQHDCQEFIQFFVDALHETMKGVLRKNDGAGGGAAQRDDQNWRNAIDMMQQHWRSEVLAPKKGSVSSPEKETPSNVRPMKYAFHSP

SEQ ID NO: 144049 - protein, 119 aa, Heterodera glycines
  Coding regions on vcDNA: vcDNA=SeqID_70472; Strand=+; Position=1 -123,320-415,578-718
  Homolog annotation: Hit_ID=CAE73810.1; Match level="QueryCoverage =88%, HitCoverage=8%, E-value=4e-45, Identity=81%"; Hit description =Hypothetical protein CBG21360 [Caenorhabditis briggsae]
MVKMQLVPDGTFRKVRNNIDRLFDKNLTDLIRGIRNNKENEARYIAACIDEIKVELRQDSIFVKANAIEKLAYLQMLGYDISWAAFNIIEVMSSTRYSEKRIGYLAAVQAFNDETDVCV

SEQ ID NO: 144050 - protein, 368 aa, Heterodera glycines
  Coding regions on vcDNA: vcDNA=SeqID_70473; Strand=+; Position=1 -75,578-628,677-810,1810-2209,2344-2790
  Homolog annotation: Hit_ID=NP_494571.1; Match level="QueryCoverage =80%, HitCoverage=37%, E-value=2e-40, Identity=65%"; Hit description =AdaPTin or adaptin-related protein (apt-5) [Caenorhabditis elegans] gb|AAK73904.1| Adaptin or adaptin-rel
CINTVIAILISISSEGPGDYTPSIQLCVQKLGILIDDSDQNLKYLGLLAMGKILLTHPKAVQAHKDIVLRCLDDKDESIRLRALDLLEMLSPGIFHVKAARFTCIFYFQILFTIFMGRGNVLLPSSGWDELTGQNSFSPHFYPSVNNVTAVLDAMLRIKLSVVPGPLLSVFVQNIAKLYTFQLCKLEADDDWDGIETLDNLLTSKLPEYQYTDHLEAQERTCNLIAMLKFASKMHTTNVKIGEALTKHFDGELNPVAAKAQRKVPVPDGLNLDECINEIDDSSVEDEMDEEEYDEEEEEHEQKKHHDGIMPTSTAHRQNDHQQQHYAIGNSSSSIGRAKGQQMKHREQSPDDAYHGGGGGGAPRVASE

SEQ ID NO: 144051 - protein, 181 aa, Heterodera glycines
  Coding regions on vcDNA: vcDNA=SeqID_70474; Strand=-; Position=1 -21,295-819
MSAQFREVVKQMLAKRKMLFHHFSYGKLGSGIAMGSGCGGGVRPRVGSGARRSEEAERSSTSMMARKTSSSTATMGLIVQQKQQKDTVIWRNGVGAGAIGSGGGRDEMTAKLIKNNNGGENNNYVGGGGYLARQITTVTTIGEEGGKEEEEEEEKEEKNDDVIEEEEEEEEETDEMDECRL

SEQ ID NO: 144052 - protein, 190 aa, Heterodera glycines
  Coding regions on vcDNA: vcDNA=SeqID_70475; Strand=-; Position=1 -108,364-406,678-769,821-974,1075-1139,1326-1404,1487-1517
  Homolog annotation: Hit_ID=NP_492174.1; Match level="QueryCoverage =96%, HitCoverage=31%, E-value=8e-83, Identity=71%"; Hit description =phosphoenolpyruvate carboxykinase cytosolic family member (73.4 kD) (1I447) [Caenorhabditis elegans] emb|
MLNKNLAQEHFIAAAFPSACGKTNLAMLEPTLPGWKAGFFGVAPGTSKKTNPMAVQTFQKNSIFTNVAETSEGKVYWEGLEDEICDRNDVTITDWMGAPWKLGSPTPAAHPNSRFCAPAKQCPIIHPDWESPNGVPIDAIIFGGRRPQGVPLVFESFSWEHGIFTGACLKSETTAAAEHQGKTVMHDPMA

SEQ ID NO: 144053 - protein, 222 aa, Heterodera glycines
  Coding regions on vcDNA: vcDNA=SeqID_70476; Strand=-; Position=1 -141,222-293,376-438,884-1000,1551-1647,1697-1808
  Homolog annotation: Hit_ID=NP_492174.1; Match level="QueryCoverage =95%, HitCoverage=29%, E-value=4e-77, Identity=67%"; Hit description =phosphoenolpyruvate carboxykinase cytosolic family member (73.4 kD) (1I447) [Caenorhabditis elegans] emb|
ATMDPAKLTPFKQTPGVSASLRQISADAFYVVNEVVIKRLGPIPILKGDFHLLPFGDFHLLPFKVQRFVAEKAELCRPRGIFICDGSEHEAEEMTDLLVERGVLTPLVAYENNYLCRTDPRDCARVESKTWMVTREKYETVTHTPAGVEPIMGHWMPPAQFADELDTRFPGCMAGRIMYVIPFSMPLMAGRIMYVIPFSMPLGSPLSKIGIQVQKMQLINKF

SEQ ID NO: 144054 - protein, 45 aa, Heterodera glycines
  Coding regions on vcDNA: vcDNA=SeqID_70477; Strand=+; Position=1-360
IFKCLHFFWLTKTSSNLVLSILFQIAPNFLFQIAPNFFYSLTRPY

SEQ ID NO: 144055 - protein, 93 aa, Heterodera glycines
  Coding regions on vcDNA: vcDNA=SeqID_70478; Strand=-; Position=1 -165,682-795
MQKLKDLVKKKKLDNKFKKLGGGRQLGGPAQQQRTEQAAGRTTSSTRSPSPAAQQRRSDAELIAAAAEKRMHGKQQNDPNAGLTPMQKMVRMQ

SEQ ID NO: 144056 - protein, 63 aa, Heterodera glycines
  Coding regions on vcDNA: vcDNA=SeqID_70479; Strand=+; Position=1 -126,1079-1144
MEVRIFWQSVLAQYSNNDFWRRAYCCGSTARANIGRSIFKLEVTILGFLVLKIPVLLICNCNQ

SEQ ID NO: 144057 - protein, 118 aa, Heterodera glycines
  Coding regions on vcDNA: vcDNA=SeqID_70480; Strand=-; Position=1 -138,188-253,473-622
  Homolog annotation: Hit_ID=CAH89609.1; Match level="QueryCoverage =96%, HitCoverage=24%, E-value=3e-43, Identity=71%"; Hit description =hypothetical protein [Pongo pygmaeus]
MDWMPALVTDILLSMDDRFLFLSCWLHGDVRQYDISDPFDVKLVGQFFVGGSIHSKSGVEVLEDKELKAQPDPLIVKGRRVEGGPQMMQLSLDGRRLYVTNSLYSVWDAQFYPELIKS

SEQ ID NO: 144058 - protein, 32 aa, Heterodera glycines
  Coding regions on vcDNA: vcDNA=SeqID_70481; Strand=+; Position=1-96
MRKAKCETPKNANNAKGEMRKAKPRPIPDLNH

SEQ ID NO: 144059 - protein, 45 aa, Heterodera glycines
  Coding regions on vcDNA: vcDNA=SeqID_70482; Strand=+; Position=1 -52,315-400
MSITQNKVHIHDQRPKLRITFFILIIEMHNKNHKILPIFLHFLII

SEQ ID NO: 144060 - protein, 77 aa, Heterodera glycines
  Coding regions on vcDNA: vcDNA=SeqID_70483; Strand=+; Position=1 -93,977-1116
MRNRSMFLLNPHGLLRGDDCKWQKRLLLMCEQHFTLSHFEAVQVGPVDFASPAGQRTVTTHFWSLQLKQTQQQSPLS

SEQ ID NO: 144061 - protein, 49 aa, Heterodera glycines
  Coding regions on vcDNA: vcDNA=SeqID_70484; Strand=-; Position=1-251
ANTESGDCCCVCLSCNDQKCVVTVRCPAGEAKSTGPTCTASKCESVKCC

SEQ ID NO: 144062 - protein, 222 aa, Heterodera glycines
  Coding regions on vcDNA: vcDNA=SeqID_70485; Strand=+; Position=1 -428,523-760
MYINFTFPKTVLLLKMNTLEIDKILSTSPFTKQTYIGCFAADQIPNMEMVKFPNCLVMNIDPITSKGSHWVCAYSPSPSHIEYYDSLGIWPPPSIHIANYLSRFKQIRYSIILLQSPNSSVCVVVMCSSFCLIDVWELPLKRFFFTKMHVDFDPHQVDWSTFSHEFIQYGGYNIFRGVPYQRGAGIGSVFRSLMRFKGPIGKQIGSSIAFKGLESGNRVLTN

SEQ ID NO: 144063 - protein, 196 aa, Heterodera glycines
  Coding regions on vcDNA: vcDNA=SeqID_70486; Strand=+; Position=1 -111,381-860
MQKRKLAPVPASEGIAVAVIVVDEKAVELARNGASAKNSSLPFLPIAVFGFVVIVGAPPNRGALAIELVSVNELDAVLFPYGEMSSTDCAADRLRDRPLTCGCEPEKEGIGAGRESNSKKVLQYPEFISKKAGKPETIMFYSALFRHGIPGELGGGVSLTITPPFQTHKWRKNYAKEPTFVENEGGFFVVVSFGIK

SEQ ID NO: 144064 - protein, 100 aa, Heterodera glycines
  misc_feature (3)..(3): Xaa can be any naturally occurring amino acid
  Coding regions on vcDNA: vcDNA=SeqID_70487; Strand=-; Position=1 -201,643-822,1122-1233
FPXAPPQPPPRPLSRFSLALSRKRRHPPLCLPPSPPSLSAPPNSLLLAPPPPVALSSVRPPPTPSRQAHNHKLTVDLVSDRLHNQSMTFRRMERELRPVH

SEQ ID NO: 144065 - protein, 86 aa, Heterodera glycines
  Coding regions on vcDNA: vcDNA=SeqID_70488; Strand=+; Position=1-548
IIFIQKIFFWVFGAVPLNRCAQIYGETESFGNSFPIACTLILRWIFAPHNCLSTPNGHLKKSIYFCFRGSPPEPMRPDLWGDRSFG

SEQ ID NO: 144066 - protein, 49 aa, Heterodera glycines
  Coding regions on vcDNA: vcDNA=SeqID_70489; Strand=+; Position=1 -110,512-551
MFAFFLAYQNFIEPGSFYSLSNRPKFFLQPRGREAAENCSETYQNLFTS

SEQ ID NO: 144067 - protein, 133 aa, Heterodera glycines
  Coding regions on vcDNA: vcDNA=SeqID_70490; Strand=-; Position=1 -161,211-262,600-788
  Homolog annotation: Hit_ID=CAF95758.1; Match level="QueryCoverage =81%, HitCoverage=22%, E-value=5e-24, Identity=47%"; Hit description =unnamed protein product [Tetraodon nigroviridis]
MAISQITEFFPISQKTFESTLRRFPDSLLGNPEKRKELWNDQLHEIFLDRSSQCFEAILHVYRSGGQVIRPASIPVELFIDELVFYELKDDVWANFCESEGCRVQSAYRKPSNKFQRKLWDLVGTAQMPNSNI

SEQ ID NO: 144068 - protein, 142 aa, Heterodera glycines
  Coding regions on vcDNA: vcDNA=SeqID_70491; Strand=-; Position=1 -87,181-522
MTPINGTITVSVVCPFLCTIMTLLFPEIAAAPSAADQSSLIMKQFFDFVYKNKAEELRALLNSLPGDELSHLLYIQYAPKGTEKRLTPLLIATVGNKPEVAAVLACQQQIRTLALKSQKDKKCLGTLSQRHGLCPSFCQIGR

SEQ ID NO: 144069 - protein, 38 aa, Heterodera glycines
  misc_feature (9)..(9): Xaa can be any naturally occurring amino acid
  Coding regions on vcDNA: vcDNA=SeqID_70492; Strand=-; Position=1-116
IFKFFIDFXMFAFFLAYQNFIEPGSFYSLSNRPKFFLQ

SEQ ID NO: 144070 - protein, 201 aa, Heterodera glycines
  Coding regions on vcDNA: vcDNA=SeqID_70493; Strand=+; Position=1 -120,479-627,1204-1349,1774-1964
  Homolog annotation: Hit_ID=CAE59253.1; Match level="QueryCoverage =79%, HitCoverage=16%, E-value=4e-67, Identity=78%"; Hit description =Hypothetical protein CBG02581 [Caenorhabditis briggsae]
MFSSIIFLYFACLLPAIAFGVLNDDNTGGGINVRKGILAQAIGGIFFAIFGGQPMIILLTTVPLAIYIKVIYRISESLGYDFFAMYACVGLWCQFFLILYAATELCSLMKLATRSAEEMFSLFIAIAFTVESIRAIHTSFMNNYEVCEDAQAAAEQAELAHRHQQQQLVQHQLNLSLLQKIINPELHHNLTQVMMIGLGNN

SEQ ID NO: 144071 - protein, 88 aa, Heterodera glycines
  Coding regions on vcDNA: vcDNA=SeqID_70494; Strand=+; Position=1 -66,988-1188
MRPNVPLFRVPEFWRLSWQAILTKKRLCPALGHIRGGLAQHVPVHCWAAVDAWRAAPFAAAFARAGRRGGARRAGPRARSVSDWLIRE

SEQ ID NO: 144072 - protein, 43 aa, Heterodera glycines; identical to SEQ ID NO: 131671
  Coding regions on vcDNA: vcDNA=SeqID_70495; Strand=+; Position=1-129

SEQ ID NO: 144073 - protein, 57 aa, Heterodera glycines
  Coding regions on vcDNA: vcDNA=SeqID_70496; Strand=-; Position=1-173
  Homolog annotation: Hit_ID=XP_239866.2; Match level="QueryCoverage =94%, HitCoverage=2%, E-value=2e-11, Identity=59%"; Hit description =similar to myosin [Rattus norvegicus]
LTNKDDVGKNTFELEKSKRAMEKEMEDLRMQVEELEEAVQLAEVQRLRMEVNIQERG

SEQ ID NO: 144074 - protein, 234 aa, Heterodera glycines
  Coding regions on vcDNA: vcDNA=SeqID_70497; Strand=-; Position=1-704
  Homolog annotation: Hit_ID=XP_320901.1; Match level="QueryCoverage =70%, HitCoverage=61%, E-value=1e-12, Identity=32%"; Hit description =ENSANGP00000017731 [Anopheles gambiae]
MKEGFLLTRAVRANYEDKCPAGPPGDAGPPGPAGPAGEPGKCPPSPGDDGDTYQPTEDGGKGVTYEEGEEEHDEKLEQDKYQPRHHLNHYHNNKHGKGGHRYAGHGHGGRGHKHRHLYGNNRHGGGGDESDESGAHGGRDKDGSYETSSKTGHNNKKYGSYEHGSAEEGKAGHKHGYGYGESSASVGGDGSYERGRAHKHGGGHKRGSYERITEAPPADGNDEEYERRVRVVRA

SEQ ID NO: 144075 - protein, 108 aa, Heterodera glycines
  Coding regions on vcDNA: vcDNA=SeqID_70498; Strand=-; Position=1 -225,370-471
MSRDYSTLRRDLFSNEEEYLLFIAIRAGQRTADLGRRIQRMRDGLPPPTLFVNDRDLWTVLEHKEIKYKTRMTLEFLFECRSGFELCRNGLKSRFFQPSKLLKSYIVQ

SEQ ID NO: 144076 - protein, 52 aa, Heterodera glycines
  Coding regions on vcDNA: vcDNA=SeqID_70499; Strand=+; Position=1 -62,128-224
MKFSKKFTFMQQKRPNGLKLRGFQSRDNIELLFLPLIQSKCTLCGFEVHFNV

SEQ ID NO: 144077 - protein, 83 aa, Heterodera glycines
  Coding regions on vcDNA: vcDNA=SeqID_70500; Strand=-; Position=1-249
MAVVIDHCAVPAVYGLLPSKTLATYTRFFETIRQSVGNNWFPYRIMSDFESGAITAAGNVFPNSIRTGCLFHFGQAIWRRIQR

SEQ ID NO: 144078 - protein, 136 aa, Heterodera glycines
  Coding regions on vcDNA: vcDNA=SeqID_70501; Strand=+; Position=1 -269,409-552
TFVCLNKLRPRASEQRDNCSSYSFGWPPPPSDPLAEERLLAQLFLCTRTTARVRQDSLYGDYTLAASPASTQLRTTHSSFWTQQQQQLKAQQQHHAQQRDNPLQQQQLAMEVVEKDETPKREPTLSDSKQRTAAEQ

SEQ ID NO: 144079 - protein, 99 aa, Heterodera glycines
  Coding regions on vcDNA: vcDNA=SeqID_70502; Strand=+; Position=1 -10,495-784
MSKCINEFLIWNIGLFEKNKIGKVGICLVCKEQNRQKSEFSINDSSTKSLIVHLNSSLHKGSEYDKKFQQLETEWKNAKQKKHKEQPKIADLMNITSSR

SEQ ID NO: 144080 - protein, 43 aa, Heterodera glycines
  Coding regions on vcDNA: vcDNA=SeqID_70503; Strand=-; Position=1 -27,391-495
MNKLCHIFMVRLIVSIIFIYFFIGPISSLFRKRNIIISSTISR

SEQ ID NO: 144081 - protein, 23 aa, Heterodera glycines
  Coding regions on vcDNA: vcDNA=SeqID_70504; Strand=+; Position=1-69
MPSTSEKVAEVHGTKEPICPIKT

SEQ ID NO: 144082 - protein, 317 aa, Heterodera glycines
  Coding regions on vcDNA: vcDNA=SeqID_70505; Strand=-; Position=1 -86,132-642,684-939
  Homolog annotation: Hit_ID=CAB88203.1; Match level="QueryCoverage =99%, HitCoverage=92%, E-value=1e-106, Identity=57%"; Hit description= putative cuticular collagen [Globodera pallida]
AILATLIVVPQLYQQINEVNSRVFDGVQAFRVNTDSAWTELMDVQISVAFRVNTDSAWTELMDVQISVTPPARPRENPFNSIFLRQKRGNGGLPPQCVCQLQQPQCPPGTPGPPGPPGPAGQPGGPGQPGRPGQPGQQPPCPQASAGCPSCPAGPPGQPGGQGPPGPPGGDGQPGQPGQGGGQGPPGPPGPPGPGGNPGQPGGPGQPGQPGAPGTKSSSVPGPPGPPGQPGGSSVPGPPGPPGQPGGPGQPGGPGQPGQPGGQGPPGPAGQPGGPGQPGGPGQPGAAGQAGQPGHDGAYCPCPPRTSVFARRSRVKV

SEQ ID NO: 144083 - protein, 82 aa, Heterodera glycines
  Coding regions on vcDNA: vcDNA=SeqID_70506; Strand=+; Position=1 -34,112-179,239-332,691-743
MRIDEAGRFLKVVKEFSQNFPTVRGLLPSPSNETLDELLRCARESVKILIESDAVTDYDMTMLRGALFGIYYYVMYHFPTPA

SEQ ID NO: 144084 - protein, 104 aa, Heterodera glycines
  Coding regions on vcDNA: vcDNA=SeqID_70507; Strand=-; Position=1-315
MQDTMCSSVEHSPQQMARASANGGGGDGGGRVAMLAATLADERGDSGPASVGSGIGRGRRGAPPRHDPPPPPGANAPPATNIAGQRQQQAATIIGTKTRRGRDQ

SEQ ID NO: 144085 - protein, 461 aa, Heterodera glycines
  Coding regions on vcDNA: vcDNA=SeqID_70508; Strand=-; Position=1 -135,612-835,1257-1503,2004-2080,2140-2307,2657-3190
MPRSRPHKQKMPCHDHISRKCHATTITRSVMDELGMDELGLWMSWPGTNIVLLVINQPADQVDVLHAVRYVSCSSLFSDHRRPSNILITMPINLTSKSQAHERDAARHGCGCAGQAGVHRTVRESRDPMTSLSPPPVHRLLDGAFGAAAAGGRSASSTPPAGAETVAADSPLRYLTSIYVPEDYTGAMEHNNSTFRLTTAEITLLAISVLLVFGVCAMLFMLLRCCKNKQQQTITKSDVEYMLDAQQAGPRPYNVELITRKMAQSDAAAVARRMPKALEQCTLSPESRATMVASAGIYSGGSVGGDGSACARTAATTMPSDTAATASGQQRRGGGGAGQHTDTATEARAVVGSHHPVADSSTTTTTTTTTTTSASSDCSSEEAGDRSGSGGEFSPQQQQSQQQQLKRAGGSGEDSRSELQLLPTTCCWYGDGTAGAEMAAALARWTNKSSSSSHKSDALST

SEQ ID NO: 144086 - protein, 27 aa, Heterodera glycines
  Coding regions on vcDNA: vcDNA=SeqID_70509; Strand=+; Position=1 -9,665-739
MDEIVLSKIRNIGFILRLMNKIEANLW

SEQ ID NO: 144087 - protein, 196 aa, Heterodera glycines
  misc_feature (115)..(115): Xaa can be any naturally occurring amino acid
  misc_feature (129)..(129): Xaa can be any naturally occurring amino acid
  misc_feature (147)..(147): Xaa can be any naturally occurring amino acid
  Coding regions on vcDNA: vcDNA=SeqID_70510; Strand=+; Position=1-936
  Homolog annotation: Hit_ID=AAL31950.1; Match level="QueryCoverage =76%, HitCoverage=33%, E-value=2e-32, Identity=56%"; Hit description =CDH1-D [Gallus gallus]
IGSSLHTDRSRNTNRPRISRNGSVPGSDGRCVQRAGTYSERVDDSPLQGIPRSRTIIAMSDPNHGKFSPVYQPLSGKDKHADFASVARVQPRTSKGHHRPVIAQFRAAEHRKSLXEVVPTEAMSQLFSXARVSLVIGINQTNRSTNXERPCTTIHRIMKKLSICQSLRCPGRVSFPVLSQIKPQAPLLVVPFLQFL

SEQ ID NO: 144088 - protein, 192 aa, Heterodera glycines
  misc_feature (134)..(134): Xaa can be any naturally occurring amino acid
  misc_feature (165)..(165): Xaa can be any naturally occurring amino acid
  Coding regions on vcDNA: vcDNA=SeqID_70511; Strand=-; Position=1-589
  Homolog annotation: Hit_ID=AAL31950.1; Match level="QueryCoverage =94%, HitCoverage=42%, E-value=2e-36, Identity=53%"; Hit description =CDH1-D [Gallus gallus]
PAAGSPTATLLRLLPVQATAIKSSSLHTDRSRNTNRPRISRNGSVPGSDGRCVQRAGTYSERVDDSPLQGIPRSRTIIAMSDPNHGKFSPVYQPLSGKDKHADFASRACSRTSKGHHRPVIAQFRAAEHRKSLXEVVPTEAMSQLFSARVSLVIGINQTNRSTNXERPCTTIHRIMKKLSICQSLRCPGRVS

SEQ ID NO: 144089 - protein, 25 aa, Heterodera glycines
  Coding regions on vcDNA: vcDNA=SeqID_70512; Strand=+; Position=1-75
TCTCGVVVKLSTFHNFSPEFNSPLG

SEQ ID NO: 144090 - protein, 153 aa, Heterodera glycines
  Coding regions on vcDNA: vcDNA=SeqID_70513; Strand=-; Position=1 -96,141-344,385-471,699-920
  Homolog annotation: Hit_ID=NP_083307.1; Match level="QueryCoverage =77%, HitCoverage=28%, E-value=9e-12, Identity=33%"; Hit description =carbohydrate kinase-like [Mus musculus] emb|CAI24581.1| carbohydrate kinase-like [Mus musculus] emb|CAI24
MPLFLGIDLGTTSVKIALIDGDKKTFLEWDRKHNALIEREEKDKHEQSPKKILDTVQKLMGEMETDKLAQVKGIGISGQMHGVMLWEADSIGLGVDRCHCSPLITWMDSRCDEQFLRKLPNIPLDSVQKCVYFLTKCRVVGVSSPTSFGPSNR

SEQ ID NO: 144091 - protein, 23 aa, Heterodera glycines
  Coding regions on vcDNA: vcDNA=SeqID_70514; Strand=+; Position=1-75
KSFKLEAASIEFLGFNSNSKMRN

SEQ ID NO: 144092 - protein, 79 aa, Heterodera glycines
  Coding regions on vcDNA: vcDNA=SeqID_70515; Strand=+; Position=1-237
MVAQLEALPESWGDRRTLLWLRQYEQFDRRTDKFWRSLGFAKHRQYSPGYENLAFFLDQLGHPPAIKTEEVAQSVGDAK

SEQ ID NO: 144093 - protein, 158 aa, Heterodera glycines
  Coding regions on vcDNA: vcDNA=SeqID_70516; Strand=+; Position=1 -83,125-363,423-577
  Homolog annotation: Hit_ID=NP_496067.1; Match level="QueryCoverage =68%, HitCoverage=17%, E-value=3e-12, Identity=36%"; Hit description =poly polymerase   family member (2J898) [Caenorhabditis elegans] emb|CAA87419.1| Hypothetical protein T15
MVAKVFLLYPNATVPTLIEKFFVTYSTWKWPMPIQLAQTDFTQKGEFLSWTPGREHFVKRQFSPRPMLRLIRPVLAMAIITPTFPEQNLAQNANLSTQKCLRNHMTKALAKIRNGNDQQKALFAPLESKTFLTMVGRLFVVEIFVGKIMATPKQIGHF

SEQ ID NO: 144094 - protein, 98 aa, Heterodera glycines
  Coding regions on vcDNA: vcDNA=SeqID_70517; Strand=+; Position=1 -98,169-367
MDQILPFVPRSDFGGPMQWAKFAEFSEKVKRNIGCNKIWLIGIEMNESPKEMSKFKSKIKANLKKKFDEKISKDFGGYSAQIESEYVDERGRIEQIFG

SEQ ID NO: 144095 - protein, 75 aa, Heterodera glycines
  Coding regions on vcDNA: vcDNA=SeqID_70518; Strand=+; Position=1 -104,217-340
MNIRSNFVLFFFIVLTLFALSRGVPLDEGVDEEGLDLKPVPASKVTDRAERIARRCVRCKRHGWGRWSSSNWGWG

SEQ ID NO: 144096 - protein, 41 aa, Heterodera glycines
  Coding regions on vcDNA: vcDNA=SeqID_70519; Strand=-; Position=1-124
CSLPPTCQSNWLFSVSRFPQRRRAHPSVHYTTNKTQPIPHS

SEQ ID NO: 144097 - protein, 33 aa, Heterodera glycines
  Coding regions on vcDNA: vcDNA=SeqID_70520; Strand=-; Position=1 -70,118-149
MAKSDKFSLKMKKLKTNHSSASADRQNEKCANA

SEQ ID NO: 144098 - protein, 35 aa, Heterodera glycines
  Coding regions on vcDNA: vcDNA=SeqID_70521; Strand=+; Position=1 -34,78-151
MITTPNKMIKQADQSEQSVFCLLPSFYAKNTAHLG

SEQ ID NO: 144099 - protein, 82 aa, Heterodera glycines
  Coding regions on vcDNA: vcDNA=SeqID_70522; Strand=+; Position=1 -57,470-600,648-708
MDGTTPIGSRQTLVEQFNKANIQTLFGQSHFGQPKTATVLQNQRIARIVHPGLVKKRPEVWHRNGGYFCRQRKRSEQKKVEE

SEQ ID NO: 144100 - protein, 49 aa, Heterodera glycines; identical to SEQ ID NO: 130195
  Coding regions on vcDNA: vcDNA=SeqID_70523; Strand=-; Position=1 -110,199-238

SEQ ID NO: 144101 - protein, 38 aa, Heterodera glycines; identical to SEQ ID NO: 129423
  Coding regions on vcDNA: vcDNA=SeqID_70524; Strand=+; Position=1-171

SEQ ID NO: 144102 - protein, 49 aa, Heterodera glycines
  Coding regions on vcDNA: vcDNA=SeqID_70525; Strand=-; Position=1 -64,137-277
  Homolog annotation: Hit_ID=CAE67355.1; Match level="QueryCoverage =100%, HitCoverage=14%, E-value=4e-13, Identity=67%"; Hit description= Hypothetical protein CBG12818 [Caenorhabditis briggsae]
MICVDNSEWMRNGDLPPTRFNCQQEAVRALIHLKLRSNPENAVGLLSLA

SEQ ID NO: 144103 - protein, 151 aa, Heterodera glycines
  Coding regions on vcDNA: vcDNA=SeqID_70526; Strand=-; Position=1 -150,252-557
MRSTLKEIFSIYSVDSFLGSPKKGVLDFQIVIWHFMDVVENAFRHIKEMELFDGKLEEIRTKFEKEWEELTEKWQINEDFKFNVKICLLHGFTHRIIRHETLNGHSEWATYAKSVSNGIFSIEGGPEFDSVSTVGMYSTGGYYRNAYKMGE

SEQ ID NO: 144104 - protein, 66 aa, Heterodera glycines
  Coding regions on vcDNA: vcDNA=SeqID_70527; Strand=-; Position=1 -81,152-271
MQSVGLLLFPLFIFIALLIIAAVTQNEKKILECPREEAPIEQLRELDKNKLPDKGEIERPKTKFCH

SEQ ID NO: 144105 - protein, 234 aa, Heterodera glycines
  Coding regions on vcDNA: vcDNA=SeqID_70528; Strand=-; Position=1 -196,338-844
  Homolog annotation: Hit_ID=XP_320889.1; Match level="QueryCoverage =71%, HitCoverage=19%, E-value=3e-34, Identity=45%"; Hit description =ENSANGP00000012033 [Anopheles gambiae] ref|XP_313651.1| ENSANGP00000013044 [Anopheles gambiae] ref|XP_314
MSKARAHEKYLPQFSSSTCSITRRGFDFQCEWCDQRMDMDFITSQWPPDQTCSPFVFTFVDHTASVADTEAPSIMGLDWIIPFERATQQPIATTLEQQSLIVNSVQPTNDPVKLEGQIKASFPKVFQPGLGHCVKTKATLHLKQNVKPVLCRARPVPHGVQAAVDEELDRLLDSGVLKPIDFSRWAAPVLAVRKKSGNVRICIDFSTGLNDALELNRHPLPRTEDIFHALRGAQ

SEQ ID NO: 144106 - protein, 420 aa, Heterodera glycines
  Coding regions on vcDNA: vcDNA=SeqID_70529; Strand=+; Position=1-1261
  Homolog annotation: Hit_ID=AAO51556.1; Match level="QueryCoverage =70%, HitCoverage=17%, E-value=2e-10, Identity=24%"; Hit description =similar to Plasmodium falciparum. Protein kinase, putative [Dictyostelium discoideum]
MIIRSPRRNPFPRRLAGENPEQRRNENNLENEANAFVFPEQNEGNNPQNSRNNQHSRQMMGEEEIHRALLDVNGQQNEQNQQLNADEEHRLLDQSNLNVLANLGGNFDANLGNNRQTEVAANMAQRQNNFVTSTPNISPGHQARQNFNFVNNRVNRRVVDRPRDALGRFIRIENNNEQEMPNFLQNPPRNPQIPPVNQQQGNNLGNFGIPNNPNLMQPLQFGMNGMYAPVAWPQQPMMAYPPPNFQMFCPPNFVPQMPVQNFVPFMNNLAPNAFQPQIPQNAIQPMRAQPTNVVQQQQNPPLTNQAIAQHNPQQEVIRQPTGLSGIEYAMILDRLPDIKGNEGSDSIRNFFKKFSQYTSEWPNKKRIESLEAKLSGRAERAYNAALATEPFAYENIKRNILQQLEETDCREMSAFDDLMN

SEQ ID NO: 144107 - protein, 92 aa, Heterodera glycines
  Coding regions on vcDNA: vcDNA=SeqID_70530; Strand=+; Position=1 -141,334-468
MLKKLRNRGHEDHEIHEQIHEFYEVSPEEVKATARGILQRGCESIFKMRDEGASNVEIEEKITEALNQIRSPQKRQEAGRFAMSCRRIFAMI

SEQ ID NO: 144108 - protein, 89 aa, Heterodera glycines
  Coding regions on vcDNA: vcDNA=SeqID_70531; Strand=-; Position=1 -137,395-527
MKRLNKSIMDLQELISQLTLANTEFAECRRKMSHYELQAYILVHIDKQMKRLNKSIMDLQELISQLTLANTEFAECRQIHRDMSNRILK

SEQ ID NO: 144109 - protein, 39 aa, Heterodera glycines
  Coding regions on vcDNA: vcDNA=SeqID_70532; Strand=+; Position=86-202
  Homolog annotation: Hit_ID=AAK94488.1; Match level="QueryCoverage =100%, HitCoverage=12%, E-value=1e-15, Identity=100%"; Hit description=putative C-type lectin [Heterodera glycines]
MFHLAAIVALAALALPLASSDKFRPCLEGYAQYGKYCYK

SEQ ID NO: 144110 - protein, 32 aa, Heterodera glycines
  Coding regions on vcDNA: vcDNA=SeqID_70533; Strand=+; Position=1-98
PSPLKALSPIMSPFLRRLKNNPPGALIRANTV

SEQ ID NO: 144111 - protein, 259 aa, Heterodera glycines
  Coding regions on vcDNA: vcDNA=SeqID_70534; Strand=+; Position=1 -69,143-238,297-386,630-1154
MAFDLKIYLHLFISFTFVGLITEASIKVVPISYLIKFNGIDHPQPQYLSYTNKQNVPKNENNNYKMDNSVVKLSPKLKDDTWDKKQKSEQNPPVNPNYIQQNQYQSTKLFDQNQSQTTSPTLIQPIQYQPAVQKQLQLTQYRPNYPHQFLPNQYQPDSISPNQFHPPADLLQQKQDQQLATHNQYQADKSQPAASPNQFQQAQYQSSVPSQIFKEMRTNTPICGSKQENHSAIGWLSSRRRKKQQIHAMECAQLLLHKL

SEQ ID NO: 144112 - protein, 88 aa, Heterodera glycines; identical to SEQ ID NO: 133373
  Coding regions on vcDNA: vcDNA=SeqID_70535; Strand=-; Position=1 -96,135-305

SEQ ID NO: 144113 - protein, 51 aa, Heterodera glycines
  Coding regions on vcDNA: vcDNA=SeqID_70536; Strand=+; Position=1-153
MYGNMGPLSLPITFLSLLLLAVFCHSEDRTVGGEEPEEKLPYKQYFSEQKY

SEQ ID NO: 144114 - protein, 97 aa, Heterodera glycines
  Coding regions on vcDNA: vcDNA=SeqID_70537; Strand=-; Position=1-294
MEKEKAKGTKGKSQKEMPKRTNEKGKAKRKCQKGQMKKEKPKGNAKRKCQKEKPKGNAKRDKSKTGQMENKLSRRKLACSDRLIFSYSLAWCNARPQ

SEQ ID NO: 144115 - protein, 133 aa, Heterodera glycines
  Coding regions on vcDNA: vcDNA=SeqID_70538; Strand=+; Position=1 -204,453-562,610-696
  Homolog annotation: Hit_ID=CAE67366.1; Match level="QueryCoverage =93%, HitCoverage=28%, E-value=2e-41, Identity=70%"; Hit description =Hypothetical protein CBG12836 [Caenorhabditis briggsae]
MSVQFSVIGVVQMVNKRSGVAFTQIDEEAFETFAIYCGLALHHAKLYEKIKRSEQASFRLLNLFSICPKYRVALEVLAYHSVCNRDELNKLKKVKLRDKIPELDLFEFNGNRLSELEKPLYAVYMFRTLFDGV

SEQ ID NO: 144116 - protein, 178 aa, Heterodera glycines
  Coding regions on vcDNA: vcDNA=SeqID_70539; Strand=+; Position=1 -219,269-380,431-517
  Homolog annotation: Hit_ID=NP_491544.1; Match level="QueryCoverage =75%, HitCoverage=30%, E-value=2e-39, Identity=59%"; Hit description =phosphodiesterase 1 (1F767) [Caenorhabditis elegans] gb|AAB53879.1| Hypothetical protein C32E12.2 [Caenor
LNKSQINRKFMPISKLDGHNVLKSLSSSDYKRALSTIRHCILATDLALFFPNKGQLSAIVKEGIFSWEDDKHRCLVQAILMTACDLIATCLVQAILMTACDLIATAKPWQVQTETVKVIFEEFYEQGDAERLNGREPIPMMDRNRAHEQGDAERLNGREPIPMMDRNRAHELPQMQVK

SEQ ID NO: 144117 - protein, 189 aa, Heterodera glycines
  Coding regions on vcDNA: vcDNA=SeqID_70540; Strand=+; Position=1 -54,109-193,250-318,712-900,949-1119
  Homolog annotation: Hit_ID=NP_508386.1; Match level="QueryCoverage =67%, HitCoverage=44%, E-value=1e-28, Identity=46%"; Hit description =COLlagen structural gene (38.6 kD) (col-164) [Caenorhabditis elegans] gb|AAA81693.1| Collagen protein 164
MAKLQIEQKHQHKFYMDMTVKMWHDILQQNEATHDNTGILMRQRRQSKPTNSPQCAQGPKGMPGIPGEPGDEGPEGEIGLPGDIGQMGPKGAPGEDGVGYAKGAQGPKGELGAPGAAGEEGPPGERGEDASPGPPGELGPQGRPGEKGKNGETGATGIAGPPGKWKCRWDGSPGDHLKAKTRNTVHIRN

SEQ ID NO: 144118 - protein, 440 aa, Heterodera glycines
  misc_feature (436)..(436): Xaa can be any naturally occurring amino acid
  Coding regions on vcDNA: vcDNA=SeqID_70541; Strand=-; Position=1 -22,364-473,601-706,735-859,906-998,1086-1137,1192-1262,1311 -1347,1386-1575,1635-1796
  Homolog annotation: Hit_ID=AAH76765.1; Match level="QueryCoverage =99%, HitCoverage=57%, E-value=4e-54, Identity=33%"; Hit description =Adprtl2-prov protein [Xenopus laevis]
DRRGVPKGKITKEQLRFGYEALGRIERHVQKGTFGRDFVEAMNDYYTRIPHSFGMRTPPPIKSPEELKRENELLEMLTGAKPAFKASKLPFQTLAHPLEENELLEMLTGAKPAFKASKLPFQTLAHPLECHYARLRWDLIPLEKDDANYKIVEEYLQGTHGPTHDKYRMKVRNIKIVEEYLQGTHGPTHDKYRMKVRNIFELSVKGTQNETQNEQKGRIGNRKLLWHGSRLANWYSSRLANWYSILAKGLRIAPPEAPSTGFMFGKGLTGFMFGKGLYFADISSKSANYSLSDPKKPGFLLLSYFADISSKSANYSLSDPKKPGFLLLSAVALGEAVELKEADSKMHQKLPKGKNSVRGVGHYVPHPNGSLSDGDVEVPCGKPINTEALSDGDVEVPCGKPINTEADDETSLIYNEFVVYPRYLLLVGSVLSLFNXSRLR

SEQ ID NO: 144119 - protein, 192 aa, Heterodera glycines
  Coding regions on vcDNA: vcDNA=SeqID_70542; Strand=-; Position=1 -477,530-629
  Homolog annotation: Hit_ID=CAB65088.1; Match level="QueryCoverage =98%, HitCoverage=29%, E-value=3e-25, Identity=37%"; Hit description =poly-(ADP-ribose) polymerase II [Homo sapiens]
EMEQKTTKTKRRKKEKDTENGGTNREKPKDSEKENLDGRISKRNKMQSEEATVDAECAELRGNAKVFVDGKGRCYDVMLSQTNIQQNNNKFYLIQLLCNQTAANKFWVWFRWGRVGFKVIFGGNNKGNSFHCQGQTNLVPFGTDFDGALELFHRKFTDKTQNDFLTDIKKFKKVAGKYDLIKIDHSREVTTE

SEQ ID NO: 144120 - protein, 183 aa, Heterodera glycines
  Coding regions on vcDNA: vcDNA=SeqID_70543; Strand=-; Position=1-551
MATSPHQQWHYDRGALLSSTMPGTAECGRHVPQQQRDDTTYYWPHPQGETDRDRFGGRGAGASDNAAASAALRRQQRQQQRHRSRLARFLHTDAAEWERHLRERQLQQELNMRRTVVQQQKQQQQQQQRSRMRNDGDAGPNEMFPQQYQQQPQQQLQPVDGSAGHEQFAYNSQQQPWPTAAPA

SEQ ID NO: 144121 - protein, 37 aa, Heterodera glycines
  Coding regions on vcDNA: vcDNA=SeqID_70544; Strand=-; Position=1-112
MAPSSSSAAAAMTPLGVILVSKDESAERVLFMYPFER

SEQ ID NO: 144122 - protein, 24 aa, Heterodera glycines
  Coding regions on vcDNA: vcDNA=SeqID_70545; Strand=-; Position=1-75
TPSEKTRCVPINRECQRKTLSFFF

SEQ ID NO: 144123 - protein, 44 aa, Heterodera glycines; identical to SEQ ID NO: 126591
  Coding regions on vcDNA: vcDNA=SeqID_70546; Strand=+; Position=1 -45,128-217

SEQ ID NO: 144124 - protein, 27 aa, Heterodera glycines
  Coding regions on vcDNA: vcDNA=SeqID_70547; Strand=-; Position=1-81
MHRIIAAVKKLVVGSVLAVRCTLCVLL

SEQ ID NO: 144125 - protein, 75 aa, Heterodera glycines
  Coding regions on vcDNA: vcDNA=SeqID_70548; Strand=+; Position=1-225
SLYNIYFRKTLILVFQRELNHHPSLSDFITAFTRDIDKQLDIGRAEHLQKSRKRPQRYIIKEQNVVRMDSCRGRL

SEQ ID NO: 144126 - protein, 57 aa, Heterodera glycines
  Coding regions on vcDNA: vcDNA=SeqID_70549; Strand=+; Position=1 -141,626-658
MFVFEFRSLCPLTETLIGDFVVPQIDAQIVRRDERLLVRVDAYRIDVRLQIIKFGLM

SEQ ID NO: 144127 - protein, 36 aa, Heterodera glycines
  Coding regions on vcDNA: vcDNA=SeqID_70550; Strand=+; Position=1-108
KKFQLNSKNFRLFIKNFGSRNSDPKNVGNRKSFRAI

SEQ ID NO: 144128 - protein, 49 aa, Heterodera glycines
  Coding regions on vcDNA: vcDNA=SeqID_70551; Strand=+; Position=1 -87,676-738
MAIKLEFAGGLDAIFNGKRETEAENDNISLDAQLNGGDKVTFISTLHGG

SEQ ID NO: 144129 - protein, 156 aa, Heterodera glycines
  Coding regions on vcDNA: vcDNA=SeqID_70552; Strand=-; Position=1 -112,230-301,1118-1257,1547-1693
MVELRSDFVLQFADYQRTVASSGSVYQRSEWESCCAKDNRACSAAPAAVYHRHDGQRFYGLAKLEKYFQKVTTNSSPMTTHQQSMNNGNGTSSVASGIDASTPTPSPASNVYYIIIFIIIIYLLMGAQRPIVFCNVSFCVVKEWKCPNFLLHCFCC

SEQ ID NO: 144130 - protein, 63 aa, Heterodera glycines
  Coding regions on vcDNA: vcDNA=SeqID_70553; Strand=-; Position=1-503
LTSKNNSLPKSFLQPFIANLISCRLKAIHCLPVPAQQSTNRVFDSLQKIIPYTKVFYNHLLPI

SEQ ID NO: 144131 - protein, 28 aa, Heterodera glycines
  Coding regions on vcDNA: vcDNA=SeqID_70554; Strand=-; Position=1-86
NRTKIEDEARDRTELIGELGLMKKKGEL

SEQ ID NO: 144132 - protein, 112 aa, Heterodera glycines
  Coding regions on vcDNA: vcDNA=SeqID_70555; Strand=+; Position=1-341
NEFLKVAWGCIGCATFTDINAQIGQTAKATVDCKAIFGEKDLDFSNEYFNYSMLAMAMATTTKQTKRKPKKLITEKPSTTVAPKTNGAWSAEMTMKAQETTIEGEPITGDQG

SEQ ID NO: 144133 - protein, 186 aa, Heterodera glycines
  Coding regions on vcDNA: vcDNA=SeqID_70556; Strand=+; Position=1 -132,181-307,446-536,901-1109
  Homolog annotation: Hit_ID=NP_871656.1; Match level="QueryCoverage =66%, HitCoverage=27%, E-value=4e-20, Identity=43%"; Hit description =CyclIn T (cit-1.1) [Caenorhabditis elegans] gb|AAN63386.1| Cyclin t protein 1.1, isoform b [Caenorhabditi
DIAAACVFLAGKSEECPRKLEHVVEAWFKLKNMKAEVQPPFTETVRRDGAELIVFLESVLLQTIGFDLQVELPHPLVLHHMNCYAGDNSAISRCAYWFASEMIRLKSIRIFVSPPPSTSFMVHQLPPPPPPPNLSAVKTNQAQQQQKTPDKVINNDQQRQRNKRPALARTGQSEEPSPAKRIPTDA

SEQ ID NO: 144134 - protein, 520 aa, Heterodera glycines
  Coding regions on vcDNA: vcDNA=SeqID_70557; Strand=+; Position=1 -141,190-252,403-555,607-937,984-1070,1121-1500,1669-2076
  Homolog annotation: Hit_ID=NP_498452.2; Match level="QueryCoverage =67%, HitCoverage=55%, E-value=5e-80, Identity=44%"; Hit description =acetylcholine receptor (acr-21) [Caenorhabditis elegans] gb|AAF39790.2| Acetylcholine receptor protein 21
MDSLPLERLEDRSVFIVNNPPFSPHSLRLAWDPRMNGGIAKMKVPVEMIWKPDIILYNNAASEYLNEMSLSIAGIFKSSCELGKKDNLFKICAQFPLRFEDVRFYPFDFQNCLMKFASWSYDGTKIDIFSESTGDTSNYMVSTEWTLREVRATKNSVIYSCCPEPYYGTSFLCHSPPFPQRYPFIDVYLLLERKPLFFVIFSCLPCVLISVLVLLGFYMPSDSGEKVTLGITSLLSTTVFLMLVSEHLPPTADALPLIGIYYGVTIFIVSLQTAFTVFTVCPFECRFVWWLFLSFPTPLSHQLNIHHIGTNGPPVPRILQKLLFGRVSRLLLLNLEKQYHSINEHVNYFIGKQKKAEQREKKGEKNGEKWENGEGKTILNGSEFKVQFVADGSNSLLKAKKKRVSFTDDFNFYCHQQKNGALPSASATTVSLPTHRYGRRILSLISPVIPSHKHHPNCAKMRVATVSNIGKKRHRHKDQSSSNMGTMSPHSSAHRSRSPSALSTTGEEDVKQKGEENTVF

SEQ ID NO: 144135 - protein, 38 aa, Heterodera glycines; identical to SEQ ID NO: 130624
  Coding regions on vcDNA: vcDNA=SeqID_70558; Strand=-; Position=1-150

SEQ ID NO: 144136 - protein, 95 aa, Heterodera glycines
  Coding regions on vcDNA: vcDNA=SeqID_70559; Strand=+; Position=1 -57,293-433,820-909
  Homolog annotation: Hit_ID=CAE68383.1; Match level="QueryCoverage =92%, HitCoverage=62%, E-value=3e-28, Identity=53%"; Hit description =Hypothetical protein CBG14139 [Caenorhabditis briggsae]
MSVDQHNNHLNDMGPPPDPVLDHYSQFKDFAKTKRDRLEEARQFQYFKRDADELEIWILEKLQTAAEESFRDPTNLQAKIQKHDAFVAEVQVGNW

SEQ ID NO: 144137 - protein, 21 aa, Heterodera glycines
  Coding regions on vcDNA: vcDNA=SeqID_70560; Strand=+; Position=1-65
MAISFFSWGFDRELGTNICLL

SEQ ID NO: 144138 - protein, 19 aa, Heterodera glycines
  Coding regions on vcDNA: vcDNA=SeqID_70561; Strand=+; Position=1-59
TFAFSSLALLNTHTIFEML

SEQ ID NO: 144139 - protein, 19 aa, Heterodera glycines
  Coding regions on vcDNA: vcDNA=SeqID_70562; Strand=+; Position=1-59
TFAFSSLALPNTHTIFEML

SEQ ID NO: 144140 - protein, 25 aa, Heterodera glycines
  Coding regions on vcDNA: vcDNA=SeqID_70563; Strand=-; Position=1-77
IEKEKSYGRKIRSTTFRLTTFFPTP

SEQ ID NO: 144141 - protein, 107 aa, Heterodera glycines
  Coding regions on vcDNA: vcDNA=SeqID_70564; Strand=-; Position=1 -78,114-299,823-882
MQNFFLYRYAKFGGNYMDRKKVIWREIVRQKETKNHRKKDNVFLWHSLFIGTHLVFSDSVFKYWSWDWESPQEIISIPVRGLEENTARGNKFQEPEHREQITAATAL

SEQ ID NO: 144142 - protein, 53 aa, Heterodera glycines
  Coding regions on vcDNA: vcDNA=SeqID_70565; Strand=+; Position=1 -77,125-357
  Homolog annotation: Hit_ID=CAE71378.1; Match level="QueryCoverage =100%, HitCoverage=6%, E-value=6e-11, Identity=58%"; Hit description =Hypothetical protein CBG18282 [Caenorhabditis briggsae]
KVMNLGALVEEVIKQSQLLFVPDVQFIKKNIESLIDKYYLQRTDQNDEYEYIS

SEQ ID NO: 144143 - protein, 231 aa, Heterodera glycines
  Coding regions on vcDNA: vcDNA=SeqID_70566; Strand=+; Position=1 -366,418-436,982-1021,1071-1200,1245-1384
MENNQIITKRNNKKLEHEGCLYVFHMFNADRDVKFWRCEHQRDEFKCRGRIHTTLNDVVLKTVGEHTCNHSAANVVTQKIVSGIKRRAVETMEPPAAIRAHTLQQIATPVMAKIPTKNATKKLVKRDSDLFGHKQFYVILARRGKWVFPVLHNALRAKHPQSSINFCLFHLVRNMKSRLTDEQTRRFTTDAAFAQAVKMITSLAFVLLEDITPALAALEDHLPDELEGVLD

SEQ ID NO: 144144 - protein, 309 aa, Heterodera glycines
  Coding regions on vcDNA: vcDNA=SeqID_70567; Strand=-; Position=1-930
  Homolog annotation: Hit_ID=XP_345024.1; Match level="QueryCoverage =97%, HitCoverage=91%, E-value=4e-32, Identity=26%"; Hit description =similar to SPAC23A1.17 [Rattus norvegicus]
PAFQSLGTQPNSIFKHSGLNPPAFQSLGLNPPAFQSLGLNPTAFQSLGLNPPAFQSLGLNPPAFQSLGLNPTAFQSLGLKPPAFQSLGLNPPAFQSLGLNPPAFQSLGLNPTAFQSLGLNPPAFQSLGLNPPAFQSLGLKPPAFQSLGLNPPAFQSLGLNPPAFQSLGLNPTAFQSLGLNPPAFQSLGLNPPAFQSLGLNPPAFQSLGLNPPAFQSLGLNPTAFQSLGLNPPAFQSLGLNPTAFQSLGLNPPAFQSLGLNPTAFQSLGLNPPAFQSLGLNPTAFQSLGLNHQHSITGTHPTAFHHWDST

SEQ ID NO: 144145 - protein, 69 aa, Heterodera glycines
  Coding regions on vcDNA: vcDNA=SeqID_70568; Strand=-; Position=1 -94,185-241,587-645
MHAFCARAIYHRACQSKAKQQRCCFERIKGIESVHRLLEIYICNLSTILIKSVNRLLENIFAIYQHFEK

SEQ ID NO: 144146 - protein, 89 aa, Heterodera glycines
  Coding regions on vcDNA: vcDNA=SeqID_70569; Strand=+; Position=1 -132,192-327
MSQFSDDSQPPVLDGPYSPVGDGGGELMDDAPPLEDVMKRLPISVEPSDNNERKVQKEPSITHELDAELFNGNGFACLSAAQAEAGRFK

SEQ ID NO: 144147 - protein, 28 aa, Heterodera glycines
  Coding regions on vcDNA: vcDNA=SeqID_70570; Strand=-; Position=1-84
LFNRRVASVRGRRLKCRGTDSDEFDGRT

SEQ ID NO: 144148 - protein, 221 aa, Heterodera glycines
  misc_feature (6)..(6): Xaa can be any naturally occurring amino acid
  Coding regions on vcDNA: vcDNA=SeqID_70571; Strand=+; Position=1 -204,256-408,468-711
  Homolog annotation: Hit_ID=CAE57585.1; Match level="QueryCoverage =78%, HitCoverage=33%, E-value=6e-43, Identity=54%"; Hit description =Hypothetical protein CBG00564 [Caenorhabditis briggsae]
DSLSIXIAKHLKDIHFYNFYNFFKGGGTMDVSILWLNNAVFVTQAMAGNNRLGGQDFNERIQRMLLQKIREKTKIREKTRNELTNREDVQQLRLAVEEAKLRLTVMPETLISLDFRSIGHFEYFLTRQEFEHQNVDLFASLTRQEFEHQNVDLFASIVQPIQAALDDCDIGAQEVDEIVLVGGSTRIPRIRQIVGTFFGFLLSNNKYFQFQCYTFYRKSPN

SEQ ID NO: 144149 - protein, 97 aa, Heterodera glycines
  Coding regions on vcDNA: vcDNA=SeqID_70572; Strand=+; Position=1 -81,243-455
MTAALGHLLVACLGQHGNELVQRVLARHGQRRFDGTGELTELVLLANLSHVQRDASQRLDQFAQCEFDGVTENECQMEKRGKDPRSVLNNQIEMERR

SEQ ID NO: 144150 - protein, 503 aa, Heterodera glycines
  Coding regions on vcDNA: vcDNA=SeqID_70573; Strand=-; Position=1 -322,681-883,1085-1434,1698-1827,2187-2324,2581-2949
MPSCVRFRHSSGSEAEEESEAVKMADHRRVSAGAPKSVAGKGSRGDNRNASPAVNSQSPTVTSSLRLTEFVPSNGGERAEKQWKEVPKKVEYEVDAVEEAIRSLEQFDPSEFVSQQYKTDQTTKFNDGTAKQQQQQRNHKGGSPFIRTRVFLARAEPVQLHPTGSANSLPSPLPERRLSLPFSADHPFGLSSADQLLFSSCHPSLLPSALSSSGSATPTLGSLTSSQQLLPSLVEPAFSQSMDSINRTPRANSPSSSAFSASQQPPQAHNGVRRAVTFNDNTVQHFYTPCDGPPPDYSDSDEAMDDGGGSMADSEDGDEMANTDKRANTAAVEAELHRRIRIGRIGRVVGTHLSGRERGSPTEPTPSARPSRQNDVGHAEKLPKDCYKLVQWVYSLSVWRDLPRGGATSVFLPPSSGTVPFHAKMHPPPPPPAPFPQQRPSSPSSSLLNYYSSESIEDEQNNNNEDSFRNWATVPMNGSLTDRHGGQAKVEDRVISESRNDQR

SEQ ID NO: 144151 - protein, 257 aa, Heterodera glycines
  Coding regions on vcDNA: vcDNA=SeqID_70574; Strand=+; Position=1 -371,507-677,770-958,1025-1079
  Homolog annotation: Hit_ID=CAE58603.1; Match level="QueryCoverage =85%, HitCoverage=57%, E-value=2e-66, Identity=54%"; Hit description =Hypothetical protein CBG01770 [Caenorhabditis briggsae]
FPLLWSIPSVLNRLCRVVVPGGFPLNVEPSVFGAAMPATNSPQSSNLAEKATDSLLNGLQNTPAVTYEDLTVATDGFSPNKIVGRGGYGVVYRGVWKHTPVKIALLDTFFSGGHQTNSGEQQQRERIRQSLQELKTLAKFRHDNVLSLYGYSLDGPEPCLVYQFMSNGTLEDRLLCRNGTEPLGWAKKLSICGGVCRGLHFLHTINQMPIIHGDVKSANILLDKHFEPKLGDFGLSRYGQRDKRRDKRPMIASHVKG

SEQ ID NO: 144152 - protein, 44 aa, Heterodera glycines
  Coding regions on vcDNA: vcDNA=SeqID_70575; Strand=+; Position=1-193
IHSFGGPCRVPRGKQCWFVSSRHRTFWLVSNHCLTCQIGRVRMT

SEQ ID NO: 144153 - protein, 100 aa, Heterodera glycines
  Coding regions on vcDNA: vcDNA=SeqID_70576; Strand=-; Position=1 -206,468-561
MPLNETESPKIMPLNATESPQNQQLTYIELFHQNQHTLTMWLIMGGKCALSSVGILFNAILVATTVKSKKLYNTCNVLFALDSLFLALFQLNSLITLLIA

SEQ ID NO: 144154 - protein, 24 aa, Heterodera glycines
  Coding regions on vcDNA: vcDNA=SeqID_70577; Strand=+; Position=1 -61,659-672
MAQHPIYLWADDVPSEQGKIVSID

SEQ ID NO: 144155 - protein, 195 aa, Heterodera glycines
  Coding regions on vcDNA: vcDNA=SeqID_70578; Strand=-; Position=1 -18,87-656
MNHLNKQIDTNWPISKGKTEEQIDTNWPISKGKTEEQIDTNWPISKGKKAAKSESDSENEENEVKLMIVNQFIKKRDAFKMESDYKKENRNKKECEIAKELGTYRAKIFQWNREFEEKGQQKKKKKYSEKDEEKMKKIIEKFDEKRKKYEKKMKSEKINYQKIDDEIAKGLGVTRGKIYKWKSEIGIKKQKNKPK

SEQ ID NO: 144156 - protein, 24 aa, Heterodera glycines
  Coding regions on vcDNA: vcDNA=SeqID_70579; Strand=-; Position=1 -47,275-302
MQQNYKAIRQLQTFVRCRFFFNII

SEQ ID NO: 144157 - protein, 342 aa, Heterodera glycines
  Coding regions on vcDNA: vcDNA=SeqID_70580; Strand=+; Position=1 -233,871-1666
  Homolog annotation: Hit_ID=EAL47341.1; Match level="QueryCoverage =86%, HitCoverage=38%, E-value=7e-15, Identity=28%"; Hit description =actin, putative [Entamoeba histolytica HM-1:IMSS]
MGKSFIKSEQSIGNEKEMTKFSLDVQIKEEIKNEVKLERLVKEIKNEQSEQMDEIGGKKRKKDEEETETEQDSSSSSSDETAEADEFDNDEQKRKLMILKEYDIRRKEWKLKNGIKKENRYKIEAEIANGLGTNRDKIYQWKRENVPTYRKRSDEAKRKTIEEFEKMKIESKNKWEKEKAKVGGQIAKEMERKIQKWKREMQNGEMKLEMAKEFGKRKRALEQKKYNEFEQEIAKKLGTNRCSIYQWKRELKLGNVLQMSSEWGDPKGGSVQGKGQGMCRGLGQGFSEGNGKGMNQGNGKGCAEGVDKGVAKGMAQGVAKGCANGLANGMAKGVAKGRLSNE

SEQ ID NO: 144158 - protein, 47 aa, Heterodera glycines; identical to SEQ ID NO: 139606
  Coding regions on vcDNA: vcDNA=SeqID_70581; Strand=+; Position=1-143

SEQ ID NO: 144159 - protein, 124 aa, Heterodera glycines
  Coding regions on vcDNA: vcDNA=SeqID_70582; Strand=+; Position=1-375
MVNISINIGSIFFFAFATSLCGGKPNDDKNAAYSSSVPSETENPKNEESKKNLVIITDMGADDQFTLEMISATELAGKVLAIGTTEKGRKAALSQSLGFEKVPVYVRSSGEEFEKMLFMNPKAE

SEQ ID NO: 144160 - protein, 44 aa, Heterodera glycines
  Coding regions on vcDNA: vcDNA=SeqID_70583; Strand=-; Position=1 -21,422-532
MKIIVLLNLYDFHYSKYLELVVQILESQPKFQQRLREMNEHDIK

SEQ ID NO: 144161 - protein, 43 aa, Heterodera glycines
  Coding regions on vcDNA: vcDNA=SeqID_70584; Strand=+; Position=1-129
MDMDKILSDMRQHISNLQDKLHVANSAVSKGQIVNEKITLMKE

SEQ ID NO: 144162 - protein, 280 aa, Heterodera glycines
  misc_feature (35)..(35): Xaa can be any naturally occurring amino acid
  misc_feature (47)..(47): Xaa can be any naturally occurring amino acid
  misc_feature (57)..(58): Xaa can be any naturally occurring amino acid
  misc_feature (134)..(134): Xaa can be any naturally occurring amino acid
  misc_feature (150)..(150): Xaa can be any naturally occurring amino acid
  misc_feature (169)..(169): Xaa can be any naturally occurring amino acid
  misc_feature (274)..(274): Xaa can be any naturally occurring amino acid
  Coding regions on vcDNA: vcDNA=SeqID_70585; Strand=+; Position=1-857
  Homolog annotation: Hit_ID=BAB33421.1; Match level="QueryCoverage =96%, HitCoverage=96%, E-value=1e-84, Identity=63%"; Hit description =putative senescence-associated protein [Pisum sativum]
KNIAILPRRDSDLEAFSHNPSDGSFAPLVYRPSTXTKCLNLRFLSYXAGLLLATGLXXGKTNLSHDGLNPAHVPYWWVNNPTLGEFCFAMIGRADIEGSKSDVAMDAWPPQASYPCGNFSDTSCWKLYTLKDRXATLSRSVFVLKIRIKXAFAFLLYERFPSSLSSPYXHLRYALTDVPPQSNSPPDTVIGACRRARVCRLMTQMGTRALPFYRLGIESMKAHDISLGPCRSHLCYTSHDSSQSRTIAELNRFFFPARFAKAVPLAEVSLDSIXVPWKSR

SEQ ID NO: 144163 - protein, 561 aa, Heterodera glycines
  Coding regions on vcDNA: vcDNA=SeqID_70586; Strand=-; Position=1 -346,709-2048
  Homolog annotation: Hit_ID=NP_510671.1; Match level="QueryCoverage =83%, HitCoverage=46%, E-value=4e-77, Identity=36%"; Hit description =predicted CDS, endonuclease/exonuclease/phosphatase family and RNA -directed DNA polymerase (XR69) [Caenor
MLIEFMNQKQLKQHVKEPTRENTILDLVMTSESELINELIVLEHFSTSDHKMAGFKIKEKFRRNNPSVYRRDFKNINFSKLSQAILENRIDLSINSVYTADQKYKEFLNKVLKLYENSVVNGSLTQSAQNKTKLSDIELNAGIIWNILRKLPRRNSTSPDNIPYILLKNCAEPITKILADIFRLALDSGQIPEIWRTSLVVPIFKKGEKTDPLNYRPVSLTSTVCRVFERILSSKILEFLNGIRFFDKEQFGFLKNRSTTTQILKTMDDIYNSLQKDQQIDIIYIDFVKAFDSVPIDLLLQKIKKIGIEGKIYKFLTNFLKNRSFKVKIGEVLSESFSIFSGVPQGSVLGPLLFLIFINDLPSFIANEASSVGIKMYADDVKLYYAHENDDKTNHLDKAIEALEKWSKINGLEISTGKCFVLYLGKNNMKKDYLINSKKISESDNVRDLGIIIDSKLHFSGHINKIVRNAYLRVFQILRVLKTREIKTLTTAYKTFVRPQLEYATEVWNPNLKKDIDKIERVQKFFTRKAFRKCGFLYKKYKERLKITDLHKLEERRKIND

SEQ ID NO: 144164 - protein, 43 aa, Heterodera glycines
  Coding regions on vcDNA: vcDNA=SeqID_70587; Strand=-; Position=1-348
PEKMPTLVVFKIFEILTFSLIIYYFAKLIHKYFLERALKRTKC

SEQ ID NO: 144165 - protein, 34 aa, Heterodera glycines
  Coding regions on vcDNA: vcDNA=SeqID_70588; Strand=-; Position=1 -60,289-333
MKEEEKGILYENDSFLFIHLLDLYGYLDGYFAQF

SEQ ID NO: 144166 - protein, 70 aa, Heterodera glycines
  Coding regions on vcDNA: vcDNA=SeqID_70589; Strand=-; Position=1 -42,408-486,543-632
  Homolog annotation: Hit_ID=NP_509322.2; Match level="QueryCoverage =78%, HitCoverage=16%, E-value=3e-19, Identity=74%"; Hit description =enhanced Susceptibility to Pathogens ESP-2, SAPK/ERK kinase, mitogen- activated protein kinase kinase, med
PKLYEGKDEPHSQRPPERIEGESKEAYGVQADVWSLGITLVEIANGRHPYGKWKTPFEQLKQVIQEPAPT

SEQ ID NO: 144167 - protein, 219 aa, Heterodera glycines
  Coding regions on vcDNA: vcDNA=SeqID_70590; Strand=+; Position=1 -91,597-662,1121-1431,1920-1940,2380-2550
  Homolog annotation: Hit_ID=CAE68087.1; Match level="QueryCoverage =83%, HitCoverage=26%, E-value=6e-19, Identity=36%"; Hit description =Hypothetical protein CBG13722 [Caenorhabditis briggsae]
TLAAKRGVPSVVRRMPRCIMACWPAWDAKFEERNSCRFCRLQKCLEVGMDPAAVRPDRDFSGQQQLLTRRLSLSAGGGTTTAITPTTSSSSNTTNNNNNTRNATGAGGTNRREKRRVRQTTALGNNGGAGGNKAAPGEDGRNGQRMPVEMRTMLMTLQNIEAKIRYEPYRMARNEELCVIVYRRLIAAIDWVELLAERMGGLSTEDRIALVNQSIIEYF

SEQ ID NO: 144168 - protein, 42 aa, Heterodera glycines
  Coding regions on vcDNA: vcDNA=SeqID_70591; Strand=+; Position=1-232
RKFNLTFANFNLLFQNFLAFYFLNPEKIFYDDFSDPEIKNSF

SEQ ID NO: 144169 - protein, 128 aa, Heterodera glycines
  Coding regions on vcDNA: vcDNA=SeqID_70592; Strand=-; Position=1 -359,468-567
  Homolog annotation: Hit_ID=EAL47145.1; Match level="QueryCoverage =95%, HitCoverage=75%, E-value=1e-11, Identity=27%"; Hit description =transcription initiation factor TFIID, putative [Entamoeba histolytica HM-1:IMSS]
MQKPIIVNIIALANLGTGIKLNSLTITECEFKYNPRKFNAAVIKCISPIKATALLWESGKMICLGTKSLIDCENAIKKFIEIIKGSGCPGASYTGLNFKRGKSMTALIFWTGKVVITGTKNNSEIEEM

SEQ ID NO: 144170 - protein, 169 aa, Heterodera glycines
  Coding regions on vcDNA: vcDNA=SeqID_70593; Strand=+; Position=1 -262,357-491,537-646
  Homolog annotation: Hit_ID=NP_608379.1; Match level="QueryCoverage =95%, HitCoverage=18%, E-value=1e-11, Identity=31%"; Hit description =CG17068-PA [Drosophila melanogaster] gb|AAF50925.1| CG17068-PA [Drosophila melanogaster] gb|AAL13977.1| L
MPSSMDRMKHLLSTGEHSDVHFLVGDGDAKEASLIKNKNLILFFNCNFINYPRFLKVLPAHQLILKSASDVFEAMFRFDAKKERPENVSGNCPDVVEIPDIEAEAFKVMLSFIYTDDLSDLNGDNAMAVLYAAKKYNIPDLVDRSLQIPISELRNVFFAYAQALLFDLE

SEQ ID NO: 144171 - protein, 173 aa, Heterodera glycines
  Coding regions on vcDNA: vcDNA=SeqID_70594; Strand=-; Position=1 -210,354-497,550-676
  Homolog annotation: Hit_ID=NP_496573.1; Match level="QueryCoverage =98%, HitCoverage=42%, E-value=7e-37, Identity=45%"; Hit description =related to bicoid interacting protein (2M394) [Caenorhabditis elegans] emb|CAA19465.1| Hypothetical prote
LFDTLLSLGQSGGFEHIFFILIAANSKNIQLARAFQPRRVLGVDIDSHLVGAARKNIRHFCDKDTKMSGKFPASFGANFGPISASTSDGPHFPDNVLFLCENYVLPSDAALETVHEEFDIIFALACSKWVVHEEFDIIFALACSKWVHLNWGDAGIKRLFLRAFRQLRTGKKL

SEQ ID NO: 144172 - protein, 300 aa, Heterodera glycines
  Coding regions on vcDNA: vcDNA=SeqID_70595; Strand=+; Position=1-900
  Homolog annotation: Hit_ID=AAL27282.1; Match level="QueryCoverage =97%, HitCoverage=70%, E-value=1e-15, Identity=33%"; Hit description =spore wall protein 2 precursor [Encephalitozoon intestinalis]
MAQAIPEEIRSVSSPPEMQPEREKSKLSVGETQPKREKTILKEIQLKKEKTKLALEEIQLKKEKTKLALGKTQPNWEKTKLATEETQPKKEKAILEEIQPKKEKTKLALRRNTIEEEKDKIGTRRNTAEERKEKIATGRNTFGEAKGNSGRNTAEEGKDKIVSGRNTAEEGKDNSEKNTAVEGKDKIGTGRNTTEEGKDKIGIGKNTTEEGKNNSGRNTIGEKSGINSTGDSGRNTAEEGKDKIGNGRNTAEEGKGNSGKNTLGGKTGRNTIEDGTGESGRNTVGVESARNAAGEGTDNI

SEQ ID NO: 144173 - protein, 111 aa, Heterodera glycines
  Coding regions on vcDNA: vcDNA=SeqID_70596; Strand=-; Position=1 -210,305-428
  Homolog annotation: Hit_ID=XP_313653.1; Match level="QueryCoverage =100%, HitCoverage=85%, E-value=3e-16, Identity=45%"; Hit description= ENSANGP00000013128 [Anopheles gambiae]
MTYQMYRSTTLGTALQSAIFSALLTLPKTFVFPFKGSLDELIADGMISQQLAGTVMTTFDKCINKALSERAEKLRAYRFCDNVWTFMMEHVEFKDTQRPIDGVIDRVKFVA

SEQ ID NO: 144174 - protein, 68 aa, Heterodera glycines
  Coding regions on vcDNA: vcDNA=SeqID_70597; Strand=-; Position=1 -52,99-252
RDPSLHPAKRMPSTVECQNSQPICSGSEPWPSSSSPLSSSLREGSTKQSSIESDAGCVASSPRPFCAN

SEQ ID NO: 144175 - protein, 228 aa, Heterodera glycines
  Coding regions on vcDNA: vcDNA=SeqID_70598; Strand=-; Position=1 -135,242-310,366-401,448-477,528-615,671-730,806-883
  Homolog annotation: Hit_ID=CAE63605.1; Match level="QueryCoverage =87%, HitCoverage=17%, E-value=3e-32, Identity=41%"; Hit description =Hypothetical protein CBG08096 [Caenorhabditis briggsae]
KSNGKLSAYSSFTIPYTTTQKYGTTHRGEQNFCKLLNCDLTNACHYLNHGLTKVPWTLRTKGYGFPLNRHTDLRPAFPLNRHTDLRPASTNGQFVSSTNGQFVSTVLGPGDFAILESPRFNLSDGINVTVLGPGDFAILESPRFNLSDGINVLLFQYFRPTHSSTIRLCLGTRPTHSSTIRLCLGTRYAKPLRTVSAFLQCPTVSAFLQCPPILRSITSKHSPAKWNS

SEQ ID NO: 144176 - protein, 80 aa, Heterodera glycines
  Coding regions on vcDNA: vcDNA=SeqID_70599; Strand=-; Position=1 -72,421-590
FNCCLAGPVLKAHPALSQGPSGPAIIHLDLKSDNMLFVKKKEGGGIEIEMLKVIDFGGSEFIKENMESTLDERQVANVCK

SEQ ID NO: 144177 - protein, 218 aa, Heterodera glycines
  misc_feature (15)..(15): Xaa can be any naturally occurring amino acid
  misc_feature (24)..(24): Xaa can be any naturally occurring amino acid
  misc_feature (61)..(61): Xaa can be any naturally occurring amino acid
  misc_feature (111)..(111): Xaa can be any naturally occurring amino acid
  misc_feature (136)..(136): Xaa can be any naturally occurring amino acid
  misc_feature (152)..(152): Xaa can be any naturally occurring amino acid
  misc_feature (177)..(177): Xaa can be any naturally occurring amino acid
  misc_feature (181)..(181): Xaa can be any naturally occurring amino acid
  Coding regions on vcDNA: vcDNA=SeqID_70600; Strand=-; Position=1-673
  Homolog annotation: Hit_ID=T02995; Match level="QueryCoverage=99%, HitCoverage=40%, E-value=3e-44, Identity=53%"; Hit description =unspecific monooxygenase (EC 1.14.14.1) - common tobacco dbj|BAA10929.1| cytochrome P450 like_TBP [Nicotiana t
VVFHWRLAAPTSPLXMIFYKSNLXGSSFPAKFAKPVPLAVVSLDSRYGQGISLSIRAVGSXPTRHLATLRESCYSPVYPRLFKFPWLNIQSTGQKSDTVNVHKDHPSPLFXLDSRIPRVRFFSKLVVQRQPKCIPXRAYTQLKRSTSSSHHXSTHHPRRNSKQPRAKAACFTQQPGXPDLXSQFFSRSYESNLPTSLTYIILSTRGCSPWRPAADIGT

SEQ ID NO: 144178 - protein, 15 aa, Heterodera glycines
  Coding regions on vcDNA: vcDNA=SeqID_70601; Strand=+; Position=1-46
MRCGGGDISQVTKYI

SEQ ID NO: 144179 - protein, 56 aa, Heterodera glycines
  Coding regions on vcDNA: vcDNA=SeqID_70602; Strand=-; Position=1-186
RNIPLVSNQPSVRLLPYYRSQQTLRLGREITACRANSERQEKNMHIYFMLRLGMTL

SEQ ID NO: 144180 - protein, 68 aa, Heterodera glycines
  Coding regions on vcDNA: vcDNA=SeqID_70603; Strand=+; Position=1 -109,233-330
MNYLRIMVYLKIQTPVGRGPAFLVSAEKPYLLYFNLLITVLGRSTKKLSVGDPQKISVWAIHKKLSDR

SEQ ID NO: 144181 - protein, 444 aa, Heterodera glycines
  misc_feature (101)..(101): Xaa can be any naturally occurring amino acid
  misc_feature (202)..(202): Xaa can be any naturally occurring amino acid
  Coding regions on vcDNA: vcDNA=SeqID_70604; Strand=+; Position=1 -184,223-1133,1178-1274,2057-2167
  Homolog annotation: Hit_ID=NP_503721.1; Match level="QueryCoverage =98%, HitCoverage=85%, E-value=1e-61, Identity=33%"; Hit description =transposase family member (5D107) [Caenorhabditis elegans] ref|NP _503720.1| transposase family member (5D
KENEGTPAKDKKRNRNNDSVKKLEAVECARKNSTCSSNEVKVDRKQINDWMTHEDKLRKQIMTPNGGKRMRMTPNGGKRMRLEGAGRPVQHPEIDIALAEXIAEKRKNKQLVSRNIIRRRAASLFIDIDIKVKTATYTTSQKPPSNYAEAVAKFINFVEQRRKAKNNFPGGIFAMDETAVWFDCPDNRCIDMKGAKDVISFXKLFRAISSNVTVVATGHEKMRVTVCLTARSHKLKPYVLVNRKRPVPQIINQFAGKLVINFDGSVWMNDDTTEDYLHKSGQSFVGERLLIWDAFGSHKSEKTTKVVKGLGVETVFVPGGCIKFIQVKASFSMKFTFFPRLPMSFMVLDWIHRSWQEISKEVIIKSFEVCGLTTPLCGLTTPLDGTEDEKIACFKPEGAIGPIGIKFLTTNLVMNPLQLLLVDVGVDGSQPEQVHSGPTLMNTT

SEQ ID NO: 144182 - protein, 340 aa, Heterodera glycines
  Coding regions on vcDNA: vcDNA=SeqID_70605; Strand=-; Position=1-1022
  Homolog annotation: Hit_ID=CAD26968.1; Match level="QueryCoverage =99%, HitCoverage=99%, E-value=2e-79, Identity=43%"; Hit description =transposase [Meloidogyne chitwoodi]
QKMDKIRLRQLLLFEFRKNSTPTQALRNICESEGNDALSLSTVKRWFTKFREGNEQLEDEPRSGRPPALDSDDLEQHVQQHPCSSSRQLAAEFGVHQTTVLNYLHQLGFINKKGAEVPHALTQQQKHQRVVTCTELLARLSAGMQLSQLITCDEKWVYLNNNGIKQWLKPNELGEPTPRRLQHAPKVLLCIWWCSSGLVRYELVPAGQTINADIYQQQLQRVHDQIRRPPFSAKFRGGVLLHDNARPHVAFSTQQKIEKLRWAVLPHPPYSPDISPCDYYLFRSMEHFLRGKEFADQNEVENALDDFFGSKNDQFYKKGIEMLPERWGRIIDQNGEYIID

SEQ ID NO: 144183 - protein, 24 aa, Heterodera glycines
  Coding regions on vcDNA: vcDNA=SeqID_70606; Strand=+; Position=1 -65,320-329
MVSDDTHRMGDIPAAWLPGVSGKT

SEQ ID NO: 144184 - protein, 140 aa, Heterodera glycines
  Coding regions on vcDNA: vcDNA=SeqID_70607; Strand=-; Position=1 -134,233-278,584-826
  Homolog annotation: Hit_ID=CAE57235.1; Match level="QueryCoverage =57%, HitCoverage=20%, E-value=5e-16, Identity=52%"; Hit description =Hypothetical protein CBG00112 [Caenorhabditis briggsae]
MVALFFCCWAPTVLFNFLRDNQWLPIFVLSQEYLFGIITHCISMSSTIWNPVLYALLNEQGILLFQFRAAFSEQFNQLRHRFCSPCNGGMTTARTRLPTIDSSAQQHRNSIRKVALPSPSFVQAVPAVAQRSKLHAERSE

SEQ ID NO: 144185 - protein, 69 aa, Heterodera glycines
  Coding regions on vcDNA: vcDNA=SeqID_70608; Strand=-; Position=1 -131,226-304
MNVPFARYLATKNIAKKNTVSKCQFLEGATREGGKSSLLGIQPMVIKICRSLQNKHRLYRRNVRCLRSV

SEQ ID NO: 144186 - protein, 124 aa, Heterodera glycines
  Coding regions on vcDNA: vcDNA=SeqID_70609; Strand=+; Position=1 -165,299-508
MQYNAFKPRREAGQLQNFVPHFTVESPSTLLDNYVSMSTVAFGQLWNGKMGISDGLLIMQYNAFKPRREAGQFQNFVPHFTVESPSTLLDNYVSMSTVAFGQLWNEKMGISDGVRSFLKIPLFV

SEQ ID NO: 144187 - protein, 74 aa, Heterodera glycines; identical to SEQ ID NO: 132339
  Coding regions on vcDNA: vcDNA=SeqID_70610; Strand=-; Position=1-391

SEQ ID NO: 144188 - protein, 41 aa, Heterodera glycines
  Coding regions on vcDNA: vcDNA=SeqID_70611; Strand=-; Position=1-133
PSLPFVHYFVSKLNHFFWLFEINCEKYTKIIFGFNYAVQCF

SEQ ID NO: 144189 - protein, 111 aa, Heterodera glycines
  Coding regions on vcDNA: vcDNA=SeqID_70612; Strand=+; Position=1 -159,288-464
MDVNEIVPFKSKYLTHYLAYHPVIKETSKTTLDLEDKKGKFEKLCKELTENAYKIESSENAKNKQDSLIKWNIENDDLTISIKIPTITNGTIKRNVIHFANNFIQWDGFHP

SEQ ID NO: 144190 - protein, 239 aa, Heterodera glycines
  Coding regions on vcDNA: vcDNA=SeqID_70613; Strand=-; Position=1 -291,345-773
  Homolog annotation: Hit_ID=NP_496388.2; Match level="QueryCoverage =92%, HitCoverage=23%, E-value=3e-11, Identity=30%"; Hit description =putative protein, with a coiled coil-4 domain (2L422) [Caenorhabditis elegans] emb|CAA93261.2| Hypothetic
QSGESDHFAGKVQFKGQNKRKPGQSDESDHFAGKIQFKGQNKRKPGQSDESDHFAGKIQFKGHNKRKPGQSDESDHFAGKIQFKGQNKRKPGQSDERQSDESDHFAGKIQFNGHNKRRPGQSDESDHFAGKIQFKGHNKRRPGQSDESDHFAGKIQFKGHNKRNPGQSDESDHFAGKIQFNGHNKRRPGQSDESDHFAGKIQFNGHNKRRPGQSDDSDHFAVKMQFKGHNKRNPGQSDD

SEQ ID NO: 144191 - protein, 83 aa, Heterodera glycines
  Coding regions on vcDNA: vcDNA=SeqID_70614; Strand=+; Position=1 -174,766-843
MTTALLWDFYMEKREALASIQQFDYDTNKLGIRLGLVSTSDVAMDEDSDGDDGRPTERGTLTTEYANIYGHGIPFSNFFQASE

SEQ ID NO: 144192 - protein, 37 aa, Heterodera glycines
  Coding regions on vcDNA: vcDNA=SeqID_70615; Strand=-; Position=1 -38,162-237
MSKKRIEWTTIPTKNHLPKLKNAYDLAKLGYLSAMIK

SEQ ID NO: 144193 - protein, 54 aa, Heterodera glycines
  Coding regions on vcDNA: vcDNA=SeqID_70616; Strand=+; Position=1 -128,275-311
MLQFHCIWPSKVKGAVKEGVGYFVKGAKQRITDYARETFMYDMYNKTVRDSKRC

SEQ ID NO: 144194 - protein, 49 aa, Heterodera glycines
  Coding regions on vcDNA: vcDNA=SeqID_70617; Strand=+; Position=1-149
MERMVRVKKKDEDIGEQERQMILKGLAVLSEEKLRCHRCSRVDLSVAEA

SEQ ID NO: 144195 - protein, 26 aa, Heterodera glycines
  Coding regions on vcDNA: vcDNA=SeqID_70618; Strand=+; Position=1-81
KSIKNLKMRIHARFSGNKLNWALLSC

SEQ ID NO: 144196 - protein, 19 aa, Heterodera glycines
  Coding regions on vcDNA: vcDNA=SeqID_70619; Strand=-; Position=1-70
NRTLTDDLMEKNPRRREFN

SEQ ID NO: 144197 - protein, 93 aa, Heterodera glycines
  Coding regions on vcDNA: vcDNA=SeqID_70620; Strand=+; Position=1 -120,281-442
MYIGLSGTGTGTGTGRQLPVFLVPVPAQIPPISTMKLRLEDKIFLWMFLDRSAVNIYQIKYENSNAKPPLQFRRTAKIGIASLSNGQRRTTCR

SEQ ID NO: 144198 - protein, 67 aa, Heterodera glycines
  Coding regions on vcDNA: vcDNA=SeqID_70621; Strand=-; Position=1-205
CLPLGYSPDSVQFQQQLKNGVGITSAAAAATVPINAENKGFKLLKGMGWAEGQGLGKHSQGIQAPEG

SEQ ID NO: 144199 - protein, 146 aa, Heterodera glycines
  Coding regions on vcDNA: vcDNA=SeqID_70622; Strand=+; Position=1-439
NGLSKNRNYAQKASQTILALPIPSTIAFIHPIMSAKIIRVPKIACDLSLEKNGLSKNRNYAQKASQTILALPIPSTIAFIHPIMSAKIIRVPKIACDLSLEKNGLSKNRNYAQKASQTILALPIPSTIAFIHPIMSAKIIRVPKIA

SEQ ID NO: 144200 - protein, 91 aa, Heterodera glycines
  Coding regions on vcDNA: vcDNA=SeqID_70623; Strand=+; Position=1 -67,381-589
MTNFAILESHFQQLMVQWELRCALNCLFPQMLITVKEVTLVLKKRMQQKTPPREWYDQCAELEDKMMGQIEKKREKREKAKSWKLREMDDE

SEQ ID NO: 144201 - protein, 48 aa, Heterodera glycines
  Coding regions on vcDNA: vcDNA=SeqID_70624; Strand=-; Position=1 -58,436-510,1508-1521
MALIRTTARAWHCPTKRSNAVDGHVRCVHERLQVLRAVADQPIGVIIA

SEQ ID NO: 144202 - protein, 102 aa, Heterodera glycines
  Coding regions on vcDNA: vcDNA=SeqID_70625; Strand=-; Position=1 -137,855-1026
MNSAEGFVSNSRLFAVVATRRGTTVGQRVVRPRVRAQPGRALYLCRLEFGNIEWDPWALFLAPLLALVQAVHILLLKQAQLAFFAALGMPNGNNVPILWANN

SEQ ID NO: 144203 - protein, 169 aa, Heterodera glycines
  Coding regions on vcDNA: vcDNA=SeqID_70626; Strand=-; Position=1 -36,547-753,1934-2005,2967-3161
MNPVFLTVRLTKPRAVHANDEFTHHEGTVHINLFVFDPIAEGTEAKVEAQKLTLTVAHAFGTKKTEKEFDLPENFLPYQYEVLLHEQRVEITAKVADRVDTPPITKADEEIRVLEKVIADAQKAIADAQKVIADSQKAIADASARIEYWKEHRSTMVSFFYIFHFYPSD

SEQ ID NO: 144204 - protein, 100 aa, Heterodera glycines
  Coding regions on vcDNA: vcDNA=SeqID_70627; Strand=+; Position=1 -55,796-1043
MECQKLRIGRRNCAVAKRASNCLFYNAFPQMLITVEKVTLMLKKRVQLSWTEFVKTPPREELAWYDQCAELEDKMMGQIEKKREKREKAKSWKLREMDDQ

SEQ ID NO: 144205 - protein, 47 aa, Heterodera glycines
  Coding regions on vcDNA: vcDNA=SeqID_70628; Strand=-; Position=1 -69,887-961
MGMSVVFMSGFKYSELWLISRLEPHQFCALEHSKYFIASIVCFYIHT

SEQ ID NO: 144206 - protein, 223 aa, Heterodera glycines
  Coding regions on vcDNA: vcDNA=SeqID_70629; Strand=-; Position=1-671
MSSPIDAILGPKENADPEAGAKASKTKGSNKPKVSPANMAEIQTELGNAKEEILSAVSKYIGEAMSTVNRGMEGFTAAINQMANALDASRAREEMEQMSLDDPELEAVSVEAGETGKEPESPTEGENEQGEPHPGPKGISLPQEQSARERGRGTGHGRAFIRGRGGHGRGTATGAAAHARHYFNMRQGHRAHHQHHNHRHPAPGHCRCHDCQPPNHHFGRRFR

SEQ ID NO: 144207 - protein, 2221 aa, Heterodera glycines
  Coding regions on vcDNA: vcDNA=SeqID_70630; Strand=-; Position=1-6666
  Homolog annotation: Hit_ID=S08405; Match level="QueryCoverage=39%, HitCoverage=74%, E-value=1e-126, Identity=32%"; Hit description =hypothetical protein 2 - silkworm transposon mag
MDDHKGSDFNPNHFTTSQNRNWSPLLVQLRLFEATVCETVRKLIEKVEDIEKGNGKVGNCIVLEGKLELFGEMMRQMDKGIGEQLVGIETDLNLAQSKLTDLELTVDQISRRLDKGDESQTEMGRPNVTEIKVAAMRSKVVEIDGIVKENRERITFLEQKVLDENEEYFWNGHDNVDGENNFSINQNVEDEQNQGLTGECEVMISDPFLLSGSHLSQYDGNPSISFSRWAQKFKDLLSLYTAQLTEEQKISRLRFCLSGPARAELDSMDLPPVTLDAALGHLQSRFENENTKSIARQNLAICRQYPGEKVFDFATRLSEAVRTALAGETEGNIRKRLLEEFLDRLIPELQYEVKSERPTDYSRAYELAQHYELLQASRKSTSNVAMNELIEKVEALAMQNVRHAPNFSDQRDHRVCFYCKKAGHVIRDCAARRREANNGPNWRRDENSRRTERNGNYSRPFGQGYERNRETWRSGNSQQNSRSNQNYRRYRDQSGTRRECDQENRFPRTPTPRVNPRGGRIAGARVASPYFLAIIAILALFSPTSILANVPKRQPMICLPDAPSSLWKLPEEPICPTWQPTESPIPMELTIYRPNTLQYKTPATACKCVKSKIHRRVGVFGAPLEEVETENLDIPTSTCHRMRDLDHSPAGELSKNGTLRSTNHSLEVGWRVWPVGMFWHMTEVLNCYTYDTVVFTRYGVEGVSTPLNNCPGCQYKSGACRCQQNSMIWSPDPTQQCPFVWVAKWAGEYATKVWISGSNDFALTFENITVRQNCKNKEFAISDQGFSVPLEEYQELVRRRDLASRETVRLRRQLDEITQEATQARDKSPVGLIYSSQLSAQLTALSARLTHTTQRLFSEAIRQICTSLQSIADQTATLAIANPTLLARFFLSNQLITARLVTEKSLEIRPCFGVNVNEMHYNWKSGFCFNRLPVTFMIYGAQRHGFLDTVTLIIYPEAREIDCQSGRWLYIQGEKKLTQYDQVNGDIKEVPWETIHKIARYGNIDLPEIGFTVFKNKVMANLSELYSPEHFTETLEAAEIHHEIVRLTKPSGAWSENSAKPEFLAGNIVSNGLFSFLKGGIFSANQIWVFCVCCYVTIGAVMRFLLPPFLAELANQLNVGESLVRVTRTLQTTKRRKRELKRVAKENDQLQLARQSAIPLTQRWTNCNGAFTNGETQIAEVAVIELGRCDEDSRIGGIINGKKVIFLLDSGAHVTLIGLESAKRLGITKFYPPEVAGVTGIGPGVIPALGQAVVTLCIAGCQFETTAIIIPNEVSKRGLYQVILGRKTMRQLPLLLDLETGQLIKKDKITRECFISEKVEEPRKSNLMSRHKTDLQTKAELSKFFGLLQRNEDIFSKHDYDLGECTISAPPILTTTETPVYSRPYRVPEKYQTELDAHLEKMLKTGVLAESNTPWVSPVVIVQKSDGNLRPCVDFRALNRVTVTDPYPIPKMETVLHKVAGKAFYSTLDLAAGFWQIPLDKHTAHKCGIITEKGVYTMRKLPFGLKNSPAIFQRIMNEVLSDIGHTCAYIDDIIVYTDTFEEHMFILEKIFDRIRNFKLKLKPQKCEFCKSEIVYLGHKLNCKGYEPSISNKEVIQHFPEPGNVKEIKRFLGLVGFFRKFIPNYAAKAAPLTLLLRGKENDANFKWETEQQKAFLALKTELTKSPSLRPPNYKKEFHLFTDASQIAWGGALMQKDNEGTLYAVAYCSKILSQTEARYPPTHGELAAIVHAIGVFHPIFYGCDITIYTDHKPLTFLLSKGKTNPKLNRWLLIFQDINPKINYVEGKNNVVADALSRVVSTEGIKWDLVMEKHFREEIPYILTTEPFVIDKNIIENETVRDENLAKVIREIKDSWQSTTKEIEPYHKIRSELYLEGNIIRKTPTQIVVPGNLKIPILKGLHTAHFGMVKTKSKARKLFWWPGMSKDIEEFINGCEICQRNADLPPITDKGRKWPEAKLCMERIHADLAGPIWNTNFLIVVDSFSKYPWVYQMNSTNSHAIIMALGNIFSEFGAPITFVSDNGPQFVSEEIEKFLWENGTKHLKSPPYTPSSNGEAEKFVQTFKKGVKKILAERGEGRIKEALQIFLREYRSYPCISTMESPAQRMFKREIRTPLDRIWVRTEEKRKQMAQKEVPKIRDKQFELGDYVWANINKTWRPGMVVGKKGDVIYVVSVEGDESPDRPVHLHYLKPRRPALARGQQGITLNQPPEDVVSTPPEEEEGIQ

SEQ ID NO: 144208 - protein, 556 aa, Heterodera glycines
  misc_feature (432)..(432): Xaa can be any naturally occurring amino acid
  Coding regions on vcDNA: vcDNA=SeqID_70631; Strand=+; Position=1 -85,1305-1425,1473-1519,1562-1604,1672-1839,1941-2190,2269-2404,2448 -2527,2599-2799,3057-3169,3241-3429
  Homolog annotation: Hit_ID=NP_495685.1; Match level="QueryCoverage =98%, HitCoverage=92%, E-value=1e-88, Identity=38%"; Hit description =glucosyltransferase (57.9 kD) (2I333) [Caenorhabditis elegans] emb|CAA86666.1| Hypothetical protein C08B1
GLKKPEIWTKKAKNGQIWTKIWIKNAKICFECVPLTLVVLGHQSPPMFGDFEAQRHWMEVTVNLSPSEWYVNSTTNDLNYWGLDYPSEWYVNSTTNDLNYWGLDYPPLTAYHSWLPPLTAYHSWLLGQIALFVDPNWVRLGHSALFVDPNWVRLGHSRGLEEPRLKLFMRLSVILTMVALFAPALIHWYWVNNERRKPSLVGALVGAPLLFPGLLFVDCAHFQYNHCSLGLFLWALSFLEKGRLRTGAFFFVLALNHKQMELYHALPIAVFLFARSFVHTNRIRSFFNLFQLALAVLLTFLILWSPFLWPEPSLALQLLRRIFPFHRGLFEDKVANFWCCASVLVKFDKVANFWCCASVLVKFKQMFSINVLVNAFLVFAFLVFFACVPSLFCLFYRPNSSNLRVALTVNALAFFLFSFQVHEKSVLLAAMXVIQKMSKRQNVCDFFHFIFLFSLFPLCLKDGVAEVLPLFLAYSFLLWLQFFPLQLSVLLVLGLQLSVLLVLGPSFAICVFQLLLSPPVRFPHLFPLLNALFNFGIFTVFWLHLNFVIVRQNLAV

SEQ ID NO: 144209 - protein, 120 aa, Heterodera glycines
  Coding regions on vcDNA: vcDNA=SeqID_70632; Strand=-; Position=1 -140,201-423
  Homolog annotation: Hit_ID=NP_493773.1; Match level="QueryCoverage =100%, HitCoverage=12%, E-value=6e-27, Identity=50%"; Hit description= cation-chloride cotransporter-interacting protein 1 (104.4 kD) (2A906) [Caenorhabditis elegans] gb|AAB95
DMHHQELQLKAMLEQLRIKAKSVMVPWDHVVQHLDKPTKSSGGSSAADITDYSEKFVRAVNETIQRNSSSAAMCFLNLPLPPPTNSNKSEQYLSKLRLLTDALPPTLLVHGLASVISTAL

SEQ ID NO: 144210 - protein, 551 aa, Heterodera glycines
  misc_feature (23)..(23): Xaa can be any naturally occurring amino acid
  misc_feature (500)..(500): Xaa can be any naturally occurring amino acid
  Coding regions on vcDNA: vcDNA=SeqID_70633; Strand=-; Position=1 -191,304-402,455-544,676-765,807-893,941-1038,1126-1288,1339 -1434,1489-1685,1737-1860,1901-1997
  Homolog annotation: Hit_ID=NP_493773.1; Match level="QueryCoverage =89%, HitCoverage=42%, E-value=1e-139, Identity=55%"; Hit description= cation-chloride cotransporter-interacting protein 1 (104.4 kD) (2A906) [Caenorhabditis elegans] gb|AAB95
KTFLLRIKLKVKKQMPQNSSHFXAMVDISSVPSLIMLGIFVATFFSSMSNLIGASRVLTRFAQDKLFGALLRPATIEVGSKRNPIISVIISWICVVMVLMIGAMNRIAKITSILFMVLMIGAMNRIAKITSILFLLSYMGVNIATLALELTSAPNFRPNFKYFSWHSCALGAISTVVMMLIIDASMSAVAVVILMLGAISTVVMMLIIDASMSAVAVVILMLLIMILHYQAPIGSWGSISQALIYHQAPIGSWGSISQALIYHQVRKYLLLLDVRKEHVKFWRPQVLLLVNRPATCCSLMDFVNDLKKSGLYVVGHVQKGQMDAEGTTMDPLQQVYPYVYPYWLSLMDYLKLKAFVELTLAENVRNGIQQLIRLSGLGAMKPNTLIRLSGLGAMKPNTVVLAFHELDSSETALTEAHLLKDLKFSKIGRAEVVEYFNTNDVKKKSIFKVLQRLDGVEYVQIQRLDGVEYVQILNDVVNLNKNLCVARHFGPFEREFVLRXPFSERRFIDVWPSHLFKQSSERRFIDVWPSHLFKQSDDGKTNEDGMPTAPG

SEQ ID NO: 144211 - protein, 228 aa, Heterodera glycines
  Coding regions on vcDNA: vcDNA=SeqID_70634; Strand=-; Position=1-4,69- 352,396-456,519-671,720-869,1180-1214
  Homolog annotation: Hit_ID=XP_420618.1; Match level="QueryCoverage =96%, HitCoverage=32%, E-value=7e-19, Identity=30%"; Hit description =PREDICTED: similar to Hypothetical protein KIAA1223 [Gallus gallus]
MAVTSLWIAVNMLQLEMCRVLIAHGANVDLGSDASLTLLLACDKGSTEIGEAIVRTNFSSKFFAISVTLLVENGVNVNLGDSEGATPTMNTSRSGNTEILRFLLSHGANIDQMDNSGTRFALLNAAANGHLEVCRLLVDEWAADVNQQAIDGITALIGACIRGRLDITVFLIEHGAGIDHADMDGYNALMWAAKEKNIEITRHLLAIGANADHMGIDADKMLFKILKV

SEQ ID NO: 144212 - protein, 18 aa, Heterodera glycines
  Coding regions on vcDNA: vcDNA=SeqID_70635; Strand=+; Position=1-57
YREDTPEGFGLPHKSGRI

SEQ ID NO: 144213 - protein, 303 aa, Heterodera glycines
  Coding regions on vcDNA: vcDNA=SeqID_70636; Strand=-; Position=1 -85,125-260,374-1064
  Homolog annotation: Hit_ID=CAE71161.1; Match level="QueryCoverage =88%, HitCoverage=75%, E-value=4e-57, Identity=42%"; Hit description =Hypothetical protein CBG18017 [Caenorhabditis briggsae]
MPPGELVALENINLEILVRDCLGEDGPAGYEQTIKWLARYGLIANALTCPECQQHVASLVKYAQSPEGFIVKKIQVHLSLHQVMKLCYYWSVHPTSTMDAVMRETGVTRKDTIVDFYNFFRDLCQDWAIRKQEEGKLGGMGTVIEIDETKMYRAKYNRGRMLNRPYEWVFGMIERGTNRVRFFPVADRTAATLLPIIADNIEAGSTIVSDGWAAYGGINNMQQQYNHQWVNHQMYFVDPNNPQIHTQGIEATWRALKQSLKHLHGTTPDLLPTYLYQYAFRRYHSNIKIFQNILEEMRREYPV

SEQ ID NO: 144214 - protein, 25 aa, Heterodera glycines
  Coding regions on vcDNA: vcDNA=SeqID_70637; Strand=+; Position=1-75
MLAICPLSLLLFLLLIFRCFHAFLW

SEQ ID NO: 144215 - protein, 17 aa, Heterodera glycines
  Coding regions on vcDNA: vcDNA=SeqID_70638; Strand=+; Position=1-52
MEKACKIWRDYIDFSAL

SEQ ID NO: 144216 - protein, 222 aa, Heterodera glycines
  Coding regions on vcDNA: vcDNA=SeqID_70639; Strand=+; Position=1 -93,337-909
  Homolog annotation: Hit_ID=YP_103819.1; Match level="QueryCoverage =81%, HitCoverage=84%, E-value=9e-35, Identity=41%"; Hit description =lipoprotein, putative [Burkholderia mallei ATCC 23344] gb|AAU49900.1| lipoprotein, putative [Burkholderia
MSFDTDQKLPVKSPADQRREANAIRTLAFVGVTRTQVLSQVYGKGGAFRAVRQADGYGGGGGGASGGGAASSQPPAAGGYGAGGGAAGGAAPQGGAAGGTAPQGEAAGGAAPHGGAAEGAAPQGGAAGGAAPQGGAAGGAAPQGGAAGGAAPQGGAGGSAAPQGAAAGGTAPQGGVAGGAAPQGGAAGGAAGGAAPQGGAAGGAAPQGGEEEVLHHREELEE

SEQ ID NO: 144217 - protein, 173 aa, Heterodera glycines
  misc_feature (40)..(40): Xaa can be any naturally occurring amino acid
  misc_feature (60)..(60): Xaa can be any naturally occurring amino acid
  misc_feature (143)..(143): Xaa can be any naturally occurring amino acid
  misc_feature (166)..(166): Xaa can be any naturally occurring amino acid
  Coding regions on vcDNA: vcDNA=SeqID_70640; Strand=-; Position=1-521
  Homolog annotation: Hit_ID=AAS54628.1; Match level="QueryCoverage =97%, HitCoverage=42%, E-value=7e-39, Identity=47%"; Hit description =AGR138Wp [Ashbya gossypii ATCC 10895] ref|NP_986804.1| AGR138Wp [Eremothecium gossypii]
LPPAPPCGAAPPSPPWGAAPPAAPPCGAAPPAAPPAAPPXGAAPPATPPCGAVPPAAAPXGAALPPAPPCGAAPPAAPPWGAAPPAAPPCGAAPPAAPPCGAAPSAAPPCGAAPPAASPCGAVPPAAPPCGAAPPAAPPPAPXPPAAGGCEEAAPPPLAPPPPPPXPSAWRTG

SEQ ID NO: 144218 - protein, 133 aa, Heterodera glycines
  Coding regions on vcDNA: vcDNA=SeqID_70641; Strand=+; Position=1 -183,1021-1239
  Homolog annotation: Hit_ID=CAE62810.1; Match level="QueryCoverage =91%, HitCoverage=60%, E-value=2e-23, Identity=43%"; Hit description =Hypothetical protein CBG06986 [Caenorhabditis briggsae]
MVFPAPLVCLVPPEMPVGPGSQRKGVVPAHRDRSGRQDPRVSPEHPETRESKGSLASSKNRGPSGPPGQPGGNGNPGPPGPNGEPGPQGPPGDEGPAGTPGQPGNAGEQGKLGEGGKSGVCDHCSTPRTAPGY

SEQ ID NO: 144219 - protein, 87 aa, Heterodera glycines
  Coding regions on vcDNA: vcDNA=SeqID_70642; Strand=-; Position=1-573
IIFIQKIFFWVFGAVPLNRCAQIYGETESFRNSFTIACTLILRWIFAPHNCLSTPNGHLKKSIYFCFRGSPPEPMRPDLWRDRILRE

SEQ ID NO: 144220 - protein, 84 aa, Heterodera glycines
  Coding regions on vcDNA: vcDNA=SeqID_70643; Strand=-; Position=1-255
MPFPFDGGRSTTAERRAIRIGYKSRAKRVDGFCADTSARIGLNPLIIKRRFECASGECQCQHPPPKGSGDMRVRVQSERVCPTL

SEQ ID NO: 144221 - protein, 20 aa, Heterodera glycines
  Coding regions on vcDNA: vcDNA=SeqID_70644; Strand=+; Position=1-60
MRKRDSYFLVRNFFVCVSNI

SEQ ID NO: 144222 - protein, 51 aa, Heterodera glycines
  Coding regions on vcDNA: vcDNA=SeqID_70645; Strand=-; Position=1 -130,465-490
MPKELDEDQIEPIDGQRKEMAANGKAPRAIEFDRAKGLDKEEQKRRKQLNK

SEQ ID NO: 144223 - protein, 51 aa, Heterodera glycines
  Coding regions on vcDNA: vcDNA=SeqID_70646; Strand=-; Position=1 -34,220-341
MALKRIKFYRTKKSSHGISHFLKFGVPQTDTWKNRFFLVFRGSPPEPMGPD

SEQ ID NO: 144224 - protein, 64 aa, Heterodera glycines
  misc_feature (11)..(11): Xaa can be any naturally occurring amino acid
  misc_feature (13)..(13): Xaa can be any naturally occurring amino acid
  Coding regions on vcDNA: vcDNA=SeqID_70647; Strand=+; Position=1-194
SSVRLGYSNKXWXAKIQPPELSTGYREAIPEGFGLPINLGPSVRGDCPEKPKKIDFSKCPFGVL

SEQ ID NO: 144225 - protein, 23 aa, Heterodera glycines
  Coding regions on vcDNA: vcDNA=SeqID_70648; Strand=+; Position=1-98
KPKLFGLFKKELKIFKNFIHLPF

SEQ ID NO: 144226 - protein, 48 aa, Heterodera glycines; identical to SEQ ID NO: 136255
  Coding regions on vcDNA: vcDNA=SeqID_70649; Strand=+; Position=1 -94,185-237

SEQ ID NO: 144227 - protein, 87 aa, Heterodera glycines
  Coding regions on vcDNA: vcDNA=SeqID_70650; Strand=+; Position=1 -84,250-429
MGIGLAMAKPSCAIANCDRHAPCQRLYSVTGSSGKNRLLPKNVSPTHYYLFLILLLMLIVLLYEYWLLFCAHEKRLFLIFGVSFNFN

SEQ ID NO: 144228 - protein, 259 aa, Heterodera glycines
  Coding regions on vcDNA: vcDNA=SeqID_70651; Strand=+; Position=1 -717,766-828
  Homolog annotation: Hit_ID=NP_608540.1; Match level="QueryCoverage =95%, HitCoverage=65%, E-value=3e-46, Identity=36%"; Hit description =CG2839-PA [Drosophila melanogaster] gb|AAF51469.2| CG2839-PA [Drosophila melanogaster]
KEKKEEQRNDESKKEKGENEERKSKEEEKKERKSNQEEKKESDEEKEEEVNEEKKDESKKENEGVNDERKRNADEKKENREEKQEEKEEKRAKEEENKEESKEEKMGERKEDEKKNESKKEKEGENEEMKSKEEEKKESKEEKKEENNKKEKEGENEERKKSKEKEDNETREEKLEEKEERRAEEEEKKKEKNDEKVEEKNNNDSEEQKVKDKRKDKEEEKKKEKGGREKKTENGAEEESRRKEMGTNAGYLSANDEWD

SEQ ID NO: 144229 - protein, 79 aa, Heterodera glycines
  Coding regions on vcDNA: vcDNA=SeqID_70652; Strand=-; Position=1 -118,172-293
MCFKFLTRNRVVQRRCFERLHVFPDLEVPDSVRENINNRASPSPGSAEEINGVRCRRTRRLSSAFPPGRRLSQKLGRAY

SEQ ID NO: 144230 - protein, 256 aa, Heterodera glycines
  Coding regions on vcDNA: vcDNA=SeqID_70653; Strand=-; Position=1 -598,728-900
MSTNCDELGGQLPMPTNNGQSCDNFSKAIDKKKRETVEKFHKIKEKVKQMGKKHSTKEWNKIERKIAQKLGANKMKIYKWKSELGMMTNKNYSVEEKRIMLKQFDQIYAKLKMKLNGKLEGKKKKCQKIIAKHLGTNISSIYTWKKEIKDGKMVKNQKTDDEKREIVEKYLKVKIKFMQNGKHSQKEWKAFNAKIKQMFERKRFTIVEKMEIMKQYYLMKKETPKFSDVKIAELLNIELMSLIKYKSEFKEKVEMF

SEQ ID NO: 144231 - protein, 62 aa, Heterodera glycines
  Coding regions on vcDNA: vcDNA=SeqID_70654; Strand=-; Position=1 -21,285-452
MVMIMMVNGIGKTMPNEKQLASVFALIIPHGGLFFNHLVDWWIIGDWRINGDWGIIRANTVL

SEQ ID NO: 144232 - protein, 42 aa, Heterodera glycines
  Coding regions on vcDNA: vcDNA=SeqID_70655; Strand=+; Position=1-128
MNYESHHSQESPLCLFSYSTVFALIIPQSPLILQSPIIHQST

SEQ ID NO: 144233 - protein, 200 aa, Heterodera glycines
  Coding regions on vcDNA: vcDNA=SeqID_70656; Strand=-; Position=1 -45,143-700
MWPKARHRPPPLAGKNCEEAINDYWQRYREGKEYRERKKEEKMKKTGQRKRKVSGMATAAGEKEQKEEKKEDEKKGAEEELQQQLPINAGTEGTNEGKAEVGEETDGAETTEEAKKEMGSAPGEMVEDGTEGREDVCKKGNLESADVGLEVEKLKKMLRDSGQMATDNAPLPLPRWVKGCGAFKRKYKKIYDNMIKINNS

SEQ ID NO: 144234 - protein, 29 aa, Heterodera glycines
  Coding regions on vcDNA: vcDNA=SeqID_70657; Strand=+; Position=1 -5,548-632
MVKCSETHQILFTSYFRHSDAFSIKKGDE

SEQ ID NO: 144235 - protein, 55 aa, Heterodera glycines
  Coding regions on vcDNA: vcDNA=SeqID_70658; Strand=+; Position=1-286
MIGRAVRNRPFIFEGIFNFISLSQKNVYVFYLRNFIPHKSILQYETGGRVLQSPI

SEQ ID NO: 144236 - protein, 27 aa, Heterodera glycines
  Coding regions on vcDNA: vcDNA=SeqID_70659; Strand=-; Position=1-81
MVMDDQQQQQPKQMVPTPPPQQNSGQT

SEQ ID NO: 144237 - protein, 483 aa, Heterodera glycines
  Coding regions on vcDNA: vcDNA=SeqID_70660; Strand=+; Position=1 -583,734-1234,1837-2201
MIPTTILHRFNTLLLNRSTTKPYKDTFVLWTIALLIWDIEEQKMLALLQLNSVAKVHGLNSFWDQIKSLISETLRNPKSEQNACVLIKLSELFLIPKKALPNIARMASKWRKECEEKTERETALRRFVGSANGVLYKNWVSIVFQVCEKTKVGATVALMQKPGAKTRLKKVMGHRTPAEELLTENNLAHIYENDVFFDNDRLLEHYTFGMEKDVPLIERKSHKLGADVVVFMRWFERKSERHIGTEKLQLIIKYMDNQIYDPIFDQDEQQLDKLGTFLKTLFIDAKTFAEKIEGKNSGEEKQKVQKNIFKKWKLMVENADKNEQGNGDDKNGEMKEWICELHANEFLNLMENEEKHRSLKNILIRHGPKKVRENLLDFVNENVATNILNKLNTFEMVKGNKPKLILKLRQNGGELNKQKEEKEKEETENDQKKEEQEKVADDEQREGKREENWENANKFHWRIIGDEDDEFTLEKEGIEQKQK

SEQ ID NO: 144238 - protein, 37 aa, Heterodera glycines
  Coding regions on vcDNA: vcDNA=SeqID_70661; Strand=-; Position=1 -99,238-252
MVKQFFLLNFYEKTNSKGTSPAHSSFFLPLLVWRPDQ

SEQ ID NO: 144239 - protein, 19 aa, Heterodera glycines
  Coding regions on vcDNA: vcDNA=SeqID_70662; Strand=-; Position=1-59
TFSFSSLALPNTHTIFEML

SEQ ID NO: 144240 - protein, 19 aa, Heterodera glycines
  Coding regions on vcDNA: vcDNA=SeqID_70663; Strand=-; Position=1-59
TFAFSSLALPNTHTIFEML

SEQ ID NO: 144241 - protein, 19 aa, Heterodera glycines
  Coding regions on vcDNA: vcDNA=SeqID_70664; Strand=-; Position=1-59
TFSFSSLALPNTHTIFEML

SEQ ID NO: 144242 - protein, 19 aa, Heterodera glycines
  Coding regions on vcDNA: vcDNA=SeqID_70665; Strand=-; Position=1-59
TFAFSSLALPNTHTIFEML

SEQ ID NO: 144243 - protein, 19 aa, Heterodera glycines
  Coding regions on vcDNA: vcDNA=SeqID_70666; Strand=-; Position=1-59
TFAFSSLALPNTHTIFEML

SEQ ID NO: 144244 - protein, 19 aa, Heterodera glycines
  Coding regions on vcDNA: vcDNA=SeqID_70667; Strand=-; Position=1-59
TFAFSSLALPNTHTIFEML

SEQ ID NO: 144245 - protein, 24 aa, Heterodera glycines
  Coding regions on vcDNA: vcDNA=SeqID_70668; Strand=+; Position=1-80
RTLSNAVRQRSSKIYSMPQILCAG

SEQ ID NO: 144246 - protein, 73 aa, Heterodera glycines
  Coding regions on vcDNA: vcDNA=SeqID_70669; Strand=+; Position=1-222
MDLTLEQDREWYISFIRDNVPEHLTEADLSHEVHLGAFNLAMQMCHALSTTDLNPAPKDISFTRPFTPASTQR

SEQ ID NO: 144247 - protein, 75 aa, Heterodera glycines
  Coding regions on vcDNA: vcDNA=SeqID_70670; Strand=-; Position=1-375
LVSSQKSCQLKTAKKAEFSKFFISIFFYSSKFSVIFSRLIEPVKSFRMISRLFDSVNNFKSYIDSKLAQTELARS

SEQ ID NO: 144248 - protein, 69 aa, Heterodera glycines
  Coding regions on vcDNA: vcDNA=SeqID_70671; Strand=-; Position=1-211
VHARQSIFRSLCIILCLQFCGWTFGQLTYAFVYMNAPLMHPLTRWQINSMLLVFLSLTAALDVPVLYIN

SEQ ID NO: 144249 - protein, 36 aa, Heterodera glycines
  Coding regions on vcDNA: vcDNA=SeqID_70672; Strand=-; Position=1 -78,334-366
MKKITFLNSLILLDCSRVSRTQFVLSMIFIYLIKEN

SEQ ID NO: 144250 - protein, 184 aa, Heterodera glycines
  Coding regions on vcDNA: vcDNA=SeqID_70673; Strand=-; Position=1 -271,351-633
IDDKAFLAFVKGQSNFEHFCIQEKDNYLFDKGLPKSVTFDQRKEHLAQRYGAHLGTVQLMREHWHCAKLGKHLESIRRRNAKNTENIWTFYDEQPQGLMPLLIRNIENFGTLIDFVKQLNRIAKFYFDAKFSRYNQYKIENAFKFKNSVISMQNFEQIFKAANYGGGNAKNDGESQLIKAQLTK

SEQ ID NO: 144251 - protein, 235 aa, Heterodera glycines
  Coding regions on vcDNA: vcDNA=SeqID_70674; Strand=+; Position=1 -71,120-195,305-434,482-525,570-630,682-821
  Homolog annotation: Hit_ID=NP_871932.1; Match level="QueryCoverage =95%, HitCoverage=36%, E-value=9e-60, Identity=56%"; Hit description =glycine dehydrogenase (2G343) [Caenorhabditis elegans] gb|AAO38610.1| Hypothetical protein R12C12.1b [Cae
VFNDLEKWLCELTGYDAFSLQPNSGANGEYAGLLGANGEYAGLLAIRKYFEAKGETQRKICLIPISAHGTNPATAHMSNFRVVPVESDKHGNINYKDLSAKAQKHGAELACAKHGAELACAMITYPSTHGVFESNILDVCHKVHEFSTHGVFESNILDVCHKVHEFGGQIYLDGANFNAQVGLCRPGDYGGQIYLDGANFNAQVGLCRPGDYGSDVSHFNLHKTEKSSKHKLYPN

SEQ ID NO: 144252 - protein, 49 aa, Heterodera glycines; identical to SEQ ID NO: 130195
  Coding regions on vcDNA: vcDNA=SeqID_70675; Strand=+; Position=1 -110,199-238

SEQ ID NO: 144253 - protein, 36 aa, Heterodera glycines
  Coding regions on vcDNA: vcDNA=SeqID_70676; Strand=-; Position=1-121
IFYRFLNVCIFFGLPKLHRTWFFLFSFKSPQIFFTA

SEQ ID NO: 144254 - protein, 41 aa, Heterodera glycines
  Coding regions on vcDNA: vcDNA=SeqID_70677; Strand=+; Position=1-123
MQLVCVLKKFGELIDLCKCCLRHKCCGELITGDAEPKAGGE

SEQ ID NO: 144255 - protein, 22 aa, Heterodera glycines
  Coding regions on vcDNA: vcDNA=SeqID_70678; Strand=-; Position=1-66
MLAQLRGKGIAEGHETSSDTIL

SEQ ID NO: 144256 - protein, 195 aa, Heterodera glycines
  misc_feature (1)..(1): Xaa can be any naturally occurring amino acid
  Coding regions on vcDNA: vcDNA=SeqID_70679; Strand=-; Position=1 -41,150-184,233-328,588-622,681-714,770-882,971-1091
  Homolog annotation: Hit_ID=NP_741571.1; Match level="QueryCoverage =78%, HitCoverage=39%, E-value=6e-46, Identity=58%"; Hit description =putative mitochondrial protein of ancient origin (5I326) [Caenorhabditis elegans] gb|AAM29667.1| Hypothet
XRVSFSSLYNSFVDRVRPASHAGSWYSENAKGLDRQLTNWLNAAGPGSWYSENAKGLDRQLTNWLNAAGPTVGAARAIISPHAGYTYCGETAAFAFKQIVPDKIFAFKQIVPDKIKRKRIFVLGPSHVVYLSGCALTTCSKYATPLGDLFVDTAVNEQLRSANGADSFEWMSVRNEEAEHSLEMQMPFIAKVMES

SEQ ID NO: 144257 - protein, 100 aa, Heterodera glycines
  Coding regions on vcDNA: vcDNA=SeqID_70680; Strand=-; Position=1-731
STGYREAIPEGFGLPINLGASVRGDCPENKNKSIFSSVRLGYSNNYGEQKSNAELKYRLYRSYSGRIRSPYKSGRIGSGGLPRNPKKNFLDKNYLNELTR

SEQ ID NO: 144258 - protein, 98 aa, Heterodera glycines
  Coding regions on vcDNA: vcDNA=SeqID_70681; Strand=-; Position=1 -157,835-974
MELMEIVDDEYKERWLGELCTEIEDDSIHVKRFGRIDEDEEIDDNNDGRDECKLLPMVTQIKNILFIPDYPFDLLTGRQPSTGKRPCEAISLLNGTIC

SEQ ID NO: 144259 - protein, 75 aa, Heterodera glycines
  Coding regions on vcDNA: vcDNA=SeqID_70682; Strand=+; Position=1-225
PGLKRPAQAKNFFYFREKIEIFPKKIPVDRARKTMFWKWSPFLWEKSLKNPKIQKPENRFLGLTRKILKIFEILK

SEQ ID NO: 144260 - protein, 60 aa, Heterodera glycines
  Coding regions on vcDNA: vcDNA=SeqID_70683; Strand=+; Position=1-180
MLAPIPIIEPATVTVPPNEDVVGSDDENQQREEELLVNQFVINSEAIKRILDDPRYADKK

SEQ ID NO: 144261 - protein, 272 aa, Heterodera glycines
  Coding regions on vcDNA: vcDNA=SeqID_70684; Strand=+; Position=1-3,49- 221,262-904
MVRPASLDEINLRWIYKQNSEEILQFLAYHGLIKNQMECKKCFNKMSLTKKKQKMDSFCGKDFRNKNAIKELGIAKSTCVNWFNFCRTQCVQQQKIGGVNVVVELDETCWVKQKHKKPKKGCSKWFFGAIKENVVQIDKEMDSSRLSDHQRRIGRHTRKWALHFPQSDHMLFRHQKSTGGGLSKLVMLPDGTEFNVNTNKCEGLWAQLKQKTKRIYGTSTNLTNSKCLNKFFDLMLGLKEKLLLMLSVILFVIIIILFAIIMLLMLNIYHYV

SEQ ID NO: 144262 - protein, 29 aa, Heterodera glycines
  Coding regions on vcDNA: vcDNA=SeqID_70685; Strand=-; Position=1-90
IVFQIDDPTAHYHVPITLSNFGYSTYKGQ

SEQ ID NO: 144263 - protein, 156 aa, Heterodera glycines
  Coding regions on vcDNA: vcDNA=SeqID_70686; Strand=-; Position=1 -113,206-429,527-660
  Homolog annotation: Hit_ID=CAC21848.1; Match level="QueryCoverage =91%, HitCoverage=66%, E-value=4e-15, Identity=38%"; Hit description =hypothetical protein [Globodera rostochiensis]
MYLSLKDWCSVFAKHPIFLNNNSFDIFYYEISIGNKRCYLIFGFAVKQQNKFDGTILSHKGTYAYYNGGDICINGEGKGRNGKYSYGVGDTVGIGVNSATRQIFFTKNGLRLDSSEFFVAQSFADDSFHPFVTLFNSDDQIEANFGPNFKFDLKSL

SEQ ID NO: 144264 - protein, 68 aa, Heterodera glycines
  Coding regions on vcDNA: vcDNA=SeqID_70687; Strand=-; Position=1 -69,737-874
MQNDQKILLEKISELEKEQKQRKSIPDKKCLRPLKANLNNADLKRDADPKAVLIWLNFNSLLEIGRVN

SEQ ID NO: 144265 - protein, 43 aa, Heterodera glycines
  Coding regions on vcDNA: vcDNA=SeqID_70688; Strand=+; Position=1 -32,344-443
MLCFVFHCILFFTKMIIFHCLKTRVEKSKYNSCEPKRKKYECG

SEQ ID NO: 144266 - protein, 28 aa, Heterodera glycines
  Coding regions on vcDNA: vcDNA=SeqID_70689; Strand=-; Position=1-107
LICFYFGLFLPFIAHTKSVLNGRMFLQQ

SEQ ID NO: 144267 - protein, 63 aa, Heterodera glycines
  Coding regions on vcDNA: vcDNA=SeqID_70690; Strand=-; Position=1-225
IPEGFGLPINLGASVRGDYPENKKIDFFKCPFGVLKQLWGAKIQRRIKVQAIGKLFRKDSVSP

SEQ ID NO: 144268 - protein, 78 aa, Heterodera glycines
  Coding regions on vcDNA: vcDNA=SeqID_70691; Strand=+; Position=1 -44,700-892
MCFYSESIITKTHFRVIPGKAESVKKQLQEKFCEDIFGEKWQYKEDQLRNDEMISEMIRNFYNLNANINQTGRGYYSV

SEQ ID NO: 144269 - protein, 15 aa, Heterodera glycines
  Coding regions on vcDNA: vcDNA=SeqID_70692; Strand=+; Position=1-49
FKAIHAAPVLGTAKH

SEQ ID NO: 144270 - protein, 60 aa, Heterodera glycines
  Coding regions on vcDNA: vcDNA=SeqID_70693; Strand=-; Position=1 -147,397-432
MVKIKIFLSFSILVKIFPIAFGHENCENAPNKTLKKICEQLYRYDKKARKMEKFSANVRR

SEQ ID NO: 144271 - protein, 41 aa, Heterodera glycines
  Coding regions on vcDNA: vcDNA=SeqID_70694; Strand=+; Position=1 -80,418-463
MPVPMRSVKWPIHLGIRLRCQSLRDAPTKLLKKKGIIKNIN

SEQ ID NO: 144272 - protein, 54 aa, Heterodera glycines
  Coding regions on vcDNA: vcDNA=SeqID_70695; Strand=-; Position=1 -96,144-212
MVHKFFLLVILAILIIGTIAEDDECADAPSPTARKYCEQLQRKAKLQRVIIISF

SEQ ID NO: 144273 - protein, 87 aa, Heterodera glycines
  Coding regions on vcDNA: vcDNA=SeqID_70696; Strand=-; Position=1-264
MGTGLLYDYPPIVYTQYPWINDLCTLVLSSWMLLFTSSIFRHQFVKDFCPKCIWPMPTNKLSEKFSKTRTNFGKQFSKFGIIKRMME

SEQ ID NO: 144274 - protein, 26 aa, Heterodera glycines
  Coding regions on vcDNA: vcDNA=SeqID_70697; Strand=+; Position=1-80
MTRRCLFELKWIGGILINYDLILTQI

SEQ ID NO: 144275 - protein, 257 aa, Heterodera glycines
  Coding regions on vcDNA: vcDNA=SeqID_70698; Strand=+; Position=1 -661,731-829
  Homolog annotation: Hit_ID=AAM51140.1; Match level="QueryCoverage =92%, HitCoverage=23%, E-value=1e-30, Identity=33%"; Hit description =SD27140p [Drosophila melanogaster]
NFLQMKIRRNLPLFTDDNGILRCKGRIEEGGFDYNTVNPIYLSHQIPILDLLISDAHLETEHGRKSQTLNYLRKKFWIPKCRRMITMVIKKNTYTKCGICAKLEAKAFSYPNPPPLPIHRVKGSSAFETIGLDYFGPITIKVKETQKVWGAIFVCTVTRAIHLEIVTDCTAQKFLLALERFMRRRRVPKMIISDNASQFVLSHKILAKITEAHWRKNKEREVELTAEREVELTANKGITWQFASPLAWRSGFFERLI

SEQ ID NO: 144276 - protein, 65 aa, Heterodera glycines
  Coding regions on vcDNA: vcDNA=SeqID_70699; Strand=+; Position=1 -95,303-405
MEVDVSSSSDSATNVLFSLRADRSLLDPTFDRSFQIALRQPMGLPTNSGPHFGLPSFLRPFRFLR

SEQ ID NO: 144277 - protein, 55 aa, Heterodera glycines
  Coding regions on vcDNA: vcDNA=SeqID_70700; Strand=+; Position=1 -35,98-229
IGGAEEIAVNDPSAAGDAQQQFNSEQLEECDRPPDAEDDVSAFWVDGDSHELVAM

SEQ ID NO: 144278 - protein, 64 aa, Heterodera glycines
  Coding regions on vcDNA: vcDNA=SeqID_70701; Strand=+; Position=1-197
HELKNRRTGKRAEHIAKQLVLSMSDLDKEFDPNDSSNEFIAFHATAETLFLLTRCAIYAVEMPK

SEQ ID NO: 144279 - protein, 97 aa, Heterodera glycines
  Coding regions on vcDNA: vcDNA=SeqID_70702; Strand=-; Position=1-294
MLNLTHFRLVHILLSCATIFLIILFHFLLSKNILTIDHRLSAKQTTVSDGVLLLSWMYTILKNGVRSLKALAVTSVNLRMFGMKNWHNFTAKMAYTH

SEQ ID NO: 144280 - protein, 353 aa, Heterodera glycines
  Coding regions on vcDNA: vcDNA=SeqID_70703; Strand=+; Position=1-1062
MQAGTTQIPGFGQLYILDPVEAMEQRRNNPRFTGEKITNEDEFVQGHQLNEQTLEILEQMIQVYHPAAQAYKQAREQLTELLQQQTPEELRFFRMTLLNERRAPAGLKDPKLHPHQIITPSTGEGMFAIHADPTGAPPPKGIWVENKQGQLNEIAPFSPWTDSLTYPLIKPMGDDGYTTGIKYAKPPSRKRKGAQNASGLFDPEAESDNESCETQSIASSDAGSVANSDAESVASVSSQHRRIDKSKQFISLRDYCKYYLAIRDENLELQYHHILSCGGGLGQRWILDQAAKIDWQIATFLRRPDMDLRISTPKNLLQYLVNQYNRQQARQNPNAQQKTVDDIGSVVRLSENT

SEQ ID NO: 144281 - protein, 21 aa, Heterodera glycines
  Coding regions on vcDNA: vcDNA=SeqID_70704; Strand=+; Position=1-67
VRWGTQPFMGAKSNAELKYRL

SEQ ID NO: 144282 - protein, 226 aa, Heterodera glycines
  Coding regions on vcDNA: vcDNA=SeqID_70705; Strand=-; Position=1 -144,400-514,932-994,1042-1257,1434-1574
  Homolog annotation: Hit_ID=XP_233960.2; Match level="QueryCoverage =92%, HitCoverage=25%, E-value=1e-40, Identity=34%"; Hit description =similar to KIAA1336 protein [Rattus norvegicus]
NILATAALKRLDFQTAEHAFVKLEDYGGIQFLKRLQNIHSDGLKKAEVDLAIDMLKKMNDWCRITQLIQTSSGPGDDILAQQTWHHQLAETFSNYGLCEQSVNCFLKCDRISEAFEMCIKLNKWDKATELSDKFHLANVEQLLSQYAFQMVGNKTKNLAMAQLYRKAAKFIQAAKIVYEVAKAEHEKQVPPQRLKKLYVMGALLVEEYHEQNREKLAKRREEGASD

SEQ ID NO: 144283 - protein, 273 aa, Heterodera glycines
  Coding regions on vcDNA: vcDNA=SeqID_70706; Strand=-; Position=1 -143,213-290,337-425,608-707,750-826,874-904,954-1055
  Homolog annotation: Hit_ID=XP_419970.1; Match level="QueryCoverage =86%, HitCoverage=14%, E-value=2e-40, Identity=39%"; Hit description =PREDICTED: similar to WD repeat domain 35 [Gallus gallus]
FPRPFQFQIQTPGSATFTTIAWMLNRGYVAVGGSDGALRVMLLNLDQDKSAGPSSASLSKSAGPSSASLSPWLSSQQLEGHSASVRLLCWNEIHRLLCWNEIHQKLASSDDAGLIIVWMSHGQSWFEEMINNRQRSTVASLKWSNDGSRIAIAYEDGQIILGSVDGNRLQIILGSVDGNRLWNKDIGASLVKLAWNSDDTLLLIWNSDDTLLLIGFTDGEVHAYDQNGNFCMKIQMLCGFTDGEVHAYDQNGNFCMKIQMLCVENVEMETALS

SEQ ID NO: 144284 - protein, 120 aa, Heterodera glycines
  Coding regions on vcDNA: vcDNA=SeqID_70707; Strand=-; Position=1 -117,479-724
MNNIYLFKCISVGQILIANLVFLYFLTAIFYGVSIVRYQWIVALLTVFGIVLSDLSDPIFSQPLAIVSLTSQNNAMAIIFLHCAVLFLLIVTSIGDYWVQKKNIKLISRYTLKSVYFIGI

SEQ ID NO: 144285 - protein, 46 aa, Heterodera glycines
  Coding regions on vcDNA: vcDNA=SeqID_70708; Strand=-; Position=1-352
INKKYCQRQCLPKKKTKNISKKAKKIENLNKFKSEKGKKLTTPLIP

SEQ ID NO: 144286 - protein, 40 aa, Heterodera glycines
  Coding regions on vcDNA: vcDNA=SeqID_70709; Strand=-; Position=1-328
NKSKRKKINLFFLIIKNIVRGSAWRKKTKNFSKKAKKLKI

SEQ ID NO: 144287 - protein, 103 aa, Heterodera glycines; identical to SEQ ID NO: 131705
  Coding regions on vcDNA: vcDNA=SeqID_70710; Strand=+; Position=1 -162,527-677

SEQ ID NO: 144288 - protein, 28 aa, Heterodera glycines
  Coding regions on vcDNA: vcDNA=SeqID_70711; Strand=-; Position=1-86
NSCGNIKARKYYARLCSLCTALGPTLYV

SEQ ID NO: 144289 - protein, 86 aa, Heterodera glycines
  Coding regions on vcDNA: vcDNA=SeqID_70712; Strand=-; Position=1 -73,150-253,484-564
MRGFGQFAQCVGTEAESRRRTDGGAADECLSERSLSGQSPEDDFDDDPVQHHQSDLFASSSLFDDFVAIVFRKDQTKRDGQIVQSE

SEQ ID NO: 144290 - protein, 136 aa, Heterodera glycines
  Coding regions on vcDNA: vcDNA=SeqID_70713; Strand=+; Position=1 -210,424-624
MQENNSSSDEEGQLLSSSSGNEEAANQELIQFIEFKSKRGASLLARNGFEYQFERNSALVDNVEYWKCVKIRSAIEQLKQSARANNPIQTRDAVDAARAALSEEVRVNAPSGSAMAKVFRSARRSAQEQHGDRGKD

SEQ ID NO: 144291 - protein, 381 aa, Heterodera glycines
  Coding regions on vcDNA: vcDNA=SeqID_70714; Strand=+; Position=1 -156,206-683,726-898,945-1283
MVIPQHLEANVITNENVNIGGQMRKIIVFSTQSAIEMLDRYRNEIAIDGTFKNAPRGFGQLFTIHVVVDACAVPCVFACLPTKHMQGYIRVFESIRNRIQNWSPGRVMCDFEASELSAIRQIFPQAIITGSGNKKSFNRPILQGCSFHLGNAIHKHIQTLPGLYNRYRNNRDDRHLFRSLQSLAFVPINEVYTFLCILMDNLIGPPEIEILELLKYFVLTYIGPSYVVAHPQIIAGEQEANYGQGCDGWLRAWIAHENLAHRNALFPIALWNLTHRLEIGLSRSNNSLEAWHNIWGALLEPNPLFSKFVKRMLKEFERWQHIVADFHNAPANGIRGKGLKRKSIYLQQDNNLRQLFAEFQQRAGQDPLQYLRAISYHLAQI

SEQ ID NO: 144292 - protein, 17 aa, Heterodera glycines
  Coding regions on vcDNA: vcDNA=SeqID_70715; Strand=+; Position=1 -23,250-280
MNLIPNLILRKFNRCEI

SEQ ID NO: 144293 - protein, 48 aa, Heterodera glycines
  Coding regions on vcDNA: vcDNA=SeqID_70716; Strand=-; Position=1 -75,200-271
MLIDQIVYNRVQPQAFGEQNVGERGNKKVLKTHLKILPSYFKCNLRLS

SEQ ID NO: 144294 - protein, 169 aa, Heterodera glycines
  Coding regions on vcDNA: vcDNA=SeqID_70717; Strand=-; Position=1 -73,177-496,569-685
MTAEVAEKWRQSYRHYRQRKHFEKKLRNSIAAAVEYGTTTTTTSAAHTVPAFIGSSAHYSNSPTSEDNGTVGVGLPPRRCKSVTIIETPSHLSPSERRARRHFRVLLRPVSLDCPAEENGGGEKGHQQPKPGYHRRHHYQKRRPKSEERQENREEKIDEDGIQMGKIGE

SEQ ID NO: 144295 - protein, 101 aa, Heterodera glycines
  Coding regions on vcDNA: vcDNA=SeqID_70718; Strand=+; Position=1 -111,394-585
MNANKLNASQPKCAASAHRLGGKRPTDGGNIFGRLATMIYIIPCIALLAAFILIAQCCGCGSEGATEKDDQQAAPSGNARLQRAKDMMLLPQLRIRRGRIL

SEQ ID NO: 144296 - protein, 444 aa, Heterodera glycines
  Coding regions on vcDNA: vcDNA=SeqID_70719; Strand=-; Position=1 -24,95-185,236-409,460-762,807-907,977-1034,1088-1240,1291-1389,1480 -1523
  Homolog annotation: Hit_ID=NP_501709.1; Match level="QueryCoverage =100%, HitCoverage=28%, E-value=1e-98, Identity=49%"; Hit description= membrane Calcium ATPase (134.6 kD) (mca-1) [Caenorhabditis elegans] emb|CAA11491.1| calcium ATPase [Caen
TLTTNRMTVVQSFLCERYFVVQSFLCERYFGEEKSQPKPGEFPKANGVILSEALSEAITVNCAYNSMIVATKKAGERIQQLGNKTECALLGWVRQIGGDYEKIRREYTEEDLLKVYTFNSLLKVYTFNSSRKMMMTVVELKNGAGRRVGFRVFVKGASEILLNKCAFFLDANGSPTEFTEHRRKRIIDEVIQRMAEDGLRTLTIAYKDYVLAGERTVGPTEVPLDSEAAVNWDDEVPLDSEAAVNWDDEQSISDGVVGLAICGIQDPVRDEVPDAIEKCRRAGITVDEVPDAIEKCRRAGITVRMVTGDNVNTARAIAIRCGILRVTGDNVNTARAIAIRCGILRPDEDFLVLEGKEFNDRIRDGRGKIDQRKLDMIWPRLRVLARAQIWPRLRVLARAQPADKYTLVKGIIDSKLNTQRLIVAVTGDGTIVAVTGDGTNDGPA

SEQ ID NO: 144297 - protein, 72 aa, Heterodera glycines
  Coding regions on vcDNA: vcDNA=SeqID_70720; Strand=-; Position=1 -57,411-467,820-926
SVHRLLEKYICNLSTILRKSVNRLLEKYICNLSTILRKSVNRLLENIFAIYAQFEKVSRNDKLHDSTKFSLL

SEQ ID NO: 144298 - protein, 68 aa, Heterodera glycines
  Coding regions on vcDNA: vcDNA=SeqID_70721; Strand=+; Position=1-205
  Homolog annotation: Hit_ID=P19910; Match level="QueryCoverage=100%, HitCoverage=22%, E-value=2e-30, Identity=98%"; Hit description =Aspartate carbamoyltransferase catalytic chain (Aspartate transcarbamylase) (ATCase) pir||OWSEAC aspartate ca
LELVLRTAAGLKANPQPELLKHKVIASCFFEASTRTRLSFETSMHRLGASVVGFADGSNTSLGKKGET

SEQ ID NO: 144299 - protein, 90 aa, Heterodera glycines
  Coding regions on vcDNA: vcDNA=SeqID_70722; Strand=-; Position=1-305
GGRCAIDLLFFEGIFKFILYPRKMSISFFEKFYTSQKRSRMRRRAVHNRHFISQRIFIFRGYPRKMAISFFDKFYTHTKALEHDREGGAQ

SEQ ID NO: 144300 - protein, 92 aa, Heterodera glycines; identical to SEQ ID NO: 125147
  Coding regions on vcDNA: vcDNA=SeqID_70723; Strand=-; Position=1-304

SEQ ID NO: 144301 - protein, 52 aa, Heterodera glycines
  Coding regions on vcDNA: vcDNA=SeqID_70724; Strand=-; Position=1 -70,615-703
MNKCASQRDFNQSTWKKVGKTEQHECEYFSAVRSLLFFSGPLFPRNVFWAQK

SEQ ID NO: 144302 - protein, 30 aa, Heterodera glycines
  Coding regions on vcDNA: vcDNA=SeqID_70725; Strand=-; Position=1 -50,481-523
MFFTGLDRLICVLFPENFFRRPSESFRRGE

SEQ ID NO: 144303 - protein, 89 aa, Heterodera glycines
  Coding regions on vcDNA: vcDNA=SeqID_70726; Strand=+; Position=1 -176,249-339
  Homolog annotation: Hit_ID=CAE72234.1; Match level="QueryCoverage =68%, HitCoverage=20%, E-value=3e-14, Identity=52%"; Hit description =Hypothetical protein CBG19349 [Caenorhabditis briggsae]
MPGSSHDKPGFFGIRYLIPSQIRCPFQLAVVAVMSAFPFMHPPMIAFVRHNVGLYLLGYITFFVVYIALICCEGVRRSFPANIILLGIL

SEQ ID NO: 144304 - protein, 108 aa, Heterodera glycines
  Coding regions on vcDNA: vcDNA=SeqID_70727; Strand=+; Position=1 -207,543-626,675-709
  Homolog annotation: Hit_ID=NP_505500.2; Match level="QueryCoverage =94%, HitCoverage=30%, E-value=7e-22, Identity=47%"; Hit description =lifeguard (33.2 kD) (5K187) [Caenorhabditis elegans] emb|CAD44126.1| Hypothetical protein F40F9.1b [Caeno
MAYSMLGIVFIATMCLALFGLVVIIVGMFTNVRILFVVYAAIGAFLFMIWLAIDIQASKMGQQPKFTNGMVMGGRTYEISPEEHIFASITLFLDIIQIFWFLLAIFGD

SEQ ID NO: 144305 - protein, 20 aa, Heterodera glycines
  Coding regions on vcDNA: vcDNA=SeqID_70728; Strand=-; Position=1 -33,399-428
MLAFTKNFNILKTRSDLVDH

SEQ ID NO: 144306 - protein, 69 aa, Heterodera glycines
  Coding regions on vcDNA: vcDNA=SeqID_70729; Strand=+; Position=1-207
MDTSSQELNACAECGFTTRDWALFTRHVERHESADGIINSWKSSKTVPTTPEAMDESVEAEDGGGTDFQ

SEQ ID NO: 144307 - protein, 119 aa, Heterodera glycines
  Coding regions on vcDNA: vcDNA=SeqID_70730; Strand=-; Position=1-367
CAKIIRVPKIACDLSLAKNGVSKNRNYAQKAPQTILALPIPSTIAFIHPIMSAKIIRVPKIACDLSLAKNGVSKNRNYAQKASQTILALPIPSTIAFIHPIMSAKIIRVPKIACDLSLA

SEQ ID NO: 144308 - protein, 238 aa, Heterodera glycines
  Coding regions on vcDNA: vcDNA=SeqID_70731; Strand=-; Position=1-715
  Homolog annotation: Hit_ID=CAE64995.1; Match level="QueryCoverage =100%, HitCoverage=90%, E-value=7e-17, Identity=32%"; Hit description= Hypothetical protein CBG09831 [Caenorhabditis briggsae]
MTVGGGTDQEKETKLAAGSGIDPEKAKKMTVGGGTDQEKEKKLAAGGGIDPEETKLAAGSGIDPEKAKKMTVGGGIDPEKAKKMTVGGGTDAGKGEMTVGGGTDQEKETKLAAGSGIDPEKAKKMTAGGGTDQEKETKLAAGSGIDPEKAKKMTVGGGTDQEKETKLAAGGGIDPEETKLAAGSGIDPEKAKKMTVGGGIDPEKAKKMTAGGGTEAGKGEMTVGGGTDQEKETKLAAG

SEQ ID NO: 144309 - protein, 265 aa, Heterodera glycines
  misc_feature (15)..(15): Xaa can be any naturally occurring amino acid
  misc_feature (202)..(202): Xaa can be any naturally occurring amino acid
  Coding regions on vcDNA: vcDNA=SeqID_70732; Strand=+; Position=1-815
  Homolog annotation: Hit_ID=CAA60020.1; Match level="QueryCoverage =97%, HitCoverage=99%, E-value=4e-33, Identity=37%"; Hit description =extensin-like protein [Vigna unguiculata] pir||T11671 extensin-like protein 127 - cowpea (fragment)
GSMPPPAANFVSFSXSVPPPTVISPFPASVPPPPSSSSPSPSMPPPPSSSSPSPGQCHFRPPSSPPGQCHLRPPTSSPSPDRCHLRPSSSSPSPGQCHFRPPTSSPSPDRPPPAVSSSPSPGQCHFRPPTSSPSPDQCHLRPSSPFPASVPPPTVSSSPSPGMPPPTVIFFAFSGSMPLPAANFVSSGSMPPPAANFFSFSXSVPPPPSSSSPSPGQCHFRPPTSSPSPDRCHLRPSSSSPSPGRCHFRPSTSSPSPSVPPPDRH

SEQ ID NO: 144310 - protein, 81 aa, Heterodera glycines
  Coding regions on vcDNA: vcDNA=SeqID_70733; Strand=-; Position=1 -150,490-585
MRKNIPTELLFEIIGAIPFDRKWAQIHVSQVFNHFLFNRMGSWLSQIKNLTFFTSLDVGPIVLAFFLNSLACRLTQTTLIT

SEQ ID NO: 144311 - protein, 17 aa, Heterodera glycines
  Coding regions on vcDNA: vcDNA=SeqID_70734; Strand=-; Position=1-68
HKHLFDLFYHIHNLIKI

SEQ ID NO: 144312 - protein, 105 aa, Heterodera glycines
  Coding regions on vcDNA: vcDNA=SeqID_70735; Strand=+; Position=1-318
MTVGGGTDQEKETKLAAGGGIDPEETKLAAGSGTDQEKAKKMTVGGGTEAGKGEMTVGGGTDQEKETKLAAGSGIDPDSVKCTIFLRNTVLFIGTEIKVDVCQRA

SEQ ID NO: 144313 - protein, 93 aa, Heterodera glycines
  Coding regions on vcDNA: vcDNA=SeqID_70736; Strand=-; Position=1 -104,181-355
MRNSFDSSNAIGLIKCNKTLETPKKKDIFLNFGKIRFGGECASFVGRQVVVRLGVCQPPVESCHCQRIAVAQAHRAPSAQRRAVGRPRHPTGM

SEQ ID NO: 144314 - protein, 143 aa, Heterodera glycines
  Coding regions on vcDNA: vcDNA=SeqID_70737; Strand=-; Position=1 -184,235-376,425-527
MEPGAKKRRKRKNAENTDGESMECEEEEDAVDEDAENNWMLGYEEAGEKPESVTTYAYAHAGSRYDHVLIYGEMLRMGVSPELIHQGNHLLEMKARKTGVYTTTVFRDSYKLIPIKLANFVNTFGLEIEGVENKKYFPHKFNK

SEQ ID NO: 144315 - protein, 112 aa, Heterodera glycines
  Coding regions on vcDNA: vcDNA=SeqID_70738; Strand=-; Position=1-469
FFLIFLPQNWYQQLPSLVWPYQTILRYLKRKQKKFLTKNGYLFFLIFLPQNWYQQLPSLVWPYQTILRYLKRKQKKILDQKMAISFFSFFYRKLGTNSCLLLSGPIKQSYDI

SEQ ID NO: 144316 - protein, 100 aa, Heterodera glycines
  Coding regions on vcDNA: vcDNA=SeqID_70739; Strand=+; Position=1-303
MAKNEILAQKNVEKEWKQNYVEICKKIGVIRDIINKWKKQFGIRCKRITEEQKIEKMKIYWQIKSENPKMSDNKIAKILKIHLKSIFNWKKQFGEQINEE

SEQ ID NO: 144317 - protein, 128 aa, Heterodera glycines
  Coding regions on vcDNA: vcDNA=SeqID_70740; Strand=+; Position=1 -184,355-557
MGSSSSSNAGSFSSAFASSSGSARSSSQGSSKLFCSEAFCACPRSHLRAIEFKKVAVAVDSVHILCPYLGFFSPYTYCITLVMTYPHAAVEVLYICNDCDHELRVTYDLVFNLHLLRGQSIKGRVEVI

SEQ ID NO: 144318 - protein, 51 aa, Heterodera glycines
  Coding regions on vcDNA: vcDNA=SeqID_70741; Strand=+; Position=1 -101,141-274
NHYFGDFVTKIVKNHYFGVLSLFFHYSTFFGKFLNKNAIRTKNTPLRIDLK

SEQ ID NO: 144319 - protein, 425 aa, Heterodera glycines
  misc_feature (382)..(382): Xaa can be any naturally occurring amino acid
  Coding regions on vcDNA: vcDNA=SeqID_70742; Strand=-; Position=1 -173,668-812,1121-1204,1258-1394,1480-1598,1652-1770,1986-2060,2140 -2194,2243-2331,2546-2695
  Homolog annotation: Hit_ID=CAE62115.1; Match level="QueryCoverage =80%, HitCoverage=83%, E-value=2e-94, Identity=49%"; Hit description =Hypothetical protein CBG06153 [Caenorhabditis briggsae]
AKSCNCYLFHLFYPELVDLLPIQLSFSALYFLIWLAAILGNASVLYVVSLKQASLSVRSVFICSLAASDILMSFTSLPITAISIFTRDWVFPSPFCKLMGIFQGGTVFVSSFTLTAIAVDRYILIKHPTKQKIEFRTAICKIEFRTAICIVIGVWTLGYACALPVGLFSSTQEYPPFCGTFCEENWPDTEEQTGRSRIRKLYGLLVLIVQFGLPTVISSLCYWNIGRLIRRQIQKRKERQLVLRLIRRQIQKRKERQLVLLQESKDRMKSQKNRTNRMMVTMVAGLVLAWLPMNLINLWRDFNSENSNEWYSLIFAACHSVAMTSAVWNPLIYSFFNPQFKETIRAVWNPLIYSFFNPQFKETIRASLERRRKSQKKFKKNXAVTALLMTQQQTNANTSESRRTSCRSLNVLITNNAPSAGNRQS

SEQ ID NO: 144320 - protein, 265 aa, Heterodera glycines
  Coding regions on vcDNA: vcDNA=SeqID_70743; Strand=-; Position=1-795
MVNGEETIIQSVGASVGFSDHADCFGTNEPSRLAEEDSPRGEIMKALLARPGRSGLKVTTQKLIDYGLGQKTAMPSVARLNEEQQQTLALIACDLPLVVLQQAPPGTGKTLTLATAIDLLLSEKNEETVIVATATSNLPVTKMVEETRAVGVSEEHLALFSGTARVRYGEQIQPLERSLLRPRLTQTFLKKVKDKKVKQFEDYKKHVFNTPLRVREAKVAESYLKYDKRKVIFLTTHMAGRIKGTISRATHLLLDEATQASFTTV

SEQ ID NO: 144321 - protein, 94 aa, Heterodera glycines
  Coding regions on vcDNA: vcDNA=SeqID_70744; Strand=+; Position=1-283
MLLWENGPEDTSFYHALRICSEEAMEQNKKAPEQKKVKDAEDLNMEIFAKMIICMGKRLKMPRRRDAILNGMHFDKLAKLVDEWDQFGKILGQK

SEQ ID NO: 144322 - protein, 104 aa, Heterodera glycines
  Coding regions on vcDNA: vcDNA=SeqID_70745; Strand=+; Position=1 -172,962-1104
MTNWHKKGRMDGGEKGEIEGEALGEAEATAADDHHHQSQFEEGRRKGTDGRRRNRRRENRKGYPTFGDLQLGDPTFGDPTFGGPNEHLSKRHLRKPRTFGNPTF

SEQ ID NO: 144323 - protein, 18 aa, Heterodera glycines
  Coding regions on vcDNA: vcDNA=SeqID_70746; Strand=+; Position=1-56
YREATPEGFGLPINLGAS

SEQ ID NO: 144324 - protein, 202 aa, Heterodera glycines
  Coding regions on vcDNA: vcDNA=SeqID_70747; Strand=-; Position=1 -218,395-785
MRFLEQSDLARGVLRLAQFATRQTLAALSGNNFEAEKLLEFNILCPIIISAQQQQQKVDFDKMVEKCIYSPENYGVASVFAELLRKAIVKNDNKNDTIFQSAKIYSELYTAILKMQKEVNLEEWRKVPMPFAMEWNKMNKFLSESVEEIDTFVKRWEEMGKNEKETKIGENVKKEGFFSDNLLEKCIPFIVESSKKGNRTNN

SEQ ID NO: 144325 - protein, 121 aa, Heterodera glycines
  Coding regions on vcDNA: vcDNA=SeqID_70748; Strand=+; Position=1 -69,1241-1357,2708-2884
MKESMNDWMIIIHHKPKEQQKQKPQNCCRKAPPAFGAWQIVPGAAHPVLSLIAPRIAFAFPDQFYADAHEYLGNWSQQFSETDEIIGDWVIFESEPTSEKVRRAYRHISVGHQLTKWMLCL

SEQ ID NO: 144326 - protein, 120 aa, Heterodera glycines
  Coding regions on vcDNA: vcDNA=SeqID_70749; Strand=+; Position=1 -216,357-500
MNQGSNNNNGGGATAMPMPPNGSGAFAMSPSTFVPSHPSPLATSSSPPPEYAPPPPLPAHGAGAYRQQTTGGHSFPTGDLANKSGVGAVYPSAHPPPAGTPTQPFPNATPPPQQHYQQHL

SEQ ID NO: 144327 - protein, 33 aa, Heterodera glycines
  Coding regions on vcDNA: vcDNA=SeqID_70750; Strand=+; Position=1 -32,389-458
MKILILCPPQSNCLLKIQMCAVENVHSTEAIIA

SEQ ID NO: 144328 - protein, 122 aa, Heterodera glycines
  Coding regions on vcDNA: vcDNA=SeqID_70751; Strand=-; Position=1 -93,486-576,682-712,790-944
  Homolog annotation: Hit_ID=CAE71639.1; Match level="QueryCoverage =100%, HitCoverage=28%, E-value=6e-34, Identity=54%"; Hit description= Hypothetical protein CBG18606 [Caenorhabditis briggsae]
YVAPPAPVHIISGSAGCQENTDTFVAHPGPWSAFRSSNYGFSRMHIFNSTHLYFEQTIAANQETIEDHFWLVVLSEKRHGPYDWTDRKRLFRHGTYVPHNYCHHPSQCEKKVAHSHLRRAQN

SEQ ID NO: 144329 - protein, 21 aa, Heterodera glycines
  Coding regions on vcDNA: vcDNA=SeqID_70752; Strand=+; Position=1-65
MAISFFSWGFDRKLGTNICLL

SEQ ID NO: 144330 - protein, 19 aa, Heterodera glycines
  Coding regions on vcDNA: vcDNA=SeqID_70753; Strand=+; Position=1-59
TFAFSSLALPNTHTIFEML

SEQ ID NO: 144331 - protein, 19 aa, Heterodera glycines
  Coding regions on vcDNA: vcDNA=SeqID_70754; Strand=+; Position=1-59
TFAFSSLALLNTHTIFEML

SEQ ID NO: 144332 - protein, 19 aa, Heterodera glycines
  Coding regions on vcDNA: vcDNA=SeqID_70755; Strand=+; Position=1-59
TFAFSSLALPNTHTIFEML

SEQ ID NO: 144333 - protein, 19 aa, Heterodera glycines
  Coding regions on vcDNA: vcDNA=SeqID_70756; Strand=+; Position=1-59
TFSFSSLALPNTHTIFEML

SEQ ID NO: 144334 - protein, 92 aa, Heterodera glycines
  Coding regions on vcDNA: vcDNA=SeqID_70757; Strand=+; Position=1 -102,342-518
MSAKVKTEASSPKQMNEKAEENELTERLELDFVEESVGDDWYGNAIMECDDTLATADEAEEEGHSKRRPTRHVRCLPRVPPKTKWRQLVPRN

SEQ ID NO: 144335 - protein, 153 aa, Heterodera glycines
  Coding regions on vcDNA: vcDNA=SeqID_70758; Strand=-; Position=1 -53,579-987
MTILENRKMMNDSLGNVRQIAISWTVEFLLGRGIAEAKCIEQQPAPPKQILAVKQNCAVRTKGFEARGQVQQQLNVCWRCGRSSHFPSVCPHIKVACRKCSKVGHLEAQCNQHQSWIIRQGKMQSRKQGNLKLGGVLINSVNQPKRLIECPIK

SEQ ID NO: 144336 - protein, 39 aa, Heterodera glycines
  Coding regions on vcDNA: vcDNA=SeqID_70759; Strand=-; Position=1 -53,445-511
MTILENRKMMNDSLGNVRFWIFFEIKFRKYYFTNNEYDV

SEQ ID NO: 144337 - protein, 48 aa, Heterodera glycines; identical to SEQ ID NO: 133602
  Coding regions on vcDNA: vcDNA=SeqID_70760; Strand=-; Position=1 -46,200-300

SEQ ID NO: 144338 - protein, 48 aa, Heterodera glycines
  Coding regions on vcDNA: vcDNA=SeqID_70761; Strand=-; Position=1 -46,200-300
MTFSASLVGYTGRNNKILSVKSAFGILMSKSVTVNDILCFSCWIHGKK

SEQ ID NO: 144339 - protein, 92 aa, Heterodera glycines
  Coding regions on vcDNA: vcDNA=SeqID_70762; Strand=+; Position=1 -120,199-356
MGPVKHLMEAEQKMCRIRNHGLRSLNHFTTNAIRSNQFLHTDPPNAPRAANFEINHLGPLISKSPPYVAMDLIFVFEIVKPFHPSNSSSSMI

SEQ ID NO: 144340 - protein, 68 aa, Heterodera glycines
  Coding regions on vcDNA: vcDNA=SeqID_70763; Strand=+; Position=1 -196,598-608
  Homolog annotation: Hit_ID=CAA36734.1; Match level="QueryCoverage =97%, HitCoverage=17%, E-value=4e-10, Identity=34%"; Hit description =DNA-directed RNA polymerase [Glycine max]
MPEFNPMTPGMPPMMPGFNPMVPGFNPMMPGFNPMMSGFNPMTPGMPSMVPGFNPMMPGFNPMMPVFI

SEQ ID NO: 144341 - protein, 15 aa, Heterodera glycines
  Coding regions on vcDNA: vcDNA=SeqID_70764; Strand=+; Position=1-49
LKAIHCLPVLGTAKH

SEQ ID NO: 144342 - protein, 84 aa, Heterodera glycines
  misc_feature (15)..(15): Xaa can be any naturally occurring amino acid
  misc_feature (24)..(24): Xaa can be any naturally occurring amino acid
  misc_feature (26)..(26): Xaa can be any naturally occurring amino acid
  misc_feature (35)..(35): Xaa can be any naturally occurring amino acid
  misc_feature (50)..(50): Xaa can be any naturally occurring amino acid
  Coding regions on vcDNA: vcDNA=SeqID_70765; Strand=-; Position=1 -183,230-397
KGGEKVPRALKNGLXEEIFKGEGXHXQIIQKTVYXLRLSARTDCYKVPLXLEFVPPEEMRIRQKGSFVSRFSIANIGICRQGYN

SEQ ID NO: 144343 - protein, 178 aa, Heterodera glycines
  Coding regions on vcDNA: vcDNA=SeqID_70766; Strand=-; Position=1 -86,149-416,482-664
  Homolog annotation: Hit_ID=CAE64114.1; Match level="QueryCoverage =85%, HitCoverage=44%, E-value=8e-25, Identity=39%"; Hit description =Hypothetical protein CBG08723 [Caenorhabditis briggsae]
MGEKRPKKLGVFVDCMEMTYEDAMRFYAKWASGLEELSADCVQQRLSIFLGRGVRAGAQMRSVVMRCPEILFMGVPQQMDMFWENILDFFTLNDLKKLMVNSPQICLMSFEEIEEIYEYIYFHMGIEPGELAESKYWHTLELDQVMSRHEFLLKTGKYTYPDPKKPQLKKVLWILEMF

SEQ ID NO: 144344 - protein, 18 aa, Heterodera glycines
  Coding regions on vcDNA: vcDNA=SeqID_70767; Strand=+; Position=1 -48,144-152
MSPQTIYAMGENPSDTQW

SEQ ID NO: 144345 - protein, 24 aa, Heterodera glycines
  Coding regions on vcDNA: vcDNA=SeqID_70768; Strand=-; Position=1-77
GKAMPPPLPPAADEVADEEDTLLT

SEQ ID NO: 144346 - protein, 47 aa, Heterodera glycines
  Coding regions on vcDNA: vcDNA=SeqID_70769; Strand=+; Position=1-143
VNNVSSSSATSSAAGGSGGGIALPSANHPFVSPTSLVPQLEAANSFW

SEQ ID NO: 144347 - protein, 89 aa, Heterodera glycines
  Coding regions on vcDNA: vcDNA=SeqID_70770; Strand=-; Position=1 -141,404-529
MGPGSRRIFWAHIPAFKNGSGPGPQQKQDLNTGLRVLKFRKNELSIPFNPMKMPSDFKSAVGRRQLSVQSNSISREASNLKSFDEICAE

SEQ ID NO: 144348 - protein, 137 aa, Heterodera glycines
  misc_feature (9)..(9): Xaa can be any naturally occurring amino acid
  misc_feature (17)..(17): Xaa can be any naturally occurring amino acid
  Coding regions on vcDNA: vcDNA=SeqID_70771; Strand=+; Position=1 -191,257-354,657-777
  Homolog annotation: Hit_ID=NP_490714.1; Match level="QueryCoverage =80%, HitCoverage=17%, E-value=5e-41, Identity=65%"; Hit description =IMportin Beta (70.4 kD) (imb-3Co) [Caenorhabditis elegans] gb|AAF39787.1| Hypothetical protein C53D5.5 [C
SKNGNFKLXNANAKKKXFKRRRKMPFPQGGNAVDAAVATTFCIGVMDTQSSGLGGGHFMTIFNATTRKCHVVDAREVAPAAATENMYKDRWNKSKFGWEAVAVPGELHGLWTEYTHFGGQVSWESIVRPTIRLMEEG

SEQ ID NO: 144349 - protein, 267 aa, Heterodera glycines
  Coding regions on vcDNA: vcDNA=SeqID_70772; Strand=+; Position=1 -264,754-913,1243-1416,1661-1870
  Homolog annotation: Hit_ID=CAE74343.1; Match level="QueryCoverage =92%, HitCoverage=38%, E-value=6e-79, Identity=57%"; Hit description =Hypothetical protein CBG22061 [Caenorhabditis briggsae]
FLWLGYPTSHALAHALEQYKAQVLNEPTMRRHFVNPATGVVYKLGEQIKTRTNFINTLRGLATAADPVAFFYRSNLTQQMVDEFKRNGGILTMDDFANYRAIVRADADIIYTQLEDGRTVCGPPPPSGAAVTQAILSILDPIVFNTSTISGNVGFLHRFIEASKFAYAARSSMGDMAFVKNATELARNITSKWWAQLARSKISWGTHPDDYYGGGYQALPNDHGTTHISVVDKHGNAVSITSTINLMCGLCVWPFNPMIQVGMLIDH

SEQ ID NO: 144350 - protein, 35 aa, Heterodera glycines
  Coding regions on vcDNA: vcDNA=SeqID_70773; Strand=+; Position=1 -12,108-203
MNQIKWRASLAAEAVKVLGTSQNKAVNVLDLEVSL

SEQ ID NO: 144351 - protein, 151 aa, Heterodera glycines
  Coding regions on vcDNA: vcDNA=SeqID_70774; Strand=+; Position=1 -223,303-418,483-599
MEFTDFSEIAFRHELLDELAKERYDAAIYELFDLCGAAIFERIGVRTKLATLTVPMYQTTAAHFGIPTFASFVPNWAHPPLNAPAMDFWERLINFLNTFYDWYKLNDRVTDLQIFFHILHSYFGTFTKIKTEKYTSKHGKFFGNFVNCKIY

SEQ ID NO: 144352 - protein, 118 aa, Heterodera glycines; identical to SEQ ID NO: 126986
  Coding regions on vcDNA: vcDNA=SeqID_70775; Strand=-; Position=1-469

SEQ ID NO: 144353 - protein, 55 aa, Heterodera glycines
  Coding regions on vcDNA: vcDNA=SeqID_70776; Strand=+; Position=1 -154,886-899
MVIRRSTKAIRKGTTVIKRVIRRGSTVIRKGTTAIRRGTKVIRRGTKVIRREFLE

SEQ ID NO: 144354 - protein, 222 aa, Heterodera glycines
  Coding regions on vcDNA: vcDNA=SeqID_70777; Strand=-; Position=1-668
MQAGTTQIPGFGQLYILDPVEAMEQRRNNPRFTGEKITNEDEFVQGHQLNEQTLEILEQMIQVHHPAAQAYKQAREQLTELLQQQSPEELRFFRMTLLDSRRAPAGLKDPKLHAHQIITPSTGEGMFSIHADPTGAPPPKGIWVENKQGQLNEIAPFSPWTDSLTYPLIKPMGDDGYTTGIKYAKPPSRKRKGAQNASGLFDSEAESDNESCETQSIASFDA

SEQ ID NO: 144355 - protein, 301 aa, Heterodera glycines
  Coding regions on vcDNA: vcDNA=SeqID_70778; Strand=-; Position=1-906
  Homolog annotation: Hit_ID=NP_920205.1; Match level="QueryCoverage =91%, HitCoverage=18%, E-value=2e-31, Identity=33%"; Hit description =putative DNA helicase homolog [Oryza sativa (japonica cultivar -group)] gb|AAP52492.1| putative DNA helica
MYDLRPDRPAMYFRPSPTDGGAQLEVNGLIYDNSHVVPYNPYILLRYRVHHNVLFAYGNKANIKYALKYPFKGPGHCYVECKQESGNKIGIDEPAQYAKMNFRGATEAYAIVHSLPFAKLSHQVVKLSIHMPNQQPIVYRAFQLVSKAQQIQQGELPETQCSAYWKQWQNEWKHDPKLKDMLFEKVPEHFIWAKDKWNKRKYNLTKRPPIGRIVPVPPSDPERFALYSLMRHFPGDPDHLKMVNGLLCTSFTEAAIMHGLLEDDKIWDKTLAEAALSRWPDQMRWLFVSILVYGQPSNAIE

SEQ ID NO: 144356 - protein, 65 aa, Heterodera glycines; identical to SEQ ID NO: 137623
  Coding regions on vcDNA: vcDNA=SeqID_70779; Strand=+; Position=1-287

SEQ ID NO: 144357 - protein, 277 aa, Heterodera glycines
  Coding regions on vcDNA: vcDNA=SeqID_70780; Strand=+; Position=1 -147,208-430,563-699,848-965,1024-1100,1145-1192,1562-1642
  Homolog annotation: Hit_ID=NP_999847.1; Match level="QueryCoverage =99%, HitCoverage=80%, E-value=1e-65, Identity=40%"; Hit description =cytohesin 1-like protein [Danio rerio] gb|AAS87372.1| cytohesin 1 -like protein [Danio rerio]
YKGKARELAKKKFNENQRQGLRDLVKAGLVNGSAEDIANFFLTCDGIKKSAIGDFLGEKDDFNLEVLQHFVHLQPLRSLPLVQAMRGFLSRFRLPGESQQIERIMEYFSGHYHVQNPGIFEHQDNCYTLCYAIIMLNTSLHNPSVKERMSLDNFLNITNSLNLPPALVTDIYNSIRSEAFKFPDDNLQEHFSAALFQQSEKQGWLEKQGSRYKTWNRRWFLLANRCLYYFESPSSREPKGIIPLENIRVRISAPNREEMHSWVSAIQRSINKDQHIE

SEQ ID NO: 144358 - protein, 40 aa, Heterodera glycines
  Coding regions on vcDNA: vcDNA=SeqID_70781; Strand=-; Position=1 -61,234-295
MALSVPCFAVRAFVIPPLLLDKPTRTLMFSNGIMPLGSRL

SEQ ID NO: 144359 - protein, 24 aa, Heterodera glycines
  Coding regions on vcDNA: vcDNA=SeqID_70782; Strand=-; Position=1 -35,355-394
MTVNRKQTQRQRETQLKIHPWDFG

SEQ ID NO: 144360 - protein, 156 aa, Heterodera glycines
  Coding regions on vcDNA: vcDNA=SeqID_70783; Strand=+; Position=1 -74,178-361,419-467,827-990
  Homolog annotation: Hit_ID=NP_594031.1; Match level="QueryCoverage =99%, HitCoverage=28%, E-value=2e-49, Identity=49%"; Hit description =aconitate hydratase [Schizosaccharomyces pombe] emb|CAB11263.1| SPAC24C9.06c [Schizosaccharomyces pombe]
MSRYEPNSRLPYEKLDANLAIIRKRLNRPLTLAEKIIYSHLDDPQNQKLERGVSYLNLRPDRVAMQDATAQMAMLQFISSGIPAVQVPTTIHCDHLIQAQVGRGLGGICIGVGGADAVDVMAGFPWELKCPNVIGVKLTGRLSGWTASKDIILKVG

SEQ ID NO: 144361 - protein, 256 aa, Heterodera glycines
  Coding regions on vcDNA: vcDNA=SeqID_70784; Strand=+; Position=1 -281,828-984,1174-1505
  Homolog annotation: Hit_ID=CAE71476.1; Match level="QueryCoverage =97%, HitCoverage=30%, E-value=4e-15, Identity=26%"; Hit description =Hypothetical protein CBG18394 [Caenorhabditis briggsae]
TKQNIPQTKAGKSTGGCEFAHADAIEDLCGAALVGNAAQSRSSTAEGDVRELYELGRRRRACPYFASRAALGLCQLVLVPYNILLHKSTRDAWRASESGLSPRNLRHIRQLHSLTVAVYNLATSTAKEEDGGAEERVLTLTQFMAKLGSASDIDLFRLLDYLDQSKLCRKLRDFRLRHSARGHSQPTVASSEQRNGAVGLKSHRGRSGQKLKQRQTAKKEMPRGNSASENIPPSANEHGEAATPADTNSTPLYQLR

SEQ ID NO: 144362 - protein, 95 aa, Heterodera glycines
  Coding regions on vcDNA: vcDNA=SeqID_70785; Strand=+; Position=1 -36,225-296,640-819
  Homolog annotation: Hit_ID=CAE65225.1; Match level="QueryCoverage =97%, HitCoverage=18%, E-value=2e-30, Identity=61%"; Hit description =Hypothetical protein CBG10101 [Caenorhabditis briggsae]
HVSLFILIRALPILQGVMFPAMHCLWSNWAPPLERGLLTGVSYAGAQIGNVLVMPLSGVLCRHGFDGGWPSIFYLLGIAGLCWCLLWALTVANTP

SEQ ID NO: 144363 - protein, 36 aa, Heterodera glycines
  Coding regions on vcDNA: vcDNA=SeqID_70786; Strand=+; Position=1-108
LAFSSSLLVYWHFLWHNISYLFLVFSFLVAFPYGTT

SEQ ID NO: 144364 - protein, 165 aa, Heterodera glycines
  Coding regions on vcDNA: vcDNA=SeqID_70787; Strand=-; Position=1 -151,266-408,450-563,1683-1772
MTSLPGETADQLFDWICSSMEKHQLDFKNLISFCADNAPTNFGVPQQLQEAHILHNAAKKGAEQLQFDIESVVYKLTSYFKGSTQRHTEFHEICDQYEIPTSNAFVERVFSLASSQWTKERNLLEVESVKALLLVQVIQLFYYYLVNPNIAGFNRKLRELRPRRR

SEQ ID NO: 144365 - protein, 128 aa, Heterodera glycines
  Coding regions on vcDNA: vcDNA=SeqID_70788; Strand=-; Position=1 -35,272-623
  Homolog annotation: Hit_ID=XP_470219.1; Match level="QueryCoverage =82%, HitCoverage=7%, E-value=1e-22, Identity=47%"; Hit description =Putative retroelement [Oryza sativa] gb|AAK98731.1| Putative retroelement [Oryza sativa]
MKSLLKIIFRQRPYRYPPETQKEIERQIKMMLDQNIIRESESEYSSPIVMVPKADKKSWRFAVDYRALNKMTKKRVFHLPNIQELLDLMGAKKFYTCMDMQQGFMQIPMAKEDMRKQRSFHIWEYTNL

SEQ ID NO: 144366 - protein, 51 aa, Heterodera glycines
  Coding regions on vcDNA: vcDNA=SeqID_70789; Strand=-; Position=1 -94,138-199
MAILLKCVLLLSIMEIFCDCMNDPGKKGKSKAIRKKAEPDDYFKMINFNAN

SEQ ID NO: 144367 - protein, 74 aa, Heterodera glycines
  Coding regions on vcDNA: vcDNA=SeqID_70790; Strand=-; Position=1-505
CFAVPRTGRQWIALNLQEIRLAISGCKKLLGNELFFEVSQTPYWCFAVPRTGMQWMALNLQEIRLAICGCKKLL

SEQ ID NO: 144368 - protein, 169 aa, Heterodera glycines
  Coding regions on vcDNA: vcDNA=SeqID_70791; Strand=-; Position=1 -299,349-417,940-1014
  Homolog annotation: Hit_ID=NP_001001173.1; Match level="QueryCoverage= 68%, HitCoverage=9%, E-value=2e-31, Identity=62%"; Hit description=5 -oxo-L-prolinase [Bos taurus] dbj|BAD13433.1| 5-oxo-L-prolinase [Bos taurus]
NTRITDVEVWERRYPVIVRRLPLRAGSGGDGRFRGGDGISRHLQFRRVLHLSLLTERRVFPYGLNGGEAAKRGKNTLCRKDGTRVNLGAKNSAESGSRDILELETPGGGGWGQNGQKCTQQDILELETPGGGGWGQNGQKCTQQGALLQPLQQFPFDGIVQFCRGQCFF

SEQ ID NO: 144369 - protein, 21 aa, Heterodera glycines
  Coding regions on vcDNA: vcDNA=SeqID_70792; Strand=-; Position=1 -54,566-577
MRTRPIWQVKQRLLTSQKKGF

SEQ ID NO: 144370 - protein, 392 aa, Heterodera glycines
  Coding regions on vcDNA: vcDNA=SeqID_70793; Strand=-; Position=1 -746,838-1268
  Homolog annotation: Hit_ID=AAK82953.1; Match level="QueryCoverage =53%, HitCoverage=62%, E-value=1e-10, Identity=31%"; Hit description =Erp precursor [Mycobacterium smegmatis]
HFNHWDSILLHSNHWDLTSPGPSAFQSLGLNSPAFQSLGLNPPAFQSLGLNSLAFQSLGLNTPAFQSPGLNSPGLQSLGLSFYAFQSQGLKTPAFQSPGLNSPGLQSLGLYSPAFQSPGLSFYAFQSPGLILLHFNHWSILLHSNHWDLTSPGPSASQSSRLNSAKFQSPELNSATFQSLGLNSPSFQFPGLNPTSIPVTGTLFSCIPITGTQLSNIPVTGTQFSSIPITGTQLTIIPIAGTEPHLILRTSITGTLFSCVSITRTQFLCIPITVTHSPAFQSLGLNPPAFQSLGLNSLAFQSLGPNLTWSFGIAIIETQFCDIPITGTQFSIIPIPGTQSHQHSNHWDSILHFSRILRHRNNRGLSSPPFQSPRTQSFTIPNNELNFTDSSA

SEQ ID NO: 144371 - protein, 245 aa, Heterodera glycines
  Coding regions on vcDNA: vcDNA=SeqID_70794; Strand=+; Position=1 -21,330-554,614-763,1016-1162,1221-1415
  Homolog annotation: Hit_ID=AAP30770.1; Match level="QueryCoverage =88%, HitCoverage=84%, E-value=2e-61, Identity=58%"; Hit description =putative gland protein G17G01 [Heterodera glycines]
MRAMKNYAFLHDISGGHCKRFTFIGKDSKTGEFGAVFDERKWHNQLFMISTNGQPIEEQQQKFMDELAEKLPPAGRHCIPITLSPFFWTEKDRNVLDYVMDLFSGQLLIAMCSLLTLGVGFIRVLRSAAEYEFYDCCTAFYSVFCWSASAWFSSCLLLYWTPSWSCINFRADDTNVPLVTLVFSIVMVCTFVFEIFFNNSLLKNRPVNASVAAADQKLRNDVAKECANVVIHRQQQKNGSAIMQT

SEQ ID NO: 144372 - protein, 60 aa, Heterodera glycines
  Coding regions on vcDNA: vcDNA=SeqID_70795; Strand=-; Position=1 -24,313-471
MAIEHSTWTVEDAQAAEREAMEFIRKYEQQNGGGGEGQQQSTMSDQRGMTAGHSPIGDDH

SEQ ID NO: 144373 - protein, 48 aa, Heterodera glycines
  Coding regions on vcDNA: vcDNA=SeqID_70796; Strand=+; Position=1 -4,233-375
MGIIRVVRCKFKKKNQLACQKLHFFSQSFLKKKTVLRSASGEKLEIFV

SEQ ID NO: 144374 - protein, 108 aa, Heterodera glycines
  Coding regions on vcDNA: vcDNA=SeqID_70797; Strand=-; Position=1 -215,272-384
LITSDGLPLYSFYEYKSGITGKPQSCGVASEKALTQTKKNGLLYKASEHGTLQGYKAAMDFLTAKRLPLVTRIFAPPSFHEYNGTFVYIPSIKECEEAEKNKTKQCTH

SEQ ID NO: 144375 - protein, 179 aa, Heterodera glycines
  Coding regions on vcDNA: vcDNA=SeqID_70798; Strand=-; Position=1-539
  Homolog annotation: Hit_ID=XP_526077.1; Match level="QueryCoverage =58%, HitCoverage=21%, E-value=2e-09, Identity=31%"; Hit description =PREDICTED: similar to flagelliform silk protein [Pan troglodytes]
MTGKIDWLQHFTAWHQFFCFFQSVGLNSPAFQSPGLNSPGVQSLGLYSPAFQSLGLNPPAFQSLGLNPPAFQSLGLNSPAFQSLGLNTPAFQSPGLNSPGLQSLGLYSPAFQSPGLSFYAFQSPGLILLHFNHWDSTLQHFNHWDSILLHFNHWDSTLQHFNHWDLISLAFQSLGPNIT

SEQ ID NO: 144376 - protein, 136 aa, Heterodera glycines
  Coding regions on vcDNA: vcDNA=SeqID_70799; Strand=-; Position=1-804
STDYREANPEGFGLPINLGASVRGDCPENKKIDFFKCPFGVLKQLWGAKIQGKNKVEVYRSYSRRIRSPHKSGRIGSGGLPRKQKNRFFQVSVWGTQTIMGSKNPTQNYSTGFREAIPEGFGLPINLGAWEEGDCP

SEQ ID NO: 144377 - protein, 87 aa, Heterodera glycines
  Coding regions on vcDNA: vcDNA=SeqID_70800; Strand=-; Position=1-677
IIFIQKIFFWVFGAVPLNRCAQIYGETESFGNSFPIACTLILRWIFAPHNCLSTPNGHLKKSIYFCFRGSPPEPMRPDLWGDRIFRE

SEQ ID NO: 144378 - protein, 147 aa, Heterodera glycines
  Coding regions on vcDNA: vcDNA=SeqID_70801; Strand=-; Position=1 -81,143-235,598-691,1000-1175
MALFGFGLGILSAISSYVGFHNIYAGMVYLASSLFYLSVIIAMKKKEPSLFLPYLIFEGIGLLCAAVISLTMFIFGIWSPQQAFSTKEQEMNFRSLMLFFAATVGIDVALNAWFYSIIYRTYNLLKKTTKLVASASAVASARVPPPV

SEQ ID NO: 144379 - protein, 78 aa, Heterodera glycines
  Coding regions on vcDNA: vcDNA=SeqID_70802; Strand=+; Position=1-237
MGGIEVMMMMMRKDDDDYEEDGQNGNENGWMTHQNEELDKIAISTWAFEAETKYRLLMRRQAPLFCLALVFVEKKRDG

SEQ ID NO: 144380 - protein, 166 aa, Heterodera glycines
  Coding regions on vcDNA: vcDNA=SeqID_70803; Strand=+; Position=1 -126,1120-1191,1526-1705,2233-2355
MGFYINLEVSTFDGASLLPPTLGLRPKAFVVLKRIWNCNDNDALRKRIPTFPFEKRLSKIDTLNLACAYINLLDVCNACKLLNFSQIFMSLRKFWPLKSIQLFFWNTQLVWQNMAGTQHKLFGAQAICFLDWTGSIGKEWEWTRPEHHLNFKFGFIILIIHNIENK

SEQ ID NO: 144381 - protein, 57 aa, Heterodera glycines
  Coding regions on vcDNA: vcDNA=SeqID_70804; Strand=-; Position=1 -67,1079-1185
MVFSGVFVFFEQKKQNWSKASNYFEGANSLAPYEQAANREGIQFSAMKNAVIQNFCH

SEQ ID NO: 144382 - protein, 70 aa, Heterodera glycines
  Coding regions on vcDNA: vcDNA=SeqID_70805; Strand=+; Position=1 -38,343-517
MHREKMLKCHEKNVINANVATTQTIQLKFSGAKDPIATFSGVDNSDPQNYHMIIKTCVLKGNVCQKGSEN

SEQ ID NO: 144383 - protein, 67 aa, Heterodera glycines
  Coding regions on vcDNA: vcDNA=SeqID_70806; Strand=+; Position=1-203
MDPSVATKGGRFSLENYKQNNSIATSCEQQLQQSGGSETLAIGKVLHGFNIAFAEDKLLLTSSTSQK

SEQ ID NO: 144384 - protein, 106 aa, Heterodera glycines
  Coding regions on vcDNA: vcDNA=SeqID_70807; Strand=+; Position=1 -126,494-595,639-728
MLEEAKTMVDQLVEVGSVHAAYYGCSAEYQFQMGDHDRYYEELAHPILNDLSDTPNAWLNELLHAVNAGDWDGFLKHEEKLVAAYSEAGRKIEALERKLRLQCLIE

SEQ ID NO: 144385 - protein, 70 aa, Heterodera glycines
  Coding regions on vcDNA: vcDNA=SeqID_70808; Strand=-; Position=1-213
MALLSDRFDILVDKHFDGKGELAIWRIIRIDKDEGPKPKLSVRIDGTFVEFPFPDQPLPNKIRFCFLQIQ

SEQ ID NO: 144386 - protein, 233 aa, Heterodera glycines
  Coding regions on vcDNA: vcDNA=SeqID_70809; Strand=+; Position=1-702
MSITRRALFATSIRHLSFHDGDALDNLRSRTSPTILTDLDQLNSIDSGLLLPDGIADDGPNATAGQALTKWLHTPSKNGQPKQLRFRAYVSPPNFECVNNFKEVSCHIFVNLFLFYQFSLDIRRATTSVSYHIQFYFWVDTMPTEPFELVNKVTKEKLTLKQNIDEFDLNVCNWLLQRCPIGETATAPVKWENRENSGANFNYIRFELWYDNNSDANLNKIIFDLWGENDGNH

SEQ ID NO: 144387 - protein, 23 aa, Heterodera glycines
  Coding regions on vcDNA: vcDNA=SeqID_70810; Strand=+; Position=1-73
PLSPPAEEENVEEEADQSNGNVV

SEQ ID NO: 144388 - protein, 112 aa, Heterodera glycines
  misc_feature (15)..(15): Xaa can be any naturally occurring amino acid
  Coding regions on vcDNA: vcDNA=SeqID_70811; Strand=+; Position=1 -156,217-374,700-723
  Homolog annotation: Hit_ID=NP_006306.2; Match level="QueryCoverage =82%, HitCoverage=38%, E-value=6e-29, Identity=59%"; Hit description =ring finger protein 3 [Homo sapiens]
VIFLFILFSKIVNYXFGFRTCPLCNGYLVEATTVIDCLHTFCKSCLLKYFEDNNDCPKCHNQIHQSHPSHYVAFDRTMQDIVYKLVPGMQAEEQRRREQVHPHGKMDENGDT

SEQ ID NO: 144389 - protein, 238 aa, Heterodera glycines
  misc_feature (36)..(36): Xaa can be any naturally occurring amino acid
  misc_feature (48)..(48): Xaa can be any naturally occurring amino acid
  misc_feature (58)..(59): Xaa can be any naturally occurring amino acid
  misc_feature (135)..(135): Xaa can be any naturally occurring amino acid
  misc_feature (151)..(151): Xaa can be any naturally occurring amino acid
  Coding regions on vcDNA: vcDNA=SeqID_70812; Strand=+; Position=1-733
  Homolog annotation: Hit_ID=BAB33421.1; Match level="QueryCoverage =95%, HitCoverage=81%, E-value=1e-73, Identity=66%"; Hit description =putative senescence-associated protein [Pisum sativum]
SKNIAILPRRDSDLEAFSHNPSDGSFAPLVYRPSTXTKCLNLRFLSYXAGLLLATGLXXGKTNLSHDGLNPAHVPYWWVNNPTLGEFCFAMIGRADIEGSKSDVAMDAWPPQASYPCGNFSDTSCWKLYTLKDRXATLSRSVFVLKIRIKXAFAFLLYERFPSSLSSLGHLRYALTDVPPQSNSPPDTVIVGGSPGHRVARLNTKMDRRTPVLPIKLGSMSSGISLAPCGSHLCYTSH

SEQ ID NO: 144390 - protein, 88 aa, Heterodera glycines; identical to SEQ ID NO: 133373
  Coding regions on vcDNA: vcDNA=SeqID_70813; Strand=-; Position=1 -96,135-305

SEQ ID NO: 144391 - protein, 80 aa, Heterodera glycines
  Coding regions on vcDNA: vcDNA=SeqID_70814; Strand=-; Position=1-551
LFEYPIRTLEKIDFFVFGAVPPNRCAQIYGETESFGNSFPIACTLILRWIFAPHKCLSTPNGHLKKSIFLFHKYFFQKVL

SEQ ID NO: 144392 - protein, 60 aa, Heterodera glycines
  Coding regions on vcDNA: vcDNA=SeqID_70815; Strand=-; Position=1-182
IKSIPSGDRDGCRGVSRVGSFHHGHRTFWLVSNRGLTCQIGRVRMMPLLQAPHQKQNDIT

SEQ ID NO: 144393 - protein, 87 aa, Heterodera glycines; identical to SEQ ID NO: 129152
  Coding regions on vcDNA: vcDNA=SeqID_70816; Strand=-; Position=1-697

SEQ ID NO: 144394 - protein, 17 aa, Heterodera glycines
  Coding regions on vcDNA: vcDNA=SeqID_70817; Strand=-; Position=1-66
HKHLFDLFYHIHNLIKI

SEQ ID NO: 144395 - protein, 59 aa, Heterodera glycines
  Coding regions on vcDNA: vcDNA=SeqID_70818; Strand=-; Position=1 -110,414-482
  Homolog annotation: Hit_ID=CAE66880.1; Match level="QueryCoverage =100%, HitCoverage=11%, E-value=1e-10, Identity=47%"; Hit description= Hypothetical protein CBG12259 [Caenorhabditis briggsae]
NGRRFLNDKFRLSPKALVERPSDGDLLANSVKDVMETLAMVDYPYPATFLAPLPGWPVK

SEQ ID NO: 144396 - protein, 230 aa, Heterodera glycines
  misc_feature (11)..(11): Xaa can be any naturally occurring amino acid
  Coding regions on vcDNA: vcDNA=SeqID_70819; Strand=-; Position=1 -163,370-552,938-1041,1386-1572,2734-2790
  Homolog annotation: Hit_ID=NP_498719.1; Match level="QueryCoverage =87%, HitCoverage=39%, E-value=5e-68, Identity=61%"; Hit description =prolylcarboxypeptidase precursor (56.9 kD) (3I996) [Caenorhabditis elegans] gb|AAA28227.1| Hypothetical p
IEKNYVFLGSXDDFNILNFIFRYLLNTDSFRDKNAPIFFYTGNEGSIEGFAENTGFMWDIAPEFGAAIVFAEHRFYGKTQPFGNESYTKLENLGYLSSEQALADFAQLIDYLKNEKLPNAKHSPVIGFGGSYGGMLTAWMRIKYPHLMDGGIAASAPVFWFLNATPPEDAYDKIVTRTFVNSGCNVESIKQSMDAIRDLAKTGGHIIVINILYSLQGTFYIHFQMPINVF

SEQ ID NO: 144397 - protein, 73 aa, Heterodera glycines
  Coding regions on vcDNA: vcDNA=SeqID_70820; Strand=-; Position=1 -209,464-476
MLNLLLFLLIVSPILAIEKPWIRRDPITLTKFSRHFALKEAPRYKWQELWYDNMPIDHFSFSDPRSFRLRIIR

SEQ ID NO: 144398 - protein, 24 aa, Heterodera glycines
  Coding regions on vcDNA: vcDNA=SeqID_70821; Strand=+; Position=1-76
ITGVSIIAVLFLVFLMPSQNLVRF

SEQ ID NO: 144399 - protein, 50 aa, Heterodera glycines
  Coding regions on vcDNA: vcDNA=SeqID_70822; Strand=+; Position=1-484
LLFKYAKNFRLNFFFINWSEANQILREHQKDKEKHCYDAYSSNSEFKIFY

SEQ ID NO: 144400 - protein, 19 aa, Heterodera glycines
  Coding regions on vcDNA: vcDNA=SeqID_70823; Strand=-; Position=1-59
MPTYYDYHSKRLKTAHGTQ

SEQ ID NO: 144401 - protein, 89 aa, Heterodera glycines
  Coding regions on vcDNA: vcDNA=SeqID_70824; Strand=+; Position=1 -132,192-327
MSQFSDDSQPPVLDGPYSPVGDGGAELMDDAPPLEDVMKRLPISVEPSDNNERKVQKEPSITHELDAELFNGNGFACLSAAQAEAGRFK

SEQ ID NO: 144402 - protein, 152 aa, Heterodera glycines
  Coding regions on vcDNA: vcDNA=SeqID_70825; Strand=-; Position=1 -64,568-748,809-948,1488-1529
  Homolog annotation: Hit_ID=NP_506859.2; Match level="QueryCoverage =97%, HitCoverage=4%, E-value=1e-57, Identity=66%"; Hit description =speract/scavenger receptor (5P989) [Caenorhabditis elegans] emb|CAB03852.2| Hypothetical protein C06B8.7 [
DSKLPELRLIDGPTVRPSRLQIRFRDRWRSVCTQMTNWTSIDTGTACRTMGYDDGAFWRFFRRNNDTYPFVMPAPKCTQGQNSLWNCPGFEDSLWNCPGFEDKEQIPLSENLCQGEDDIGIYCWGRPTFIGWARHGKGLIILFNMFHFFTQL

SEQ ID NO: 144403 - protein, 95 aa, Heterodera glycines
  Coding regions on vcDNA: vcDNA=SeqID_70826; Strand=+; Position=1 -24,360-621
MAGRKGPRATLFRALAIPLCGFISAYFSIQQQSDTVIRPNGLMPFWYMNVPRYTFDQNVKMFITNMYCNALKPFKQLQMNREEFVLLLAILITQT

SEQ ID NO: 144404 - protein, 101 aa, Heterodera glycines
  Coding regions on vcDNA: vcDNA=SeqID_70827; Strand=+; Position=1 -173,567-699
MMRREKKKLLGTSTCRTHWPLSFQQRYAKNVAKTSSCMTVAMSGKAKRTLSLFSAVLSVGGRNRSCATFSNSALEHALTGNICPRSYKQRTGGNSSSFYGL

SEQ ID NO: 144405 - protein, 24 aa, Heterodera glycines
  Coding regions on vcDNA: vcDNA=SeqID_70828; Strand=+; Position=1-80
RTLSTAVRQRSSKIYSMPQILWAG

SEQ ID NO: 144406 - protein, 24 aa, Heterodera glycines
  Coding regions on vcDNA: vcDNA=SeqID_70829; Strand=+; Position=1-80
RTLSTAVRQRSSKIYSMPQILWAG

SEQ ID NO: 144407 - protein, 33 aa, Heterodera glycines
  Coding regions on vcDNA: vcDNA=SeqID_70830; Strand=-; Position=1 -82,415-434
MSMKQHITSLERKYAEKKPKLKARLRKILFNDF

SEQ ID NO: 144408 - protein, 92 aa, Heterodera glycines
  Coding regions on vcDNA: vcDNA=SeqID_70831; Strand=-; Position=1 -16,465-727
MVLRRAFLRRRNSECLSPFREAEDSDQAATSMEEKVEEMRRAIWTICADVERMESNFVVGMPHIKVQVSQSLITGLIAFGLINSASQTPIKS

SEQ ID NO: 144409 - protein, 100 aa, Heterodera glycines
  Coding regions on vcDNA: vcDNA=SeqID_70832; Strand=-; Position=1 -91,345-443,755-868
  Homolog annotation: Hit_ID=NP_506699.1; Match level="QueryCoverage =57%, HitCoverage=8%, E-value=5e-15, Identity=65%"; Hit description =cyclic nucleotide-gated channel (5P506) [Caenorhabditis elegans] emb|CAB02935.4| Hypothetical protein F14H
SGPTAFGNLTKKYAMSFYWSALTLVTLGEQPWPENSVQSMFEIVDTLIGLLVFAAIIGDVGIMPCQPSNARQSDQMGGIPMDEQRSGPNSGRKCGKNKNQ

SEQ ID NO: 144410 - protein, 45 aa, Heterodera glycines; identical to SEQ ID NO: 124527
  Coding regions on vcDNA: vcDNA=SeqID_70833; Strand=-; Position=1-138

SEQ ID NO: 144411 - protein, 63 aa, Heterodera glycines; identical to SEQ ID NO: 142617
  Coding regions on vcDNA: vcDNA=SeqID_70834; Strand=+; Position=1-710

SEQ ID NO: 144412 - protein, 24 aa, Heterodera glycines
  Coding regions on vcDNA: vcDNA=SeqID_70835; Strand=+; Position=1 -52,295-317
MEKACKIWRDYIDFSALELLELAS

SEQ ID NO: 144413 - protein, 100 aa, Heterodera glycines
  Coding regions on vcDNA: vcDNA=SeqID_70836; Strand=+; Position=1 -165,661-696,1289-1387
  Homolog annotation: Hit_ID=CAE60287.1; Match level="QueryCoverage =46%, HitCoverage=17%, E-value=8e-10, Identity=41%"; Hit description =Hypothetical protein CBG03870 [Caenorhabditis briggsae]
MGGEIRQRFTSSRQQQQQQEQQQRRQQPQQQQSAGKGSSLTVVVGGESQQQQRQQPVKNADFIIPVEYADPVVDLLDKRRIFRSRLFRESCVFYEGNYVK

SEQ ID NO: 144414 - protein, 24 aa, Heterodera glycines
  Coding regions on vcDNA: vcDNA=SeqID_70837; Strand=+; Position=1 -52,295-317
MEKACKIWRDYIDFSALELLELAS

SEQ ID NO: 144415 - protein, 44 aa, Heterodera glycines
  Coding regions on vcDNA: vcDNA=SeqID_70838; Strand=-; Position=1 -118,253-269
MSPLRFIIAFLLVVLCAFSPLITAQEERVDNEPAALRARQYLCK

SEQ ID NO: 144416 - protein, 30 aa, Heterodera glycines
  Coding regions on vcDNA: vcDNA=SeqID_70839; Strand=-; Position=1-3,67- 156
MLYPLILKISLRKHGEINFIFFYCINYFYK

SEQ ID NO: 144417 - protein, 75 aa, Heterodera glycines
  misc_feature (23)..(23): Xaa can be any naturally occurring amino acid
  misc_feature (25)..(25): Xaa can be any naturally occurring amino acid
  Coding regions on vcDNA: vcDNA=SeqID_70840; Strand=+; Position=1 -43,121-311
  Homolog annotation: Hit_ID=NP_497744.1; Match level="QueryCoverage =98%, HitCoverage=22%, E-value=2e-15, Identity=53%"; Hit description =galanin receptor 2 (3E774) [Caenorhabditis elegans] emb|CAA88290.1| Hypothetical protein T27D1.3 [Caenorh
YFICYSPIQLFLCRGLFNLSIHXPXYEFVLLMNALAILCSACNPLLYTLFSSRFRARIGHLLCLCCDIFYRRNNK

SEQ ID NO: 144418 - protein, 122 aa, Heterodera glycines
  Coding regions on vcDNA: vcDNA=SeqID_70841; Strand=-; Position=1-368
NRRIIFSFWNKTFARNSEKEMWEKGGGGGEKHRQKDKQSNFETELKVEKCHSSAFLGDSETKGKAKRQKKGGKVMEDKSKDGRSDRRRKRHSLVKKFHVCVFVSSVPFAVFRKRRRAVGHCH

SEQ ID NO: 144419 - protein, 88 aa, Heterodera glycines
  Coding regions on vcDNA: vcDNA=SeqID_70842; Strand=-; Position=1 -253,383-396
MGFRDVDDDGYEEEEAAAVNGGGGTSPMNGGGNNKLATATTTAKLFQNGITTNTNGKKGGDDDDDGQEEEEANDGDTTITAHGNVLWW

SEQ ID NO: 144420 - protein, 144 aa, Heterodera glycines
  Coding regions on vcDNA: vcDNA=SeqID_70843; Strand=-; Position=1 -99,405-605,653-787
MKSSLFSLRPFFLIFSLLFLSSKFRLQNACPFQSLSADQIEDNASEETEAAEESAFVQQQSTRPPKESTDQFAETIETTINGHKMGKMTNIRRRKKSVVPYDYFPRDVFPTLKNIIIEETTEQTTTTTTPVTVEQTRQTTKIPK

SEQ ID NO: 144421 - protein, 41 aa, Heterodera glycines
  Coding regions on vcDNA: vcDNA=SeqID_70844; Strand=+; Position=1-124
MGKRKLLPKIHGKKGVKERQKKREERKAQTAKAMQARWAKK

SEQ ID NO: 144422 - protein, 18 aa, Heterodera glycines
  Coding regions on vcDNA: vcDNA=SeqID_70845; Strand=+; Position=1-56
YREAIPEGFGLPINLGAS

SEQ ID NO: 144423 - protein, 95 aa, Heterodera glycines; identical to SEQ ID NO: 136768
  Coding regions on vcDNA: vcDNA=SeqID_70846; Strand=-; Position=1 -318,653-1168

SEQ ID NO: 144424 - protein, 66 aa, Heterodera glycines
  Coding regions on vcDNA: vcDNA=SeqID_70847; Strand=-; Position=1-204
LFEYPKRTLEKIDFFVFGAVSPSRCAQIYGETESFGNSFPIACTLILRWIFAPHKCLSTPNGLLKK

SEQ ID NO: 144425 - protein, 182 aa, Heterodera glycines
  Coding regions on vcDNA: vcDNA=SeqID_70848; Strand=-; Position=1 -480,531-599
  Homolog annotation: Hit_ID=BAA92244.1; Match level="QueryCoverage =84%, HitCoverage=42%, E-value=3e-33, Identity=46%"; Hit description =type 1 protein phosphatase-1 [Vicia faba]
MAKEEYCFDAKAAAAAGQSRRPSTTASVLVQGDGQSSRFVDAIIRKVTQPPLQRFTDEVDHKFWNVLKQLIKFSFFAQITDEELKQLCKAATDVFRMQPTLVRIRPPVVVVGDIHGQFSDLQRIFTTHGPPPEQQYMFLGDYVDRGAHSMETIILLFCYKIKYPSNFMLLRGNHECSNINKA

SEQ ID NO: 144426 - protein, 68 aa, Heterodera glycines
  Coding regions on vcDNA: vcDNA=SeqID_70849; Strand=-; Position=1 -88,610-725
MPQIYNSKSEFTPSAQVPPRGSSSHWPADARLPTGGRGQCRTDAFGIAQPNLGNAVFLAVWPRRAGQH

SEQ ID NO: 144427 - protein, 32 aa, Heterodera glycines
  Coding regions on vcDNA: vcDNA=SeqID_70850; Strand=-; Position=1-138
LKFSVYVAQKISYSELIAFTKPLNSFALLICT

SEQ ID NO: 144428 - protein, 92 aa, Heterodera glycines
  Coding regions on vcDNA: vcDNA=SeqID_70851; Strand=+; Position=1 -68,218-332,558-650
MVYQSKEHCRVLFAQLEAVESNTLQLLANTLDDALTKAELVKKRQSEDVLLHMTVLNTKYLGWQGWKKTTLNVTQLLEKYGQLNFDPINVEE

SEQ ID NO: 144429 - protein, 49 aa, Heterodera glycines
  Coding regions on vcDNA: vcDNA=SeqID_70852; Strand=+; Position=1 -66,507-590
MSMNVQYMIALWAKLCNIEEKNANREHKLLVMNINNKNLVGFEQMRKDT

SEQ ID NO: 144430 - protein, 47 aa, Heterodera glycines
  Coding regions on vcDNA: vcDNA=SeqID_70853; Strand=-; Position=1-143
SPISPVSPIQPMSTDWSNAIDAQEMGAGGVGGGISSGSLHESLHELS

SEQ ID NO: 144431 - protein, 55 aa, Heterodera glycines
  Coding regions on vcDNA: vcDNA=SeqID_70854; Strand=-; Position=1 -30,1056-1193
MGASIKMPNCANFRCFSTSNQLNFARICTNAAEAISDIPNGATILFGGNREIFYF

SEQ ID NO: 144432 - protein, 15 aa, Heterodera glycines
  Coding regions on vcDNA: vcDNA=SeqID_70855; Strand=-; Position=1-45
MNIMPANLGKMPMKN

SEQ ID NO: 144433 - protein, 66 aa, Heterodera glycines
  Coding regions on vcDNA: vcDNA=SeqID_70856; Strand=-; Position=1-201
MANYSVKLPISDSQFAWFIVELAWLVNRDRAGSINTALMLRRMCEFRVIIMIANKPLFKKNDYLNK

SEQ ID NO: 144434 - protein, 78 aa, Heterodera glycines
  Coding regions on vcDNA: vcDNA=SeqID_70857; Strand=+; Position=1-237
MTAKFYLGSVINQFPISTYEQQLGKGFMAYKELYDKMDKKKDDAKFNKKYAKVPKNNAEEMKPLPDPCEQAKLKWKKN

SEQ ID NO: 144435 - protein, 97 aa, Heterodera glycines
  Coding regions on vcDNA: vcDNA=SeqID_70858; Strand=+; Position=1 -132,1066-1227
MAQTNNNHLKHAFALFLVTAFVILIAVVLAEKSVTNSDSATAAKDIQRMEKLQKAQEYVDKLNEAQNYWTVRPILSITAKLFLKLFIYLRPSFTKIL

SEQ ID NO: 144436 - protein, 188 aa, Heterodera glycines
  Coding regions on vcDNA: vcDNA=SeqID_70859; Strand=+; Position=1 -254,310-622
MGGPCVAEGEALGQMKRELTDRRIIEFVAGGPKNYGIRHTAGEGSEERANLKIRRFRLSNTAQQLLTFEAMKDLTLATYNIDGPIDDALDNDDLYVYGGGEHRAISVNFPQIDRNVYADLYTHEAHKDYRPFYAKGRVRPGMQTRPFGYVEDDGQPNGGQRTPDASTIEKFFGTRSHTARTLWVVLML

SEQ ID NO: 144437 - protein, 127 aa, Heterodera glycines
  Coding regions on vcDNA: vcDNA=SeqID_70860; Strand=+; Position=1 -159,372-529,607-671
MVDVPADFAVLLNSAPPISRIESNKMHWLRKRQQTNATALQRGIDQIGQLATERPVTSFARFADSPDEQALYLLWEPLTSDQPTANGGPSSRIYGYLKVKLTNKELKGRPGPTIVFGGRRRATVRHD

SEQ ID NO: 144438 - protein, 132 aa, Heterodera glycines
  Coding regions on vcDNA: vcDNA=SeqID_70861; Strand=+; Position=1-399
MLGVGQLGNHCQVRNLDSGPAKLEKHNGRNEPKKAQKRQPMAEQTTGENQREGKSDTNGAENAKVEIGNGKMPNQPMICHDFRRPKRRKMPGRRDKSLSIPTNGVDTASVTWRKMAKCFCPSTFAVFPWNIH

SEQ ID NO: 144439 - protein, 297 aa, Heterodera glycines
  Coding regions on vcDNA: vcDNA=SeqID_70862; Strand=-; Position=1 -116,202-307,355-542,597-725,793-975
  Homolog annotation: Hit_ID=CAE68630.1; Match level="QueryCoverage =95%, HitCoverage=45%, E-value=2e-49, Identity=44%"; Hit description =Hypothetical protein CBG14518 [Caenorhabditis briggsae]
GHFYDLCASMWFTYLLFLEKVVLLLSWQAGLLMFIGQVTDAVSTPLVGVTDAVSTPLVGMLSDLSLLPGILRRFGRRKSWHIIGTVCVTLSFPLIFSGCLLCHTVCVTLSFPLIFSGCLLCHLPFLRLLWFIPPIMLFQFGWAAVQISHLAMIPELSNSEHTRMSMTSYRYGFTVAANLFVSMTSYRYGFTVAANLFVFACLFLFLAQDKDTSKIKPSDLANFRNLGLVAVALGTANLGLVAVALGTAVTALFYGGVSEPNSGQRRMSRLNSESGDEHRLGRMSSKKIFYHGAEMER

SEQ ID NO: 144440 - protein, 16 aa, Heterodera glycines
  Coding regions on vcDNA: vcDNA=SeqID_70863; Strand=-; Position=1-49
EAIPEGFGLPINLGAS

SEQ ID NO: 144441 - protein, 32 aa, Heterodera glycines
  Coding regions on vcDNA: vcDNA=SeqID_70864; Strand=+; Position=1 -62,189-225
MLFLLFVFVFLIINNSTDKILKNVKLFTNFMQ

SEQ ID NO: 144442 - protein, 48 aa, Heterodera glycines
  Coding regions on vcDNA: vcDNA=SeqID_70865; Strand=+; Position=1 -94,185-237
MHAFCARAIYHRACQSKAKQQRCCFERIKGIESVNRLLENIFAIYQQF

SEQ ID NO: 144443 - protein, 36 aa, Heterodera glycines
  Coding regions on vcDNA: vcDNA=SeqID_70866; Strand=+; Position=1-109
SKSSLTTAQKNMFFVHFRPRGAQEKNSLLPKNWSPN

SEQ ID NO: 144444 - protein, 274 aa, Heterodera glycines
  Coding regions on vcDNA: vcDNA=SeqID_70867; Strand=-; Position=1 -50,92-266,321-375,421-501,545-631,671-758
  Homolog annotation: Hit_ID=CAE57570.1; Match level="QueryCoverage =89%, HitCoverage=38%, E-value=4e-49, Identity=46%"; Hit description =Hypothetical protein CBG00548 [Caenorhabditis briggsae]
MKPDLKDRDFMYKLIVGQLFYDGHQQLALNQLFYDGHQQLALNLAQTLGLSLRPPPPSDKLFRLVAIAKQFVEDPESKERETILQVLFGFESAGLDLEFDADVVPGFESAGLDLEFDADVVPTSPEPSLYETVYLTTHKAPCRAAAFTSPEPSLYETVYLTTHKAPCRAAAFSPDGALVATASNDCSIKILDVDKIISSPDGALVATASNDCSIKILDVDKIISRQVPQKALSESGPDAHHPVIRLCPLSESGPDAHHPVIRLCPHLDVTNKTL

SEQ ID NO: 144445 - protein, 202 aa, Heterodera glycines
  Coding regions on vcDNA: vcDNA=SeqID_70868; Strand=-; Position=1-606
  Homolog annotation: Hit_ID=NP_500013.1; Match level="QueryCoverage =96%, HitCoverage=13%, E-value=4e-55, Identity=53%"; Hit description =predicted CDS, polyprotein family member (4B673) [Caenorhabditis elegans] gb|AAC02594.1| Hypothetical pro
MNFLGYIVNKNGYTSSISKVESILNLQNPTNVKEIRQVVGMASFFRKHIPNFSTIVEPLTRLTRKEKQFNWTDEQEKAFEKIKKILSEKPVLIFPDYSKPFHIFCDASNVGQGGALMQWDSENRVYNAIAYCSRTLSKTERNWPPVQTELGAIIFSLRQFKPFIFMSNIELHTDHKPLAFLLKKAETHQKLARWLIELQNYK

SEQ ID NO: 144446 - protein, 22 aa, Heterodera glycines
  Coding regions on vcDNA: vcDNA=SeqID_70869; Strand=+; Position=1-81
KSIKNLKMRIHARFSGNKLNRA

SEQ ID NO: 144447 - protein, 146 aa, Heterodera glycines
  Coding regions on vcDNA: vcDNA=SeqID_70870; Strand=-; Position=1-438
MASINDLDYVRDYDYVYDLDFDEMEECVEILDQENERNIRNYDVFEEHNYAKRQRFVDGGPSQGSMNLDAEVAGSSRMTDSQFEDRRLENLRKKRERDRIRWQNKSQESRNVRLEQMRNRNCNAIADESVAQRRMRLEQMRNRNCN

SEQ ID NO: 144448 - protein, 64 aa, Heterodera glycines
  Coding regions on vcDNA: vcDNA=SeqID_70871; Strand=-; Position=1 -30,632-795
MQMDATDAADISVTDCENERSESGVTIDNRGEHSFHFIIDEEDDEMQPMEMDEEEKADEGTKRR

SEQ ID NO: 144449 - protein, 48 aa, Heterodera glycines
  Coding regions on vcDNA: vcDNA=SeqID_70872; Strand=-; Position=1-145
IHSFFNNCLLNYELWRKINKTKFRSLFPDHHLYVLQPLHLNMMNVQSL

SEQ ID NO: 144450 - protein, 84 aa, Heterodera glycines
  Coding regions on vcDNA: vcDNA=SeqID_70873; Strand=-; Position=1 -132,751-870
MRRLSQLFLRCHWTPSEIAASCRHASSAATARPLYMDVQATTPMTWDKTDWRNARFEYTPKQVNPHNAAHLIAELAPVPSEERV

SEQ ID NO: 144451 - protein, 29 aa, Heterodera glycines
  Coding regions on vcDNA: vcDNA=SeqID_70874; Strand=-; Position=1 -15,338-412
MTKAEINKGLLGLLNDKKIVGFAWQRKKL

SEQ ID NO: 144452 - protein, 211 aa, Heterodera glycines
  Coding regions on vcDNA: vcDNA=SeqID_70875; Strand=+; Position=1 -453,1263-1442
MEPNNNNDQANQCQQTDISKSIESAVLPTMMELGGDEANASSPRAAETAQMPSLNATATNGGPGSFCDGTLGAPPYDNGHQNAAVTIAAAASLPKTTKALGEPANSGVAGGGGVDSLDQPSDDVEESHQAEELVVKEECIFPQDEYMEDEELQLVDQHNDDSPPENGIATTTDGTNERQQKNNGTTARDGETKQNQPKTIRMVVPIMLTTL

SEQ ID NO: 144453 - protein, 86 aa, Heterodera glycines
  Coding regions on vcDNA: vcDNA=SeqID_70876; Strand=-; Position=1 -179,1179-1262
  Homolog annotation: Hit_ID=NP_054798.1; Match level="QueryCoverage =80%, HitCoverage=18%, E-value=5e-10, Identity=36%"; Hit description =Kruppel-like factor 15 [Homo sapiens] gb|AAH36733.1| Kruppel-like factor 15 [Homo sapiens] sp|Q9UIH9|KLFF
IGSSSAADDDSKVGSSSRSAKLKRELRFHCDWPGCAYATAYGGDLNKHKRKHTGERPYQCPQCEYSTNKSSDWTKHLKTGKHKKSL

SEQ ID NO: 144454 - protein, 190 aa, Heterodera glycines
  Coding regions on vcDNA: vcDNA=SeqID_70877; Strand=-; Position=1 -115,201-434,527-576,813-984
  Homolog annotation: Hit_ID=EAA47202.1; Match level="QueryCoverage =77%, HitCoverage=32%, E-value=1e-08, Identity=26%"; Hit description =hypothetical protein MG11027.4 [Magnaporthe grisea 70-15] ref|XP _359956.1| hypothetical protein MG11027.4
TLAQLLKVTRSAQRREAAEDAVPPAKRQMGFRRGPLANPPPPPPPSQIEDGLPLPMPPSNAEVVAEPNATTSTTTAAKVIASRNTGCSTSSTALTMVTRSAQRRAAEEEAVPALAIPPPPPAGCSSSSSTAANPPPPSIRIPKGKTPKKVRPRRPEPDQPDDQYELRAVLATAEVVSGGTTHLCLYVDFL

SEQ ID NO: 144455 - protein, 18 aa, Heterodera glycines
  Coding regions on vcDNA: vcDNA=SeqID_70878; Strand=+; Position=1-56
YREAIPEGFGLPINLGAS

SEQ ID NO: 144456 - protein, 66 aa, Heterodera glycines
  Coding regions on vcDNA: vcDNA=SeqID_70879; Strand=+; Position=1 -42,536-693
MTLAFSFAAPLQKKRLMDPSKGLHNKIADKVTLAIDITEVEKLDSNPNKPNGTIVMEIDRLSNFAQ

SEQ ID NO: 144457 - protein, 64 aa, Heterodera glycines
  Coding regions on vcDNA: vcDNA=SeqID_70880; Strand=-; Position=1 -129,189-254
MSKWIPTFYTLNQKVLKQIRKVSSKKIISSTLRSPLFIFLIFPIDTTESLTPVAGHICVEYRGA

SEQ ID NO: 144458 - protein, 91 aa, Heterodera glycines
  Coding regions on vcDNA: vcDNA=SeqID_70881; Strand=-; Position=1 -66,113-149,195-364
MSSFAPFSALFLLAMVLNFHSLNGLIKRESALSNVEIAEKKDALNEEFTRKFGDLREGCFPRPKGKGCRCTVKGPMGHDEEKRFDRDEECR

SEQ ID NO: 144459 - protein, 231 aa, Heterodera glycines
  misc_feature (217)..(217): Xaa can be any naturally occurring amino acid
  Coding regions on vcDNA: vcDNA=SeqID_70882; Strand=-; Position=1 -115,164-317,415-511,732-795,900-1031,1333-1417
  Homolog annotation: Hit_ID=CAE61469.1; Match level="QueryCoverage =90%, HitCoverage=15%, E-value=2e-43, Identity=41%"; Hit description =Hypothetical protein CBG05362 [Caenorhabditis briggsae]
QDNCSWNAQCFDLPDDGDVPSWRCVCNPGFRGNGVNCTDACLNFCLNACLNFCLNDGICRKNRLGHVECQCKENFSGERCEIRFQVFFVGFVLISMLFSVVFLSVVFLLIIIVVVIWMISLRFNRSSSSEAKFSNLISLPPPLRSVLPGSPPCSPPPPIPPIGLYYEDEQPYEQSAGGGTLPRGAARHLRGGSQSQEVGAGQKNVQQHMYRQNNEQXIEKMKKVPIPNQTE

SEQ ID NO: 144460 - protein, 338 aa, Heterodera glycines
  Coding regions on vcDNA: vcDNA=SeqID_70883; Strand=+; Position=1-1017
  Homolog annotation: Hit_ID=NP_912739.1; Match level="QueryCoverage =71%, HitCoverage=20%, E-value=6e-33, Identity=35%"; Hit description =unnamed protein product [Oryza sativa (japonica cultivar-group)]
MYNPQGIITLAQHKVAELEALADIDWRLHSCFNLSCVHFSLPDPPNSIAKNTDAAIEEFFFGDDDLNLPPGQPNPRPQPNTPPPLNSDQQKVFDAVLLAIQSNPRDSTVPRRFFIYGDGGTGKTFLFGQIIRRLRKAPYTYKVLATASTGCAAILLPYGKTAHSTFRLGREVSLDKLPSIPLESFFARRIREAQLIIIDEITMLHNTVIEVIDRVCKEMAIRQHKDLLFGGKTVIFSGDFKQSLPVVPHEGLTAQVTACFQTSPLFGQFTTMKLTINQRLGQGQQAYLQMCRQIGLGETGEHFWIPPQFLVKSKEELIDYVYPNFQQLLGNDKELLNR

SEQ ID NO: 144461 - protein, 72 aa, Heterodera glycines
  Coding regions on vcDNA: vcDNA=SeqID_70884; Strand=-; Position=1 -144,189-348
LKILPDNVLQRFVVGSTHGIVLQLDLNGMILRSWHDPEGSVISHISEVDDDGGDFLYLSSFVNNYIGRMSKE

SEQ ID NO: 144462 - protein, 70 aa, Heterodera glycines
  Coding regions on vcDNA: vcDNA=SeqID_70885; Strand=+; Position=1-213
MVGSQQQQQYHLLPTQQLNHNRNKQYTTQQQQQQQFTSPYATSNYGYHELTHPPAYSMSMVGGGDAGQRR

SEQ ID NO: 144463 - protein, 149 aa, Heterodera glycines
  Coding regions on vcDNA: vcDNA=SeqID_70886; Strand=+; Position=1 -172,270-316,511-740
MSNKLIQFFVSLFISLAACGHVPPPNHWSASLDKPKSGALPKWTLNRQEEEDFNEDFGRETQCGLTKHHFQYRIEHGQIAPDNDWPWAVSVRLECETKQSAKREVLGICSGVLIGAKWILTAAHCLFATDDILRCKGVELNGLIPEKGA

SEQ ID NO: 144464 - protein, 60 aa, Heterodera glycines
  Coding regions on vcDNA: vcDNA=SeqID_70887; Strand=+; Position=1-183
LASLVFALTVTGSKRRRKAKSNAMESPINAVAFAWMFTIIWTTLTKNIKVVKIEVKMLIN

SEQ ID NO: 144465 - protein, 41 aa, Heterodera glycines
  Coding regions on vcDNA: vcDNA=SeqID_70888; Strand=+; Position=1 -30,214-309
MQNTQRTEPKALAYGRIIYECSLCSIGHGFPLSPRAKMAET

SEQ ID NO: 144466 - protein, 68 aa, Heterodera glycines
  Coding regions on vcDNA: vcDNA=SeqID_70889; Strand=-; Position=1 -94,185-297
MHAFCARAIYHRACQSKAKQQRCCFERIKGIESVHRLLEKYICNLSTFLRSELEMINFTIQTNFRCSN

SEQ ID NO: 144467 - protein, 68 aa, Heterodera glycines
  Coding regions on vcDNA: vcDNA=SeqID_70890; Strand=-; Position=1 -94,185-297
MHAFCARAIYHRACQSKAKQQRCCFERIKGIESVNRLLEKYICNLSTILRNELEMINFSIQTNFRCSN

SEQ ID NO: 144468 - protein, 240 aa, Heterodera glycines
  Coding regions on vcDNA: vcDNA=SeqID_70891; Strand=+; Position=1 -54,105-339,374-546,608-730
  Homolog annotation: Hit_ID=CAE62259.1; Match level="QueryCoverage =100%, HitCoverage=4%, E-value=2e-31, Identity=37%"; Hit description =Hypothetical protein CBG06318 [Caenorhabditis briggsae]
VQKFTRAKDEQYYNNLAYVEKPQKDFPGLELEPVQLKAGQAYVEKPQKDFPGLELEPVQLKAGQVSRYQPVHEKLETVALRELKEKEAKKEAEPLPDWASGEVKLGEPGATEGMTNKGPEPEREPSIPHPEPEREPSIPHRDQVKLKTAKPKPATEAPPVEHVTIEEDRAKMASIQQGPPIEQEPFVAHKDQVQIKQQFKVAHKDQVQIKQQFKPKEVKVHEQGKVDADKQLKDIPPVVK

SEQ ID NO: 144469 - protein, 24 aa, Heterodera glycines
  Coding regions on vcDNA: vcDNA=SeqID_70892; Strand=+; Position=1-76
ITGVSIIAVLFLVFLMLSQNLVRF

SEQ ID NO: 144470 - protein, 36 aa, Heterodera glycines
  misc_feature (9)..(9): Xaa can be any naturally occurring amino acid
  Coding regions on vcDNA: vcDNA=SeqID_70893; Strand=+; Position=1-155
KPKLFGLFXKELKIFKNFIHLPFDRKSIREPYLTLN

SEQ ID NO: 144471 - protein, 226 aa, Heterodera glycines
  Coding regions on vcDNA: vcDNA=SeqID_70894; Strand=-; Position=1 -82,138-244,479-613,875-1028,1245-1338,1458-1566
MRRWLMILIVAVAFAALAFGPISVKCGVLEDVKDYVEAFSNIIVPAGSVGEQLKMISLSMPRLPESEELQALNLLHVTMIKQFNGLDQRIEHLGNKLIEHMALVEYDQWLNKRVNLNCVKPTQEEADTFAKASKIFDLIDKNSTNFVHLTQRRYADFRRNKIYGPSFALESAIVDLHHSLKIGLYQRNHGRCILKEISDANENIREELYELILMIELDSLKLVLFI

SEQ ID NO: 144472 - protein, 113 aa, Heterodera glycines
  Coding regions on vcDNA: vcDNA=SeqID_70895; Strand=-; Position=1 -184,233-390
  Homolog annotation: Hit_ID=AAV34698.1; Match level="QueryCoverage =94%, HitCoverage=41%, E-value=2e-11, Identity=37%"; Hit description =IC5 [Globodera pallida]
MPSDKLAGKHSNSYGYQSDGTFWVNGFCVSGKLGFSEGDTVGCGVNLATGRIILTKNGLRLDTTKMFAVASSADDPLFPCVSLCESNDKIVANFGPNFKFDPSAVEVKILLIK

SEQ ID NO: 144473 - protein, 16 aa, Heterodera glycines
  Coding regions on vcDNA: vcDNA=SeqID_70896; Strand=-; Position=1-49
EAIPEGFGLPINLGAS

SEQ ID NO: 144474 - protein, 28 aa, Heterodera glycines
  Coding regions on vcDNA: vcDNA=SeqID_70897; Strand=-; Position=1 -37,520-569
MYYLSPFVRKMPEFRKSDFRAILATYVA

SEQ ID NO: 144475 - protein, 70 aa, Heterodera glycines
  Coding regions on vcDNA: vcDNA=SeqID_70898; Strand=-; Position=1-215
AKFGVTELFSPNDRPNGKSLPEYLREKYDGGLLIAFEAAGSHLAVVCQINNHNSPPNSKLWSSFIFGYDN

SEQ ID NO: 144476 - protein, 92 aa, Heterodera glycines; identical to SEQ ID NO: 127421
  Coding regions on vcDNA: vcDNA=SeqID_70899; Strand=+; Position=1-304

SEQ ID NO: 144477 - protein, 90 aa, Heterodera glycines
  Coding regions on vcDNA: vcDNA=SeqID_70900; Strand=-; Position=1-437
NRNYAQKAPQTILALPIPSTIAFIHPIMSAKIIRVPKIACDLSLEKNGVSKNRNYAQKAPQTILALPIPSTIAFIHPIMSAKIIRVPKIA

SEQ ID NO: 144478 - protein, 147 aa, Heterodera glycines
  Coding regions on vcDNA: vcDNA=SeqID_70901; Strand=+; Position=1 -64,217-467,516-578,924-989
  Homolog annotation: Hit_ID=AAL87143.1; Match level="QueryCoverage =88%, HitCoverage=28%, E-value=4e-14, Identity=40%"; Hit description =DEAD box RNA helicase Vasa [Melanotaenia fluviatilis]
MPTEFKVPKFNKSDTLVEFLLEYWKTRKTLVFVERKRSSDMLAIALRQNNIRALSINRSGKSSTISRFSLCFSDRTLKQRLGAAEDFASGKILVLVATDVAARGLNFPGVETVINVDLPEQDAYERILETTGHELPTFLLEIAKGQK

SEQ ID NO: 144479 - protein, 146 aa, Heterodera glycines
  Coding regions on vcDNA: vcDNA=SeqID_70902; Strand=-; Position=1 -179,1435-1696
MKELSAQLRQCEREKADLTKKALILEEQVNGEAKEFDRRFRERDRIQREVMEDNGRLYQNGIWWLGGREWCGKGGASEHGVKGPIEEAEDDEAEQNEEMAEEQCPGLTEECDDRQSEEADEPSASQRPGGLFRSARGSNVKKGGAA

SEQ ID NO: 144480 - protein, 56 aa, Heterodera glycines
  Coding regions on vcDNA: vcDNA=SeqID_70903; Strand=+; Position=1-173
GVTVIFGAWVIFGISVTELGLGIEISPLNFIFWVGFTFDSKFVFGTFGNLVVCEMV

SEQ ID NO: 144481 - protein, 19 aa, Heterodera glycines
  Coding regions on vcDNA: vcDNA=SeqID_70904; Strand=+; Position=1-61
GSPPEPMRPDLWGDRILRE

SEQ ID NO: 144482 - protein, 201 aa, Heterodera glycines
  Coding regions on vcDNA: vcDNA=SeqID_70905; Strand=+; Position=1 -36,90-659
MLSEDGSRDNQMERSLVRGVEGHDDLSRRIGSLSLRTIHQQQPVTLPAYRGRTGPLADGQQPTQSAGRRRTRRRGKRRPLNLVKALCRFNGGCMPSVLPQMIQRRRMENLGFLRDLRLQTVHLKNNIMISANSFSFHSAGSLLAYRGYLSITVEQHLYVRHRVRLRFPFLPCVAQYGGNHHHYYFPLELLEICSRPTDESS

SEQ ID NO: 144483 - protein, 196 aa, Heterodera glycines
  Coding regions on vcDNA: vcDNA=SeqID_70906; Strand=-; Position=1 -171,580-858,1167-1307
MVAVRQALLVCIPLLFIVLNLPPIHLQLRIGSSGSYNAWIQGSLIRGSKNALKSVLVEYGYWTLELDHRLVAYDGRRRAISENIEGIASDMGTVAGGAAGFGALVATIILPGLGLAAAPLVGAAVGSLIAGGVGAIGGFFYNFGKSFACHTSCPHETACYRLESDVSWMCCTQNLRRKVVKDFAEVICKVLRRNNV

SEQ ID NO: 144484 - protein, 51 aa, Heterodera glycines
  Coding regions on vcDNA: vcDNA=SeqID_70907; Strand=+; Position=1-167
RKVFATVLNCSLIFSFFGIFSRTRARHVEEERNLRDTVHNQCNRSFKKSKK

SEQ ID NO: 144485 - protein, 81 aa, Heterodera glycines
  Coding regions on vcDNA: vcDNA=SeqID_70908; Strand=-; Position=1-246
MFGIMCRPVLFMVCAFFVLFFVYATKPELFMPNHAPTDENEIPNIGKAEPDAIGRFGHDHPRNSDTETEKPAHGFGISPEF

SEQ ID NO: 144486 - protein, 346 aa, Heterodera glycines
  Coding regions on vcDNA: vcDNA=SeqID_70909; Strand=-; Position=1-1038
MTTTTTTKTNPWTTTRWAPMTTTKQRWTPTMSSSASTWTTRRTRIQYVTKARSQQTDATTPPGTIKSAKSAKRDLGTNRDGADVFWCSDRGSTIWELKGTENSPFCRPPPTLTAQWHNLAIELFAKVIKPEQIAFAWHCSIKRTSERYYTNLLADKFVTIEKEFPPVNKRICKQMAIHQECPFAKSEMTNHEAQLWSTNDELEVNFPGPIAGLFKGEQISTATNCFAQPATLFVKRHNLQMFSPVHQIQNCQYATEFCQLPDNSTLIWKSTCNGNECQTCDYDRAEIISGKFTAAYGETVATWISEDHQKALTFAKNAPELIACDGTRIVMSEQNFGIAKEQYDDI

SEQ ID NO: 144487 - protein, 116 aa, Heterodera glycines
  Coding regions on vcDNA: vcDNA=SeqID_70910; Strand=-; Position=1 -166,514-698
MELKEEREFWAFFRRLLRYFLSLESHFMAAAAHQTKMRQLTLKSMRAHQVIIAKGSSPTTEILKERKEAEEEKEADKQKSLQTEVGETEENWDNLFLERKTKWNCPEKANDKQRWT

SEQ ID NO: 144488 - protein, 127 aa, Heterodera glycines
  Coding regions on vcDNA: vcDNA=SeqID_70911; Strand=+; Position=1 -164,205-271,326-479
SLNGTSNYLLALFSFFEILHQFGHFLFVYIAFYGQNLIEYRLAAKIVFISSLGYGAIYISMLFTGVDRLIVIIFDEMNNKHKIRLYLATVTIMSAFCGCISTVSLYQDAQLHGDLMITGCTVDFFMV

SEQ ID NO: 144489 - protein, 190 aa, Heterodera glycines
  Coding regions on vcDNA: vcDNA=SeqID_70912; Strand=-; Position=1 -135,213-512,558-695
MNSLKRFQLPEQGTRQQEELDSVEPKHISDVVNFNSAGVFYVLGKACPFRSKGLICRRKLSDDNMCEACGQKAIAPIHTVFVRLLLQDVEQADIAQRVTMFSSVAEEFLGMKAAELLAKEKEPESLAKHLDDLIAVKIIAKVNIKANNQTYTGFDWIVNLFKKCPGNDDSDVPKEKNDVEGIATKKAKKN

SEQ ID NO: 144490 - protein, 419 aa, Heterodera glycines
  Coding regions on vcDNA: vcDNA=SeqID_70913; Strand=+; Position=1 -178,246-301,1739-1963,2195-2503,2617-2678,2740-2999,3146-3315
  Homolog annotation: Hit_ID=NP_505981.1; Match level="QueryCoverage =53%, HitCoverage=85%, E-value=1e-31, Identity=35%"; Hit description =COLlagen structural gene (33.2 kD) (col-158) [Caenorhabditis elegans] emb|CAB02874.1| Hypothetical protei
MFQFALFLLLLIVEFADIANLFHLSQLENSLGQFPTSSTTEKTITEYVPWLYRFGQKLMPCQDNIPSDECQKHENDCQEFPSLAAKVCLIGLTILAKNDVLLLCCTEAESYTAAERKYLSDKGNGQSPKECRKNEEMSAHAATSGAIAFSGATAQADGLWDDLLTMGAGTSSNRKRRAAIESAAEDDNLPTNRNRRNGYSVASAVPAPPCSETVNQTRKCLKFIKSAKRSIHAHTERPGRRETMARRDWRESREKTNCLAGPQGNPGEAGRPGVRGMRGPKGSPGMPGRDGVPGLPGIQGDEGEQGKDGLPGKGGEHGQDAEKPIGRRGPKGAPGEHGNEGPVGSPGNPGPIGKQGPPGQLGPLHARAEKGTKAEGAAQGSNTEGHREKANTAETKVVAHIAEGCTDRKSGGKGRRNDK

SEQ ID NO: 144491 - protein, 28 aa, Heterodera glycines
  Coding regions on vcDNA: vcDNA=SeqID_70914; Strand=-; Position=1 -47,215-251
MCTFVGAGEDSVSYKSNFKEFENLRPKK

SEQ ID NO: 144492 - protein, 88 aa, Heterodera glycines; identical to SEQ ID NO: 124691
  Coding regions on vcDNA: vcDNA=SeqID_70915; Strand=-; Position=1 -96,135-305

SEQ ID NO: 144493 - protein, 138 aa, Heterodera glycines
  Coding regions on vcDNA: vcDNA=SeqID_70916; Strand=+; Position=1-415
MVAKTRGWPSWKFYDYMHSRLGQRGLFHQDTVQLMRQIKAPLDLDAYDADTYVPLVISHWNNAQQQQQHRFALFIFGSTGHYKPIYKYIDSTYDTPLVLYFNNNHFDGVHFLSGLFGGKKYCLECEKPYKKPKEHMQS

SEQ ID NO: 144494 - protein, 177 aa, Heterodera glycines
  Coding regions on vcDNA: vcDNA=SeqID_70917; Strand=+; Position=1 -225,267-530,609-653
MVKLENSWIDASNQESPYISTLASSGLAAFHKKFRQLYGQQQPTLIRCAAFLDPNICAVLPKIVATNSNWGKVAEICATIKTVAQIRHPDCNSLIPRPCTSPSLSGFDRSPRAAIDIEIDRYMNLCDSLFMKIDPLKFWSENQKSLPILASLAREFLGIPATSISRLITLQSLFRDT

SEQ ID NO: 144495 - protein, 45 aa, Heterodera glycines
  Coding regions on vcDNA: vcDNA=SeqID_70918; Strand=-; Position=1 -70,313-380
MAKNEILAPKNVEKEWQQNYAEIWAYIENDKSTFLLLFAENQPQC

SEQ ID NO: 144496 - protein, 169 aa, Heterodera glycines
  Coding regions on vcDNA: vcDNA=SeqID_70919; Strand=+; Position=1 -466,696-739
MKLFPLLLLIILFLIVKIGSEKKKLQQKSFGEIFGEKWQEKEEEKRNELKKREIIGKYYKIKEKIKQKGRKYSTKEWNKIDGKIAKKLGTNSNYIQKWIKEFGLQKKKCYKSKTDEEKLEIVQKFIEMTNEYKQKKKYSHIEWATKLCRNWQENWRNLENYFRRTAEEE

SEQ ID NO: 144497 - protein, 15 aa, Heterodera glycines
  Coding regions on vcDNA: vcDNA=SeqID_70920; Strand=-; Position=1 -12,47-82
MTVLVEDSYGFPFEN

SEQ ID NO: 144498 - protein, 75 aa, Heterodera glycines
  Coding regions on vcDNA: vcDNA=SeqID_70921; Strand=+; Position=1 -168,398-457
MVINYIKPLTRHLSIETPANLADALGMHTPNWAFYHYSSPNYRSAWPWRMFRDRFDCEQIMYNKHFSVQPIYRNN

SEQ ID NO: 144499 - protein, 98 aa, Heterodera glycines
  Coding regions on vcDNA: vcDNA=SeqID_70922; Strand=+; Position=1 -232,278-342
MIRNKLEILQKSRKKRYLSDISNTTEEAVNLGVKFVEPNAVRTSDSVEQPNLKEAEVSTMTFERGKTNFGGDCLWLNGFVSHTSQEIAEDAQIELLII

SEQ ID NO: 144500 - protein, 65 aa, Heterodera glycines
  Coding regions on vcDNA: vcDNA=SeqID_70923; Strand=-; Position=1-196
MTISPPVERYIDSVCDLGPIFTEIGQSLRAQNHQPSFVLTPTGNIRRAEQQQQKREVAENSEENA

SEQ ID NO: 144501 - protein, 202 aa, Heterodera glycines
  Coding regions on vcDNA: vcDNA=SeqID_70924; Strand=-; Position=1 -181,226-391,591-853
CPIFAKFQNQQQEQSTHFLPPPMTSSSGDEWQSAYECLPQWTKQMPKMPPETAPKPQQDLSSSFPSFCAASFAESVQCSVNLCKFHAYSRQLAAKSIWPMSDSQAEMFQSVVSVEGNQRIRPILNESATFSEHQANDEVRNLMGASGTVSPPAQMHTSPETQSDSNITRNTTILNLVRSAIGESGIQRTRQFFARDKFKCDK

SEQ ID NO: 144502 - protein, 18 aa, Heterodera glycines
  Coding regions on vcDNA: vcDNA=SeqID_70925; Strand=+; Position=1-56
YREAIPEGFGLPINLGAS

SEQ ID NO: 144503 - protein, 67 aa, Heterodera glycines
  Coding regions on vcDNA: vcDNA=SeqID_70926; Strand=-; Position=1 -185,310-328
  Homolog annotation: Hit_ID=NP_872018.1; Match level="QueryCoverage =80%, HitCoverage=6%, E-value=1e-22, Identity=96%"; Hit description =HCO3- transporter (2G447) [Caenorhabditis elegans] gb|AAM98009.1| Hypothetical protein F57F10.1b [Caenorha
MFNFSIPDEFDNVTLMYSKHEKIPMKDFGSEIRATMDIDHLLNKAVLLLDLQETSLEEIFANKNERF

SEQ ID NO: 144504 - protein, 61 aa, Heterodera glycines
  Coding regions on vcDNA: vcDNA=SeqID_70927; Strand=+; Position=1 -76,240-349
MCVTLPLHWLPVLDPLVSILCVSDYQLPNNMRTIQVMRAMFIGQTLKFYPNSLSLNFLFRF

SEQ ID NO: 144505 - protein, 171 aa, Heterodera glycines
  Coding regions on vcDNA: vcDNA=SeqID_70928; Strand=+; Position=1 -110,297-702
MAQKKGMEIVNRFGKALPIPKIQLPRKVTGFECIKISLIDRNAIAFLQRFRHLFSVCPINLITDMFSERILEFILQNIWPMIAKNICAIYLMKYTFRHLRKFVPTILDDCPSLRIISFHAGVDYFFTEFPPDDSAMASDGQALAKWLLIPHPDDVPKVLKCWLNMEKGIGR

SEQ ID NO: 144506 - protein, 114 aa, Heterodera glycines
  Coding regions on vcDNA: vcDNA=SeqID_70929; Strand=-; Position=1 -43,208-274,503-692,751-792
PHFLEKKFNITDTRGIIGVLASSLALACYQNNSFPEKSHPENQIAYSYPRKGGENYAKNISTVFFFLHFQKFQNYILNGFKVYCDADFFEVPEDYDFTTRVTSHIDHVELTETR

SEQ ID NO: 144507 - protein, 17 aa, Heterodera glycines
  Coding regions on vcDNA: vcDNA=SeqID_70930; Strand=-; Position=1-51
MAPADRAAKEMEYALNE

SEQ ID NO: 144508 - protein, 16 aa, Heterodera glycines
  Coding regions on vcDNA: vcDNA=SeqID_70931; Strand=-; Position=1-49
EATPEGFGLPINLGAS

SEQ ID NO: 144509 - protein, 152 aa, Heterodera glycines
  misc_feature (141)..(141): Xaa can be any naturally occurring amino acid
  Coding regions on vcDNA: vcDNA=SeqID_70932; Strand=+; Position=1-468
  Homolog annotation: Hit_ID=AAP92584.1; Match level="QueryCoverage =82%, HitCoverage=25%, E-value=1e-34, Identity=62%"; Hit description =Ab2-057 [Rattus norvegicus] gb|AAP85373.1| Aa1262 [Rattus norvegicus] gb|AAP85367.1| Aa1011 [Rattus norveg
IRCGAWPFFLLGAICLVYSDNERDSSLLNSWLIASGHNFLEGFSVFSRTKLSNNRSVMPLDVRGCTRATLAKSACLPSPKGVGKPVKICRDWDRTLQLLSVNEEFLVGASHQLALNTSLPFVHTARRCPGLSHFEKFGDGXCSGRSVCRLEP

SEQ ID NO: 144510 - protein, 96 aa, Heterodera glycines
  Coding regions on vcDNA: vcDNA=SeqID_70933; Strand=-; Position=1 -138,747-899
MDNFESKVVAQFGQVHTANRANATVVALDHLLNADRDIFSAGAVVDQKNDGPPIFAFVLRNIRNIFDDLTTLINAIGDVAKAGKKAQNGQMGKHYS

SEQ ID NO: 144511 - protein, 179 aa, Heterodera glycines
  Coding regions on vcDNA: vcDNA=SeqID_70934; Strand=+; Position=1 -73,242-442,831-1045,1117-1167
MSSMYHHLLLKITMFLAFAAAHFPVAAIQCVSGMALTYINNSTGAENVTIGVQQMVKCHHGCVRAVCSVNLPELSDHFGFKIVHAFGHGTYKLYGNRPVAVVSGCAAPKNGTATESAADIFFGNGTIGGTECKQVAVCTTGELCNPKPSSASRTSSALAIAFPSPPWCPAMCSRSEMAY

SEQ ID NO: 144512 - protein, 38 aa, Heterodera glycines
  Coding regions on vcDNA: vcDNA=SeqID_70935; Strand=-; Position=1 -69,590-637
MTNWTDTLCLLAGAETSADELSMKWLIFGDRHDGLQDF

SEQ ID NO: 144513 - protein, 67 aa, Heterodera glycines
  Coding regions on vcDNA: vcDNA=SeqID_70936; Strand=+; Position=1-204
MNTAVVVRPRDRQHFRHSNVPPVLNILDQATDLYGDLFRMVIDPEGINGGSGGGAQVITSDEEEYGR

SEQ ID NO: 144514 - protein, 97 aa, Heterodera glycines
  Coding regions on vcDNA: vcDNA=SeqID_70937; Strand=+; Position=1-294
LKRVPVDECENIGKEKRPIAGGETSSNSTGSGENKIWAQSPQGKIGNFKLIIFKIKIIKINVNQANRYENVLQLFSNAAAAELKKRTVHKNMEKCAW

SEQ ID NO: 144515 - protein, 92 aa, Heterodera glycines; identical to SEQ ID NO: 125147
  Coding regions on vcDNA: vcDNA=SeqID_70938; Strand=-; Position=1-304

SEQ ID NO: 144516 - protein, 75 aa, Heterodera glycines; identical to SEQ ID NO: 138893
  Coding regions on vcDNA: vcDNA=SeqID_70939; Strand=-; Position=1-228

SEQ ID NO: 144517 - protein, 128 aa, Heterodera glycines
  Coding regions on vcDNA: vcDNA=SeqID_70940; Strand=-; Position=1 -22,71-185,546-636,692-773,1269-1292
  Homolog annotation: Hit_ID=NP_113818.2; Match level="QueryCoverage =96%, HitCoverage=22%, E-value=3e-24, Identity=46%"; Hit description =DEAD (Asp-Glu-Ala-Asp) box polypeptide 25 [Rattus norvegicus] gb|AAF21360.2| gonadotropin-regulated testi
MLDWMMRRKHIDASKIVSFRKHIDASKIVSFALDEADVMIGQQGYQDKSIRIQKSVPSSCQCMLFSATYSDAVIKFADQLIADPTLITIRRQDIRRQDQSLPYIRQYFVRCKDREDKYQSLSTIVHKM

SEQ ID NO: 144518 - protein, 225 aa, Heterodera glycines
  Coding regions on vcDNA: vcDNA=SeqID_70941; Strand=-; Position=1-678
MHVDFDPLAVDWSHFAEPPPRMDTMLMSGGGSSMGGGGGGGSASSYPVFTGLPYQRGAGGIGSMFRSFLRFLVPIGRQAGAAIGRQGLETGSRVLSQMLEGRNVKEAMTEEGRAGLKNLLDKAADNLSRQRSTAAAATTNHGGAGRGGRGGGLFDFKRYRKIVNNNNNNKRKSSSSSSSSTNNIKKNKKRRTGNLQSTVGPSLSTPAAAAAAKTKGVRFDALGSF

SEQ ID NO: 144519 - protein, 396 aa, Heterodera glycines
  Coding regions on vcDNA: vcDNA=SeqID_70942; Strand=-; Position=1 -564,701-1327
  Homolog annotation: Hit_ID=NP_502797.1; Match level="QueryCoverage =92%, HitCoverage=99%, E-value=1e-37, Identity=27%"; Hit description =HASI (4P602) [Caenorhabditis elegans] emb|CAB16520.1| Hypothetical protein Y57G11C.19 [Caenorhabditis ele
MRKLRVKSTNKVNSNNKNAALQAQKRELLVEKVLDELYKDTRSNAAFTSVEPLLLEARRQHPGRHIRRAEVRRYLARQRVYTLHRRAVRRFRRLPTLASGLHTDWQADLADFTALKRHNRGHAYLLVCADTLSRQLFVEPLKSKRSSDIVQAFEKIFRRVGYVPWKLMTDQGKEFTAAPVQRFLVDQEERLYRYFTHRGAKCWTGVIQHIVTALNGSPNRALFGLRPNDINFGNAERVRRNQLERLAAGQQQRQSPRARPPFRVGNRVRIEKHKHVFKKGYLPRFTDELFTVAEVRTSRLPITYKLRDDDGELLTGWFYAQDLCLVLPPPPPLQSKRDEPIADKAGAAASTTVGPVYDIERVLRRRRGRDGAEHCFVKWKGYSAAHNSWIPATSII

SEQ ID NO: 144520 - protein, 206 aa, Heterodera glycines
  Coding regions on vcDNA: vcDNA=SeqID_70943; Strand=+; Position=1 -37,939-1321,1373-1571
MLVVATVAADARASEFLNNHSMDMFRFKVHNAVKDTDDAAADSAAHDQCQQRQQREVASPRTMPLSLLVEEQAHVSAAAEAAAEAASAVDQKMSAAPNDTPAITDTKIDFMTDEQTVAAAPPPLFSEIEPTQQQQQKQQQWRTAEIIAPKVELSAEDNGDDDDDDDDEAGQQVKQEADRNGMDAHHSNCAKGPLLFIDEQENEEEE

SEQ ID NO: 144521 - protein, 418 aa, Heterodera glycines
  Coding regions on vcDNA: vcDNA=SeqID_70944; Strand=+; Position=1 -22,212-594,646-1275,1346-1567
  Homolog annotation: Hit_ID=AAO22235.1; Match level="QueryCoverage =50%, HitCoverage=26%, E-value=3e-09, Identity=25%"; Hit description =nucleolin [Cyprinus carpio]
MQFEEMATSEFLNNHSMDMFRFKVHNAVKDTDDAATDSAAPHDQCQQRQQREAPPRTMPLSLLAEEQTHASAAAEAAAEAASVVDQQMSVAPNDTPAIAGTKIDFMTDEQTVAAAPPPLFSEIEPTHQQQQKQQQGGTAEITTPKVELSAEDNGDDDDEAGQQVKQEADRNSMDAHHSNCAKGPLLFIDEQENEEEDSEEDEHISTTHRRQGMDSSFDYEDDDDDDDNDDDDDDEMESVSGCAESDKCGHCHHPHQLPRNALEVLKMPLIDYLCALNHGCSVGELQALFLSKGAHGRMVTHLQKRCLLRTVHLRPTERNITLHAHNFSARSASLTFACGGYLNLTVRQYFFAKHGVRLRHPSLPTLVEFGGGMHASYYPLECIQVHVAVTAPEDAASTTSTTTTTTTASPTACVRLTN

SEQ ID NO: 144522 - protein, 829 aa, Heterodera glycines
  Coding regions on vcDNA: vcDNA=SeqID_70945; Strand=-; Position=1 -1295,1401-1624,1955-2327,2423-2640,2739-3118
  Homolog annotation: Hit_ID=NP_001004509.1; Match level="QueryCoverage= 16%, HitCoverage=9%, E-value=8e-09, Identity=32%"; Hit description =si:busm1-180o5.3 [Danio rerio] emb|CAD60788.1| novel protein similar to DNA polymerases [Danio rerio]
MKGVWLLPNESIDQLGERVSAMVRCAYPGLTEQLYDEYSAMHFIRALPNPELATILEMTRKPGATFDEFIAQAARAEAIQNAARNTWRMTKLSSHGTSQNQRRHVVCYNCGRVGHTSRNCYSQSTQQTHQDNPSSNFQPSESFRNQNSHFQQNDEPPKRENLFIGAVNLEHRSEIEQFFGKTTNLSEKGRFWEESPAVGKILAAKVSVFGRKLDAMLDGGSQISLISAKFFLEIMDKVSQKDIVTRSESRIIDINGKEVKSFGIVALPIQRGPLEAKIRVFVAQSTFGYDLLFGTNAMDQLGFKMLDAVNCRIVDFSPASKPENSPLITFKTFVCHGNTSTNREGQKKGNKHRSDPKNDTGTKKGKVVEKKSNRNAVDNKRSPLFNKTFVPQLKTKEIPIKNSENFGKSAANKQPLNSVQMKVGVPNEKAMKLGLCDRHPDCRSQSPFHRGENDAKLGQRVFYRREKHRKEPDRGMLGDGRRHRLNSPPPIGCRMDSKGRGRLFSEARVACFVTSHARLYLYDWLEEVRRVGGRSLYCDTDSVLYVKQRGAEGVREGNALGDMKRELPGRRIIDFFAAGPKNYGFQHVDACTGGDLKAERKVRSFELNYAADQQLQYERMRQLVINHFGSGQQHQQQQQQQQRGHAADAADGSDGQEERTISVPCQRFVRNRQADIFTRRSTRVYRPVYTKGRVLRRGAAECVDEVPPQSIRTRPFGWSCCAGGGASPDSTVMNEEEEEPMQMAPSAADQEEDQWREHVWPNDIGDDEDDDDEPGPERKRARVEQCVAPPPSPPQSPLREPDAEPEPVAGCSTWDQTTRHTKHICRNNF

SEQ ID NO: 144523 - protein, 105 aa, Heterodera glycines
  Coding regions on vcDNA: vcDNA=SeqID_70946; Strand=-; Position=1 -231,767-850
  Homolog annotation: Hit_ID=CAE61659.1; Match level="QueryCoverage =73%, HitCoverage=24%, E-value=3e-14, Identity=49%"; Hit description =Hypothetical protein CBG05595 [Caenorhabditis briggsae]
MQRIGFIGLGNMGGHMARNLLSRGAQLVVYDVDQSKLETIQSERGPSALKIAKNPAEVASDCIEIVTMLPTSSHVRSREICPFAGQSAPIPTPFGRAGRTEPAEA

SEQ ID NO: 144524 - protein, 43 aa, Heterodera glycines
  Coding regions on vcDNA: vcDNA=SeqID_70947; Strand=-; Position=1-260
QSRLNKKTSLKPPYSAITPTKSNLNIKFPVMIYLMNSDGWLIN

SEQ ID NO: 144525 - protein, 659 aa, Heterodera glycines
  Coding regions on vcDNA: vcDNA=SeqID_70948; Strand=-; Position=1 -311,359-668,766-954,1011-1193,1243-1586,1647-1851,1895-2164,2218-2384
  Homolog annotation: Hit_ID=NP_498245.2; Match level="QueryCoverage =99%, HitCoverage=71%, E-value=9e-88, Identity=35%"; Hit description =related to Islet cell Diabetes Autoantigen phogrin, IA2 type transmembrane protein-tyrosine phosphatase (
CDFSEDLCTDGEVCLPDGLFGQCYSDDESALVRPLVLDRPINGVQSELLRAELTRLAELGLDWPDARAQCVLAYFKLAVAFRLDYDTEFCTVRNPENIWALIQRVQNALLAEAEIERAEEEDEAESLLVTDPRDEAGDGGAAAGQGQAQFQTAEDDGGEAVEVIPIVVLDGGQGEDEDGKDRMAYEMYGKAEREVPKKTGSKNETKAEKAMDKRTTDALSATEEVELDQFVHNLLDGRPAAERQMGALSERQLSRLARFIRQLQNVVQNETVNEAQEEQLQEEAPPPLLAEAEAAQPTEEDAVDHVLLLKKDSEQFNNADMGLANTVHKIVKGGIQRVEGNRVYLKVAKEQLTEEELYKLIGYLDKKIAQPNNLYFDEFLYENGQLSFRISRLGVLQPNKDKKDGNADAALENASGVAQAVYKRRKDIQTLAGIRVDETGIGSGVDVVPVERSQRDWLFVPIMAVSAMTIFTLLVVLAANLVRMRRHRQEGPILAPCRDGGGKAGGSVCDDLCPADEVPGIALNTQALPRGLRKLSAPTGADQQLDIGTGHVLLAFLKEHMEKPGEVSKEWESVKDYANAAGEATVARRAENAAKNVDATVLPYDDSLVTLHGFNSTETLIDVSSSVAEHSPAYYNASKIFDANPEPTYIVAQAKQQNT

SEQ ID NO: 144526 - protein, 87 aa, Heterodera glycines
  Coding regions on vcDNA: vcDNA=SeqID_70949; Strand=+; Position=1-262
  Homolog annotation: Hit_ID=NP_498245.2; Match level="QueryCoverage =100%, HitCoverage=11%, E-value=6e-19, Identity=54%"; Hit description= related to Islet cell Diabetes Autoantigen phogrin, IA2 type transmembrane protein-tyrosine phosphatase
GCDFSEDLCTDGEVCLPDGLFGQCYSDDESALVRPLVLDRPINGVQSELLRAELTRLAELGLDWPDARAQCVLAYFKLAVAFRLDYD

SEQ ID NO: 144527 - protein, 26 aa, Heterodera glycines
  Coding regions on vcDNA: vcDNA=SeqID_70950; Strand=-; Position=1 -24,88-144
MSTKLLYLVLNDAWRITNFAILGLIF

SEQ ID NO: 144528 - protein, 147 aa, Heterodera glycines
  Coding regions on vcDNA: vcDNA=SeqID_70951; Strand=+; Position=1 -189,291-545
  Homolog annotation: Hit_ID=AAG23159.1; Match level="QueryCoverage =77%, HitCoverage=65%, E-value=6e-37, Identity=56%"; Hit description =polyprotein [Heterodera glycines]
MTTKSAAATIDHLRYLFTRHGIPETLVSDNGTQFASTEFAKFMANNGIIHLFSAPYNPMSNGQTTPNDSLSESKSPAEMLLGRKPRTTLDLLKPPPPRPTERDEKMERNFNRRFGTRTQNFGPHEKVWARHRLSQNWKAEPFLKAPE

SEQ ID NO: 144529 - protein, 106 aa, Heterodera glycines
  Coding regions on vcDNA: vcDNA=SeqID_70952; Strand=-; Position=1-361
  Homolog annotation: Hit_ID=S52407; Match level="QueryCoverage=87%, HitCoverage=39%, E-value=4e-11, Identity=34%"; Hit description=TATA box-binding protein - Entamoeba histolytica
KDHLIGTLYQKMQKPIIVNIIAFANLGTGIKLNSLTITECEFKYNPRKFNAAVIKCTTPIKATALLWESGKMICLGTKSLIDCENAIKKFIEIIKGLGCPGASYTG

SEQ ID NO: 144530 - protein, 72 aa, Heterodera glycines
  Coding regions on vcDNA: vcDNA=SeqID_70953; Strand=-; Position=1-220
  Homolog annotation: Hit_ID=NP_642710.1; Match level="QueryCoverage =98%, HitCoverage=30%, E-value=1e-24, Identity=71%"; Hit description =glutathione S-transferase [Xanthomonas axonopodis pv. citri str. 306] gb|AAM37246.1| glutathione S-transf
ELRNVHPLGKSPVLQDGELVLAESGAILDYLADRYDTQRQLSPSPMPAEGAERIAYRYWLHYAEGSAMPPLL

SEQ ID NO: 144531 - protein, 53 aa, Heterodera glycines
  Coding regions on vcDNA: vcDNA=SeqID_70954; Strand=-; Position=1-259
ISPFALFAFFGRFPFRFSHFAFWARNAIFTPLRIGLNSHKIFQNFTYKLANFQ

SEQ ID NO: 144532 - protein, 143 aa, Heterodera glycines
  Coding regions on vcDNA: vcDNA=SeqID_70955; Strand=-; Position=1 -117,165-371,430-537
  Homolog annotation: Hit_ID=CAE59952.1; Match level="QueryCoverage =93%, HitCoverage=11%, E-value=4e-45, Identity=64%"; Hit description =Hypothetical protein CBG03440 [Caenorhabditis briggsae]
MTPIDFEKDDDSNHHVDFVTSASNLRAENYDIEKADRMKTKQIAGKIIPALATTTALVSGLVCIELYKTIEADGRRSTAQIEHIKNAFINLATPFIAFSEPGKAQKKKYLDIDFTLWDRFEVDGPMTLGQLIDWVEVVIASTV

SEQ ID NO: 144533 - protein, 167 aa, Heterodera glycines
  Coding regions on vcDNA: vcDNA=SeqID_70956; Strand=-; Position=1-503
MKLIFSVFLFCSSSIFISLEKHEKTKKIQLNFTEIGDFIEALKQQTQHKNSMEIMAKNGREIVKEITENFQNSAQKDIQNLLDEILDKVWNTNGLIAEKCFGKMGQQKVKANEGIANGNAIEEEMSGELARHELSRMGSKVIKDTMFNYYQENLLAKSKVYKWWIRY

SEQ ID NO: 144534 - protein, 85 aa, Heterodera glycines
  Coding regions on vcDNA: vcDNA=SeqID_70957; Strand=-; Position=1 -162,297-392
MYCVHGNSADSTPQQYAYPNGINSTGTVTKGAGDGTVNIDSLRVCQQWKDQGKLVNQVVEIANVSHEGILHTRQFYDVIDSILIA

SEQ ID NO: 144535 - protein, 39 aa, Heterodera glycines
  Coding regions on vcDNA: vcDNA=SeqID_70958; Strand=+; Position=1-119
MAREAKVRTKSRSDELEIIREAPLNKKLLGLPDSLSNCF

SEQ ID NO: 144536 - protein, 26 aa, Heterodera glycines
  Coding regions on vcDNA: vcDNA=SeqID_70959; Strand=+; Position=1 -7,358-431
MKVHGNQMAMDLASGDQGSAGPKMEN

SEQ ID NO: 144537 - protein, 157 aa, Heterodera glycines
  Coding regions on vcDNA: vcDNA=SeqID_70960; Strand=-; Position=1 -164,331-414,627-852
MYVDGHGSNFPSNLASCGAIPSPYSGTFSLKAWVAYALAISDPFDLQKCILYMMSLSYDSASGAYRNRTGMNVTFTARRPFGLTCPMTCLLTDSNQSCNPNENSTSTDVYFGALISHLAQFGYVKGCNLFGAPYDWRLAPQLSADNLIIIFEEYKCS

SEQ ID NO: 144538 - protein, 72 aa, Heterodera glycines
  Coding regions on vcDNA: vcDNA=SeqID_70961; Strand=-; Position=1-224
IRFAIFFGLINQWHFRHTFTNYPNALFCHLKMFSSKLRPIQKPISSTHLHLFADDSSFICGNCFGKVIKRNI

SEQ ID NO: 144539 - protein, 40 aa, Heterodera glycines
  Coding regions on vcDNA: vcDNA=SeqID_70962; Strand=-; Position=1 -69,136-189
MRTLPYFIIFITSREKLLAKMAELSLYIILLLLKKKIKNV

SEQ ID NO: 144540 - protein, 15 aa, Heterodera glycines
  Coding regions on vcDNA: vcDNA=SeqID_70963; Strand=+; Position=1 -15,216-248
MAGAKEISRKAIVYV

SEQ ID NO: 144541 - protein, 68 aa, Heterodera glycines
  Coding regions on vcDNA: vcDNA=SeqID_70964; Strand=+; Position=1-206
MVPFELVNEWTNEKLTLAKANENELDKSWIMKRCKIIGETAAVNWEDGNWDNNCNNVFFWLEGDTNCI

SEQ ID NO: 144542 - protein, 35 aa, Heterodera glycines; identical to SEQ ID NO: 140871
  Coding regions on vcDNA: vcDNA=SeqID_70965; Strand=-; Position=1-107

SEQ ID NO: 144543 - protein, 76 aa, Heterodera glycines; identical to SEQ ID NO: 126706
  Coding regions on vcDNA: vcDNA=SeqID_70966; Strand=-; Position=1-325

SEQ ID NO: 144544 - protein, 87 aa, Heterodera glycines
  Coding regions on vcDNA: vcDNA=SeqID_70967; Strand=-; Position=1-263
  Homolog annotation: Hit_ID=NP_637656.1; Match level="QueryCoverage =97%, HitCoverage=17%, E-value=2e-29, Identity=78%"; Hit description =hypothetical protein XCC2301 [Xanthomonas campestris pv. campestris str. ATCC 33913] gb|AAM41580.1| conse
AGSIVAAPGQTPRLIAAGNPGMAVGGMGDLLTGIIASLRAQGLAAFDAAAAGALLHALAGDAAAADGARGLLPTDLLAPLRRLANPD

SEQ ID NO: 144545 - protein, 40 aa, Heterodera glycines
  Coding regions on vcDNA: vcDNA=SeqID_70968; Strand=-; Position=1-121
RRHAYWRHKMRDGVPNSAGMEKRMCAVGFVPEFPVFSSIS

SEQ ID NO: 144546 - protein, 46 aa, Heterodera glycines
  Coding regions on vcDNA: vcDNA=SeqID_70969; Strand=-; Position=1-155
LHVIAEKIRDQFPNVDRLIAKRKPSLSKRLTESKNLEIYLICNFNQ

SEQ ID NO: 144547 - protein, 103 aa, Heterodera glycines
  Coding regions on vcDNA: vcDNA=SeqID_70970; Strand=-; Position=1 -102,508-717
  Homolog annotation: Hit_ID=XP_393434.1; Match level="QueryCoverage =56%, HitCoverage=3%, E-value=1e-10, Identity=44%"; Hit description =similar to 1D-myo-inositol-trisphosphate 3-kinase isoform A [Apis mellifera]
MPVQASPLAALKRHQPQTVWPVAGAFADCTAQNTVHVDAFLFDDDDVDQLAADGILRRHFCTKCRSTDVEQFNFISHSLTIDEVCACAGVGFQNPMHFLIEKL

SEQ ID NO: 144548 - protein, 21 aa, Heterodera glycines
  Coding regions on vcDNA: vcDNA=SeqID_70971; Strand=-; Position=1-65
GLGEARLCTRSRSRRRSPIFI

SEQ ID NO: 144549 - protein, 45 aa, Heterodera glycines; identical to SEQ ID NO: 124527
  Coding regions on vcDNA: vcDNA=SeqID_70972; Strand=-; Position=1-138

SEQ ID NO: 144550 - protein, 95 aa, Heterodera glycines; identical to SEQ ID NO: 125597
  Coding regions on vcDNA: vcDNA=SeqID_70973; Strand=+; Position=1-678

SEQ ID NO: 144551 - protein, 92 aa, Heterodera glycines
  Coding regions on vcDNA: vcDNA=SeqID_70974; Strand=-; Position=1 -180,504-602
  Homolog annotation: Hit_ID=NP_493879.1; Match level="QueryCoverage =85%, HitCoverage=19%, E-value=2e-12, Identity=44%"; Hit description =transposase family member (2B289) [Caenorhabditis elegans]
MTPNGGKRMRLGGAGRPVQRPDIDNALAEWVTERQKNQQPVSRSIIQRRAAELFMDTGTKASVGWLQKFLRRHDFVLRNKTSTDDCQKPSSS

SEQ ID NO: 144552 - protein, 30 aa, Heterodera glycines
  Coding regions on vcDNA: vcDNA=SeqID_70975; Strand=+; Position=1 -45,99-146
MACCAKMARKIHFFEVNRDCHALQDHIKII

SEQ ID NO: 144553 - protein, 85 aa, Heterodera glycines
  Coding regions on vcDNA: vcDNA=SeqID_70976; Strand=+; Position=1 -59,368-565
  Homolog annotation: Hit_ID=CAE63047.1; Match level="QueryCoverage =96%, HitCoverage=13%, E-value=4e-21, Identity=57%"; Hit description =Hypothetical protein CBG07318 [Caenorhabditis briggsae]
VAKWIGTGRKEDKEGQTEKIYFDKNFVLLERPPGHPGPGHFKFVAHFAYSLPFECPLPSGCETSYESGSAHIRYFARAILETEQR

SEQ ID NO: 144554 - protein, 116 aa, Heterodera glycines
  Coding regions on vcDNA: vcDNA=SeqID_70977; Strand=-; Position=1-687
STGYREAIPEGFGLPINLGASVRGDCPENKKIDFFKCPFGVLKQLWGAKIQRRIKVQTIGKLFRKDSEGFGLPINLGASVRGDCPENKKIDFFKCPLGYSNNYGEQKSNAELKYRL

SEQ ID NO: 144555 - protein, 122 aa, Heterodera glycines
  Coding regions on vcDNA: vcDNA=SeqID_70978; Strand=+; Position=1 -328,414-454
MFVVAQIAPLTLALLLITLLMASDRCAVALTAGLGNGVNVQPSYYNSGKVSLGLSQLKTLATKVKTVRIEVEPFIPISLAKQWISEAAKNGFSIIVTYHKATVLGSNDAKISASLLNCSVIY

SEQ ID NO: 144556 - protein, 104 aa, Heterodera glycines
  Coding regions on vcDNA: vcDNA=SeqID_70979; Strand=+; Position=1-438
NGLSKNRNYAQKASQSILALPIPSTIAFIHPIMSAKIIRVPKIACDLSLAKNGVSKNRNYAQKASQTNLALPIPSTIAFIHPIMSAKIIRVPKIACDLSLEKMV

SEQ ID NO: 144557 - protein, 72 aa, Heterodera glycines
  Coding regions on vcDNA: vcDNA=SeqID_70980; Strand=-; Position=1-511
IIFIQKIFFWVFGAVPLNRCAQIYGETESFGNSFPIVCTLILRWSFAPHKCLSTPNGHLKKSIFLFSGQSPR

SEQ ID NO: 144558 - protein, 87 aa, Heterodera glycines
  Coding regions on vcDNA: vcDNA=SeqID_70981; Strand=+; Position=1-323
FLPGGTQFFTLTTPALFFFNYFLHLITQRSRLIRSSPNFAGKLLRTLQMLINFLRIFCLEEHSSSHLPHQHYFFLIIFFILSPNVLD

SEQ ID NO: 144559 - protein, 168 aa, Heterodera glycines
  Coding regions on vcDNA: vcDNA=SeqID_70982; Strand=-; Position=1 -382,825-946
MAKNEIINHRTQKREEKQREDKKENRNDMEDVREENIFTFEGLFEEADDETFVGDKRESGAANGPKPEIAGEGKDMPEMAGDTTDRPEITGEEKYRPGMEVETVYLLSLARENETLNVKCDWPFRSKASQCATFVSGLSGKGRAIGGGHSAGQKGSVPVVSRSSQQEL

SEQ ID NO: 144560 - protein, 68 aa, Heterodera glycines
  Coding regions on vcDNA: vcDNA=SeqID_70983; Strand=-; Position=1-207
MDAEARDEMRRQTTDGWERMQKTTAEEEGGGGYIQLTLFPYMIPTVQIVLLYLTVCTVFVARLSFKRP

SEQ ID NO: 144561 - protein, 33 aa, Heterodera glycines
  Coding regions on vcDNA: vcDNA=SeqID_70984; Strand=-; Position=1-101
MGDKNKNTIKLAISVICTGLLTALLLVIIWLLT

SEQ ID NO: 144562 - protein, 129 aa, Heterodera glycines
  Coding regions on vcDNA: vcDNA=SeqID_70985; Strand=-; Position=1 -171,353-505,995-1060
MWLMAIFAFWLNLFHIVLLTWSDYPREHYNQAMVELALRVQQETGVTAVKFTSFTWAICAVKIRRYVGNTFAQGQQENATGGICATTSLRKQKMREYNNEITRALIVQECKRRSRRKRRTIEQKGNHFN

SEQ ID NO: 144563 - protein, 49 aa, Heterodera glycines
  Coding regions on vcDNA: vcDNA=SeqID_70986; Strand=-; Position=1-148
MTTKEKKWKRNSQLPEKGPNDQNLSEREREVPNPNKGCHGEWTNCANAK

SEQ ID NO: 144564 - protein, 42 aa, Heterodera glycines
  Coding regions on vcDNA: vcDNA=SeqID_70987; Strand=-; Position=1 -88,137-175
SCPPSISICNRTKKDFRSVLTRPNSSNKKRQSFGTQSAEIAL

SEQ ID NO: 144565 - protein, 82 aa, Heterodera glycines
  Coding regions on vcDNA: vcDNA=SeqID_70988; Strand=-; Position=1 -158,233-323
MIYLFPFSFKGNLSRIILPHLNFDLLGIEFYVKFPTNLLVTIAFSSNAPFLYITDHQKAFRSQFKRIFGKNESKHLIVAFAN

SEQ ID NO: 144566 - protein, 172 aa, Heterodera glycines
  Coding regions on vcDNA: vcDNA=SeqID_70989; Strand=+; Position=1-519
  Homolog annotation: Hit_ID=NP_502882.1; Match level="QueryCoverage =57%, HitCoverage=19%, E-value=5e-13, Identity=34%"; Hit description =DNA polymerase like family member (4Q408) [Caenorhabditis elegans] emb|CAB60306.1| Hypothetical protein Y
MYEMKVQAQKKKNPKVVFRDSFNLMPCALGQLVPAYGLDVEEKPFFPHMVNRPDNYGRQIYPTPDDYLAQGMMPEKRRQFDQWYEQHRQAPFLLDEALASYCKNDVDILTAALVAFRREFFEITKRQAVNETDDQESNAGIDVLRECMTIASACMKHFRSNHLPAAAIREQR

SEQ ID NO: 144567 - protein, 110 aa, Heterodera glycines
  Coding regions on vcDNA: vcDNA=SeqID_70990; Strand=+; Position=1 -11,275-596
MNRRWICNDVWMDILPSFDHAQLGLKIALLSPRFDALVDTHFDGKSELTTWKWIRICKDEAQPPKAKVSVPVGANFVQQSPWEPMDANFVDFPLPDLPLPNKLRIRFMIE

SEQ ID NO: 144568 - protein, 185 aa, Heterodera glycines
  Coding regions on vcDNA: vcDNA=SeqID_70991; Strand=+; Position=1 -276,916-1197
MCNLMLNNAHHLDQLCRRISPTLLTDLDKLNWIYSGRLFPDVCAADGSNASGARQVLYKWLHTPTKDGTPKKLYCRETIGFPNNQWVHNFKEEFPRATTSASYTINFNLYLVKMRIWPFELVNERTNERMTLIKEPDRGAQLGDWLLNRCPLAMADQQQQQQQKVENSDAKLNSVYFRLRGDCIG

SEQ ID NO: 144569 - protein, 339 aa, Heterodera glycines
  Coding regions on vcDNA: vcDNA=SeqID_70992; Strand=-; Position=1 -285,342-1077
  Homolog annotation: Hit_ID=AAL78214.1; Match level="QueryCoverage =43%, HitCoverage=76%, E-value=3e-15, Identity=32%"; Hit description =putative esophageal gland cell protein Hgg-20 [Heterodera glycines]
FICADCWLLVFDFLAPSQLGLGIALISRRFDFYVDEHFKTRKWMLNKQLLITWDIEENGTKKMQIIDADRKETLPIPQKPLPNKVIGFSGRIQIIYIDQNVLTFLGHFHRFFATSAMDLDIVIENGRILEFVLHNIWPMFRDSIRRLFLNAIAFRCLRQLAPSMLTDCPSLCAVVFNDGIVSEFPIDDSAMASDVQVLAKWLFTPHPDGVPKWLKCSVNSSVEQWSSTMEQFKSVDYSPLFMSFLSLFKAFSNASSPVTFCIFLTLSSTLIDFVMPFDLINEVTGEQLTLEHHDTNHCWLTRCPIGWDEIKWDNVWEEVSAARPKQIIIWIKDDGFDEG

SEQ ID NO: 144570 - protein, 16 aa, Heterodera glycines
  Coding regions on vcDNA: vcDNA=SeqID_70993; Strand=-; Position=1-49
EAIPEGFGLPINLGAS

SEQ ID NO: 144571 - protein, 36 aa, Heterodera glycines
  Coding regions on vcDNA: vcDNA=SeqID_70994; Strand=+; Position=1-155
KPNFFGLFKKELKIFKNFIHLPFDRKSIREPYLTFN

SEQ ID NO: 144572 - protein, 22 aa, Heterodera glycines
  Coding regions on vcDNA: vcDNA=SeqID_70995; Strand=-; Position=1 -18,57-107
MILDHTHPYALFFVILRSVVLL

SEQ ID NO: 144573 - protein, 82 aa, Heterodera glycines
  Coding regions on vcDNA: vcDNA=SeqID_70996; Strand=-; Position=1 -62,415-601
MRRKKGQKNEKGQITKRNKVNPKQLLTRKRTPRENGHAKTYPSHAKTSPRENGHAKMATRKRPRENDPDRSSACEAAQNEKK

SEQ ID NO: 144574 - protein, 105 aa, Heterodera glycines
  Coding regions on vcDNA: vcDNA=SeqID_70997; Strand=-; Position=1-318
MSDLLSQKRAALKRAQEELAEAERTNRRPTPAPAGRPLSLAAICPSPSKNPPSPIAMPRKQHRTICGPYSIDNLLASPLIKRLPPNGQSAESAKLLRKRNECLKG

SEQ ID NO: 144575 - protein, 196 aa, Heterodera glycines
  Coding regions on vcDNA: vcDNA=SeqID_70998; Strand=+; Position=1 -71,456-663,706-1017
MPNGEGPRNAHKFDFGFKEHQRIGITNADKFCLFYALVASKFYLEVHRNIFNRFMNNIMRQRDAAIELLHNCGIDINEYSYGVEQLPNVQKYWDEIYPGKYRVVAFEKSADPRKSIRVLWKGQMGREKVVPIFLENGHWNGLKNYACFFNRGKKFCVECECFYDQDVKHTFDCRARCYYCKQSARRAVSNGECSED

SEQ ID NO: 144576 - protein, 113 aa, Heterodera glycines
  Coding regions on vcDNA: vcDNA=SeqID_70999; Strand=-; Position=1 -287,341-395
AFPSASSPVNFIVTIRFPPPFADSVVPFVLTNELTREQLALKRTDNSHRFLLVRCPIVRDESKWTKWEEEAIGWRFYDQWNQIDIQIYNEDKVGDGLLDANPGPSDQQTEVNE

SEQ ID NO: 144577 - protein, 64 aa, Heterodera glycines
  Coding regions on vcDNA: vcDNA=SeqID_71000; Strand=+; Position=1-194
SHILANAQEQIQHLEFSLVTGGKGMERELASHRLDDNVATELKLVLAAGLYPQFGVVDPTNNFR

SEQ ID NO: 144578 - protein, 48 aa, Heterodera glycines
  Coding regions on vcDNA: vcDNA=SeqID_71001; Strand=-; Position=1-161
FRRRLSAPPDLHLPLFLQVFCRKTAKIGSFLVKKCSCYPAVEKKLLVK

SEQ ID NO: 144579 - protein, 54 aa, Heterodera glycines
  Coding regions on vcDNA: vcDNA=SeqID_71002; Strand=+; Position=1 -115,175-223
MFSIVGKKVFNTTSCNFLSKAFYAHMSKDEIMWHWPAQKFDQHFIDYLNKPDID

SEQ ID NO: 144580 - protein, 79 aa, Heterodera glycines
  Coding regions on vcDNA: vcDNA=SeqID_71003; Strand=-; Position=1-338
NPEISNWRILLQDWNSKFFPGQDPAGLILQILHLKSAGSCAGLRILGNFKKFCINKKVFQSIKKYSNIFLNQKMMKMKH

SEQ ID NO: 144581 - protein, 76 aa, Heterodera glycines
  Coding regions on vcDNA: vcDNA=SeqID_71004; Strand=-; Position=1-349
MIYLYNVSKIVKVNHPSAAGGNRRPAVHPQGRAKTSRFWASLKKSRNVKEICTKPQKYLPKYVNKNRNFCSKKAFV

SEQ ID NO: 144582 - protein, 88 aa, Heterodera glycines
  Coding regions on vcDNA: vcDNA=SeqID_71005; Strand=-; Position=1 -96,135-305
MPKQNEIVLKYSFLDLTWFLDIEAVFYALSKTKKCLVVKTIFHISLHNFVSSARIETGIRPLERAARALQEGMERKNSYFWDFFRNQN

SEQ ID NO: 144583 - protein, 44 aa, Heterodera glycines
  Coding regions on vcDNA: vcDNA=SeqID_71006; Strand=-; Position=1-231
IQISDLSCAINIEIKGSIYHRSFNELIHPNSFVVTVPTSDAHFG

SEQ ID NO: 144584 - protein, 191 aa, Heterodera glycines
  Coding regions on vcDNA: vcDNA=SeqID_71007; Strand=+; Position=1 -98,447-588,630-963
  Homolog annotation: Hit_ID=AAH77268.1; Match level="QueryCoverage =81%, HitCoverage=31%, E-value=1e-28, Identity=41%"; Hit description =MGC80032 protein [Xenopus laevis]
MASQQPQQSVTNYSLQFRINAQYMNEQFRDSVSAFRDFMLEDVRKWLMRVTGVSLDDRLALTGSRYSSGDCLLPHDDKLEGRAFAFVLYLTPGWEESDGGQLCLFDSDPAKNYPGEIVKRIQPRENTFSLFPVQHNSWHSVSEVLSEQKQRLSLNGWFHYAPGTANVAQTGPNCAVEEPICRVEPSMNITA

SEQ ID NO: 144585 - protein, 21 aa, Heterodera glycines
  Coding regions on vcDNA: vcDNA=SeqID_71008; Strand=-; Position=1 -54,577-588
MRTRPIWQVKQRLLTSQKKGF

SEQ ID NO: 144586 - protein, 195 aa, Heterodera glycines
  Coding regions on vcDNA: vcDNA=SeqID_71009; Strand=+; Position=1 -162,273-698
MAFPPLPFFFLFPLALVPLQRTAAVHPPLFNRIVPTSERTVNLTLTRDFGEAKAAASKNELKGNDESANNSNLTASPVEAKIHRLKELRNEMRALTAMIKEERRRSGMAGAQTKLRRLENIQANPKTFGTGTDQSRRKCAPKSVGQLKMKLKSIISPFVFRRQTISKMAQKSAKQNSLGYATIGPIGGRNAQDKG

SEQ ID NO: 144587 - protein, 37 aa, Heterodera glycines
  Coding regions on vcDNA: vcDNA=SeqID_71010; Strand=-; Position=1-196
NDALHRRMITLGFLSVNVFRIYDDDISKLFEWILINW

SEQ ID NO: 144588 - protein, 66 aa, Heterodera glycines
  Coding regions on vcDNA: vcDNA=SeqID_71011; Strand=+; Position=1 -27,155-328
MDKFAKKKKLYNEVSALYATSDQMIVGEEPAPAQAGAAAEDAANKSAKRAALAAQKRQLALDRVYS

SEQ ID NO: 144589 - protein, 89 aa, Heterodera glycines
  Coding regions on vcDNA: vcDNA=SeqID_71012; Strand=+; Position=1 -136,187-320
MHFSTIRSATFPTSGLLSLEMFDDYDKMLRAMSEAIKWLILHLPKDEFMSRNKRFNLFAIAEDSGEILTVLKQLSQFEYKFRKVFTLFH

SEQ ID NO: 144590 - protein, 88 aa, Heterodera glycines
  Coding regions on vcDNA: vcDNA=SeqID_71013; Strand=-; Position=1 -210,840-896
  Homolog annotation: Hit_ID=CAE66567.1; Match level="QueryCoverage =100%, HitCoverage=2%, E-value=2e-19, Identity=44%"; Hit description =Hypothetical protein CBG11882 [Caenorhabditis briggsae]
ASPVNCEVNDGSVFSCADGRQCFPIARKCDGNYDCRDLSDEKDSCATNHTVGDRFRVPLVYGAISPLVFSKNRRCVPHKFRCDYYDDC

SEQ ID NO: 144591 - protein, 110 aa, Heterodera glycines
  Coding regions on vcDNA: vcDNA=SeqID_71014; Strand=+; Position=1 -61,108-379
  Homolog annotation: Hit_ID=XP_477035.1; Match level="QueryCoverage =38%, HitCoverage=6%, E-value=5e-10, Identity=64%"; Hit description =putative DEAD-box RNA helicase DEAD3(i|6753620) [Oryza sativa (japonica cultivar-group)] dbj|BAC83834.1| p
MKFSIILLLSLAFCALIIDAYPSGNGKDLEADNEKTEVKEEKMEKREAEVEEGKKEKKAAEEEVGKKEKRGSGGGTWGNGGRGNGGGGHGGGGHGGGHGGGNDSSGGGDD

SEQ ID NO: 144592 - protein, 84 aa, Heterodera glycines
  Coding regions on vcDNA: vcDNA=SeqID_71015; Strand=-; Position=1-255
MDDQSLDHSAGDLKAQYRRLKKESAEQDERISQLYEKKLKQEKQLAEQDERLARLRSNSEFQVEEKGSECTNNGAMCQKWSQFM

SEQ ID NO: 144593 - protein, 134 aa, Heterodera glycines
  Coding regions on vcDNA: vcDNA=SeqID_71016; Strand=+; Position=1 -259,306-451
MKRARQSEKLGAFPEIEFAVNTMGVTVYCPRHLQTPRFVPWDQPGRCSSCRSGTVELDYIIQPEGVTIFSNRLKTDGENFVPFDAIVDFADRAKFRIRARNKVFTLPLRHPEVHAAGPSLEEAVKGQKEMTQMP

SEQ ID NO: 144594 - protein, 73 aa, Heterodera glycines
  Coding regions on vcDNA: vcDNA=SeqID_71017; Strand=-; Position=1-221
NNPRRDGKSEFTFDYSWVIHQNKNKNNGKMDKCLWHLRHFLLFFYGFFQARACGVDLRVSQRQSEHLISCPYA

SEQ ID NO: 144595 - protein, 178 aa, Heterodera glycines
  Coding regions on vcDNA: vcDNA=SeqID_71018; Strand=+; Position=1 -208,251-327,369-620
MDELKKEKFSPQNGDDVSIIGDNNNNNITQTLLDLQPGPSKRGRKPRLDKIHEEIASAVKKAKAMEIEGVDESPKKQPKNVFDYPSIFWKLGRPKYGVFTFMCDECRGENFRQGKSSFKLINQNGEQQQRLVFAQSFCQDCAKLNFDCTDLIMKHKKKDESATTTMAKSFRWTKDAEK

SEQ ID NO: 144596 - protein, 178 aa, Heterodera glycines
  Coding regions on vcDNA: vcDNA=SeqID_71019; Strand=+; Position=1 -208,251-327,369-620
MDELKKEKFSPQNGDDVSIIGDNSNNSITQTLLDLQPGPSKRGRKPRLDKIHEEMASAVKKAKAMEIEGVDESPKKQPKNVFDYPSIFWKLGRPKYGVFTFMCDECRGENFRQGKSSFKLINQNGEQQQRLVFAQSFCQDCAKLNFDCTDLIMKHKKKDESATTTMAKSFRWTKDEEK

SEQ ID NO: 144597 - protein, 181 aa, Heterodera glycines
  Coding regions on vcDNA: vcDNA=SeqID_71020; Strand=-; Position=1-546
MANKLILLPYEHYKGLVAARETKNDDADDIAERTNLGFVKRQVTAAVQKRKGNVSERNAMYNQHLRRYLKMRKEHKERPVRVQLSNGAQLLNKTVETGVQVRPGPDEPKDKSVMVTDEDEDEEIEVPKFLTPTSQTQGSNRSPRTNKKAAKQQKLIEKKDHLLAIIMSDPQRFGANENVSH

SEQ ID NO: 144598 - protein, 190 aa, Heterodera glycines
  Coding regions on vcDNA: vcDNA=SeqID_71021; Strand=+; Position=1 -98,168-569,1090-1162
MARAHLAALKWLALSWPCTPPTPMGGYRNPVKKKDGRGKKKNFFAVGANVIASLGDEPWRAGRVISRKEGTYDVQFLDGTTGEFPAKGVQPYKPDEDENLNFLLDGFGLKRASSVDLSGSTAAMADEIKRKMIFEKLPTVDTRHKNADLRMRMMDGGPALFKGEMLGIINEKFSKISKSLVKNKLIFDLI

SEQ ID NO: 144599 - protein, 167 aa, Heterodera glycines
  Coding regions on vcDNA: vcDNA=SeqID_71022; Strand=-; Position=1-506
SVGTSSSFERSIYESADNESASSSSFDHCGQNANGETEESAIMDKISTKIDHLDNDWEDFANWKKSGGIKVEMVENKQIENKSCKEQIWIKEEVSEFDQMVENDQNAKENEKIKSANDENENGAKENKKFNRNKKIVVQNIIRKCEWAECELKFENDNKLYDHLKTV

SEQ ID NO: 144600 - protein, 318 aa, Heterodera glycines
  Coding regions on vcDNA: vcDNA=SeqID_71023; Strand=+; Position=1 -47,668-954,2017-2636
MVTMATDFCNRLPTEGENVSSGYLHCVQFLLYHHMQKLVWRLENKWGIISDQNNDKNLEAKNHLLQIYTEKKMIAWEQMVKIYGKELKDLTEVNELIRRKFEFCLIIEGETQLKCNAIGAENAHLFLKNFHKIVFEPEYERNWSKKAELIGTNIFNSLRKELRKNEQLKQNKGNEDQKEKAKIMAKNWKLAETSMRVRVQVLVNTAERKCRTLPKKPFRQIQKLGRNLSKRLERSWSSKNREINQNESGGDKFDELTLESENYTKNPFRNGERKSINRTTRRENENTTKNPLRNFQEFGRSISKRLERSWSFKNNEEN

SEQ ID NO: 144601 - protein, 73 aa, Heterodera glycines
  Coding regions on vcDNA: vcDNA=SeqID_71024; Strand=+; Position=1-222
MDKSFDEFLFQCAGQFIEAVAEEQFSYKLFVNLNTMQLDTEMDFPPSMKDEIMVSKNVGKNARGKWFMMRSIS

SEQ ID NO: 144602 - protein, 155 aa, Heterodera glycines
  Coding regions on vcDNA: vcDNA=SeqID_71025; Strand=+; Position=1 -166,630-930
MGSQRKHSAERKLYKAQTMRRRRRKRTDDNEIFGGQKTLGELMSEERQLRKSEFTDTIVAIRCLQEEDETSSSEQQQTKTLGELFDEDHFEAPEIVMEKIERKMEKIRQKIAQESLGKRLKDYEMFIRAFYIALAFELFERMHGEEGAMTTNWHF

SEQ ID NO: 144603 - protein, 121 aa, Heterodera glycines
  Coding regions on vcDNA: vcDNA=SeqID_71026; Strand=+; Position=1 -40,347-672
MKLNLDQFTMSYDGQCDLTNDLNDCFVASDGIDFDAQVEKVSLFGKETSEMSTLEKAAESLFKKLNRWSYKFGQRGKRHRNILKRYFSGKMKDILGVIPEMMTDKVSPFEVIWSSQDISTP

SEQ ID NO: 144604 - protein, 153 aa, Heterodera glycines
  Coding regions on vcDNA: vcDNA=SeqID_71027; Strand=+; Position=1 -20,63-504
  Homolog annotation: Hit_ID=CAE74243.1; Match level="QueryCoverage =64%, HitCoverage=15%, E-value=9e-15, Identity=41%"; Hit description =Hypothetical protein CBG21928 [Caenorhabditis briggsae]
MSRFLTRLEAPGYHSIVDYPMSFSTINDKIDNNMYLNLDQFKSDICLVSDNAMLYNNTGSVYFLAAQKLKVLAKYYFSEKYLLFLVYSLPFGKALTEEQLGIRLRRKEEQTPRQLKEKSGRERPLPFLRQSLAFIRVKIMKLILVTVKKLRKY

SEQ ID NO: 144605 - protein, 64 aa, Heterodera glycines
  Coding regions on vcDNA: vcDNA=SeqID_71028; Strand=-; Position=1-192
MNDKIDWLGLRGLASFSWLFLQSPGLNPPAFQSLGLNPPSFQSLGLNSPAFQSLALNPFSSALL

SEQ ID NO: 144606 - protein, 95 aa, Heterodera glycines; identical to SEQ ID NO: 124528
  Coding regions on vcDNA: vcDNA=SeqID_71029; Strand=-; Position=1-819

SEQ ID NO: 144607 - protein, 95 aa, Heterodera glycines; identical to SEQ ID NO: 124528
  Coding regions on vcDNA: vcDNA=SeqID_71030; Strand=-; Position=1-832

SEQ ID NO: 144608 - protein, 74 aa, Heterodera glycines
  Coding regions on vcDNA: vcDNA=SeqID_71031; Strand=+; Position=1 -6,304-522
MGSPPAENKEQVEELQKAIENTREFQAMKKDKQIKEIKEDKDVRLAWFGPQMWDFITKKEEGTTSEAAAQKGDL

SEQ ID NO: 144609 - protein, 118 aa, Heterodera glycines
  Coding regions on vcDNA: vcDNA=SeqID_71032; Strand=-; Position=1-469
PKNGYLFFLIFLPQTWYQQLPSLVWPYQTILRYLKRKQKKFLTKKWLSLFSHFFTANLVPTVAFSCLALSNNLTIFETQTKKILDQKIAISFFSFFYRKLATNSCLLLSGPIKQSYDI

SEQ ID NO: 144610 - protein, 16 aa, Heterodera glycines
  Coding regions on vcDNA: vcDNA=SeqID_71033; Strand=-; Position=1-49
EAIPEGFGLPINLGAS

SEQ ID NO: 144611 - protein, 21 aa, Heterodera glycines
  Coding regions on vcDNA: vcDNA=SeqID_71034; Strand=-; Position=1 -49,613-629
MHLSPFCATVPFLFFFEIKMK

SEQ ID NO: 144612 - protein, 54 aa, Heterodera glycines
  Coding regions on vcDNA: vcDNA=SeqID_71035; Strand=+; Position=1-165
GWGGYGYGYPYGFYGKRQAGFGPSGNAGTFGDGGEGNANGGGEGRGGPSSPNNF

SEQ ID NO: 144613 - protein, 957 aa, Heterodera glycines
  misc_feature (497)..(497): Xaa can be any naturally occurring amino acid
  Coding regions on vcDNA: vcDNA=SeqID_71036; Strand=+; Position=1 -21,105-328,407-656,718-859,920-1099,1238-1304,1350-1415,1506 -1525,1573-2255,2484-2755,2790-2905,2955-3028,3075-3281,3329 -3401,3482-3513
  Homolog annotation: Hit_ID=NP_507869.1; Match level="QueryCoverage =99%, HitCoverage=93%, E-value=1e-172, Identity=42%"; Hit description= UNCoordinated locomotion UNC-51, serine/threonine kinase (94.9 kD) (unc-51) [Caenorhabditis elegans] emb
KEIKILQELKGLQHENLVSELKGLQHENLVSLLRCVETSTHVYLVMEYCNHGDLAEYLFSRQSLNELTIQHFFTQIARALEALNRKAIVHRDLKPQNILLCNPRHPQNILLCNPRHPLVPLPSQLVVKLADFGFARSLPEGIMAGTLCGSPMYMAPEVIMSHNYGAKADLWSIGTIIYQCLTGKAPFVAQTPQALAQTPQALRNYYERHAELKPNIPDFCSALLSDLLMSLLKKNPLDRIEFNSFFNHPFFTTELPTSNVSPSFFNHPFFTTELPTSNVSPSRHLVRRPSAEVQAQPTQNRPKFSGSPTQTQNGPNCKSPQPVRRNAHAPGVLRRQVPPPSHSPQNAAAMNESTDFTFLPQNAAAMNESTDFTFLPPLQETHPVKQPVKQVQVHSSIPRQTNIAKAVPVPNKRVQVHSSIPRQTNIAKAVPVPNKRHAFAKMEERRNASKKSAVNRATDEFRGAATAREGNGCIWGREEAQSPSVEEIELPVGIEIXRQNLFKACLARFIVYDQQKTSGAAASRSSLPVSGRLRRNTTAIDEPSTSNAPSQTTDGNDKFPMMAIPKSATFVMTSIGGQQQKEAEKTAKELDNIRFQNTTPPPTVSGLNAHNQKKIEFKVINETNGTERHSNFSNSSITDNSEMIIQNADTNDKAPSTTDRSPDNFLFDAPDPPPELEQETLLGAGHKQTLAKLRFVLDLIEAIASVAENKTNPMAIAMEGNKRKSFTRTAPTSSDAYRFTRTAPTSSDAYRRAEQLVLYVRALHVLSSALVMAQKQINASILHPSSAVQNVLNQLNASILHPSSAVQNVLNQLNEKYHYCLARSQELASLGIPGQDPCLARSQELASLGIPGQDPQAMVVSAERIMYQHAIDLCQSAALDELFGNPHLCPKRYQTAYMMLHTLLYTVQNEQDKTVLLKYKVQNEQDKTVLLKYKNAVEKRLRILERQRQGLCASVIN

SEQ ID NO: 144614 - protein, 149 aa, Heterodera glycines
  Coding regions on vcDNA: vcDNA=SeqID_71037; Strand=-; Position=1 -315,374-508
MNVDHLQRTSHRKLADQIADVISRDRSRSASRASLEGISREVRHKFAHYTPKKKEQQQTRQNDSVDPEDALLILGLVGTQKAYRRLKGTIRLINAKLDVFPPLKKVLDIKRRICGPLQYAPIETNVGVGFVSLMLGQLWRRVFCLPKTI

SEQ ID NO: 144615 - protein, 87 aa, Heterodera glycines
  Coding regions on vcDNA: vcDNA=SeqID_71038; Strand=-; Position=1-264
  Homolog annotation: Hit_ID=CAE71246.1; Match level="QueryCoverage =77%, HitCoverage=12%, E-value=1e-10, Identity=46%"; Hit description =Hypothetical protein CBG18122 [Caenorhabditis briggsae]
MSKEADNFNSFDKADALMDVPESSRKKKLVKLGAKVLETRKEARKVLPEEQYVQNLEKLIVRDYFPELPKMKVNKSDEIGNSKFNWV

SEQ ID NO: 144616 - protein, 150 aa, Heterodera glycines
  Coding regions on vcDNA: vcDNA=SeqID_71039; Strand=-; Position=1 -346,667-773
MQLSQALRLVNERTLVSFVQQLPLVAQLFGDGRIVHFRIVRRHSLSLPARPHHKGTDKWAHFSMINSSEIKNQLFYCKIQEKTNKNYKFCYFIGLFTCSSASSLQRWLTTAAVAGALSGSLITFSIAKLYSCAATDRRQWNLFLMLCNEW

SEQ ID NO: 144617 - protein, 80 aa, Heterodera glycines; identical to SEQ ID NO: 134858
  Coding regions on vcDNA: vcDNA=SeqID_71040; Strand=+; Position=1 -71,179-346
  Homolog annotation: Hit_ID=XP_309771.1; Match level="QueryCoverage =82%, HitCoverage=30%, E-value=2e-24, Identity=77%"; Hit description =ENSANGP00000012491 [Anopheles gambiae] gb|EAA05566.1| ENSANGP00000012491 [Anopheles gambiae str. PEST]

SEQ ID NO: 144618 - protein, 83 aa, Heterodera glycines
  Coding regions on vcDNA: vcDNA=SeqID_71041; Strand=-; Position=1 -117,577-711
MLKRRQPAPLNPQRVIRENRKTPKMVFKFCQRVQARLLQGFLGRFAASNGRFAPVTTVIRRGKMVIRRGTTMIRRGTKVIEEV

SEQ ID NO: 144619 - protein, 16 aa, Heterodera glycines
  Coding regions on vcDNA: vcDNA=SeqID_71042; Strand=-; Position=1 -39,205-216
MEKACKIWRDYIDSSF

SEQ ID NO: 144620 - protein, 89 aa, Heterodera glycines
  Coding regions on vcDNA: vcDNA=SeqID_71043; Strand=-; Position=1-665
FLSKKIFFWVFGAVPLNRCAQIYGETESFGNSFPIACTLILRWIFAPHNCLSTPNGHLKKSIFLFSGQSPRADAPRFMGRPNPSGIASL

SEQ ID NO: 144621 - protein, 35 aa, Heterodera glycines
  Coding regions on vcDNA: vcDNA=SeqID_71044; Strand=+; Position=1-174
MFGIFFGLPKLHRTWVLLFSFKSPPNFFYSLTRPY

SEQ ID NO: 144622 - protein, 228 aa, Heterodera glycines
  Coding regions on vcDNA: vcDNA=SeqID_71045; Strand=-; Position=1-697
  Homolog annotation: Hit_ID=XP_308960.1; Match level="QueryCoverage =96%, HitCoverage=47%, E-value=1e-28, Identity=33%"; Hit description =ENSANGP00000022672 [Anopheles gambiae]
LPTLASPVLLDRHSFLTRLIVQEIHADLRHAGVDWTLTEFLSRYWMPQARRTIRGILRGCPSCRRMTAPPFARPTMPPLPSMRFKPANPFEFVGLDFAGPTPSRLSDGSLTKAYLVIITCFVTRAVYLEATTDLSAPSFINILRQFFSRRGRPRRILSDNATFVQTSKALDILTCPPSETDVVTFAARRGIQWDFIPAYHMGSLYEQLIGLVKSCIKRTIGRRILDYR

SEQ ID NO: 144623 - protein, 26 aa, Heterodera glycines
  Coding regions on vcDNA: vcDNA=SeqID_71046; Strand=-; Position=1 -24,844-900
MINCRSEFRLRLKQNKDQVYCNDHAY

SEQ ID NO: 144624 - protein, 136 aa, Heterodera glycines
  Coding regions on vcDNA: vcDNA=SeqID_71047; Strand=+; Position=1 -49,411-769
MRAERQMQMQQQQVVGPFNSINLWSDLRLFECADKADEADEADEVNRALEEVELDWREKVDEKRRRKMEKDFRRMEKERAEQQRKAGDVQPEQLSGAEKRKLYGPQFDAAKFRADVEAEKPCDGEPLQVAEYYLFR

SEQ ID NO: 144625 - protein, 38 aa, Heterodera glycines
  Coding regions on vcDNA: vcDNA=SeqID_71048; Strand=+; Position=1 -25,73-164
MLMNGFETGLLSINGAVFCTYPDLIYTSGSVGLCKNFL

SEQ ID NO: 144626 - protein, 247 aa, Heterodera glycines
  Coding regions on vcDNA: vcDNA=SeqID_71049; Strand=-; Position=1 -157,349-683,979-1061,1362-1470,1542-1601
  Homolog annotation: Hit_ID=AAB42377.1; Match level="QueryCoverage =99%, HitCoverage=52%, E-value=7e-23, Identity=27%"; Hit description =BmSERPIN [Brugia malayi]
AQADFALNLLREVSTDDRSCIVSPFSAAVTLSMVYAGAKEKTGEEMGQLLANVPLKNASPKVMRDNNHPLPLLITLPHQSPVFNPLPIPNCPLGAPESEVHKYFGALLKSITSGTNSSNTLETANKVYVKKGIKVKDAFKEQIEGNYGGQFETVEFEDGKGTAEKINKFVKEATHKKIRDLVTPDNFDENTRLVLINALYFKGTWADKFDSKFTKKAKFHVDAKNFKELEMMHLEAYFIYYKNAQVV

SEQ ID NO: 144627 - protein, 42 aa, Heterodera glycines
  Coding regions on vcDNA: vcDNA=SeqID_71050; Strand=+; Position=1-128
MARKDFRFPTFLGSEFRLPKFLMKSRKFFKFFFQKTSKFVQF

SEQ ID NO: 144628 - protein, 89 aa, Heterodera glycines
  Coding regions on vcDNA: vcDNA=SeqID_71051; Strand=+; Position=1 -62,273-480
MSHLDTCIVCSFCFTIICKSWAKRVSFFFLMRFVTRNSFVLCAIYFSGSGQSVSGQSVSGQSVSEGQSVSNGQSVSNGQSVSNGQSVSG

SEQ ID NO: 144629 - protein, 33 aa, Heterodera glycines
  Coding regions on vcDNA: vcDNA=SeqID_71052; Strand=-; Position=1-219
INFQMFLNKSGVFKKIAYELVTGLDCPLTDCPL

SEQ ID NO: 144630 - protein, 118 aa, Heterodera glycines
  Coding regions on vcDNA: vcDNA=SeqID_71053; Strand=-; Position=1 -95,242-503
MPTLRSKALSLFCRAAKNAKQGQKTNDGWPLCKIGTYFQYRNKVWDVQRIDYAQFYLFGPDVIECRHCAYRRWTNSPGKPTNALRKSFEEVPYECAETIPYSHPGERRWAQQNGGRRK

SEQ ID NO: 144631 - protein, 65 aa, Heterodera glycines
  Coding regions on vcDNA: vcDNA=SeqID_71054; Strand=-; Position=1 -79,227-345
MKRTETILRVFKTFAMDGNALEGGAAGLKMGSRRQKRSAVAAIAIIAFLGFIFVFAQLSAATGSY

SEQ ID NO: 144632 - protein, 102 aa, Heterodera glycines
  Coding regions on vcDNA: vcDNA=SeqID_71055; Strand=+; Position=1 -42,187-453
MSLNLIELLYFITKNIEELAIEVKKSKDKIRKFLDEKLPKGATLIDEKQYGEIKKMRKELADAIDKVAEEEGKDGNTKSSTVNLPFPKNSGIYWTINAHNFY

SEQ ID NO: 144633 - protein, 51 aa, Heterodera glycines
  Coding regions on vcDNA: vcDNA=SeqID_71056; Strand=-; Position=1 -120,170-202
MVEDQQQEGMNKWKRMGDQQNKKENFMHCTEQYAAPELIENLSDGKKIYDE

SEQ ID NO: 144634 - protein, 77 aa, Heterodera glycines
  Coding regions on vcDNA: vcDNA=SeqID_71057; Strand=+; Position=1-231
MGQKIEKKPLSLDEKSVLDEQTQLGNLREEFDQKRKNFEELTKSLTSQDEKGRINEMNKLWKNLNQQIVDRGNLLSS

SEQ ID NO: 144635 - protein, 104 aa, Heterodera glycines
  Coding regions on vcDNA: vcDNA=SeqID_71058; Strand=-; Position=1 -199,664-778
NFTCQVEVNPGQIGGPGAATAVSKCHRKMLDKVEIMHGKKLPIMAKAVVPENRPGPGIARTLYQAWKMFGDPNAIILYVNQPDLFPVCHFEQLQFVMFQVEKLA

SEQ ID NO: 144636 - protein, 18 aa, Heterodera glycines
  Coding regions on vcDNA: vcDNA=SeqID_71059; Strand=+; Position=1-56
YREAIPEGFGLPINLGAS

SEQ ID NO: 144637 - protein, 36 aa, Heterodera glycines
  Coding regions on vcDNA: vcDNA=SeqID_71060; Strand=+; Position=1-108
MIGRAVRNRPFIFEGIFKFILYPRKMAISFFEKFYT

SEQ ID NO: 144638 - protein, 65 aa, Heterodera glycines
  Coding regions on vcDNA: vcDNA=SeqID_71061; Strand=-; Position=1 -155,233-275
RIPPLRLRAVQASGGVERHRFGFGWHHPTQRHAERHLFEAVVSAKCALCRNETTFQNWTWRMTAH

SEQ ID NO: 144639 - protein, 327 aa, Heterodera glycines
  Coding regions on vcDNA: vcDNA=SeqID_71062; Strand=+; Position=1 -126,1760-2285,2461-2792
MTMMMLREEEKPPRGMVEEAKSKFEEKHLPKKKPPNGTRLMKTLAVQQVLFALLHQTALYCLNVSSPHRFFSSHPSKMYRSPSSSSSLSFSAPNPFLSSADQQLISDRTFDPTRVYRNEIAGGKMSETYESLVRNIFRPEQSRQESSVFLPPSFAPPSAHLSQQQFGKHRQNTVNGQQSTLGGVPSPSTNGRERPRISAAAMKRIEDRLGEDVLDDSLPKAITNFCSFGQMMTSCGSRRWMRFTPSWALTRPPPLLRSRRRPSIPRFPPLTLRPPPQTRRDVVAPRPASCPNIPSTCPSVPRNMPNWPTRRLRHNHRTAAQHWARIA

SEQ ID NO: 144640 - protein, 147 aa, Heterodera glycines
  Coding regions on vcDNA: vcDNA=SeqID_71063; Strand=+; Position=1-443
MTIINTTVLCQSNTNPASRELKIFVDPPGVHYTVSAVVITVNRDGTMPNMPRHIFHGTKTWTQLDGREMFILEKTKLDGRRGVVFEYGPENATEEEMVWVLRYRIIKIKFERKIVKASKFIYYRQRDIERHAERQREGNRVIAKRKK

SEQ ID NO: 144641 - protein, 94 aa, Heterodera glycines
  Coding regions on vcDNA: vcDNA=SeqID_71064; Strand=+; Position=1 -130,267-334,520-605
  Homolog annotation: Hit_ID=NP_500187.2; Match level="QueryCoverage =95%, HitCoverage=23%, E-value=2e-25, Identity=60%"; Hit description =vacuolar proton ATPase, Vacuolar proton ATPase VHA-11 (43.5 kD) (vha- 11) [Caenorhabditis elegans] gb|AAF5
SPSAEVWIVSAPLDATPQETWERLQTNTHNLSTNSKFNIPDLKVGTLDQLVGLSDDLAKLDAATEQTTRKLVQYFSEVLEEERNKLLENLVVSG

SEQ ID NO: 144642 - protein, 73 aa, Heterodera glycines
  Coding regions on vcDNA: vcDNA=SeqID_71065; Strand=-; Position=1 -135,211-295
MSQNRDENSQPPVLDGPYPLAQERNEFVEDEAPVLLEMLDRLSQGGICQAMGLFSFALADCLATFHTFAILFD

SEQ ID NO: 144643 - protein, 404 aa, Heterodera glycines
  Coding regions on vcDNA: vcDNA=SeqID_71066; Strand=-; Position=1 -265,310-646,838-1100,1366-1657,1867-1926
  Homolog annotation: Hit_ID=NP_510849.1; Match level="QueryCoverage =92%, HitCoverage=50%, E-value=2e-35, Identity=34%"; Hit description =predicted CDS, zn-finger, CCHC type and RNA-directed DNA polymerase and Integrase, catalytic domain conta
KCTIKAALNGEKGILLDFYVVEKGSFDLLGLAWIRAFEQAYSKPVATTLKFDQPTHSVQIKGTECTPTQLKAELQAQFPNVLSDSLGFPVFCGSRPVPLGVQSEVDAELDRMIELGFLQKVDYSKWAAPIVAVRKANGKVRQCFDFSTGLNNALEPHHHPLPRPDELFAKLSGAKFFSQIDFKDAYLQICVDEQSRQLLGRIQQFGFHVQMEKCKFLVKEIKFLGQIVSADGIRPDPCRTLALQQMPPPHDITTLRSFLCAINYYGKYIKNIHQLRGPLDELLKKGIKQAQLFIDHRLSSVQRTFCHPPVTSKSHTEGAALGSPRHSSHKNLARSFVYWPSMDTDIETIVRGCSQCQQAAKQSPKQPLQPWPTTTSVFERIHIDLEFNQAHFFTSVPPAIKRSS

SEQ ID NO: 144644 - protein, 92 aa, Heterodera glycines
  Coding regions on vcDNA: vcDNA=SeqID_71067; Strand=-; Position=1 -77,243-444
MRTKPKLSLLTKCEQRLKMLKDTKFKGFESIRDRYFEKSLDLDLDSMLGLDLDFLDKNPGKSRSRKNPGSSRPGSRPGPGFFETHLKNQKKV

SEQ ID NO: 144645 - protein, 24 aa, Heterodera glycines
  Coding regions on vcDNA: vcDNA=SeqID_71068; Strand=+; Position=1-80
GTLSTAVRQRSSKIYSMPQILWAG

SEQ ID NO: 144646 - protein, 97 aa, Heterodera glycines
  Coding regions on vcDNA: vcDNA=SeqID_71069; Strand=-; Position=1 -100,218-411
MSNGSEEDEHNDDIMPNDALRNRQKYGKKRANFGRELSDEEKIKIVKKFMLIRERIDNGNFSKKITAEQIVNKLGVTMHQIKHWKFKYGLSKSQIPN

SEQ ID NO: 144647 - protein, 139 aa, Heterodera glycines
  Coding regions on vcDNA: vcDNA=SeqID_71070; Strand=+; Position=1 -186,237-470
MPAETAAANNHFVLMGQPKGEGSPFLVPNPMYTLNLKQQHFGGVPLPVHHQHQMSLSVGSAESAADHHQCRPRQQSLYCSNSSRQSEPPPQQSAAEQQQQQQHLYAAQQQQMRTSPMEVKSQLLAQLANELGSPTEQRN

SEQ ID NO: 144648 - protein, 41 aa, Heterodera glycines
  Coding regions on vcDNA: vcDNA=SeqID_71071; Strand=-; Position=1-122
PQQHSAVCSVCATRFSHILGCERKLGEAFDKEMIVQSTATG

SEQ ID NO: 144649 - protein, 93 aa, Heterodera glycines
  Coding regions on vcDNA: vcDNA=SeqID_71072; Strand=-; Position=1-282
  Homolog annotation: Hit_ID=NP_740776.1; Match level="QueryCoverage =88%, HitCoverage=10%, E-value=2e-12, Identity=42%"; Hit description =ubiquitin-protein ligase with C2 and WW domains; suppressor of deltex; atrophin-1 interacting protein Ned
TSAKLNSGGFLSKAPDAYVEIIVDSKEDQAKKTSVKKKTNSPHWDESFTLNVTENSVIEFKIFCKAKVFDDSLLASKSVKMSNWLRKESNNGK

SEQ ID NO: 144650 - protein, 110 aa, Heterodera glycines
  Coding regions on vcDNA: vcDNA=SeqID_71073; Strand=+; Position=1-333
KLLEFYRKERDMFTEGLEKASVNVEEFKFPTENVEQIFDGLFALEITGKQMKANYETTKEAQREHQKQSNAEAMRAQNLVKAKPTKCQSGGLTRVSKPGFLVCPMPFHPE

SEQ ID NO: 144651 - protein, 200 aa, Heterodera glycines
  Coding regions on vcDNA: vcDNA=SeqID_71074; Strand=+; Position=1 -104,152-277,432-622,740-923
  Homolog annotation: Hit_ID=CAE66268.1; Match level="QueryCoverage =72%, HitCoverage=22%, E-value=7e-21, Identity=36%"; Hit description =Hypothetical protein CBG11512 [Caenorhabditis briggsae]
AIDVIVVEQPDGSLASTPFHVRFGKYGVFNYENKYVDIEINGEEIDLKMKLGENGVAFFLANDEEGIGETKNAEGKEFLRESQNKKWSEDTQQNNRPSAIDLENQRKCSFASSSSSTSSCTSQPQHNECPPTATTTAERKQSDAAKAVKNVQSVLSQPQGVRPTEPSATAFFVVHLFVPKESLFARFGQFVVAFVEHLRL

SEQ ID NO: 144652 - protein, 159 aa, Heterodera glycines
  Coding regions on vcDNA: vcDNA=SeqID_71075; Strand=+; Position=1-477
  Homolog annotation: Hit_ID=NP_001004509.1; Match level="QueryCoverage= 98%, HitCoverage=10%, E-value=1e-19, Identity=33%"; Hit description =si:busm1-180o5.3 [Danio rerio] emb|CAD60788.1| novel protein similar to DNA polymerases [Danio rerio]
MPVKFDQRLLFPLCEKCAKHITAKYPNGLKDNIYSCPHYNPNDRAFVSTCTHLELNAALEAGYTVRKVFHVLQYDQWSNNVFKSYVSEMMAIKIHATGFPSWCESEEEKSEYIEECWMKFAIKLDKEKMKSEPGKRYIAKLCLNSLWGRFSMRNLLSKA

SEQ ID NO: 144653 - protein, 34 aa, Heterodera glycines
  Coding regions on vcDNA: vcDNA=SeqID_71076; Strand=-; Position=1 -3,121-216,254-259
MNSLLCEKLNAAAATMADIYGALLLHAIFDGSKF

SEQ ID NO: 144654 - protein, 192 aa, Heterodera glycines
  misc_feature (99)..(99): Xaa can be any naturally occurring amino acid
  Coding regions on vcDNA: vcDNA=SeqID_71077; Strand=-; Position=1 -94,161-318,370-425,591-656,703-928
VNPINKCFWLFVFYRQKSAKLSISIGTSAGTSLPSASDSLSSAASPAEFVPSSPIASPSPADCCQVCTNGTTSFCSSLRPASQSKHSSTHNSLIEVILXTLQKANRMVAHCLFSSINFLRHFRRILAFRLSEKLSKSCIRLDKFAQHFCGHNGNRKRLLSRGKGVGGPPIRHFDGEKNEPKLTEDKLSSGTA

SEQ ID NO: 144655 - protein, 165 aa, Heterodera glycines
  Coding regions on vcDNA: vcDNA=SeqID_71078; Strand=-; Position=1 -256,1984-2223
  Homolog annotation: Hit_ID=CAE70206.1; Match level="QueryCoverage =45%, HitCoverage=12%, E-value=1e-14, Identity=46%"; Hit description =Hypothetical protein CBG16681 [Caenorhabditis briggsae]
MTSKNNSPRNGSQCHGCQQQTNVNGTKCDNKRILVVQTTGDANGGNANGGGVATVLTNTTAMPTTAAAKEQPQPKEQTEQQMAQSGIVRWIKLKTDPNYKPPPEEVVALTRETFDEFVGDKPLVLVEFYAPWWHKIQVPKINNCLKVRPLQAIGTRIRRSSKTFE

SEQ ID NO: 144656 - protein, 223 aa, Heterodera glycines
  misc_feature (197)..(197): Xaa can be any naturally occurring amino acid
  Coding regions on vcDNA: vcDNA=SeqID_71079; Strand=+; Position=1 -585,824-857,1075-1126
  Homolog annotation: Hit_ID=AAG23159.1; Match level="QueryCoverage =99%, HitCoverage=96%, E-value=2e-91, Identity=73%"; Hit description =polyprotein [Heterodera glycines]
VQNCEPCQLAAKAPIKTDLHSWPKPTGPWQRIHIDFAGPFFAKFLIVVDSFSKYPEVFEMANSTASATIEKLRYLFTRHGIPETIVSDNGTQFSSSEFAKFVAANGITHLFSAPYNPMSNGQVERFVDTFKRAFRKLKGEGKPNKEIIDIFLITYRTTPNDSLPDLKCPAELLLGRRPRTTIDLLRPPPHQPFETYXMRHLSCHFLHIFPPIIISLSHLHHWF

SEQ ID NO: 144657 - protein, 46 aa, Heterodera glycines
  Coding regions on vcDNA: vcDNA=SeqID_71080; Strand=-; Position=1-139
LKLHPKDFSLILDDEYLVAVAVHRYSSATPQELTFTREIIRRTTAI

SEQ ID NO: 144658 - protein, 87 aa, Heterodera glycines
  Coding regions on vcDNA: vcDNA=SeqID_71081; Strand=+; Position=1-261
MENADEKPPPVTSSGGTNAAAATAALAMQKIVQQHAATIANQVQQQQQQQTGTEYKQTNAYFGRQIMEKYHVYLPEKWVLPCFLLVL

SEQ ID NO: 144659 - protein, 48 aa, Heterodera glycines
  Coding regions on vcDNA: vcDNA=SeqID_71082; Strand=+; Position=1-153
FFCPWAEKLVFFTLKRNAQFVYIKKEERIIILIIYKQNDKLRKARGSF

SEQ ID NO: 144660 - protein, 76 aa, Heterodera glycines
  Coding regions on vcDNA: vcDNA=SeqID_71083; Strand=-; Position=1 -59,542-710
MEKEQQKHTAERQQPNMQGSFEVLDSGKAFSPSMTPNPKNCRTSVAQIRHKAMAQIQVEPAEVPMPSCQIKMMDKR

SEQ ID NO: 144661 - protein, 165 aa, Heterodera glycines
  Coding regions on vcDNA: vcDNA=SeqID_71084; Strand=-; Position=1 -77,512-932
MFGPTATTWTNSAAALGSNSSSHAWGNKKNIPNDSYYTELANTQKENKKFGIKENVIRFIFKNSEENSKENFKKIIEYLTDKAMEKNEKGWVIEKISYDLYCEALSDPLIIPPRDLVQNNADVVLESFYHIQQSFSEIDLLNEEISLIITTYAAPNGSGIKKNSV

SEQ ID NO: 144662 - protein, 296 aa, Heterodera glycines
  Coding regions on vcDNA: vcDNA=SeqID_71085; Strand=+; Position=1 -184,230-318,364-673,724-958
  Homolog annotation: Hit_ID=NP_493393.1; Match level="QueryCoverage =95%, HitCoverage=32%, E-value=4e-47, Identity=37%"; Hit description =synaptojanin, N-terminal (88.0 kD) (1O249) [Caenorhabditis elegans] emb|CAB63333.1| Hypothetical protein
VERVCALPVLTDGMIHKKLLSLDGFERLKNRPRNLLKLMSHKVPIKNPSPKLIDEIIAFFNQPKSFYFSHNIAFFNQPKSFYFSHNFDITKTLQQRYAIGLSSTSDNRFFWSSTSDNRFFWNKNLLNEMFVNDGSPKWITPLIYGFIEHKSIVFDVDIRAHMTLISRRSVKRAGVRYLRRGIDEDGDVANFVETEFIVCVFGHCLSFVQCRGSVPVFWCRGSVPVFWSQKGFQLKPPLVIDRPLDISLPIFASHINRLISNYGTPLVLVNLVDQSGKEASLGEVYCRESQDRRQQA

SEQ ID NO: 144663 - protein, 92 aa, Heterodera glycines; identical to SEQ ID NO: 131128
  misc_feature (45)..(45): Xaa can be any naturally occurring amino acid
  Coding regions on vcDNA: vcDNA=SeqID_71086; Strand=-; Position=1-1210
  Homolog annotation: Hit_ID=XP_523367.1; Match level="QueryCoverage =91%, HitCoverage=58%, E-value=2e-21, Identity=66%"; Hit description =PREDICTED: similar to rRNA intron-encoded homing endonuclease [Pan troglodytes]

SEQ ID NO: 144664 - protein, 339 aa, Heterodera glycines
  misc_feature (50)..(50): Xaa can be any naturally occurring amino acid
  misc_feature (202)..(202): Xaa can be any naturally occurring amino acid
  misc_feature (259)..(259): Xaa can be any naturally occurring amino acid
  misc_feature (272)..(272): Xaa can be any naturally occurring amino acid
  misc_feature (276)..(276): Xaa can be any naturally occurring amino acid
  Coding regions on vcDNA: vcDNA=SeqID_71087; Strand=+; Position=1 -272,304-346,404-707,886-1067,1106-1194
  Homolog annotation: Hit_ID=EAA17111.1; Match level="QueryCoverage =90%, HitCoverage=71%, E-value=1e-39, Identity=40%"; Hit description =hypothetical protein [Plasmodium yoelii yoelii]
PFRGRTSTLIFPVARVQPRTSKGITDLLLLNFVRLNTENPSKKLCPQKQXANYLVGRVSLVIGINQTNRHELRTAMHHHPPNHEKAINLFPVLSQIKPQAPFPVLSQIKPQAPLLNRKTFVSGKLPTRANKSNRKTFVSGKLPTRANKSRRIASWHRLRSELGRYLIAFEPLTFFLINEDILAKCFRCSPSCYGPRISPLTXQYEWPRLSLLTIISVSKTNNRTEILFYYSIFLTAAIILCILRAGITAAAGTRLALSXILVKGFKLYPFRXPASXEIGLVISRHYLLALRVAISQAPSPESNPYPPLPVISQAPSPESNPYPPLPVITMVVRYSTIES

SEQ ID NO: 144665 - protein, 143 aa, Heterodera glycines
  Coding regions on vcDNA: vcDNA=SeqID_71088; Strand=-; Position=1 -231,805-1005
MEILLEVILGSSDEEMTEVLEVYSEQYGGNLSEDIQKIGEKAQGKNSKGKNDTEEAKAVREILGDRLQNLKNRAAIKDTIKELGTICGHWKTLNNSSNERDEHLETDEDIENMYGLAKKILVNFEPDTADSAEVASVWSESVP

SEQ ID NO: 144666 - protein, 43 aa, Heterodera glycines
  Coding regions on vcDNA: vcDNA=SeqID_71089; Strand=+; Position=1 -42,368-457
MLKGCLYVILVLIANCYVQLKIQLDRFMGSGQTPKKQGVFILN

SEQ ID NO: 144667 - protein, 787 aa, Heterodera glycines
  misc_feature (91)..(91): Xaa can be any naturally occurring amino acid
  misc_feature (465)..(465): Xaa can be any naturally occurring amino acid
  misc_feature (618)..(618): Xaa can be any naturally occurring amino acid
  misc_feature (636)..(636): Xaa can be any naturally occurring amino acid
  Coding regions on vcDNA: vcDNA=SeqID_71090; Strand=+; Position=1 -164,391-590,690-782,847-930,978-1108,1164-1205,1260-1488,1549 -1667,1737-1949,1976-2076,2148-2345,2457-2584,2625-2769,2871 -2980,3544-3592
  Homolog annotation: Hit_ID=NP_503052.1; Match level="QueryCoverage =97%, HitCoverage=79%, E-value=1e-109, Identity=34%"; Hit description= cyclin M2 (89.5 kD) (4S142) [Caenorhabditis elegans] gb|AAK77203.1| Hypothetical protein C52D10.12 [Caen
SSGISVVEPNVPVRVVVFGLFLDRIALVAFTTDNCLNSGLFSKISVNELTTWFFFFSEFFLGLRGCIQKFGFYGVCRMLEMVSSSPPSISXIDEMRTWIRATSDPPVHYMPEEIQVVLFFTLFLLSALFSGLNLGLMALSPQELTLILNSGSERERKYAKVILPVRKGSERERKYAKVILPVRKAGNMLLCTILIMNVIVNSAISILMMNVIVNSAISILMEDLTSGIVAFVLASLGIVVFGEIVPQSVCIKKGLQVGAKTIWKGLQVGAKTIWLTRFFMLITLPLAWPIGKLLDCFFMLITLPLAWPIGKLLDCILGEDLVGMDHEKLLEMLRMAHQHNEELAEDLKIAVGAMEIAEKIVREVMTPIEDVFDVFMLSDEAVLDSDCVADVVRRGYSRIPVFTNNDRNQITGLLFIKDLALLKPNERLTVSTICDFYARTLRFVTDDTPLQTMLEEFKEVETLNXLKMELIFTIPRVNITWPLVGIITLEDIVEEILQSEIVDTIPRVNITWPLVGIITLEDIVEEILQSEIVDESDVVYDNKYRTKLQKGQKGKLRRITDSEDREGDKCKWLSESLAKVTAQWLSAMRPALFGDKAMDTKALHLLIRLNARKVGFSXIPLQVNTKVPFSKFHLIXRAGRPSDHFILLIEGNAVAHFPKNQMKFDVGAWECFGTEILDQMEDRPKNQMKFDVGAWECFGTEILDQMEDRWLTIIRWTKTSGKCTTKRQWPQMDFIFISDFDLLVRKDCRFIELTPSSYATASRLSTLLRAISLFILRVKHIRANVNR

SEQ ID NO: 144668 - protein, 159 aa, Heterodera glycines
  Coding regions on vcDNA: vcDNA=SeqID_71091; Strand=+; Position=1 -331,473-621
MQKLSCLGDFNTQQQNQQHNNASVSSLMYNSNYHQQQQHQNSSGASSGVCSPASPFPPAGRTPMQSQQQQLRMNPQQQSNGGNEFTPLVRMGSGNGAVGQHPYSFRQQHGAKTIAVTCLLSPWDEQQQHEQPCQFGDVLQPRLDHFRVARVAAVHSFRQ

SEQ ID NO: 144669 - protein, 335 aa, Heterodera glycines
  Coding regions on vcDNA: vcDNA=SeqID_71092; Strand=+; Position=1 -95,176-530,785-952,1000-1386
MTATNSSTARVAGASTSAPGGSSADTLASTIASVASGGGSFEFEKAIGTSPLPSSLPTAGDSSAALLTPTVGPAVGPSTSAQPQQLTSSPGVKRRKNQQITQTVTAIVNALEQPPIAVEQQQSLPAYGGGALSHPLQQQTSLGMQQHEQMTVPSQCRIHVQNPPQTHGDFPPTGTKIQVVHMQPPAAAISHHLQQQMSDNLSPQQQISVARPISTRLSTLQPDHNLNSSSSSALCDYHVANANNNDSINGVHQIGPPSIAELSSSAEMSHHSTPRVAAAPPYSPYHHQQQVAAAFVSPAPQNQHHFYGSTMPQQLSPSSAYKYNNQQQLQHHSYH

SEQ ID NO: 144670 - protein, 181 aa, Heterodera glycines
  Coding regions on vcDNA: vcDNA=SeqID_71093; Strand=+; Position=1 -187,279-637
MQPNFHFLIVLILFGVSICTASSYTWKSEPNLANNVQTFAKFMDDLYVEYKKTVKMGQFNAKYTILRNPSTILLTNYSDKQKRTVFNLTFVKCVAEIAYFRVINKNANSNFSYQKFKIVPGLDAKDEFVGFLHFDQTLGQQIAEKFKDEIFSEKKQIPEEVVNQILQLAFSFAARVILSIV

SEQ ID NO: 144671 - protein, 223 aa, Heterodera glycines
  Coding regions on vcDNA: vcDNA=SeqID_71094; Strand=-; Position=1 -285,327-494,606-824
MKLYSKRIGSKTVMTTDCSENPNYCYKWTSAGVKKDDGQRFVCAGCRKIKDRKDVPSDRKLPTRKVLENGSWASDGAKYPHFCEPIRKTEVLGVEERRKVQAELALGSRENIASAKVRIECIVEENYKLLPTQEKAEIRDSACGNAVATKKELQQEISKPLWLTYRGRIAHEESDHFQELFLLECTDVMALFSSPRQLALFKRTETIVCDGTFKMAPRGIYQV

SEQ ID NO: 144672 - protein, 150 aa, Heterodera glycines
  Coding regions on vcDNA: vcDNA=SeqID_71095; Strand=+; Position=1 -110,456-502,623-827,1519-1609
MNTKSQEKPPAEIYTFLHDHFVSLASKQQSSSTWIWSQLFLFGWFLSNAQFGVKKKREINCAFVNFGRVLAKRLKFVHEKFNTFADGKEKECGGRDPHTTNYYDYKHHHAFISDNNTPAEGQGLGFISFGPDQAVFAWAQFLNCNFFIVN

SEQ ID NO: 144673 - protein, 184 aa, Heterodera glycines
  Coding regions on vcDNA: vcDNA=SeqID_71096; Strand=+; Position=1 -70,128-611
MLMFEEPLWNYGQVIGIDANEAQDVVKFCEDLQQNVVSAALNSPIRKAMTVMKLTELEEFQYLNSIINSLRDEENMDELNIFAENYDKKLMIDKQQSLKELLAILMKIYADYSNASKREISKNAIRLTHSGNEILRFGQILYETLENLENLPEDRVKYDENEQLLTIPLLFVNHLLERLNEFIE

SEQ ID NO: 144674 - protein, 125 aa, Heterodera glycines
  Coding regions on vcDNA: vcDNA=SeqID_71097; Strand=-; Position=1-376
MIIRSPPLTRQRALNLRTFAQNQNAAVEEQQQQQQVEGVHGENEPLVNAPISPGLNRNLSLSAEENEHHFSEMEAAAANDDEIRRRLLHVSIQSNLPPRANGGGNNGAEQQQIRNANVGHEDFVE

SEQ ID NO: 144675 - protein, 74 aa, Heterodera glycines
  Coding regions on vcDNA: vcDNA=SeqID_71098; Strand=-; Position=1 -82,143-282
MAKLAEGLEIGEQFSREWGRTDYEGGKDEEDEEDDEADNTSTTDSMNTIVEFGICEPSENGQNQWQSETMEKRK

SEQ ID NO: 144676 - protein, 139 aa, Heterodera glycines
  Coding regions on vcDNA: vcDNA=SeqID_71099; Strand=+; Position=1 -46,94-354,405-517
MNKGKSIVMADSKKEGTTTVKIPHRYGAVSGMSGQNASPKASQIGSPKNSPKGTQIGSPRSISSPKSTQIGSPKGIQIGSPRKEKTKLSSAVGSSDFNVIDESKEAKKPSQFKPSPSRSQNKREQQRLNVTIGEAGRGN

SEQ ID NO: 144677 - protein, 126 aa, Heterodera glycines
  Coding regions on vcDNA: vcDNA=SeqID_71100; Strand=+; Position=1 -120,218-478
  Homolog annotation: Hit_ID=NP_494707.1; Match level="QueryCoverage =54%, HitCoverage=10%, E-value=3e-21, Identity=66%"; Hit description =guanine exchange factor (73.6 kD) (2E305) [Caenorhabditis elegans] gb|AAC26284.1| Hypothetical protein K0
MPSAFERMPRKRKECQGKGKSAKGEERVECLRERYQMGKKCANTEDKIYSEWDCPQALAVHNYAIQQEDELSLSKGDVVNILRKMTDGWFYGERTRDAQMGWFPSSYVQQVALFNSNPLKFIVFLI

SEQ ID NO: 144678 - protein, 165 aa, Heterodera glycines
  Coding regions on vcDNA: vcDNA=SeqID_71101; Strand=-; Position=1 -128,323-551,828-965
  Homolog annotation: Hit_ID=CAE69764.1; Match level="QueryCoverage =96%, HitCoverage=6%, E-value=2e-18, Identity=33%"; Hit description =Hypothetical protein CBG16045 [Caenorhabditis briggsae]
MAERHTAHAYKAANLSCSVESRVPFTVFWLFEGKTIGGPLFYEWSVPRAITRLLPFWILEVIDFADCLTPVIKLRSEPPPHIVAIRNESVAIHGTAFLHCRTQSIEQAKITWLHNQSKAYTFGNNGTLRIFDTSIDDSGEYKSQARTSGGLSEAVGKLNVLQAPR

SEQ ID NO: 144679 - protein, 255 aa, Heterodera glycines
  Coding regions on vcDNA: vcDNA=SeqID_71102; Strand=+; Position=1 -673,1257-1348
  Homolog annotation: Hit_ID=CAE70735.1; Match level="QueryCoverage =76%, HitCoverage=59%, E-value=7e-15, Identity=29%"; Hit description =Hypothetical protein CBG17479 [Caenorhabditis briggsae]
HVTTTPYHQQSNGMAEGAMRIMANIISQMVNEKGNNWDEILPHAIFSYNISIHSATKFSPFFIINLRQPKLPTDRLLKLPSPDELVSDISVYTRIQTEKAAKAWEIVRNEILKAQERNKEENDQIRKAHEREFEIGDLVLVKKEVLGHKFDQRWLGPMRCVGVEKEKKNVVLQSIDGSAKLRKVHQEKVKHFNGPAILPLRQSDEPLNWEKYVDDPNLEQEEIEEKENLEIGYGPNFVTLRDSEGMISDQDDLEE

SEQ ID NO: 144680 - protein, 162 aa, Heterodera glycines
  Coding regions on vcDNA: vcDNA=SeqID_71103; Strand=+; Position=1 -132,190-546
MPKEGQSARKRLREGSPNKGELFTNNRWDEKMREIEEVNKNSKEDEAQVATKELQKVLRKMEGKEKSGNELEDEVGLPGNLREARCFKCGRSGHFARECRDGGDGNRGSRVWRNWGDARGRTGRGTWRNSDQNQADEGPSTSTSSAHLTDFGTFFNYIGGNQ

SEQ ID NO: 144681 - protein, 92 aa, Heterodera glycines; identical to SEQ ID NO: 124679
  Coding regions on vcDNA: vcDNA=SeqID_71104; Strand=-; Position=1-699

SEQ ID NO: 144682 - protein, 75 aa, Heterodera glycines
  Coding regions on vcDNA: vcDNA=SeqID_71105; Strand=+; Position=1-226
MVIRRGTMVIRRGTMVIRRGTMVIRRGTMVIRRGTTVIRRGTTVIRRGTMVIRRGTMVIRRGTMVIRRGTMVIRR

SEQ ID NO: 144683 - protein, 202 aa, Heterodera glycines
  misc_feature (200)..(200): Xaa can be any naturally occurring amino acid
  Coding regions on vcDNA: vcDNA=SeqID_71106; Strand=-; Position=1 -115,187-305,373-538,601-788
  Homolog annotation: Hit_ID=NP_497046.1; Match level="QueryCoverage =89%, HitCoverage=6%, E-value=2e-47, Identity=56%"; Hit description =basement membrane proteoglycan (2O938) [Caenorhabditis elegans] emb|CAB07706.1| Hypothetical protein ZC101
SAMALLPMALFLILSSQNANSVDHQRSHRMGRQRSFNEDTPTPSSDLQINVHPPELSVREGREASFECRARTTDNSFYPEVVRWTRVGGRLPDGVREGGGRLTIPQAQLQHAGQYACVAMHNGRTVEAHATLHVQSYGPQEGPQELQGDTKVAAGCMADERACGSNECVKLDYVCDGEPDCRDRSDELEGKGKGAKQKQXSE

SEQ ID NO: 144684 - protein, 150 aa, Heterodera glycines
  Coding regions on vcDNA: vcDNA=SeqID_71107; Strand=-; Position=1 -201,252-503
  Homolog annotation: Hit_ID=AAH84430.1; Match level="QueryCoverage =62%, HitCoverage=20%, E-value=3e-11, Identity=32%"; Hit description =Unknown (protein for MGC:86446) [Xenopus laevis]
MALRKFLNQKKNQQVCFNDEVERHEFEQELSLDIIGEFIKVPFKDPRKGYSLSIRSASFLGVYDLVERIIAEDANCVNVPNKHGWTALMYAAQGGNVDICQLLLQHGARLDVKNGQGQDAYELAKNWGHKRVMDLIKAKTYLRQSNNGKK

SEQ ID NO: 144685 - protein, 56 aa, Heterodera glycines
  Coding regions on vcDNA: vcDNA=SeqID_71108; Strand=+; Position=1-170
  Homolog annotation: Hit_ID=AAQ94601.1; Match level="QueryCoverage =100%, HitCoverage=10%, E-value=2e-10, Identity=53%"; Hit description= flavin containing monooxygenase 1 [Danio rerio]
LQYVDYMDELAKLVGCKPKLVGRIFTDPCLAKVLLFNGLVPYQFRLDGPHRWEGAR

SEQ ID NO: 144686 - protein, 34 aa, Heterodera glycines
  Coding regions on vcDNA: vcDNA=SeqID_71109; Strand=-; Position=1 -21,418-501
MGRGGKSVNGKLTKHGHRRINKLIERKKQWTQNS

SEQ ID NO: 144687 - protein, 89 aa, Heterodera glycines
  Coding regions on vcDNA: vcDNA=SeqID_71110; Strand=-; Position=1 -198,245-314
  Homolog annotation: Hit_ID=CAE62091.1; Match level="QueryCoverage =89%, HitCoverage=18%, E-value=2e-12, Identity=50%"; Hit description =Hypothetical protein CBG06117 [Caenorhabditis briggsae]
MTEGKAYYRDDEGDYDYGLKDDESDSECSIGYRPTIVSSNNPISLLNLRLKVIMGLKRSGKTSIRKVVFQKMSPNETLFVESTARVTNE

SEQ ID NO: 144688 - protein, 76 aa, Heterodera glycines
  Coding regions on vcDNA: vcDNA=SeqID_71111; Strand=-; Position=1 -135,473-568
IADLGNSFRETRKFKNAIDELPIKSAQGNASKGESFSGQSNEDKVKIKITNSVGNKDVQLGRSRSTSIIGRFAKEN

SEQ ID NO: 144689 - protein, 46 aa, Heterodera glycines
  Coding regions on vcDNA: vcDNA=SeqID_71112; Strand=+; Position=1 -51,207-296
MDKWGRINFYVFVVTLVFYKILWLRPLASQAHKFFVFFKYAQQFQN

SEQ ID NO: 144690 - protein, 47 aa, Heterodera glycines
  Coding regions on vcDNA: vcDNA=SeqID_71113; Strand=-; Position=1-142
FLNNEVPFPVNIRLLMTLFILISVQREFCHVTLSYAKFSNSVDKDGN

SEQ ID NO: 144691 - protein, 77 aa, Heterodera glycines
  Coding regions on vcDNA: vcDNA=SeqID_71114; Strand=-; Position=1 -151,252-334
MPPQYKWMEFNASLAHPSDPVVFLVIFSFFLSLLFFIIMFKDIESDSASCGRIIIDLMVAAVPQTTENFKQLCAGAL

SEQ ID NO: 144692 - protein, 39 aa, Heterodera glycines
  Coding regions on vcDNA: vcDNA=SeqID_71115; Strand=+; Position=1-119
VRLGYSNNYGEQKSNAELKSDYREAISEGFGLPINLGAS

SEQ ID NO: 144693 - protein, 87 aa, Heterodera glycines
  Coding regions on vcDNA: vcDNA=SeqID_71116; Strand=-; Position=1-678
IIFIQKIFFWVFGAVPPNRCAQIYGETESFRNSFTIACTLILRWIFAPHNCLSTPNGHLKKSIYFCFRGSPPEPMRPDLWGDRILRE

SEQ ID NO: 144694 - protein, 156 aa, Heterodera glycines
  Coding regions on vcDNA: vcDNA=SeqID_71117; Strand=+; Position=1 -297,1018-1191
MAFPCHGRISDQREGTFSMDIEKLSEFAREEVNSRRLSKHFYTKGLPWKIWAQIRTKKNSTEKYLGVFLWCIAQIIGGTNQFKFEIFYFMIKMKIGVANQTIDNSTVGQDKEHWSQIFSSSAGFSLFYFIFHLHYPSTGWGFENFISFAVNANSNK

SEQ ID NO: 144695 - protein, 115 aa, Heterodera glycines
  Coding regions on vcDNA: vcDNA=SeqID_71118; Strand=+; Position=1 -273,1203-1277
MATAKLKYWVLQNEAQMEPYCERSVAAQQKLGYSTKDSEEMVAIPMAFRANLKMAAIQMAFRANLKMAAIQMAFRANLMGVHRIGRDLALAPPLTPRFAFVRRRSLFVFAYLQIE

SEQ ID NO: 144696 - protein, 102 aa, Heterodera glycines
  Coding regions on vcDNA: vcDNA=SeqID_71119; Strand=-; Position=1 -125,571-754
MKPKKSWTYAAVAHTGAGQIRAIVDSAVARVTTNSSVAMLAINNMTGSAKFGRRFNAHKKKCAALIKRQQSAPSTELKSELRQAFMDDIMEGSFLMDYIRDH

SEQ ID NO: 144697 - protein, 121 aa, Heterodera glycines
  Coding regions on vcDNA: vcDNA=SeqID_71120; Strand=-; Position=1 -160,238-440,522-524
  Homolog annotation: Hit_ID=NP_500063.1; Match level="QueryCoverage =99%, HitCoverage=13%, E-value=7e-51, Identity=74%"; Hit description =RNA helicase (109.9 kD) (4C62) [Caenorhabditis elegans] gb|AAK68386.1| Hypothetical protein F53H1.1a [Cae
MSPTRELALQTWKEANKFARNLGLHVVCVYGGVGISEQIAELKKGAEVIVCTPGKVTNLRRVTYLVMDEADRMFDMGFEPQVMKIVNNIRPDRQTVLFSATFPKQMEALARKVLERPVEIQ

SEQ ID NO: 144698 - protein, 52 aa, Heterodera glycines
  Coding regions on vcDNA: vcDNA=SeqID_71121; Strand=+; Position=1 -42,617-733
MCVGCYLAISTMEKSSQFHLNAPARLHFDFSITVHICSKILNFIVYNPADPV

SEQ ID NO: 144699 - protein, 86 aa, Heterodera glycines
  Coding regions on vcDNA: vcDNA=SeqID_71122; Strand=-; Position=1-622
KNRFIFVFGALQPNRCAQIYGETESFRNSFPIACTLILRWIFAPHKCLSTPNGHLKKSIFLFSGQSPRTDAPRFMGRPNPSGIASL

SEQ ID NO: 144700 - protein, 85 aa, Heterodera glycines
  Coding regions on vcDNA: vcDNA=SeqID_71123; Strand=-; Position=1 -34,566-681,745-851
  Homolog annotation: Hit_ID=NP_509294.1; Match level="QueryCoverage =85%, HitCoverage=17%, E-value=6e-16, Identity=56%"; Hit description =DeHydrogenase, Short chain (48.0 kD) (dhs-29) [Caenorhabditis elegans] gb|AAK68350.1| Dehydrogenases, sho
MCCDHRRSIWACNVDIVIANAAILFFELTQNLKDDQIRKALDVNVLGTINTIRSFLPAMEAAGHGHKVAISSIASYFGETMGMAY

SEQ ID NO: 144701 - protein, 51 aa, Heterodera glycines
  Coding regions on vcDNA: vcDNA=SeqID_71124; Strand=-; Position=1 -67,149-237
MHHHPPNHEKAINLSILTVSGPALHHTSPGTGRLSFPGSSPPGRINPPADR

SEQ ID NO: 144702 - protein, 148 aa, Heterodera glycines; identical to SEQ ID NO: 141051
  misc_feature (137)..(137): Xaa can be any naturally occurring amino acid
  Coding regions on vcDNA: vcDNA=SeqID_71125; Strand=+; Position=1-450
  Homolog annotation: Hit_ID=AAP92584.1; Match level="QueryCoverage =81%, HitCoverage=24%, E-value=5e-34, Identity=63%"; Hit description =Ab2-057 [Rattus norvegicus] gb|AAP85373.1| Aa1262 [Rattus norvegicus] gb|AAP85367.1| Aa1011 [Rattus norveg

SEQ ID NO: 144703 - protein, 240 aa, Heterodera glycines
  Coding regions on vcDNA: vcDNA=SeqID_71126; Strand=+; Position=1 -62,174-831
MSAKIIRVPKIACDLSLAKMVVPKIACDLSLEKNGLSKNRNYAQKASQTILTLPILPSTIAFIHPIMSAKIIRVPKIACDLSLAKNGLSKNRNYAQKASQTILTHPIPSTIAFIHPIMSAKIIRVPKIACDLSLAKNGLSKNRNYAQKASQTILAHPIPSTIAFIHPIMNAKIIRVPKIACDLSLAKNGVSKNRNYAQKASQTILTLPIPSTIAFIHPIMNAKIIRVPKIACDLSLAKNG

SEQ ID NO: 144704 - protein, 51 aa, Heterodera glycines
  Coding regions on vcDNA: vcDNA=SeqID_71127; Strand=-; Position=1 -21,78-212
MPKKAFKGFPGSLITNPASISTYIEPGLEIEQKVENSKNFRIHFYVRICAE

SEQ ID NO: 144705 - protein, 86 aa, Heterodera glycines
  Coding regions on vcDNA: vcDNA=SeqID_71128; Strand=-; Position=1-262
  Homolog annotation: Hit_ID=CAE65078.1; Match level="QueryCoverage =76%, HitCoverage=7%, E-value=3e-14, Identity=57%"; Hit description =Hypothetical protein CBG09936 [Caenorhabditis briggsae]
CLSSLNLPAALDDVTKQEQCPESIREKSAKVKNNGGISAMSAKINELPSLYKRNDEILNEVEAVLKQMPSPHSLSDFTTYQRGKGK

SEQ ID NO: 144706 - protein, 100 aa, Heterodera glycines
  Coding regions on vcDNA: vcDNA=SeqID_71129; Strand=-; Position=1 -34,407-675
MKKSYIQKIDKMLRSADGTNAMKGLCKLFDQQTIVELFRLLHIDPNLLGCPLPPQMRIVLIEAKSEEKNGSSSSNSETEKENGKAKNGTFDEMAQKMVDN

SEQ ID NO: 144707 - protein, 131 aa, Heterodera glycines
  Coding regions on vcDNA: vcDNA=SeqID_71130; Strand=-; Position=1-396
MPTPTHQHVALGGWKRERVRLRSQQNLNRLFVRPALSKEQLKEEYEARLRKRQQNPAPPAPPTQLPKTTNDQTPIVAPNQKEASEDMSKPPEVFDQTIIVCYEALKSLPPTDKISHQIQSLKEQYPHLFNK

SEQ ID NO: 144708 - protein, 99 aa, Heterodera glycines
  Coding regions on vcDNA: vcDNA=SeqID_71131; Strand=-; Position=1-297
MPTPTHQHVALGGWKRERVRLRSQQNLNRLFVRPALSKEQLKEEYEARLRKRQQNPAPPAPPTQLPKTTNDQTPIVAPNQKEASEDMSKPPEVFDQTII

SEQ ID NO: 144709 - protein, 98 aa, Heterodera glycines
  Coding regions on vcDNA: vcDNA=SeqID_71132; Strand=-; Position=1 -232,647-710
MEENIEKFITKRLLEDIEKMKENAREMMENSETLKETCEKLKENGERLEEPKNWRNGERLDENGERLDEKGERLDEKAQIRRRNDETGQLTAGESPNL

SEQ ID NO: 144710 - protein, 122 aa, Heterodera glycines
  Coding regions on vcDNA: vcDNA=SeqID_71133; Strand=-; Position=1-366
MEHYQQKRPSNSPFVDILPKKPRQDLVINQILGVVQQGGGDTSPSKEAPKDYVQKLGSSVEHVAQFHYTKMKSRFSISDVPFYPERLLAGIIPHCIDSATKASRGRGNRATPPWMFDNQSSL

SEQ ID NO: 144711 - protein, 114 aa, Heterodera glycines
  Coding regions on vcDNA: vcDNA=SeqID_71134; Strand=+; Position=1-343
MERPLPLPQLIDHGGALFHTSAIDKSIIGEKKTQRIYPILDDLFYTNTNEMDNEKSNSALAQTMSCSSTTASDSHSSENSTSFIASSIGLEIAPSPSNPFSSYCEPFDGYLKFD

SEQ ID NO: 144712 - protein, 386 aa, Heterodera glycines
  Coding regions on vcDNA: vcDNA=SeqID_71135; Strand=+; Position=1 -74,158-628,952-1159,1201-1606
MLSTRNGSSVQCGPSTKKWDFRSIGNNFTEEMENYKLLDYQTTTCQKFGFTKNITEFRVNPDGGRPDEAMREAIDDMIKVAFKTTEEKMKRKVRMFGVAITGAGLAFPVWVPYRAYPQNNADVIMQEINKLGQSGDGDENKKMLLLSEPVTMKITCVTMPSGEGPRNVHKFDFGLKEHQRIGIVNTDKFCLFYALASSMNYLIMDKYSFIRFMKNLARQKEAAVELLRNCGIDINEYSYGVEQLPNVQKYWDEIYPGKYRVVAFEKSADPRKSIRVLWKGPMGRENVVPIFLENGHWDGLKNYVCFFNRGRKFCVECECFYDQDVYHTMDCRARCYYCNRVGGMPCQKESGVKIECPKCHRYFYNWECYNYHQGHQTCKLWRRCVI

SEQ ID NO: 144713 - protein, 19 aa, Heterodera glycines
  Coding regions on vcDNA: vcDNA=SeqID_71136; Strand=-; Position=1-72
NRTLTDDLMGKNPRRREFN

SEQ ID NO: 144714 - protein, 93 aa, Heterodera glycines
  Coding regions on vcDNA: vcDNA=SeqID_71137; Strand=-; Position=1 -94,146-174,232-351,597-635
  Homolog annotation: Hit_ID=NP_498117.2; Match level="QueryCoverage =78%, HitCoverage=8%, E-value=7e-27, Identity=79%"; Hit description =gro-1 OPeron gene GOP-1, GOP-1 (gop-1) [Caenorhabditis elegans] gb|AAL14108.1| GOP-1 [Caenorhabditis elega
MRQSSATPYINVQLLQTLNILFENIRNETSLYFLLSNNTVNLIITHTFDFANEEIIAYFISFLKTLSFKLNPKTVNFFFNESKNGLNDLLLKH

SEQ ID NO: 144715 - protein, 46 aa, Heterodera glycines
  Coding regions on vcDNA: vcDNA=SeqID_71138; Strand=-; Position=1-150
QESPKNDQNEAMSNKLEDINSLMTRLTLHNRSLAKLFALNQTGSLF

SEQ ID NO: 144716 - protein, 101 aa, Heterodera glycines
  Coding regions on vcDNA: vcDNA=SeqID_71139; Strand=-; Position=1 -107,160-358
  Homolog annotation: Hit_ID=CAE70177.1; Match level="QueryCoverage =89%, HitCoverage=23%, E-value=4e-10, Identity=34%"; Hit description =Hypothetical protein CBG16650 [Caenorhabditis briggsae]
MGAVVCLASFLALFSVFPQNLFGYSCKSLSGKEVDWFVAYKLPDLGSDGDGTAFLYSDANTAAWRLSDKNVEDKSSAIGLTVSQLFTAKKKKASRTVSTAF

SEQ ID NO: 144717 - protein, 117 aa, Heterodera glycines
  Coding regions on vcDNA: vcDNA=SeqID_71140; Strand=+; Position=1-354
MPNYHSNILTVRRSRNEALPPLPSYEDATKLPALIPAAQENTDEQRHGIEERAGRETEEQRQRNGERAGRETGEQRQRNEERAGREAEEQTGGEDEAVTEAAAGQAEEGAIGRPIPR

SEQ ID NO: 144718 - protein, 73 aa, Heterodera glycines
  Coding regions on vcDNA: vcDNA=SeqID_71141; Strand=+; Position=1 -91,437-567
MSLIVLQQQQRKKSLCVVPRGAGGGDYTTSIAKAAVLSSPMFQQTKQQQQAGASGANATAQQQQQQLRPSTKS

SEQ ID NO: 144719 - protein, 53 aa, Heterodera glycines
  Coding regions on vcDNA: vcDNA=SeqID_71142; Strand=-; Position=1 -135,244-270
MYKQLVNVEQQGDPMEKEQKKVELAPTVAEIGILMLKKQNRKIKMRDTFNYAD

SEQ ID NO: 144720 - protein, 604 aa, Heterodera glycines
  misc_feature (45)..(45): Xaa can be any naturally occurring amino acid
  misc_feature (595)..(595): Xaa can be any naturally occurring amino acid
  Coding regions on vcDNA: vcDNA=SeqID_71143; Strand=+; Position=1 -163,604-803,1109-1285,1672-1742,1831-1946,2117-2226,2377-2428,2495 -2637,2681-2783,2841-2961,3019-3168,3636-3804,3893-3994
  Homolog annotation: Hit_ID=CAE61593.1; Match level="QueryCoverage =93%, HitCoverage=33%, E-value=1e-163, Identity=53%"; Hit description= Hypothetical protein CBG05508 [Caenorhabditis briggsae]
VSIGRLLANFSIFNVSRLPTFWPPRHLEAPRNCRKQVSFLAQRKXIWYKKRIRHTILDRPLADRVLKMVCLLSLISVCMHTPRTLQLIPHFTWVLLVLDANVVAIFTWEVVLKANNMGYFRHQNAYFRDRWCQFDFFLLLFHWISLLLHIYQLFVHSELFAQFGLVYYDWLGVIRCVRPLVIIRLIRLMLTFQVPRQRIQQLLKRSSTQVQNVTVFFLFFMALYAIMGIQLFGRMDYHCVMPGTDPKNVTINDLAIPDTMCSKEGQGGYECPDNMECMKLVLSAKSEGFYGMFDHFGASVFTVYLAASEEGWVYASVFTVYLAASEEGWVYVMYDCLDSLPSHLAFFYFVTLIFFLAWLVKNVFIAVITETFAEIRNVFIAVITETFAEIRVQFSESWKKEEMTTIEDDFKKKIESTDDGWRLIRLDTEDKLNPRIKQFQTVKWFSFKIFCLSSLSSIFQILRSTGFQCAIISLVLANAAINASFVYRHDETDAKRRNLYYLIECVFTVLFDVECLVKLFCYGRQFFKRNIFKFELILAIGGTFNIQRHLYNQNYFTYFQVFRLFRLIKASFRLFRLIKASPMLEDFVYKVKYKXIKLNIIYFI

SEQ ID NO: 144721 - protein, 51 aa, Heterodera glycines
  Coding regions on vcDNA: vcDNA=SeqID_71144; Strand=-; Position=1 -52,667-770
MYFIFVMFFTLSRLFWPAKKYCIDGLVNECLQIPIPQLSNAFLASTQCPTV

SEQ ID NO: 144722 - protein, 125 aa, Heterodera glycines
  Coding regions on vcDNA: vcDNA=SeqID_71145; Strand=+; Position=1 -46,329-489,528-698
MPCGENNISHFTPYHVKKLFEFLQFCFHNFRKLFGIIMPKQNEIVLKYSFLDLTWFLDIEAVFYAISKTKKCLVVKTIFHISLHNIVSSARIETGIRPLERAARALQERMERKNSYFWDFFRNQN

SEQ ID NO: 144723 - protein, 63 aa, Heterodera glycines
  Coding regions on vcDNA: vcDNA=SeqID_71146; Strand=+; Position=1 -84,672-779
MDAEKQQINAGETDFGKMAYSEGNRRTKEKHAFIELSSLVPLPPPIRDQLDKTATLRSTIAFL

SEQ ID NO: 144724 - protein, 314 aa, Heterodera glycines
  Coding regions on vcDNA: vcDNA=SeqID_71147; Strand=-; Position=1 -826,875-990
  Homolog annotation: Hit_ID=AAK21961.1; Match level="QueryCoverage =41%, HitCoverage=61%, E-value=3e-57, Identity=76%"; Hit description =secreted venom allergen-like protein vap2 [Heterodera glycines]
MKLFSMFLLLTLAFAAFAERSSSSSSSSESSESSEECSSEEGNPGTEPETTTVVDSDENCNATSDSPNDESSPVPSSDSPNDESSSVPSSDSPNDESSPVPSSDSPNDESSPVPSSDSPNDESSSVPSSDSPNDESSSVPSSDSPNDESSPVPSSDSPNDESSSVPSSDSPNDESSPVPSTADPSSPQYTLPVTEEDKNAAVQCHNKFRSELALGNSFNKTGGNKMPSASNMHKMEWDDNLAKFAAEWANKCSISHSWNGWAGENLAMNGGTFTNKDAFEYACGRWWGELAALGFPKDLILTGENFGGIGHWTQ

SEQ ID NO: 144725 - protein, 160 aa, Heterodera glycines
  Coding regions on vcDNA: vcDNA=SeqID_71148; Strand=+; Position=1-483
MAQAMTHHLDCRRMAQTMTRHLDCLTMAQTMNHHLDCPTMAQAMTHHLDCPTMAQEMTRHLDCPTMAQMAQEMTRHLDCPTMAQEMTHHLDYLMSRCNFRPNQQQLSSPVLYRDCLLLKNIPPMIRTIRCCYCCCSQQKRRMPKSGEETLRIVSFLIIIN

SEQ ID NO: 144726 - protein, 152 aa, Heterodera glycines
  Coding regions on vcDNA: vcDNA=SeqID_71149; Strand=-; Position=1-456
  Homolog annotation: Hit_ID=CAG59394.1; Match level="QueryCoverage =89%, HitCoverage=63%, E-value=8e-16, Identity=40%"; Hit description =unnamed protein product [Candida glabrata CBS138] ref|XP_446467.1| unnamed protein product [Candida glabra
MKLFSMFLLLTLAFAAFAESSSSSSSESSESSEECSSEEGNPGTEPETTTVVDSDENCNATSDSPNDESSPVPSSDSPNDESSPVPSVPSSDSPNDESSPVPSSDSPNDESSPVPSSDSPNDDSSSVPSSNSPNDESSSVPSSDSPNDESSP

SEQ ID NO: 144727 - protein, 124 aa, Heterodera glycines
  Coding regions on vcDNA: vcDNA=SeqID_71150; Strand=-; Position=1-373
IHPIMNAKIIRVPKIACDLRLEKNGVSKNRNYAQKASQPILAHPIPSTIAFIHPIMSAKIIRVPKIACDLSLEKNGLSKNRNYAQKASQTILALPIPSTIAFIHPIMSAKIIRVPKIACDLSLE

SEQ ID NO: 144728 - protein, 146 aa, Heterodera glycines
  Coding regions on vcDNA: vcDNA=SeqID_71151; Strand=-; Position=1-439
NGLSKNRNYAQKASQSILALPIPSTIAFIHPIMSAKIIRVPKIACDLSLAKNGVSKNRNYAQKASQTILTLPIPSTIAFIHPIMSAKIIRVPKIACDLSLAKNGVSKNRNYAQKAPQTILALPIPSTIAFIHPIMNAKIIRVPKIA

SEQ ID NO: 144729 - protein, 92 aa, Heterodera glycines; identical to SEQ ID NO: 124679
  Coding regions on vcDNA: vcDNA=SeqID_71152; Strand=-; Position=1-659

SEQ ID NO: 144730 - protein, 55 aa, Heterodera glycines
  Coding regions on vcDNA: vcDNA=SeqID_71153; Strand=+; Position=1-166
MTLMPTAETTTANLGTPTEQNQPQEQQQKAGTAAGTTTTAAATDAASAAVVMEEQ

SEQ ID NO: 144731 - protein, 101 aa, Heterodera glycines
  Coding regions on vcDNA: vcDNA=SeqID_71154; Strand=+; Position=1-308
VQQQNPQQKDTPAALSVRSQLPIKPGPKPKKPQMEKKQRKEKPPPPPPKQKDLKITCSPCGEIGHMKTNRHCPLYGKEEDLASKTVGEICQAIILLVDINV

SEQ ID NO: 144732 - protein, 157 aa, Heterodera glycines
  Coding regions on vcDNA: vcDNA=SeqID_71155; Strand=+; Position=1 -301,425-595
MNFFFCIYNLVNYWYFKLYYIPCANGQTNAQPKKPFAVVSVCRHRSHKWPPPPQQKTANKGRPRKDAATDAPNIGRPNGRQQSDKTDEKAMDNERMPKAEACSQNLQPIDRLGMGGHQQVSRTKFHKIGIAFVISMEFLRIGNLKMNAVHVYGESKE

SEQ ID NO: 144733 - protein, 102 aa, Heterodera glycines
  Coding regions on vcDNA: vcDNA=SeqID_71156; Strand=+; Position=1-309
  Homolog annotation: Hit_ID=XP_531376.1; Match level="QueryCoverage =53%, HitCoverage=13%, E-value=5e-09, Identity=45%"; Hit description =PREDICTED: hypothetical protein XP_531376 [Pan troglodytes]
MSDKSLYLNAQFNVDSNVALPVADNTNPAGPANPNPAGPANPNPAGPANPNPAGPANPNPAGPANPNPAGPANPNPAGALNLNGAAFDDTLSLYGEERLDRH

SEQ ID NO: 144734 - protein, 31 aa, Heterodera glycines
  Coding regions on vcDNA: vcDNA=SeqID_71157; Strand=+; Position=1-93
MDVWADIAKADFMDERFSRVITANKAYNLFQ

SEQ ID NO: 144735 - protein, 31 aa, Heterodera glycines
  Coding regions on vcDNA: vcDNA=SeqID_71158; Strand=+; Position=1-93
MASDGQNDNGCKMIQADQQNNNKITVTQNVM

SEQ ID NO: 144736 - protein, 155 aa, Heterodera glycines
  Coding regions on vcDNA: vcDNA=SeqID_71159; Strand=-; Position=1-468
MSKKNFQETSKEIRRSKNTKNYFKNSSNLGKCFEEVESHTNENKKFGIKEHVTTFYFKCPENEDPEQMFKKILKKLMTDAMNREAEPGWKIEKISVDLYCSALSDPVIIPARPFQHSNPDIVFNEFMHRQQSFGEVNLLDQRISIIIATYSFPVK

SEQ ID NO: 144737 - protein, 662 aa, Heterodera glycines
  misc_feature (252)..(252): Xaa can be any naturally occurring amino acid
  misc_feature (279)..(279): Xaa can be any naturally occurring amino acid
  misc_feature (655)..(655): Xaa can be any naturally occurring amino acid
  Coding regions on vcDNA: vcDNA=SeqID_71160; Strand=-; Position=1 -20,4189-4249,4597-4839,4882-5249,5281-5441,5486-5687,5727-5908,6002 -6280,6324-6390,6473-6635
  Homolog annotation: Hit_ID=NP_507780.1; Match level="QueryCoverage =99%, HitCoverage=39%, E-value=3e-82, Identity=31%"; Hit description =predicted CDS, DNA polymerase type B, organellar and viral family member (5T899) [Caenorhabditis elegans]
PNSPPPKFSTQDGNVSSKKFKCGRRKLYFRDFWMLSQNKLADLPKTLGLKTAAKLYFPHKYNKNENFGKRLPNLPSLGDYCPDNMKEEEAVKLEAWHNENFQTEFELGEQLKTYCENDVEILMESILKTEFELGEQLKTYCENDVEILMESILKFRQLFLGITGDLDVMKDSVTIAGVVIKIFRAKFLKDRHIPIMPEGGYEKAENQSKIAVKYFEWLAQKGVKVRHACNGGEVEFGAEGGLCDWGREKNNXVSVLKGCAFHGCPRCFLPSPNGRTMNXVSVLKGCAFHGCPRCFLPSPNGRTMEENQSRTEIRMEILREKCKNFSIGEVWVCDVREELKKNKEMCDVREELKKNKEMKKFFESVPDKGPINPRDAYAGGRTMPFCLYAKATEEIEISMFDIISLYPFVNYGNTPYPVGVPKIVVTPYPVGVPKIVVSRNFNVNWTAPDDVPYDGLLKVKVIPPKNLLYPLLPVHIDEMLLFPNCTTFTSIELRKALELGYRIVGFYRAYHFEQDSQLFKGYVRMFLKIKVEASGWPAEVKSEDEKRAFIEMYKAKYDIGLDYDKIGFNPGLRMIAKLGLNSLWGKFSMGLNSLWGKFSMRNTLSSTEIVGKCTGKRRSSSGSIKCRNIVLSLWTTSAARLLYEYMAVYRKGGVXLLYCDTG

SEQ ID NO: 144738 - protein, 232 aa, Heterodera glycines
  Coding regions on vcDNA: vcDNA=SeqID_71161; Strand=+; Position=1 -99,458-659,1195-1324,2216-2282,5728-5760,5812-5976
MTERTWPTSTNNNVEKQMTKSRNCRRSSMRPSIREGRNETESVSRIAFKGAGGERAEAERPTYFHIFRGEVQLATETVARADYEPKGRGDRFPDKKHVEAELLRRDGTIRAEGTVNRSDYANDGKRGEGHEISWVNGREASAPLKLRQWPLLAKHMETPMYNKHKDENEVGKAVVTVGKEVVKVADKIIDHIPLLAQARAIARVAANRILGNKEKWECGPDHEIKVVDELLH

SEQ ID NO: 144739 - protein, 28 aa, Heterodera glycines
  Coding regions on vcDNA: vcDNA=SeqID_71162; Strand=-; Position=1 -66,719-739
MTPFFPAAGLQGNQILRIKLKTLSVKLF

SEQ ID NO: 144740 - protein, 64 aa, Heterodera glycines
  Coding regions on vcDNA: vcDNA=SeqID_71163; Strand=+; Position=1 -104,510-600
MPTKDGTEFEFFNVRKGIICPLKNLRFFFAIAILGMFVSCDQSVSQLGTTQPTEDKLSLMGQFG

SEQ ID NO: 144741 - protein, 141 aa, Heterodera glycines
  Coding regions on vcDNA: vcDNA=SeqID_71164; Strand=-; Position=1 -107,364-451,766-1008
  Homolog annotation: Hit_ID=YP_062940.1; Match level="QueryCoverage =64%, HitCoverage=26%, E-value=3e-18, Identity=51%"; Hit description =pantoate--beta-alanine ligase [Leifsonia xyli subsp. xyli str. CTCB07] gb|AAT89835.1| pantoate--beta-alan
MSTSSKLTVINTIATMRQFVREHRKQNANLCVALVPTMGALHQGHLRLAHQARQWNNDKKEQNGTTDQCASPPLVIVSIFVNPLQFGANEDYERYPRTLEADLAKLEGVVDCAFVPNAVEMFGEEKQPLNHKDEEDGIGIK

SEQ ID NO: 144742 - protein, 89 aa, Heterodera glycines
  Coding regions on vcDNA: vcDNA=SeqID_71165; Strand=+; Position=1 -60,111-320
MMFFLSAFAIILQCQIAVGQLVAPLLLHAQTGPDFIVHPHVEPEHLDDDDIDDAPVPHSARLGLLEHFLGGQRTLELIEQEHQFHEREK

SEQ ID NO: 144743 - protein, 33 aa, Heterodera glycines
  Coding regions on vcDNA: vcDNA=SeqID_71166; Strand=+; Position=1 -63,852-890
MCYADAQDNGDCCAKKGVPSENPMGWRDTCSKA

SEQ ID NO: 144744 - protein, 61 aa, Heterodera glycines
  Coding regions on vcDNA: vcDNA=SeqID_71167; Strand=+; Position=1 -83,344-446
MFCFNTMRAIILLTFVVIQCQIVQMSGGRCYNPSDKFHGCCQQIGMTSTMTNLQSLIRDGN

SEQ ID NO: 144745 - protein, 163 aa, Heterodera glycines
  misc_feature (29)..(29): Xaa can be any naturally occurring amino acid
  Coding regions on vcDNA: vcDNA=SeqID_71168; Strand=+; Position=1 -280,512-669
  Homolog annotation: Hit_ID=CAE57967.1; Match level="QueryCoverage =71%, HitCoverage=22%, E-value=1e-26, Identity=45%"; Hit description =Hypothetical protein CBG01028 [Caenorhabditis briggsae]
YNIERFLRLKIRVQTLDFHDRINFLKIRXSIGSISLCLNDQLLSVLNRTCCHTTTLGDITVEKGTAVVCDLLSLHHDKAVWGEDADEFRPERWLEAGHQLPPFYAFGGGPRICIGMRFAMIEEKLALVRILRKYSIVQTADTEVKLAFSGQSVITPKSVTVGL

SEQ ID NO: 144746 - protein, 16 aa, Heterodera glycines
  Coding regions on vcDNA: vcDNA=SeqID_71169; Strand=-; Position=1-49
EAIPEGFGLPINLGAS

SEQ ID NO: 144747 - protein, 85 aa, Heterodera glycines
  Coding regions on vcDNA: vcDNA=SeqID_71170; Strand=+; Position=1-255
MTEWHLLELALLEKGQNQKWEKIEQLKEKWKEAFDHHLINREEKSRIFKQIVEKLKVMVTFSIDCSTTLYESLKMAKIVSTSRIL

SEQ ID NO: 144748 - protein, 46 aa, Heterodera glycines
  Coding regions on vcDNA: vcDNA=SeqID_71171; Strand=+; Position=1 -66,140-214
MPTKNGLSNYLIGSGLKLNFKLASGFEPTRPKPFLTIRAIRLPSLR

SEQ ID NO: 144749 - protein, 44 aa, Heterodera glycines; identical to SEQ ID NO: 126591
  Coding regions on vcDNA: vcDNA=SeqID_71172; Strand=+; Position=1 -45,128-217

SEQ ID NO: 144750 - protein, 149 aa, Heterodera glycines
  misc_feature (138)..(138): Xaa can be any naturally occurring amino acid
  Coding regions on vcDNA: vcDNA=SeqID_71173; Strand=-; Position=1-452
  Homolog annotation: Hit_ID=AAP92584.1; Match level="QueryCoverage =80%, HitCoverage=24%, E-value=5e-34, Identity=63%"; Hit description =Ab2-057 [Rattus norvegicus] gb|AAP85373.1| Aa1262 [Rattus norvegicus] gb|AAP85367.1| Aa1011 [Rattus norveg
GAWPFLVRGAICLVYSDNERDSSLLNSWLIASGHNFLEGFSVFSRTKLSNNRSVMPLDVRGCTRATLAKSACLPSPKGVGKPVKICRDWDRTLQLLSVNEEFLVGASHQLALNTSLPFVHTARRCPGLSHFEKFGDGXIRASVGMQTGT

SEQ ID NO: 144751 - protein, 24 aa, Heterodera glycines
  Coding regions on vcDNA: vcDNA=SeqID_71174; Strand=-; Position=1 -52,296-318
MEKACKIWRDYIDFSALELLVLAS

SEQ ID NO: 144752 - protein, 60 aa, Heterodera glycines
  Coding regions on vcDNA: vcDNA=SeqID_71175; Strand=-; Position=1-217
FISIFSESALKHTKLYLQVSLGTLMLFLSKREMNKIFNSFLNRPKSLGLTLKSETDQKRT

SEQ ID NO: 144753 - protein, 21 aa, Heterodera glycines
  Coding regions on vcDNA: vcDNA=SeqID_71176; Strand=-; Position=1-66
LGLYSSGHFEANHSREPNDRG

SEQ ID NO: 144754 - protein, 97 aa, Heterodera glycines
  Coding regions on vcDNA: vcDNA=SeqID_71177; Strand=+; Position=1 -153,215-355
  Homolog annotation: Hit_ID=CAE71319.1; Match level="QueryCoverage =87%, HitCoverage=31%, E-value=4e-12, Identity=45%"; Hit description =Hypothetical protein CBG18214 [Caenorhabditis briggsae]
MGAEAQFHRKGRELGRGKFGVVKKALFTDQQGNETAVAIKQLHCVKSNKEQVTEFMNDARIMRKLRQNVVQFYGIAVEREPVMIIMESVSGGSLKDF

SEQ ID NO: 144755 - protein, 88 aa, Heterodera glycines
  Coding regions on vcDNA: vcDNA=SeqID_71178; Strand=+; Position=1 -125,183-324
MCGVLGYCAREVLPNGAMPFQFAGYRLPHHVPSPSRVETKRASQGTAPGLPAEVRHAARLGPESQQPILNGRGVRLDEANTEGGRRRQ

SEQ ID NO: 144756 - protein, 171 aa, Heterodera glycines
  Coding regions on vcDNA: vcDNA=SeqID_71179; Strand=-; Position=1-517
  Homolog annotation: Hit_ID=CAG83749.1; Match level="QueryCoverage =93%, HitCoverage=33%, E-value=5e-22, Identity=46%"; Hit description =unnamed protein product [Yarrowia lipolytica CLIB99] ref|XP _499823.1| hypothetical protein [Yarrowia lipol
CTSSNHCCTSSITVVPLLITFVPLLITVVPLLITAVPLLITVVLLLITVVPLLITVVPLLITVVPLLITVVPLLITVVPLLITVVPLLITVVPLLITAVPLLITVVPLLITVVPLLITVVPLLITAVPLLITVVPLLITVVPLLITVVPLLITVVPLLITVVPLLITVYLF

SEQ ID NO: 144757 - protein, 113 aa, Heterodera glycines
  Coding regions on vcDNA: vcDNA=SeqID_71180; Strand=+; Position=1-341
VASCSGAAASSSTVGSMVVSHLQQQQQQHHAQAVQQQQQYVQHHQHHGTNADMTATAVVVQSPPPPPYSAGVVSVPSHQLPSGMSGTAAHAVAGGAVPIASNATAAMVQQTQQ

SEQ ID NO: 144758 - protein, 68 aa, Heterodera glycines; identical to SEQ ID NO: 127362
  Coding regions on vcDNA: vcDNA=SeqID_71181; Strand=-; Position=1-397

SEQ ID NO: 144759 - protein, 78 aa, Heterodera glycines
  Coding regions on vcDNA: vcDNA=SeqID_71182; Strand=-; Position=1 -99,146-283
MLGITSRQSKCTKIIMSISDHEIVECCSGGVYQYGLKLRRLYAPADAEFEYVLKVRGMTLNYDVINNQGLRYDSSSRC

SEQ ID NO: 144760 - protein, 15 aa, Heterodera glycines
  Coding regions on vcDNA: vcDNA=SeqID_71183; Strand=+; Position=1-49
LKAIHCLPVLGTAKH

SEQ ID NO: 144761 - protein, 49 aa, Heterodera glycines
  Coding regions on vcDNA: vcDNA=SeqID_71184; Strand=+; Position=1 -93,748-804
MAAEKYSTERIATLGESLRHAKGRATYYKQEDALETTQINYEAQFRGKH

SEQ ID NO: 144762 - protein, 227 aa, Heterodera glycines
  Coding regions on vcDNA: vcDNA=SeqID_71185; Strand=-; Position=1 -261,474-668,721-807,1739-1879
  Homolog annotation: Hit_ID=NP_506014.1; Match level="QueryCoverage =98%, HitCoverage=32%, E-value=3e-74, Identity=59%"; Hit description =protein kinase C (80.2 kD) (pkc-1) [Caenorhabditis elegans] emb|CAC70080.1| Hypothetical protein F57F5.5
MSSRAKRKPLSVSVSESTAGLEPSTSSPKSAASAATAPSRLPSSVASAEVSEGRGGDSPKGISGTDGRAALADFTFIKVLGKGSFGKVMLAERKGTDEVYAVKVLKKDVILQDDDVECTMCEKRILALAAKHPFLTALFCSFQTPDKLFFVMEYVNGGDLMFQIQRARKFEEPRARFYAAEDNILLDADGHCRLADFGMCKEGITKDSLTSTFCGTPDYIAPEAFFQ

SEQ ID NO: 144763 - protein, 52 aa, Heterodera glycines
  Coding regions on vcDNA: vcDNA=SeqID_71186; Strand=+; Position=1 -3,389-544
MNDNSREEIEKTEKVFESMVQNMKRMIGKMIKVDDSDSTEIVQVKIKPIEAF

SEQ ID NO: 144764 - protein, 70 aa, Heterodera glycines
  Coding regions on vcDNA: vcDNA=SeqID_71187; Strand=-; Position=1 -288,467-599
  Homolog annotation: Hit_ID=A53530; Match level="QueryCoverage=97%, HitCoverage=9%, E-value=2e-18, Identity=58%"; Hit description =protein kinase C (EC 2.7.1.-) epsilon-related - Caenorhabditis elegans gb|AAA18259.1| protein kinase C
MVLFNGTAKIRVVEARDLQPTEWSKRFNQSDDPDSQLVDAYVNVDCDEYHVGKTVTRPKTKSPVWNEDYQ

SEQ ID NO: 144765 - protein, 45 aa, Heterodera glycines
  Coding regions on vcDNA: vcDNA=SeqID_71188; Strand=-; Position=1-136
MLGKPKMDEQGIEEEFKKRMEELNLEESEVKKMAGLSEALGEVIE

SEQ ID NO: 144766 - protein, 169 aa, Heterodera glycines
  Coding regions on vcDNA: vcDNA=SeqID_71189; Strand=-; Position=1 -241,285-553
MAYVELSKDMAEYKLVENGIKAMALVEQTVYDLDTFGLRMEPQNILDLDRQYLERAERITRNDHLKRHFGLRKRMEEAIKKLNNDFDIIVQRKTSLINGKPKTLWEKLAELDGKADLNLFGTPSDFEGFDSEYIRKIEEIKTDAASLVDYKGLKMRSEMAKQRENTGRK

SEQ ID NO: 144767 - protein, 85 aa, Heterodera glycines
  Coding regions on vcDNA: vcDNA=SeqID_71190; Strand=-; Position=1 -410,475-797
KNRFIFVFGAVPPNRCAQIYGETESFGNSFPIACTLILRWIFAPHNCLSTPNEHLKKSIYFCFRGSPPEPMRHRFMGRPNPSGIA

SEQ ID NO: 144768 - protein, 187 aa, Heterodera glycines
  Coding regions on vcDNA: vcDNA=SeqID_71191; Strand=+; Position=1 -129,227-374,415-700
  Homolog annotation: Hit_ID=CAG82817.1; Match level="QueryCoverage =50%, HitCoverage=13%, E-value=1e-13, Identity=46%"; Hit description =unnamed protein product [Yarrowia lipolytica CLIB99] ref|XP _500586.1| hypothetical protein [Yarrowia lipol
MVRKRTDISVPNNNVRISADLSSGPLSSKQKFLIDGPLVLIDTQFYKVESFPIKDKGISDSKWQKVYSLFKLWYPLSFREGQNEHTHSFHNIGEAFCAVLHLHALNLFGGLDLSKIGCITPYSAQAEKIQKLMAMGRDEGPRFEVSSVDAFQGQQREAIVMSLVRNNKMRDIGFLREHRRTNVSHSD

SEQ ID NO: 144769 - protein, 92 aa, Heterodera glycines
  Coding regions on vcDNA: vcDNA=SeqID_71192; Strand=-; Position=1 -120,186-329
  Homolog annotation: Hit_ID=NP_506179.1; Match level="QueryCoverage =93%, HitCoverage=36%, E-value=1e-23, Identity=60%"; Hit description =mitochondrial ribosomal protein L49 (5N209) [Caenorhabditis elegans] emb|CAA99906.1| Hypothetical protein
KANHLPSIFLERRRDELNPKTMDFEYVELVILTGIDGDVFACERACERDLRAYCEKRLGHPIATHVDELKGKIKISGADRTIAEQFVYDYET

SEQ ID NO: 144770 - protein, 60 aa, Heterodera glycines
  Coding regions on vcDNA: vcDNA=SeqID_71193; Strand=+; Position=1-321
LFFAFDPQRSRLIESSPNFAGKLLRTLQMLINFLRIFCLEEHSSSHLPHQYYFFLIIFCI

SEQ ID NO: 144771 - protein, 79 aa, Heterodera glycines
  Coding regions on vcDNA: vcDNA=SeqID_71194; Strand=+; Position=1-321
FAWEEHSSSHLPHQYYFYILFLHLITQRSRLIESSPNFAGKLLRTLQMLIYFLRIFCLEEHSSSHLPHQYYFFLIIFCI

SEQ ID NO: 144772 - protein, 43 aa, Heterodera glycines
  Coding regions on vcDNA: vcDNA=SeqID_71195; Strand=+; Position=1-131
MERNTDKTTGAKTIAKKCSGKASALAMCACPTRGSSLQWSPCP

SEQ ID NO: 144773 - protein, 516 aa, Heterodera glycines
  Coding regions on vcDNA: vcDNA=SeqID_71196; Strand=+; Position=1 -262,454-702,752-862,970-1146,1204-1371,1467-1500,1567-1686,1729 -1960,2184-2380
  Homolog annotation: Hit_ID=NP_501001.1; Match level="QueryCoverage =99%, HitCoverage=55%, E-value=8e-36, Identity=26%"; Hit description =bicaudal D like (4H330) [Caenorhabditis elegans] gb|AAB09108.1| Hypothetical protein C43G2.2 [Caenorhabdi
ERLALADREKAQAGELGLHLLREKEQLELTHEVFAALCLLLLSQCLEFAQRVGLCQDGIGANTETIGIHSVKPTPCGGDRIGPRVGTQLNIFKSESERLAFELESFQLRVTELETEKRTMREEVSRGKRKGRKERKTPPFVKLKELKQREQFALNENGELEEENVSLQKQVSSLKSTQIEFESMKLQLKNLLEEVVILQTVADEANKLRSLAERQEAEALAAAQQEREQRLALKKEFEQLRNQGHLSTLNSLYLGIKGADRDIVKQLENSFISDNPIETFANGNAKGPKDLFSELNGDLEDRLNGAQAENERLKEAKQTQPRFLSKCFFRFSIEECDVSKLKDYMVLALERFDERMELKKEAKETEKREQRMREALREAILLAGRKDAHLTIARGMIVRLGQTLHTFFTELNGTEEGQQNQSERRHIANGLADRLNAVAQRIQPFENGMKRLGSPPPNGGGESPPPTDVSSFVSVETSESDSPRVLLPSPELCRPMLSQNFLKELEGIKIGADAQK

SEQ ID NO: 144774 - protein, 66 aa, Heterodera glycines
  Coding regions on vcDNA: vcDNA=SeqID_71197; Strand=-; Position=1 -63,109-246
MAKLFAILVFSFLLLWCPYELLFAVSSDLSVGWTPLRLKIVLNVIFLLAMSSTVVSPIVYYHMSER

SEQ ID NO: 144775 - protein, 128 aa, Heterodera glycines
  Coding regions on vcDNA: vcDNA=SeqID_71198; Strand=+; Position=1 -225,615-776
MSIQQKLALTQRLEELEMDRERQMQQLRERGATGDAGGHANAHQPQQSQQPKRTGPGGGQRSGGGATYHQPTTRARQRRLCTCDGRFARAATAFEAFFVKIMENERNARPTQCECLAIFVLGDTDTFG

SEQ ID NO: 144776 - protein, 93 aa, Heterodera glycines
  Coding regions on vcDNA: vcDNA=SeqID_71199; Strand=+; Position=1 -93,185-214,268-376,428-478
  Homolog annotation: Hit_ID=AAP06039.1; Match level="QueryCoverage =97%, HitCoverage=61%, E-value=2e-32, Identity=73%"; Hit description =similar to GenBank Accession Number S63672 RNase L inhibitor (clone 8) - human [Schistosoma japonicum]
FILHSKKSGFIVEHDFIMSTYLADRVIVFDGQPAIKATANAPQPLVNGMNRFLSQLNITFRRDNESHRPRINKLNSQLDVDQKTSQNYFYLDN

SEQ ID NO: 144777 - protein, 84 aa, Heterodera glycines
  Coding regions on vcDNA: vcDNA=SeqID_71200; Strand=-; Position=1 -64,158-348
MLNLIDNEQSYGPKSLPTTFWDGQKKRTERKVTGRGKSGEERESSREGKREDRVEEDKKDGKEWAQRKQTKPSQAKVTNFKKFG

SEQ ID NO: 144778 - protein, 144 aa, Heterodera glycines
  Coding regions on vcDNA: vcDNA=SeqID_71201; Strand=+; Position=1 -67,150-254,888-1147
MHHHPPNHEKAINLSILTVSGPALQPYFPRNRKTFVSGKLPTRANKSAGGSLVGIVYGPFSGVEPLSSVTRHRHGSQIHYHRKLIRQTLERHVSGTRPCDQLSCSESTLDARRALGFVANKCTPLWGDWSFGACISSRITTVIQ

SEQ ID NO: 144779 - protein, 92 aa, Heterodera glycines; identical to SEQ ID NO: 131128
  misc_feature (45)..(45): Xaa can be any naturally occurring amino acid
  Coding regions on vcDNA: vcDNA=SeqID_71202; Strand=-; Position=1-1463
  Homolog annotation: Hit_ID=XP_523367.1; Match level="QueryCoverage =91%, HitCoverage=58%, E-value=2e-21, Identity=66%"; Hit description =PREDICTED: similar to rRNA intron-encoded homing endonuclease [Pan troglodytes]

SEQ ID NO: 144780 - protein, 88 aa, Heterodera glycines
  Coding regions on vcDNA: vcDNA=SeqID_71203; Strand=-; Position=1 -162,242-346
MSYKILSITQLLIAVVLLVATCLAFHGPTIVEKPGFNAEKEVEKLYPAIMNNKMKMKIFNINLERDYSHHLLSQQQPRVDNIPNQIID

SEQ ID NO: 144781 - protein, 56 aa, Heterodera glycines
  Coding regions on vcDNA: vcDNA=SeqID_71204; Strand=-; Position=1 -98,391-463
MWFVLCAFVIPSVFCALLGLYLCIYQTRVPPVRDESAHLLYAAKRQPPSPPPALMK

SEQ ID NO: 144782 - protein, 33 aa, Heterodera glycines
  Coding regions on vcDNA: vcDNA=SeqID_71205; Strand=+; Position=1 -12,447-536
MEQQSFNSSTFATRYSTGGRCFSTIPSTTSKLA

SEQ ID NO: 144783 - protein, 97 aa, Heterodera glycines
  Coding regions on vcDNA: vcDNA=SeqID_71206; Strand=+; Position=1-294
EILDSCSLIENPSEAKKCRDGVTDAKVARLRKEGTEEMCVAEGFCGKGEMKELEKKMERMEKRIDDTKQKFEKGLSIIPPVDSNPVDSDTGIKMDNK

SEQ ID NO: 144784 - protein, 87 aa, Heterodera glycines
  Coding regions on vcDNA: vcDNA=SeqID_71207; Strand=-; Position=1-262
STGFESTGGIMLRPFSNFCFVSSILFSIRSIFFSNSFISPFPQNPSATHISSVPSFLSLATLASVTPSRHFFASEGFSISEQESRIS

SEQ ID NO: 144785 - protein, 104 aa, Heterodera glycines
  Coding regions on vcDNA: vcDNA=SeqID_71208; Strand=-; Position=1-313
MDPNNGFYDKSKDKVTLAIDVITDDEPKVEKFTLDQRKSTGTISMEIEKVSEFSREIFLSERKSKTVHIKGLPWKIWTKIEKNNESTGNEKCLGFYLWCDAPKE

SEQ ID NO: 144786 - protein, 38 aa, Heterodera glycines; identical to SEQ ID NO: 130624
  Coding regions on vcDNA: vcDNA=SeqID_71209; Strand=+; Position=1-348

SEQ ID NO: 144787 - protein, 113 aa, Heterodera glycines
  Coding regions on vcDNA: vcDNA=SeqID_71210; Strand=-; Position=1 -132,291-497
CTKKGSEWEIGERIRCLHQAIEYEAKITYKWHNNGVTFYRIHYVGWNQKWDETVCETEAESRFRAWDSSPLPPGMFNVEMLCGKRFQKRRWEYRVRWEGFDETEDTWEPEYKL

SEQ ID NO: 144788 - protein, 17 aa, Heterodera glycines
  Coding regions on vcDNA: vcDNA=SeqID_71211; Strand=-; Position=1 -42,1350-1361
MATEACSKSTLQYQLFF

SEQ ID NO: 144789 - protein, 83 aa, Heterodera glycines
  Coding regions on vcDNA: vcDNA=SeqID_71212; Strand=-; Position=1 -72,138-317
MFNNIFFFFLIVAPFIAAYKPSCKCPENEQPGQLSCNGCEPSCDNRKPEVCTKMACECSCDCVPGLLRDKKTKKCVPKEKCPY

SEQ ID NO: 144790 - protein, 131 aa, Heterodera glycines
  Coding regions on vcDNA: vcDNA=SeqID_71213; Strand=+; Position=1 -115,171-451
MFLKRRISEPSDEDEKQRTNQIPIDNNSCVDGIPLNIQSLRKTYVDREEPFLLEKDMLSCPFDQFSIWFGNAITQTDLKYEEVNGFALSTVSRLVYVFCINLTTPNSDQIITKVHFEQTAKYAIFISLTGI

SEQ ID NO: 144791 - protein, 149 aa, Heterodera glycines
  Coding regions on vcDNA: vcDNA=SeqID_71214; Strand=-; Position=1 -37,317-549,1682-1861
MFVPQVPLNLVIKHNGQFLPIAPENLACREATNGSGFNCELSVNQMVVDDECRDVSIWARMDNDTSTLQLLGEQVKKKKKLKQFRENWIRDLSNCTKTDDHMNCVAELVIKPDQIGQLQRVPTAAISKMIKMPKSNLTEKNRRRLDEGN

SEQ ID NO: 144792 - protein, 75 aa, Heterodera glycines
  Coding regions on vcDNA: vcDNA=SeqID_71215; Strand=+; Position=1 -44,90-272
RNQPHSHCLEDICRPRRTSFFSLLSASVVWNEKERRQGKTEIEKWNGSNDGSKKNKFDGKLRCVFYPIFFFAPIH

SEQ ID NO: 144793 - protein, 15 aa, Heterodera glycines
  Coding regions on vcDNA: vcDNA=SeqID_71216; Strand=-; Position=1 -14,140-173
MITGRNSAILVFIDT

SEQ ID NO: 144794 - protein, 171 aa, Heterodera glycines
  Coding regions on vcDNA: vcDNA=SeqID_71217; Strand=-; Position=1 -135,190-287,585-651,850-1065
MITPESYYPTLQVKDIGNASKPNEERLAQIIRWNWGENGAQRIVETHTLNKGSELNYRRCDNASSFVIRILKKRETKNAFPASSNSLPDDDLTVEIGDKQITDNLSRSDGRVRPLADVRFPGDQSHAQRGDEGEAAANDHFERIGRGHGPIQRIFGGHHLSYNERTFSAQP

SEQ ID NO: 144795 - protein, 255 aa, Heterodera glycines
  Coding regions on vcDNA: vcDNA=SeqID_71218; Strand=+; Position=1 -66,195-581,654-922,972-1017
MDPDPEDLGQITISHELIDGKKIHQSDVIQLLQNWKSIFESCPLNLSIRFLSDRVWRLIERDIFPLMSKNIENLDLSDNIVRICPTILSQCAILRTVNYTLNSSIYDPSSWQPVQDWLISPRADNGTPLRIVNFLCESEAVNLQCIQELKKAFRLATSRASFIMVFFDQHRLSPFSINNKCTGEELTLIRHDRVFNNFKLVRHGRPNFLPKATLDRAAEWLMEDEMHRIVVNLRDDDVGDGLLDSFPSAGPSDRH

SEQ ID NO: 144796 - protein, 81 aa, Heterodera glycines
  Coding regions on vcDNA: vcDNA=SeqID_71219; Strand=-; Position=1 -104,224-365
MAEMYNWSDIAQRTERVYGNSLKEPEGSINHKLRNQLNAGFWFGLIWAWVTAVNILFASVLDWVDPRDGIETVDNKAKTNN

SEQ ID NO: 144797 - protein, 84 aa, Heterodera glycines
  Coding regions on vcDNA: vcDNA=SeqID_71220; Strand=-; Position=1-255
MGKSSKNSGRKLNRNKLMAQKDEEEKEDEEEEEKVEEDDDEEEDEEEQGEEEGDNGRETEPYIDGWTNGRTKGKATGSNFFLTI

SEQ ID NO: 144798 - protein, 268 aa, Heterodera glycines
  Coding regions on vcDNA: vcDNA=SeqID_71221; Strand=+; Position=1 -58,104-181,230-286,356-460,533-692,884-969,1121-1159,1221-1320
  Homolog annotation: Hit_ID=CAE65833.1; Match level="QueryCoverage =94%, HitCoverage=39%, E-value=3e-69, Identity=55%"; Hit description =Hypothetical protein CBG10957 [Caenorhabditis briggsae]
KTHPIELTIDSGSIRGEYLTIGANTIGANEFAVFKGIPYAAPPVGSLRFQMPEPPAKWRGVMNASQYPPQMPEPPAKWRGVMNASQYPPMMCAQRPRDRKVDPVKLYKIHVSEDCLYLNLFAPSQCQCQFTNDTYPVIVWVHGGRFQYGSSADYPQNAILNNFVSRKAIFVSVNYRLGPMGFLSTGDSVLPGNLGLWDLMLSLKWVQINAHVFGGDPNNVMMMGHGSGASAVSLLMGHGSGASAVSLLALSPKAEGKSKRMNEKRTKH

SEQ ID NO: 144799 - protein, 138 aa, Heterodera glycines
  Coding regions on vcDNA: vcDNA=SeqID_71222; Strand=+; Position=1 -174,1197-1334,1660-1764
  Homolog annotation: Hit_ID=CAE65833.1; Match level="QueryCoverage =23%, HitCoverage=6%, E-value=6e-10, Identity=90%"; Hit description =Hypothetical protein CBG10957 [Caenorhabditis briggsae]
MTDGLSVMVAEQLVDNLTQGFSGFTNHRLIREGAMHEYVWTRVDPSLKVSALNESILESNIWTPSMWEICKRSLIWTSNWAIIRCKNAYGTNETTANRKNAEKVLATWMLLFCSLFFFAILVGLACYCTRKETDEDEL

SEQ ID NO: 144800 - protein, 326 aa, Heterodera glycines
  Coding regions on vcDNA: vcDNA=SeqID_71223; Strand=-; Position=1-978
  Homolog annotation: Hit_ID=NP_502797.1; Match level="QueryCoverage =89%, HitCoverage=80%, E-value=6e-43, Identity=34%"; Hit description =HASI (4P602) [Caenorhabditis elegans] emb|CAB16520.1| Hypothetical protein Y57G11C.19 [Caenorhabditis ele
MDGSSKENSTEQNNPDAADNQEGISPEKVELINSTLDKLYNDPSSPAAFAGVTALWKEARKKLKNLRKKDVQHYLEGHRTYTLMRSRRVRFPRAKTVAAGFMTDVQVDLADFQALSRHNRGHRYLLVAVDVLSKRLFVVPLKNKRAEEMLEAFRQLIDQMPMVPHRIFSDKGTEFKNRLLKEFFDEQEIEKHEPVHSSVKASVAERAIRNVKQRLYRYFAQKETLNWVDAVQKIVDGINSAPTRVHGMRPIDVDFSNAQKVWKRLYGHPALQKRTPRFRKDEFVRMSREKGQFEKGYLPNYGDEILEIDDVLKAVRPIRYKLGMST

SEQ ID NO: 144801 - protein, 119 aa, Heterodera glycines
  Coding regions on vcDNA: vcDNA=SeqID_71224; Strand=+; Position=1 -12,504-851
MQFMQKSVGHIRTANFSCLRSVRHTEPVTVCIQQLTLCYLMQYSPQVGAVVVEQPDDLYDKCTRVMQCVKLREALTNLVRCVDTDKSIRLRAEHMRTMRGLDMGKFNGRFTKCEQWKVM

SEQ ID NO: 144802 - protein, 52 aa, Heterodera glycines
  Coding regions on vcDNA: vcDNA=SeqID_71225; Strand=+; Position=1 -127,527-558
MTTEEKRRPIETDSRRFEETGMLESKNSRTASCACPGDAEGHGFSVIIEHLP

SEQ ID NO: 144803 - protein, 231 aa, Heterodera glycines
  misc_feature (230)..(230): Xaa can be any naturally occurring amino acid
  Coding regions on vcDNA: vcDNA=SeqID_71226; Strand=-; Position=1 -212,256-529,633-811
  Homolog annotation: Hit_ID=XP_421216.1; Match level="QueryCoverage =94%, HitCoverage=13%, E-value=2e-56, Identity=50%"; Hit description =PREDICTED: similar to likely ortholog of mouse aquarius [Gallus gallus]
SLPSRSDLREEWMNIRKNDVFFLLKLKPIHPVGHKFDVRKPFKSQFEIEYLRGCEVEGILGPDGRVLDEMENRDIIRKINRDIIRKIPGDLRIYRVRFDANQYREDALRGVETDVYFTFNLVIRRDPKTNNFKAVLATIRQLLNTECVVPDWLHDLILGYGEPDTAHYSKMNSMNSTVASVDFNDTFLSFDHLKKSFPGKKHNLEDQKPVPPFRSFPFTTTDCCCICHFXP

SEQ ID NO: 144804 - protein, 108 aa, Heterodera glycines
  Coding regions on vcDNA: vcDNA=SeqID_71227; Strand=+; Position=1-327
MCYVPATTTAQRRTDASTAVRSPHERASHIGAANQPSEAARHRHIATQQPYTGFHTCSTERYTTAPTYGSTPKAWIVRQLPRNVGQRPQVISNDLCPSADGGIWWCQR

SEQ ID NO: 144805 - protein, 125 aa, Heterodera glycines
  misc_feature (2)..(2): Xaa can be any naturally occurring amino acid
  misc_feature (114)..(114): Xaa can be any naturally occurring amino acid
  Coding regions on vcDNA: vcDNA=SeqID_71228; Strand=-; Position=1-378
  Homolog annotation: Hit_ID=XP_227769.1; Match level="QueryCoverage =72%, HitCoverage=70%, E-value=6e-26, Identity=68%"; Hit description =similar to Ac1147 [Rattus norvegicus]
KXLAHCFCGHNFLEGFSVFSRTKLSNNRSVMPLDVRGCTRATLAKSACLPSPKGVGKPVKICRDWDRTLQLLSVNEEFLVGASHQLALNTSLPFVHTARRCPGLSHFEKFGDGXCSGRSVCRLEP

SEQ ID NO: 144806 - protein, 1174 aa, Heterodera glycines
  Coding regions on vcDNA: vcDNA=SeqID_71229; Strand=-; Position=1-3525
  Homolog annotation: Hit_ID=CAE72551.1; Match level="QueryCoverage =22%, HitCoverage=34%, E-value=2e-19, Identity=29%"; Hit description =Hypothetical protein CBG19735 [Caenorhabditis briggsae]
MRKRKMKAMVFRPRKWDNNTIGTEIEIGTITQCIVIWRETMDAELLAVLTKVEEICYELLCIWVVPKGVPIHVMKKRFPAIVRVPEEENINNLLTKLEQIGMPIEKRGEQKWHETVATNAQKVNWNQLGNGRREKAAGSHSHNSFVPTHFSSYLPTTTKMFFPTPEMPKKGENFGKIQSENFDPFVVLGVKRKSQSPESNYEYEDIFEGPLCTKRTKFWVNSKCETTKTEPLDVKTFFKNENKEIYQPHWKPIVLSSPSGKKGAFFFGKNFVFSNFHPSSFMMDGFKWDNVEQKYCFEKASYFGYFNLAKMIKFKNGITEPSEFKKFTDKDMDQYKSLEENPKSFDQYEWNRVREGVIRPILWAKFTQNEKFGQMLLETGKLPLYEASVNLSWGIGIDIRERQLIFSNMDQGFKGKNMCGRLLEDIRQKLNPMGTVNQKRPTNQINEKDLDQILKKIENDRKISVFKTENILRQCTRIKEVVKENWDMNVFIQGSIYNGLGRKESDLDLVMINSKGIPNDWTKNDSCQFFDKLRKKLRESGMALTRTLIIPSRNVSILEITIDSDDQEINAQISCNNLIGLINSKWLACYVQLDARFKTLYFAILEWADYFEIHQSANGGGTLNSYGWTSLLIFYLIKIPNPVLPNLIKILPEIFEIRNITYTKKQIFEILKQKLIWETTNSQSISSLLIGFFEFYTKINFEESRLNMKEGKIDFWEKSAQEMKMHLFILEPFGAFNVARSVTQNGFSKIKNAFHATWEKLKFGIQNPKKLLEAIKGKENDEIIEEKLNLNRILISDQELVQGQEANTPMDSASKSRKWVLNSQKYFFNALMIINIINFCVATQPMICHNRAQTKLVQFKRDTSSCGKISRFLEQPTRALMLDLFRPNPDNFQFEAWRCIKTRQTQKYRTDLFGYKIEEIPDQILLPTTFEDCHQMAIYKKCEFGVLSGEIGQKHTNKKLIIEQSWWKIGFQKTESENCFLSKITLFGTPGSDIIHSPADDTKNCKYSDGQCQLENGVYLLWEIKKNIKNLFDEKTCVYKREAKINGTYVPGIWMSNDNNRALVFDQNSKKVESCGERLRVSAQGFAIIEEQFKELMKNEKNSFDQNIRNKRKRFKRWNTPFSSEIEKSLYRFGATVSARPFRRNRFGAAVSAQCRFGARVVSARNQKKGRKKS

SEQ ID NO: 144807 - protein, 160 aa, Heterodera glycines
  Coding regions on vcDNA: vcDNA=SeqID_71230; Strand=-; Position=1 -64,264-409,462-732
MCRRDCRRPMGRSDHFQAPRRNAEPLGNELQEALSSAAFFDDFMPFVLAFEFGATFCGENGGTTKLCKEKCLSQTLVAPKTKAPFVGTTKFHGTTPRSVPKTTFGIVPTTEQTFAFKPFVRHVDHFGTNCTHIFFTSEVDKFLLNITATPYEIACNDYEK

SEQ ID NO: 144808 - protein, 109 aa, Heterodera glycines
  Coding regions on vcDNA: vcDNA=SeqID_71231; Strand=-; Position=1-819
LFEYPKRTLEKIDFFVFGAVPPNRRAQIYGETESFGSSFPIACTLILRWIFAPHNCLSTPNGHLKKSIFFVFGAVPPNRCAQIYGETESFGNSFPIACTLILRWIFAPP

SEQ ID NO: 144809 - protein, 18 aa, Heterodera glycines
  Coding regions on vcDNA: vcDNA=SeqID_71232; Strand=+; Position=1 -39,388-405
MKMKMAHPMSKMEIIEDT

SEQ ID NO: 144810 - protein, 146 aa, Heterodera glycines
  Coding regions on vcDNA: vcDNA=SeqID_71233; Strand=+; Position=1-441
  Homolog annotation: Hit_ID=AAN75564.1; Match level="QueryCoverage =81%, HitCoverage=7%, E-value=8e-11, Identity=34%"; Hit description =adhesin FhaB [Bordetella avium]
MDTAQRRIAIRRKLKKDEAYDDDDQRKKYRIYQPPPLPRAKVKVEHPRPPPPRPRPNVKREQQQKPKSEFKPPATSKKTGHPTPAKRVPEFVDLDPRPSTSRQAGYNPPPPTPKIKHEPTTKRPMPYRIPKREPKVEEAPQQQQPQ

SEQ ID NO: 144811 - protein, 37 aa, Heterodera glycines
  misc_feature (30)..(30): Xaa can be any naturally occurring amino acid
  Coding regions on vcDNA: vcDNA=SeqID_71234; Strand=+; Position=1-169
NASLFGRSPKPRSLKKSDRIYKSEKNNAMXNASFAAQ

SEQ ID NO: 144812 - protein, 183 aa, Heterodera glycines
  Coding regions on vcDNA: vcDNA=SeqID_71235; Strand=+; Position=1 -50,1567-1612,1666-1805,1938-2035,2387-2544,2600-2641,2748-2765
  Homolog annotation: Hit_ID=NP_996955.1; Match level="QueryCoverage =88%, HitCoverage=12%, E-value=6e-16, Identity=32%"; Hit description =hypothetical protein zgc:77279 [Danio rerio] gb|AAH66436.1| Hypothetical protein zgc:77279 [Danio rerio]
MKCCQICHGIISRYILNNEKEIEEALQVLSRMIREGGITLWNDYFNTIFFAIQQIISQDLERHFNIIKISALKTLKELCLVQPKRLVAKTELLVMIILNAHECEDATVVRAAEDCGAAVANHLPTNTCMHLLLTVIDDKHSKYHQLSGAIKMLGSMLSKLPPEEVVELLPTVVPRMTQSRNFL

SEQ ID NO: 144813 - protein, 88 aa, Heterodera glycines; identical to SEQ ID NO: 133373
  Coding regions on vcDNA: vcDNA=SeqID_71236; Strand=+; Position=1 -96,135-305

SEQ ID NO: 144814 - protein, 16 aa, Heterodera glycines
  Coding regions on vcDNA: vcDNA=SeqID_71237; Strand=-; Position=1-49
EAIPEGFGLPINLGAS

SEQ ID NO: 144815 - protein, 90 aa, Heterodera glycines
  Coding regions on vcDNA: vcDNA=SeqID_71238; Strand=-; Position=1 -132,370-510
  Homolog annotation: Hit_ID=NP_501755.2; Match level="QueryCoverage =97%, HitCoverage=7%, E-value=9e-38, Identity=85%"; Hit description =probable cation-transporting atpase w08d2.5 family member (4K582) [Caenorhabditis elegans] emb|CAA94236.2|
MCGDGANDCAALKAAHAGISLSEAEASIAAPFTSKVADIRCVPTIIREGRAALVTSFGVFKYMAGYSLTQFVTILQLYWLNTNLTDFQVT

SEQ ID NO: 144816 - protein, 148 aa, Heterodera glycines
  Coding regions on vcDNA: vcDNA=SeqID_71239; Strand=+; Position=1 -27,285-704
MFRVTARYLIQNFDEDNYCLFYAMQATLVRSISYLDRRRFHDYVNGNSEMRGKLKHDALEMMNAVNSPAGQPITMRKYMCRELWTGGMGKNSLVNGISKHLSSDRQAITSLYSNMDQRTMLYRSSFTSKRGILMVCRKVGICSASHIV

SEQ ID NO: 144817 - protein, 137 aa, Heterodera glycines
  Coding regions on vcDNA: vcDNA=SeqID_71240; Strand=-; Position=1 -264,522-671
MQKTEPVHFYQSACMIFLQLIFFYSLMRLIKFGKKTSLHKNFTFNVDDQREYEFTLIFNDTYKFYVNRILFYEQNTSITPAWAINFVRCESEDGISMELYSLLNYGELVKIEGRVDRNATVIKIYLFHEVAQFTEMS

SEQ ID NO: 144818 - protein, 65 aa, Heterodera glycines
  Coding regions on vcDNA: vcDNA=SeqID_71241; Strand=-; Position=1 -39,112-270
MLLLEEPTTVEIDQILPTNLYRNKIFVPCPIVGKQRQKLQKRKQFCNQFVAQPTRTAHQRCFSYE

SEQ ID NO: 144819 - protein, 151 aa, Heterodera glycines
  Coding regions on vcDNA: vcDNA=SeqID_71242; Strand=-; Position=1 -66,143-248,307-454,747-882
  Homolog annotation: Hit_ID=AAL75900.1; Match level="QueryCoverage =43%, HitCoverage=14%, E-value=3e-13, Identity=56%"; Hit description =AT4g38220/F20D10_340 [Arabidopsis thaliana] ref|NP_568036.2| aminoacylase, putative / N-acyl-L-amino-acid
MDPSAVFRAQRRAGKYLRPGAQDMKSVGVQYIEALRLLLNANGHKPFLRTVHVLFGPDEEIGGHDGMEKFVQTDKFRALNVRLCIGRRVGQRNGCLPRVLRRKGRLVDENHLSCRFGMLSICFLDFPIEKPLDTDHDLSKTQLGPYARLAV

SEQ ID NO: 144820 - protein, 129 aa, Heterodera glycines
  Coding regions on vcDNA: vcDNA=SeqID_71243; Strand=+; Position=1 -53,98-242,290-481
MLTTLEELKATPCGTQLASFCGQIVSILPSEKKLTALLACASGKNVVLTEFKSVSSKFSKICSLGIVVKFYMLKAQRFQERFDGKTIYVTPLDYEFVVMTFTRMELIQCAIATADSFEKLTSGCIYCEF

SEQ ID NO: 144821 - protein, 295 aa, Heterodera glycines
  Coding regions on vcDNA: vcDNA=SeqID_71244; Strand=+; Position=1 -204,502-648,708-899,950-1119,1189-1363
MASSPSSPSPLFYVLSVLANSNLFPFFFALSIGIPSALLYCLELVVIVANFADFNSAFFVLVAFRVVSLWRHGLPLFLAVTFILPLPLTIPILNKGTYIHVQDDNATFTLDNYKTDNKFDSSEIATSFSFFVGVVCLLLNLASIVAYKLRKVGHQNATIEHKLTIFTMITFFGHFIATISWVLVSLTSINEVDEQNKPSSYVQMWFGLTFEENETLFQANFNQFPWVNDLSMLAIPAWLLLWASSKMREIIAKKFNWIRRNGQQKNIAIVTVKRNVVPMSAKVQPQKHLLTNQRN

SEQ ID NO: 144822 - protein, 131 aa, Heterodera glycines
  Coding regions on vcDNA: vcDNA=SeqID_71245; Strand=-; Position=1 -13,490-872
MEQMARKNVERSVHCRAEFRAEYEKFEPLSLRVQQTDGHLRSNRRKIGKVKKELNFFFKLTHLLFSIDILLVTGSRASHIEVKKANDWQNQWKNGFSQNVRHMFENMRREKSTLLVIDDKMDVLIEAVNSI

SEQ ID NO: 144823 - protein, 43 aa, Heterodera glycines
  Coding regions on vcDNA: vcDNA=SeqID_71246; Strand=+; Position=1 -94,1097-1134
MQEHGMIFDAVHGRTVHKFDERLGGGADVMDNIRMLYLRKDKT

SEQ ID NO: 144824 - protein, 110 aa, Heterodera glycines
  Coding regions on vcDNA: vcDNA=SeqID_71247; Strand=-; Position=1 -172,215-375
MISRLLEQKEAIYQYAFENRSFDLTLTEEEWKLIEELISLLQPIEEASKMLMKSPLSAQIPIAVTLHSKLFSAKLINKEIDSVRCSLVNEIEKYFFGLREKRFINTYLFS

SEQ ID NO: 144825 - protein, 263 aa, Heterodera glycines
  Coding regions on vcDNA: vcDNA=SeqID_71248; Strand=+; Position=1 -266,842-1005,1127-1291,1341-1391,1440-1587
  Homolog annotation: Hit_ID=NP_510605.2; Match level="QueryCoverage =56%, HitCoverage=31%, E-value=2e-24, Identity=39%"; Hit description =putative protein, with at least 2 transmembrane domains (XQ462) [Caenorhabditis elegans] emb|CAB03159.2|
SVVALAVVRHCLVGRALAHHRGARVPVRVHLDAATMTVVHVLARLCAVLARAVCPVRVHHVTDRVNSQRIGEKSRMMNIFDYKPLYIIGKFGVDNKPIKITDLEKARAKKEESEQKLMEKKERRERKKRQMAELRERARIERRRKNFAGAVDLLLTYCRLITSFAVLVGNIHKTFIPRYLAPPLENVYDSPDLLMFFTITLLIDVGFFWLLVFWSYCQQMALCCRLGFCRFLLWCVALVFVGGGLMLYPMHFVHEQLGLLLIL

SEQ ID NO: 144826 - protein, 55 aa, Heterodera glycines
  Coding regions on vcDNA: vcDNA=SeqID_71249; Strand=+; Position=1-215
PSLTRHSFFNRNDRPMPCNLINRSRMRRSAPSQAAARKQPLRKSPRQTLLSGFVL

SEQ ID NO: 144827 - protein, 107 aa, Heterodera glycines
  Coding regions on vcDNA: vcDNA=SeqID_71250; Strand=-; Position=1 -61,115-374
MTGLIRDRSRYFSSLPPRVESPFSGVEPLSSVTRHHHGSQIHYHRKLIRQTLERHVAGTRPCDQLSCSESTLDARRALGFVANKCAPLWGDWSFGACISSRITTVIQ

SEQ ID NO: 144828 - protein, 213 aa, Heterodera glycines
  Coding regions on vcDNA: vcDNA=SeqID_71251; Strand=-; Position=1 -11,72-353,407-754
  Homolog annotation: Hit_ID=AAL78214.1; Match level="QueryCoverage =71%, HitCoverage=75%, E-value=4e-10, Identity=29%"; Hit description =putative esophageal gland cell protein Hgg-20 [Heterodera glycines]
MNRRWICNDVWMDIFPSFDHAQLGLKLALLSPRFNALVDKHFDGKSELTIWRRIEIRRKDKGPEAKLSVLMGEYKFAEFQLPDRPLPSKIRLKCLMIDYIDHSVIAFLRSNHQIFDKRGTKLRLGILPSQTTDDRQPIWDVFVREIWPIFASNIRRLRFIDGDHLDNLRRRTSPTILTDLDQLIAIYSIHLLPDPIGDNFDGPNATAGQALSK

SEQ ID NO: 144829 - protein, 21 aa, Heterodera glycines
  Coding regions on vcDNA: vcDNA=SeqID_71252; Strand=+; Position=1-65
MAVSFFSWGFDRKLGTNICLL

SEQ ID NO: 144830 - protein, 19 aa, Heterodera glycines
  Coding regions on vcDNA: vcDNA=SeqID_71253; Strand=+; Position=1-59
TFAFSSLALPNTHTIFEML

SEQ ID NO: 144831 - protein, 19 aa, Heterodera glycines
  Coding regions on vcDNA: vcDNA=SeqID_71254; Strand=+; Position=1-59
TFAFSSLALPNTHTIFEML

SEQ ID NO: 144832 - protein, 19 aa, Heterodera glycines
  Coding regions on vcDNA: vcDNA=SeqID_71255; Strand=+; Position=1-59
TFAFSSLALPNTHTIFEML

SEQ ID NO: 144833 - protein, 19 aa, Heterodera glycines
  Coding regions on vcDNA: vcDNA=SeqID_71256; Strand=+; Position=1-59
TFAFSSLALPNTHTIFEML

SEQ ID NO: 144834 - protein, 19 aa, Heterodera glycines
  Coding regions on vcDNA: vcDNA=SeqID_71257; Strand=+; Position=1-59
TFAFSSLALPNTHTIFEML

SEQ ID NO: 144835 - protein, 19 aa, Heterodera glycines
  Coding regions on vcDNA: vcDNA=SeqID_71258; Strand=+; Position=1-59
TFAFSNLALPNTHTIFEML

SEQ ID NO: 144836 - protein, 234 aa, Heterodera glycines
  Coding regions on vcDNA: vcDNA=SeqID_71259; Strand=-; Position=1 -148,442-998
MAARFNEAMVARLIELVQSRQDDLNPPTRTAKANEKQKEAWKFVTDSMNRVPGGVQTGLNIGDTIFFEGKEQEESAEFSSQQVVVEEGKSYAVLGTVPRGEAVKTPKFESSTSRVPFRSRAGTASTVTAADVMELQRSVLEMQLKEMTKKQEIFKKFEDVLDDAKTFFTEGREFFRGKHSNEKEMADFQTFLANGLVAATMPLFSASQTYGKHLKVAKSKELFWVIVLIQHVAG

SEQ ID NO: 144837 - protein, 120 aa, Heterodera glycines
  Coding regions on vcDNA: vcDNA=SeqID_71260; Strand=-; Position=1 -81,137-286,487-620
AQSVNTNFADLVDSKRKSPYMQTSYQQKSCSKNKHNDGSVRHRKIKPVKLLMNNPSADVEAEVVKRPSSLSRPILNTRRLEKGESSMSKYFDDSLRRSRSKNSSFSSTSSSSSLASEFLV

SEQ ID NO: 144838 - protein, 178 aa, Heterodera glycines
  Coding regions on vcDNA: vcDNA=SeqID_71261; Strand=-; Position=1 -30,867-1056,1106-1215,1502-1651,1699-1755
  Homolog annotation: Hit_ID=NP_502244.1; Match level="QueryCoverage =91%, HitCoverage=28%, E-value=5e-22, Identity=35%"; Hit description =BTB domain containing (67.7 kD) (4M616C) [Caenorhabditis elegans] emb|CAB01179.1| Hypothetical protein F3
MRKGLFSCLSIISAHRAILSSASDVFEAMFRYNEGQIEIPDIEIGAFKTMLRFIYTKSFDGLDANNLLEVLKAAHKYNISGLVKECAKFSIQKLPNVFVAFEQALLLKMEDFALRCLRYIDQNISALIKSKAFLQINQDLLCIILESDQLKISEIEIWNAALRWADEQCRQKGIECSR

SEQ ID NO: 144839 - protein, 117 aa, Heterodera glycines
  Coding regions on vcDNA: vcDNA=SeqID_71262; Strand=+; Position=1-352
MANFKCLFQCAFCFFFLRFSVIAVEHNEKDLFDEIWKNLNNKTPKVKGFEKIKVKMEPQMDNEQMINMEKYGQIGKTKVKKEKCENGQTEKANYSTRKQIKKEHQSEEGTEINRQTK

SEQ ID NO: 144840 - protein, 91 aa, Heterodera glycines
  Coding regions on vcDNA: vcDNA=SeqID_71263; Strand=+; Position=1 -156,246-362
MMIRRARKTMLDVRSTHPSPVRTSKIQRKYVSCSGFPESKDSRPPTSSDDLILSLTCFSRQPLSLRLFENPPTPTPLEEKVHPPFQFHHNV

SEQ ID NO: 144841 - protein, 43 aa, Heterodera glycines
  Coding regions on vcDNA: vcDNA=SeqID_71264; Strand=+; Position=1 -79,235-287
MDQFPRGFSPAGSDSSRPQHYKRSWPTRVERGREFWANRDFSG

SEQ ID NO: 144842 - protein, 206 aa, Heterodera glycines
  Coding regions on vcDNA: vcDNA=SeqID_71265; Strand=+; Position=1-621
MRSQCHRQKRCQSEDGDPSLKGMSTTTRIFGNTPRRQLSVKERSVAEEADSELGDSSATEEGGTESIRWTAAGDVPLLQNERLSRQEFVAVLRFASLRHSLAPSVYNNRSERRQTVPIRGTRRSRGTLALPHAAASDGTAERARDFRAVGGRVGRDEPKDEQRGTGREKVGTRGDGGGQRQTKANGSDGDDATPQRQHRSTIGQTN

SEQ ID NO: 144843 - protein, 22 aa, Heterodera glycines
  Coding regions on vcDNA: vcDNA=SeqID_71266; Strand=-; Position=1-69
MSVSLRFFIRILFIKWLMAGYF

SEQ ID NO: 144844 - protein, 24 aa, Heterodera glycines
  Coding regions on vcDNA: vcDNA=SeqID_71267; Strand=+; Position=1-76
ITGVSIIAVLFLVFLMPSQNLVRF

SEQ ID NO: 144845 - protein, 24 aa, Heterodera glycines
  Coding regions on vcDNA: vcDNA=SeqID_71268; Strand=-; Position=1 -52,295-317
MEKACKIWRDYIDFSALELLELAS

SEQ ID NO: 144846 - protein, 28 aa, Heterodera glycines
  Coding regions on vcDNA: vcDNA=SeqID_71269; Strand=+; Position=1 -13,261-334
MRFVVPTVIWANLESDGANMRPRGKLEF

SEQ ID NO: 144847 - protein, 716 aa, Heterodera glycines
  Coding regions on vcDNA: vcDNA=SeqID_71270; Strand=+; Position=1-2151
  Homolog annotation: Hit_ID=NP_498959.1; Match level="QueryCoverage =94%, HitCoverage=30%, E-value=9e-81, Identity=31%"; Hit description =zn-finger, CCHC type and RNA-directed DNA polymerase  and Integrase, catalytic domain containing protein
MDVDKVQPITNLPMPQTRKELHSLLGFFTYYRKFIYSFGTIAAPLFKLLQENVKFSIGEVEKEAIKSLKEKVLKDVVLYFPNFEKAKNDPSRCFIMMTDASKVGLSAVLCQHDDEMKLRPIYFASRQCSKYESRYAATELEALAVRFGAKKFAQFITMLPTRVLTDHKSLVPMFKSKEETGNARVDKWLMELNSRFILKVEYQPGKMNVIADLLSRSFQLNNEGIAEPLLEEDKALIGMIKILTAEEVEASIEEKREKWSRASEESEMKHIYEFLKKKIFPDDPRQAQNLKETCHKYTLLDGLLYLCEDNGKLRLFVPSEFRENLVKQRHEGKCAGHMSDKKLFLQLAEQYFWPNMLKDCMKIHQHCRICAHTKEARANEPPLKVVRTSEPFELLCIDILDVGPSQSEFKYICVMVDHFSKYLIAEPIRNKSAEAVAKVLVEKAILIYGTPKKIHSDKGKEFVNSTIEEIVKTFGIERSLTAGYDPQANGLVERVNRIIIAMLKKSTASCWTWDERLPYIVFAYNITPSKTTKFSPFSMIFGKIARFTMDGEVPLQVNPAYTIDSDTYLQLFRENVLNMLNEARKNSDEERMRSKIWYDSQPKVTANKFEAGQRVMVAFPGLNRRSRHKKFLWSHFGPYLILEINESSAFLVPIDNRNAEPIKVPIERLIRIPPGIPDISTLPKGKNPFKNALKSLIVSILSSFEVCESDGQMAPL

SEQ ID NO: 144848 - protein, 301 aa, Heterodera glycines
  Coding regions on vcDNA: vcDNA=SeqID_71271; Strand=+; Position=1-906
MTAARSFVKSIIEGAPKEELHLFVTKKGDYVATGQCPTEEDQMKALECWFEKCSVAKHALEESGFKKIGMYEPVGLNHLADSEKKKWEEAMGETPWVLEKLRAKIIHKATKLIALPRVIIGDSTAHQLAEILDQTAVIGPKNGTLAETVRSLKPVVLSSKVKAALIIVGRDSLLGGETIAVMMEQYEMIANLCRRFPQVKFFWTCPPYVHDKHDEYEELIESLVPMMSQKPFLPVWVTESDNGWTDERGRFASAEGMAVHPIRLPGRSEAENSVNSIDRSCRCYDRSGGPSPSKHFVFGRK

SEQ ID NO: 144849 - protein, 381 aa, Heterodera glycines
  Coding regions on vcDNA: vcDNA=SeqID_71272; Strand=-; Position=1 -115,305-1333
  Homolog annotation: Hit_ID=NP_510671.1; Match level="QueryCoverage =88%, HitCoverage=34%, E-value=1e-11, Identity=22%"; Hit description =predicted CDS, endonuclease/exonuclease/phosphatase family and RNA -directed DNA polymerase (XR69) [Caenor
MVLGLCETWLTNNETIIFSDQTLNENYVIFSAIRNNSKEKYITNNTIIIGDFNIGSKDITWVNNIPVPHTGLGITFLDFFNKFSLNTNIIGPTRGNSILDLCLFTNPDLVSSIELKDSIVFSDHSALYFNIDIPFQRQKPPKITVRNFTQSKIKAFNSYLLSNLSSSLTTTYTLESKYNVFANTIQNALDLFIPKNTFVKNRPPNFPLSLRSSIKEKACIWRKMKKDPVKFKPIYDSLALHIKIQVKKFYENRQRKFLSANPINLYKIIRKHNFSSTSIPSIETESGFIFDDFEKAQYFAKYFSQTFSNDISSSYPLPGGDQAQVYLSEIIFDVSDTIQKLNLLDGKNNTSPDLINNQILKNSFLPLARPITDLLKLSFNT

SEQ ID NO: 144850 - protein, 100 aa, Heterodera glycines
  Coding regions on vcDNA: vcDNA=SeqID_71273; Strand=-; Position=1 -202,256-335
  Homolog annotation: Hit_ID=CAE62853.1; Match level="QueryCoverage =100%, HitCoverage=20%, E-value=1e-22, Identity=55%"; Hit description= Hypothetical protein CBG07032 [Caenorhabditis briggsae]
LWSIRQLKVLAPLALVANLVYLGAVLIILEYMISHLYSIDELPAVGNLSDLPLCFGTVIFAIEGIAVVLPVENHVLPVENHMDRPQHFISPNGVLKPSCL

SEQ ID NO: 144851 - protein, 77 aa, Heterodera glycines
  Coding regions on vcDNA: vcDNA=SeqID_71274; Strand=-; Position=1-258
IFKFILYPRKMSIFFFEKFYTSQKRLRMRRRAVHNRHFISQRIFIFRGYPRKMAISFFDKFYTHTNALEHDREGGAQ

SEQ ID NO: 144852 - protein, 92 aa, Heterodera glycines; identical to SEQ ID NO: 125147
  Coding regions on vcDNA: vcDNA=SeqID_71275; Strand=-; Position=1-304

SEQ ID NO: 144853 - protein, 35 aa, Heterodera glycines
  Coding regions on vcDNA: vcDNA=SeqID_71276; Strand=-; Position=1-107
MIGRAVRNIPFIFEGIFKFILYPRKMAISFFDKFY

SEQ ID NO: 144854 - protein, 70 aa, Heterodera glycines
  Coding regions on vcDNA: vcDNA=SeqID_71277; Strand=-; Position=1-211
  Homolog annotation: Hit_ID=YP_068811.1; Match level="QueryCoverage =98%, HitCoverage=29%, E-value=1e-26, Identity=84%"; Hit description =NAD(P)H-flavin reductase [Yersinia pseudotuberculosis IP 32953] ref|NP_407217.1| NAD(P)H-flavin reductase
PTQQDYIELHIGASELNLYAMAVMDRILKEQAITVDVPHGDAWLREEGSRPLVLIAGGTGFSYARSILLT

SEQ ID NO: 144855 - protein, 20 aa, Heterodera glycines
  Coding regions on vcDNA: vcDNA=SeqID_71278; Strand=-; Position=1-61
TGYREAVPEGFGLPINLGAS

SEQ ID NO: 144856 - protein, 54 aa, Heterodera glycines
  Coding regions on vcDNA: vcDNA=SeqID_71279; Strand=+; Position=1-164
NFVEAYTEASRPVSEICLAIKAASRPQTGASRPFLNFVGLLRPLRGLRRALRAR

SEQ ID NO: 144857 - protein, 92 aa, Heterodera glycines
  Coding regions on vcDNA: vcDNA=SeqID_71280; Strand=-; Position=1 -108,456-626
MNSTQKQIFMGTLELIQNSMEFKETRKDKDLVGEYQDKLLDAMNKVASGLPDSAKLQAIISGGSPMPIIIAEKPFFNAPPPPPAANEDDDAQ

SEQ ID NO: 144858 - protein, 42 aa, Heterodera glycines
  Coding regions on vcDNA: vcDNA=SeqID_71281; Strand=-; Position=1-182
KQKMGKIIKLIAWLKFNQINISWYHSISFNSFNCSLSEYNFS

SEQ ID NO: 144859 - protein, 149 aa, Heterodera glycines
  Coding regions on vcDNA: vcDNA=SeqID_71282; Strand=-; Position=1 -202,589-702,783-916
MGFNLFIRHADLHHEAESMCQMYNQLTPKFMACMARANADSRRLGAFNAIKGGWSCFSGIFLIGMLKTVGFNSLQLIPKSNNSQWGAEMLTKLILSFLDELFEVPEDNGDVEVNEEYFSIAEPIDFGALYVDFLRDLMERSRVKNGQLK

SEQ ID NO: 144860 - protein, 84 aa, Heterodera glycines
  Coding regions on vcDNA: vcDNA=SeqID_71283; Strand=-; Position=1 -212,265-307
MGACCSRQRWRKAAFPPRDGIADAISGTRKKHKDGEWLKKDKKLQKLIEYSGAHPEELSGIGAYLIQHLNRDLDKKNYTRVEVN

SEQ ID NO: 144861 - protein, 43 aa, Heterodera glycines
  Coding regions on vcDNA: vcDNA=SeqID_71284; Strand=+; Position=1-130
MDLQNSMRARTINTHKTRKMIKMRLDRNKRISMRKVALEIGLN

SEQ ID NO: 144862 - protein, 125 aa, Heterodera glycines
  Coding regions on vcDNA: vcDNA=SeqID_71285; Strand=-; Position=1 -94,152-199,281-470
  Homolog annotation: Hit_ID=CAE67580.1; Match level="QueryCoverage =94%, HitCoverage=11%, E-value=4e-36, Identity=60%"; Hit description =Hypothetical protein CBG13113 [Caenorhabditis briggsae]
YICLTFSDRIDLFVGGMLEDPVVRGLVGPTVACIIGPQFARTRDGDRACIIGPQFARTRDGDRFYFENPGIFTRAQLAEIRRSSLARVICDNGDDFRTVPREAFRTGPIVQCIEIPQMDLSKWKE

SEQ ID NO: 144863 - protein, 19 aa, Heterodera glycines
  Coding regions on vcDNA: vcDNA=SeqID_71286; Strand=-; Position=1-60
EPVNSCIGCKCRRCCTPNS

SEQ ID NO: 144864 - protein, 246 aa, Heterodera glycines
  Coding regions on vcDNA: vcDNA=SeqID_71287; Strand=-; Position=1 -81,150-585,1323-1546
MGEAQRTEQLEGMSQFDGSEKESHLGTLDNIARGDQSEQFGHNCRRKGIDGRPMDEGKAFEQTSDPSVVPIGQFEQRTRNRGTVQRSISTEKHTNAREERMAEGKQKKVRRIRVEFIQKMPAKNGIENRAKCQPFVAFLPLPQFAFECIFFRFQFFSVFTFLAIFGLLIGYLGQIHLERAELNGEIVRRQNDDHLRSANHLTDKARLKAFEAKARRSGPNGEKRIEEGELKKEENRTNKQMEKGME

SEQ ID NO: 144865 - protein, 44 aa, Heterodera glycines
  Coding regions on vcDNA: vcDNA=SeqID_71288; Strand=-; Position=1-134
MPVIQALRHSMRSIGAPELRSVKRELEPQVRACTPKPHSRAEQV

SEQ ID NO: 144866 - protein, 95 aa, Heterodera glycines
  Coding regions on vcDNA: vcDNA=SeqID_71289; Strand=-; Position=1-660
MFEYPKRTLEKIDFFVFGAVPPNRCAQIYGEAESFGSSFPIACTLILRWIFAPHNCLSTPNGHLKKSIFLFSGQSPRTDAPRFMGRPNPSGIASL

SEQ ID NO: 144867 - protein, 78 aa, Heterodera glycines
  Coding regions on vcDNA: vcDNA=SeqID_71290; Strand=+; Position=1 -95,459-600
MIKLCPVGMQPEPSAIGYVPCDLLAPGQCSEGKFYCETGQARATAPHGRASARVQMGTNAMSQLANRMCKFKKTKLAF

SEQ ID NO: 144868 - protein, 148 aa, Heterodera glycines
  Coding regions on vcDNA: vcDNA=SeqID_71291; Strand=+; Position=1 -123,411-638,681-773
MSHSENRHLSTEEKMEENNNLKQKITQKGALKMEKIGARSRPLSIELEVSEDKLTTNNEQLHSFSQGEIVIFHAQFSDGNFSLFLLLTSNANLLVQYKFCASSQFASVSLKKFFPEKDFSHLATVAITADSSLIVCLSNDGPTIFMVP

SEQ ID NO: 144869 - protein, 78 aa, Heterodera glycines
  Coding regions on vcDNA: vcDNA=SeqID_71292; Strand=-; Position=1 -70,113-279
MELGIGERTLIKWKNELLPNYYKTKNNYSNEDKLIKMKQYFKMKASNVEISDGIIAEKLGIGRATLFIRWKKEFIHFN

SEQ ID NO: 144870 - protein, 80 aa, Heterodera glycines
  Coding regions on vcDNA: vcDNA=SeqID_71293; Strand=-; Position=1 -108,946-1080
MSLFVRFVRISGHCSYFINIFIILWQNVTNLSRKYRSGKIQPNFDEIFGERWDKNEEEDQMIKIELNQLNGKYEADQMDE

SEQ ID NO: 144871 - protein, 239 aa, Heterodera glycines
  Coding regions on vcDNA: vcDNA=SeqID_71294; Strand=-; Position=1 -550,595-764
MNFCHLIFIIFFIIYKIESGKIRPNFYEIFGDGWNKNEREEQVIKNDEQNENSATVDQMDGENGNGPNDQQKRETIQKFEAIKERLKQKGKYEWKNNNKIEWKIAKLLGQNRQKIYKWKKELNLNKTKKKSFYEGKKNEFIERFDEFKSLYGQRKQKEFVKELGISKDTFTRWKKELLPNYNKTQNNYSNDDKLKKMKQYFKIKEKNPKITDQRIAKDLRIGYSTLKRWKQELVSISDM

SEQ ID NO: 144872 - protein, 34 aa, Heterodera glycines
  Coding regions on vcDNA: vcDNA=SeqID_71295; Strand=+; Position=1-103
KISGIFMSDHFWDENVFDLIVELEKEGRHVRLDW

SEQ ID NO: 144873 - protein, 57 aa, Heterodera glycines
  Coding regions on vcDNA: vcDNA=SeqID_71296; Strand=+; Position=1 -90,288-371
MRRNVQIGKINESIEKAKRCVLVFVKGYACYQKKCKIGRLDRNHKLYHNLVIRTKKL

SEQ ID NO: 144874 - protein, 92 aa, Heterodera glycines
  Coding regions on vcDNA: vcDNA=SeqID_71297; Strand=-; Position=1 -115,160-321
  Homolog annotation: Hit_ID=NP_510442.2; Match level="QueryCoverage =97%, HitCoverage=22%, E-value=6e-43, Identity=91%"; Hit description =putative protein, with at least 4 transmembrane domains, of eukaryotic origin (44.5 kD) (XP322) [Caenorha
MCRILFIVPIYAFDSWLSLLFFSNDVYIYFNSIRDCYEAFVIYSFLSLCYEYLGGESNIMAEIRGKPIRPTSIWTFTCCLSGKQYTIEFLRF

SEQ ID NO: 144875 - protein, 107 aa, Heterodera glycines
  Coding regions on vcDNA: vcDNA=SeqID_71298; Strand=+; Position=1 -147,535-708
PFPDWTSPITFAHHKANASIASHPSSSPMATIILFSCVRCSTFRSVNVMQKPFPGGVRVRLLPNSKNNGRPLIQSANISSTNGEQQKNLIAVVEQHLEQYTKDLVKE

SEQ ID NO: 144876 - protein, 63 aa, Heterodera glycines
  Coding regions on vcDNA: vcDNA=SeqID_71299; Strand=-; Position=1-371
NRNYAQKAPQTILALPIPSTIAFIHPIMNAIIIRVPKIACDLSLQKNGVSKIVITLKKLLKQF

SEQ ID NO: 144877 - protein, 45 aa, Heterodera glycines
  Coding regions on vcDNA: vcDNA=SeqID_71300; Strand=+; Position=1-135
MSQNRDENSQPHVLDGPYPPAQEGVEFVEDEAPLMLEVLERLIQG

SEQ ID NO: 144878 - protein, 98 aa, Heterodera glycines
  Coding regions on vcDNA: vcDNA=SeqID_71301; Strand=+; Position=1 -135,959-1120
MSQNRDENSQPPVLDGPYPLAQERNEFVEDEAPVLLEMLDRLSQGVKGHIENEDGTSTRVMIEHYDKYNGLCGFESFLASCAFTFFGFFVHVSYEDDD

SEQ ID NO: 144879 - protein, 77 aa, Heterodera glycines
  Coding regions on vcDNA: vcDNA=SeqID_71302; Strand=-; Position=1-234
MIEGERGCYVERRRNKNGIVQIRGYIFKDDQTMDECGIAKADVIYGRNIFGWKKISEEPKSASSSRPKLEKTGNKAT

SEQ ID NO: 144880 - protein, 132 aa, Heterodera glycines
  Coding regions on vcDNA: vcDNA=SeqID_71303; Strand=-; Position=1 -147,1252-1503
MSYSYSSTLKTPQKCFHDYENLQTAELHITPHPGYPRTKAGKFIKFFLTVRWAKAALSAAALSGMLSPPISAPLATTAAPSTVAGNGTIVADSRCARSCQPTTVAAATSGQQQMPSTLPTQLSRGGGHNSLI

SEQ ID NO: 144881 - protein, 46 aa, Heterodera glycines
  Coding regions on vcDNA: vcDNA=SeqID_71304; Strand=+; Position=1 -80,210-270
MTAQIQQQQWHQQMQRQQQQGQQPMMGKFSQWRLSAPPCPHFTLFF

SEQ ID NO: 144882 - protein, 146 aa, Heterodera glycines
  Coding regions on vcDNA: vcDNA=SeqID_71305; Strand=-; Position=1-439
NGVSKNRNYAQKASQTILALPIPSTIAFIHPIMSAKIIRVPKIACDLSLEKNGLSKNRNYAQKASQTILALPIPSTIAFIHPIMSAKIIRVPKIACDLSLEKNGLSKNRNYAQKASQTILALPIPSTIAFIHPIMSAKIIRVPKIA

SEQ ID NO: 144883 - protein, 92 aa, Heterodera glycines; identical to SEQ ID NO: 125147
  Coding regions on vcDNA: vcDNA=SeqID_71306; Strand=-; Position=1-304

SEQ ID NO: 144884 - protein, 193 aa, Heterodera glycines
  misc_feature (80)..(80): Xaa can be any naturally occurring amino acid
  Coding regions on vcDNA: vcDNA=SeqID_71307; Strand=+; Position=1 -241,352-445,533-750
  Homolog annotation: Hit_ID=CAE66962.1; Match level="QueryCoverage =90%, HitCoverage=87%, E-value=4e-34, Identity=41%"; Hit description =Hypothetical protein CBG12356 [Caenorhabditis briggsae]
HIGMNIIAALDANCGIGRSNALPWHLPEEYAHFVRVTTHTTDPRKRNAVLMGRKCWESIPKKFKPLKGRLNIVVSFDSNXKINDQLIVAKQLDEVFAILNDEPFKDTVETIWNVGGHDIYANVGGHDIYALGLQHPSLHKVVLTRLDKAFDCDVHFPTVDWAQFERKDDFNGPEEMHEERKVTWHVTSYTRKK

SEQ ID NO: 144885 - protein, 16 aa, Heterodera glycines
  Coding regions on vcDNA: vcDNA=SeqID_71308; Strand=-; Position=1-49
EAIPEGFGLPINLGAS

SEQ ID NO: 144886 - protein, 115 aa, Heterodera glycines
  Coding regions on vcDNA: vcDNA=SeqID_71309; Strand=+; Position=1-350
  Homolog annotation: Hit_ID=NP_670964.1; Match level="QueryCoverage =87%, HitCoverage=100%, E-value=4e-11, Identity=29%"; Hit description= hypothetical protein y3666 [Yersinia pestis KIM] gb|AAM87215.1| hypothetical [Yersinia pestis KIM]
LYLFYHCCTSSITVVPLLITVVPLLIPVVPLLITVVPFLITVVPLLIPVVPLLITVVPLLTTVVPLLITVVPFLITVVPLLITVVPFLITVVPLLIPVVPLLITVVPLLTTMYLF

SEQ ID NO: 144887 - protein, 53 aa, Heterodera glycines
  Coding regions on vcDNA: vcDNA=SeqID_71310; Strand=-; Position=1-159
MFAKEREWKGAAIAPKKPSDQAEKESKGKETARKDTLADLIKKDERNEEPTNS

SEQ ID NO: 144888 - protein, 108 aa, Heterodera glycines
  Coding regions on vcDNA: vcDNA=SeqID_71311; Strand=+; Position=1 -17,152-317,416-559
MCRLAMKEYAKGIIPRACAKIRRLFGRSAAIQTAADGAGTGSTTTPSMVQRECKAKLMVIYMDIKMNEIYFEKIFDFMIVAKDLMIKTRADVGDPRHIQSARVIRKLN

SEQ ID NO: 144889 - protein, 68 aa, Heterodera glycines
  Coding regions on vcDNA: vcDNA=SeqID_71312; Strand=-; Position=1 -94,185-297
MHAFCARAIYHRACQSKAKQQRCCFERIKGIESVNRLLEKYICNLSTILRSELEMIIFTIQTNFRCSN

SEQ ID NO: 144890 - protein, 142 aa, Heterodera glycines
  Coding regions on vcDNA: vcDNA=SeqID_71313; Strand=+; Position=1 -71,318-672
MVTIVSCNAPQANPKVVHINQLKRFKTHNPPNSQFPSSFSDQFHSPTKSDIRSFMDSDNRSMSSDTSTIRRVIDEAVDNVVCSELLEGQDPIDIDLSYALEVELLGPQEPTNPRITPQPDNNSEVWQSCDDDNMDTSSSKLD

SEQ ID NO: 144891 - protein, 33 aa, Heterodera glycines
  Coding regions on vcDNA: vcDNA=SeqID_71314; Strand=+; Position=1-101
MQKSLPKYPNDPERLPKEVILRRAAELAEALYN

SEQ ID NO: 144892 - protein, 24 aa, Heterodera glycines
  Coding regions on vcDNA: vcDNA=SeqID_71315; Strand=-; Position=1-72
MSKRGRGGASGAKFRVSLALPVGA

SEQ ID NO: 144893 - protein, 45 aa, Heterodera glycines
  Coding regions on vcDNA: vcDNA=SeqID_71316; Strand=-; Position=1 -70,119-186
MTQQKTVIKKRCEHWSHFFNRLKANYWSKIVLNTKPKKKHGNIEN

SEQ ID NO: 144894 - protein, 74 aa, Heterodera glycines
  Coding regions on vcDNA: vcDNA=SeqID_71317; Strand=+; Position=1 -87,213-350
MFYCHWQQLRTIDAARYPVRPKLHLLAAHVGRYAHLGTPEKVVEKLVKHVTLLNALHDRGVENNQENGNKYPNF

SEQ ID NO: 144895 - protein, 88 aa, Heterodera glycines
  Coding regions on vcDNA: vcDNA=SeqID_71318; Strand=-; Position=1-265
ESRRRSLNRLANCRITSNKSTDHKAKALHTDAVPNICLFVFVLEVSNIRFATPPPQPPPVLRNVPLPPVTSNNNEMMVDRTCRNNTAK

SEQ ID NO: 144896 - protein, 28 aa, Heterodera glycines
  Coding regions on vcDNA: vcDNA=SeqID_71319; Strand=+; Position=1-85
IFFVCVSNIVRLFDRARQEKATVGTKFA

SEQ ID NO: 144897 - protein, 181 aa, Heterodera glycines
  misc_feature (6)..(6): Xaa can be any naturally occurring amino acid
  misc_feature (21)..(21): Xaa can be any naturally occurring amino acid
  misc_feature (131)..(131): Xaa can be any naturally occurring amino acid
  misc_feature (136)..(136): Xaa can be any naturally occurring amino acid
  Coding regions on vcDNA: vcDNA=SeqID_71320; Strand=-; Position=1 -190,314-464,604-754,844-878
  Homolog annotation: Hit_ID=AAH81039.1; Match level="QueryCoverage =89%, HitCoverage=47%, E-value=1e-41, Identity=53%"; Hit description =MGC81738 protein [Xenopus laevis]
GAKQIXQSALSDIYEFKIYSXVRRPHKMISDDTKIKVTVRTLSTELCCPICLDLLTCTMTTKECLHRFCSECITTALMRGNKECPTCRKKIVSKRSLRPDPNFDFLISKVHKSRTKQRCSPSSLFGLILNXKGNIXKSIEEGIKAQAAYRKQRVRSYDYESCNLKFPEKKTNLKFPEKKTC

SEQ ID NO: 144898 - protein, 380 aa, Heterodera glycines
  Coding regions on vcDNA: vcDNA=SeqID_71321; Strand=+; Position=1 -861,2124-2331,2412-2485
MESTSQNAVSLSGSDFDPIYFSPEENQRWGKLLDRMRTFEQAVCRQFRRIEHTFVQITNQTQIQDTVERVKNLESSIKELENATELDTFETKEKLIDAEEEVERVKMRIDGYERFTKVRFGKIIEKMKSEVGRITENLDTLQGRVQLLEYEQDEYGRDAEWMEDENFRGQALISPEQNDKRDDISVGECEIMVSDPFLGGIAPLEGYDGNPSVSFSRWVARLEDMLSLYPQLTEPQKLSRLRILLRGQARAEFESIEPAPETLVVALEHLKMKFENENTRSIARQTMTRPYSLCNYVKVADWKGEYSTDIWTANSGDFALTFVNRTDKADCDGKWFVASDQSFAIPRESYLEMIDKTGSAVNRIKCKSYAKYPKIVRGDR

SEQ ID NO: 144899 - protein, 1107 aa, Heterodera glycines
  Coding regions on vcDNA: vcDNA=SeqID_71322; Strand=+; Position=1-3324
  Homolog annotation: Hit_ID=S08405; Match level="QueryCoverage=89%, HitCoverage=82%, E-value=1e-131, Identity=31%"; Hit description =hypothetical protein 2 - silkworm transposon mag
MVQNFTGERVRNNAAISQEAVEAQLVKCNPKPVLKNKCSMAGARPNVIEMEKHFACNIPLTERWLSVDSIPTTSKRRKNEPAEPGPSENRKIVTIAMMRVNSCDEKFRVMARVNGYEIKMLLDTGAHVSLCNVETARKLGIKQLSPSDIVGVVGISDKMIPIIGRSTINLEVAGCQVLSTVYVVNSKIGSTGSYEMILGRRGFRQLPLFLDLQTGELVRKSDGKIFVCEKVETDKNLVKPMDNNLGKPVELVKCLDRYSDIFSKHDYDLGGCTIKAPPIITTSATPERVRPYPVPEKYEKELKGHIEKMLEAGVIKESFTPWAHNVVLVKKSNGQLRPCVDFRPLNKVTVPDPYPIPRMDKTIYRVAGRKFYSTLDLASGFWQIPLDGNSSYKCGIVTPWGLYQMLKLPFGLRNAPSIFQRTMDKVLEGVRNVTVYIDDILIHTNTVEEHIEVLGKVFDRLRKSGLKLKMNKCSFLKKQCTYLGHILNEKGYRPSLSNQEVIEAFPAPKNAKEVKRFLGMMSFFRKFIPNFAEIANPLQQLTKERAEFVWNSLEKMAFEELKGKLIEAPCLRAPNYKLPFYLFTDASSIAYAGALMQSEHEQEMYAVGYWSRTLSIAESKLPATHGELAAIVNAVQNFRPIIYGADLTILTDHRPLTFLFSKASSNPKINRWLMALQEFEPQVIYLEGKANRVADALSRVPIKWEQIEMKSKEEIPFLLVAEEETEVNRSIIEKESEKDPIVSQVIAKIQENWQEPIPEELMQYFRERDKLSFDGKIVWKNPGRQMVIPEKLRGQILQMLHRAHFGIVRSKARARSLVWWPQMSEEIENFVKECNICQMNAPSVPKNDPEHKWPEAKLPFERVHADLAGPVWGTNFLVIVDAYSKYPFVAQMQSTHSTAIITYLRELFGMFGSPKTLVTDNGPQFVSLETETFLSNEGVKHLTSPAYHPSSNGEAERFVRTFKEGMTKLLQEGKSLKVAQFLLLQEYRATQCQANGGDTPSQKFFGRQIRTALEKIKMPKKVPEANEGDDPPGRTNENKERSQRRDNPFSPGDMIWFRAAEGQWAPGILLQPMGERMWEIELEGSNVPRSAHVDQLKGRRLGSVRHN

SEQ ID NO: 144900 - protein, 163 aa, Heterodera glycines
  Coding regions on vcDNA: vcDNA=SeqID_71323; Strand=+; Position=1-489
MDAENVPPQNELEKLEREALDSKKSKSRGHEERLKNEIAQMMGQLREAMKEEVRGAVEGLWAKTEPLLVAQKRSTDALTEAFDEFTSQVHIGGKNIDEYEFTSQVYVAGKSVDEERCDNPQPADDPSEKGGETDPPVGGGANPPVSGEPVQASSLPPEQPTVN

SEQ ID NO: 144901 - protein, 264 aa, Heterodera glycines
  Coding regions on vcDNA: vcDNA=SeqID_71324; Strand=+; Position=1-795
MDAENVPPQNELEKLEREALDSKKSKSRSHEERLKNEIAQMMGQLREAMKEEVRGAVEGLWAKTEPLLVAQKRSTDALTEAFDEFTSQVHIGGKNMDEYEFTSQVYVAGKSVDEERCDNPQPADDPSEKGGETDPPVGGGANPPVSGEPVQASSLPPEQPTVNVRAPQRGGRGQWCPSGYKGQWKAQGSGPKHQKRVGYLMRQLERELREEQAPEGCMCWSCRRGKWNGDRGGRGGGMGRGHRGAYGRGRTNYQQHAGPSHRGH

SEQ ID NO: 144902 - protein, 269 aa, Heterodera glycines
  Coding regions on vcDNA: vcDNA=SeqID_71325; Strand=+; Position=1-810
  Homolog annotation: Hit_ID=NP_510849.1; Match level="QueryCoverage =96%, HitCoverage=19%, E-value=8e-37, Identity=35%"; Hit description =predicted CDS, zn-finger, CCHC type and RNA-directed DNA polymerase and Integrase, catalytic domain conta
MTVPSVPKNDPEHKWPEAKLPFERVHADLAGPVWGTNFLVIVDAYSKYPFVAQIQSTHSTAIITYLRELFGMFGSPKTLVTDNGPQFVSLETETFLSNEGVKHLTSPAYHPSSNGEAERFVRTFKEGMTKLLQEGKSLKVAQFLLLQEYRATQCQANGGDTPSQKFFGRQIRTALEKIKMPKKVPEANEGDDPPGRTNENKERSQRRDNPFSPGDMIWFRAAEGQWAPGILLQPMGERMWEIELEGSNVPRSAHVDQLKGRRLGSVRHN

SEQ ID NO: 144903 - protein, 247 aa, Heterodera glycines
  Coding regions on vcDNA: vcDNA=SeqID_71326; Strand=-; Position=1 -91,175-428,526-729,777-971
METLTDDEGICREPSDQLKLLACAYYTIGYCSLSRKFLSFPWVASWDVLDAVRRSRMMSALGQPGTATTGSCSRMFSAMFDSFGERISEHIERFVSARRTQLEGFSARCFGTDRTDFDNGAFAIFKGLAPLMFFCVSWAEHMGLFAQSPLKEEHICLLLLSAGLTNQPQNVINSEERRPWLSETPVEWAESEATPRRAVTRPGRRFSSFVESLASRDFEQLHCLDFAHLGLGSAAFMFMVVLCPTPN

SEQ ID NO: 144904 - protein, 260 aa, Heterodera glycines
  Coding regions on vcDNA: vcDNA=SeqID_71327; Strand=-; Position=1 -312,450-746,1374-1547
  Homolog annotation: Hit_ID=NP_508149.1; Match level="QueryCoverage =80%, HitCoverage=35%, E-value=6e-12, Identity=28%"; Hit description =microtubule-interacting protein that associates with TRAF3 (XB385) [Caenorhabditis elegans] gb|AAC47924.1
MAPPKPKKIVIPTNNNLTEEEDQLASTDKQQQQQVALILEENAEKETTKETENFLIAEDDDDQLFLGAAAEGANVTNLRQGDEHGILVNRIVENTRMLEEKHLQEDGPFVEADEPDLQEQRRVRVEIESVQRVLQRATQNVQPLVRTMEFAADDFDTMLRELEECRKQSLVVERKLQERSTGVSSEVVALSTTLRALDNDIREKLMKRRLDFDNQSPMANGIRLRNDHLTLEYRPDKPMLRSIGKAVSFLMSEVFSRSPM

SEQ ID NO: 144905 - protein, 270 aa, Heterodera glycines
  Coding regions on vcDNA: vcDNA=SeqID_71328; Strand=-; Position=1-813
  Homolog annotation: Hit_ID=NP_508149.1; Match level="QueryCoverage =86%, HitCoverage=40%, E-value=2e-33, Identity=36%"; Hit description =microtubule-interacting protein that associates with TRAF3 (XB385) [Caenorhabditis elegans] gb|AAC47924.1
MGSTDQTKALFSTLIQRPTLTDQLLQRPPFKFIHDIVHETLRVTGFLDGLFTSDELDSTKAGSSRDNKMAFLQKLIDALNMDGHLDDVKPAKIVAGKEAEMTNFLLQSLATEATMYAKQDNNKQQQGDVAVKKSASHSSASSKSKSTTVEAASSPSASKSKNDDDEKRKSKKESSSRRDKEKKEEEHHRSSLTKHRSKDKVSSSKISRTNGNHRISNETAAEKKPSTDREKRKKRSEGLPKKKSASSIKNANDAAVLDENVLNHQQKHNR

SEQ ID NO: 144906 - protein, 24 aa, Heterodera glycines
  Coding regions on vcDNA: vcDNA=SeqID_71329; Strand=+; Position=1-73
MKEENAGTSGSTQTNNTYVLLPDI

SEQ ID NO: 144907 - protein, 148 aa, Heterodera glycines
  Coding regions on vcDNA: vcDNA=SeqID_71330; Strand=-; Position=1 -96,300-527,881-1003
  Homolog annotation: Hit_ID=NP_500145.2; Match level="QueryCoverage =49%, HitCoverage=4%, E-value=1e-14, Identity=49%"; Hit description =CRAG protein (4C711) [Caenorhabditis elegans] gb|AAC68958.2| Hypothetical protein F52C12.4 [Caenorhabditis
MPQSQQELNNSSDDDTLAVSSSSSIQPVEGGKIVQSFTVPYISPLVLRRELETLVTNAADGALVLARPGMRIAHPIIFWNLFYYCRRLELPTHLLTWVAGAVVIHCVQDMPRLPSADEDKQQQQQQHNDAVAEPSSGNEAEEPGRTRN

SEQ ID NO: 144908 - protein, 39 aa, Heterodera glycines
  Coding regions on vcDNA: vcDNA=SeqID_71331; Strand=-; Position=1-118
MPSRQRKPPPPSSALMGRMLPSKSDESVRSWQLMDRRSP

SEQ ID NO: 144909 - protein, 131 aa, Heterodera glycines
  Coding regions on vcDNA: vcDNA=SeqID_71332; Strand=+; Position=1 -30,129-386,435-516
  Homolog annotation: Hit_ID=CAE58521.1; Match level="QueryCoverage =100%, HitCoverage=2%, E-value=4e-33, Identity=55%"; Hit description =Hypothetical protein CBG01673 [Caenorhabditis briggsae]
KTTAVHQFVRGDLLSINCHERTDSSDLLGSIRPKGGGGFRWRDGIVLQAMRRGQRLLVDEISLAPDSVLERLNSLLEPQRAILLTDAGAAHQTVTAAGGFQLVTVTAAGGFQLVATMNPGNDHGKKEVSES

SEQ ID NO: 144910 - protein, 95 aa, Heterodera glycines; identical to SEQ ID NO: 133575
  Coding regions on vcDNA: vcDNA=SeqID_71333; Strand=-; Position=1-656

SEQ ID NO: 144911 - protein, 34 aa, Heterodera glycines
  Coding regions on vcDNA: vcDNA=SeqID_71334; Strand=-; Position=1-103
MSASKFFLKSNDDEVFEVDRNVIRLSTTLNTMFQ

SEQ ID NO: 144912 - protein, 37 aa, Heterodera glycines
  Coding regions on vcDNA: vcDNA=SeqID_71335; Strand=-; Position=1 -53,590-650
MAFFLGLGMAFWLWFCAVRIPRLQNIVKANINYLWEP

SEQ ID NO: 144913 - protein, 303 aa, Heterodera glycines
  Coding regions on vcDNA: vcDNA=SeqID_71336; Strand=+; Position=1-909
MKEHYDAQAKVTENKFQIGDRVMVIFPGSHIRSPHKKILWNHFGPFRITELNKSTATVIPSDNPYGNPMTVPLERLVRVPKELPNICTMPKGKNPYKNVLNGLISVAGLICQENIKLYGEEKLNSKPDGIIGQLRSIAFLGGEEEHMETEQTDDKEAETNESENEENVEEKMDGKEVDANGSEKEANLEEEDQISVVQEEEEPKTLSWTLACVGDGHKCCSDVVVADLDAVLDRSGIGLTKIENPLKALLAMFLLKSEAVASASAAKKLISQILDTDADWELATYCSAREDDVKNGTFPSESD

SEQ ID NO: 144914 - protein, 84 aa, Heterodera glycines
  Coding regions on vcDNA: vcDNA=SeqID_71337; Strand=+; Position=1 -38,1207-1273,1598-1693,1783-1836
MLVREKHGNDGHHANCGHWTVNESLGKDKSLWHFSALPFAVDFVGLGLNYWLFICLKGQLQIASAFSIPKTTVIKIGLIFSNVQ

SEQ ID NO: 144915 - protein, 54 aa, Heterodera glycines
  Coding regions on vcDNA: vcDNA=SeqID_71338; Strand=+; Position=1 -20,51-195
MNEMVILFWHCVFALEFVVVKDLSSVWILDLEFDATAFEHFDLLWPRVGQITDY

SEQ ID NO: 144916 - protein, 38 aa, Heterodera glycines
  Coding regions on vcDNA: vcDNA=SeqID_71339; Strand=+; Position=1 -20,51-147
MTELVILFWHCVFALGFAVVKDLSSIWILDLDFDATAF

SEQ ID NO: 144917 - protein, 40 aa, Heterodera glycines
  Coding regions on vcDNA: vcDNA=SeqID_71340; Strand=-; Position=1 -24,555-653
MFMQRREEKNFPYSNSAKLRDLKSTVDLLTSITFFRMKVG

SEQ ID NO: 144918 - protein, 75 aa, Heterodera glycines; identical to SEQ ID NO: 129999
  Coding regions on vcDNA: vcDNA=SeqID_71341; Strand=+; Position=1-225

SEQ ID NO: 144919 - protein, 77 aa, Heterodera glycines
  Coding regions on vcDNA: vcDNA=SeqID_71342; Strand=-; Position=1 -53,215-395
MRSVKHGGKKGMRFRYKLNLEFDLEFYFHFKYIDQQAQQIDTINSCRFFNTFSSLIKKAWQTQLSSRQNLSAMGTGL

SEQ ID NO: 144920 - protein, 31 aa, Heterodera glycines; identical to SEQ ID NO: 134217
  Coding regions on vcDNA: vcDNA=SeqID_71343; Strand=+; Position=1-93

SEQ ID NO: 144921 - protein, 150 aa, Heterodera glycines
  misc_feature (7)..(7): Xaa can be any naturally occurring amino acid
  misc_feature (146)..(146): Xaa can be any naturally occurring amino acid
  Coding regions on vcDNA: vcDNA=SeqID_71344; Strand=-; Position=1 -196,435-526,569-672,714-735
  Homolog annotation: Hit_ID=NP_509747.1; Match level="QueryCoverage =76%, HitCoverage=9%, E-value=9e-46, Identity=76%"; Hit description =abnormal cell MIGration MIG-15, serine threonine protein kinase involved in cell migration and signal tran
YSFEGFXYPNLKSFKNSESLIMNLTLILTNKGRHLKTQALAAIKIMNINEDEEEEIKAEINMLKKYSHHPNIATYYGAFIKKLPSSTGKHDQLWLVMEFCGGGMEFCGGGSVTDLIKSFEGGYLKEEWIAYVCKEILRGAHLHRGXAHLH

SEQ ID NO: 144922 - protein, 267 aa, Heterodera glycines
  Coding regions on vcDNA: vcDNA=SeqID_71345; Strand=-; Position=1-802
  Homolog annotation: Hit_ID=AAM77229.2; Match level="QueryCoverage =100%, HitCoverage=10%, E-value=1e-129, Identity=87%"; Hit description=insecticidal toxin A2 [Xenorhabdus nematophila]
MAQLSLSVQTLRLSEAELSVLVISGFTVLGVRSQPAGQHNIDTLFSLYRFHQWINALGNLSSDTLDMLRQQTLTADRLASVMGLDISMVTQAIACADVSSLQSWQNINAVLQWMDVASELHTMPSVIRRLVNIRYVTVPNKAESDLPSWDEWQTLAENMEAGLSTQQAQALADHTAERLSSVLCHWFLANIQPEGIFLQSRDDLYSYFLIDNQVSSAIKTTRLAEAIAGIQLYINRALNRIESNARADVSTRQFFTDWAMNIRYSTW

SEQ ID NO: 144923 - protein, 146 aa, Heterodera glycines
  Coding regions on vcDNA: vcDNA=SeqID_71346; Strand=+; Position=1 -154,245-345,593-757,948-968
  Homolog annotation: Hit_ID=XP_526729.1; Match level="QueryCoverage =93%, HitCoverage=28%, E-value=4e-18, Identity=37%"; Hit description =PREDICTED: similar to hypothetical protein FLJ20534 [Pan troglodytes]
MSNYGPDYLQMLKKRRAKESLGMPFHGIGIKVPVNNKGIGYRPLSDDAKENAQLKRNIETMGTTDNEEKKAELKEKFYQMYSWVQFANDEMDFGMGLEFGHDLFMSNYACFDGMAKSVLMTSYELLGRKQFATLLEKHMEFGVCFW

SEQ ID NO: 144924 - protein, 24 aa, Heterodera glycines
  Coding regions on vcDNA: vcDNA=SeqID_71347; Strand=-; Position=1-72
MTAEDAFITNAKVAATDRFLCDPS

SEQ ID NO: 144925 - protein, 201 aa, Heterodera glycines
  Coding regions on vcDNA: vcDNA=SeqID_71348; Strand=-; Position=1 -135,187-267,647-907,962-1090
  Homolog annotation: Hit_ID=NP_496289.2; Match level="QueryCoverage =42%, HitCoverage=69%, E-value=2e-14, Identity=44%"; Hit description =TBP-Associated transcription Factor family member (14.3 kD) (taf-13) [Caenorhabditis elegans] emb|CAA9011
MIDESCLFDSEEEEDEEAKKKTPEERKYLFRKELRSMLFGFGDERNPNDDTLEALEQIVVEYVKEVCRKALELRNASKYADERLNSKALAIELQNARTFLTILLPFIVPLLSGLIILLTIYHFLTTQIAQLRTEFSQTKSELALQFADTKLDLTTQIGQVNRRFEHEFTDMKHQFAEVCKKMDEILVQTKKSKKFSVFRRE

SEQ ID NO: 144926 - protein, 220 aa, Heterodera glycines
  Coding regions on vcDNA: vcDNA=SeqID_71349; Strand=+; Position=1 -93,191-761
RFPTKKASSTLVFPAKFKLSAVPMTSRNVSKNIAWCEAAQKTANGKRKKGEGPIPSWPGEPFSLDLLVEQGLIEVGAGRFGPQIRPWLQCSVNGFQFCEFAARDDFSQLGAVSVGGDIQLNSLEVSTAEGPAIAHEGGDKGPREADEENAQEQPPIVMPAHPEPQPVPAEPTPQQPQPPPAQGPLVSHTINPFRYAVDEGIFESFAVGALPSSAPCVASD

SEQ ID NO: 144927 - protein, 48 aa, Heterodera glycines
  Coding regions on vcDNA: vcDNA=SeqID_71350; Strand=+; Position=1 -69,351-428
MYVQYSSNWWVFPCRSLSGSVGYAENKYPEFSRSLITNMIIILAYSEP

SEQ ID NO: 144928 - protein, 239 aa, Heterodera glycines
  Coding regions on vcDNA: vcDNA=SeqID_71351; Strand=+; Position=1 -369,419-769
MNAKIIRVPKIACDLSLEKNGVSKNRNYAQKASQTILAHPIPSTIAFIHPIMSAKIIRVPKIACDLRLEKNGVSKNRNYAQKASQPILAHPIPSTIAFIHPIMNAKIIRVPKIACNLSLEKNGRIQFLSTIAFIHPIMSAKIIRVPKIACDLSLAKNGVSKNRNYAQKAPQTILALPIPSTIAFIHPIMNAKIIRVPKIACDLRLEKNGVSKNRNYAQKASQPILAHPIPSTSPLYIPL

SEQ ID NO: 144929 - protein, 32 aa, Heterodera glycines
  Coding regions on vcDNA: vcDNA=SeqID_71352; Strand=+; Position=1 -45,86-139
MESNHMFNQGRMLQCVVFWVADFKYGTISVNF

SEQ ID NO: 144930 - protein, 53 aa, Heterodera glycines
  Coding regions on vcDNA: vcDNA=SeqID_71353; Strand=-; Position=1 -97,569-599,651-683
FTKYRPVIFRHIREELSGSTEISAPAPTKTQTKNNRVDWKKERITNQETFGQM

SEQ ID NO: 144931 - protein, 71 aa, Heterodera glycines
  misc_feature (24)..(24): Xaa can be any naturally occurring amino acid
  Coding regions on vcDNA: vcDNA=SeqID_71354; Strand=-; Position=1-912
GYFRLNITNSEFHEASLHSFLVLXNCLKCIPKNALKMIKPVFSRISCQYFPIRNDTVNSFASLIHSCFASD

SEQ ID NO: 144932 - protein, 98 aa, Heterodera glycines
  Coding regions on vcDNA: vcDNA=SeqID_71355; Strand=-; Position=1 -47,107-353
MSDRRKEGEEKMAKAIFISADCWLSVFDLLTPSQLGLGIALISHRFDFYVDEHFKTRKWALKIIRIERKIGENGTKQMEITNDNRKSLPIPKMQLPRK

SEQ ID NO: 144933 - protein, 63 aa, Heterodera glycines; identical to SEQ ID NO: 137894
  Coding regions on vcDNA: vcDNA=SeqID_71356; Strand=-; Position=1-485

SEQ ID NO: 144934 - protein, 26 aa, Heterodera glycines
  Coding regions on vcDNA: vcDNA=SeqID_71357; Strand=+; Position=1 -36,97-141
MEEEKRGKQREKFNATPMQDNSCLLS

SEQ ID NO: 144935 - protein, 167 aa, Heterodera glycines
  Coding regions on vcDNA: vcDNA=SeqID_71358; Strand=-; Position=1-504
  Homolog annotation: Hit_ID=NP_620256.1; Match level="QueryCoverage =87%, HitCoverage=56%, E-value=6e-21, Identity=42%"; Hit description =phosphatidylinositol glycan, class L [Rattus norvegicus] gb|AAH74020.1| Pigl protein [Rattus norvegicus]
MFFGPTLLFLSSIGVQLHLLCITSGNSEGLGTIRRNELYSSASVYGIQPKYISFVDPEERRFPDGFRDWNITSLSALIYSYIRRLKPDGLITFDEWGISGHPNHRDSFKAILNLNTEGKLKELGLKTALALKSVAVLRKYVGAVDLFLNEFVMSDGNTFVTYSANPL

SEQ ID NO: 144936 - protein, 54 aa, Heterodera glycines
  Coding regions on vcDNA: vcDNA=SeqID_71359; Strand=+; Position=1 -93,141-212
  Homolog annotation: Hit_ID=NP_490985.1; Match level="QueryCoverage =98%, HitCoverage=33%, E-value=7e-09, Identity=47%"; Hit description =small membrane protein 1 (17.4 kD) (1D38) [Caenorhabditis elegans] gb|AAF60878.1| Hypothetical protein Y7
MAGCLDALPHQAHFDWDTKRNTYSAVASGFLFFLAWWLMIDTAVTAQKAHWTNW

SEQ ID NO: 144937 - protein, 74 aa, Heterodera glycines
  Coding regions on vcDNA: vcDNA=SeqID_71360; Strand=+; Position=1 -92,137-269
  Homolog annotation: Hit_ID=CAE60387.1; Match level="QueryCoverage =89%, HitCoverage=42%, E-value=2e-19, Identity=60%"; Hit description =Hypothetical protein CBG03988 [Caenorhabditis briggsae]
MRNSSQLGARLWLMFGFIGSFACIVAGVWVMFGDFVLKEGQNDNWPGIALFLHTFFIFVASLVYKFGRTEELWE

SEQ ID NO: 144938 - protein, 180 aa, Heterodera glycines
  Coding regions on vcDNA: vcDNA=SeqID_71361; Strand=+; Position=1 -148,190-328,374-411,459-586
  Homolog annotation: Hit_ID=NP_490986.2; Match level="QueryCoverage =100%, HitCoverage=24%, E-value=5e-38, Identity=53%"; Hit description= abc transporter (1D44) [Caenorhabditis elegans]
MPFIGVGPGGATPSGLEMAKRLARHVWPKGQWRVKGRVLFAFSLLIAAKLLNATVPFLLNATVPFVLRDIVDFFNGKLPAELSLGFALPGEAILSAGIALIIAYGAARGGAARGGTSLFNELRNAVFARVAQRSIRDILRNAVFARVAQRSIRDISRNIFLHLHSLDMSFHLNRQTGALS

SEQ ID NO: 144939 - protein, 113 aa, Heterodera glycines
  Coding regions on vcDNA: vcDNA=SeqID_71362; Strand=-; Position=1 -190,238-387
VSIAFGQCTNYAELEQTLFEMCQANGQMHYRMKVWFQAENWLCVKHSVVDTILMANSNLKRRGPRSAGDLSLMTPRLKKHSFHNETFDRYDRRECIEVVWMKLMQAVITWMKQ

SEQ ID NO: 144940 - protein, 253 aa, Heterodera glycines
  Coding regions on vcDNA: vcDNA=SeqID_71363; Strand=-; Position=1-760
  Homolog annotation: Hit_ID=NP_057417.2; Match level="QueryCoverage =98%, HitCoverage=10%, E-value=4e-10, Identity=33%"; Hit description =splicing coactivator subunit SRm300 [Homo sapiens] dbj|BAA83718.1| RNA binding protein [Homo sapiens]
RARSVPIRGGSPTAVKSRVRSVPIRGGSPTAVKSRVRSVPIRGGSPTAVKSRVRSVPIRGGSPTAVKSRARSVPIRGGSPTAVKSRVRSVPIRGGSPTAVKSRARSVPIRGGSPTAVKSRARSVPIRGGSPTAVKSRARSVPIRGGSPTAVKSRARSVPIRGGSPTAVKSRARSVPIRGGSPTAVKSRVRSVPIRGGSPTAVKSRVRSVPIRGGSPTAVKSRVRSVPIRGGSPTAVKSRARSVPIRGGSPTAG

SEQ ID NO: 144941 - protein, 75 aa, Heterodera glycines
  Coding regions on vcDNA: vcDNA=SeqID_71364; Strand=-; Position=1 -21,163-369
MPKKAFKADEALRGTSIENNFFLAKCYQHLNEKEKAIEYFGKLLTLEPNNLYEAERQKLTVEILTKEFKMNPLKL

SEQ ID NO: 144942 - protein, 82 aa, Heterodera glycines
  Coding regions on vcDNA: vcDNA=SeqID_71365; Strand=-; Position=1 -149,420-519
MALAKLKTSVFAIFVVLFVSIDKCRCTNILFTFFHDTGSHFQSVFPLMQNLNVTLPMTFGHAVFPPLIWPFILGHVTRNSEF

SEQ ID NO: 144943 - protein, 18 aa, Heterodera glycines
  Coding regions on vcDNA: vcDNA=SeqID_71366; Strand=-; Position=1 -3,306-359
MFFLNLDLIWTKTSKIKD

SEQ ID NO: 144944 - protein, 308 aa, Heterodera glycines
  misc_feature (300)..(300): Xaa can be any naturally occurring amino acid
  Coding regions on vcDNA: vcDNA=SeqID_71367; Strand=-; Position=1 -153,207-320,371-428,724-820,868-959,1011-1130,1303-1439
  Homolog annotation: Hit_ID=CAE57447.1; Match level="QueryCoverage =94%, HitCoverage=68%, E-value=5e-62, Identity=43%"; Hit description =Hypothetical protein CBG00409 [Caenorhabditis briggsae]
CDEKPLWESLMGHGFLVLFCFALIGNCINLLIYNSDQIRFFIAIRMLCTKLLMNTLMNTCMMVVMVPQALRVIRFWDIGGSTDILYWTFWPYQAYLTNVFGFAYLTNVFGFCAMWLTVLMTAECYIHIFFPSKSKTLCTKQTVWRSYLVIFFAALILASIYPLNRTVSLSNRCNRTIALILASIYPLNRTVSLSNRCNRTIVKINTSQNFVMGFFEKVHTLADLFVMGFFEKVHTLADLLLSILLPLTLLVSFLNSICHTVPLQRKKRENHFAAEKRGVTRIGLITCFIQVPPPGGGFVXSALSLQLL

SEQ ID NO: 144945 - protein, 247 aa, Heterodera glycines
  Coding regions on vcDNA: vcDNA=SeqID_71368; Strand=+; Position=1 -137,186-409,461-534,596-904
MNKLFFPLVNLYKDNSLQLMHEKLKNQQLDTWEQLQNAILKEKEARKQKMEELMSQQRNKSSTKIVNKLTRKSIKNHSKKQLETNLEKGSESFEGVQVPILNLAKDGQKCQTFLTEGPNDDIGMDSDIEYGTESKMLKPNPQKERKIDYHYFYRFDANAIICRYCPYCRPTQKRFKPTNALKSHLKTQHMSVLKQYRRSNYILKEDSGKEQKEGGTIKTPAKQWEGSSLKNLEDTTDEAKFRKYLNF

SEQ ID NO: 144946 - protein, 49 aa, Heterodera glycines
  Coding regions on vcDNA: vcDNA=SeqID_71369; Strand=+; Position=1-149
MCRSRSSSFCSRRRFSTNSGLDSVRANGANVPQSGEIGGNNAADGTESY

SEQ ID NO: 144947 - protein, 333 aa, Heterodera glycines
  Coding regions on vcDNA: vcDNA=SeqID_71370; Strand=-; Position=1-999
MIVDRLPDIKGNEGSDLIRNFFKKYSQYTIDWPNKKRIESLEAKLSGRAERAYNAALASEPFAYENIKRSILQQLEETDCREMSAFNDLMNGVLRKSSENLDDLADRISSLVRRAYPGLTRNLADEYSIKHLIRSLNNPELALSLELHRRNGMSFDEFMALASRAETTQKAAKIQNGERSKPYYERNFQHTHQGERNSEMISKNFSPRPICYNCNEPGHISRNCNKAGVQSNRNAPAFFPRNQQQQQFHNSPATGANRIVQNSKNGVTPAVRSQNFLKQNCIRMEEEVKTDATDATVAGVKLEKEVIEYLRDELEKSETFCSGFEPNAMIGKM

SEQ ID NO: 144948 - protein, 45 aa, Heterodera glycines; identical to SEQ ID NO: 124527
  Coding regions on vcDNA: vcDNA=SeqID_71371; Strand=-; Position=1-138

SEQ ID NO: 144949 - protein, 95 aa, Heterodera glycines; identical to SEQ ID NO: 128210
  Coding regions on vcDNA: vcDNA=SeqID_71372; Strand=+; Position=1-679

SEQ ID NO: 144950 - protein, 683 aa, Heterodera glycines
  Coding regions on vcDNA: vcDNA=SeqID_71373; Strand=+; Position=1 -74,130-600,1041-1248,1291-1851,1899-2160,2200-2518,2561-2715
  Homolog annotation: Hit_ID=NP_507780.1; Match level="QueryCoverage =58%, HitCoverage=30%, E-value=4e-39, Identity=28%"; Hit description =predicted CDS, DNA polymerase type B, organellar and viral family member (5T899) [Caenorhabditis elegans]
MAAKRNGTSQQSGPSTKKWDFRSIGNNFTEEMETFKLVDYRSTICEKFGFTKNIVEFTINPDVGRPDKAMQDAVDTMIQVAFKNTEERMMRKVRMFGVAITGAGLAFPVWVPYRAYPQNNAEVIMQEINKLGQSGDGEENKKMLLLSEPITMKITCVTMPSGEGPRNVHKFDFGFKEHQRIGITNADKLCLFYALVASKFYLELHVDSFRRFMKNIVRQRDAAIELLHNCGIDINEYSYGVEQLPNVQKYWDEIYPGKYRVVAFEKSADPRKSIRVLWKGPMGRENVVPIFLENGHWDGLKNYVCFFNRGRKFCIDCECFFDKDVKHTFECRARCYYCNRVRGMPCEKESGVKIECPKCHRYFYNWECYNYHHGHQTCKLWRRCVICDKTYRFNPKKEHECGETYCQLCSVSHDPKRGCYIMPIEEKEEKDVYRIVVWDSETSQDSIYKGDQKEHVINYISVRVTCTECCDDKNRTNCKICGEERIKDWSEAEGHEPTKDFVEWILTAFTNYDTYIFAHNAGRFDGHFVFNYLCRTGKNPLPLINGLKIYEFKVQNSKKHSKLIWRDSCLLMPVKLESLKATFNLDCEDKPFFPYYYNKKENYGIRLEHLPPMEDYSPGSMNKDKFIKFEKWYNENKGAPFYLDEELRNYCRNDTEILLLSIIEFRRILINDITKGFDPLPRS

SEQ ID NO: 144951 - protein, 77 aa, Heterodera glycines
  Coding regions on vcDNA: vcDNA=SeqID_71374; Strand=-; Position=1-302
PSRGAARRGKKTPATIWEIGFGRRQLQSGPIGFGFETPPIVDFLWGGNFKGLHPSHRHGLVRETPATNPQPFGTIYY

SEQ ID NO: 144952 - protein, 85 aa, Heterodera glycines
  Coding regions on vcDNA: vcDNA=SeqID_71375; Strand=-; Position=1 -39,360-561,806-822
MTRSSVRSRGCPSVCNIKTQGIELVTAALPSLSNEAFQHLHNEFKLLHNKNIADSIIGCEQTSAEDGTTTTTTPKCSLGEAKIGI

SEQ ID NO: 144953 - protein, 51 aa, Heterodera glycines
  Coding regions on vcDNA: vcDNA=SeqID_71376; Strand=+; Position=1 -138,659-676
MQQNTGEREDRKKRGGEGEGAAEGEANARGDKRREKGRAAKDAPTEYTEGN

SEQ ID NO: 144954 - protein, 419 aa, Heterodera glycines
  Coding regions on vcDNA: vcDNA=SeqID_71377; Strand=+; Position=1 -1044,1811-2026
MISPGHHQDHFSNPSFGSPSYNSSPDEEEQNRRQEQSSSPSLSEIEEKDHTFLKIDVETEKESSPQQMRSAGGGIFPQNSANFHRYNVNDHRATVKMETTAEMGGDGEKCGCIGEMPPTSCAENAIPTSAHAPPISIPSSMPPFPSNPSQQPQHTVSTTIFQQQWFTQWLANNPFFASALDGYLNNNNSNISAIGGGGGIKGLLTHTQQQQHSNVASHNHSSSQMAMLQALIAAATSSTSASPSFGNYSSVVNASTPMSNGGFKLAPQQQHQPPPKKAKTATGGGKGKASANVAAADASHHRRQQQKDTKIDGGIGATTDNDLLSVHIPHNHFHSPFSSNGSANSPTSQDTPTTVTSKGSGEFSGKKSRGKAERIRQIVTRITTAAEEVAEEKVREELIDCARQLQLVTSSAEEKDEEA

SEQ ID NO: 144955 - protein, 80 aa, Heterodera glycines
  Coding regions on vcDNA: vcDNA=SeqID_71378; Strand=-; Position=1 -87,167-321
PNVFPPAPLLRSTAALPSLLNVTPTQSAGLLPSSNLQSLLGEVPSLLKNRGHQLFAVPPNIPPLRLFDVHEQKQPLPNGF

SEQ ID NO: 144956 - protein, 192 aa, Heterodera glycines
  Coding regions on vcDNA: vcDNA=SeqID_71379; Strand=-; Position=1 -243,334-509,655-814
  Homolog annotation: Hit_ID=CAI11587.1; Match level="QueryCoverage =73%, HitCoverage=14%, E-value=7e-10, Identity=32%"; Hit description =novel protein [Danio rerio]
QQSIEIVNAFLGNHQKNPTAPLNNTILSQLTNKHSENVPSLTANLAPSAEQQQPLPVPPLPSETSSMDTFMVPPPPPPPVRACQNSQCLADSPMDIEDDQDEVETSEKERNAKECEKKGRNKKVQMADELMKRALRPYFKRRRITKDEYKEIMIKGVAKLKKRHSLKAEKVEKFVSKYVQLVAAKRKNQFGY

SEQ ID NO: 144957 - protein, 132 aa, Heterodera glycines
  Coding regions on vcDNA: vcDNA=SeqID_71380; Strand=-; Position=1 -54,214-558
MIKLKFHSVHTRNVLIDQNLSQAQSPVDRRSFIVHAKTSVTVADHQQQRHTFNQLPQPWRVHNDLTDEVLLFEHVITNQQQQRVIYLLRLRRCHANQLKDADKFYAKHFEDFLFFKDHPCKGFVESPKLILG

SEQ ID NO: 144958 - protein, 154 aa, Heterodera glycines
  Coding regions on vcDNA: vcDNA=SeqID_71381; Strand=-; Position=1 -74,206-401,488-547,637-716,894-933
  Homolog annotation: Hit_ID=CAE68756.1; Match level="QueryCoverage =99%, HitCoverage=14%, E-value=2e-57, Identity=71%"; Hit description =Hypothetical protein CBG14689 [Caenorhabditis briggsae]
IPQFRLPYNVVDFEIQLAKDIGVKIETGRSLHRDDLTLDRLQKQGVKAVFIGIGMPEPKRAPMFDGLTPENGFYTSKDFLPLVAKASKSGMCHCAKTQLPRLSGRVIVLGAGDTAAGDTAFDCATSALRCGALRVTVVFRKGFTSIRAVPEEVN

SEQ ID NO: 144959 - protein, 30 aa, Heterodera glycines
  Coding regions on vcDNA: vcDNA=SeqID_71382; Strand=+; Position=1 -64,264-292
MYSKAYVLFMDFMLICTKKPNEVQEIFNNK

SEQ ID NO: 144960 - protein, 109 aa, Heterodera glycines
  Coding regions on vcDNA: vcDNA=SeqID_71383; Strand=+; Position=1-331
LLLLLIAQAVQNKMNFPGTETFREMPIIHQQKKQEVVDSDDESTTSFSSSYSSSSSSSSSTECQSPLLKLGGRTLFNKPTICRKVAITKHSWTKGTAEANLNKNAVPIV

SEQ ID NO: 144961 - protein, 77 aa, Heterodera glycines
  misc_feature (74)..(74): Xaa can be any naturally occurring amino acid
  Coding regions on vcDNA: vcDNA=SeqID_71384; Strand=-; Position=1 -146,380-466
  Homolog annotation: Hit_ID=NP_495878.1; Match level="QueryCoverage =94%, HitCoverage=38%, E-value=3e-27, Identity=73%"; Hit description =integral membrane protein -related (22.6 kD) (2J103) [Caenorhabditis elegans] emb|CAA91047.1| Hypothetica
KMWLSTMKSTLVVFGCTFFEMFDIPVFWPILVMYFIVLTTLTMKRQIMHMIRYRYIPFTFGKPRPQGKEETGKXTHI

SEQ ID NO: 144962 - protein, 70 aa, Heterodera glycines
  Coding regions on vcDNA: vcDNA=SeqID_71385; Strand=-; Position=1-213
MPQQAQFPILQQRLDIAFQLVELERRLGWGEDVQDEINALQQQMQQLLEQLQNLVARGSTGSETILLIRL

SEQ ID NO: 144963 - protein, 63 aa, Heterodera glycines
  Coding regions on vcDNA: vcDNA=SeqID_71386; Strand=+; Position=1 -67,145-227,285-326
MLLIQAALFYLPKWTQEKLLQKSCLLTNAVAQFAVVNALTGRGHRWWGIEQIYVFSKRIILSK

SEQ ID NO: 144964 - protein, 29 aa, Heterodera glycines
  Coding regions on vcDNA: vcDNA=SeqID_71387; Strand=-; Position=1 -66,123-146
MAIYFFEKFSMQQTLSNMKRSAKNGYLFF

SEQ ID NO: 144965 - protein, 29 aa, Heterodera glycines
  Coding regions on vcDNA: vcDNA=SeqID_71388; Strand=-; Position=1 -66,123-146
MAISFFEKFSMQQTLSNMKRSAKNGYLFF

SEQ ID NO: 144966 - protein, 29 aa, Heterodera glycines
  Coding regions on vcDNA: vcDNA=SeqID_71389; Strand=-; Position=1 -66,123-146
MAISFFEKFSMQQTLSNMKRSAKNGYLFF

SEQ ID NO: 144967 - protein, 120 aa, Heterodera glycines
  Coding regions on vcDNA: vcDNA=SeqID_71390; Strand=-; Position=1 -157,496-622,830-905
  Homolog annotation: Hit_ID=CAE66567.1; Match level="QueryCoverage =80%, HitCoverage=2%, E-value=4e-29, Identity=53%"; Hit description =Hypothetical protein CBG11882 [Caenorhabditis briggsae]
MLSQPFFWMNFPFFLKDHLKHPCLGHNCAHFCFAVPSSDQSAPLKRKCACKQGYKVNPNNELACIRDIMEPVEPLCPRNGSQFQCANGRCIPLEWRCDGEDDCLDGSDEIDENTQASCYK

SEQ ID NO: 144968 - protein, 153 aa, Heterodera glycines
  Coding regions on vcDNA: vcDNA=SeqID_71391; Strand=+; Position=1 -25,97-192,239-579
MAPGVRSQGLKQTETVPTADGEGTSTQAAESGPSTSALDLRPRSSPRPLSATPIRRHERVRPTTTEKATHMDLTTMDKATDVDLAYEDAATQTKQLDKQLKEQEQVISFLQQQVRNRDALIADLRRRLEQQAKDQPTRKFCRIFRAIYHPNCF

SEQ ID NO: 144969 - protein, 71 aa, Heterodera glycines
  Coding regions on vcDNA: vcDNA=SeqID_71392; Strand=-; Position=1 -197,294-312
MLISKTIQKFQNHVSEHFALVQLCQQFGTMLSNVIPAFRPLDKPLGVGGIGILSLLVLCSSGCWQRIFLNF

SEQ ID NO: 144970 - protein, 207 aa, Heterodera glycines
  Coding regions on vcDNA: vcDNA=SeqID_71393; Strand=-; Position=1 -34,128-195,590-787,847-970,1258-1298,1358-1424
  Homolog annotation: Hit_ID=CAE68855.1; Match level="QueryCoverage =89%, HitCoverage=85%, E-value=5e-62, Identity=66%"; Hit description =Hypothetical protein CBG14817 [Caenorhabditis briggsae]
KEMRRVDEEMQRLRHEFEGYRPAASRSSPYTTAGEENGNFGTQKSHPDSTCAPQGGGSSLSNGAGGGAMARHSPTYDPYLENLKSPLIKDESDGKTLRLRFDVAQYRPEEFDVAQYRPEEVTVKTVDNRLLVHAKHEEKTPSRTVYREYNQEFMLPRGTNPEQISSTLSTDGVLTVEAPLPQLAISTLSTDGVLTVEAPLPQLAIQN

SEQ ID NO: 144971 - protein, 127 aa, Heterodera glycines
  Coding regions on vcDNA: vcDNA=SeqID_71394; Strand=+; Position=1-384
MVDEVIKWWIRIACVYSTFLFLRDIVLPCTLAYLFNPVRVTFLSLMGVRRQPLQPMLGKTLRQEEVPLREVLRSPQPRTSPHRSLSPVHLDVIARSARYQQTRAQSDANLAEVDTPFGRRTRRREEH

SEQ ID NO: 144972 - protein, 200 aa, Heterodera glycines
  Coding regions on vcDNA: vcDNA=SeqID_71395; Strand=+; Position=1-603
MDNTAPKKFLTSFDQLQIPPEIDNDSTIPDYAKLLIKQLQSLLATASSLVQSQVTANDAIEEDRRQRTVVITNVPEFQSGKGSERGEADRALVNLILDTVDLDQTPVVFRVGMRTPNRARPLKMEFPTRHAARHVLRMKGKALALNALHGARIRESMTKEQLAERRKLIEQCAKKRKEDAGDWIIYANQVILRSDIDTNS

SEQ ID NO: 144973 - protein, 95 aa, Heterodera glycines
  Coding regions on vcDNA: vcDNA=SeqID_71396; Strand=-; Position=1-661
LFEYPKRTLEKIDFFVFGAVPPNRCAQIYGETESFRNSFPIACTLILRWIFAPHNCLSTPNGHLKKSIFLFSGQSPRTDAPRLMGRPNPSGIASL

SEQ ID NO: 144974 - protein, 231 aa, Heterodera glycines
  Coding regions on vcDNA: vcDNA=SeqID_71397; Strand=+; Position=1 -358,530-867
  Homolog annotation: Hit_ID=NP_498347.2; Match level="QueryCoverage =98%, HitCoverage=36%, E-value=3e-31, Identity=33%"; Hit description =proteasome Regulatory Particle, Non-ATPase-like, S1 (rpn-2) [Caenorhabditis elegans] gb|AAM81115.1| Prote
TSTSIIRQALDTYKDVQLSRGKVPSGLEDFVNRIFNQNLELKEYSLVVGFSSDTRRIDMIERTVNAVSKDGGSTTTILMDTLNKLYESHLDVEFHDQVLGLIIRFLECQKEPNYFALSQNNALMAYQLAFDLYENAPQEFLNQMKMHLFPSSPSTEEPKTETKTPEKEKLERILSGVETIKHHMQFLIKNNHTDMLILRQLKDASRVNCTHNAVVIANGLMHCGTTCDDFL

SEQ ID NO: 144975 - protein, 98 aa, Heterodera glycines
  Coding regions on vcDNA: vcDNA=SeqID_71398; Strand=-; Position=1 -102,288-482
MKLLSATPDSSISHDNSCQNERLALCDKINYFSNSHQRFTPAGHWSVAHRHHWAKRSLVPMALVVLLLLDNGAVKMHKQRDGWLMECVIMTIIRDMIN

SEQ ID NO: 144976 - protein, 678 aa, Heterodera glycines
  Coding regions on vcDNA: vcDNA=SeqID_71399; Strand=+; Position=1 -175,219-550,599-715,799-1303,1557-2464
MATDWIHNAYPEQALGGGGGDEPVNGNVNWLQIMDDDDDQNEKREMQSEVDEENKMKKAEIAKVIPRKCSCGGNGQSQQQQQPQQQREKTEMPLIEHLCERYKCSTKELEVLFQNLKSRRQILQHMRFNVRLRTNYLHPANRNFVVQCNDLSSLSASEAFAMRGYLGITVQTYFYVKHGVRLRHPNLPCAIRFGGRDHHDLFPMECLNKNNKLMLDIQNCTVTFKVLKRPLNKTEFLAIAHNGVNVEWNPRRFHAIIMRLRYTPRTVAALIFQSGRVVLTGVQHPDRAKKEAKRVLRRLRASLRCANIETTLLLLILRVVNIVGSHTFTHRIHITHLVPIMHSSTSFCSVHYDPTIFPALRCKIKLNDDDDDVYATSSEKSWNSIAESVDRKARDNNFQWPSTHEKGTWAAVAATGEESRARAQTGANVRDGNEMVQAEAISEREGGVALAAATKNALSERGSEVEQQHQQVVVMARGGAISNGDGARAKAEATGGAKSVVETRITEHHGEERLAAATAVIHREERREERRRKIRVRNRDRQQGGEERQRGEGHRQSHPNERHNDNFHSSLQLNLPPNRMNRREQDEHMHHSRDGLMGQSNNQQGEERQQGGGGHRQYRPTESPNDNFHSSLQLNLPPSRLEGREQEERIHHSRDGLMGQSNNQQMRKRIQRECFCTC

SEQ ID NO: 144977 - protein, 56 aa, Heterodera glycines
  Coding regions on vcDNA: vcDNA=SeqID_71400; Strand=-; Position=1-209
EKQLFLMEQNFQIFNVDDTKFRHPFTLTISGSTGSGKSEWVMRFLKNVDTLIPMGQ

SEQ ID NO: 144978 - protein, 84 aa, Heterodera glycines
  Coding regions on vcDNA: vcDNA=SeqID_71401; Strand=+; Position=1 -224,295-325
MLRHKLQMEDDVGAILFFLKELTQYSARIIVVCRNSQKVTFLALCPPMECQKQGELFQSIKQNLIESIGPYSFVGLDEPPAIKK

SEQ ID NO: 144979 - protein, 192 aa, Heterodera glycines
  Coding regions on vcDNA: vcDNA=SeqID_71402; Strand=+; Position=1 -178,222-622
MATDWIHNAYPEQALGGGGGGDEPVNGNVNWLQIMDDDDDQNEKKRDESEVDEENKMKKAEIAKVIPRKCSCGGNGQSQQQQQPQQQREKTEMPLIEHLCERYKCSTKELEVLFQNLKSRRQILQHMRFNVRLRTNYLHPANRNFVVQCNDLSSLSASEAFAMRGYLGITVGHINWIWYPHIIILNTVLKPL

SEQ ID NO: 144980 - protein, 59 aa, Heterodera glycines
  Coding regions on vcDNA: vcDNA=SeqID_71403; Strand=+; Position=1 -60,317-436
MFLVEFDLDLDPGLDFSWIQVQAWIQVSRSLDFSWTWIFLDFCPGNPGPGPGIFQNVEL

SEQ ID NO: 144981 - protein, 366 aa, Heterodera glycines
  Coding regions on vcDNA: vcDNA=SeqID_71404; Strand=+; Position=1 -200,403-547,624-823,1088-1259,1310-1471,1512-1733
  Homolog annotation: Hit_ID=NP_726651.1; Match level="QueryCoverage =30%, HitCoverage=21%, E-value=1e-38, Identity=64%"; Hit description =CG17743-PB, isoform B [Drosophila melanogaster] ref|NP_524630.1| CG17743-PA, isoform A [Drosophila melano
MTNSDPSLATSAFLTTNFDSTMDPLFSPPPAPIVPILTAEEGNTLMSAGDSNDPPELRHWANIGETNHQPKHLSTQKKTNVKRRDRRRSSAFVPSARSKEELESLLNGNIDPNKPVRNVLVEAGIGAEFGLRLKSSSTLPTLFERNFVPAIEVPKCRGNISKGRRSMELAKAMGQEEGERSGCVPSSTHLLNNLGPSSSMEEQRTKRKNRTESVQKMDQPMLSSQLFTQKIPCSYKGCQKTFVKQSAMRKHLQIHGPRQHICQQCSRSFIERSKLKRHLLVHSGEKRFVCDFEDCGKRFSLDFNLRTHIRTVHTGERPFQCPFCHKQFAQSANLRIHRRSHNCRPTVDGGKEKQKNGANRQKVTSC

SEQ ID NO: 144982 - protein, 44 aa, Heterodera glycines
  Coding regions on vcDNA: vcDNA=SeqID_71405; Strand=-; Position=1-133
MPHRHQSVGDDISFNNNQSKHSEIVENELLTVAERNGEELEMVP

SEQ ID NO: 144983 - protein, 28 aa, Heterodera glycines
  Coding regions on vcDNA: vcDNA=SeqID_71406; Strand=-; Position=1-84
MSAEEAARLSWMSAYESGKESGKLRISR

SEQ ID NO: 144984 - protein, 281 aa, Heterodera glycines
  Coding regions on vcDNA: vcDNA=SeqID_71407; Strand=+; Position=1 -393,452-849
  Homolog annotation: Hit_ID=NP_497599.2; Match level="QueryCoverage =91%, HitCoverage=45%, E-value=4e-57, Identity=31%"; Hit description =myotactin, LEThal LET-805 (479.6 kD) (let-805C) [Caenorhabditis elegans] gb|AAK21414.2| Lethal protein 80
LNSFYQQNYVLVYSLVRLSPSEALFDSVPGTRWEAKMLTQSVEPGEEPQRSKWSPRAVLLTRSSPTEIFLKVTPRDDPTQADAFWDLPADYEDWPWGVDLQYRLTRLGSCRKLSKADTEPVIMENVQDKQVLLDNLHPGSEYEVTVTLRQVLLDNLHPGSEYEVTVTLRQPPGVDRRVAPKKAVQRFQTADQPPSGAPNKLRVEGRWDTKLAFGWEPPECLEQNGEISQYEYELNGLDEWNQGTRQGVSPRTRADIGELLPGSLYRFRVRCFQKALCPIHS

SEQ ID NO: 144985 - protein, 253 aa, Heterodera glycines
  Coding regions on vcDNA: vcDNA=SeqID_71408; Strand=+; Position=1 -93,168-349,402-652,1016-1127,1173-1248
  Homolog annotation: Hit_ID=NP_497599.2; Match level="QueryCoverage =99%, HitCoverage=5%, E-value=3e-65, Identity=51%"; Hit description =myotactin, LEThal LET-805 (479.6 kD) (let-805C) [Caenorhabditis elegans] gb|AAK21414.2| Lethal protein 805
VDSLTMKTGGAKNYTVMVPGNSIKFTELQPDTIYTIYNITVQGGTDSGYGATVWGSWATLSLGKTWILRLKDRTPGSLTVEWDPVWGIAHRGYILTAKALTAKAIHSTHPHLRIGSMRTVDVPSTATELTIRGLEPTSTYNVTLQLKDQMDGAWSIYSTLQPGCFLPGDIRHCDQTPHATSMSWEPVLGAAATHYQVRYIHLHQIRTLWVEEPERHRKELLCPKDPCNLCPKDPCNRLCYLVFNLANPPEEYA

SEQ ID NO: 144986 - protein, 42 aa, Heterodera glycines
  Coding regions on vcDNA: vcDNA=SeqID_71409; Strand=+; Position=1 -99,246-275
MAIEREGNQKEKDKPGQVGTECKHRMETLSPKKTKLIIWVAY

SEQ ID NO: 144987 - protein, 295 aa, Heterodera glycines
  misc_feature (266)..(266): Xaa can be any naturally occurring amino acid
  Coding regions on vcDNA: vcDNA=SeqID_71410; Strand=+; Position=1 -161,215-437,465-755,824-882
  Homolog annotation: Hit_ID=NP_497598.2; Match level="QueryCoverage =98%, HitCoverage=5%, E-value=2e-50, Identity=41%"; Hit description =myotactin, LEThal LET-805 (497.5 kD) (let-805C) [Caenorhabditis elegans] gb|AAK21413.1| Lethal protein 805
ITSPLTATPFLAAGWPWWWLLLLLLLLLLCLLLCCLLAWLLAKCRLSRSSHSLLIFLLFHSLLSSLLIFLLFHSLLSSENAASDVNGRERERLLRDEKTEHYERSRGDFEDGYAHGYRAARAGGRAEEDYRGRDEAFRPTNPMFKEGYAKGLRDAGERGMSTSMANLARPTNPMFKEGYAKGLRDAGERGMSTSMANLAQRPTQRLGYSSGYMQGFRDGNSGVFGDRISESLLRRLEEQYPDNEEFRAGYIDGFKDGVSGGRVSEXTFRDSRRIQQTFRDSRRIQQSLTELTERL

SEQ ID NO: 144988 - protein, 102 aa, Heterodera glycines
  Coding regions on vcDNA: vcDNA=SeqID_71411; Strand=-; Position=1 -291,628-645
MPITKTETAATTTYDGSAQKTKPRQKTSTIKTGRTSTKPCRRDKRCGDGGDEAATSVGEIKGDGMAGGMGTRRGMPEGTRKDIEMTRKRRSTQREEGVNTKE

SEQ ID NO: 144989 - protein, 48 aa, Heterodera glycines
  Coding regions on vcDNA: vcDNA=SeqID_71412; Strand=-; Position=1 -82,242-306
MWRLKTAEQRKKYENLNKILLNSCFHQVVACRSDHKTGQWTTPRPSRS

SEQ ID NO: 144990 - protein, 72 aa, Heterodera glycines
  Coding regions on vcDNA: vcDNA=SeqID_71413; Strand=-; Position=1 -145,201-274
MCLRKLSCDFSKRAIGCKWANPEGLAGDVNAWEIGVRKKQKDAANTLFDGDIALAQLHKNAPAYLVSETIQA

SEQ ID NO: 144991 - protein, 52 aa, Heterodera glycines
  Coding regions on vcDNA: vcDNA=SeqID_71414; Strand=-; Position=1-156
MPHVIEHKIRLLGSPSSPHRSPPPSEFGRYVELQKDKSWAEMPFERNDAKEK

SEQ ID NO: 144992 - protein, 263 aa, Heterodera glycines
  Coding regions on vcDNA: vcDNA=SeqID_71415; Strand=-; Position=1-793
  Homolog annotation: Hit_ID=XP_497907.1; Match level="QueryCoverage =63%, HitCoverage=62%, E-value=3e-20, Identity=46%"; Hit description =PREDICTED: similar to mKIAA1114 protein [Homo sapiens]
ISITGTQPTNISITGTQPTNISITGTQPTNISITGTQFSCISITGTQPKSIPITGLNPPTFQSLALNPPTFQSLALNPPTFQSLALNPPTFQSLALNPPTFQSLALNPPTFQSLGLNPPTFQSLALNPPTFQSLALNPTAFQSLALNPPTFQSLALNPPTFQSLALNPPTFQSLALNPTAFQSLALNPPTFQSLALNPQHFNHWHSTHQHFNHWHSTHSISITGTQPTNISITGTQPNSIPITGTQPTNISITGTQPSSIQSL

SEQ ID NO: 144993 - protein, 64 aa, Heterodera glycines; identical to SEQ ID NO: 129150
  Coding regions on vcDNA: vcDNA=SeqID_71416; Strand=-; Position=1-745

SEQ ID NO: 144994 - protein, 220 aa, Heterodera glycines
  Coding regions on vcDNA: vcDNA=SeqID_71417; Strand=-; Position=1-664
  Homolog annotation: Hit_ID=XP_497907.1; Match level="QueryCoverage =99%, HitCoverage=70%, E-value=2e-30, Identity=44%"; Hit description =PREDICTED: similar to mKIAA1114 protein [Homo sapiens]
NPTAFQSLALNPLTFQSLALNPPTFQSLALNPPTFQSLALNSPAFQSLGLNPRAFQSLLNPPTFQSLALNPPTFQSLALNPPTFQSLALNPPTFQSLALNPPTFQSLALNPPTFQSLGLNPPTFQSLALNPPTFQSLALNPTAFQSLALNPPTFQSLALNPPTFQSLALNPPTFQSLALNPTAFQSLALNPPTFQSLALNPQFQSLALNPPTFQSLALNL

SEQ ID NO: 144995 - protein, 64 aa, Heterodera glycines; identical to SEQ ID NO: 129150
  Coding regions on vcDNA: vcDNA=SeqID_71418; Strand=-; Position=1-861

SEQ ID NO: 144996 - protein, 163 aa, Heterodera glycines
  misc_feature (152)..(152): Xaa can be any naturally occurring amino acid
  Coding regions on vcDNA: vcDNA=SeqID_71419; Strand=-; Position=1 -46,180-629
  Homolog annotation: Hit_ID=AAP92584.1; Match level="QueryCoverage =84%, HitCoverage=27%, E-value=1e-35, Identity=59%"; Hit description =Ab2-057 [Rattus norvegicus] gb|AAP85373.1| Aa1262 [Rattus norvegicus] gb|AAP85367.1| Aa1011 [Rattus norveg
SSGSGGSMVAKLKLNAWPFLVRGAICLVYSDNERDSSLLNSWLIASGHNFLEGFSVFSRTKLSNNRSVMPLDVRGCTRATLAKSACLPSPKGVGKPVKICRDWDRTLQLLSVNEEFLVGASHQLALNTSLPFVHTARRCPGLSHFEKFGDGXCSGRSVCRLEP

SEQ ID NO: 144997 - protein, 72 aa, Heterodera glycines
  Coding regions on vcDNA: vcDNA=SeqID_71420; Strand=+; Position=1 -147,243-314
MLIGLREMSAKLRSDIKHNGPCSIDLCKPISVLVGSSISMLLFGHPLKERLAGRFKRFDLIEKAKKTSINSW

SEQ ID NO: 144998 - protein, 82 aa, Heterodera glycines
  Coding regions on vcDNA: vcDNA=SeqID_71421; Strand=+; Position=1 -6,195-437
MRKKDGNSAEDGGIKILRYDLTYEKLSEFDLDFDCVDTFEGVTLERVAMGCGQTENRLFLYDRTMVTGEIPFWQISLDWTKV

SEQ ID NO: 144999 - protein, 124 aa, Heterodera glycines
  Coding regions on vcDNA: vcDNA=SeqID_71422; Strand=-; Position=1 -39,320-457,583-780
  Homolog annotation: Hit_ID=AAH84657.1; Match level="QueryCoverage =85%, HitCoverage=23%, E-value=6e-21, Identity=49%"; Hit description =Unknown (protein for MGC:98289) [Xenopus laevis]
MVFSLEVHSLFLNLWSLSSESFSIFFVSRLIGGLSKASVSVAIAIVTDIMPTEERGKGMALIGGSFSLAFLIGPSIGAFFSIGARESGEFNPSPALLAIALTLAELALLVFFLPETLAKAKARL

SEQ ID NO: 145000 - protein, 81 aa, Heterodera glycines
  Coding regions on vcDNA: vcDNA=SeqID_71423; Strand=-; Position=1 -117,382-510
SDRRLRKSVPSSPQTILVLAGLFVCGLILLISGLIVLITDLFNVAANAAASEEKRASEEMAMVGGNKKLKRMLAQVPSTMI

SEQ ID NO: 145001 - protein, 44 aa, Heterodera glycines
  Coding regions on vcDNA: vcDNA=SeqID_71424; Strand=+; Position=1 -89,278-325
TDITTHSDKINKLTNAVDQIEVSMMSAAEAKREQNDKKPQKLFF

SEQ ID NO: 145002 - protein, 116 aa, Heterodera glycines
  Coding regions on vcDNA: vcDNA=SeqID_71425; Strand=-; Position=1 -94,144-295,336-445,509-626
SLFIFENMPTPICDTPSISGVKKDQFEATKKWRKALKNFHESMPLSTHRRQLRTFTETFTGKDALDFAEQIFPSVFPLCNTRDKSRQLLERFLCFGYITNVRDENCKSFSDNGHFV

SEQ ID NO: 145003 - protein, 243 aa, Heterodera glycines
  Coding regions on vcDNA: vcDNA=SeqID_71426; Strand=+; Position=1 -366,421-593,669-861
GYEGGVPEESLDFFRSPMFLLSERAASTEEPLASEAARPSENERQRKAAVIACHYQVIKGTENGERKAMAFVVGVKTKPDQVQIFFNDLIVCASDPVPLHWPSFCVPFARIFDLRVFERPEKIRIRLMERLSRMAKWQEIGEVFLPLLADHKTGTSADDNRKEEGSLVGLQFASTVHRGSFKDSLGCGGQAPFMQGRLFCALKSTSGKRGEKNEERKGQREKVGKGKSNERENDQKSKGDRNE

SEQ ID NO: 145004 - protein, 102 aa, Heterodera glycines
  Coding regions on vcDNA: vcDNA=SeqID_71427; Strand=+; Position=1-309
MDRKKTEILQKCRKRKFLDNNDSENEGNSEHREQNAENDGCDDDFEEERAIINFELLKMEAFVFGLKVGNLLEKDENLSKAFGTHTKKTTDGGALCVAAMPA

SEQ ID NO: 145005 - protein, 25 aa, Heterodera glycines
  Coding regions on vcDNA: vcDNA=SeqID_71428; Strand=-; Position=1-75
MGPLGAQTFNAWVQSQATLASYPFR

SEQ ID NO: 145006 - protein, 318 aa, Heterodera glycines
  Coding regions on vcDNA: vcDNA=SeqID_71429; Strand=+; Position=1 -430,480-765,1106-1346
MTIFYEITNGENPAEGNNRKLTLKWLQNDGSAILCNENFQKIHENLRIKKTNGDEAFIEKAENNWNNFCAMFKNGKSIRKIETNLVERAKESVLNLETMPPALVKNIRKIAQNENFNAENKQKMAELLDQFIVGLNIFRKLVGDTFWTDKIVKHQQQLQLARRKRRANLIKSAECLFSIGLGALAATLGIVLGADLGQKRHNDVESYFELNERLEVAGIFLCFFLFVFCIVYICKTCRSQILSKNNFYSLRILKHPTIAPPSGIGGAQDNAKGMHGTKEGRTKCRLDHLRGKHCQAIGDTGNATPTNKCPASRRGKWT

SEQ ID NO: 145007 - protein, 33 aa, Heterodera glycines
  Coding regions on vcDNA: vcDNA=SeqID_71430; Strand=+; Position=1-117
MILGLGFLGKSLFFFLSSPWPETHEKHVFLGCC

SEQ ID NO: 145008 - protein, 151 aa, Heterodera glycines
  Coding regions on vcDNA: vcDNA=SeqID_71431; Strand=-; Position=1-641
LFEYPKRTLEKIDFFVFGAVPPNRCAQIYGETESFRNSFPIACTLILRWIFAPHNCLSTPNGHSLEKIDFFVFGAVPPNRCAQIYGETESFGNSFPIVCTLILRWIFAPHKCLSTPNGHLKKSIFLFSGQSPRTDAPRFMGRPNPSGIASL

SEQ ID NO: 145009 - protein, 196 aa, Heterodera glycines
  misc_feature (9)..(9): Xaa can be any naturally occurring amino acid
  Coding regions on vcDNA: vcDNA=SeqID_71432; Strand=-; Position=1 -197,246-339,599-678,742-896
  Homolog annotation: Hit_ID=NP_508844.1; Match level="QueryCoverage =73%, HitCoverage=39%, E-value=5e-41, Identity=57%"; Hit description =calumenin-like protein precursor (36.1 kD) (XF588) [Caenorhabditis elegans] gb|AAB04578.1| Hypothetical p
FKVCCINSXIINMTFFNILRTFFKKFSFLKSGKETDPKHDHEQFLGKDEARQYEELTPEKSKERLAKLVPKMDLNSDGQVDKLVPKMDLNSDGQVDELELEHINFMQKRYVNNDVERTWKNYKEEQLKNGLLDWQDYRNLIYGKPQNLIYGKPQEGQEISPEYVKMIERDERRWKVGSGPKRPANLLNREANGRIL

SEQ ID NO: 145010 - protein, 146 aa, Heterodera glycines
  Coding regions on vcDNA: vcDNA=SeqID_71433; Strand=+; Position=1 -354,463-636
  Homolog annotation: Hit_ID=EAL47145.1; Match level="QueryCoverage =95%, HitCoverage=83%, E-value=1e-13, Identity=27%"; Hit description =transcription initiation factor TFIID, putative [Entamoeba histolytica HM-1:IMSS]
MQKPIIVNIIALANLGTGIKLNSLTITECEFKYNPRKFNAAVIKCTTPIKATALLWESGKMICLGTKSLIDCENAIKKFIEIIKGSGCPGASYTGLNFKRGKSMTALIFWTGKVVITGTKNNSEIKEMYHHILPYLKMAQKKLGRR

SEQ ID NO: 145011 - protein, 50 aa, Heterodera glycines
  Coding regions on vcDNA: vcDNA=SeqID_71434; Strand=-; Position=1-201
FSKRIFNFRIRKIIIKKFRIEKIKPAQKVWDQKDLNLQKKKLNFLHLSLW

SEQ ID NO: 145012 - protein, 251 aa, Heterodera glycines
  Coding regions on vcDNA: vcDNA=SeqID_71435; Strand=-; Position=1 -343,418-830
MSARIIRVLKIACDLSLAKNGVSNNRNYAQKAPQTILALPIPSTIAFIHLIMNAKIIRVPKIACDLRLEKNGVSKNRNYAQKASQPILAHPIPSTIAFIHPIMSAKIIRVPKIASHPIPSTIAFIHPIMNAKIIRVPKIACDLSLAKNGVSKNRNYAQKASQTILALPIPSTIAFIHPIMSAKIIRVPKIACDLSLEKNGVSKNRNYAQKAPQTILALPIPSTIAFIHPIMNAKIIRVPKIACDLRLKKMV

SEQ ID NO: 145013 - protein, 75 aa, Heterodera glycines
  Coding regions on vcDNA: vcDNA=SeqID_71436; Strand=-; Position=1 -129,343-441
MIYNSDRRGATVIKRGTTVIRRGTTVIRRGTAVIRRGTTVLEEAIFEEKFCPSENQKGLPLGQEIRNNFSGDNFF

SEQ ID NO: 145014 - protein, 28 aa, Heterodera glycines
  Coding regions on vcDNA: vcDNA=SeqID_71437; Strand=+; Position=1-85
NHCCPSSNHFCTSSNHFCTSSNHFLPLL

SEQ ID NO: 145015 - protein, 95 aa, Heterodera glycines; identical to SEQ ID NO: 143146
  Coding regions on vcDNA: vcDNA=SeqID_71438; Strand=+; Position=1 -410,575-992

SEQ ID NO: 145016 - protein, 87 aa, Heterodera glycines
  Coding regions on vcDNA: vcDNA=SeqID_71439; Strand=+; Position=1-263
SADDYYALRLLYNLPVGFAIALLIYHLAWYRINFADSILINPFWKEFVKWLMIVSAALSYSLNPVGGGDVLQQLMLASTLMVTSFSV

SEQ ID NO: 145017 - protein, 181 aa, Heterodera glycines
  Coding regions on vcDNA: vcDNA=SeqID_71440; Strand=-; Position=1 -96,135-252,468-628,667-837
MPKQTEIVLKYSFLDLTWFLDIEAVFYAISKTKKCLVVKTIFHISLHNFVSSARIETGIRPLERAARALQEVKKLFEFLQFCFHNFRKLFGIIMPKQNEIVLKYSFLDLTWFLDIEAVFYAISKTKKCLVVKTIFHISLHNFVSSARIETGIRPLERAARALQEGMERKNSYFWDFFRNQN

SEQ ID NO: 145018 - protein, 93 aa, Heterodera glycines
  Coding regions on vcDNA: vcDNA=SeqID_71441; Strand=+; Position=1 -167,844-958
MLGERLKSCTGCECRRCCTLSGCCAMTENCLKNIHQKKGNKIRNTLSRIACRQTEGGAGGGVESSRGLNFCWAGFIGNTGCNAAIGFDVDIAC

SEQ ID NO: 145019 - protein, 129 aa, Heterodera glycines
  Coding regions on vcDNA: vcDNA=SeqID_71442; Strand=-; Position=1 -121,922-1005,1756-1938
LKAEGKSEPLEADKAIVAKNKADPGQPSDPSDMITAKDKNALQPVLPMNPAQQKFNPREDSTPPPAPLTIFRHCTATAKRTATAALASGAALQALSKHIVFFSISTMNGVITNFVDVFAFNRSIIKIIV

SEQ ID NO: 145020 - protein, 48 aa, Heterodera glycines; identical to SEQ ID NO: 133532
  Coding regions on vcDNA: vcDNA=SeqID_71443; Strand=-; Position=1 -46,288-388

SEQ ID NO: 145021 - protein, 105 aa, Heterodera glycines
  Coding regions on vcDNA: vcDNA=SeqID_71444; Strand=-; Position=1-318
MLDINPEKRMSATAIIDFLNGGCAPNIGIGNEEKMPIFGKVDADFLSISLRAEIYRVKGIYEENKKIRLENLEKIQALLTTVTKRQKLLFSMLAKRKHICEGQKN

SEQ ID NO: 145022 - protein, 96 aa, Heterodera glycines
  Coding regions on vcDNA: vcDNA=SeqID_71445; Strand=-; Position=1 -65,263-363,660-781,948-950
MRRGTPIPTQPPTSRTLALMTTRRPDQWTWTQLFFYAVQFFAIFAYTVVQYALVRVYYAFRYLTTRAAWYAIKYTILWPILAPYYAAVSYYNKARF

SEQ ID NO: 145023 - protein, 18 aa, Heterodera glycines
  Coding regions on vcDNA: vcDNA=SeqID_71446; Strand=-; Position=1-54
MRTRPIWQVKQRLLTSQK

SEQ ID NO: 145024 - protein, 235 aa, Heterodera glycines
  Coding regions on vcDNA: vcDNA=SeqID_71447; Strand=-; Position=1-705
MSKGKDRVGKILVTNVETYGTQTVAMLDGGAQISLIGAGFLYELIKERGLDLKKSDFSRTSARIADVNGQQLKCFGVVTIPITRKGCSQIPICFHITSAQFGYDLLLGTNSLSKLGFLLYDTANKEMIEFEEISQNDSNSARVIFSTKIQPRSTRLIEIGVGDQWNGKDVVISPQTVKGNVKVEESVGKVENGKVVAQITNLSAFLAQIDEKTEIATVESAEIVFDSENSIIQAE

SEQ ID NO: 145025 - protein, 19 aa, Heterodera glycines
  Coding regions on vcDNA: vcDNA=SeqID_71448; Strand=+; Position=1-59
KNSNINLYQVKIIQNYLVF

SEQ ID NO: 145026 - protein, 41 aa, Heterodera glycines
  Coding regions on vcDNA: vcDNA=SeqID_71449; Strand=+; Position=1-125
MDLTPEQERELYNAYYRPNVPEDLTEAELSHETHLEAFNRA

SEQ ID NO: 145027 - protein, 181 aa, Heterodera glycines
  Coding regions on vcDNA: vcDNA=SeqID_71450; Strand=-; Position=1 -91,139-593
MQKVKIRVGQIMDEEYLIQLDEMFPEILQIDLLLPWTQTVLYKRLLATKSGTDQHLRIECRFALPVLFHRLKWLIVKTPTLKGKVLALFREKLRKVQRIAFRGLRRELVGIRQTELMREELLKSVCILQRFYEFASAISALPNGAKEMPTEEEIRNWNTGRNCMTEEGLIRAYQVDKGFIL

SEQ ID NO: 145028 - protein, 502 aa, Heterodera glycines
  Coding regions on vcDNA: vcDNA=SeqID_71451; Strand=-; Position=1 -277,375-757,804-1059,1106-1696
MSKIVRAKMISFSLCFLFLLFLANLNDGGKNKKLKQKPMKSAQKFEEKKIFWERNGEFSMAKQWTEKANECLKNVDTLAEKEEEEEEENGEKDECNKLMANFVLFFKKSASNDAAAKEIVPTLNVNSMLWFIRRKIINLLNFSKILFANDENVVGIIEEFVREWKKTFGKNWRENAQKKREICTQYKFGIYFIKLMVYYAKSCEALAEYLRKEISLEIFRVDEAIFLNCDINGQTEQMYNNLLEQIGHINGQNFMELLDIYENFREFFNGFENEKMRKTKEAMNKLVKSEYVTKIEDKFPNIFRIDIILNSSLFERLQSLLTNKSFSTAYRMEFSRLTMAFLIDRSFNSDLLLIGGGKGAHSSDRITANWREAMAEAIAAAYTDLGSEQNLCMLIKMNEFAQLISKKRNEKGSEKLPWDLRMDELCEDGTERAKIMDKFVGAELGEIYTAAIERVVAYRREHFIGILRIPGAKTRLKQLVESEQRMTELASKNGLGEALREI

SEQ ID NO: 145029 - protein, 111 aa, Heterodera glycines
  Coding regions on vcDNA: vcDNA=SeqID_71452; Strand=+; Position=1 -73,118-227,530-682
MLGFVYADDLSELNGDNAMEVLYAAKKYNITGLIGPPLQIPISELRNVFLAYAQALLFELDALRWADEKCRQNGVECSPENLRAVLGPALFKIHLPNFHEADFSKYVGKNV

SEQ ID NO: 145030 - protein, 50 aa, Heterodera glycines
  Coding regions on vcDNA: vcDNA=SeqID_71453; Strand=+; Position=1 -101,153-195,559-567
MPRKMKRIVSLNWLNDAIAKRQVTAPSKACHLPSIWSSTRYNPKTFAKLS

SEQ ID NO: 145031 - protein, 154 aa, Heterodera glycines
  Coding regions on vcDNA: vcDNA=SeqID_71454; Strand=-; Position=1-468
FFLIFLPQTWYQQLPSLVWPYQTILRYLKRKQKKFLTKKCLSLFSHFFTAKLVPTVAFSCLALSNNLTIFETQTKKILDQKWLSLFSHFFTAKLVPTVAFSCLALSNNLTIFETQTKKILDQKIAISFFSFFYRKLGTNSCLLLSGPIKQSYDI

SEQ ID NO: 145032 - protein, 88 aa, Heterodera glycines
  Coding regions on vcDNA: vcDNA=SeqID_71455; Strand=-; Position=1 -79,135-322
MGTNYSTSNSAPFDYGMTSRKKGKNRTYESNHFDKNYLIEGTEFWAENEYRKDSYLFERRKGSDRANCEFEKGEEAIDQFISRKGNPI

SEQ ID NO: 145033 - protein, 654 aa, Heterodera glycines
  Coding regions on vcDNA: vcDNA=SeqID_71456; Strand=-; Position=1 -1876,3140-3228
  Homolog annotation: Hit_ID=NP_508324.1; Match level="QueryCoverage =71%, HitCoverage=18%, E-value=4e-41, Identity=22%"; Hit description =predicted CDS, peptidase family A16 and RNA-directed DNA polymerase and Integrase, catalytic domain and Z
MDSSFFYSNNSHISNSYPKIEKKKQNEIGDTLFRNKRSTNFLIECITGGITLNIINPVDIIGVCSQGYCITINKPNLKETIIFPQEIIKNNYEFEIKLILNNTITEVSKSNCNASPICEMIKCKICIEYLRAPQCIEHFHFIIIISVVLFTIYILSISMQIIKFIYSTLKWIFKFVFFCNKKKNLKPKTKSKSRSYTLKSRTAILLLMILNFIHLTKSCDEITNLIANSTNCPRDENGKIECTFDQTILISIKPEHKTCLKLEDKIRNTTFKTIKFSTEELILTCERESEYFMRNYEILSESVKRCPTMGQCQGSTCEKIKSDSSNPEISDKANKKPGYSYCVPSCGGWHCQCFIATDGCLFYRTYMEENGNDYFEVTKCNQWPIELNFKYEIESDDGSTADSTLLKPGILNKKDNIEMTLTTMTIPPTPIFGSKFIINKVNNDAIIVNNEDLLRNSIRCPDENSAKTFSCKFPPEACKCNGGDTQVNCECTKDPLPEMFEQQNEKLPIDFKGSHLFFENNQIKAKLKQTTALQLQITLKGFKTTPFYDKTKCTVESISLSGCYACKGADWKFKCKSEFGSALAQLVCPNQKVEINCDTEDKEQIIQLTYNIEEINEKCSLICPGVKRKAESKPDTELKHTKKDENKTDEFKIL

SEQ ID NO: 145034 - protein, 558 aa, Heterodera glycines
  Coding regions on vcDNA: vcDNA=SeqID_71457; Strand=-; Position=1-1677
  Homolog annotation: Hit_ID=NP_504187.1; Match level="QueryCoverage =33%, HitCoverage=15%, E-value=4e-15, Identity=26%"; Hit description =predicted CDS, integrase, catalytic domain containing protein family member (5E782) [Caenorhabditis elega
MITEIESLVNSRPLTFIYDDINSYQILRPIDFLLPHQNICIPPILEENEFGDPTYKPKFNSYEKTVELWKKTSKLLDDYWKLWTEEYIPSLRERYQINHKNPKQCVKDFPKINDIVLIKEELPRALWKTGIIKELIIGSDNIIRGAKIEFPNKSIMNRPLKLIYPLELSKNIDENDEINKQINNLILNSRDSIHTEIKKCSFCFSNDHLQIHCTKYKGYRMRKMRAKNLSLCYKCLKPGHRIKNCKNEENFCDKCKIHKSICLNYREHYDQNSSNNDDLNNLLSKKRNNLSQTINSTPSTLLQKLLFIALLLFVVPMNTYSNYNCPKDLKNYTTILTSFCVEEGIIVRKNLQNNEFCSDMLSCLNRHLIYNHTPYCGPKCECSKWAQQCSFVPYQSIKKYNKKIVKKLIRQAGPSICAFKQNPRCMNKTKGKFHAIRLYDNSIYFVKNLHIRYAQIESKYDYLCLGEGNLTIGSPGYCELFHCDKKGTKFCYHDQRERIYLILGKIEIPIKEWGIIETEYYTEDNQKRKKHKQKESLDSLFFNSNYTESHQKAKKKKD

SEQ ID NO: 145035 - protein, 113 aa, Heterodera glycines
  Coding regions on vcDNA: vcDNA=SeqID_71458; Strand=-; Position=1 -96,176-421
  Homolog annotation: Hit_ID=NP_741736.1; Match level="QueryCoverage =95%, HitCoverage=15%, E-value=1e-13, Identity=42%"; Hit description =transforming sequence-like (XD417) [Caenorhabditis elegans] gb|AAB52871.3| Temporarily assigned gene name
MLRLEEHRQLGDSEEIADGLAREHAEYGTEALDDVIRPCRTLRKRGIELSEKGDDLSELLNSTKGSDSVGPKCDELNRMAEVLGGAVERRGQMLEKSRKMHAQIAKVSGEKKL

SEQ ID NO: 145036 - protein, 136 aa, Heterodera glycines
  Coding regions on vcDNA: vcDNA=SeqID_71459; Strand=-; Position=1-664
VFGAVSPNRCAQIYGETESFRNSFPIACTLILRWIFAPHNCLSTPNGHSLEKIDFFVFGAVPPNRCAQIYGETESFGNSFPIVCTLILRWIFAPHKCLSTPNGHLKKSIFLFSGQSPRTDAPRFMGRPNPSGIASL

SEQ ID NO: 145037 - protein, 24 aa, Heterodera glycines
  Coding regions on vcDNA: vcDNA=SeqID_71460; Strand=+; Position=1-80
RTLSTAVRQRSSKIYSMPQILWAG

SEQ ID NO: 145038 - protein, 24 aa, Heterodera glycines
  Coding regions on vcDNA: vcDNA=SeqID_71461; Strand=+; Position=1-80
RTLSTAVRQRSSKIYSMPQILWAG

SEQ ID NO: 145039 - protein, 122 aa, Heterodera glycines
  Coding regions on vcDNA: vcDNA=SeqID_71462; Strand=-; Position=1-369
  Homolog annotation: Hit_ID=NP_643175.1; Match level="QueryCoverage =100%, HitCoverage=19%, E-value=1e-22, Identity=50%"; Hit description= chemotaxis protein [Xanthomonas axonopodis pv. citri str. 306] gb|AAM37711.1| chemotaxis protein [Xantho
MVPSIRKTADLVQEIAAASAEQSTGLEQINNAVHQMAQTTQMTASASEELSATSEEMSAQAMHLQDLMRFFRVGEMHKSAPRSVKAGPGSGGTGKQERMRRLSMLDAAEDEASVDESSFKRF

SEQ ID NO: 145040 - protein, 238 aa, Heterodera glycines
  Coding regions on vcDNA: vcDNA=SeqID_71463; Strand=+; Position=1 -176,368-442,1336-1515,2085-2370
MHIFPWLNPEQVSRKLALLSARFDGLVDTHFKSRKWAFVWMLIYYSNNVNRSGVSGVDVGFRGLRIDELTPSKNLIDFKCIELRYFDSSVLSLLHRFKPLFLMGITLQLMGKGMEAPRGWALRIHQLLPLIGITNIHKLYVSTGGYSRLCGLLVSISATFLIDCPNLRLIYYDAIMTGPDRPFDTAKKVQEWLQWPRGDGRPKVLFRSYQLPIVDEFKQARRAQAIGRNAYAKASNHS

SEQ ID NO: 145041 - protein, 114 aa, Heterodera glycines
  Coding regions on vcDNA: vcDNA=SeqID_71464; Strand=+; Position=1 -42,105-407
MKFLISNLQIMDRNDFLTATIPANYIICFISFGIHPENVEQFQLDNKRTNERLKIERKVLDQQQQQKSKVCMTRAPIGRDERQWAEWMRKAWQEEEKRNLLIFWISEANMGPDI

SEQ ID NO: 145042 - protein, 105 aa, Heterodera glycines
  Coding regions on vcDNA: vcDNA=SeqID_71465; Strand=+; Position=1-818
FCVGFLLPINCLSTPNGTLKKIDFFVFGAVPPNRCAQIYGETESFGNSFPIACTLILRWIFTPHNCLSTPNGHLKKSIFLFSGQSPRTDAPRFMGRPNPSGVAFL

SEQ ID NO: 145043 - protein, 135 aa, Heterodera glycines
  Coding regions on vcDNA: vcDNA=SeqID_71466; Strand=+; Position=1 -129,486-578,982-1167
MNVVNRQLMITAENRQYKKGRLAEKRKDRNAAFKCTFGEDIAKVLINPRQLLQLLQLGPAEFERVVVGLYVVHKVAKFIAPSAEHIKRKAQELEEALRETQQMKRTAEDLAGPMHNTKRIKDNEQYDEEEEDDDE

SEQ ID NO: 145044 - protein, 79 aa, Heterodera glycines
  Coding regions on vcDNA: vcDNA=SeqID_71467; Strand=-; Position=1 -53,350-494,718-759
  Homolog annotation: Hit_ID=CAF92377.1; Match level="QueryCoverage =88%, HitCoverage=7%, E-value=2e-14, Identity=54%"; Hit description =unnamed protein product [Tetraodon nigroviridis]
MSNDVTLANHMESSGVPGRIHITDATLNALNGTYRVEVGNGQERSRHLVEKGIKQTWLVVSEEGKEKAADHRKLHSVIK

SEQ ID NO: 145045 - protein, 65 aa, Heterodera glycines
  Coding regions on vcDNA: vcDNA=SeqID_71468; Strand=-; Position=1 -108,432-521
MVDQINKAKSEEIEKMREQIGQLHKEIAMIKQNSEWKMQEIFTQFGRIQTGIDELKHQNENVLIK

SEQ ID NO: 145046 - protein, 56 aa, Heterodera glycines
  Coding regions on vcDNA: vcDNA=SeqID_71469; Strand=-; Position=1 -166,829-833
MNGLKEHIGEEEYVKLEKVLEEKRQAEQKPSIIEKKHDKDGENSEEGMGKRIKDKR

SEQ ID NO: 145047 - protein, 39 aa, Heterodera glycines
  Coding regions on vcDNA: vcDNA=SeqID_71470; Strand=-; Position=1 -81,610-648
MICSVLHLFYHYKMILLLLQELIKQLIDFIHIWYIFWTF

SEQ ID NO: 145048 - protein, 95 aa, Heterodera glycines
  Coding regions on vcDNA: vcDNA=SeqID_71471; Strand=+; Position=1-648
MFEYPKRTLEKIDFFVLGAVPPNRCAQIYGETESFGNSFPIACTLILRWIFAPHNCLSTPNGHLKKSIFLFSGQSPRTDAPRFMGRPNPSGIASL

SEQ ID NO: 145049 - protein, 86 aa, Heterodera glycines
  Coding regions on vcDNA: vcDNA=SeqID_71472; Strand=+; Position=1-261
MGNDGQKGGEGPEYGGKWKKEKTKSKGKGRKSEKGREIWGKERRREKKRILGAIGKWEKGKGKREEKPKENGKKRLLGLCLFTFIV

SEQ ID NO: 145050 - protein, 140 aa, Heterodera glycines
  Coding regions on vcDNA: vcDNA=SeqID_71473; Strand=-; Position=1 -141,196-319,427-581
MREQIEKRSGFVTKWFNKWPNVAEIEDFERGLREKKRNLAKWSTHLEEVLEKAEGKVTTKEHLKEVFYDAVKVKRITKATDAKDFISICDLAVDERMVKRKLRNTDLTKKSESATLSWASWATKQACKVQIGKKSGKMKE

SEQ ID NO: 145051 - protein, 112 aa, Heterodera glycines
  Coding regions on vcDNA: vcDNA=SeqID_71474; Strand=+; Position=1-339
MTLANCRIPQLCFILLFALLLLINLAQSDQQLSKGILLITFNHFIYYFAIFGEQSPMDAELDTNNEHEQHYGDGVFVDAVPMCGGGANMPKRAFVEGQKINGVKAADKVPKE

SEQ ID NO: 145052 - protein, 52 aa, Heterodera glycines
  Coding regions on vcDNA: vcDNA=SeqID_71475; Strand=+; Position=1-158
MCSFCPIHCAVALRPGGLAPMDSDPDASKIHPMSGVSSSSTPNTAQTIWGGI

SEQ ID NO: 145053 - protein, 116 aa, Heterodera glycines
  misc_feature (7)..(7): Xaa can be any naturally occurring amino acid
  Coding regions on vcDNA: vcDNA=SeqID_71476; Strand=+; Position=1 -123,205-391,756-796
  Homolog annotation: Hit_ID=CAE68917.1; Match level="QueryCoverage =92%, HitCoverage=8%, E-value=2e-34, Identity=61%"; Hit description =Hypothetical protein CBG14896 [Caenorhabditis briggsae]
SCIGLSXLFAFQIVIGICAMQRKANSKPMRSIMLKMNEFYKDFLDFVIFPEETILNESVENWPLCDCLISFHSTDFPLKKAIEYEKARRPYVLNDLHRQFDLVIRRPPFRPISNPE

SEQ ID NO: 145054 - protein, 44 aa, Heterodera glycines; identical to SEQ ID NO: 126591
  Coding regions on vcDNA: vcDNA=SeqID_71477; Strand=-; Position=1 -45,128-217

SEQ ID NO: 145055 - protein, 153 aa, Heterodera glycines
  Coding regions on vcDNA: vcDNA=SeqID_71478; Strand=+; Position=1 -27,550-990
  Homolog annotation: Hit_ID=AAP92584.1; Match level="QueryCoverage =83%, HitCoverage=26%, E-value=2e-33, Identity=61%"; Hit description =Ab2-057 [Rattus norvegicus] gb|AAP85373.1| Aa1262 [Rattus norvegicus] gb|AAP85367.1| Aa1011 [Rattus norveg
SVGWRVYFGPFLVRGAICLVYSDNERDSSLLNSWLIASGHNFLEGFSVFSRTKLSNNRSVMPLDVRGCTRATLAKSACLPSRKGVGKPVICRDWDRTLQLLSVNEEFLVGASHQLALNTSLPFVHTARRCPGTAISRNSGTVSVSVSVGMQTG

SEQ ID NO: 145056 - protein, 199 aa, Heterodera glycines
  Coding regions on vcDNA: vcDNA=SeqID_71479; Strand=-; Position=1-601
ESGRVRRDAAKTQSAGQTLRGIAEWSGEAAIERDEVKIWPKLVPVTSKSEPSPILWPPVPTTKRPQTVPKEEGKKRISGGNDDELQTNGESRKEKKKEEVFRDLPSGVEVVSSLVEKAVENGQKSRNKTQRQKIMETLGKVGTENGRTDHSHIYHLPITLRQRTEDELGQKSKIDQHNKCREFWIAIRPSRQIRDERLQ

SEQ ID NO: 145057 - protein, 79 aa, Heterodera glycines
  Coding regions on vcDNA: vcDNA=SeqID_71480; Strand=-; Position=1 -81,224-533
IVKNIRKLFSVLIMLYNTFKPRREAGQFQNFVPHFTVESPSTLLDNYVSMSTVAFGQLWNGKMGISDGVRSFLKIPLFV

SEQ ID NO: 145058 - protein, 51 aa, Heterodera glycines
  Coding regions on vcDNA: vcDNA=SeqID_71481; Strand=-; Position=1 -153,445-447
MMSKIGRIFTGVLALSSVAPGAANASQKGGEVQAVKKQQCAPPPQMPGRDL

SEQ ID NO: 145059 - protein, 95 aa, Heterodera glycines
  Coding regions on vcDNA: vcDNA=SeqID_71482; Strand=-; Position=1-288
MGDGIVGQVQAGQLSEVDKRFGKTEQRKFTLKNGENFGKNGGLPGHNVCAYVQIGQIVAETDFFSHFDNFWGKKDWDKLVDGFLKKLKNWNHAKS

SEQ ID NO: 145060 - protein, 722 aa, Heterodera glycines
  Coding regions on vcDNA: vcDNA=SeqID_71483; Strand=-; Position=1-2169
  Homolog annotation: Hit_ID=NP_508324.1; Match level="QueryCoverage =98%, HitCoverage=24%, E-value=1e-89, Identity=33%"; Hit description =predicted CDS, peptidase family A16 and RNA-directed DNA polymerase and Integrase, catalytic domain and Z
MDTDVNEIAEFKSNNLLHYLPHNPVIKESSNTTKIRPVFDASAKLKGNNSLNDEIHQGPKLLPDLCGLILRFRLKNYVLIGDLEKAFLRVGLNELDRDTTRFLWVNKSYLNEIRQNYREIEMRDIELRRFTRIPFGVNASPFLLTAVVNLHLSKINEMFEKFKTIQVNKELCLNDKEEEFKNLCVELKQNAYVDNFVMMCDDEKEIQFKHYWSKEIFKLASMNLREFVSNHEQSNKEIQKLEGSEIPKVTKMLGIKWNVDSDELELQIKIPLMSKDTTKRQILTMIAKNFDPMGWISPVILKYKLFFQKLWRLNKDWDDKLDDQEIIEWNNISNTDMITIPRSPFTSQYLNHSILHIFSDASELAYATSAYLHTNDQVNLLFAKTRLTPLKGLTIPKLELLGLLIAARAAKFIKTESKLNLENTYIWSDSKCVLSWLKCKKNLPIFIKNRVEEIKQIALELHITFHYVKSADNPADLASRGATMSELKYNKLWWNGPKWLKLEEENWPPHSFYSPDQEEAPYLDNTEEIINTQINLIKNEYNGIIEWDKFSSWLKITRICQTLLKFIFFKLQNSKKFKEKFIYSKFENALQLKIMAQKMLIRIIQREMEPNKEEERQLRIYLDNDMILKCEGRLKNAQIQGVNPIFLPRKHYGTHLIIMDYHTRNLHAGTMTTLSEIRKTYWIPKGRRIVDQIRRQCYHCRRYNAKPFQQPQMPPLPKSRVK

SEQ ID NO: 145061 - protein, 35 aa, Heterodera glycines
  Coding regions on vcDNA: vcDNA=SeqID_71484; Strand=+; Position=1 -29,324-402
MAASSFRHRWSYSFTSTSAFCRVSNADGLGDATLD

SEQ ID NO: 145062 - protein, 151 aa, Heterodera glycines; identical to SEQ ID NO: 132093
  Coding regions on vcDNA: vcDNA=SeqID_71485; Strand=+; Position=1 -135,211-531

SEQ ID NO: 145063 - protein, 77 aa, Heterodera glycines
  Coding regions on vcDNA: vcDNA=SeqID_71486; Strand=-; Position=1 -73,1474-1598,2028-2063
MEGKGPKGKGIYPFQEISMKRIKAAGFAWCLDGHSPLLTVLNSASNWHCFRPVSMLQWTNISTAEGLVFCNTLDGHF

SEQ ID NO: 145064 - protein, 61 aa, Heterodera glycines
  Coding regions on vcDNA: vcDNA=SeqID_71487; Strand=+; Position=1-712
CQKLIENINLYSGYSSVKNDATLAIRPRKKSSFEWYLQIKCQKEAEIQKKIPSQGQATIAV

SEQ ID NO: 145065 - protein, 17 aa, Heterodera glycines
  Coding regions on vcDNA: vcDNA=SeqID_71488; Strand=-; Position=1-66
HKHLFDLFYHIHNLIKI

SEQ ID NO: 145066 - protein, 25 aa, Heterodera glycines
  Coding regions on vcDNA: vcDNA=SeqID_71489; Strand=+; Position=1-77
MILEYADPQNVQVSKLSFFIIRMGL

SEQ ID NO: 145067 - protein, 41 aa, Heterodera glycines
  Coding regions on vcDNA: vcDNA=SeqID_71490; Strand=-; Position=1-127
LGHFVGQRIQESFLRVFANQTGQSWYHSKAADEENLFLSKC

SEQ ID NO: 145068 - protein, 32 aa, Heterodera glycines
  Coding regions on vcDNA: vcDNA=SeqID_71491; Strand=-; Position=1 -66,449-481
MAQILSKLALQVADYVTVYLAQLKTCFRKNKK

SEQ ID NO: 145069 - protein, 87 aa, Heterodera glycines
  Coding regions on vcDNA: vcDNA=SeqID_71492; Strand=-; Position=1 -115,246-394
MDKEVELSSTIFPICIHCGAREKFEEGKAYIAGWGYLKNSCTQKSQKSPLTLMGRSAQLVKCKKSFFNDGQERICIEKNTIEQVGKF

SEQ ID NO: 145070 - protein, 15 aa, Heterodera glycines
  Coding regions on vcDNA: vcDNA=SeqID_71493; Strand=+; Position=1-49
LKAIHCLPVLGTAKH

SEQ ID NO: 145071 - protein, 43 aa, Heterodera glycines; identical to SEQ ID NO: 136181
  Coding regions on vcDNA: vcDNA=SeqID_71494; Strand=+; Position=1-296

SEQ ID NO: 145072 - protein, 58 aa, Heterodera glycines
  Coding regions on vcDNA: vcDNA=SeqID_71495; Strand=+; Position=1 -116,183-243
MAQMSAHGQMAKLLSNNFLKFDLAICHCAEQLRLANKVGFPSTQKMSIPSAWSWPICI

SEQ ID NO: 145073 - protein, 240 aa, Heterodera glycines
  Coding regions on vcDNA: vcDNA=SeqID_71496; Strand=-; Position=1 -311,379-504,550-835
  Homolog annotation: Hit_ID=A48575; Match level="QueryCoverage=74%, HitCoverage=43%, E-value=2e-87, Identity=61%"; Hit description =paramyosin - nematode (Onchocerca volvulus)
MLHRQFEPCQHRGTEDHQEAERAAQGVAGQPGGHAAPVAANAGPGQLECERVTHCICFCHLQYALAQRKVSALAAELEECKTALDNAVRARKQAELDLEEAHGRINDLQSINNNLTAIKNKLETELSTAQADLDEATKELHAADERANRALADAARAVEQLHEEQEHSMKIDALRKSLEEQVKQLQVQIQEAEAAALLGGKRVIAKLETRIRDLETALDEETRRHKETQNALRKKDRRIK

SEQ ID NO: 145074 - protein, 19 aa, Heterodera glycines
  Coding regions on vcDNA: vcDNA=SeqID_71497; Strand=-; Position=1-57
MEGTTTRPPTLTLALHSLK

SEQ ID NO: 145075 - protein, 108 aa, Heterodera glycines
  Coding regions on vcDNA: vcDNA=SeqID_71498; Strand=+; Position=1-327
MPINPTNVILLLQEHYHGKAPPPTQLTPEEKQLAKDFLNTLEFCAKQGSEIETLEDLIVDELAVFDQKDQQDSDEQFDLEDDESEDSEGSFSSPASTVFLFSLDQFLH

SEQ ID NO: 145076 - protein, 32 aa, Heterodera glycines
  Coding regions on vcDNA: vcDNA=SeqID_71499; Strand=-; Position=1 -91,439-446
MLLMNTNKLCRQQHRIAYLIQLMKRTIAKNAF

SEQ ID NO: 145077 - protein, 49 aa, Heterodera glycines; identical to SEQ ID NO: 137875
  Coding regions on vcDNA: vcDNA=SeqID_71500; Strand=-; Position=1-435

SEQ ID NO: 145078 - protein, 127 aa, Heterodera glycines
  Coding regions on vcDNA: vcDNA=SeqID_71501; Strand=+; Position=1 -177,928-1134
MMRNGTVTIPRPDTAPKCVGKECKAAKKERKDKPTKVRKDTVVVPYGGYTVIRWKIGDTRFEDAVHFFGSVLALLTDLLLSDFFHHNVTGRRRFDLKISQKENRTERVEKRTRWMRFSKKSKAMSNV

SEQ ID NO: 145079 - protein, 94 aa, Heterodera glycines
  misc_feature (4)..(4): Xaa can be any naturally occurring amino acid
  Coding regions on vcDNA: vcDNA=SeqID_71502; Strand=+; Position=1 -106,160-562
SSFXAETEEPIYGLANLDYHWHGETADPNWDGGEKVDFLLNRCTARQCVLLGCPFRTENGTFAAFDGRKFKCHSIDELRNNGKLNNYPSGHGYD

SEQ ID NO: 145080 - protein, 303 aa, Heterodera glycines
  Coding regions on vcDNA: vcDNA=SeqID_71503; Strand=-; Position=1 -121,174-345,440-664,788-1021,1136-1295
MPVSIIPDPNDPYFIPSVPMYRDFRKEIDLNDSICDRFFEEQQSPKAGHPVEQPVPKVQAKQRPVSRRSLSQVREQTAIAQPTMRFGNTSRRSVITKGTSNEGMPISSGPVTRSTFSSAKASDVSHAVRSTVPEVQAKQRPVSRRSLSQVPEQTPTFVQPPMRTSRRSVFTKGINSEGMPVNSGPVTCSTVSASKAPDVSHAVRLTVPEVQAKQRPVSRRSLSQVREQTSAIVQPPMRFGNTSRRTVISKGTSNEGMTVSSGPVTRSTVSAAKASGVSHAVRGICVVRNMPTNNKKQQTKDKQ

SEQ ID NO: 145081 - protein, 191 aa, Heterodera glycines
  Coding regions on vcDNA: vcDNA=SeqID_71504; Strand=-; Position=1 -47,111-275,339-646
  Homolog annotation: Hit_ID=NP_492775.2; Match level="QueryCoverage =100%, HitCoverage=42%, E-value=3e-66, Identity=33%"; Hit description= laminin alpha chain (343.7 kD) (1L197) [Caenorhabditis elegans] gb|AAC26793.1| laminin alpha chain [Caen
PEGIYEGGGRCVECQHNTVGVNCEKCLPGFYRHNTVGVNCEKCLPGFYRPTNVSHYRTDACRPCDCDLVGAESNQCIRDETEVTEQMRRPGDCRCKLGFGGRRCEHCALGFRNHPICEPCPCDSAGSLNFDTCEEDQCVCKRNVEGERCDRCKSGTIYLDRENPEGCQPCFCFGKSTECREFDWDTAKVGN

SEQ ID NO: 145082 - protein, 123 aa, Heterodera glycines
  Coding regions on vcDNA: vcDNA=SeqID_71505; Strand=-; Position=1 -150,261-482
MYIKIYKPQPICFTLAEKDGNNCDLRLFAIVGQSHVLGTEPNAKAAAVTENELPQSYSATLPPPHLDATADFFSTSNSDNDVLPPFDLVASVALPPAVQCRKFFADLRPVRVCWFCGVRENDI

SEQ ID NO: 145083 - protein, 94 aa, Heterodera glycines
  Coding regions on vcDNA: vcDNA=SeqID_71506; Strand=+; Position=1 -167,414-529
DFCEIPTIFRAHFPQISADLRHCRCFCVGFRAEHMRLTDDSEQSQVAIISVFFGQYQALMPILFVFLMNYVASVLGLNQYIMSITPENHGAHIL

SEQ ID NO: 145084 - protein, 68 aa, Heterodera glycines
  Coding regions on vcDNA: vcDNA=SeqID_71507; Strand=+; Position=1-204
MESDSNPQQQSVPVQQLPSDASPQPQQNGGGDSADKIGPDQMRLLSAQIAAYKMLARNEPVPRALLRE

SEQ ID NO: 145085 - protein, 169 aa, Heterodera glycines
  Coding regions on vcDNA: vcDNA=SeqID_71508; Strand=+; Position=1-978
FQQKQLRSAQACAWAAKETEQVVMTQRWPGIRASRTWEEPSRRWTQLRGQCTGTHTSTPDFPVRTLPQAKGLRALMSRVFSNASTLVPRQGVPIHELIGLVNHGNTPLTRIPTPPPTLGSASPVLSSPQHLCLRPHLHKSINSANFFNTQTSCMFIRVDSCQSLEKLRP

SEQ ID NO: 145086 - protein, 18 aa, Heterodera glycines
  Coding regions on vcDNA: vcDNA=SeqID_71509; Strand=-; Position=1-56
PYRDRDLSFSKPGTGNRD

SEQ ID NO: 145087 - protein, 248 aa, Heterodera glycines
  Coding regions on vcDNA: vcDNA=SeqID_71510; Strand=+; Position=1-747
MTAHVPKVAGRESYKLWGKFTPQIEVIINGFAARIEILYIIKVGYFNAFLEAMQTFQGGTEDQFFVNNRVTLRIEPPNDDIVHGPSGSAAVFCAVFGLACNRLCSSDTVVSATLERGQLFGVGSLLFKIRAAKAKRMKTLVLSVDNQLEWEEIAASAPHEIGTTRKVAAYGLHASGRTPTALLDGDVRLGLTLGALLLLLLRVTEEVQVGHDQLVVHHKARLTTDFAAQQQNFTSQQPPNQSDGVLLL

SEQ ID NO: 145088 - protein, 118 aa, Heterodera glycines
  Coding regions on vcDNA: vcDNA=SeqID_71511; Strand=+; Position=1 -112,562-806
MRFHREATKRSPRHRPEKAGECLGVQVIEDDNGNVIDGELFIMTANVPKVAGREPYILWGKFAPQTEVINGFAARIKILYVIKDGYYNAFLEAMQTFQGGTDDQFFENNRVTLRIEPG

SEQ ID NO: 145089 - protein, 84 aa, Heterodera glycines
  Coding regions on vcDNA: vcDNA=SeqID_71512; Strand=-; Position=1-253
FFCVNLLKCSSSIEEGKLLGSNADNISGYRFDYNIFHLSRTDCNRQFAGQRQFSEHLMRFHREATKRSPRHRPEKAGECLGVQV

SEQ ID NO: 145090 - protein, 185 aa, Heterodera glycines
  Coding regions on vcDNA: vcDNA=SeqID_71513; Strand=+; Position=1 -262,310-414,459-551,915-941
  Homolog annotation: Hit_ID=CAE74421.1; Match level="QueryCoverage =97%, HitCoverage=15%, E-value=4e-53, Identity=61%"; Hit description =Hypothetical protein CBG22153 [Caenorhabditis briggsae]
LIRLTNECPPPAMYRELMYEDSAAPIKKYCELCQSLPTYGVTFFLVKEKLPGKNRLIPRLLGVNKDSVMRVDERTKAVLKEWPLEQVRRWAASVRRWAASFKTFTLDFGDYKDGYYSVQTLEGERIGQLIGGYIDIILKKKRIVDLIGGYIDIILKKKRIVDSGGIEGDEGATMVEDIVAPAKAT

SEQ ID NO: 145091 - protein, 187 aa, Heterodera glycines
  Coding regions on vcDNA: vcDNA=SeqID_71514; Strand=+; Position=1 -177,234-565,617-671
IDSGALFPDGIADDGPNATAGQALSKWLHTPSKNGQPKQLHRNNYFGPPKLEWVNNFKETFRRATTSVSYTIQLYIIVEPMPIEPFELVNEVTNEKLTLKHSEELDYNCLYNWLLKRCPIGETAPVKWKNRENSGANLNYIRFELRYANYSGANLNNIRFEVWGGNSCIGPLSLPAEEEEADESNEN

SEQ ID NO: 145092 - protein, 118 aa, Heterodera glycines
  Coding regions on vcDNA: vcDNA=SeqID_71515; Strand=-; Position=1 -98,160-331,379-465
MLFVEKEFALIDELELLNQFVYQSQSQSSETQNQQKPRNEFYQIWTPFYMDSQLKKLSSDAEKTTNTRKRRRKAHHSMEERSDGRDFLLSNCRIVQNLFTKFQNSCKGFMEFDANVPR

SEQ ID NO: 145093 - protein, 63 aa, Heterodera glycines
  Coding regions on vcDNA: vcDNA=SeqID_71516; Strand=+; Position=1 -11,126-303
MTDRVTREDGSVIEEEKTENGEFVVIFERANGNGNPSGFKQSKRMQKGRGYVIDLSPDLQVAN

SEQ ID NO: 145094 - protein, 135 aa, Heterodera glycines
  Coding regions on vcDNA: vcDNA=SeqID_71517; Strand=-; Position=1-410
  Homolog annotation: Hit_ID=NP_702063.1; Match level="QueryCoverage =97%, HitCoverage=3%, E-value=7e-11, Identity=22%"; Hit description =hypothetical protein PF14_0175 [Plasmodium falciparum 3D7] gb|AAN36787.1| hypothetical protein [Plasmodium
FQSLGLNPPAFQSLGLNPPAFQSLGLNPPAFQSLELNPPAFQSLVLNPPAFQSLVLNPPAFQSLVLNPPAFQSLGLNPPAFQSLELNPPTFQSLVLNPPAFQSLGLNPTETQQHSNHWDNSPAFQSLALNPPAFE

SEQ ID NO: 145095 - protein, 66 aa, Heterodera glycines
  Coding regions on vcDNA: vcDNA=SeqID_71518; Strand=-; Position=1 -96,551-655
SKRNEGIGGKAHDGIGATENGQSAVGRENWGGKQRVDSPAKGRGRVPSLPAAHGAAMFAVNGRPQR

SEQ ID NO: 145096 - protein, 52 aa, Heterodera glycines
  Coding regions on vcDNA: vcDNA=SeqID_71519; Strand=+; Position=1 -57,324-425
MFGRCRSEMAKTNSWDDIRFIGLNFQPIETLGKALNRLRHLHAHTIAFIFHF

SEQ ID NO: 145097 - protein, 83 aa, Heterodera glycines
  Coding regions on vcDNA: vcDNA=SeqID_71520; Strand=-; Position=1 -94,185-241,595-695
MHAFCARAIHHRACQSKAKQQRWCFERIKGIESVNRLLEKYICNLSTILRKSVNRLLEYIFAIYRSILRSEVETSRFNQFSLL

SEQ ID NO: 145098 - protein, 62 aa, Heterodera glycines
  Coding regions on vcDNA: vcDNA=SeqID_71521; Strand=-; Position=1 -27,440-481,876-932,1017-1078
MAHPPTLFPNHSPVGRFTPNPFENHTQVGPTPNKQLTPNPSTDCAQIEQLVPNGRLVPRWTD

SEQ ID NO: 145099 - protein, 17 aa, Heterodera glycines
  Coding regions on vcDNA: vcDNA=SeqID_71522; Strand=+; Position=1 -21,144-176
MPLVFILGLFSRIYIKI

SEQ ID NO: 145100 - protein, 32 aa, Heterodera glycines
  Coding regions on vcDNA: vcDNA=SeqID_71523; Strand=-; Position=1-96
WNVPDGERRELKLYTEEGLFRLVTTFATKEAE

SEQ ID NO: 145101 - protein, 83 aa, Heterodera glycines
  Coding regions on vcDNA: vcDNA=SeqID_71524; Strand=+; Position=1 -23,59-287
MSPIALKIELIDSPILYFMRKNWHCDKIPDEFEEYERTECQKYRKYLDILYEYLYREYVGIPTVKPKFVFKKEIEIEGPIIYA

SEQ ID NO: 145102 - protein, 227 aa, Heterodera glycines
  Coding regions on vcDNA: vcDNA=SeqID_71525; Strand=+; Position=1 -430,485-666,779-851
YIDHSVIKFFRSKKRFFDKSGTKLEVFVHSIDTYVQPIWDVFTREIWPIFAKSIRHLGLHNANALDNLRSRISPTLLTDLDQFSIDSGYLCPDGIADDGPNGNAGQALTKWLHTPTKNGQPKQLRFRAYVSPPNFEWVNNFKETFRRATTSVSYKIQLYFWVEPMPIEPFELMNEVTKEKLTLKQEIDEFDLNVYNLGKPRKSEPLAPPAEEKEGEEEADQSNKNVV

SEQ ID NO: 145103 - protein, 57 aa, Heterodera glycines
  Coding regions on vcDNA: vcDNA=SeqID_71526; Strand=+; Position=1 -37,695-831
MRKVITNFAELNGKWVTKWPFLWQYNCPLKAFSEIQSKDDQLPCPNKGRSIAVCQIS

SEQ ID NO: 145104 - protein, 17 aa, Heterodera glycines
  Coding regions on vcDNA: vcDNA=SeqID_71527; Strand=+; Position=1 -34,428-447
MMVLLLLFELDDEFSVQ

SEQ ID NO: 145105 - protein, 98 aa, Heterodera glycines
  Coding regions on vcDNA: vcDNA=SeqID_71528; Strand=-; Position=1-662
INRFIFVFGAVPPNRCAQIYGETESFGNSFPIACTLILRWIFAPHNCLSTPNGHLKNRFFYFINIFSESALKRTKLYLHVSLGTLMLFLSKREMEKNF

SEQ ID NO: 145106 - protein, 24 aa, Heterodera glycines
  Coding regions on vcDNA: vcDNA=SeqID_71529; Strand=-; Position=1 -14,302-362
MYGYKLEAPKGYDLSKKKMRTIGE

SEQ ID NO: 145107 - protein, 182 aa, Heterodera glycines
  Coding regions on vcDNA: vcDNA=SeqID_71530; Strand=-; Position=1 -279,520-628,696-769,879-965
  Homolog annotation: Hit_ID=CAE69855.1; Match level="QueryCoverage =90%, HitCoverage=25%, E-value=4e-65, Identity=71%"; Hit description =Hypothetical protein CBG16183 [Caenorhabditis briggsae]
MPTITELGQYVCVFRTNSTEFDLLFFTAERTLIRFPTDARASWPMIVATIRMRRRPLFYVFNHILPCVLISSMALLGFCMPPETGEKINMLNTVILSMGVYLQSITESIPPTSEAVPLIGMYYVASLAIVCLATAMNVYTLNIHRRGTTNQGRRVPWWMRKYILGYLATFLLIRVHEPDSIT

SEQ ID NO: 145108 - protein, 948 aa, Heterodera glycines
  Coding regions on vcDNA: vcDNA=SeqID_71531; Strand=-; Position=1-2844
  Homolog annotation: Hit_ID=NP_508324.1; Match level="QueryCoverage =42%, HitCoverage=15%, E-value=1e-51, Identity=33%"; Hit description =predicted CDS, peptidase family A16 and RNA-directed DNA polymerase and Integrase, catalytic domain and Z
MEHVILADIEKAFLQLGIRHADRDACRFIWLNNPETAELNPISHSELRIYRFCRVSFGLTVSPFLLNATLREHLALFDSDLARRIEENLYVDNIMFDAKPTEKLQDLVTQAKTIFEAAGMKLREFYGSNIEELKKLQPDDLAKDLEDNKVLGIRWKPKHNRLIFKLPIFEGKITKRTILSQIAKVYDPLGLMSPVLLPAKLILQEVQNLNPKWDDELPANINKDWLKLMAQWLDRGEAITIEFPRHIKDIDSVEFHCFCDASKYGMRIAVYQKAKTTIMKDECNLIYAKSLVKPIKVAAHDGTIPKLELQALTLGVKAVKFIQAQIKFADHQVIMWTDSQCSVERLRENKRQDRFVANRLQKIREANFQVRHVRTDSNPADMASRGADPQCLRTALLWRFGPIWLSKADKWPESNVIYRPGDEFKEVEKPPIVDIPEQPIQAVHSFIASVMDDSVSLAGSDDESQQPRPKKKFKIPKRRSALLRPIGQQQSPLQGQHKRRKQLQDSGLRKLFQAISDQQGSSKATTKAIEESREVQKAPRHEQIEHEQRMVRKSQQEANRHLQPKKRQQKEIQEVPHSTTEEQQRETKRQQIERQQNDEQRAINQQTRSKAWQELARQFDYDLMDQPDPTEKQPEETDQPTKSKQQSTKDKEDKELERHRIGRKKTIDMQEKRQRSRDEWPEENETLLSYVQRIYGPENWTSAWQRGRVLRELHELEDQGRWMIHHKSDRLQLSVSRMYGGKRPFAEFRFVEGRYYSHMVPEDVIFLQAVPTEEQLEIITINDTTAPATNTEQTKHPTKPQRPQSPKLEEYRMADSKPNTHSQFNLFEPCDNTHTTCAKTATYGSTAGNRFQMEEFQNFRANNFFEALLFNWLTRNMNLPAEEIWAAHEGYIQSDTTVEEVAQMFYQQKVADNGRQIARDQHLNEVINVWRNSCDRFGELYNQPAHKQ

SEQ ID NO: 145109 - protein, 223 aa, Heterodera glycines
  Coding regions on vcDNA: vcDNA=SeqID_71532; Strand=+; Position=1-669
  Homolog annotation: Hit_ID=XP_311783.1; Match level="QueryCoverage =100%, HitCoverage=43%, E-value=2e-24, Identity=31%"; Hit description= ENSANGP00000025124 [Anopheles gambiae]
IEENLYVDNIMFDAKPTEKLQDLVTQAKTIFEAAGMKLREFYGSNIEELKKLQPDDLAKDLEDNKVLGIRWKPKHNRLIFKLPIFEGKITKRTILSQIAKVYDPLGLMSPVLLPAKLILQEVQNLNPKWDDELPANINKDWLKLMAQWLDRGEAITIEFPRHIKDIDSVEFHCFCDASKYGMRIAVYQKAKTTIMKDECNLIYAKSLVKPIKVAAHDGTIPKL

SEQ ID NO: 145110 - protein, 170 aa, Heterodera glycines
  Coding regions on vcDNA: vcDNA=SeqID_71533; Strand=-; Position=1-513
MRHQISWSDEAVLHVLFPVLLPLLLLTGVVRSGQPISGLPDDGGFDMPERSDGAKVGHLRHAFSILEPELAQSVWSREGLKNPIRRTTTIPMNDRLDIGNTGELQPKGRFSDQRLRAITFLITHSLSAGANKPMKRRPRKAETVSEYDTLNDDFLTEYDLLNLDFSLDEP

SEQ ID NO: 145111 - protein, 154 aa, Heterodera glycines
  misc_feature (20)..(20): Xaa can be any naturally occurring amino acid
  Coding regions on vcDNA: vcDNA=SeqID_71534; Strand=-; Position=1 -38,91-147,253-433,479-552,602-792
AHSNCPRRATDSYLLTNIYXGNNIHKGTTRIMVQEVLKRFARIRFEQWRNVRQIKTKLGSMKRNCSFPPVDDHSWKRKKVGNEGGKVAEEDVIDRILFSPSQIPQNLSERFHRLKKMDRISRHQMIVPICGMSSFVGLSNVRIAKMAKSCSTHK

SEQ ID NO: 145112 - protein, 60 aa, Heterodera glycines
  Coding regions on vcDNA: vcDNA=SeqID_71535; Strand=-; Position=1-372
YAQKASQTILALPIPSTIAFIHPIMSAKIIRVPKIACDLSLAKNGVSKIVITLKKLLKQF

SEQ ID NO: 145113 - protein, 123 aa, Heterodera glycines
  Coding regions on vcDNA: vcDNA=SeqID_71536; Strand=+; Position=1-372
MLYNLENYVIFGGFLPILALSLFLAFRLSHSDFVHPPSPLFSAAAADQRRRKDDASDQFVLASVHVFSPLPADDAPLSPTKHRQFNLGVVANLLAQLLPVPPPLPLFMGNVEPANAIADDRGY

SEQ ID NO: 145114 - protein, 75 aa, Heterodera glycines
  Coding regions on vcDNA: vcDNA=SeqID_71537; Strand=-; Position=1 -55,518-675,763-777
MASVSNDYRQMKTVPPPSKYQPSNQTGQGKRIVDSLWDLRLDSILGDQQITEAVHQLIVAIIIIALISAVLYLEV

SEQ ID NO: 145115 - protein, 113 aa, Heterodera glycines
  Coding regions on vcDNA: vcDNA=SeqID_71538; Strand=-; Position=1-344
SASSDSSLTSSTASSTLNSTNNTTESEEPFHGQSRKGTSQEESRNEASDKTFMQKKELHLPISDTCFSPGRFHPQPFVAHRTAKWEQAKVVEQHVPYICDEQPKRKPKRFPLD

SEQ ID NO: 145116 - protein, 37 aa, Heterodera glycines
  Coding regions on vcDNA: vcDNA=SeqID_71539; Strand=+; Position=1 -33,89-166
MAPINMSSEDPLYLAYRSVGPSADLIVPAVALNLVVL

SEQ ID NO: 145117 - protein, 103 aa, Heterodera glycines
  Coding regions on vcDNA: vcDNA=SeqID_71540; Strand=+; Position=1-312
MSNFAALKASQNLLGQFQQHQQMLNNCHASPAIQRQRSIDYDTEREKNSEMGPMTGGVGTAMSTADLVTALGTIKAQNNSSNIGTDKCEDNEKTRRNLRNFVK

SEQ ID NO: 145118 - protein, 92 aa, Heterodera glycines; identical to SEQ ID NO: 125147
  Coding regions on vcDNA: vcDNA=SeqID_71541; Strand=-; Position=1-304

SEQ ID NO: 145119 - protein, 75 aa, Heterodera glycines
  Coding regions on vcDNA: vcDNA=SeqID_71542; Strand=-; Position=1 -165,293-355
MIGRAVRNIPFIFEGIFKFILYPRKMAISFFEKFYTSQKRLRMRRRAVHNRHFISQRIFIFRGYPRKMAISLFDK

SEQ ID NO: 145120 - protein, 82 aa, Heterodera glycines
  Coding regions on vcDNA: vcDNA=SeqID_71543; Strand=-; Position=1-274
FIFEGIFKFILYLRKMAISFFEKFYTSQKRLRMRRRAVHNRHFISQRIFIFRGYPRKMAISFFDKFYTHTNALEHDREGGAQ

SEQ ID NO: 145121 - protein, 125 aa, Heterodera glycines
  misc_feature (114)..(114): Xaa can be any naturally occurring amino acid
  Coding regions on vcDNA: vcDNA=SeqID_71544; Strand=+; Position=1 -56,999-1082,1134-1329
  Homolog annotation: Hit_ID=AAL13488.1; Match level="QueryCoverage =75%, HitCoverage=9%, E-value=1e-24, Identity=61%"; Hit description =GH01650p [Drosophila melanogaster]
FYFREFLNLYSISEKWLSYWLTCVKELKRDFSQKIVIASIMASFNQQDWEFLASRSEEAGQDWEFLASRSEEAGADALELNLSCPHGMGERGMGLACGQVIQISIFKYISFSFXTKVENISTYFI

SEQ ID NO: 145122 - protein, 75 aa, Heterodera glycines; identical to SEQ ID NO: 138893
  Coding regions on vcDNA: vcDNA=SeqID_71545; Strand=-; Position=1-228

SEQ ID NO: 145123 - protein, 16 aa, Heterodera glycines
  Coding regions on vcDNA: vcDNA=SeqID_71546; Strand=-; Position=1-49
EAIPEGFGLPINLGAS

SEQ ID NO: 145124 - protein, 100 aa, Heterodera glycines
  Coding regions on vcDNA: vcDNA=SeqID_71547; Strand=+; Position=1 -174,427-555
  Homolog annotation: Hit_ID=CAE75191.1; Match level="QueryCoverage =97%, HitCoverage=17%, E-value=5e-13, Identity=40%"; Hit description =Hypothetical protein CBG23137 [Caenorhabditis briggsae]
MACHPEYQQKVHAEIVEHFGAIDGEEEDDEQLLQLTASDVNKLPYLDRCIRETMRMFPLIPILERELQADLRICDKTLPRGAIVAIMPLVIHHNEKVGEG

SEQ ID NO: 145125 - protein, 145 aa, Heterodera glycines
  Coding regions on vcDNA: vcDNA=SeqID_71548; Strand=+; Position=1 -72,251-616
MTGLPFSPSIDSSNHKTTKLFPLVNFLKSTLNYVDKWFRVERFPTNLKWISLKEMKVTSAEVMSLAEQIAPEVNDNELFDEITTLNEILESISDEKFGEMNAEQKWMKVFEAELPNLVLLVSKILSIPVSNACVERVFSLFSSVD

SEQ ID NO: 145126 - protein, 548 aa, Heterodera glycines
  Coding regions on vcDNA: vcDNA=SeqID_71549; Strand=+; Position=1 -51,331-390,445-507,558-685,739-824,869-1089,1154-1448,2126-2176,2368- 2718,2763-2854,2936-3130,3315-3367
  Homolog annotation: Hit_ID=NP_491165.1; Match level="QueryCoverage =92%, HitCoverage=65%, E-value=1e-111, Identity=66%"; Hit description= human Spastic ParapleGia homolog (spg-7) [Caenorhabditis elegans]
MAVAAAVIVGLQYFINRLAYTEISWKQFYTDFLEKNNVERLEVIDNKWVRVITREPTQTVFYFNIGSVDTFERSLTQAQQHLGMETSQQQVPVLYKSETDIVGMIPHMVNFLITGIFLFYMFRMFRGFGGKKPGQRGGGGGFPGMGNLFGVGQSTARVINREDVKTAFADVAGCEEAKIEIMEFVNFLKNPAQYKALGAKIPKGALLTGPPGTGKTLLAKATAGEANVPFITVSGSEFLEMFVGVGPSRVRDMFEMARKKAPCILFIDEIDAVGRKRGGKGAMGGHSEQENTLNQLLVEMDGADIANVCNESALIAARDAHDEVTSKDFENAIERVIAGMEKKSQVLQPDEKKTVAYHEAGHAVAGWFLEFADPLLKATTYFPKLISIIYFPIVLGVNHSAWKGPRLRAIYAQGSIPLLEGAAAGQNVHDFGCVTCGRVSEEIFFGRITTGAQDDLRKITQIAYSQVVKFGMSEKVGPVSFDTPEPGEMAFDKPYSEATAQLIDQEVRDMVSAALRRTRELLMSKVEQIERVALRLLEKEILAREDMI

SEQ ID NO: 145127 - protein, 74 aa, Heterodera glycines
  Coding regions on vcDNA: vcDNA=SeqID_71550; Strand=+; Position=1 -98,308-434
MRRFVNSAKCQRFVNSMIRQLSQNATIRQLSQIQNATIRQLSQMSTIRQLNDSSTQPKCDDSSTQPNVNDSSTQ

SEQ ID NO: 145128 - protein, 39 aa, Heterodera glycines
  Coding regions on vcDNA: vcDNA=SeqID_71551; Strand=+; Position=1-120
VRLGYSNNYGEQKSNAELSTGYKGAIPAGFSLPINLGGI

SEQ ID NO: 145129 - protein, 95 aa, Heterodera glycines; identical to SEQ ID NO: 124528
  Coding regions on vcDNA: vcDNA=SeqID_71552; Strand=+; Position=1-660

SEQ ID NO: 145130 - protein, 194 aa, Heterodera glycines
  Coding regions on vcDNA: vcDNA=SeqID_71553; Strand=-; Position=1 -253,469-629,668-838
MPKQNEIVVKYSFLDLTWFLDIEAVFYAISKTVIPNPQIFESGFQKKCLVVKTIFHISLHNFVSSARIETGIRPLERAARALQEVKKLFEFLQFCFHNFRKLFGIIMPKQNEIVLKYSFLDLTWFLYIEAVFYAISKTKKCLVVKTIFHISLHNFVSSARIETGIRPLERAARALQEGMERKNSYFWDFFRNQN

SEQ ID NO: 145131 - protein, 58 aa, Heterodera glycines
  Coding regions on vcDNA: vcDNA=SeqID_71554; Strand=+; Position=1 -138,197-235
  Homolog annotation: Hit_ID=NP_741904.1; Match level="QueryCoverage =93%, HitCoverage=10%, E-value=5e-10, Identity=53%"; Hit description =tweety (XL991) [Caenorhabditis elegans] emb|CAD44123.1| Hypothetical protein F42E11.2c [Caenorhabditis el
MLSVLFAGVIAFCRQSRKGAIIFSGLGLVIFLVTWLLFSAAFPLTVRVFCNRLSDLCI

SEQ ID NO: 145132 - protein, 56 aa, Heterodera glycines
  Coding regions on vcDNA: vcDNA=SeqID_71555; Strand=+; Position=1 -47,204-324
MQEPNTSPGATSKALGDKLVPGALPLAMIRQLSMEQNEAEHKLEALLARLFNGSAE

SEQ ID NO: 145133 - protein, 153 aa, Heterodera glycines
  Coding regions on vcDNA: vcDNA=SeqID_71556; Strand=+; Position=1 -132,176-385,458-577
MNAISGLDLPYTRMEMFAAATKPLIGTQGIVENLSALADFDLSKLQFPSEANSNDPNQGANIFSRQYIEEWFRYSARNVLKLNYDQSSADNKATAANYSSIETQQQQLYSTTASIQFSEAAALGVIQLNCLNARNIQQKVAEFVETLESHPNL

SEQ ID NO: 145134 - protein, 396 aa, Heterodera glycines
  Coding regions on vcDNA: vcDNA=SeqID_71557; Strand=+; Position=1 -261,324-500,577-1329
MDNEKIFRKASADQEIIKKNIGEWESKREEVTSLIAQAKNDFSGHIQSIKNGKQLSQLPKIQVPKPPPGPKIMPLAPIQPHSSSTSLLQNNGGGAPQQMPPSPLPLDRKVITPPGRSHIGASAPQQQGLAGAGLGQVRIASLNSPLNPNMTNAASAGRQSISSSANVTPVKFHSQPTAIAALSQPPPQAHPPGHFTTIAPIGVRPQNYQNGITVPSASSSSTTIQHQKMSGAQRHSPQLSGASMIGGAQFHANAPPPPIQQFHVVGNSLSSVGQPNATLQQKQQQANAGGGGSFQTWGGGWGDQLNNISELFGQGRSFGPLGSEFGGSGGGVVDGMRSASVIHPPAAGVIGAPSSTVSTGNNVSSNNPPSSQPIGAGRNLQNMSPSQQRNGWPSFG

SEQ ID NO: 145135 - protein, 33 aa, Heterodera glycines
  Coding regions on vcDNA: vcDNA=SeqID_71558; Strand=-; Position=1 -99,530-532
MPPSVKGYDEQIDGPLKTFLDLSKKIGGDVATM

SEQ ID NO: 145136 - protein, 81 aa, Heterodera glycines
  Coding regions on vcDNA: vcDNA=SeqID_71559; Strand=-; Position=1 -146,1043-1142
  Homolog annotation: Hit_ID=NP_741826.1; Match level="QueryCoverage =71%, HitCoverage=12%, E-value=1e-20, Identity=87%"; Hit description =innexin, putative gap junction protein, OPUs gap junctional protein (49.9 kD) (inx-1) [Caenorhabditis ele
MLLYYLAAIFKGLHPRVDDDFVDKLNYHYTSAIIFAFAIIVSAKQYVGRFTTCPIFAWAVVGVLTSLFFMVSSKCFTWAMS

SEQ ID NO: 145137 - protein, 77 aa, Heterodera glycines
  Coding regions on vcDNA: vcDNA=SeqID_71560; Strand=-; Position=1 -78,444-547,596-644
  Homolog annotation: Hit_ID=NP_504559.1; Match level="QueryCoverage =100%, HitCoverage=49%, E-value=1e-33, Identity=87%"; Hit description= AdaPTin or adaptin-related protein (18.6 kD) (apt-2C) [Caenorhabditis elegans] gb|AAB65902.1| Adaptin or
MINYMLLFSRQGKLRLQKWYVAYPDKAKKKITRELVTTILSRKPKMCAFLEYKDTKVVYKRYASLYFCCAIEQTDNE

SEQ ID NO: 145138 - protein, 150 aa, Heterodera glycines
  Coding regions on vcDNA: vcDNA=SeqID_71561; Strand=-; Position=1 -136,197-376,705-818,893-913
AFTFNPTQSSSGNGDGSPKEFGAAGTTSPPQSAGLVKHHSSTNCNGRLSSDSRPSSPPAEACTEKQQHKIAAKVAGQSAGDGEDDQGEEEHVCSLQFINSPAIRRVPKLGLCLWLGTSAGAVVAFQLQVPTNRTGASLTVTPSAMFNGPK

SEQ ID NO: 145139 - protein, 20 aa, Heterodera glycines
  Coding regions on vcDNA: vcDNA=SeqID_71562; Strand=+; Position=1-65
TDQKRTKLCRDTERKRNNLF

SEQ ID NO: 145140 - protein, 54 aa, Heterodera glycines
  Coding regions on vcDNA: vcDNA=SeqID_71563; Strand=-; Position=58 -96,151-276
MKFAPLALLVILLVSLVAAVSANSNNPFDADAADNGGMVRHALASNFRFWHFCL

SEQ ID NO: 145141 - protein, 100 aa, Heterodera glycines
  Coding regions on vcDNA: vcDNA=SeqID_71564; Strand=-; Position=1 -95,693-897
MATAPAALSGHRLTPNFMFPPTASSTPIQRDPSMDFEHPVFMQNQLPMTNAKQRMPNYMKQQPNVQQQQQQQQHHQQTSSDDFDRAVADSMPELHNRSFQ

SEQ ID NO: 145142 - protein, 22 aa, Heterodera glycines
  Coding regions on vcDNA: vcDNA=SeqID_71565; Strand=+; Position=1 -13,77-132
MQRLENFRHGSLCPHMAQLLCA

SEQ ID NO: 145143 - protein, 36 aa, Heterodera glycines
  Coding regions on vcDNA: vcDNA=SeqID_71566; Strand=-; Position=1-113
WMFNYRICSNYSPVSINPAVSNYSPVCLRGVLKNNP

SEQ ID NO: 145144 - protein, 17 aa, Heterodera glycines
  Coding regions on vcDNA: vcDNA=SeqID_71567; Strand=-; Position=1-53
SISTLRRRLEVLKLKIW

SEQ ID NO: 145145 - protein, 46 aa, Heterodera glycines
  Coding regions on vcDNA: vcDNA=SeqID_71568; Strand=-; Position=1 -52,297-385
MEKACKIWRDYIDFSALEILGVSIIAVLFLCLFDALRKIWFASDQL

SEQ ID NO: 145146 - protein, 36 aa, Heterodera glycines; identical to SEQ ID NO: 143999
  Coding regions on vcDNA: vcDNA=SeqID_71569; Strand=-; Position=1-155

SEQ ID NO: 145147 - protein, 27 aa, Heterodera glycines
  Coding regions on vcDNA: vcDNA=SeqID_71570; Strand=+; Position=1-81
MHRIIAAVKKLVVGSVLAVRCTLCVLL

SEQ ID NO: 145148 - protein, 120 aa, Heterodera glycines
  Coding regions on vcDNA: vcDNA=SeqID_71571; Strand=-; Position=1 -114,298-350,553-748
MVVQCVVVVPVFRSRLSRLLVRVEVVAASFGLKSQNIIIFSGGDVPLAFPRILFQNAMYTCVKGKMGKLDGQIFKMQMKIKVQLTGAGREMDEETIWCPKQRAFKKKWPNQSNIYLDIRM

SEQ ID NO: 145149 - protein, 77 aa, Heterodera glycines
  Coding regions on vcDNA: vcDNA=SeqID_71572; Strand=-; Position=1 -174,394-452
  Homolog annotation: Hit_ID=CAE64757.1; Match level="QueryCoverage =90%, HitCoverage=6%, E-value=3e-11, Identity=47%"; Hit description =Hypothetical protein CBG09547 [Caenorhabditis briggsae]
ALGQLGLARTAYETAISFQPGHIDARINLSTILQQLDQSELALETLKDLNYDSCSHIPDERLLCRQAEVLLEQRKAD

SEQ ID NO: 145150 - protein, 241 aa, Heterodera glycines
  Coding regions on vcDNA: vcDNA=SeqID_71573; Strand=-; Position=1 -319,952-1123,1168-1401
MTHHSPSFLDIRTRNELLAHRLALCDREDEILRHFYTFMSPNERRPMENQQFNAQLEDEIEAEPIDLNLAIISYGRQFNKSQRGQQEGLSGDQVAQSRGESMPVNKGYGISDLAHLLLSSVNSSLRIHFLDQWVALYVHKFEQFRQIQRNGKGGGNTMPKVFANKNKLERIVKRQKQQFQASLPGQFLRVLPKLATDYRKLAEAKANPMESEQNQWKGCELLGRMIGGFEMIRKDFERRKS

SEQ ID NO: 145151 - protein, 74 aa, Heterodera glycines
  Coding regions on vcDNA: vcDNA=SeqID_71574; Strand=+; Position=1 -56,916-1003,2167-2214,2273-2305
MPSNSTPFDEGKQKMAEKKCEMNPGKNLEKEANAYGNLMDLPFMAKIEKFVGTAQFGIKKPFRKNHIVEHRNEN

SEQ ID NO: 145152 - protein, 133 aa, Heterodera glycines
  Coding regions on vcDNA: vcDNA=SeqID_71575; Strand=+; Position=1 -60,935-1052,1107-1330
  Homolog annotation: Hit_ID=AAD48446.1; Match level="QueryCoverage =79%, HitCoverage=66%, E-value=7e-22, Identity=47%"; Hit description =nucleoside diphosphate kinase [Trypanosoma brucei]
MSKKNILNGTEIGEISRFRLIVATRKQAMDHYVACAGQPFFPKVISYMTSGPVVAMIWEGVGVVRGIRKILGATPDKVPPPGTLRADYRNNSDVGKYHDTVCHGSDSAEDAQREFGIWFDKSEMPAPLSRVSG

SEQ ID NO: 145153 - protein, 73 aa, Heterodera glycines; identical to SEQ ID NO: 137169
  Coding regions on vcDNA: vcDNA=SeqID_71576; Strand=-; Position=1 -18,115-237,295-375
  Homolog annotation: Hit_ID=NP_501505.1; Match level="QueryCoverage =91%, HitCoverage=53%, E-value=4e-19, Identity=56%"; Hit description =ganglioside-induced differentiation associated protein 3 like (4J504) [Caenorhabditis elegans] emb|CAA910

SEQ ID NO: 145154 - protein, 74 aa, Heterodera glycines
  Coding regions on vcDNA: vcDNA=SeqID_71577; Strand=+; Position=1-225
MAPATQLPQTNAPTPVVEDGPNQKKTSDDIPKQPEVFDETILVCYEALNSFPPTDKIVHQIQSLKKQYPHLFNK

SEQ ID NO: 145155 - protein, 382 aa, Heterodera glycines
  Coding regions on vcDNA: vcDNA=SeqID_71578; Strand=-; Position=1 -161,208-294,343-421,697-894,1024-1647
  Homolog annotation: Hit_ID=NP_956177.1; Match level="QueryCoverage =46%, HitCoverage=21%, E-value=8e-13, Identity=34%"; Hit description =Similar to hypothetical protein FLJ10637 [Danio rerio] gb|AAH45349.1| Similar to hypothetical protein FLJ
MSTIKEKAHSQAMEKWEKEKAHGTVREQMQKKIERNSFRIRNRGSMAVITTMDSPTEFDTITEYISEQIVVLNERNRTSTKKNSVLIDQIHLFVLNIATESSKMFSKEKEEAQSGQSINYDVEMLHPRSAHFALTSLGLLMGETKMLDSASAHENLFTSVRLKWCTASPKLKSDKFPILQRSFPITPAHVSLRQSVCLTSFITNGKSVLLEVFPDVYQGRAEHCKLSPNLHQKLISHYLSRDVNGALLLHCVAMGKKGFTHSLLTDYSNLAKLSANFGGKLSSENVYGPKGSSAELANGLNRTAMAQLIQAAQIVPCPNEQFELVDDESDCDDGEERNSGEEGTEKARCQTVDQIWQNLLVQRETFAVGDIEKETAAERAPK

SEQ ID NO: 145156 - protein, 200 aa, Heterodera glycines
  Coding regions on vcDNA: vcDNA=SeqID_71579; Strand=-; Position=1 -273,406-549,602-764,867-890
  Homolog annotation: Hit_ID=CAE69497.1; Match level="QueryCoverage =98%, HitCoverage=21%, E-value=7e-45, Identity=46%"; Hit description =Hypothetical protein CBG15703 [Caenorhabditis briggsae]
LDLIALNAGDANVWVTGLMALASGTVPGTNGTTASANLRERWLATAFREADADKKGTISEKAAMRLIRSLNTRLLTNRISKKMKNNGGEAQLQQKGRLDEAQFIEAYKDMSTRPEIYFLMVRYANKDYLNTNDLQLFLDLQLFLETEQGLSGVGVDFCENLIDQCEPSAEARELNVMTVGWTVITLSKGKGHFHPNHSSL

SEQ ID NO: 145157 - protein, 336 aa, Heterodera glycines
  Coding regions on vcDNA: vcDNA=SeqID_71580; Strand=-; Position=1 -155,228-338,385-477,607-745,811-938,986-1042,1100-1176
  Homolog annotation: Hit_ID=NP_500253.1; Match level="QueryCoverage =89%, HitCoverage=41%, E-value=2e-67, Identity=49%"; Hit description =spastic paraplegia 3A homolog, atlastin, putative guanylate-binding protein, similar to ARL-6 interacting
NSLEIHWSVFIRMIFQVVVLLMDTQGIFDSVSTFKNCATVFALSTMVSSVQIFNINKNIQEDIFNINKNIQEDHLQHLQLFTEYARLALDEDKKSKPFQSLLFLVRDWSVPHVAEYGSSLLFLVRDWSVPHVAEYGSIGGQRILDKRLEVTSRQHPELRQLRRHIRSSFDNIRCFLMPHPGRYVATNPHYRGELDRMELDFKAQLSSLANYVMELDFKAQLSSLANYVFYPNNLVVKQIGGQPITCRELAGYINAYFEVFSKAEMPEPKTILNAYFEVFSKAEMPEPKTILNTAEANHLAAVVRAKAVYMRETAEANHLAAVVRAKAVYMREMEEV

SEQ ID NO: 145158 - protein, 187 aa, Heterodera glycines
  Coding regions on vcDNA: vcDNA=SeqID_71581; Strand=-; Position=1 -290,457-555,600-774
  Homolog annotation: Hit_ID=CAD48140.1; Match level="QueryCoverage =95%, HitCoverage=18%, E-value=6e-46, Identity=49%"; Hit description =hypothetical protein [Brugia malayi]
MEEEAQKDIEERDALSKRIREREKHNTRHVMSKSEARSKAEATKRLNISEKDDEANDMMGKLRYESRKSYLAKRKEDKRMELEAKVHDDETIFANEKLTKREQLDAKYRKEVLHYVKQYDEAGNVLKVPRYHVPDASSKIIPTEYVEENELPGGDGRRWEDEKLGSAVFHYGAKDAKAKPMEKGQIP

SEQ ID NO: 145159 - protein, 69 aa, Heterodera glycines
  Coding regions on vcDNA: vcDNA=SeqID_71582; Strand=+; Position=1-208
MADFDKHAAQREAESLRTLAFFGVCLSTVATVIAVLSVPFAYQHFQQIGALMHERSGLLQNALRQHVAR

SEQ ID NO: 145160 - protein, 101 aa, Heterodera glycines
  Coding regions on vcDNA: vcDNA=SeqID_71583; Strand=+; Position=1 -155,227-377
MSGHFGTLTPRLVHPTSPVLLTKNGPLGAQHSTPGFRVKQPWLHTHLEFENSYPGGNFGGNQLLDGSISLSPLYPSQTIDLHVRIASDFHQSFLWLHPAQE

SEQ ID NO: 145161 - protein, 16 aa, Heterodera glycines
  Coding regions on vcDNA: vcDNA=SeqID_71584; Strand=-; Position=1 -8,689-731
MSILLPLYLAFNEDNM

SEQ ID NO: 145162 - protein, 70 aa, Heterodera glycines
  Coding regions on vcDNA: vcDNA=SeqID_71585; Strand=-; Position=1 -16,220-416
MDDAHFEPIGTAYWHYVDDNELQLFAQCPNLGPYDRKASEALIQIDHFDGLTDGDQWRFVNGAASIHSNH

SEQ ID NO: 145163 - protein, 36 aa, Heterodera glycines
  Coding regions on vcDNA: vcDNA=SeqID_71586; Strand=+; Position=1-108
NPWVLYPPTKFHLEIPRTPGDLPLSVEFRQTKYSTS

SEQ ID NO: 145164 - protein, 50 aa, Heterodera glycines
  Coding regions on vcDNA: vcDNA=SeqID_71587; Strand=-; Position=1-153
NKLRSHFIVSGNTSEKIDNVFGIHIGIGIIVIILGEVNVIDVVIECAVMF

SEQ ID NO: 145165 - protein, 21 aa, Heterodera glycines
  misc_feature (8)..(8): Xaa can be any naturally occurring amino acid
  Coding regions on vcDNA: vcDNA=SeqID_71588; Strand=+; Position=1-63
KYNVSYEXSFICNHAKMATRK

SEQ ID NO: 145166 - protein, 92 aa, Heterodera glycines; identical to SEQ ID NO: 140812
  Coding regions on vcDNA: vcDNA=SeqID_71589; Strand=-; Position=1-304

SEQ ID NO: 145167 - protein, 92 aa, Heterodera glycines; identical to SEQ ID NO: 127421
  Coding regions on vcDNA: vcDNA=SeqID_71590; Strand=-; Position=1-304

SEQ ID NO: 145168 - protein, 30 aa, Heterodera glycines
  Coding regions on vcDNA: vcDNA=SeqID_71591; Strand=+; Position=1 -52,119-159
MKALSLPNFYLTKLWTKGFLIEIFTKQEKN

SEQ ID NO: 145169 - protein, 37 aa, Heterodera glycines
  Coding regions on vcDNA: vcDNA=SeqID_71592; Strand=+; Position=1-111
MRKLSCTVWNSMVGWGMPVTLHSNTTWPPICASWSDR

SEQ ID NO: 145170 - protein, 123 aa, Heterodera glycines
  Coding regions on vcDNA: vcDNA=SeqID_71593; Strand=-; Position=1 -291,483-563
ETLEKLSPSSDNGDSEANSDQILARLLSVHQTDKAAKAKPTKSTQITFSDSLIDLCPPPTIGQEPLSFALGEDDPFAYEPAELGELADFDLPEDLPGLSGTGTGTGFFKNEITVTGLSSTGTA

SEQ ID NO: 145171 - protein, 25 aa, Heterodera glycines
  Coding regions on vcDNA: vcDNA=SeqID_71594; Strand=+; Position=1-75
TCTCGVVVKLSTFHNFSPGFNSPLG

SEQ ID NO: 145172 - protein, 94 aa, Heterodera glycines
  Coding regions on vcDNA: vcDNA=SeqID_71595; Strand=+; Position=1-287
FKSLGLNPPAFQSLGLNPPAFKSLGLNPPAFQSPGLNPPTFQSPGLNSSAFQSLGLNPPTFQSLGLNPPTFQSTGLNPPGFQSLGLNPSAFQSL

SEQ ID NO: 145173 - protein, 18 aa, Heterodera glycines
  Coding regions on vcDNA: vcDNA=SeqID_71596; Strand=+; Position=1-56
MTSYYLNRLFRVRSMSLQ

SEQ ID NO: 145174 - protein, 146 aa, Heterodera glycines
  Coding regions on vcDNA: vcDNA=SeqID_71597; Strand=-; Position=1-439
NGVSKNRNYAQKASQTILAHPIPSTIAFIHPIMSAKIIRVPKIACDLRLEKNGVSKNRNYAQKASQPILALPIPSTIAFIHPIMNAKIIRVPKIACDLSLEKNGLSKNRNYAQKASQTILALPIPSTIAFIHPIMSAKIIRVPKIA

SEQ ID NO: 145175 - protein, 73 aa, Heterodera glycines
  Coding regions on vcDNA: vcDNA=SeqID_71598; Strand=-; Position=1 -150,302-373
MPVITGLTQLMAFNREKEMMREIMKNGPIHASHIMYTGYGSCCKNNEIYEDGSTLARMVLGNDQTPKNGVSLF

SEQ ID NO: 145176 - protein, 61 aa, Heterodera glycines
  Coding regions on vcDNA: vcDNA=SeqID_71599; Strand=+; Position=1-185
MGAIVRLILRAFCDFVRVQKFSRHGFEQLQVDFAYVRQKLWYFVADEHMLNTCIEDIVTAA

SEQ ID NO: 145177 - protein, 138 aa, Heterodera glycines
  Coding regions on vcDNA: vcDNA=SeqID_71600; Strand=-; Position=1 -278,351-489
MSTPPGREMPHKVLFGLTCRNLNEAKAMANANQCLLLVTHLISSAVDELASSKLLRKTTICSTPIRKGVSIRSRMFPNWPLLNTSMCPSAAPTHRQTEQFAVHCLRLNSHFAFVRVVNGQSAVATRGQQIIAPNVQRI

SEQ ID NO: 145178 - protein, 45 aa, Heterodera glycines
  Coding regions on vcDNA: vcDNA=SeqID_71601; Strand=+; Position=1-161
CKQNKKQSEQLINLILIVHTNRSLHFFTNSPNYRWIQQFGLGTLV

SEQ ID NO: 145179 - protein, 37 aa, Heterodera glycines
  Coding regions on vcDNA: vcDNA=SeqID_71602; Strand=-; Position=1-114
GCAEPDKIRFRLNRRFRLWPKIRYGFKTDYDYGPKSD

SEQ ID NO: 145180 - protein, 114 aa, Heterodera glycines
  Coding regions on vcDNA: vcDNA=SeqID_71603; Strand=+; Position=1 -71,502-575,665-762,934-1018
  Homolog annotation: Hit_ID=CAE58994.1; Match level="QueryCoverage =100%, HitCoverage=18%, E-value=2e-41, Identity=70%"; Hit description= Hypothetical protein CBG02267 [Caenorhabditis briggsae]
SDSLAVIAANLDCIPYFKNKTTIGYARSMPTACAVDRVAKARGRQCYEVPTGWKYVPTGWKYFGNLMDAGKLSLCGEESFGTGSDHIREKDGLWALLAWLQILAHKKQSVEQLV

SEQ ID NO: 145181 - protein, 116 aa, Heterodera glycines; identical to SEQ ID NO: 127487
  Coding regions on vcDNA: vcDNA=SeqID_71604; Strand=+; Position=1-351

SEQ ID NO: 145182 - protein, 146 aa, Heterodera glycines
  misc_feature (21)..(21): Xaa can be any naturally occurring amino acid
  misc_feature (54)..(54): Xaa can be any naturally occurring amino acid
  Coding regions on vcDNA: vcDNA=SeqID_71605; Strand=-; Position=1-447
  Homolog annotation: Hit_ID=NP_671477.1; Match level="QueryCoverage =91%, HitCoverage=46%, E-value=2e-27, Identity=56%"; Hit description =rRNA promoter binding protein [Rattus norvegicus] gb|AAK21974.1| rRNA promoter binding protein [Rattus no
HATARLTRPLEPILFPKLRIXFADFPYLHYSRLEAVHLGDLLRISVRSGRRFKXLPSHFQGPCGAHETPQEPRCFTGATSLSQAEPLPGTHTLNEKRTLARTPHDVCEFICVTAQNSSCEPSFLAWRGNEPTSLSATGWTNCASTE

SEQ ID NO: 145183 - protein, 68 aa, Heterodera glycines
  Coding regions on vcDNA: vcDNA=SeqID_71606; Strand=+; Position=1 -126,273-353
MYFPEDVDFTARIRSIVRTLPKEIGDFKAITLKELEGGSDPQALWVEIPYIFADFNMANLCIFGSHFK

SEQ ID NO: 145184 - protein, 98 aa, Heterodera glycines
  Coding regions on vcDNA: vcDNA=SeqID_71607; Strand=-; Position=1 -28,76-344
MYLHKKGIPETLKRFKPRNQKDEVIIRLIRDEDIDETAEIIQESYLQDCLKIKHATPEQCKQMKKVPLERTRMALSKFKAEEDGALIVAETTALTDAG

SEQ ID NO: 145185 - protein, 100 aa, Heterodera glycines
  Coding regions on vcDNA: vcDNA=SeqID_71608; Strand=-; Position=1-304
  Homolog annotation: Hit_ID=CAE73582.1; Match level="QueryCoverage =88%, HitCoverage=41%, E-value=7e-20, Identity=45%"; Hit description =Hypothetical protein CBG21056 [Caenorhabditis briggsae]
TKTPGPPGPSTKTPGPPGPSTKTPGPPGPSTKTPGPPGPSTETPGPPGPSTETPGPPGPSTETPGPPGPSTETPGPPGPSTAGTSSTKTYTVPTTPKRLF

SEQ ID NO: 145186 - protein, 92 aa, Heterodera glycines
  misc_feature (86)..(86): Xaa can be any naturally occurring amino acid
  misc_feature (92)..(92): Xaa can be any naturally occurring amino acid
  Coding regions on vcDNA: vcDNA=SeqID_71609; Strand=+; Position=1-664
LFEYPKRTLEKIDFFVFGAVPPSRCAQIYGETESFRSSFPIACTLILRWIFAPHKCLSTPNGHLKKSIFFVFGAVPPNPMRPDLWXDRILPX

SEQ ID NO: 145187 - protein, 79 aa, Heterodera glycines
  Coding regions on vcDNA: vcDNA=SeqID_71610; Strand=+; Position=1-283
CFSIKKEDGEKIFKKIFPYILVISFCFWWGAWNSGIMRTRPIWQVKQRLLTSQKVRCRDETNQHCLPRGTRHGPPKEWI

SEQ ID NO: 145188 - protein, 141 aa, Heterodera glycines
  Coding regions on vcDNA: vcDNA=SeqID_71611; Strand=+; Position=1 -207,274-415,549-625
  Homolog annotation: Hit_ID=NP_871815.1; Match level="QueryCoverage =68%, HitCoverage=28%, E-value=1e-18, Identity=50%"; Hit description =DeHydrogenase, Short chain (dhs-2) [Caenorhabditis elegans] gb|AAO38639.1| Dehydrogenases, short chain pr
MGPAALLLLLPSLLLLFLLIRALLELIPVSRLDKRSVLITGCDSGFGFDLALRCLGAGMRVFAGCLTQTGIQSLKKSAQEKGIAVELLEPIELDVTSDESVAKALEFVERKLGPGKELGRLADSKGLRRCFPGYGQTKPSE

SEQ ID NO: 145189 - protein, 34 aa, Heterodera glycines
  Coding regions on vcDNA: vcDNA=SeqID_71612; Strand=-; Position=1 -34,312-382
MSAKDALKPIQSILSQKSFVSSYFICWCPITISD

SEQ ID NO: 145190 - protein, 41 aa, Heterodera glycines
  Coding regions on vcDNA: vcDNA=SeqID_71613; Strand=-; Position=1 -115,510-520
MNEWNGHGKERKWWWWCCWTLGVVGLANFSFLLADLAVKDI

SEQ ID NO: 145191 - protein, 17 aa, Heterodera glycines
  Coding regions on vcDNA: vcDNA=SeqID_71614; Strand=+; Position=1-66
HKHLFDLFYHIHNLIKI

SEQ ID NO: 145192 - protein, 30 aa, Heterodera glycines
  Coding regions on vcDNA: vcDNA=SeqID_71615; Strand=-; Position=1 -88,915-919
MLIKKGSNTKLIRSLLHGDLISPFWLGTRV

SEQ ID NO: 145193 - protein, 17 aa, Heterodera glycines
  Coding regions on vcDNA: vcDNA=SeqID_71616; Strand=-; Position=1-66
HKHLFDLFYHIHNLIKI

SEQ ID NO: 145194 - protein, 47 aa, Heterodera glycines
  Coding regions on vcDNA: vcDNA=SeqID_71617; Strand=-; Position=1-485
LEKMPTLVAFKIFRNSDFFINYLFFAKLIHKYFFRKCSETHKTLFTG

SEQ ID NO: 145195 - protein, 78 aa, Heterodera glycines
  Coding regions on vcDNA: vcDNA=SeqID_71618; Strand=-; Position=1-236
CGGGNPFYAWKYYRNLTVSGTNHTMNTGCKPYKMPSQSNCVFSCNKEWLQQQYPNKAKTPKTPGGIPLFGTTWEVFLA

SEQ ID NO: 145196 - protein, 100 aa, Heterodera glycines
  Coding regions on vcDNA: vcDNA=SeqID_71619; Strand=+; Position=1 -210,266-358
  Homolog annotation: Hit_ID=NP_497931.2; Match level="QueryCoverage =93%, HitCoverage=11%, E-value=7e-20, Identity=54%"; Hit description =WD repeat endosomal protein (76.3 kD) (3F671) [Caenorhabditis elegans] emb|CAA86338.2| Hypothetical prote
MTIPRFHRDRLSATEMLQLRKVMEHVWEKILYPAETATDDCGGGASAAHSLATQLPENIEERIELFCNEQKLDSDMDLRTVKHLIWKQGGDLLIFYRPVK

SEQ ID NO: 145197 - protein, 118 aa, Heterodera glycines
  Coding regions on vcDNA: vcDNA=SeqID_71620; Strand=-; Position=1 -216,283-422
  Homolog annotation: Hit_ID=NP_778174.1; Match level="QueryCoverage =86%, HitCoverage=92%, E-value=8e-10, Identity=31%"; Hit description =e(y)2 protein [Mus musculus] ref|NP_064574.1| e(y)2 protein [Homo sapiens] gb|AAH48361.1| E(y)2 protein [
MQGSSARSFLNPLKKLQRKEDLEKEFVESGEKDRVQEVVERRLHESGWAKRVESMCEEYIAKKVAKVNKAAWGYERVELQAMVDELKDASRRIVPDEVKRELMQLIQEFVNSRTSTGE

SEQ ID NO: 145198 - protein, 224 aa, Heterodera glycines
  Coding regions on vcDNA: vcDNA=SeqID_71621; Strand=-; Position=1 -62,257-533,1597-1672,1809-1951,2190-2308
  Homolog annotation: Hit_ID=CAE67550.1; Match level="QueryCoverage =58%, HitCoverage=35%, E-value=6e-09, Identity=34%"; Hit description =Hypothetical protein CBG13075 [Caenorhabditis briggsae]
HYAYNAGDPNVQGATSFDPQVGGTYKAYFDQPVPGTVPPAAAPQPLASAYVGRPASNAPVFPPPQPPQVQQMAAPVGGAWAASGGPPQQRGPPAPLNSFMGGPPPYGQQTPRGGGDGGFDRRSSGGGPMRQERSRGGGMQQGDVETDQNGGPKIRIYKEGGQSKGECTITFRDTAVAQRVMDTYNGFGGGRDFRRDGGGGSGGRGPPRDGGGFEGELWKSNDGV

SEQ ID NO: 145199 - protein, 216 aa, Heterodera glycines
  Coding regions on vcDNA: vcDNA=SeqID_71622; Strand=+; Position=1 -130,372-494,730-811,1077-1392
  Homolog annotation: Hit_ID=CAE67006.1; Match level="QueryCoverage =90%, HitCoverage=98%, E-value=5e-24, Identity=30%"; Hit description =Hypothetical protein CBG12405 [Caenorhabditis briggsae]
MKSAINRVMLNIFSKKMASCSSDKSVRLWDLRNPSSHTKLSTPGANLFVTWSYCDNFIIFGDKSDNLGVIDARAMKTLELFTFKDEINEFVCHPNGQLIFVATDLGKLEVLRLDYPVRSVSFSHCSNLIASGSEDRVIDISWTPTGEKCALSKNAYTFSNIQIRVAEVPIATECYDVAWHPRLYLLAYAISGGLNDNRSDRSDQSTLRVFGYSGGI

SEQ ID NO: 145200 - protein, 160 aa, Heterodera glycines
  Coding regions on vcDNA: vcDNA=SeqID_71623; Strand=-; Position=1-766
SPLNRRTANPSLEVSRPTYSNKRRECRPDTPVLSVSTSSNFTSSLTLSAECFATFPHGTCSLSDSWPYLVLDEVYHLIWAAIPNNPTPRHVKMDRHRQLDRSCTFSGAPVKGNLNKRANPSSRSIRYTSQPRGAAIQRWTLPSSLAVTTGILVSFFSSAY

SEQ ID NO: 145201 - protein, 20 aa, Heterodera glycines
  Coding regions on vcDNA: vcDNA=SeqID_71624; Strand=-; Position=1-60
SRLKTGASRPFLNLLALDGR

SEQ ID NO: 145202 - protein, 128 aa, Heterodera glycines; identical to SEQ ID NO: 125618
  Coding regions on vcDNA: vcDNA=SeqID_71625; Strand=-; Position=1-1505

SEQ ID NO: 145203 - protein, 261 aa, Heterodera glycines
  Coding regions on vcDNA: vcDNA=SeqID_71626; Strand=-; Position=1 -63,126-293,510-715,1132-1348,1588-1719
  Homolog annotation: Hit_ID=CAE64782.1; Match level="QueryCoverage =94%, HitCoverage=48%, E-value=2e-22, Identity=29%"; Hit description =Hypothetical protein CBG09575 [Caenorhabditis briggsae]
MTRRNAFFQRNSIRKTWASDALNDTVIRFLIGDAPKSDARNQKARDEQIKLELEFKKFGDLIFLNGITDNYQNLHLKWHAALEWQQNFCKNAEFLMKTDDDTIVHLPRLDRWIEHKFRPALKQNVATYFGWIISGVKPIRDKGHRWFVPKSAYPYEWYPAYMQGATYLASAQAISAVMRHVHEVNGFNMDDIVFTGILAKLANVTLFDAGAHFRVGNALHANEKCVDRIPEAVALYGADSLAQFEEIYDKLDSIECAQSKA

SEQ ID NO: 145204 - protein, 95 aa, Heterodera glycines; identical to SEQ ID NO: 125597
  Coding regions on vcDNA: vcDNA=SeqID_71627; Strand=+; Position=1-660

SEQ ID NO: 145205 - protein, 439 aa, Heterodera glycines
  Coding regions on vcDNA: vcDNA=SeqID_71628; Strand=+; Position=1 -25,1182-1368,1405-1526,1582-1647,1711-2000,2784-2876,3031-3115,3239 -3537
  Homolog annotation: Hit_ID=XP_392622.1; Match level="QueryCoverage =98%, HitCoverage=70%, E-value=1e-51, Identity=34%"; Hit description =similar to LIM-homeodomain protein MLHX2 [Apis mellifera]
AFIRVKSDTLFGFLCSACHRPILDQSFLLVDDQKWHSECCVCVICGQNLEKEPTCFVRDGFLFCHRDYFALSKYGKPCDRCGIPIARGLSKYGKPCDRCGIPIARGELVMKVPQNGNSDQKSLLFHVHCFSCVCCGQMLSPGQQFTVGFSCVCCGQMLSPGQQFTVGISAILILAHFHLNPSLSLGILILAHFHLNPSLSLGQFSHKMSDEEQVTLKNFEFLNFFRNQLHFLTDLCSSNLGGHGQQTNRKVFEQLSTGVISPNNPNRQPIFFCGIEQGKPREKGRGEKRRKRKSQFTKANAILGAIQKGKIFSSNGGETPGAMGANGRQKRMRTSFKHHQLRTMKNYFACNHNPDAKDLKQLSQKTGLTKRVLQVWFQSNSSHWRCFHLSSSECPCQTSAESANSRGSGGGNNGTNPSLTTAMSGVHVHASLSTSVECG

SEQ ID NO: 145206 - protein, 99 aa, Heterodera glycines
  Coding regions on vcDNA: vcDNA=SeqID_71629; Strand=+; Position=1 -288,663-674
  Homolog annotation: Hit_ID=NP_502000.1; Match level="QueryCoverage =94%, HitCoverage=22%, E-value=3e-16, Identity=42%"; Hit description =nodulin MtN3 family protein (4L544) [Caenorhabditis elegans] emb|CAA94322.1| Hypothetical protein C06G8.1
MVNFVTTVATFFCGMYQIRGFPTFSLFSSGICRQIWKRGETADIKAYSFLLGVLGSSYWFTYGVLLQHPLIQYVNACQFVIYSAYTAFYWTMSTKKIGA

SEQ ID NO: 145207 - protein, 44 aa, Heterodera glycines
  Coding regions on vcDNA: vcDNA=SeqID_71630; Strand=-; Position=1 -68,112-175
  Homolog annotation: Hit_ID=XP_392325.1; Match level="QueryCoverage =100%, HitCoverage=6%, E-value=3e-12, Identity=68%"; Hit description =similar to CG9054-PA [Apis mellifera]
MTAFDELGVLPELATALNDLEWTLPTDIQSEAIPAILGGGDVCM

SEQ ID NO: 145208 - protein, 122 aa, Heterodera glycines
  Coding regions on vcDNA: vcDNA=SeqID_71631; Strand=-; Position=1 -155,558-636,705-839
  Homolog annotation: Hit_ID=NP_498638.1; Match level="QueryCoverage =97%, HitCoverage=20%, E-value=5e-40, Identity=62%"; Hit description =ALDH9B2, ALdehyde deHydrogenase (alh-12) [Caenorhabditis elegans]
PAVLTDLDDEMEIVKEEIFGAVMLILRFKTDKEAIARANATQFGLASGLCTTNLARAHRVAAQLKVGTVFVNTYNDAEVHIPFGGFKNSGHGRENCVECLHEYSQVKSVYVNIDEGLQHNLG

SEQ ID NO: 145209 - protein, 20 aa, Heterodera glycines
  Coding regions on vcDNA: vcDNA=SeqID_71632; Strand=-; Position=1 -28,658-692
MCFPLDELLAVAAIKKRTLA

SEQ ID NO: 145210 - protein, 264 aa, Heterodera glycines
  misc_feature (20)..(20): Xaa can be any naturally occurring amino acid
  misc_feature (32)..(32): Xaa can be any naturally occurring amino acid
  misc_feature (42)..(43): Xaa can be any naturally occurring amino acid
  misc_feature (119)..(119): Xaa can be any naturally occurring amino acid
  misc_feature (135)..(135): Xaa can be any naturally occurring amino acid
  misc_feature (201)..(201): Xaa can be any naturally occurring amino acid
  misc_feature (258)..(258): Xaa can be any naturally occurring amino acid
  Coding regions on vcDNA: vcDNA=SeqID_71633; Strand=-; Position=1-808
  Homolog annotation: Hit_ID=BAB33421.1; Match level="QueryCoverage =100%, HitCoverage=94%, E-value=9e-88, Identity=67%"; Hit description= putative senescence-associated protein [Pisum sativum]
FSHNPSDGSFAPLVYRPSTXTKCLNLRFLSYXAGLLLATGLXXGKTNLSHDGLNPAHVPYWWVNNPTLGEFCFAMIGRADIEGSKSDVAMDAWPPQASYPCGNFSDTSCWKLYTLKDRXATLSRSVFVLKIRIKXAFAFLLYERFPSSLSSLGHLRYALTDVPPQSNSPPDTVIGAGRRARVARLNTKMDTRRTPVLPIKXGIDESSGISLAPCGSHLCYTSHDSSQSQTRVKLNRVFFPAKFAKPVPLAVVSLDSRXGQWESR

SEQ ID NO: 145211 - protein, 383 aa, Heterodera glycines
  Coding regions on vcDNA: vcDNA=SeqID_71634; Strand=+; Position=1 -175,249-521,564-667,803-863,910-1107,1162-1295,1336-1446,1497-1589
  Homolog annotation: Hit_ID=BAD04052.1; Match level="QueryCoverage =98%, HitCoverage=60%, E-value=4e-38, Identity=33%"; Hit description =vasa homologue [Leucopsarion petersii]
MAEAWNGGNDNLGGGRGGGRGALPPMAEAWNVGNDNLGGGRGGRGRGALPPMDSGTDFDNSGVGARGGRGRGAPPLVDLGLDFGQPHNLSNHRTNHGLSGPETNGVSARGGRGRGALMPMDDAFNVRNDNFGGAEGHGAQPPMDSGCNLGGEGFVPTKRSIAELFEEDARVKDKYITIRDEDENKANYTVPRKIQSLTFPLIKAGHDLKGHAETGSGKSAAFLLPIIDAVMKLKKGGHYKSRRCCPFALIVEPTRELTVQVYDQARKLAEECDVSVSRAYGMFLRHVNLRQISTDGCDILVGTPGRLCDFFQSKNLLCDQIKVLVFDEADQLLEDGFQAVLRQLNNVNNWPQPENRQTLLFSATFPLVVQNWADEWMRKDSMM

SEQ ID NO: 145212 - protein, 95 aa, Heterodera glycines
  Coding regions on vcDNA: vcDNA=SeqID_71635; Strand=+; Position=1-703
MFEYPKRTLEKIDFFVFGAVPPNRCAQIYGETESFGSSFPIACTLILRWIFAPHNCLSTPNGHLKKSIFLFSGQSPRTDAPRFMGRPNPSGVASL

SEQ ID NO: 145213 - protein, 86 aa, Heterodera glycines
  Coding regions on vcDNA: vcDNA=SeqID_71636; Strand=-; Position=1 -141,192-308
  Homolog annotation: Hit_ID=XP_321452.1; Match level="QueryCoverage =91%, HitCoverage=29%, E-value=2e-09, Identity=40%"; Hit description =ENSANGP00000022095 [Anopheles gambiae]
IVAKTFADYSVIPISIAGTLPLKAHISVATNEILSVGKDKDSQSILKCIERDATFRYNVLTVDSEEAVPCLNVNNHLIFRLDLNEP

SEQ ID NO: 145214 - protein, 24 aa, Heterodera glycines
  Coding regions on vcDNA: vcDNA=SeqID_71637; Strand=+; Position=1-102
TLKLFQKPAVKLCIFKGDESTLAM

SEQ ID NO: 145215 - protein, 281 aa, Heterodera glycines
  Coding regions on vcDNA: vcDNA=SeqID_71638; Strand=-; Position=1 -500,1223-1271,1327-1623
PSPHLDVETIYKKIKEKMLAQFEGWWKRVPEQKEPLYEFFKQLEDISMRYVMAIVDAFFDGISIESFRQEYSLGVKGGAVSGMIRIGFDTLALIQTSKFVYFNEHWEKCQLNLSVLIRDRTTGVGGSRVLIPTESRSIPTILKERSGRIPNLIPLDSEKIQRYPNPAIIIIRPAAHLEFISIYVKVIKTKDQQRPIAKNDRTIHPNQRVGSETEQIAKISANDKTPTGVIGETNAFFDHFFADQHNNNLFDKESHHFNLNIFIQTFDKSLQITKFLTIGLA

SEQ ID NO: 145216 - protein, 117 aa, Heterodera glycines
  Coding regions on vcDNA: vcDNA=SeqID_71639; Strand=-; Position=1 -346,480-487
MYVNIRRFPTDQFADQVDIYRDDPREDVHELWRKFTESIDWIHRLNCGRKLLQFIQLLHRLLPKYTEMNRLKAEDQREQLEEEMFWAAEEEETVPTPPAEGAARGDDEGNSAKNRAP

SEQ ID NO: 145217 - protein, 22 aa, Heterodera glycines
  Coding regions on vcDNA: vcDNA=SeqID_71640; Strand=-; Position=1-66
FLLHFCYEIYGKRPKYVLKFEN

SEQ ID NO: 145218 - protein, 73 aa, Heterodera glycines
  Coding regions on vcDNA: vcDNA=SeqID_71641; Strand=-; Position=1-224
FVNVLDIFGMNQLSFRLANVSVKPSMVGEARILFRATRKAVADSKHEVHGGIWDPRQSRKFEMAEAKINKSLE

SEQ ID NO: 145219 - protein, 222 aa, Heterodera glycines
  Coding regions on vcDNA: vcDNA=SeqID_71642; Strand=-; Position=1 -166,217-429,1317-1600,2281-2286
MQEHLSLRSPNIGQRSPSIRSPMQALKISPRGEIVANDSAAANEHNVSSSDHSKYDRTESGSAGFFRDPAGLNSGSRPRDPSRLLFQNLLDLVGIPTRGSSDPSRPVTTLYKEFVDFKISASLFWAKKSAKTPRGELIEMYWDDEIMETKSQEKVGGEVSNEKSFQKISKQLINQLSKLRERFNAKPKKGRGFIVLLEDIYFEVGSPGLRSKINKISEAMKK

SEQ ID NO: 145220 - protein, 28 aa, Heterodera glycines
  Coding regions on vcDNA: vcDNA=SeqID_71643; Strand=-; Position=1-86
IFCISIEKKILNRLIRKFNTKIRPTLEL

SEQ ID NO: 145221 - protein, 83 aa, Heterodera glycines
  Coding regions on vcDNA: vcDNA=SeqID_71644; Strand=+; Position=1 -59,206-398
MPNQLTRLKIWYVNINQQLRASKAAVVPCWWRQHWHNCCQPAQMPLVFVANRTASSSSPLLQAFDGWKWRMVKAFGSYVQLDV

SEQ ID NO: 145222 - protein, 214 aa, Heterodera glycines
  Coding regions on vcDNA: vcDNA=SeqID_71645; Strand=+; Position=1 -76,113-681
MNAKIIRVPKITCDLILEKNGLSKNPLPIPSTIAFIHPIMSAKIIRVPKIACDLSLAKNGVSKNRNYAQKASQTILALPIPSTIAFIHPIMSAKIIRVPKIACDLSLAKNGVSKNRNYAQKASQTIFLALPIPSTIAFVHPIMSAKIIRVPKIACDLSLAKNGVSKNRNYAQKASQTILALPIPSTIAFIHPIMSAKIIRVPKIACDLSLEKMV

SEQ ID NO: 145223 - protein, 107 aa, Heterodera glycines
  Coding regions on vcDNA: vcDNA=SeqID_71646; Strand=-; Position=1 -50,526-766,832-864
MSKEAENKFCIISWALRLPQQNKTSTSERIRHLAYARRHSAELALALSLLGIMFMVLAMEFGLAKWQKMDEAMRWTLAVTTVTLLLVTVRYHVLQAKTRYLKYRNTF

SEQ ID NO: 145224 - protein, 152 aa, Heterodera glycines
  Coding regions on vcDNA: vcDNA=SeqID_71647; Strand=-; Position=1 -24,221-445,1083-1292
MNSLKTDYAINNTLLTSGLMEDHHLEQGTATIKPVDVLMNAWSVAERLYNDGKVKALGVSRTDIEMVKLLCERAKTRPHCWQVIDLAPLMANFDDVLSLCSHHKVVPIVRANAMGASSKFGSQQQRGFYHTLLREMANKYGKSATQVATGTH

SEQ ID NO: 145225 - protein, 44 aa, Heterodera glycines
  Coding regions on vcDNA: vcDNA=SeqID_71648; Strand=-; Position=1 -106,980-1008
MRVSWSSVHHSEHTYIICLTSLTPINSFISTMNDESLIKKYSLK

SEQ ID NO: 145226 - protein, 103 aa, Heterodera glycines
  Coding regions on vcDNA: vcDNA=SeqID_71649; Strand=+; Position=1 -294,666-683
  Homolog annotation: Hit_ID=NP_492763.1; Match level="QueryCoverage =82%, HitCoverage=20%, E-value=1e-13, Identity=45%"; Hit description =predicted CDS, putative protein family member (1L135) [Caenorhabditis elegans] emb|CAB02095.1| Hypothetic
MVVAQSVRAVRVVLDADMGVINPDHLLEHFLAKFDTELPHGGTIDMVFYERIFNGEIMAGSYWARNTRFAIEMLHFWANFTVPSRTPFRGGTDNGAIHDNRGY

SEQ ID NO: 145227 - protein, 276 aa, Heterodera glycines
  Coding regions on vcDNA: vcDNA=SeqID_71650; Strand=+; Position=1-828
MNAKIIRVPKIACDLSLAKNGLSKNRNYAQKASQTILALPIPSTIAFIHPIMSAKIIRVPKIACDLSLAKNGVSKNRNYAQKASQTILALPIPSTIAFIHPIMNAKIIRVPKIACDLSLEKNGLSKNRNYAQKASQTILAHPIPSTIAFIHPIMNAKIIRVPKIACDLSLEKNGVSKNRNYAQKASQPILAHPMPSTIAFIHPIMNAKIIRVPKIACDLSLAKNGVSKNRNYAQKASQPILAHPIPSTIAFIHPIMSAKIIRVPKIACDLSLAKNG

SEQ ID NO: 145228 - protein, 189 aa, Heterodera glycines
  Coding regions on vcDNA: vcDNA=SeqID_71651; Strand=+; Position=1 -552,1020-1040
  Homolog annotation: Hit_ID=XP_308192.1; Match level="QueryCoverage =96%, HitCoverage=46%, E-value=2e-51, Identity=56%"; Hit description =ENSANGP00000021557 [Anopheles gambiae]
SAFEKAKAIMFSELLLTHYDPHTSIVVAADASKDGIGATISHIFPDKKEVIEHASTVLTNAQQNYSQIEKEALALVFAVQKFHRMLFGRKFTLLTDHKPLLASKKGIPIYAASRLQRWALIMANYDFEIRYINTASFGQADVLSRLIANYPRPEEDILIANICTKTECYISTILQTKTEQLPVTPSLAL

SEQ ID NO: 145229 - protein, 94 aa, Heterodera glycines
  Coding regions on vcDNA: vcDNA=SeqID_71652; Strand=-; Position=1 -8,779-1055
MSKLNTHFQAVVVERFALMKDEDFLNFFGTPVDETVEEDKNENNNIHLRSELKAADGEEDKNDLPTEFDAREAWKDCAEIIQSGYAQGGLEDDL

SEQ ID NO: 145230 - protein, 59 aa, Heterodera glycines
  Coding regions on vcDNA: vcDNA=SeqID_71653; Strand=-; Position=1 -75,348-452
MGCRALEDPLVENANGGRNGQRSSRATLYDWLRARYECKSAFLNVYEKICMDNREIVFK

SEQ ID NO: 145231 - protein, 149 aa, Heterodera glycines
  Coding regions on vcDNA: vcDNA=SeqID_71654; Strand=-; Position=1 -129,181-255,324-370,426-624
  Homolog annotation: Hit_ID=NP_871817.1; Match level="QueryCoverage =96%, HitCoverage=38%, E-value=2e-27, Identity=42%"; Hit description =oxysterol-binding protein (1G409) [Caenorhabditis elegans] gb|AAN84853.1| Oxysterol binding protein (osbp
MQAPDWGNYDTNGTDYDYIYNNSDERDNWNSEQAGVFRHLVTQLGTGQTLQNLALPTFVLGTTLSPRNLDELIAGAYENTAEKRFLAVLKYYLNSFYPARKTDDAKKPYNPILGEVFRCRWTLPGVPLSASRTAGGPFPGSATNQVQFK

SEQ ID NO: 145232 - protein, 184 aa, Heterodera glycines
  Coding regions on vcDNA: vcDNA=SeqID_71655; Strand=+; Position=1 -115,163-347,431-523,1128-1274,2195-2209
  Homolog annotation: Hit_ID=NP_501807.2; Match level="QueryCoverage =53%, HitCoverage=21%, E-value=3e-11, Identity=39%"; Hit description =delayed-early response protein/equilibrative nucleoside transporter family member (4K785) [Caenorhabditis
MTTGSDRTQLQMQLHFNANNSSEASQSQNSSEQMQNCSTNERVAGEDSVPFIDRETFGDAENDIGRRPPPDRFRLVYLIVLLHGMGMLLPWNTFITIAGDYYLQFKFANVSNEDNYKVYFFNYLTVCAQIPNFYNYYVQKAAKARANNGMNILHEETGEAKANRKVTHPPVKTYIAVFSEGSQI

SEQ ID NO: 145233 - protein, 43 aa, Heterodera glycines
  Coding regions on vcDNA: vcDNA=SeqID_71656; Strand=+; Position=1-502
PIRWTILCIQQRYSTDCVNNYVYICPGLADENFQKPHSASKKA

SEQ ID NO: 145234 - protein, 264 aa, Heterodera glycines
  Coding regions on vcDNA: vcDNA=SeqID_71657; Strand=+; Position=1 -15,62-579,712-973
  Homolog annotation: Hit_ID=CAE63201.1; Match level="QueryCoverage =35%, HitCoverage=13%, E-value=9e-19, Identity=45%"; Hit description =Hypothetical protein CBG07556 [Caenorhabditis briggsae]
MKHNQIEQLDDGHLRNLSSLSLLTLTGNKISQISPNFAQNTPNLRYIYLGDNKLERIDPSSIKQFSAAEIIDLSFNNLAEISAELFNGMENLQVTELGEKRRLGEQLFHALASELGVECHQRRRRRRLRHHSAAPSVAAPQLLGLRVAQHVPRRALPQASVPCPQQHPHCAGQQNNSRLPPLWAQISSQSECKASDKEQQMRRPNGLFFRESARLHPRRFPRDERTRSDQFDNRSKPHLQDELRKRSGGQMSTKTGKCAMEGML

SEQ ID NO: 145235 - protein, 94 aa, Heterodera glycines
  Coding regions on vcDNA: vcDNA=SeqID_71658; Strand=+; Position=1 -191,287-380
MAKQMLTTDIRKNSLPSPEFADSLETKMAKRPLQENGEFSRDEEAAHVEVEEKKPSQKEVVAKHTTPVHPPHPVIQKETNKKNKTKNMAQKLPK

SEQ ID NO: 145236 - protein, 1178 aa, Heterodera glycines
  misc_feature (200)..(200): Xaa can be any naturally occurring amino acid
  misc_feature (757)..(757): Xaa can be any naturally occurring amino acid
  Coding regions on vcDNA: vcDNA=SeqID_71659; Strand=-; Position=1 -218,261-390,458-595,697-931,992-1342,1385-1533,1589-1715,1759 -1873,1936-2103,2142-2271,2332-2517,2663-2762,2804-2849,2888 -3005,3071-3273,3316-3405,...
  Coding regions on vcDNA: Position=...3529-3619,3662-4008,4063-4162
  Homolog annotation: Hit_ID=XP_310539.1; Match level="QueryCoverage =97%, HitCoverage=70%, E-value=0.0, Identity=39%"; Hit description =ENSANGP00000017317 [Anopheles gambiae]
FEVPSGRFVREGLFCAFSSASLDRPLAEMVLLHSTSDFCLLGVRGGGKSLVVNEFAKRLGYPVETIVLYQDMSSRELLQRRKILPNGDTQWIVLYQDMSSRELLQRRKILPNGDTQWEDNQLVRAAKRGALCVLDGVDRVHWSTAESIASLVHHRHWSTAESIASLVHHRFLALPNGTRLVGNSHFELLASQRIERTNAXNVFRIPDSFRIVALGSESAPKWLNAQLLSQFLFCSLPSLSIDDRLRIIQQRVPNASVGHERLLRLIDRLSNSHDASIRTIASSIRTIASSLSLRRLIHILRRHSAHPEEIFDAVQRAALTRFVPPIVRRAFDATLAEIADGKKKHAEFEKEELEKMRKRAEVPDGMSSVGESETKVGGRPADEAMIPSTLFFDNPQHLIVMANMARDHLIVMANMARDFHLGAHLLLIGNQGVGKNKVTDRLLELLDRPRKYMQLHRDTTDTTVQSLTVQSTVVDGVLTYEDSPLVQAICDGLVLVIDEADKAPLHVVAAPLHVVAILKSLLDEEPFYLSDGRRVCPGKRKKGDESETLVVHPEFLVVHPEFRAILLANRPGFPFLGNDLYALLGDLLAVHALDNPSKESELAMLSKYGPDVPQEVLELLVSVFGDLRSVPQEVLELLVSVFGDLRSLVDQQLISYPYSTRELVNIVKHLQKFPDDPLPEVIRNVFDFPDDPLPEVIRNVFDFDAYSVDTAQLIGEVFQRKGISIGEKDRQCKVVLLIILSKRCRSFVKVSSSNAIXEFIIQQIDPNNVPHVGGNTWAGGTGGYNTAGLGGVGGPFRGYNTAGLGGVGGPFRLDAGHAVHQLLDAGHAVHQLPDSAKEQVPEHIRKRAREIAREEYAKRLKEIDMGEYDAEIDMGEYDAAAYEELATRVGRQVRVLRSVIDSLEQRKHERQWAKHQTSGDLDDAKLIEGMAGERNIYRKRIEQPPKRIEQPPDPSNQQQPKRIRLCFDVSGSMYRFNGYDQRLQRSLEAALLVMEGLDGKEDKVKYEIYGHSGESAYEIYGHSGESASIPFVTLDQRPANEKERLNVLKRMLAHSQFCTSGDYTVEALSLAVRELDRNDFDEKFVVLLSDANLDRYGIRPSEVSRALQMGDSVNAFIVLIGSLGEQAKNLQRHLPAGKTFIAMDALQRHLPAGKTFIAMDAAQIPEIMQQIFASTVVR

SEQ ID NO: 145237 - protein, 27 aa, Heterodera glycines
  Coding regions on vcDNA: vcDNA=SeqID_71660; Strand=+; Position=1-81
MHRIIAAVKKLVVGSVLAVRCTLCVLL

SEQ ID NO: 145238 - protein, 151 aa, Heterodera glycines
  Coding regions on vcDNA: vcDNA=SeqID_71661; Strand=-; Position=1 -80,159-211,256-464
  Homolog annotation: Hit_ID=NP_740855.1; Match level="QueryCoverage =100%, HitCoverage=8%, E-value=1e-39, Identity=61%"; Hit description =splice (1G205) [Caenorhabditis elegans] gb|AAK21388.1| Hypothetical protein F46F11.1a [Caenorhabditis ele
YGHFSGINRKVQLKYLKTSAEKANTAENASSVPTLFLILNASSVPTLFLILKWGGELTTAGILQAEALGRLFRTLYPKWGGELTTAGILQAEALGRLFRTLYPGIRRTDGKDSPEDTQGLGFLRLHSTYRHDLKIYASDEGRVQMTAAAFA

SEQ ID NO: 145239 - protein, 134 aa, Heterodera glycines
  Coding regions on vcDNA: vcDNA=SeqID_71662; Strand=-; Position=1 -140,281-446,1644-1741
MMASPGTDLEAKFRLRVFALLSSAPALHQLIQSKSNTASSARIDLARFLAAYYLGIDLARLFEQLNRCHHVEAVVPGGVATSTVLPNLMVCAELDDGEENFEAVIQADVLFSEEFGPFGLLNECIKALSSRMVA

SEQ ID NO: 145240 - protein, 185 aa, Heterodera glycines
  Coding regions on vcDNA: vcDNA=SeqID_71663; Strand=+; Position=1 -429,1818-1904,2117-2158
MDPDQIRVSSVGMLKVGTRVHSTKFRPFPEETTLPSVLDTAEEEDNTIYSNLRDEVEQCKQHDVVVNYSRLNLGNSGTSATGDGTNAAASTAAAQDEHQRHKEEEDGQKIYDTICGQAVVPQKGSKTLPIVNKAGPNLGPGWLNLAKDEQFRLQTLLILPFQHITKYQLLLNLYFYFLLNWVFIP

SEQ ID NO: 145241 - protein, 45 aa, Heterodera glycines
  Coding regions on vcDNA: vcDNA=SeqID_71664; Strand=-; Position=1-136
PPFSIFFLLSGGNTQTHIPHLFFIICSSFLHSLFTKPYSPNSLYE

SEQ ID NO: 145242 - protein, 54 aa, Heterodera glycines
  Coding regions on vcDNA: vcDNA=SeqID_71665; Strand=-; Position=1-164
ECHGTGNFCQNRDRDLPGPVKPGPGPRFLFGTGTARKTGTNREILKIQKNFKNL

SEQ ID NO: 145243 - protein, 148 aa, Heterodera glycines
  Coding regions on vcDNA: vcDNA=SeqID_71666; Strand=+; Position=1 -193,305-399,707-862
  Homolog annotation: Hit_ID=CAE71453.1; Match level="QueryCoverage =56%, HitCoverage=13%, E-value=7e-17, Identity=56%"; Hit description =Hypothetical protein CBG18370 [Caenorhabditis briggsae]
MAVDIFGTAATAKLSTAVGSLPELLEKKRLIDLHTNVATALLDNIKTRKLDVLYETEEKLLTGQEIPVIETLRDCPDKDDILRLILIALCSRNMPTGFFSFGCRGGTAPRGRHQDGQHVLQTAQPLIALRHGGRPKFGAQKHNLPLTK

SEQ ID NO: 145244 - protein, 75 aa, Heterodera glycines; identical to SEQ ID NO: 132731
  Coding regions on vcDNA: vcDNA=SeqID_71667; Strand=-; Position=1-225

SEQ ID NO: 145245 - protein, 217 aa, Heterodera glycines
  Coding regions on vcDNA: vcDNA=SeqID_71668; Strand=-; Position=1 -24,300-544,877-914,1084-1215,1298-1344,1578-1747
  Homolog annotation: Hit_ID=CAE66567.1; Match level="QueryCoverage =92%, HitCoverage=39%, E-value=3e-54, Identity=38%"; Hit description =Hypothetical protein CBG11882 [Caenorhabditis briggsae]
AEKQVACDLYSASFLVVAGKNFVKSIPTDQSHTKSDAFEPISGAAITSVDFHHETKSIFFVDAAGINKGINRFVLGDSESQVIVKNNYGGYIIKSVAIDWINNNIYFINADSDRSNIEVCQMNGENRKILLSTRTETPTSIAVDPITRFVYWADQGQTPAIQRAWLDGTHKQVVVHDELKEPTDLIIDPNRGEIKKCLSDFIEIQKKTQIFFIFIWA

SEQ ID NO: 145246 - protein, 23 aa, Heterodera glycines
  Coding regions on vcDNA: vcDNA=SeqID_71669; Strand=+; Position=1-70
MDEMNKEKEKKSDFISKLVRLLK

SEQ ID NO: 145247 - protein, 210 aa, Heterodera glycines
  misc_feature (99)..(99): Xaa can be any naturally occurring amino acid
  misc_feature (130)..(130): Xaa can be any naturally occurring amino acid
  misc_feature (162)..(162): Xaa can be any naturally occurring amino acid
  misc_feature (166)..(166): Xaa can be any naturally occurring amino acid
  Coding regions on vcDNA: vcDNA=SeqID_71670; Strand=-; Position=1-649
  Homolog annotation: Hit_ID=T02955; Match level="QueryCoverage=98%, HitCoverage=75%, E-value=2e-46, Identity=54%"; Hit description =probable cytochrome P450 monooxygenase - maize (fragment)
MILHKVRLESSSTGSSFPAKFAKPVPLAVVSLDSRRDSGNLVDPFVRVGKPTRHLATLRESCYSRVYPRLIKFPWLNIQSTGQIRHGQRPKDHPSPLFXLDSRIPRVRASSKLVVQRQPKCIPDEHTRSXSAPQAALTTSPRTIQKNSTQPRAKGFTQQPGXPDLXSQFFSRSYESNLPTSLTYIILSTRGCSPWRPAADIGTIRQEIQI

SEQ ID NO: 145248 - protein, 37 aa, Heterodera glycines
  Coding regions on vcDNA: vcDNA=SeqID_71671; Strand=-; Position=1 -60,148-201
MAEFAHRAGAPLECLCMALKVQKRQEGTDAEGNRRWK

SEQ ID NO: 145249 - protein, 92 aa, Heterodera glycines; identical to SEQ ID NO: 125147
  Coding regions on vcDNA: vcDNA=SeqID_71672; Strand=+; Position=1-304

SEQ ID NO: 145250 - protein, 88 aa, Heterodera glycines
  Coding regions on vcDNA: vcDNA=SeqID_71673; Strand=-; Position=1-266
SLAAKFKPIGELSDYQQQINGSQGKSFTYGCCTKHLLICIFVLEVSNIRFATPPPQPPPVLRNVPLPPVTSNNNEMMVDRTCRNNTAK

SEQ ID NO: 145251 - protein, 102 aa, Heterodera glycines
  Coding regions on vcDNA: vcDNA=SeqID_71674; Strand=+; Position=1-309
MPNILEMLNNDATVLLNPFTALFQSVKKASLPVVVTRDYNIYAAFVCNCCAFSEFTFLVKKSATFPCRSNNNLMEKAVKNEYRIRPPLFLKFVVKNSAVIFF

SEQ ID NO: 145252 - protein, 41 aa, Heterodera glycines
  Coding regions on vcDNA: vcDNA=SeqID_71675; Strand=-; Position=1 -89,266-302
MKIHCIFFILLINELFVVPLIFGQPIKEKSVLEGVPITLNE

SEQ ID NO: 145253 - protein, 171 aa, Heterodera glycines
  Coding regions on vcDNA: vcDNA=SeqID_71676; Strand=-; Position=1 -194,248-335,536-766,840-842
MARNGMARKALNPQAYEASAVKQMQSYKQTKSMELFKERGMKFTCVDSSQQQQEENRNGRAGGTSGGTLSSIGTVSACPVDMMDPSDREAIQFYEGERNGGRETKGSLAKSTEGGGFGASSLERAKRFGLIPPKFDPRIPPPPIFQPPKRKEIEQPKEKRAIKQETEVVVE

SEQ ID NO: 145254 - protein, 74 aa, Heterodera glycines
  Coding regions on vcDNA: vcDNA=SeqID_71677; Strand=+; Position=1 -169,330-386
SNILGENKDPEFTIEWSTPCEMNEEMKDKAGSLLIEVADRMLPRFQDEHNKKILQELATSVTEKGWLMEEQIYK

SEQ ID NO: 145255 - protein, 109 aa, Heterodera glycines
  Coding regions on vcDNA: vcDNA=SeqID_71678; Strand=+; Position=1-330
VAALLYCCQLLCRCLWRLRWDPNVNAIPLLTALGDFLGTTLLAIAFLAHAELFPEYSVNGTNCTNGTISQQDTVEDAMLQVVEQQLLLGNADTTLATETAELMLLNRTL

SEQ ID NO: 145256 - protein, 249 aa, Heterodera glycines
  Coding regions on vcDNA: vcDNA=SeqID_71679; Strand=-; Position=1 -130,1428-1604,2093-2287,2446-2574,2630-2685,2922-2984
  Homolog annotation: Hit_ID=NP_503306.1; Match level="QueryCoverage =95%, HitCoverage=38%, E-value=2e-71, Identity=67%"; Hit description =GEX (Gut on EXterior) Interacting protein GEI-7, bifunctional glyoxylate cycle protein, mainly expressed
DANSPTWRNQIEGQINLYDAIRGQIHYVNPVTKQEYTLKQDTAAMTSDFLRAYTLLSIKIAHQRNIFAMGGMAAQIPIKHDMAANETALGAVRKDKEREASDGHDGTWVAHPGLVPIAREVFDQIMQGPNQIGKQLQSFETDNKRLTMAPEGVRTEAGFRRNISITLGYMDNWLRGIGCVPLYNLMEDAATAEISRTQLWQWARHEARLEDGRTVDPQLVKMTIASETETSSSRKASEQRTGDGHFCKI

SEQ ID NO: 145257 - protein, 201 aa, Heterodera glycines
  Coding regions on vcDNA: vcDNA=SeqID_71680; Strand=+; Position=1-603
  Homolog annotation: Hit_ID=AAF63787.1; Match level="QueryCoverage =91%, HitCoverage=57%, E-value=7e-11, Identity=31%"; Hit description =200 kDa antigen p200 [Babesia bigemina]
MRPRSTPSAAAGGTEAAVDALRRENERLKRENSHLNKSLEKQREEAERTAIRLRRMETQSRANAEAWEERKRNERNAALLRKRVEEGAERERLLQERLERRERHIEQLSREQQGRLGDTERVQATMAQWRAKVALLEQREGTLSQERVVLGERCNELTRRLEAMTREHRNAKKRLAELTKAQREEKAEEKLRVEGKAIGGE

SEQ ID NO: 145258 - protein, 92 aa, Heterodera glycines
  Coding regions on vcDNA: vcDNA=SeqID_71681; Strand=-; Position=1-279
MAAGHHLTTFPSLDGLTEQFGDHVRGHGFPWAIFLDKNYTAPTPPQPTTTEEEEEADANDGTVNEAVNDGDHELLTDWEQQQKQKQRRKNPR

SEQ ID NO: 145259 - protein, 15 aa, Heterodera glycines
  Coding regions on vcDNA: vcDNA=SeqID_71682; Strand=+; Position=1-47
MTYNPKEADREIEKA

SEQ ID NO: 145260 - protein, 90 aa, Heterodera glycines
  Coding regions on vcDNA: vcDNA=SeqID_71683; Strand=+; Position=1 -82,344-534
MDRIPYNFPTPSSRSRILKLATSTSESRNIFFPLHLQPMFDAAYGNFNNIHRERSKIFPCLSGFGSADGSAFRIDRFCAADTSGSRQAAY

SEQ ID NO: 145261 - protein, 95 aa, Heterodera glycines
  misc_feature (73)..(73): Xaa can be any naturally occurring amino acid
  Coding regions on vcDNA: vcDNA=SeqID_71684; Strand=-; Position=1-444
LFEYPKRTLEKIDFFVFGAVPPNRCAQIYGETESFGNSFPIACTLILRWIFAPHNYLSTPNGHLKKSIFLFSXQSPRSDAPRFMGRPNPSGIASL

SEQ ID NO: 145262 - protein, 24 aa, Heterodera glycines
  Coding regions on vcDNA: vcDNA=SeqID_71685; Strand=-; Position=1-80
RTLSTAFRQRSSKIYSMPQILWAG

SEQ ID NO: 145263 - protein, 24 aa, Heterodera glycines
  Coding regions on vcDNA: vcDNA=SeqID_71686; Strand=-; Position=1-80
GTLSTAVRQRSSKIYSMPQILWAG

SEQ ID NO: 145264 - protein, 194 aa, Heterodera glycines
  Coding regions on vcDNA: vcDNA=SeqID_71687; Strand=-; Position=1-585
  Homolog annotation: Hit_ID=CAD40308.1; Match level="QueryCoverage =82%, HitCoverage=7%, E-value=2e-24, Identity=39%"; Hit description =OSJNBb0013O03.3 [Oryza sativa (japonica cultivar-group)]
MEEFFFGDDDLNLPPGQPNPRPQPNTPPPLNSDQQKVFDAVLLAIQSNPRDSTVPRRFFIYGDGGTGKTFLFGQIIRRLRKAPYTYKVLATASTGCAAILLPYGKTAHSTFRLGREVSLDKLPSIPLESFFARRIREAQLIIIDEITMLHNTVIEVIDRVCKEMAIRQHKDLLFGGKTVIFSGDFKRVAAGRAS

SEQ ID NO: 145265 - protein, 116 aa, Heterodera glycines
  Coding regions on vcDNA: vcDNA=SeqID_71688; Strand=-; Position=1-351
MTCAYAKLLGPCFKTGRTDDRLLHRERTSESLSWTELVAGTCRTRPPPTPSSSQHGPETIAQFTQSKQHSPDPGTRPQKAGLKTELTQLLRASQRTPPANAPFATEQKDSKPQSGG

SEQ ID NO: 145266 - protein, 37 aa, Heterodera glycines
  Coding regions on vcDNA: vcDNA=SeqID_71689; Strand=-; Position=1-112
MCAKGPGVDPNYNAETCRKSAFDKLDKMTFFIIGDMG

SEQ ID NO: 145267 - protein, 253 aa, Heterodera glycines
  Coding regions on vcDNA: vcDNA=SeqID_71690; Strand=-; Position=1 -65,266-962
MSKIWHIFAHFLRIFVSALCWSLGFLCLGFSVSVSGSSLGVKPREILVSSVSKSIKPKSFHTNYQILNYNFCSAKKQEEARQLPAVKPIFLTEGYLINFIVLVQRFNDHSKYFRQNDPNFSINFELQNELEMNYEIITGNEKNWQNRLIQKAMEEFKKANYEAKKSEIWRKKFKQKTMEQFEKEFKKLWETEKLRMEFENKMKKIYENAQENVKMEKNVSNKSETQRRNYEKKFAALISSPFYEHLIEPIIID

SEQ ID NO: 145268 - protein, 259 aa, Heterodera glycines
  Coding regions on vcDNA: vcDNA=SeqID_71691; Strand=-; Position=1 -72,134-829,1041-1052
MLSFIIIIIILQFFFIPISHANPSMDDNMLIAFMKCHQQTQISEYSTQKYEAYLGTVYFMRKNWQCAKIGKRFEQYERTECQKYRKYLGILYEYLFREFAGHNTVKPKFMLKRHQFEMEEPSIIYVLHSLAKVLRFYLNPFNSNRYQYKLNNLFSNKHFINEFEPKLLNAFGNDNEQEEMPINEAILKLAIYTANGQSDEIVEKIINRIIFDRNLKKMFKKAEQNAKENGPWSANEISEDAHKIIWRSKFDDSLNWILD

SEQ ID NO: 145269 - protein, 51 aa, Heterodera glycines
  Coding regions on vcDNA: vcDNA=SeqID_71692; Strand=+; Position=1 -67,149-237
MAISFFDKFYTHTNALEHDREGEILYLTKALAYETEGCAQSPFYFTEDFYI

SEQ ID NO: 145270 - protein, 92 aa, Heterodera glycines; identical to SEQ ID NO: 129648
  Coding regions on vcDNA: vcDNA=SeqID_71693; Strand=-; Position=1-304

SEQ ID NO: 145271 - protein, 97 aa, Heterodera glycines; identical to SEQ ID NO: 143380
  Coding regions on vcDNA: vcDNA=SeqID_71694; Strand=-; Position=1-304

SEQ ID NO: 145272 - protein, 48 aa, Heterodera glycines; identical to SEQ ID NO: 136255
  Coding regions on vcDNA: vcDNA=SeqID_71695; Strand=-; Position=1 -94,185-237

SEQ ID NO: 145273 - protein, 95 aa, Heterodera glycines
  Coding regions on vcDNA: vcDNA=SeqID_71696; Strand=+; Position=1 -103,565-749
MLCSNFLAFLFLLFYCHFSCAINPDPKFPVHTIQIDAPHRTATFGGPPGVRPFISGSIFTSGVGPAAAGAISSSHNHQPTAVCSENEFRCDDGEI

SEQ ID NO: 145274 - protein, 138 aa, Heterodera glycines
  Coding regions on vcDNA: vcDNA=SeqID_71697; Strand=-; Position=1 -68,225-415,466-541,610-691
MAQKIQASGFDSKIKGNADQETQGRFSLRIFGLSQTLITNDPVVLREHLDNRSIDVTAIDELDEEHILLSYENKKEWVEEHDCSNIMISLWMTSAARLLLLKAMQKVVRTPGHGFVDLSPPVRHLPAQNWPTFGSVHG

SEQ ID NO: 145275 - protein, 44 aa, Heterodera glycines
  Coding regions on vcDNA: vcDNA=SeqID_71698; Strand=-; Position=1-131
STGYSEAIPEGFGLPINLGASVRGDCLETKKIDFFQVSVWGTQT

SEQ ID NO: 145276 - protein, 65 aa, Heterodera glycines
  Coding regions on vcDNA: vcDNA=SeqID_71699; Strand=+; Position=1-199
EKIKKKLVMAAGKKADGEVAARQKKRKRKMSDESNGDDESDEKDSASEAEEGWCAERADIGHSWS

SEQ ID NO: 145277 - protein, 401 aa, Heterodera glycines
  Coding regions on vcDNA: vcDNA=SeqID_71700; Strand=-; Position=1 -72,141-416,468-533,604-691,749-962,1013-1158,1217-1311
  Homolog annotation: Hit_ID=CAE64927.1; Match level="QueryCoverage =99%, HitCoverage=32%, E-value=2e-84, Identity=44%"; Hit description =Hypothetical protein CBG09751 [Caenorhabditis briggsae]
SMNSRRLVQVPLTVWNRKRTRKVANLAANHQAVANLAANHQANDLIVGGLEQLITARFCYGPMDLVVLSHENVLVYVLPSGGEWFLKGVETTDKNGRLSIDLGRSLPIGIHNVRLIVQGDRNYLSVNIAVVPTGTPVVVFSIDRNYLSVNIAVVPTGTPVVVFSIDGSLTASVSVTGRDPRLRSLTASVSVTGRDPRLRPGAVDVVRFWQQQGFLIIYLTGFLIIYLTARPDMQQRLVSAWLATHNFPQGLLFFTPSLSTEPLRQKTQHIKHLLDMGICIHAAYGSAKDIPVYSNAGLESERIFKVGGHRRVYSNAGLESERIFKVGGHRRRGCVSLDDGYCYHLHDLHSGKIVIPRRVENSSLADGTNRINSSLADGTNRIQRTLSFGPRMGRYNQKDQP

SEQ ID NO: 145278 - protein, 70 aa, Heterodera glycines
  Coding regions on vcDNA: vcDNA=SeqID_71701; Strand=-; Position=1 -23,72-261
MLSHVFYRKFFELLIVNLTEFQHYLCYHKNIDNYKRWLPYLMGINESYLLEEEFPYIMHIGKFELITLIT

SEQ ID NO: 145279 - protein, 102 aa, Heterodera glycines
  Coding regions on vcDNA: vcDNA=SeqID_71702; Strand=-; Position=1 -97,554-765
KNKDDLLECPKENVPISVLRQNDAHNQDLSAKEYKILDEMQNEFKKILSNESKSNYKNNFVKSDRKKWLDVKMLFWHFNLSIEDAFGKMDEINVYNLFKIII

SEQ ID NO: 145280 - protein, 33 aa, Heterodera glycines
  Coding regions on vcDNA: vcDNA=SeqID_71703; Strand=-; Position=1-99
MKQTHLKNLIRFVTVFLIAIRLIGADNAESDEE

SEQ ID NO: 145281 - protein, 61 aa, Heterodera glycines
  Coding regions on vcDNA: vcDNA=SeqID_71704; Strand=+; Position=1 -137,289-337
MKDVCPNPSPAFDGATNVPLLAKTLNPATADGTGASSTMGCSMCQSPLPGFLRTAYLLVKY

SEQ ID NO: 145282 - protein, 118 aa, Heterodera glycines
  Coding regions on vcDNA: vcDNA=SeqID_71705; Strand=-; Position=1 -183,401-574
MHQIGLVLSFSATFVLLATLFPSCAANTECVWATGLVKCNKNQTKVLGAVVELWDLDSPQNTDFQNPLDSDDKATFTEVDDPTGLWKLDGCASDHDWFSINRYQKWCHDNSYNCFDLA

SEQ ID NO: 145283 - protein, 82 aa, Heterodera glycines
  Coding regions on vcDNA: vcDNA=SeqID_71706; Strand=+; Position=1 -41,532-739
MPKYVQNMCQTPKISFVDSSAMEMQILSKQRENYEDFFYFLAKVLSKFGGKLTKNENRETIEIGIDGGHKILESLKNMPIIC

SEQ ID NO: 145284 - protein, 41 aa, Heterodera glycines
  Coding regions on vcDNA: vcDNA=SeqID_71707; Strand=+; Position=1 -88,718-755
MRQEHYNCTTEHHKTSEMFVLFIYYLNNFGGRIFCGTIFQF

SEQ ID NO: 145285 - protein, 92 aa, Heterodera glycines
  Coding regions on vcDNA: vcDNA=SeqID_71708; Strand=-; Position=1 -96,153-331
TANLVPTVAFSCLALSNNLTIFETQTKKILDQKMAISFFSFFYRKLGTNSCLLLSGPIKHLFSHFFTANLVPTVAFSCLALSNNLTIFETQT

SEQ ID NO: 145286 - protein, 75 aa, Heterodera glycines
  Coding regions on vcDNA: vcDNA=SeqID_71709; Strand=+; Position=1-228
MIGRAVRNRPFIFEGIFKFILYPRKMSISFFEKFYTSQKRLRMRRRAVHNRHFISQRIFIFRGYPRKMAISFFDK

SEQ ID NO: 145287 - protein, 96 aa, Heterodera glycines
  Coding regions on vcDNA: vcDNA=SeqID_71710; Strand=-; Position=1-291
MERYAFNFLQSTADLSISAQEYLWSIFGIKTSSAAVKNLVHHQPEIESQIFTFCGTQIAMNSLARRIAGLSGAAAVAMAGFSAHRGRREIPVLQKP

SEQ ID NO: 145288 - protein, 50 aa, Heterodera glycines
  Coding regions on vcDNA: vcDNA=SeqID_71711; Strand=+; Position=1 -64,432-519
MIRRFTLECLSRFGTEVEDVANRSALDFEAHSNPLALHRRRAARRSQFLG

SEQ ID NO: 145289 - protein, 71 aa, Heterodera glycines
  Coding regions on vcDNA: vcDNA=SeqID_71712; Strand=-; Position=1 -137,794-932
  Homolog annotation: Hit_ID=CAE65966.1; Match level="QueryCoverage =83%, HitCoverage=31%, E-value=1e-15, Identity=62%"; Hit description =Hypothetical protein CBG11149 [Caenorhabditis briggsae]
MMNIRSNGKIRFAVSCSSNMNRSMEAHFFLQKRGFNVQSFGSGNYVKLAGPSVDKPKFTSSTHHKEHILQT

SEQ ID NO: 145290 - protein, 51 aa, Heterodera glycines
  Coding regions on vcDNA: vcDNA=SeqID_71713; Strand=+; Position=1 -140,305-320
MSFILFPSTLSLAYWLCSGFGSWVRIPMYVAELIELNPLMGLDPCPWLELF

SEQ ID NO: 145291 - protein, 95 aa, Heterodera glycines
  Coding regions on vcDNA: vcDNA=SeqID_71714; Strand=+; Position=1-655
MFEYPKRTLEKIDFFVFGAVPPNRCAQIYVETESFGNSFPIACTLILRWIFAPHNCLSTPNGHLKKSIFLFSGQSPRTDAPRFMGRPNPSGIASL

SEQ ID NO: 145292 - protein, 154 aa, Heterodera glycines
  Coding regions on vcDNA: vcDNA=SeqID_71715; Strand=+; Position=1-463
FCLIFLPQTWYQQLPSLVWPYQTILRYLKRKQKKFLTKKWLSLFSHFFTANLVPTVAFSCLALSNNLTIFETQTKKFSKNCYLFFLIFLPQTWYQQLPSFVWPYQTILRYLKRKQKKFLTKNGYLFFLIFLPQTWYQQLPSLVWPYQTILRYLK

SEQ ID NO: 145293 - protein, 198 aa, Heterodera glycines
  misc_feature (115)..(115): Xaa can be any naturally occurring amino acid
  misc_feature (138)..(138): Xaa can be any naturally occurring amino acid
  Coding regions on vcDNA: vcDNA=SeqID_71716; Strand=-; Position=1 -71,267-672,736-855,914-1000,1043-1098
  Homolog annotation: Hit_ID=NP_510634.1; Match level="QueryCoverage =69%, HitCoverage=42%, E-value=3e-28, Identity=43%"; Hit description =misexpression suppressor of KSR (35.6 kD) (XQ738) [Caenorhabditis elegans] emb|CAA92227.1| Hypothetical p
RIQRDAQVHFGCVRSGKLRAFGRQSCELWQFSWHFSCHQFICLENHSIETHCFHLVPHPKVFLTVHDVGKTYLSCVDLANSPTLSPLVGQRAVFLHVSVPGQAPGAENFVGDFPXMEQLGDGLSQVMEQFNLSKCIAXGEGAGADIVCRFAMSFPQLVVGAVLVRCVSTTHGIVAGVKEHFTDFVRNDGEMTHSAWNW

SEQ ID NO: 145294 - protein, 127 aa, Heterodera glycines
  Coding regions on vcDNA: vcDNA=SeqID_71717; Strand=+; Position=1-384
MTFYYLFACLYIILLLANSSTGGNNKKGKQNAQSYNENNQASNTYKEYLPGSVLKNGRNIKELKELFVKKIKKIMKEASEDRGQRTTNNECAVDLPADFWDQFQEIAKLPEIKGVKFDGNRMIIEEK

SEQ ID NO: 145295 - protein, 86 aa, Heterodera glycines
  Coding regions on vcDNA: vcDNA=SeqID_71718; Strand=+; Position=1 -60,300-500
MNNIGSDRFMETMFFDEDFRLDHPELGRQVIVEQPEFDRVFGVLQHGQHHDAQEALVEMAGGQREDVNPIVRLTGAHQFAKNGSRK

SEQ ID NO: 145296 - protein, 167 aa, Heterodera glycines
  Coding regions on vcDNA: vcDNA=SeqID_71719; Strand=-; Position=1 -95,285-453,812-1058
  Homolog annotation: Hit_ID=NP_509268.1; Match level="QueryCoverage =80%, HitCoverage=9%, E-value=4e-42, Identity=58%"; Hit description =UDP-glucose ceramide glucosyltransferase-like 1 (XI114) [Caenorhabditis elegans] gb|AAF99954.1| Hypothetic
FSQIFTILRQNFEIGILLSLAPSGWWAKFVNKLMGTGQSYDRINIFSLASGHLYERFLRIMMLSVLKNTKHPVKFWLLNNYLSPQFRESLPVMASHYGFDYQLIEYKWPSWLHQQTEKQRVMWGFTLTTMGGFYYADPQFAIFQEFRTFIPLILINLAFSAFFNVLK

SEQ ID NO: 145297 - protein, 32 aa, Heterodera glycines
  Coding regions on vcDNA: vcDNA=SeqID_71720; Strand=-; Position=1 -56,106-148
MKAEKSKVKMTIRRNIVNRNILLSDYFIIKRN

SEQ ID NO: 145298 - protein, 34 aa, Heterodera glycines
  Coding regions on vcDNA: vcDNA=SeqID_71721; Strand=-; Position=1-215
GSFEASDGRFAPVSKFVGLLRPLRGLRRALRARF

SEQ ID NO: 145299 - protein, 45 aa, Heterodera glycines
  Coding regions on vcDNA: vcDNA=SeqID_71722; Strand=+; Position=1-135
MDQRDSHCPYVLSSKSSDKGTCLTNLSGNEEPGGEGPPRGREEKR

SEQ ID NO: 145300 - protein, 88 aa, Heterodera glycines
  misc_feature (17)..(17): Xaa can be any naturally occurring amino acid
  misc_feature (50)..(50): Xaa can be any naturally occurring amino acid
  Coding regions on vcDNA: vcDNA=SeqID_71723; Strand=-; Position=1-273
  Homolog annotation: Hit_ID=NP_671477.1; Match level="QueryCoverage =96%, HitCoverage=29%, E-value=6e-22, Identity=65%"; Hit description =rRNA promoter binding protein [Rattus norvegicus] gb|AAK21974.1| rRNA promoter binding protein [Rattus no
RLTRPLEPILFPKLRIXFADFPYLHYSRLEAVHLGDLLRISVRSGRRFKXLPSHFQGPCGAHETPQEPRCFTGATSLSQAEPLPGTHT

SEQ ID NO: 145301 - protein, 647 aa, Heterodera glycines
  Coding regions on vcDNA: vcDNA=SeqID_71724; Strand=+; Position=1-1944
  Homolog annotation: Hit_ID=AAU44208.1; Match level="QueryCoverage =99%, HitCoverage=45%, E-value=1e-109, Identity=36%"; Hit description= unknown protein [Oryza sativa (japonica cultivar-group)]
MPKYCTWVKKDKKWKYPRQGYQNKIGRMVPVRPSETEKYYLRFLLLNVYGKSFKDLKTVNGVEYDSFGKACLARGLVRDDEEWHKCLEEATYFSRKHAKGLRTLFVNILVHCAPKYPARLWDSFKELMVDDIKRKNPSFSIKQINNIGLKLIDQCLRYYDKSLRDFKDMPQIINKTKIVDEDEIYDPENELELANRLIMMMNDEQKAIIDKMRNILEEKDGQKCIFIDGPGGTGKSFTLKTIYHLVRSFNKNICNMAFSGIAATILKKGRTLHNRFKLPLNIKKTSTSGIEINSSDAEEIKNIEVFIWDEAPMASRFIIDIIDRKLKELMGNEKPFGGKIFILSGDFRQCLPIKEFSTRSETVNLLIKNSHLWNFFITMNLTKNMRANPNEREFARQLIEVGNGTAGENGFITVPDQCISKGDLANEIFGEIIKESNFNELSNYAILSPYNTVVDRYNEEIMEKFPGETHTYLSIDETDLISDLTVTPEILNSLKCPSMPNHILNLKQKSMVMLLRNLNVREGLCNGTRLQIVDTGEHVLNCVIRSGDKIGETTLIPRITLIENKNFPFVLRRHQFPVRIAFAFTINKSQSQTFEKIGIDYCDEPFTHGQTYVALSRAKSWNGIKIKLSEDNKENKIKNIVWHETLL

SEQ ID NO: 145302 - protein, 76 aa, Heterodera glycines
  Coding regions on vcDNA: vcDNA=SeqID_71725; Strand=+; Position=1 -168,218-280
ESKSDFEGHEFDWVIMAICMDNKNEEEDAKKKMEKEEGEVDEESEDREDEIQLVGEKGKINDDDDDDEEIVVVVAP

SEQ ID NO: 145303 - protein, 172 aa, Heterodera glycines
  Coding regions on vcDNA: vcDNA=SeqID_71726; Strand=+; Position=1-519
MKRRWDFRSMSFFEQPSLPEQSSSSQRQSQQYDDDNQQYGEGDTTTTAARTGGRKDKQQKAEDLFKQVTHSVHRLERFSVSRHITEFVLNASVEEPEEVMRSAFQMLMARAIQHSEQQSGRKVVKIGVTLQGRGLLIGKCRHCYALTHPFEQAYMIPSSYLFDHQSKTAATH

SEQ ID NO: 145304 - protein, 122 aa, Heterodera glycines
  Coding regions on vcDNA: vcDNA=SeqID_71727; Strand=+; Position=1 -57,194-325,380-559
MDLRNFGGVSFMARQTNARRLVTGLKRRAAETCEAPATIRAQVLQNTCTPVLASFPSKDATKKVIKRLRRDENAPRVEPLNLEQLEIPNTYRVYKRTEIDEEQFLLADTGVFQIHGQNGPQR

SEQ ID NO: 145305 - protein, 44 aa, Heterodera glycines; identical to SEQ ID NO: 140010
  Coding regions on vcDNA: vcDNA=SeqID_71728; Strand=-; Position=1-372

SEQ ID NO: 145306 - protein, 135 aa, Heterodera glycines
  Coding regions on vcDNA: vcDNA=SeqID_71729; Strand=+; Position=1-439
KASQTILALPIPSTNAFIHPIMSAKIIRVPKIACDLSLAKNGVSKNRNYAQKASQTILAHPIPSTIAFIHPIMNAKIIRVPKIACDLSLAKNGVSKNRNYAQKAFQTILALPIPSTIAFIHPIMSAKIIRVPKIA

SEQ ID NO: 145307 - protein, 22 aa, Heterodera glycines
  Coding regions on vcDNA: vcDNA=SeqID_71730; Strand=+; Position=1-66
MNVMKTGEEHDITNFKLGKTQK

SEQ ID NO: 145308 - protein, 179 aa, Heterodera glycines
  Coding regions on vcDNA: vcDNA=SeqID_71731; Strand=-; Position=1 -187,233-388,570-764
  Homolog annotation: Hit_ID=NP_509790.1; Match level="QueryCoverage =90%, HitCoverage=51%, E-value=3e-21, Identity=36%"; Hit description =phosphatidic acid phosphatase (XL315) [Caenorhabditis elegans] pir||H89632 protein F13E6.5 [imported] - C
YVPWRQITFTGRLFDVGEGRATTLLFLLKCLIYMALDIVIWVALTFLSYKLLVWTFFTPFERGFYCNDQSIREPLVPNTVSTSLLIAITLGAPFFFIFLADLMRTTRPRRRNITQVINRSTLEYLNYCIAFWLMTLAIDAFKCLIGRIRPNFLSMCKPREWSEVCTVTPDAYVKLAHCT

SEQ ID NO: 145309 - protein, 127 aa, Heterodera glycines
  Coding regions on vcDNA: vcDNA=SeqID_71732; Strand=-; Position=1-384
MTFQSLGLNPPAFQSLRLNSQAFQSLGLNSPAFQTMGLKSPAFQTLGLNPPAFQSLGLNSPAFQSLGLKSPAFQTLGLNPPTFNDIPISGTQSTSISISETQFSGIPNNGTQISRIPNTGTQPTNFQ

SEQ ID NO: 145310 - protein, 127 aa, Heterodera glycines
  Coding regions on vcDNA: vcDNA=SeqID_71733; Strand=+; Position=1-382
  Homolog annotation: Hit_ID=DAA04499.1; Match level="QueryCoverage =99%, HitCoverage=9%, E-value=4e-33, Identity=53%"; Hit description =TPA: pol polyprotein [Schistosoma mansoni]
QTDLISHNINTGNSNPIKSAPRPIPFGVRAKVTEMIKDYLDRGIIRQSSSPWASPIVLVTKKDGSVRFCVDYRKLNAVTVKDSYPLPNIEQILMYLGNRKFFSVLDLISGFWQVKVNAEDEPKTAFT

SEQ ID NO: 145311 - protein, 53 aa, Heterodera glycines
  Coding regions on vcDNA: vcDNA=SeqID_71734; Strand=-; Position=1-161
PDVPPWHTSATALAMCEQLSTHIGPDAGAFVLHRKRRISRKPDTGEQEYCYLP

SEQ ID NO: 145312 - protein, 875 aa, Heterodera glycines
  Coding regions on vcDNA: vcDNA=SeqID_71735; Strand=+; Position=1 -32,67-1014,1245-2892
  Homolog annotation: Hit_ID=NP_502797.1; Match level="QueryCoverage =35%, HitCoverage=86%, E-value=1e-49, Identity=35%"; Hit description =HASI (4P602) [Caenorhabditis elegans] emb|CAB16520.1| Hypothetical protein Y57G11C.19 [Caenorhabditis ele
MELINTTLTTMCYSTVKEARKKIKHLRKEEVQRYLEGHRTYTLMRPRRVRFPRAKTIAAGFMTDVQVDLADFQALSRHNGGHRYLLVAVDVLSKRLFVVPLKNKRAEEMLEAFKELIEQMPMFPHRIFSDKGTEFKNKLVKEFFEEHEIAKHEPVHSSVKASVAERAIRNVKQRLYRYFAEKQTLNWVDTVQQIVDGINSAPSRVHGMRPIDVNFRNAQKVWKRMYGQQLLKISQRRAPRFRKNEFVRMSREKGQFEKGYLPNYGDEILEVDQVLKAVRPIRYKLRDDRGEKFRGTFYEQELARVRKDDETSYRIEKVFRKRRKPDGGSWVCGLHSISYPYSWHSTIGTLDDQWIDIHFTNLHSVDDDRQRVIRVPVPQASHKKVEQLRDFLQATLKSQEKVRLKPLAHEEGYFDKPVVLGSPPHAKRLKRSTIDDLSSLPSPPRYDETDEQQSQQQQPQSPPRFDETEKEDKKVKETTPPSAAKQPIPPAPILAPPSHPPTEAPKAVTATKQAAPKSATAPPPKPSVTSTITAAKTTPPPAPIPPIKQAPSAPKPSPSKTAAVPKPTPTPTPASKSTIPTPASSTKAQNIPKIPPPLAAKPKEPNVAKKSTVPTTVSTTSISSLTSQIGPTPTTPKPPPPPIKPIPTSIPAPSPPPPPPPPPPPPQSIAKDAKRSVEAPNESNKESKRLDVDDRFFGGLAAGDEFPDDDDKESEWPYDPFKNIVDDVEIQYLDDFERFKVVFKNPVISHLSFSPQLGYVLGFENPQHVGPQEISKYGCDLRGGFSSFAVYSKGLTENMIVGNSLSSLLRVVSVSGATPGDYNEKIYDSPIYARVLPREISEIEIELRTMDKGRLVPFAYGTTMVVLIFKKVINF

SEQ ID NO: 145313 - protein, 196 aa, Heterodera glycines
  Coding regions on vcDNA: vcDNA=SeqID_71736; Strand=+; Position=1-591
MVLVSEFCAQFLSCPTKSLRDRLNHPEDRVRVLQQLIGKKVQTTYKDRNGMCKCFFVGGMTERGAAFEPAYGRLRKPFNINVAAHFYARHRVKLHYPYVPCIIEGFTRGEDRYYPMELLEIVDDKKGGRLFGRLFTEIEEQEEEDTKSDCSHSSNTSYLQFNGKGFKWYESTDEIANTGRGECSQPSSSSPSHTYW

SEQ ID NO: 145314 - protein, 445 aa, Heterodera glycines
  Coding regions on vcDNA: vcDNA=SeqID_71737; Strand=-; Position=1 -33,355-919,962-1153,1200-1426,1474-1794
  Homolog annotation: Hit_ID=NP_001004509.1; Match level="QueryCoverage= 82%, HitCoverage=24%, E-value=2e-41, Identity=30%"; Hit description =si:busm1-180o5.3 [Danio rerio] emb|CAD60788.1| novel protein similar to DNA polymerases [Danio rerio]
MLLTNGKSAGETRYPTGHPKVHVLNQQVDWRCATDNPYDLSLLKVWVVPPRRCDVPVLPVKVGDRLCFPLCIKCAVDYPNGGVDNEYSCTHNDQQRGWVSTCTSLELNAALDEGYHVTKLFRVLQYESSDDQLFKSYIREFMAQKIQATGFDANIKGNADLEDQFVRECYEKYGITIDKAKMQPNKGKRSIAKLCLNNLWGRFSLRNFGLSQTLITGDPAVFAEYLDNRSLDVTAIDQLDDEHMLISYEKKKEWVEEHACSNIVISLWTTSAARLLLLRAMQKVVRTQGCVLLYTDTDSLIFAHPIGLCPLQTGPHLGQFTDEYPKHEILEFCSGGAKQYGLKLRRKDAPADADNEYVLKVRGMTLSYDVIQNQGLRYETFKDKVLRFAETGEPQPINVMYPNFLRPSIKDGRVISCPLQKIYKPFVGKGIVGADFQIFDFGHTL

SEQ ID NO: 145315 - protein, 250 aa, Heterodera glycines
  misc_feature (247)..(247): Xaa can be any naturally occurring amino acid
  Coding regions on vcDNA: vcDNA=SeqID_71738; Strand=-; Position=1 -534,592-682,1275-1366,1542-1567
  Homolog annotation: Hit_ID=CAD22154.1; Match level="QueryCoverage =97%, HitCoverage=50%, E-value=2e-57, Identity=45%"; Hit description =pherophorin-dz1 protein [Volvox carteri f. nagariensis]
PEENVPPLPPRSPAPNENEPPRPPRSPAPNENEPPRPPHSPPPKENEPPRPPRSPPEENEPPRPPSSPPEENEPPRPPRSPPEENEPPRPPRSPPEENEPPRPPRSPPEENEPPRPPRSPLEENEPSRPPRSPPPEENELPRPPPEPPRSPPVPPRPPPAEPNEPVRSPSEPPKSSPPEKLPEKLPKLLPVPPPLPPKDDTPVTPLTPRPNEAPRFPPAVSPPPIPPPPFPPRRFPPESFPPLFFSXNSC

SEQ ID NO: 145316 - protein, 221 aa, Heterodera glycines
  Coding regions on vcDNA: vcDNA=SeqID_71739; Strand=+; Position=1 -21,68-186,272-428,487-680,725-842,894-950
  Homolog annotation: Hit_ID=BAA03584.1; Match level="QueryCoverage =99%, HitCoverage=31%, E-value=6e-30, Identity=36%"; Hit description =Drosophila vasa homologue [Mus musculus] pir||I49638 probable RNA helicase protein - mouse (fragment)
HMLKEELILMEQMKVLVLDEADQLLEDESARDLRQIAKIDGWPKVKYATFPDEVQKWADEWVKPTALFVSNKKPVSANVKVVQKFIRVSRSSKNHELLKQERAELKAEKRVFPPLNFYSMFHHLADEPEPKIRPTMVFVKMKRTADVISTYLNLNKVPSTTINGDRPQKLRHAALDDFRAGRYQVVVTTDVCARGIDLKELDHVINMDLPIDYTTYVHRIG

SEQ ID NO: 145317 - protein, 67 aa, Heterodera glycines
  Coding regions on vcDNA: vcDNA=SeqID_71740; Strand=-; Position=1 -94,185-294
MHAFCARAIYHRACQSKAKQQRWCFERIKGIESVNRLLEKYICNLSTILRSELEMINFTIQDQFSVL

SEQ ID NO: 145318 - protein, 136 aa, Heterodera glycines
  Coding regions on vcDNA: vcDNA=SeqID_71741; Strand=-; Position=1 -36,85-459
MQQIITYWFYEILSIIKELMDPSRGFYDKDGDKVTLAIDVIVKEENADKLDYSNPNKTNGKIVMEIGKLAEFSREICLSERSSEIKQIKGLSWKILALLINQNNKSSEKCLAFYLLCAGSKNGTKWEFIPLNQIGN

SEQ ID NO: 145319 - protein, 203 aa, Heterodera glycines
  Coding regions on vcDNA: vcDNA=SeqID_71742; Strand=-; Position=1-610
  Homolog annotation: Hit_ID=XP_318550.1; Match level="QueryCoverage =92%, HitCoverage=19%, E-value=1e-36, Identity=37%"; Hit description =ENSANGP00000020240 [Anopheles gambiae]
MDMEESSELEVAAVDYVFQTTLDQLPITAEEVAPRTQEDDELQQVLHQCRTHWPKTAHSSTLAAYFTHRNRLSEIKGCLLMGDRVVIPAKLRQRILTTLHFTHPGIVRMKNLAKQFVYWPKIDLDVDGWVRNCEECALASKAPPKVPLQPWPASTQVYERLHMDFAGPCADGNKYLVVVDSFSKWPEIIKMKSTTAHLLIDKI

SEQ ID NO: 145320 - protein, 49 aa, Heterodera glycines; identical to SEQ ID NO: 131679
  Coding regions on vcDNA: vcDNA=SeqID_71743; Strand=-; Position=1-188

SEQ ID NO: 145321 - protein, 58 aa, Heterodera glycines
  Coding regions on vcDNA: vcDNA=SeqID_71744; Strand=+; Position=1-175
YKVIRAIPTNDSQVLALRHFANLMESSNSRKGTVQFWQHAYTLHSNADIFADSDSAKK

SEQ ID NO: 145322 - protein, 315 aa, Heterodera glycines
  Coding regions on vcDNA: vcDNA=SeqID_71745; Strand=-; Position=1 -125,1264-1400,1447-1658,1715-1863,2173-2289,2431-2637
  Homolog annotation: Hit_ID=CAE62692.1; Match level="QueryCoverage =80%, HitCoverage=52%, E-value=3e-13, Identity=25%"; Hit description =Hypothetical protein CBG06840 [Caenorhabditis briggsae]
QQDRRDFRREMYQVSIYGSTMLRYKLYTFANNEDSTAAYSWQKLFNFMADSTSISASSRADYLKRYMTDEKKKKKGAKEQKSGKSAGMRLLDDEDTFIRTPHAKPSKIDEERIEEDEDDELMGRHRPQFDGIETEGQRNGWAQFQNGLIRHRRRRWGTLSDDDIKKEPLSPAHLEADEERGKSRSKEKKRRTKDTTEAKHEIKEEETNEMPTIAKKRRMDNGGRAGLLSKEAMEREERELRERDLQRLNELEASTAESGRDAETRKRETGFERRRRGEKRETAEDAARKEREAAKQKEMEAKYSLWNRGVAQAEE

SEQ ID NO: 145323 - protein, 92 aa, Heterodera glycines; identical to SEQ ID NO: 125147
  Coding regions on vcDNA: vcDNA=SeqID_71746; Strand=-; Position=1-304

SEQ ID NO: 145324 - protein, 78 aa, Heterodera glycines
  Coding regions on vcDNA: vcDNA=SeqID_71747; Strand=-; Position=1-234
MIGRAVRNRPFIFEGIFKFILYPRKMAISFFEKFYTSQKRLRMRRRAVHNRHFISQRIFIFRGYPRKMAISFFDKFYT

SEQ ID NO: 145325 - protein, 38 aa, Heterodera glycines
  Coding regions on vcDNA: vcDNA=SeqID_71748; Strand=+; Position=1-116
PVFIAINDPSITADQIDALVADIANGLFAVCVTLGVVP

SEQ ID NO: 145326 - protein, 69 aa, Heterodera glycines
  Coding regions on vcDNA: vcDNA=SeqID_71749; Strand=-; Position=1-440
AISAGKQKKSDEESLKMATGFWCQYRQTTHQQTLHVKLHNFQMDNQLPASTFPSLLAMVPQPKSVVKNG

SEQ ID NO: 145327 - protein, 27 aa, Heterodera glycines
  Coding regions on vcDNA: vcDNA=SeqID_71750; Strand=+; Position=1-81
MHRIIAAVKKLVVGSVLAVRCTLCVLL

SEQ ID NO: 145328 - protein, 87 aa, Heterodera glycines; identical to SEQ ID NO: 144693
  Coding regions on vcDNA: vcDNA=SeqID_71751; Strand=-; Position=1-838

SEQ ID NO: 145329 - protein, 71 aa, Heterodera glycines
  Coding regions on vcDNA: vcDNA=SeqID_71752; Strand=+; Position=1 -40,502-677
MLMIHPMTEPSVDGKSQQKSTASAPAEFQRAKCLAESEVIKEKPSIRTRLIVCVVCGAIIAFCLIKLFIWK

SEQ ID NO: 145330 - protein, 15 aa, Heterodera glycines
  Coding regions on vcDNA: vcDNA=SeqID_71753; Strand=+; Position=1-49
LKAIHCLPVLGTAKH

SEQ ID NO: 145331 - protein, 167 aa, Heterodera glycines
  Coding regions on vcDNA: vcDNA=SeqID_71754; Strand=+; Position=1 -403,547-649
NFGFILKLSEFTLTHFDIYKLLETILNESPSSNKKDTKSAKNKNKTASAPSPPKIYTFLMDNFIASSHYKKHLETSKKIDKFVKCAFVNFGQLLLLRGKFNFPEFKKFADEREKECGKLPFKDDIDIDNTPLSGCKQFALQLFNDEPLWNYARAIKIEQNECKSKMN

SEQ ID NO: 145332 - protein, 54 aa, Heterodera glycines
  Coding regions on vcDNA: vcDNA=SeqID_71755; Strand=-; Position=1 -117,269-316
MHWRFDFFALGFNAIVFFLFLFALNSEGPEKWSWENVLLDFYVLLYVFVSLCEK

SEQ ID NO: 145333 - protein, 48 aa, Heterodera glycines
  Coding regions on vcDNA: vcDNA=SeqID_71756; Strand=-; Position=1-193
VNIDHRPQTQKCLKTVRIDVKRFEMGWKNRIRGALALFQDEKCRKWSA

SEQ ID NO: 145334 - protein, 16 aa, Heterodera glycines
  Coding regions on vcDNA: vcDNA=SeqID_71757; Strand=-; Position=1-49
EAIPEGFGLPINLGAS

SEQ ID NO: 145335 - protein, 99 aa, Heterodera glycines
  Coding regions on vcDNA: vcDNA=SeqID_71758; Strand=+; Position=1-300
MSDNSQIAIQLQRMAFLLDEKEAGLETIQKLLVAKNEFLEKNAADILERQKIQHAIESQQNARAQLLIEITNNLLTAASDFQFHLDLHIIGENPLSESP

SEQ ID NO: 145336 - protein, 32 aa, Heterodera glycines
  Coding regions on vcDNA: vcDNA=SeqID_71759; Strand=-; Position=1 -11,68-155
MNRRWVCIDVWMDIFPLFDHAQLGLKRSLISL

SEQ ID NO: 145337 - protein, 176 aa, Heterodera glycines
  Coding regions on vcDNA: vcDNA=SeqID_71760; Strand=+; Position=1 -419,832-941
  Homolog annotation: Hit_ID=AAC72366.2; Match level="QueryCoverage =98%, HitCoverage=14%, E-value=8e-73, Identity=84%"; Hit description =guanylyl cyclase [Heterodera glycines]
MPSLFSLIFFLMLFVSSPSRHRLVTAVSSNSSSSPIGTSTDAFGIPSPTSPISTALTSYTNGTATFGIPPPPISPIINASSSLPPIDPLEASVQLKIGFLFANGTQRLRTLFGFGQSAPAVTLALERARQEHLIDSINFTYTWRMCDCFQPWAVGYATQLILTENVDALIGPPCVT

SEQ ID NO: 145338 - protein, 16 aa, Heterodera glycines
  Coding regions on vcDNA: vcDNA=SeqID_71761; Strand=-; Position=1-49
EAIPEGFGLPINLGAS

SEQ ID NO: 145339 - protein, 101 aa, Heterodera glycines
  Coding regions on vcDNA: vcDNA=SeqID_71762; Strand=-; Position=1 -45,93-353
MHRHALKQLRKLKDLKFPTSQPFYRALVDCHNQIFAFYKTVGPGESGCLSYSLCVLPRIPKALCTVTKSKFDTVVANGAVFHVRTKSEFVEERCTENGGGI

SEQ ID NO: 145340 - protein, 121 aa, Heterodera glycines
  Coding regions on vcDNA: vcDNA=SeqID_71763; Strand=-; Position=1 -150,363-467,521-631
TKRRFLCPSVKTKEQMIFEIDFRISATIGEKIMFGKKHDGSTDDLRKATRVAPPGPALKNKLDKFVDRKLNECVARVEKLVNNKKDEVKDLAEHLEASDGWHLNEEQIHQFFKSRNANASP

SEQ ID NO: 145341 - protein, 44 aa, Heterodera glycines; identical to SEQ ID NO: 126591
  Coding regions on vcDNA: vcDNA=SeqID_71764; Strand=-; Position=1 -45,128-217

SEQ ID NO: 145342 - protein, 149 aa, Heterodera glycines
  misc_feature (144)..(144): Xaa can be any naturally occurring amino acid
  Coding regions on vcDNA: vcDNA=SeqID_71765; Strand=+; Position=1 -380,785-857
  Homolog annotation: Hit_ID=AAP92584.1; Match level="QueryCoverage =91%, HitCoverage=27%, E-value=3e-35, Identity=59%"; Hit description =Ab2-057 [Rattus norvegicus] gb|AAP85373.1| Aa1262 [Rattus norvegicus] gb|AAP85367.1| Aa1011 [Rattus norveg
GAWPFLVRGAICLVYSDNERDSSLLNSWLIASGHNFLEGFSVFSRTKLSNNRSVMPLDVRGCTRATLAKSACLPSPKGVGKPVKICRDWDRTLQLLSENEEFLVGASHQLALNTSLPFVHTARGWPRLAGSLRQCGMHARGATXRLCWR

SEQ ID NO: 145343 - protein, 42 aa, Heterodera glycines
  Coding regions on vcDNA: vcDNA=SeqID_71766; Strand=+; Position=1-170
CCLYHPTPLMGSNERALWHLNCSFGSSHIASSAYQKWPTCSS

SEQ ID NO: 145344 - protein, 15 aa, Heterodera glycines
  Coding regions on vcDNA: vcDNA=SeqID_71767; Strand=+; Position=1-49
LKAIHCIPVLGTAKH

SEQ ID NO: 145345 - protein, 75 aa, Heterodera glycines
  Coding regions on vcDNA: vcDNA=SeqID_71768; Strand=+; Position=1-228
MVRRRIHREQDLAENELDMSCKAICSRDRFWHGAKDEQQGEQDEKEHDNCPMAQIRTVYKAGYGRNERRRNEGVP

SEQ ID NO: 145346 - protein, 64 aa, Heterodera glycines
  Coding regions on vcDNA: vcDNA=SeqID_71769; Strand=+; Position=1-197
TNLDIPLHLVDNSFEDNLALGHGHQYMERFGYHDGNERDEFLTKRPKRQAVIIIKTTNYSFYYF

SEQ ID NO: 145347 - protein, 138 aa, Heterodera glycines
  Coding regions on vcDNA: vcDNA=SeqID_71770; Strand=+; Position=1 -107,151-381,430-508
MGIWSSIWPQIILPGIFALVSVLFNFSLILVTFTKIKDHKVCNWLLAFDSFCQLFFVAPFLVNFLAQILQYTTVDYRICTGSLMASTVASYASFLALFLISAERLLIVLFPIKMNWIKEQTIRRFSLFFLYFLSFLAL

SEQ ID NO: 145348 - protein, 144 aa, Heterodera glycines
  Coding regions on vcDNA: vcDNA=SeqID_71771; Strand=-; Position=1 -257,300-477
YGRGENGEFHKPAYIAGRYRLFYVNSKNTKVKSAAWYANRGVHYKIEDCPDKPEDEDGYVPPPEQEQPGVIAGQPPVTLANALHDDLHGPADREAIIGLQPTDEIASAFDAFAEKAEDFVDLLRTRIMELEQQTRTLQRNLRQK

SEQ ID NO: 145349 - protein, 72 aa, Heterodera glycines
  Coding regions on vcDNA: vcDNA=SeqID_71772; Strand=-; Position=1 -15,127-330
MIKSMDLNASESDEFVGQRISRDWQWISIDQNMLNNITEIEESLAKEKELGRNLKRQNENILMNRQKHLNPS

SEQ ID NO: 145350 - protein, 31 aa, Heterodera glycines
  Coding regions on vcDNA: vcDNA=SeqID_71773; Strand=-; Position=1-94
MVQIQVQKYSKQDKLLEMLKTDAIWRPRPNG

SEQ ID NO: 145351 - protein, 93 aa, Heterodera glycines
  Coding regions on vcDNA: vcDNA=SeqID_71774; Strand=-; Position=1-282
MVRRRIHREQDPAENELDMSCKAIRSRNRFWHGAKDDQQGEQDEKEHANYPMAQIRTVYKARNGEIWSHISMPILCLLGQTILSFVSDYEGNS

SEQ ID NO: 145352 - protein, 19 aa, Heterodera glycines
  Coding regions on vcDNA: vcDNA=SeqID_71775; Strand=-; Position=1-59
TFAFSSLALPNTHTIFEML

SEQ ID NO: 145353 - protein, 19 aa, Heterodera glycines
  Coding regions on vcDNA: vcDNA=SeqID_71776; Strand=-; Position=1-59
TFAFSSLALPNTHTIFEML

SEQ ID NO: 145354 - protein, 19 aa, Heterodera glycines
  Coding regions on vcDNA: vcDNA=SeqID_71777; Strand=-; Position=1-59
TFAFSSLALPNTHTIFEML

SEQ ID NO: 145355 - protein, 19 aa, Heterodera glycines
  Coding regions on vcDNA: vcDNA=SeqID_71778; Strand=-; Position=1-59
TFAFSSLALPNTHTIFEML

SEQ ID NO: 145356 - protein, 19 aa, Heterodera glycines
  Coding regions on vcDNA: vcDNA=SeqID_71779; Strand=-; Position=1-59
TFAFSSLALPNTHTIFEML

SEQ ID NO: 145357 - protein, 19 aa, Heterodera glycines
  Coding regions on vcDNA: vcDNA=SeqID_71780; Strand=-; Position=1-59
TFAFSSLALPNTHTIFEML

SEQ ID NO: 145358 - protein, 19 aa, Heterodera glycines
  Coding regions on vcDNA: vcDNA=SeqID_71781; Strand=-; Position=1-59
TFSFSSLALPNTHTIFEML

SEQ ID NO: 145359 - protein, 30 aa, Heterodera glycines
  Coding regions on vcDNA: vcDNA=SeqID_71782; Strand=+; Position=1 -52,257-297
MEKACKIRRDYIDFSALDFLFISLFDIESI

SEQ ID NO: 145360 - protein, 24 aa, Heterodera glycines
  Coding regions on vcDNA: vcDNA=SeqID_71783; Strand=+; Position=1-76
ITGVSIIAVLFLVFLMLSQNLVRF

SEQ ID NO: 145361 - protein, 89 aa, Heterodera glycines; identical to SEQ ID NO: 144620
  Coding regions on vcDNA: vcDNA=SeqID_71784; Strand=+; Position=1-648

SEQ ID NO: 145362 - protein, 132 aa, Heterodera glycines
  Coding regions on vcDNA: vcDNA=SeqID_71785; Strand=-; Position=1 -262,429-565
  Homolog annotation: Hit_ID=XP_421272.1; Match level="QueryCoverage =69%, HitCoverage=17%, E-value=3e-16, Identity=53%"; Hit description =PREDICTED: similar to dihydrolipoamide S-succinyltransferase (E2 component of 2-oxo-glutarate complex) [G
MPPLPKEPISSKPVSEIKVPKFQQQPPHAPAGDSTAITGQRSETRVKMNRMRLRIAERLKEAQNTSAMLTTFNEVNTNGGEAGDMSECRSVQRGTDAQAVPRGVHEEAWCQVGSDVSVRPRVRNWVAGTARG

SEQ ID NO: 145363 - protein, 21 aa, Heterodera glycines
  Coding regions on vcDNA: vcDNA=SeqID_71786; Strand=-; Position=1-82
LNNTIHFFLLIALDKKRENTN

SEQ ID NO: 145364 - protein, 42 aa, Heterodera glycines
  Coding regions on vcDNA: vcDNA=SeqID_71787; Strand=+; Position=1-208
NFFIWTSLFVTRNHYFGDFVTKIVKNHYFGVLSLFFHYFDIF

SEQ ID NO: 145365 - protein, 216 aa, Heterodera glycines
  Coding regions on vcDNA: vcDNA=SeqID_71788; Strand=-; Position=1 -141,391-516,809-958,1568-1798
MGRMELDLDQMVKGKPNLVEEEAAYGQRKREITASIANMFEQYVDSLNRLRPLSVKCVLADDELKRLKRRRRVMGMDDDDIGEQLNTVKKRYQAQCKIREDHKINVEEAKDAFKTLAKYSPAENEQSHEETRAFTKMKSDVHEYQRLLEEHDKLGTEVRRVGERNERWKREMDDRLSEWLDPLGELVANISNNFTNFFAQLGCAGEVRLDTPPENK

SEQ ID NO: 145366 - protein, 79 aa, Heterodera glycines
  Coding regions on vcDNA: vcDNA=SeqID_71789; Strand=-; Position=1 -150,221-310
KFLFLINPPVDQTRTRKWPFKCQFYFDGGIAILASTKTQFRPTIFAMLDKVKEEIEFVTTRMITFLTLEKRIISRPIIF

SEQ ID NO: 145367 - protein, 37 aa, Heterodera glycines
  Coding regions on vcDNA: vcDNA=SeqID_71790; Strand=-; Position=1 -10,225-328
MTFSKRAQDLAEEGGLAEMMDIFRTTTTAERTEAAER

SEQ ID NO: 145368 - protein, 31 aa, Heterodera glycines
  Coding regions on vcDNA: vcDNA=SeqID_71791; Strand=+; Position=1-93
MGSKNPTQNYSTGYREAIPEGFGLPINLCAS

SEQ ID NO: 145369 - protein, 321 aa, Heterodera glycines
  Coding regions on vcDNA: vcDNA=SeqID_71792; Strand=+; Position=1-968
  Homolog annotation: Hit_ID=NP_507535.1; Match level="QueryCoverage =50%, HitCoverage=25%, E-value=3e-13, Identity=30%"; Hit description =retrotransposon gag protein and Zn-finger, CCHC type family member (5S599) [Caenorhabditis elegans] emb|C
RAELDSMDLPPVSLDAALGHLQSRFENENTKSIARQNLAICRQYPGEKVFDFATRLSEAVRTALAGETEGNIRKRLLEEFLDRLIPELQYEVKSERPTDYSRAYELAQHYELLQASRKSTSNVAMNELIEKVEALAMQNVRHAPNFSDQRDHRVCFYCKKAGHVIRDCAARRREANNGPNWRRDENSRRTERNGNYSRPFGQGYERNRETWRSGNSQQNSRPNQNYRRYRDQSGTRRECDQENRFPRTPTPRVNPRGGRIAGARVASPYFLAIIAIFGSVLSNLNPCKCSKTAADDLFTGRSVEFIGNSPEEPISPHVATD

SEQ ID NO: 145370 - protein, 59 aa, Heterodera glycines
  Coding regions on vcDNA: vcDNA=SeqID_71793; Strand=-; Position=1-178
MVRRKEEFLGWDAPHLIFPFFCFTTGQRRLCSLTRSCPIKVLGLSTVKCGANFGTVPPH

SEQ ID NO: 145371 - protein, 49 aa, Heterodera glycines
  Coding regions on vcDNA: vcDNA=SeqID_71794; Strand=-; Position=1 -101,368-443
GTWTFHSKMWCKFWNCPASRRGLKALYIIIKSENNFRIFFHNLFQKTTK

SEQ ID NO: 145372 - protein, 92 aa, Heterodera glycines
  Coding regions on vcDNA: vcDNA=SeqID_71795; Strand=+; Position=1-304
MIGRAVRNRPFIFEGIFKFILYPRKMAISFFEKFYTSQKRLRMRRRAVHNRHFISQRIFIFRGYPKKMAISFFDKFYTHTNALEHDREGGAQ

SEQ ID NO: 145373 - protein, 35 aa, Heterodera glycines
  Coding regions on vcDNA: vcDNA=SeqID_71796; Strand=+; Position=1-109
SMLAFHARMGRKLCRFRPPQIAAVSTVPASAGGDN

SEQ ID NO: 145374 - protein, 53 aa, Heterodera glycines
  Coding regions on vcDNA: vcDNA=SeqID_71797; Strand=-; Position=1 -95,146-209
NFRRFVSHCSVIASATCEVGKQIIVHNGGEAALVELSGGRVAEQFAEKQLSQF

SEQ ID NO: 145375 - protein, 106 aa, Heterodera glycines; identical to SEQ ID NO: 134274
  Coding regions on vcDNA: vcDNA=SeqID_71798; Strand=+; Position=1-321

SEQ ID NO: 145376 - protein, 173 aa, Heterodera glycines
  Coding regions on vcDNA: vcDNA=SeqID_71799; Strand=+; Position=1 -216,270-374,1164-1364
MHLDYKPDNLVYVELENGGKILKVIDFDGTYLLPDAKDRKGKLAIVSDRLKILTGTERYNAPEFYAELFAKKLSTKTDIWAVGIMLYEILFLQKKYTIYEEMGSDTQSFKNLLYHLNEIHRGFTVSKDLIKYNHHPITYSAEWLSKFNVKILFWMFQAWTDFPRVGLLITVII

SEQ ID NO: 145377 - protein, 79 aa, Heterodera glycines
  Coding regions on vcDNA: vcDNA=SeqID_71800; Strand=+; Position=1 -210,1084-1113
MSAKGIMDFLDGNCCPVELYEEKLEIENIFNDLSVKELNKNIDQRVEMDTTEFEEKQKLLAMKRMMKKARLLRALNSEA

SEQ ID NO: 145378 - protein, 85 aa, Heterodera glycines
  Coding regions on vcDNA: vcDNA=SeqID_71801; Strand=+; Position=1 -106,178-328
PSLDIVEPEISQKLSKKVDPSAALFAVFDGHNGAECATFASAHLTECFLDAFEQSDDIEKILNDAFERLDKRITEKCTSEVGIAK

SEQ ID NO: 145379 - protein, 122 aa, Heterodera glycines
  Coding regions on vcDNA: vcDNA=SeqID_71802; Strand=-; Position=1 -251,296-413
MSINGSALSAFQRIWHGFLSKKKVSRAEVMSLAEQIDPEVNDNELFDEITALNEILESISDQKFGEMNAEQDHLLCRVYFSNKIFFGSIALYESNQLIIVGFYTISLLMFEAFGYHSKAQSL

SEQ ID NO: 145380 - protein, 111 aa, Heterodera glycines
  Coding regions on vcDNA: vcDNA=SeqID_71803; Strand=-; Position=1-336
MDTALPSSCWSLSVPSSTAAAAGGICTGGSMPATTNPAQIGLMAMRRSETVPPLGHPDTSLFYMSNFPSMEMSSRRPPLPPLVPLPTFTEEEEEEGERDDDGTGIFREIEK

SEQ ID NO: 145381 - protein, 22 aa, Heterodera glycines
  Coding regions on vcDNA: vcDNA=SeqID_71804; Strand=+; Position=1-68
SNIVRLFDRARQEKATVGTNFA

SEQ ID NO: 145382 - protein, 59 aa, Heterodera glycines
  Coding regions on vcDNA: vcDNA=SeqID_71805; Strand=+; Position=1-179
PQTWYQQLPFFVWPYQTILRYWKRKQKKFLTKKWLSLFSHFFTANLVPTVAFSCLALSN

SEQ ID NO: 145383 - protein, 95 aa, Heterodera glycines; identical to SEQ ID NO: 124528
  Coding regions on vcDNA: vcDNA=SeqID_71806; Strand=-; Position=1-704

SEQ ID NO: 145384 - protein, 48 aa, Heterodera glycines
  Coding regions on vcDNA: vcDNA=SeqID_71807; Strand=+; Position=1-144
MFTSSAQKYLGRKASEIRMMEQDGDGEGLARLLDSFIGKKIVAKITIK

SEQ ID NO: 145385 - protein, 102 aa, Heterodera glycines
  Coding regions on vcDNA: vcDNA=SeqID_71808; Strand=+; Position=1 -30,645-912,946-956
  Homolog annotation: Hit_ID=NP_500081.1; Match level="QueryCoverage =84%, HitCoverage=11%, E-value=2e-18, Identity=52%"; Hit description =CaLPain family member (clp-6) [Caenorhabditis elegans] gb|AAF36079.1| Calpain family protein 6 [Caenorhab
MSPQLLAYNNRDGLYEDAKFPVESIQLYFTAGPVAIRWLRPGEIVAHPQFINQEPIAGDVRQGSIGNCWALSAASVLAQYGPLFYRVVPPDQGFGHNYAVRI

SEQ ID NO: 145386 - protein, 362 aa, Heterodera glycines
  Coding regions on vcDNA: vcDNA=SeqID_71809; Strand=+; Position=1 -434,484-930,973-1061,1103-1221
MKAKFYLLAYILLVCCCSKLFHGISFEELTSNNHAKPLIDQYLRKEIKTKGELLEKLAEIGVDLSLRSLERYISKIKNRKSTEGNKVDMENAEVSQCFSKFDNKFLFIIGHESEYRKFNKTNEREGVIYLYCMCCKKLKKPNSDSLIASAILRDGLLDRTHQIIHDKQCKGVPLEQLAAEQIDRSQRRDLVQCSINPKSLWREVFLFIKTRTFFVKGSDRAREHDVAEDIEIEDISGISFNYPNWQSVRSSYYRRRRNHLGDCSDPFNVPERLQLNKRGSIKLLLKKKISEEDMWLRFRDKELGVMLFISHSQIKAVSHCKVLVSDGTFELAPLKFQQIWTIHGLVRAFPLAGVFAQFRNFG

SEQ ID NO: 145387 - protein, 232 aa, Heterodera glycines
  Coding regions on vcDNA: vcDNA=SeqID_71810; Strand=-; Position=1-699
MALGPALFRLRQHITSAENLLDEDDPDAQTVISLRQERDHIIRILSRMEAEMDAWGTIMNALQGPAREAEEALFANFVRDDRHLTDWLEDARELLAHIAAELANPPNQVMPAGGQQPVAAVNQAMPQMPAIPVAINAAAGANLQQPAAANHAYLPPPVPVANVHNMPILPPAAAPQATARLPQSVFLFFRANQWNGPRFGRVSRVPSTVPPLSPSTNSTISTVAYAERLLVP

SEQ ID NO: 145388 - protein, 180 aa, Heterodera glycines
  Coding regions on vcDNA: vcDNA=SeqID_71811; Strand=+; Position=1-1021
ILVRVLIVPIPMTGLIRDRSRISRHYLLAWRVGICAPAAILRRSGHFSGPFSGVEPLSSVTRHHHGSQIHYHRKLIRQTLERHVAGTRPCDQLSCSESTLDARRALGFVANKCAPLWGDWSFGACISSRITTVIQVRSQGQVNYSWCNEPYAVSLSGRLNLHMHGLIFEMNTSVQAGSTR

SEQ ID NO: 145389 - protein, 67 aa, Heterodera glycines; identical to SEQ ID NO: 128477
  Coding regions on vcDNA: vcDNA=SeqID_71812; Strand=-; Position=1-205

SEQ ID NO: 145390 - protein, 72 aa, Heterodera glycines
  Coding regions on vcDNA: vcDNA=SeqID_71813; Strand=-; Position=1-217
  Homolog annotation: Hit_ID=YP_011575.1; Match level="QueryCoverage =100%, HitCoverage=31%, E-value=4e-15, Identity=57%"; Hit description= thiamine-phosphate pyrophosphorylase [Desulfovibrio vulgaris subsp. vulgaris str. Hildenborough] gb|AAS9
PKGIPLIINDHVDVCLASGADGVHLGANDLPVESARELLGPDAILGYSVNNEKALEHAIRLGHKIDYLGVGP

SEQ ID NO: 145391 - protein, 144 aa, Heterodera glycines
  Coding regions on vcDNA: vcDNA=SeqID_71814; Strand=-; Position=1 -224,289-345,414-518
  Homolog annotation: Hit_ID=CAE71449.1; Match level="QueryCoverage =100%, HitCoverage=32%, E-value=3e-45, Identity=65%"; Hit description= Hypothetical protein CBG18361 [Caenorhabditis briggsae]
QHIALNTSDIVHAIQSLRARGLEFLSIPDSYYASLKQRLSDAGVELKEDLEKLRELKILVDFDEQGYLLQIFSKPCQDRPTLFPCQDRPTLFLEIIQRHNHQGFGAGNFGFGAGNFKALFESIEAEQNERGNLFYKDVAVGGEK

SEQ ID NO: 145392 - protein, 29 aa, Heterodera glycines
  Coding regions on vcDNA: vcDNA=SeqID_71815; Strand=-; Position=1-90
NVKSINFFCCCCCRIDGAAIAFERSFFSF

SEQ ID NO: 145393 - protein, 67 aa, Heterodera glycines
  Coding regions on vcDNA: vcDNA=SeqID_71816; Strand=+; Position=1 -41,836-997
MAAPSIRQQQQQKKTNLINQDIFILSDLDPPNQDKFDKSGQIASLQYYHMLLFGEREMALALAKCHQ

SEQ ID NO: 145394 - protein, 63 aa, Heterodera glycines
  Coding regions on vcDNA: vcDNA=SeqID_71817; Strand=-; Position=1 -381,512-634
LTLKNNSLPKSFLQPLIANLISCRFKAIHCLPVSAQQSTNRVFDSLQKIIHYPKVFYNHILPI

SEQ ID NO: 145395 - protein, 45 aa, Heterodera glycines; identical to SEQ ID NO: 143169
  Coding regions on vcDNA: vcDNA=SeqID_71818; Strand=+; Position=1-136

SEQ ID NO: 145396 - protein, 82 aa, Heterodera glycines
  Coding regions on vcDNA: vcDNA=SeqID_71819; Strand=-; Position=1 -52,128-189,348-452
  Homolog annotation: Hit_ID=CAE59677.1; Match level="QueryCoverage =96%, HitCoverage=44%, E-value=3e-27, Identity=78%"; Hit description =Hypothetical protein CBG03100 [Caenorhabditis briggsae]
DSRVTEALEQLTSDQIEQFRKYFNMFDFRKYFNMFDKEGKGFIKATQVGQILRTMGQAFEERDLKQLIREFDSDGSGEIEFE

SEQ ID NO: 145397 - protein, 91 aa, Heterodera glycines
  Coding regions on vcDNA: vcDNA=SeqID_71820; Strand=-; Position=1 -5,223-493
  Homolog annotation: Hit_ID=NP_035425.2; Match level="QueryCoverage =93%, HitCoverage=64%, E-value=3e-22, Identity=52%"; Hit description =ribosomal protein S12 [Mus musculus] gb|AAH87174.1| Unknown (protein for MGC:97945) [Xenopus laevis] gb|A
MMREAHFCVLAKSCDEASFEKLVRSLCKEHTIPILEVEDKAELGQMVGQCKYDKDGKARKIVGCSVAVVKDYGRDEEAKNDLQEVLKKISD

SEQ ID NO: 145398 - protein, 136 aa, Heterodera glycines
  Coding regions on vcDNA: vcDNA=SeqID_71821; Strand=+; Position=1 -345,962-1027
  Homolog annotation: Hit_ID=NP_496487.1; Match level="QueryCoverage =77%, HitCoverage=44%, E-value=2e-24, Identity=47%"; Hit description =putative protein of ancient origin (28.3 kD) (2L940) [Caenorhabditis elegans] emb|CAA93779.1| Hypothetica
MPTFPWSKKRKASDDEVVESGMTVRQILEEREEYVKNIGIEYRFGCYEEKRADSCQYLGEYFEAVQTDFKSAFDTFRQNCEQRKFPRSCFKYGQYLAAGRACEASFKKVGWMKRGSCVNVSLMYRNGEGIPKDEKK

SEQ ID NO: 145399 - protein, 96 aa, Heterodera glycines
  Coding regions on vcDNA: vcDNA=SeqID_71822; Strand=-; Position=1 -60,227-318,363-500
MHEIIPREQMPPLLTPEEETMPKLLHGSYKNLVAFLDTNSFRFEDKVWLFDIIHKTVFRMVKVRLYLAFKSPHNLRGLAFITDPDGYWIEIFNPNN

SEQ ID NO: 145400 - protein, 246 aa, Heterodera glycines
  Coding regions on vcDNA: vcDNA=SeqID_71823; Strand=-; Position=1 -169,522-696,756-875,932-1042,1090-1196,1287-1307,1364-1403
  Homolog annotation: Hit_ID=CAE60539.1; Match level="QueryCoverage =94%, HitCoverage=25%, E-value=3e-39, Identity=33%"; Hit description =Hypothetical protein CBG04166 [Caenorhabditis briggsae]
SLAQRSRREDLSDLLQRYIRRAYSRWAHFVVAHTWKIVVLCFIASAICGFKMLNTKVKNQITGYTPYGSRSLNEFAVQDEFFGQTGLGVKILLLILPKKGNNLMNLESLRETVDVDNLVRHNLTFYNQKHDRDESFSMICNFYCNVSEPVQLFYTGFQDQYDRVMKHEPLNDRIKLDYPFSLIMGRKVNLQPNFYGVHVSKTSKPKFGNMDKIESIVIRYRAEKTRGWTDDDISAYEDTITDYFEK

SEQ ID NO: 145401 - protein, 44 aa, Heterodera glycines
  Coding regions on vcDNA: vcDNA=SeqID_71824; Strand=-; Position=1-370
IKFLKIFNSFLNRPKSLGLTFFSETYQKRTKLCRDTERKRNNLF

SEQ ID NO: 145402 - protein, 146 aa, Heterodera glycines
  Coding regions on vcDNA: vcDNA=SeqID_71825; Strand=-; Position=1-439
NGVSKNRNYAQKASQTILAHPIPSTIAFIHPIMSAKIIRVPKIACDLSLAKNGVSKNRNYAQKASQTILAHPIPSTIAFIHPIMSAKIIRVPKIACDLSLAKNGVSKNRNYAQKASQTILALPIPSTIAFIHPIMSAKIIRVPKIA

SEQ ID NO: 145403 - protein, 55 aa, Heterodera glycines
  Coding regions on vcDNA: vcDNA=SeqID_71826; Strand=-; Position=1 -69,145-200,267-309
MQTLRHALFDAITANGKKSGESPTPFRLSAKQQKKRRTNEGGKINSDNILFIAFC

SEQ ID NO: 145404 - protein, 24 aa, Heterodera glycines
  Coding regions on vcDNA: vcDNA=SeqID_71827; Strand=-; Position=1 -67,606-613
MSRSSIDALFANSIKKQSSSQNVF

SEQ ID NO: 145405 - protein, 101 aa, Heterodera glycines
  Coding regions on vcDNA: vcDNA=SeqID_71828; Strand=-; Position=1 -110,297-491
  Homolog annotation: Hit_ID=CAE71393.1; Match level="QueryCoverage =93%, HitCoverage=15%, E-value=8e-31, Identity=62%"; Hit description =Hypothetical protein CBG18300 [Caenorhabditis briggsae]
QIGLEIIPLVQTFGHLEWVLKLEQFAHLREHPKFPQVICIGNDEAFELLKTMVVQVAEVHARFGMRHFHMGADEVFQLGVCNESVREMRAQGGRERVRAKN

SEQ ID NO: 145406 - protein, 67 aa, Heterodera glycines
  Coding regions on vcDNA: vcDNA=SeqID_71829; Strand=-; Position=1 -58,658-803
MANSPSTTVTFSGISTIRAAPSMTPRAVQGDRPPSGASPPNPSPSRSQCEWNRCRCPIVRISDSTAG

SEQ ID NO: 145407 - protein, 155 aa, Heterodera glycines
  Coding regions on vcDNA: vcDNA=SeqID_71830; Strand=+; Position=1 -149,730-927,1363-1482
  Homolog annotation: Hit_ID=CAE62158.1; Match level="QueryCoverage =81%, HitCoverage=1%, E-value=4e-22, Identity=45%"; Hit description =Hypothetical protein CBG06205 [Caenorhabditis briggsae]
TLIQLCYPKCEQSDTGTYSIRIVNDLGSDSVDLRLKVVDRPAPPEGSLKDLETSGTPARIVEIPENVTVVEGELAIIKCVVEGNPAPTIVWKKGARKMPLTDDRVRCQTDGDTGHVSLIISKCRPQDGGEYTLMVKNAHGKHNVGAKLLVTPAAE

SEQ ID NO: 145408 - protein, 22 aa, Heterodera glycines
  Coding regions on vcDNA: vcDNA=SeqID_71831; Strand=-; Position=1 -7,447-508
MDARDEETLNDPLQPQDAEGDH

SEQ ID NO: 145409 - protein, 19 aa, Heterodera glycines
  Coding regions on vcDNA: vcDNA=SeqID_71832; Strand=-; Position=1-59
TFAFSSLALPNTHTIFEML

SEQ ID NO: 145410 - protein, 19 aa, Heterodera glycines
  Coding regions on vcDNA: vcDNA=SeqID_71833; Strand=-; Position=1-59
TFAFSSLALPNTHTIFEML

SEQ ID NO: 145411 - protein, 19 aa, Heterodera glycines
  Coding regions on vcDNA: vcDNA=SeqID_71834; Strand=-; Position=1-59
TFSFSSLALPNTHTIFEML

SEQ ID NO: 145412 - protein, 19 aa, Heterodera glycines
  Coding regions on vcDNA: vcDNA=SeqID_71835; Strand=-; Position=1-59
TFAFSSLALPNTHTIFEML

SEQ ID NO: 145413 - protein, 19 aa, Heterodera glycines
  Coding regions on vcDNA: vcDNA=SeqID_71836; Strand=-; Position=1-59
TFAFSSLALPNTHTIFEML

SEQ ID NO: 145414 - protein, 19 aa, Heterodera glycines
  Coding regions on vcDNA: vcDNA=SeqID_71837; Strand=-; Position=1-59
TFSFSSLALPNTHTIFEML

SEQ ID NO: 145415 - protein, 19 aa, Heterodera glycines
  Coding regions on vcDNA: vcDNA=SeqID_71838; Strand=-; Position=1-59
TFSFSSLALPNTHTIFEML

SEQ ID NO: 145416 - protein, 160 aa, Heterodera glycines
  Coding regions on vcDNA: vcDNA=SeqID_71839; Strand=-; Position=1 -177,233-448,488-577
  Homolog annotation: Hit_ID=NP_505838.2; Match level="QueryCoverage =78%, HitCoverage=42%, E-value=4e-10, Identity=32%"; Hit description =predicted CDS, serpentine Receptor, class G (gamma) (srg-40) [Caenorhabditis elegans] emb|CAA99919.2| Hyp
MLDQIYNFSLSHRQLFNYFGICTDIPSTIVYILEMITIIRHKQFSKSSFYKLFFIRTVADLLNLVPNNFGNLLPAFFGQQLLPIYSTVPNWAIVFLTFFVKTFEFKVSNIVTVFILLNRFTAIAFPFRHKMLWKKYFWHLIVFMLILPMIITVPSTTIIF

SEQ ID NO: 145417 - protein, 550 aa, Heterodera glycines
  Coding regions on vcDNA: vcDNA=SeqID_71840; Strand=-; Position=1 -1139,1307-1820
MKRFSLSQNSSSSFPKKSQPNKCIRKIDNLTSKSKKYQLVRSKSKFVIEEIDKCADPAAELRSCVHHSIEEAILDGQNTLGAANKVGVIISSELLDQGDIILPITPITANVVDAVFNQFCKVEQSKSKHVNLYGAPFIITVTVLNTNGLPRQRTTKGKGRPPVSSQSHIFKVNNNDNYCLFYALELMRYYSLYKRGIITRDNWRWINNNQTTVLRQKALQLLREAGIPTTETEYDAEVYIHQVQGLWNVKYPGEYKIFIFNDYQMRPITKSDITDYQFPILLYHNNNHFDGIKTLSKFFNKRYYCISCESAYSHKFEHSSKCSSLCHGCREVGVDYPCDPQQGYSKKCEHCNTPFTTTAVMGATSTRICAPNFNAAKIVGIIAYDFEATQDKKVENRFEHEVNFAAATIICTDCIINGYWNKSLQGKKCQICGPHRSITFSPFDYTETTVDQKVVTQQPLCEFVQWLLFDHNKKFPTVAFAHFGGRYDMTMIIKEVLSQGIHNPDIIKQGNRLYELKIRENEHGPLTIFHDSYNLMPIKLSGLIKIVGFI

SEQ ID NO: 145418 - protein, 86 aa, Heterodera glycines
  Coding regions on vcDNA: vcDNA=SeqID_71841; Strand=-; Position=1 -93,145-216,448-543
MPKVAQPMVKNVVKKGNSNAFIVVTKERPFLWKTETELKKKMEKRVPIGFMPLKKPMSTNFAKKTFYSNTIAAEPNWHMYIKKFHW

SEQ ID NO: 145419 - protein, 110 aa, Heterodera glycines
  Coding regions on vcDNA: vcDNA=SeqID_71842; Strand=+; Position=1 -58,95-245,453-576
MAQHSAMRFVMASEQSDVIYLGASEFWAIIVFSMLSQRSNNRRRRHPMTCPPMVMPAPPASMISAITPLITLKIQFVTADHELLWSYLDNQITHLGEEFFGDRKGGIADI

SEQ ID NO: 145420 - protein, 40 aa, Heterodera glycines
  Coding regions on vcDNA: vcDNA=SeqID_71843; Strand=-; Position=1-125
NSKYQLFLPFYLQKILRQDALFDCPNNSKEARDLRSQTGS

SEQ ID NO: 145421 - protein, 21 aa, Heterodera glycines
  Coding regions on vcDNA: vcDNA=SeqID_71844; Strand=-; Position=1 -54,574-585
MRTRPIWQVKQRLLTSQKKGF

SEQ ID NO: 145422 - protein, 153 aa, Heterodera glycines
  Coding regions on vcDNA: vcDNA=SeqID_71845; Strand=+; Position=1 -92,141-381,435-563
  Homolog annotation: Hit_ID=A44982; Match level="QueryCoverage=98%, HitCoverage=94%, E-value=8e-32, Identity=41%"; Hit description =collagen UCOL1 - pig roundworm (fragment) gb|AAA29371.1| collagen
PGVAGPDGVQGKIGLRGSDGIPGASLAEQEWCFDCPQAPPGPKGPKGPKGPNGVPGLPGRAGKRSQINLSLNYMGISLAGEKGPPGVPGSPGLPGLVGPNGPPGPKGEPGKLNDLPAAKGPTGLHGLDGPLGPPGPDGPSGKPGPSGPPGQLV

SEQ ID NO: 145423 - protein, 59 aa, Heterodera glycines
  Coding regions on vcDNA: vcDNA=SeqID_71846; Strand=+; Position=1 -54,230-355
MSSGWKFVLYFLLLLLLLWEPKMMKSRQKSKLIMSNKSVKNVALRRCLFCLTKIVNSTI

SEQ ID NO: 145424 - protein, 97 aa, Heterodera glycines; identical to SEQ ID NO: 143380
  Coding regions on vcDNA: vcDNA=SeqID_71847; Strand=+; Position=1-304

SEQ ID NO: 145425 - protein, 36 aa, Heterodera glycines
  Coding regions on vcDNA: vcDNA=SeqID_71848; Strand=+; Position=1-108
MTRAIDANGRPNGKKSPKGENLIKSIPSGDRAGCRG

SEQ ID NO: 145426 - protein, 24 aa, Heterodera glycines
  Coding regions on vcDNA: vcDNA=SeqID_71849; Strand=+; Position=1-73
MAKTFGPMGQMPQQKQQQGKCRPI

SEQ ID NO: 145427 - protein, 519 aa, Heterodera glycines
  Coding regions on vcDNA: vcDNA=SeqID_71850; Strand=-; Position=1-1560
  Homolog annotation: Hit_ID=NP_510849.1; Match level="QueryCoverage =84%, HitCoverage=32%, E-value=2e-77, Identity=36%"; Hit description =predicted CDS, zn-finger, CCHC type and RNA-directed DNA polymerase and Integrase, catalytic domain conta
RWALILLNYDFSIEFVRTDCTGQADALSRLISDQRSCSKDEDVVIAKLLADTEADVAHVFNTQTEQLPLTAKEIAEAQLSDPLIREVLECTMGRWPNKGLNPEIKPYFTVRNNLSIISDCLVFNGRTIIPQALRDRILKALHLAHPGIVRMKSLARELVYWPSMDADIESLVKSCVPCQEAAKQPTKHPLQPWPSTTSVFERVHIDLAGPCSNGRTYLVVIDTYSKWPEIFQLNNTSSHSVISQLQWLFDRYGVPKTLVSDNGPQFSSSVFKEFCKNNGIKHIFSPPYHPQSNGAAERYVDYFKRQLKKCSGDRNWLSKSLLSYRSTPIAVLGQRSPAELFLGRKLRTKLSLMRPETIPKQQHHEHTSKMKLQFDKKHNVKPVQFKIGEQVQFLNYRNGKTLWLFGRIVSNKGLIYEIRSPQLGNRIVTRHANQIRTTMAQRGDETCPVADDIIFAREEHGTGNETTDDQQTNTQPQQRAAQQEEQGQNQQPLPLRRSEQTRKRVRFLSPTHTGQSYDH

SEQ ID NO: 145428 - protein, 382 aa, Heterodera glycines
  Coding regions on vcDNA: vcDNA=SeqID_71851; Strand=-; Position=1 -189,232-418,458-686,729-1040,1109-1339
  Homolog annotation: Hit_ID=NP_501949.1; Match level="QueryCoverage =88%, HitCoverage=66%, E-value=2e-40, Identity=31%"; Hit description =tc5 transposase and CENP-B protein and Tc5 transposase, C-terminal family member (4L315) [Caenorhabditis
QLSYDLINVIEKCNRERIEVEISEDLVYDEFAEIGGKEGSESDDEFEIEGESQFESEEESPTKSSSSSNYVPSPKKVMSPHITLEDKKKALIFYRSAQKGYRSLTAMSKNFRWIKKESDLKKLRNFEINMKDKISAYKNLDHLLFEFFIEKRKMNLPIKNSDLRRWALQLNNQSGNKVSGFKAGIYWLKGFKRRKHIVTRKITKFVGKKWAKDQEKIYTDSAEFVSDTKTLIGKEHPDLVLNTDQSGFELELHSTHTLEISGTKKVEGYVQSVGSTTHSYTICPIFSADGLLYSPMLIVIGEKSGAENILSVAGRSHIMTKEIAKKFVSDVLLPIISGKKTVLILDSWPTWKSVIGEKESTSERMVVDDIRIQTIPPGCTGL

SEQ ID NO: 145429 - protein, 59 aa, Heterodera glycines
  Coding regions on vcDNA: vcDNA=SeqID_71852; Strand=-; Position=1 -137,294-336
MLAGLTNLYTDYWISAAMRNNKQKRGRKGRWLWKIADKKERRADDEYLACPAHNICGME

SEQ ID NO: 145430 - protein, 25 aa, Heterodera glycines
  Coding regions on vcDNA: vcDNA=SeqID_71853; Strand=-; Position=1-82
RTLSTAVRQRSSKIYSMPQILWAGY

SEQ ID NO: 145431 - protein, 97 aa, Heterodera glycines
  Coding regions on vcDNA: vcDNA=SeqID_71854; Strand=+; Position=1 -43,88-338
MAGNLQRSDHQIIKVCGLTTPLDGTEDEKIACFKPEGAIGPIGIKFLRKFRTNETAKDGRNNHEEDGLSDDDDAGWMESEMTTNCSFFEPLLLLNLF

SEQ ID NO: 145432 - protein, 92 aa, Heterodera glycines; identical to SEQ ID NO: 129648
  Coding regions on vcDNA: vcDNA=SeqID_71855; Strand=-; Position=1-304

SEQ ID NO: 145433 - protein, 92 aa, Heterodera glycines
  Coding regions on vcDNA: vcDNA=SeqID_71856; Strand=-; Position=1-304
MIGRAERNLPFIFEGISKFILYPRKMAISFFEKFYTSLKRLRMRRRAVHNRHFISQRIFIFTGYPRKMAISFFDKFYTHTNALEHDREGGEQ

SEQ ID NO: 145434 - protein, 129 aa, Heterodera glycines
  Coding regions on vcDNA: vcDNA=SeqID_71857; Strand=+; Position=1 -129,193-452
MNSQQRQAERAQLRARLNLLVDEVDFVVQGLISNYQADGLINEAPHEGQLMGMDHGQGLQHEQQQQQPWELDPPMPAQQFEIGPQLPDAWELVPYQPTPQWAQVAHVEQHPQQQQHYHPPAQQQQQQQG

SEQ ID NO: 145435 - protein, 143 aa, Heterodera glycines
  Coding regions on vcDNA: vcDNA=SeqID_71858; Strand=-; Position=1 -132,496-718,985-1061
MLDVSGLTEADQKKNPGAIVRALKFYAAAVKQRENDKFMYPQKSVYPVSEDDIETDEFEFASGSTTASNGGAIPRRSSSTPHQCNSESCGNINSGHALEQFNATWYYDTDESATVADHEFFFENWHAAKRVSNLQTCQIEPQN

SEQ ID NO: 145436 - protein, 336 aa, Heterodera glycines
  Coding regions on vcDNA: vcDNA=SeqID_71859; Strand=-; Position=1 -84,131-314,515-1257
  Homolog annotation: Hit_ID=CAE58647.1; Match level="QueryCoverage =85%, HitCoverage=52%, E-value=4e-56, Identity=46%"; Hit description =Hypothetical protein CBG01815 [Caenorhabditis briggsae]
SLNTQTYPNKLWHEGRVPYMLEEGMSALQRAAIASAFDEYKGKSQFAREGLAKRMKERANALRQNVHSLRPETKYRIRLHLCETELRVGMHALGFFHEHSRTDRDEYVDLLEDNVRPGMLRNFEKYPKKIIDPLGMPYDYGSVMHYHKLAFSRNGRATIVPVWEKGGGILTIAFVRSRKAWKLDKGLKGNLAKKSEDEFRHKLSEIDAMKVNKLYRCDSEGPATETTTTAPKRTSETTAETKTTPEGQTEEQTTTEESEPTTGEEETAEQTEETTTDDGAGAETETTTEETERGTTEETAATTETETEPEKTTTHLAFRNKTKPKERRTKWPNVAK

SEQ ID NO: 145437 - protein, 59 aa, Heterodera glycines
  Coding regions on vcDNA: vcDNA=SeqID_71860; Strand=-; Position=1-178
MDPRNGFYDKNEDKVTLAIDVIVGQAEMDRAISADQSKSKGTLFMDIEKVSQFAREIIW

SEQ ID NO: 145438 - protein, 68 aa, Heterodera glycines
  Coding regions on vcDNA: vcDNA=SeqID_71861; Strand=-; Position=1-304
AVLVRFITAPNLLASQQSLLNLPDRTGAHDSTVPSTPPKAKRYNQNIRKNFLKNFFSIFVFDTKASEC

SEQ ID NO: 145439 - protein, 223 aa, Heterodera glycines
  Coding regions on vcDNA: vcDNA=SeqID_71862; Strand=-; Position=1 -114,169-262,307-435,1288-1620
  Homolog annotation: Hit_ID=CAF92976.1; Match level="QueryCoverage =47%, HitCoverage=19%, E-value=2e-09, Identity=36%"; Hit description =unnamed protein product [Tetraodon nigroviridis]
MSLSVVDRMKRMLSTGEDADVHFLVGEGEEKEASLKIKRVAAHKVILKHASEVFEAMFRFDSQNQNVENACANCVVEVPDVEAAAFKVMLSFIYADDLSQLDGDNAMAVLYAVPSGVLTVEEVIGIYQFHCHPNLHMVSELYPLKFPRQGRISDRTEGTLQLEIEKMSEFAGKVMGSCRYSKTVHIRGLPFEILAKINATTENDENFVGKWLGIFLWCTAPTE

SEQ ID NO: 145440 - protein, 175 aa, Heterodera glycines
  Coding regions on vcDNA: vcDNA=SeqID_71863; Strand=-; Position=1 -162,260-322,372-409,471-485,537-565,627-740,794-828,879-950
  Homolog annotation: Hit_ID=CAE63308.1; Match level="QueryCoverage =98%, HitCoverage=40%, E-value=1e-71, Identity=71%"; Hit description =Hypothetical protein CBG07697 [Caenorhabditis briggsae]
VRQAYLKWPSAIIPYTVSQQYLLYGRDQIVQAIDEYSTKTCIKFRPKTPSDMDYIHIFPDDGCYSLVGKVGGKQPVSLGDGCMSKGIIIHELMHAVGFFHEQSRSDRDNYVNIKWDNIDQNLRDQFDKYSQNMIDFLGTQYDYGSVMHYGPYAFTKNGKPTIQPKQPGKTIGQAI

SEQ ID NO: 145441 - protein, 92 aa, Heterodera glycines; identical to SEQ ID NO: 129555
  Coding regions on vcDNA: vcDNA=SeqID_71864; Strand=+; Position=1-304

SEQ ID NO: 145442 - protein, 127 aa, Heterodera glycines
  Coding regions on vcDNA: vcDNA=SeqID_71865; Strand=-; Position=1-384
MTAIAAVSPPFESASRNGAAGTGAGGCVAGTARHRQFAESRSLSTATNWCKMRNAIAEAGNGNDGGGVEALLLTKRTKAAAQMPNCAAPSTKAATADKCHPITTTVAPEAVPYYQLNSAENVNGEAN

SEQ ID NO: 145443 - protein, 16 aa, Heterodera glycines
  Coding regions on vcDNA: vcDNA=SeqID_71866; Strand=-; Position=1-49
EAIPEGFGLPINLDAS

SEQ ID NO: 145444 - protein, 34 aa, Heterodera glycines
  Coding regions on vcDNA: vcDNA=SeqID_71867; Strand=+; Position=1-109
GDPFVLQSFFKIKNHNFLSGVLKVANHESDMYFD

SEQ ID NO: 145445 - protein, 172 aa, Heterodera glycines
  Coding regions on vcDNA: vcDNA=SeqID_71868; Strand=+; Position=1 -63,105-183,227-258,473-514,756-881,934-1038,1097-1168
  Homolog annotation: Hit_ID=CAE69517.1; Match level="QueryCoverage =100%, HitCoverage=100%, E-value=3e-41, Identity=44%"; Hit description=Hypothetical protein CBG15726 [Caenorhabditis briggsae]
MSNIAFIRIQKECKEIILCKELQENGVTIEPVNETLFEIIGKIRGPPDSPYENGIFILDVKIPQEYPFQPPKLLDWLFSLVLLSVQSLLLSPEPKDPQDAIVAKQCLSDPALFRSTAKYWAQHYANAPGEIDRNKAKCVSTLQEMGASKDASISALSCYNWNLAKATEFLFT

SEQ ID NO: 145446 - protein, 69 aa, Heterodera glycines
  Coding regions on vcDNA: vcDNA=SeqID_71869; Strand=+; Position=1 -114,764-856
  Homolog annotation: Hit_ID=NP_572998.1; Match level="QueryCoverage =95%, HitCoverage=73%, E-value=1e-12, Identity=54%"; Hit description =CG9065-PA [Drosophila melanogaster] gb|AAF48421.1| CG9065-PA [Drosophila melanogaster]
MYTGDAAISGSSAQQAKTGTESSTSKPKACCVCKETKGKRDECIILNGEENCGQLIEAHKKCMREYGFE

SEQ ID NO: 145447 - protein, 38 aa, Heterodera glycines
  Coding regions on vcDNA: vcDNA=SeqID_71870; Strand=+; Position=1-186
GVKCAICVKISLNTSLVNPFKECSQMLPLCCVFLVDEL

SEQ ID NO: 145448 - protein, 132 aa, Heterodera glycines
  Coding regions on vcDNA: vcDNA=SeqID_71871; Strand=+; Position=1 -4,1051-1445
  Homolog annotation: Hit_ID=NP_499402.1; Match level="QueryCoverage =90%, HitCoverage=27%, E-value=1e-30, Identity=51%"; Hit description =putative cytoplasmic protein of eukaryotic origin (3M21) [Caenorhabditis elegans] pir||T23762 hypothetica
MRINSVHFQEVKKNSIELSLFEYDRRFEQKFPQFFINYDYRKPLDVPSNLHHNFDFLIADPPFLSDECFIKIAQTIRLLSKKETKLIINTGAVMEGLLQRILDVRRTEFRPVHKNNLANEFLSFSNYPLSIL

SEQ ID NO: 145449 - protein, 192 aa, Heterodera glycines
  Coding regions on vcDNA: vcDNA=SeqID_71872; Strand=+; Position=1 -299,345-623
  Homolog annotation: Hit_ID=NP_507780.1; Match level="QueryCoverage =87%, HitCoverage=10%, E-value=3e-13, Identity=29%"; Hit description =predicted CDS, DNA polymerase type B, organellar and viral family member (5T899) [Caenorhabditis elegans]
MYEMKVRKQKKRNPNVVFRDSFNLMPCSLAALIPSYGLDVEDKPFFPHLANRPENYGREIQPTPDDYLANGMMPGKRRQFDEWYAEHHHEPFWLDEALASYCTNDVEILMAALVAFRREFFEISRRQEYIDGIDDRENHDGIDVLRECMTIAGACMRHFRTNHLPSEHLAIVPERGYDNAQNQSLLALRFFH

SEQ ID NO: 145450 - protein, 121 aa, Heterodera glycines
  Coding regions on vcDNA: vcDNA=SeqID_71873; Strand=-; Position=1-364
MQTRYASSVRFHLIGFTSSLTLSSKCFATFPHGTCSLSDSWPYLVLDEVYHLIWAAIPNNPTPRHVKMGRHRQLDRSCTFSGAPVKGNLNKRANPSSRSIRYTSQPQRSCDSALDSSQFTR

SEQ ID NO: 145451 - protein, 173 aa, Heterodera glycines
  Coding regions on vcDNA: vcDNA=SeqID_71874; Strand=-; Position=1-524
  Homolog annotation: Hit_ID=XP_345024.1; Match level="QueryCoverage =98%, HitCoverage=88%, E-value=4e-16, Identity=26%"; Hit description =similar to SPAC23A1.17 [Rattus norvegicus]
FPSLGLNPPAFQSLGLNSPAFQSLGLNPPAFQSLALNPPAFQSLGLNPPAFQSLGLNPPTFQSLVLNPTAFQSLGLNPPAFQSLGLNPPAFQSLGLNSFQSLALNPPAFQSLGLNPPAFQSLGLNPPAFQSLGLNPTAFQSLGLNPPAFQSLGLNPPAFQSLVLNPTAFQSLG

SEQ ID NO: 145452 - protein, 204 aa, Heterodera glycines
  Coding regions on vcDNA: vcDNA=SeqID_71875; Strand=+; Position=1-615
MDVINESANSEIRQKLIQMPQGSADQAQPMSEGTIIIDLERTGSTTTIANEFASIPQHDQTGTNDNANPNDQTNFVNPNDQQLVKPRETGQLMPMTADNLNLASLHEADNVEQFVMIPTPNMRQINAENRVNSKRNSKSGEKTDFGAAESINEASPSTVQRKRGRSKTLKIQDKNAVGKSKMGVEKPSMKSAKGKSKMVFIIKY

SEQ ID NO: 145453 - protein, 103 aa, Heterodera glycines
  Coding regions on vcDNA: vcDNA=SeqID_71876; Strand=-; Position=1 -205,261-355,748-759
MPFFFFFLEFAKACGGGTELIPFFGYALRIVVEAPIELGTDTKTEEDDGQQQKQWGECATFGSGKTEKEAEIIFEKNSQEAPAETFRDEPFFEFVKAIVSGSH

SEQ ID NO: 145454 - protein, 304 aa, Heterodera glycines
  Coding regions on vcDNA: vcDNA=SeqID_71877; Strand=+; Position=1 -195,380-1099
MRRSQMLARNESFLETLCNAKKANDLIRDATDEQLLCLVEICLNILKGRVPLRTRHLNKLKAHAQHTKRYLFVPEEIYQSLASPPPSDGTPIGLVRNRIKQIKNDDGINEAERAIKYEQELKRLNKLTRDEDERPVGVKLENLSDVVDAMPKPVNVKRPIVVATRRHLKVGRARKANVEQLEDVDDDDDDDETPKPSSSNKRQPTQTEILKLIYKNAQSLGVSEEGQVLRAGGRPFITSSVYDIVSHLMNKDKRGQNKETTAFKEFVERARQIPLLSRHLFPEGQSGKGIYKNTTLKFNPSLWI

SEQ ID NO: 145455 - protein, 82 aa, Heterodera glycines
  Coding regions on vcDNA: vcDNA=SeqID_71878; Strand=+; Position=1 -193,803-858
MCSYIINRTRTGPGSRRDFAGPGPRPIFFRQTTKTGSPFKTGVPVPRSGVPVTRSGVPVPRSRPDNYHFYIVFVGYFVILII

SEQ ID NO: 145456 - protein, 89 aa, Heterodera glycines
  Coding regions on vcDNA: vcDNA=SeqID_71879; Strand=+; Position=1-270
MTQNERVQNFQSKSYKTFLIKEDRENNFNRECNGKKFSSQSSLIPLVIDGELSLCFYCLDVFESLPITLSIKMFVLCLSSSKMLMSDQY

SEQ ID NO: 145457 - protein, 104 aa, Heterodera glycines
  Coding regions on vcDNA: vcDNA=SeqID_71880; Strand=+; Position=1 -103,288-499
MYFEKYRALATGLFKSSLRFSISSLGVTVCGAGVVVVLLCVPCGALYRPIEFVPIYEGEGEEEEEEHGMTDNAKEMTKEENDGETDGQHQYKGRTRKAQKTKPF

SEQ ID NO: 145458 - protein, 81 aa, Heterodera glycines
  Coding regions on vcDNA: vcDNA=SeqID_71881; Strand=+; Position=1-246
  Homolog annotation: Hit_ID=NP_504502.1; Match level="QueryCoverage =85%, HitCoverage=16%, E-value=3e-15, Identity=55%"; Hit description =aminomethyltransferase (43.9 kD) (5G193) [Caenorhabditis elegans] gb|AAB37080.1| Hypothetical protein F25
MPIANPTDGSSVGFVTSGCPSPTLGKNIGMGYVDKAYAKVGNILTVEAGRDRMIEVEVVKMPFVKSAYYLKPTSVDEDKKK

SEQ ID NO: 145459 - protein, 190 aa, Heterodera glycines
  Coding regions on vcDNA: vcDNA=SeqID_71882; Strand=+; Position=1 -130,1332-1774
MPELEAERKGMLNLTNGTVSAPGTDKQLSLEEAVLRKDRIHRKGFFLLVWACLLCYLLSYLPGASAEQGTVEALHTRWEPEAIGPITFSDINYDYEDYGQTTEEPPTTTPPPPSTTSPPPTEPEPPSATTPNPTVPTPTWCPVAITGLAALVVLLCLCLCCCPSVPQSVANWCRRFVHRFCTCAGEGEKF

SEQ ID NO: 145460 - protein, 116 aa, Heterodera glycines
  Coding regions on vcDNA: vcDNA=SeqID_71883; Strand=+; Position=1-353
FFLLVWACLLCYLLSYLPGASAEQGTVEALHTRWEPEAIGPITFSDINYDYEDYGQTTEEPPTTPHIFEKIQKILKINKNKSYGVSEVPGSGFEIGRNGCYIRDQRPPKPHKTCFY

SEQ ID NO: 145461 - protein, 28 aa, Heterodera glycines
  Coding regions on vcDNA: vcDNA=SeqID_71884; Strand=-; Position=1-95
PTNLLTNSLLIHSVPKCRPLSCAQQPLG

SEQ ID NO: 145462 - protein, 100 aa, Heterodera glycines
  Coding regions on vcDNA: vcDNA=SeqID_71885; Strand=-; Position=1 -122,186-385
  Homolog annotation: Hit_ID=NP_499776.1; Match level="QueryCoverage =78%, HitCoverage=35%, E-value=2e-13, Identity=48%"; Hit description =cell division protein (3O526) [Caenorhabditis elegans] emb|CAB07618.1| Hypothetical protein F45G2.9 [Caen
NVDLLCKADFTRRATQTEIRRRLNGRRVDLLLSDMAPNPTGESYMDHLRIIKLCRDLFMFGTVPDPEPILAPNGILLCKVSIHYSIFKKKFLDFRRRSQK

SEQ ID NO: 145463 - protein, 94 aa, Heterodera glycines
  Coding regions on vcDNA: vcDNA=SeqID_71886; Strand=-; Position=1-283
LFDSGLFLEQSVSGSGSWWNPTPADQVPTNRPGTVRCRHFPKPSHKNAKTNRNAKALTLPLFVKCQSDSRQLSDEELHFAKSHLLMAESVPPFG

SEQ ID NO: 145464 - protein, 16 aa, Heterodera glycines
  Coding regions on vcDNA: vcDNA=SeqID_71887; Strand=+; Position=1-50
MAIVHSPPSSYASAFV

SEQ ID NO: 145465 - protein, 192 aa, Heterodera glycines
  Coding regions on vcDNA: vcDNA=SeqID_71888; Strand=+; Position=1 -57,318-470,600-721,958-1204
  Homolog annotation: Hit_ID=CAG03307.1; Match level="QueryCoverage =82%, HitCoverage=44%, E-value=4e-20, Identity=36%"; Hit description =unnamed protein product [Tetraodon nigroviridis]
MRENKIGIYNNHLNAFVTTDFTKVFASKKSKKELYKIASGEMAPHFLLNVGDNFYDEGVTKEDVAERFEQNFTEVYNYDSLNVPWYTIAGNNDWESKDGIEPQIEHPSGKWTFPAQHYVVNYEFGESPDNRKTARFIMIDTTVLCGNGATVFGKMQKKDTQKYAKMIENAKKHFKWLRKELREAKRRLKYEQ

SEQ ID NO: 145466 - protein, 271 aa, Heterodera glycines
  Coding regions on vcDNA: vcDNA=SeqID_71889; Strand=-; Position=1 -113,170-382,438-763,1170-1333
  Homolog annotation: Hit_ID=XP_394516.1; Match level="QueryCoverage =89%, HitCoverage=33%, E-value=1e-17, Identity=31%"; Hit description =similar to ENSANGP00000021505 [Apis mellifera]
MYGGQTNANGSGVQICVEPLNEWEIQEVGYDGVEKYIKPLAFKDHLRKNAQNIEWSKIIGEKTNADTLTEESDSDDSQLEGSPIGLAQTTKGFIEPIAGPWAMVAKHLHNSLQEVDILMDCMRIARTDYLSPMVTALVQDERTEAEQVAVSKAFQLHTRRRVLNETAREIERMANARRGASSETDKNDFFNELRELRENWRIRKVGPNIFGDLGYKTYDEKTAESFFKVTNRPSTSEEDVKHVHWRKALPWAQNSLICREILARVLRIPFD

SEQ ID NO: 145467 - protein, 40 aa, Heterodera glycines
  Coding regions on vcDNA: vcDNA=SeqID_71890; Strand=-; Position=1 -76,834-880
MKGCRKMEKFSTNFVHFSPRRITRQEKNSELGSVKVLLKF

SEQ ID NO: 145468 - protein, 134 aa, Heterodera glycines
  Coding regions on vcDNA: vcDNA=SeqID_71891; Strand=-; Position=1-405
  Homolog annotation: Hit_ID=XP_308192.1; Match level="QueryCoverage =100%, HitCoverage=34%, E-value=7e-38, Identity=57%"; Hit description= ENSANGP00000021557 [Anopheles gambiae]
MPAPHDKTSLRSFLGALNYYGRFIKEIREIRTPLDQLLRKDENWNGSEERQKAFEKAKIMTSDLLLTHYNPTLPIIVAADASKNGIGATTGHVFPDKSGKVIEHASCVLSNSQQNYSQIEKEAMALVFAVQKFH

SEQ ID NO: 145469 - protein, 158 aa, Heterodera glycines
  Coding regions on vcDNA: vcDNA=SeqID_71892; Strand=-; Position=1 -370,725-828
MNARIIRVPKIACDLSLAKNGVSKNRNYAQKAPQTILALPIPSTIAFIHPIMSAKIIRVPKIACDLSLAKNGVSINRNYAQKAPQTILALPIPSTIAFIHPIMSAKIIRVPKIACDLSLAKKWSLPIPSTIAFIHPIMNAKIIRVPKIACDLSLAKNG

SEQ ID NO: 145470 - protein, 28 aa, Heterodera glycines
  Coding regions on vcDNA: vcDNA=SeqID_71893; Strand=-; Position=1-85
IFFVCVSNIVRLFDRARQEKATVGTKFA

SEQ ID NO: 145471 - protein, 36 aa, Heterodera glycines
  Coding regions on vcDNA: vcDNA=SeqID_71894; Strand=-; Position=1-141
NATKKILDQKIAISFFSFFYRKLGTNSCLLLSGPIK

SEQ ID NO: 145472 - protein, 139 aa, Heterodera glycines
  Coding regions on vcDNA: vcDNA=SeqID_71895; Strand=-; Position=1 -281,435-510,666-728
MNITAAPISEYSTMLVYITSLKLAVIKNYPFSFFRLYPSFSNSNSAIITQNALGPVAFSHRSFDGQSGTKQKAGATDGNVQICPVQMFGIFNRRLAFCPPNFVSHQRFFNENVTDPSPKNTKCICTKTNAMAIMSKTMT

SEQ ID NO: 145473 - protein, 410 aa, Heterodera glycines
  misc_feature (107)..(107): Xaa can be any naturally occurring amino acid
  Coding regions on vcDNA: vcDNA=SeqID_71896; Strand=+; Position=1 -25,411-466,531-601,650-842,941-1025,1084-1202,1282-1418,1569 -1708,1785-1893,1991-2033,2156-2384
  Homolog annotation: Hit_ID=CAE63792.1; Match level="QueryCoverage =94%, HitCoverage=55%, E-value=5e-75, Identity=41%"; Hit description =Hypothetical protein CBG08333 [Caenorhabditis briggsae]
NDQSERAKNSVMCGLSLFYSMLVTIFALVLELSHLMVTLVLELSHLMVTNNSRRNLGFNDMMFGIYMYGCSILMFGIYMYGCSILFLLYCYCALLLNPRWKRKIDYXEKSISIKCINLIYKIYFFAVFSAESSANIVSHDGPSAGSLFLRLGCVVFGVIGTVYYAFNVFLCFNVFLCASDGTCPHYVIVLDIMAIAFVFVQMHFVFCNWKLLAISDYQVICRFGTAHLIATNLWTWIRYILIEESLMGDEIRWAKCHAPSVENAEHLNGANLDISIGGTGLLLGAGLTVKRSVRKCHGAECVLASFNEVMYTSIVSFNEVMYTSIVEYSLIGAAVMFIVWKNIGQRQKKSDYVYVSRKHRIRMDCSKNNQGLFFGLAFLTTTFTSISIFSYTINTFTIIHLHFKPFHNPS

SEQ ID NO: 145474 - protein, 92 aa, Heterodera glycines
  Coding regions on vcDNA: vcDNA=SeqID_71897; Strand=-; Position=1-304
MIGRAVRNIPFIFEGIFKFILYPRKMAISFFEKFYTSQKRLRMRRRAVHNRHFISQRIFIFRGYPRKMAISFFDKFYTHTNALEHDREGGAQ

SEQ ID NO: 145475 - protein, 60 aa, Heterodera glycines
  Coding regions on vcDNA: vcDNA=SeqID_71898; Strand=+; Position=1 -48,94-228
MNETQIKEKEEMVIMQMCSDQNPCWPMIGYGIFLLILTIGGILSNFSVIFITIRTKFKNF

SEQ ID NO: 145476 - protein, 39 aa, Heterodera glycines
  Coding regions on vcDNA: vcDNA=SeqID_71899; Strand=-; Position=1 -44,128-203
MAVQSCELQYPSVQHGKKHNKQSFNANEKHYKEGSADAC

SEQ ID NO: 145477 - protein, 17 aa, Heterodera glycines
  Coding regions on vcDNA: vcDNA=SeqID_71900; Strand=+; Position=1-53
LKPSIACRFSAQQSTNR

SEQ ID NO: 145478 - protein, 49 aa, Heterodera glycines
  Coding regions on vcDNA: vcDNA=SeqID_71901; Strand=+; Position=1 -90,364-423
DLHIKFGPFLDEKAAEFDSDTLNRYKEQQRSKNFPAMFWDAPEMFNCFP

SEQ ID NO: 145479 - protein, 34 aa, Heterodera glycines
  Coding regions on vcDNA: vcDNA=SeqID_71902; Strand=-; Position=1-104
MEAVHNETPSGMPTHKRTIKVNKILFDYCLTNKS

SEQ ID NO: 145480 - protein, 81 aa, Heterodera glycines
  Coding regions on vcDNA: vcDNA=SeqID_71903; Strand=-; Position=1 -169,654-730
MPLSANSTKLAVVSIGILALLSILSAEAQAMQTADVEGIDEQKLLFLACIQGKLESALFLLTRGFWKRVYSSQKAKVKRKD

SEQ ID NO: 145481 - protein, 470 aa, Heterodera glycines
  Coding regions on vcDNA: vcDNA=SeqID_71904; Strand=-; Position=1-1419
  Homolog annotation: Hit_ID=NP_508294.1; Match level="QueryCoverage =92%, HitCoverage=37%, E-value=6e-63, Identity=36%"; Hit description =predicted CDS, endonuclease/exonuclease/phosphatase family and RNA -directed DNA polymerase (XC178) [Caeno
NKLENSNNTSIDSIPNIFLKNCKENLVYPLFHIFCFSMMTGQVPNIWKKSIICPVPKIPNPINPIDFRPISLLCSISKILEENITQKITNFVETNDVLPNCQHGFRRKHSVTTQLLEVIDDFSLALENKKSIDVIYFDLAKAFDTVPHERLVSKLKNIGINGTLLKWLQNYLQNRTFFVRVGSAFSDEFPCLSGVPQGSNLGPLLFLIYISDLPNFCKTENVEIKLFADDLKAYSILSKNTISPLHSFINKFRNYCELNGLKIAPNKCLVSHIGPKNPNECYFINNIPILKSEKGEPVRDLGIYFSNDLKWEKHIEFITKKAIRTSFALLKSLKTKNPKILINIFNIYCRSILEFGSPVFNPYMKKDIDALENVQKTFLRIVFRRNNNKDDIPGYNELLQLFKQESLLKRRTKIDLKLFHDIILGKIHIQHNDSFSIYSGLKNDYIIKTGSTNVRFHSFFIRTSRLYRSL

SEQ ID NO: 145482 - protein, 174 aa, Heterodera glycines
  Coding regions on vcDNA: vcDNA=SeqID_71905; Strand=-; Position=1-525
MAEQFNAIAERLNEIERKINSNNNDNSSAEEKERKRSLVLIGLPEAVAAKPSERAKEHAETVAEVLDALDVEVCPQMVYRMGRRIDEKRKGPRLVKVVLPATTFQRFALAQWGRNRTELKQHVGWQRLLVRPSLTKEELAAEREIREQRRMNYEESKKNEMVTTRRGGNMGKNF

SEQ ID NO: 145483 - protein, 60 aa, Heterodera glycines
  Coding regions on vcDNA: vcDNA=SeqID_71906; Strand=-; Position=1 -35,137-284
MGRLRFFDWIRRGVFFPKLRVKYPKPKHKVRRSKLGVVFEAEGEAHFFEARVLGVGVKKC

SEQ ID NO: 145484 - protein, 21 aa, Heterodera glycines
  Coding regions on vcDNA: vcDNA=SeqID_71907; Strand=+; Position=1-65
GLGEARLSTRSRSRRRSPIFI

SEQ ID NO: 145485 - protein, 35 aa, Heterodera glycines
  Coding regions on vcDNA: vcDNA=SeqID_71908; Strand=+; Position=1 -93,141-155
MRKCQKLEIKKHREGVNGVDQAKLDNERDAKLNQL

SEQ ID NO: 145486 - protein, 35 aa, Heterodera glycines
  Coding regions on vcDNA: vcDNA=SeqID_71909; Strand=-; Position=1 -78,130-159
MMGIPSRNPDQSRRFWKNNREGSRVRNSVVLSEFA

SEQ ID NO: 145487 - protein, 103 aa, Heterodera glycines
  Coding regions on vcDNA: vcDNA=SeqID_71910; Strand=-; Position=1 -190,332-453
MFDFVPKLLAAGLGILLLFISSTSAGGPFDGGSFGISPFGTSAFGAAPPLFPPPPAPFFRNYGPFALHKLFVYIYPYPIYSASGYGGYGGSFGGFGGSGYGKK

SEQ ID NO: 145488 - protein, 27 aa, Heterodera glycines
  Coding regions on vcDNA: vcDNA=SeqID_71911; Strand=-; Position=1 -70,649-662
MRHHRWTSTTARCCCTIHGRRHKSKCI

SEQ ID NO: 145489 - protein, 219 aa, Heterodera glycines
  Coding regions on vcDNA: vcDNA=SeqID_71912; Strand=+; Position=1 -305,414-768
  Homolog annotation: Hit_ID=XP_307604.1; Match level="QueryCoverage =33%, HitCoverage=21%, E-value=4e-09, Identity=39%"; Hit description =ENSANGP00000015459 [Anopheles gambiae]
MEDLSDLLPESSVWSVIYTPRNQIERIKRVKIPLIQLKKFDGSVESWIPFWETFRVHVHEDNSVTKIEKHNLLESNLEGEAKDLIEGIPISEDGYQFAIDLLLLSSLNQNIDLSPHYLFLEGKLSPLVLDKYFVIKDAEDNQNWDTTKFRNALSRAIEQIKNRQEVKQKCGKERDLNYNRNDSEVTMNFAVKFREEWEKLLNEQKTKKLEKTKEITEGV

SEQ ID NO: 145490 - protein, 45 aa, Heterodera glycines
  misc_feature (21)..(21): Xaa can be any naturally occurring amino acid
  Coding regions on vcDNA: vcDNA=SeqID_71913; Strand=-; Position=1-135
FAPHNCLSTPTGHLKKSIFLXSGQSPRTDAPRFMGRPNSSGIASL

SEQ ID NO: 145491 - protein, 36 aa, Heterodera glycines
  Coding regions on vcDNA: vcDNA=SeqID_71914; Strand=-; Position=1-120
NFLKYKPKLFGLFKKELNIFKIFIHLPFDRKSIREP

SEQ ID NO: 145492 - protein, 49 aa, Heterodera glycines; identical to SEQ ID NO: 137875
  Coding regions on vcDNA: vcDNA=SeqID_71915; Strand=-; Position=1-436

SEQ ID NO: 145493 - protein, 81 aa, Heterodera glycines
  Coding regions on vcDNA: vcDNA=SeqID_71916; Strand=-; Position=1 -24,85-303
  Homolog annotation: Hit_ID=AAH75558.1; Match level="QueryCoverage =88%, HitCoverage=26%, E-value=1e-18, Identity=67%"; Hit description =Splicing factor, arginine/serine-rich 1 (splicing factor 2, alternate splicing factor) [Xenopus tropicalis
MGNQHRFQPRGNGPYGGGGGGGGDRGDRGGGGGGGGRGGGGGRYGRSPPRDRPRGRFPYRLAVSGLPISGSWQDLKDHMRD

SEQ ID NO: 145494 - protein, 39 aa, Heterodera glycines
  Coding regions on vcDNA: vcDNA=SeqID_71917; Strand=-; Position=1-119
CDHIVKSPMKSLFLRVEIADPVLPESSVVTTMFSYVGEN

SEQ ID NO: 145495 - protein, 72 aa, Heterodera glycines
  Coding regions on vcDNA: vcDNA=SeqID_71918; Strand=-; Position=1-279
LFFFNYFFHFITQRSRLIRSSPNFAGKLLRTLQMLINFLRIFCLEEHSSSHLPHQHYFFLIIFFILSPNVLD

SEQ ID NO: 145496 - protein, 87 aa, Heterodera glycines; identical to SEQ ID NO: 142763
  Coding regions on vcDNA: vcDNA=SeqID_71919; Strand=-; Position=1-323

SEQ ID NO: 145497 - protein, 224 aa, Heterodera glycines
  Coding regions on vcDNA: vcDNA=SeqID_71920; Strand=+; Position=1 -49,528-1153
  Homolog annotation: Hit_ID=EAL49109.1; Match level="QueryCoverage =89%, HitCoverage=29%, E-value=2e-09, Identity=25%"; Hit description =lysozyme, putative [Entamoeba histolytica HM-1:IMSS]
MPKIKSKFEWMGEWVNKNGLKRVNKKFKKNEKIVLIEKFEKMKKEQLIKKRNINKKANQIEKEIAKKLDVSLTSIYTWKRQFEEENKNEWTKMKKLIKVFEEVKHRFILEKGKMTRKVMKIVEQKIANKIGTDRQQIFKWKRKFKVKNEARKDDKSAIIAEFEAMKKEYLRKHGNLNKKAKEIEEEIVKELGTSRTTIRRWKAQMASQKKNHNKGRQGEIIEKY

SEQ ID NO: 145498 - protein, 91 aa, Heterodera glycines
  Coding regions on vcDNA: vcDNA=SeqID_71921; Strand=+; Position=1 -231,1221-1265
MPSRSTTSISVGIGIFFALFCSIFFAIVTVAGVIVGISAAVVTVAGVIVGIFFAVVTVAGVIVGTFFADVTVVVVIVDNKKHLRLSRSTKV

SEQ ID NO: 145499 - protein, 66 aa, Heterodera glycines
  Coding regions on vcDNA: vcDNA=SeqID_71922; Strand=-; Position=1-201
MEASFWHKILKKHSITLKNLPKFAFAVEMFVHKCIETGRKQCQIRGRAEDGQIRGECPSKHPCKRN

SEQ ID NO: 145500 - protein, 127 aa, Heterodera glycines
  Coding regions on vcDNA: vcDNA=SeqID_71923; Strand=-; Position=1 -294,1014-1100
MADINIPRWGELEQWKNNVHRIHGGVKEQHLRHTPQPPSPRTTTGIAMEQQSTTTTKRSPNGGAGANGDDGDGGNDCHAAENGSEEKKPTMTTTTVAAKTPIGTVLNAFRRKIKDEKLARRCKALIR

SEQ ID NO: 145501 - protein, 74 aa, Heterodera glycines
  Coding regions on vcDNA: vcDNA=SeqID_71924; Strand=-; Position=1-225
MANSSRIVWSVNLFTFKDAFCSGNFGVITVITLWPINGGQRDTIALIVIGVNNSKQNRSIDPIHEIFIPSRFWI

SEQ ID NO: 145502 - protein, 276 aa, Heterodera glycines
  Coding regions on vcDNA: vcDNA=SeqID_71925; Strand=+; Position=1 -26,68-122,165-283,343-413,460-658,701-855
  Homolog annotation: Hit_ID=NP_740966.1; Match level="QueryCoverage =99%, HitCoverage=31%, E-value=2e-37, Identity=37%"; Hit description =DEAD/DEAH box helicase and helicase, C-terminal (72.0 kD) (2A705) [Caenorhabditis elegans] gb|AAB71200.2|
ESGIAVGIDHSVSNVIHSVSNVINFDFPLSTDMYVHRVGRTARGFNKGTYVHRVGRTARGFNKGTAISFASQEELNLFEVVRTEINERMGQAVIQPYEVRMKDFEGQAVIQPYEVRMKDFESFQLRARDVIAACTKTVIRETRMAEDVIAACTKTVIRETRMAEIRAELLKSKRLDAYFEKNPREKRALEQDRKQFKLNVHSAGIADVPDYIVPKALRGQDFNSEQKRTKPKALRGQDFNSEQKRTKSERNNRKRKRPLKRKHAKMLSDPLQSFKF

SEQ ID NO: 145503 - protein, 34 aa, Heterodera glycines; identical to SEQ ID NO: 140281
  Coding regions on vcDNA: vcDNA=SeqID_71926; Strand=+; Position=1-106

SEQ ID NO: 145504 - protein, 29 aa, Heterodera glycines
  Coding regions on vcDNA: vcDNA=SeqID_71927; Strand=+; Position=1-100
WLTITSSNLALSILIQIAPNFFYSLTRPY

SEQ ID NO: 145505 - protein, 155 aa, Heterodera glycines
  Coding regions on vcDNA: vcDNA=SeqID_71928; Strand=+; Position=1 -99,207-400,845-1016
MWLELQVTQLEMEAQKIRGIYDATRLEAHRAIEAANAFTQIAHGLLQARNNTRTAQQLMKETQGHLRGVAEAATNAKSASKSMGATIDTAAMEVSAARAQGDTLDVRLANIQPRLSQAKADLAKVSRTNGELNAREDTVAEIDKIMDKAENAYQK

SEQ ID NO: 145506 - protein, 74 aa, Heterodera glycines
  Coding regions on vcDNA: vcDNA=SeqID_71929; Strand=+; Position=1 -108,905-1021
MRISTACKIAGQIMMKIKNFSGFASEKGGGEQFSKAELMDTRNGLYNKKNTVTLGIQFTVEGEDGGEQQAMEAD

SEQ ID NO: 145507 - protein, 43 aa, Heterodera glycines
  Coding regions on vcDNA: vcDNA=SeqID_71930; Strand=+; Position=1-136
LFENFLKRGDPFVLQNFFVIKNHDNLLSGVLKVANHESDMYFD

SEQ ID NO: 145508 - protein, 89 aa, Heterodera glycines
  Coding regions on vcDNA: vcDNA=SeqID_71931; Strand=-; Position=1 -216,564-617
MQGNCNDMFVLNDCAEADGKCGNGTMDKFCEKPLKWNCKECNGTKCNNISKLSTASTAKPMIKPITVKNDENRIFVLNALSESKIRDEN

SEQ ID NO: 145509 - protein, 91 aa, Heterodera glycines
  Coding regions on vcDNA: vcDNA=SeqID_71932; Strand=-; Position=1 -91,614-798
MTDILKQWDIGEAQEAHRCVGSCQTYRCSDTTKCYGTLLPSNDYKVPKEFKELFTNYKKRSTINCKGEKCQTFTCQDGENWANKKRANNWE

SEQ ID NO: 145510 - protein, 72 aa, Heterodera glycines
  Coding regions on vcDNA: vcDNA=SeqID_71933; Strand=-; Position=1-318
LSLFSHFFTANLVPTVAFSCLALSNNLTIFETQTKKILDQKIAISFLSFFYRKLGTNSCLLLSGPIKQSYDI

SEQ ID NO: 145511 - protein, 77 aa, Heterodera glycines
  Coding regions on vcDNA: vcDNA=SeqID_71934; Strand=-; Position=1-289
PKNGYLFFLIFLPQTWYQQLPSLVWPYQTILRYLKRKQKKILDQKNSYLFFSHFFTANLVPTVAFSCLALSNNLTNI

SEQ ID NO: 145512 - protein, 170 aa, Heterodera glycines
  Coding regions on vcDNA: vcDNA=SeqID_71935; Strand=-; Position=1-513
  Homolog annotation: Hit_ID=AAH46263.1; Match level="QueryCoverage =94%, HitCoverage=41%, E-value=3e-19, Identity=39%"; Hit description =LOC398566 protein [Xenopus laevis]
MRRSTPNLFSVPDYQQPSAFRPPPPAAAAVANLLQSQQPPQQSPSSVAANASATVAAVALSNALSSVQQLLQHQQQQHQQQQQQQRLAAMAVAAAGAATANGLFRQHSFGGIGFTEQQQQQQQQQQQQQQQQQQQQQLVQLQQIAAVPQQQQQQQQQQQVAHNQQQNSPK

SEQ ID NO: 145513 - protein, 30 aa, Heterodera glycines
  Coding regions on vcDNA: vcDNA=SeqID_71936; Strand=-; Position=1 -58,119-153
MRFNGNFKTSQMVFTNSDQHIDIREMKLTD

SEQ ID NO: 145514 - protein, 140 aa, Heterodera glycines
  Coding regions on vcDNA: vcDNA=SeqID_71937; Strand=+; Position=1 -373,1012-1061
MQTFPGCPRRFAQESAAGCGGKHNSEQYNKTNYPASAQQPATGGAEPVEDVPLPTPAVVPTDRRRQHVHGPGGWANLTARPFGTCHWQPQQLFGAIARRQPDGGCAVGERRVQLPAASPGPDGPGKFGAIPSDCQGAQLT

SEQ ID NO: 145515 - protein, 91 aa, Heterodera glycines
  Coding regions on vcDNA: vcDNA=SeqID_71938; Strand=-; Position=1-276
MNAQVGNSQTHLNFCFMFIKTDLAHVELAAHGLEKVVPYPLRAGMHHPITGGIDLTIITNFATQCRIGPFQHCLMTTIVQQFLNLKHFAKT

SEQ ID NO: 145516 - protein, 73 aa, Heterodera glycines
  Coding regions on vcDNA: vcDNA=SeqID_71939; Strand=+; Position=1-223
GFRRTSPTEAALLWPGQHTDGGPSAQKKPEGQPIESDRSPHNTGFLPPRGNSPLGHGPMQTFCCCCCCCWAGT

SEQ ID NO: 145517 - protein, 102 aa, Heterodera glycines
  Coding regions on vcDNA: vcDNA=SeqID_71940; Strand=-; Position=1-309
MTEKYKQKREYSKNEWKQNYAEICKKIGVSKTTIIKWKKQFGISKKRITEEEKKEKMKIYSQIKRENTKMSDNEIAKTLKIHQNTIIRWKKQFVEENFGGLN

SEQ ID NO: 145518 - protein, 137 aa, Heterodera glycines
  misc_feature (17)..(17): Xaa can be any naturally occurring amino acid
  Coding regions on vcDNA: vcDNA=SeqID_71941; Strand=-; Position=1-1167
QYNVQQQTGECRPDTPXSVRFHLIGFTSSLLSLQVLCTFPHGTCSLSDSWPYLVLDEVYHLIWAAIPNNPTPRHVKMGRHRQLDRSCTFSGAPVKGNLNKRANPSSRSIRYTSQPQRSCDSALDSSQFTRRYYGNPR

SEQ ID NO: 145519 - protein, 116 aa, Heterodera glycines
  Coding regions on vcDNA: vcDNA=SeqID_71942; Strand=+; Position=1-351
MTCAYAKLLGPCFKTGRTDDRLLHRERTSESPSWTELVAGTCRTRPPPTPSSSQHGPETIAQFTQSKQHSPDPGTRPQKAGLKTELTQLLRASQRTPPANAPFATEQKDSKPQSGG

SEQ ID NO: 145520 - protein, 209 aa, Heterodera glycines
  Coding regions on vcDNA: vcDNA=SeqID_71943; Strand=+; Position=1 -121,184-394,679-976
  Homolog annotation: Hit_ID=NP_499163.1; Match level="QueryCoverage =77%, HitCoverage=42%, E-value=2e-46, Identity=55%"; Hit description =ubiquitin-specific protease, possibly N-myristoylated (3K867) [Caenorhabditis elegans] emb|CAB54287.1| Hy
MQRDNLLTCLADLFSNISSQKRRVGTIAPKRFVTKLKRENELFDNFMQQDAHEFFNYLLNAISEVLMEEKKKEQLGGSLRKANSAMAPNKRSFSANAKGQPNDLSAKQLTSTSDITGQQELTWIQEVFQGTLTNETKCLNCETISSKDEDFLDLSVDIEQVLAIRCAIVKPNWLFFRMFPLAIVFAIFPTWKHCRVTRNICAKHAAVSM

SEQ ID NO: 145521 - protein, 219 aa, Heterodera glycines
  Coding regions on vcDNA: vcDNA=SeqID_71944; Strand=-; Position=1 -166,339-431,478-588,638-862
  Homolog annotation: Hit_ID=XP_518230.1; Match level="QueryCoverage =96%, HitCoverage=30%, E-value=3e-45, Identity=47%"; Hit description =PREDICTED: similar to solute carrier family 35, member B3; CGI-19 protein; chromosome 6 open reading fram
MSLGLVFFSLADSKVLNFDRIMISLALVADAIIGNVQEKAMREYNASNDENVLFSYSIGFAYILVGLCLSGQIGEAFLFFAQRPLQTYGYSVLIGIVGYFGVRPLQTYGYSVLIGIVGYFGVNVVLTMVRTSGALVTVTVTTMRKAVTTMRKAVTIVFSFYFFAKPFTLGYLWGGLVVLLAIYLNVYTKNKKQLKLAEWWSNLAESYNGQKFAAERKLL

SEQ ID NO: 145522 - protein, 117 aa, Heterodera glycines
  Coding regions on vcDNA: vcDNA=SeqID_71945; Strand=-; Position=1 -316,488-525
MRDCAKAKAETIAILRIIAHFKNGKNETWRFVCPLIDYLKYLTDRTFNAKEKWPANWQCYGAEMAKTVREQRKMLKNKHFELIDTLLNDGTEENAEFLIIVREQRVTNLHGQKSLIR

SEQ ID NO: 145523 - protein, 127 aa, Heterodera glycines
  Coding regions on vcDNA: vcDNA=SeqID_71946; Strand=-; Position=1 -153,216-354,666-756
  Homolog annotation: Hit_ID=CAF92878.1; Match level="QueryCoverage =93%, HitCoverage=25%, E-value=1e-14, Identity=36%"; Hit description =unnamed protein product [Tetraodon nigroviridis]
EFSRRCLDYIDQNAETLFESEEFLQIDQNLLCEIFGRDQLKIADELIIWNAALRWADEKCRQNAVECSAENGRSALGPALFKIRFPLISTEFFTKSIVPSGVLTTDEFLSVYQFHCSPNLRDVPGLK

SEQ ID NO: 145524 - protein, 102 aa, Heterodera glycines
  Coding regions on vcDNA: vcDNA=SeqID_71947; Strand=-; Position=1 -84,159-252,307-435
  Homolog annotation: Hit_ID=CAE62132.1; Match level="QueryCoverage =90%, HitCoverage=15%, E-value=9e-09, Identity=35%"; Hit description =Hypothetical protein CBG06176 [Caenorhabditis briggsae]
MASSKSGILADRMKHLLGTAKLADAYFLLLSAHKLILVSASDVFEAMFRFDSKNGKPEKASVDNPVEVPDVEPTAFKVMLSFIYADDLSELNGDNAMAVLCA

SEQ ID NO: 145525 - protein, 21 aa, Heterodera glycines
  Coding regions on vcDNA: vcDNA=SeqID_71948; Strand=-; Position=1-62
LYICYIGFEFRFKKQNLPAEG

SEQ ID NO: 145526 - protein, 95 aa, Heterodera glycines
  Coding regions on vcDNA: vcDNA=SeqID_71949; Strand=-; Position=1 -475,639-986
MFEYPKRTLEKIDFFVFGAVPPNRCAHIYGETESFGSSFPIACTLILRWIFAPHNCLSTPNGHLKKSIFLFSGQSPRTDAPRFMGRPNPSGVASL

SEQ ID NO: 145527 - protein, 103 aa, Heterodera glycines
  Coding regions on vcDNA: vcDNA=SeqID_71950; Strand=-; Position=1 -93,418-636
MDSLCGSSDDTPLPQTKKSKIIRKKLSATFKADSNRDSVQEVLDALDVVQTRDSHFSGIEYKVINSLKNNRTIAHRPPYHAREHLYVYKIYQKKRYPFFWDTL

SEQ ID NO: 145528 - protein, 161 aa, Heterodera glycines
  Coding regions on vcDNA: vcDNA=SeqID_71951; Strand=-; Position=1-484
MEQEENSEKSTTPTTESDITLSDRMQRKSDTSSSTNICCDETAEAFFDAILPHDKLQQPQQQPLQRTYTTTSTTTTAKRQLTEDERQLLADVIVSSMFGTSSNQTNGEDAATNSAAADHAGGSNSTIRQAEIDEQQHYAASTTSSSYACTVSSTSKQADGP

SEQ ID NO: 145529 - protein, 160 aa, Heterodera glycines
  Coding regions on vcDNA: vcDNA=SeqID_71952; Strand=+; Position=1 -164,482-577,654-732,1048-1156,1283-1316
YLRRISEGADPTLVDIESLDEESGDGEERDEDGPMVGQTVAASCEAFANSRMNCEKEQLMRAICEHRGAVEACWAHNPEVDGSKPSGRRAKPKRQFITPKVRQAAPKGVILNGQSFPVTPPFNICRAIRHIKLKHPEVMPEHRGGQSARDGFQCQEKQQN

SEQ ID NO: 145530 - protein, 77 aa, Heterodera glycines
  Coding regions on vcDNA: vcDNA=SeqID_71953; Strand=+; Position=1 -47,111-265,491-522
MEWTSPGSTSVKRTKNITVLPSNMYVKQLSNATEDVNKRIAYGIGVGKERGFIHNGDFVVIVTGWQAESRITEGRVQ

SEQ ID NO: 145531 - protein, 98 aa, Heterodera glycines
  Coding regions on vcDNA: vcDNA=SeqID_71954; Strand=-; Position=1-563
IGMSILFFASLPTLIAMVMTMVIFVKIFIKEIFDPSFVDSIFSHTIFHFYIYKPIFFFAFFFVCLSETINFCFEIPSSYIKIYQILSTLDPYKLWPTC

SEQ ID NO: 145532 - protein, 185 aa, Heterodera glycines
  Coding regions on vcDNA: vcDNA=SeqID_71955; Strand=+; Position=1 -33,88-612
MLSQEETEDRLERTSVCGIEGSDGLSGRFAEMSVTLRTSEGSAQLGRRRAGLARRRRRRRHNRRSLVKELCLFNKCRPEYLAMMLRRRKKENIKFIGDRKIETVHLRQNLQIYPESFTLFGANRMYAYRGMLGVTVEQHLYAKHRVRLKFPNLPCVVQDGGNGHQSYFPLELLKISSLAMQDETA

SEQ ID NO: 145533 - protein, 30 aa, Heterodera glycines
  Coding regions on vcDNA: vcDNA=SeqID_71956; Strand=+; Position=1-177
TQILKIIDFYLGFFINYLIFFQNFKKISRA

SEQ ID NO: 145534 - protein, 117 aa, Heterodera glycines
  Coding regions on vcDNA: vcDNA=SeqID_71957; Strand=+; Position=1 -103,143-262,751-881
  Homolog annotation: Hit_ID=CAE64797.1; Match level="QueryCoverage =63%, HitCoverage=15%, E-value=1e-19, Identity=59%"; Hit description =Hypothetical protein CBG09590 [Caenorhabditis briggsae]
MTDAQRFQTIVQVHAFDPFRNTEAALENANNIAEGIIHVDLLNFLEANLPKKKKKVLLGVGDQRLSASLVEALPELIKIVPELYKYVCCATAIMNREKMDEAGKRKSKVLPRKFDKV

SEQ ID NO: 145535 - protein, 91 aa, Heterodera glycines
  Coding regions on vcDNA: vcDNA=SeqID_71958; Strand=+; Position=1 -173,413-514
  Homolog annotation: Hit_ID=Q9D6Z1; Match level="QueryCoverage=100%, HitCoverage=16%, E-value=8e-32, Identity=72%"; Hit description =Nucleolar protein Nop56 (Nucleolar protein 5A)
NTPKYGLLFHSTFIGRAQAKHKGRISRFLANKCSLASRIDCFSDVPVPSFGEALRQQVEERLVYYEKGVIPKKNLDVMHGAVEEATVEVEK

SEQ ID NO: 145536 - protein, 63 aa, Heterodera glycines
  Coding regions on vcDNA: vcDNA=SeqID_71959; Strand=+; Position=1 -69,303-425
MPKSDERILGPSGKFEQFILVMHRMRKAKESGKKGQRKRKQTEKRKTNNNQRMDKPIALLLNN

SEQ ID NO: 145537 - protein, 100 aa, Heterodera glycines
  Coding regions on vcDNA: vcDNA=SeqID_71960; Strand=-; Position=1 -99,163-368,505-557
GYRKNRQIGLYRRVNWDKCRLSILSAFCCAILHLNFRLKREVIEFRFGESRKCETRTIFIFCSKTISSFYGVILFGSRGKRLAKRTLGNPRKSIVTRSKP

SEQ ID NO: 145538 - protein, 24 aa, Heterodera glycines
  Coding regions on vcDNA: vcDNA=SeqID_71961; Strand=+; Position=1-80
RTLSTAVSQRSSKIIPCHRYYGQD

SEQ ID NO: 145539 - protein, 187 aa, Heterodera glycines
  misc_feature (1)..(1): Xaa can be any naturally occurring amino acid
  misc_feature (186)..(186): Xaa can be any naturally occurring amino acid
  Coding regions on vcDNA: vcDNA=SeqID_71962; Strand=-; Position=1 -97,151-287,630-747,793-912
  Homolog annotation: Hit_ID=CAG01849.1; Match level="QueryCoverage =90%, HitCoverage=26%, E-value=8e-48, Identity=56%"; Hit description =unnamed protein product [Tetraodon nigroviridis]
XCNVSFHIGVLSPPSHFIGLDLEMAFNFHYHEVLQTIAEMFIDLVLQTIAEMFIDLFKYLQGNYIAEIEAVRRQYPAEPFLFTQSPLVLQYPEAVAMLKKAGVEQGDEEDLSTPNEKLLGRLVREKYQTDFYVLDKYPLAVRPFYTMDFYVLDKYPLAVRPFYTMPDPNDTKYSNSYDMFMRGIAXL

SEQ ID NO: 145540 - protein, 206 aa, Heterodera glycines
  Coding regions on vcDNA: vcDNA=SeqID_71963; Strand=+; Position=1 -472,632-779
MTSQKPAEDDPIGAEETVTTAADCVNELLETTEIQAEVDELVKSVVEFVSEAASAAADDVDHQQQRNAADESAKSRFGISSHEIAIPCKEFDRLLRKIGLKSGAKRQCPGKRMCPPRKVKASASDGVSAKIPKLSENGTAGGKQKKKKMQNIVEFDQVMASLLGNFEDDPIFLKCKEVQGMTKDLAQLTFQINQFLCHFITFIPVE

SEQ ID NO: 145541 - protein, 43 aa, Heterodera glycines
  Coding regions on vcDNA: vcDNA=SeqID_71964; Strand=-; Position=1-505
CFAVPRTGRQWIALNLQEIRLAISGCKKLLGKELFFEVSQTPY

SEQ ID NO: 145542 - protein, 158 aa, Heterodera glycines
  Coding regions on vcDNA: vcDNA=SeqID_71965; Strand=+; Position=1 -113,620-983
MARLSHNLSIALLQSGRTQLSKRNNNDGPSQRTIKHTKALIKEVPEAIFCRSFLLSNGSLKIASSILNAKKAVSASSDDDPSFISEFVLCGEAPRLWAKVKQLEGQKRFLEAAQLLDGVEVENLRLIHQFLANQMTDSLRLLLDQARLYRIAGNTKRR

SEQ ID NO: 145543 - protein, 30 aa, Heterodera glycines; identical to SEQ ID NO: 126607
  Coding regions on vcDNA: vcDNA=SeqID_71966; Strand=-; Position=1-92

SEQ ID NO: 145544 - protein, 21 aa, Heterodera glycines
  Coding regions on vcDNA: vcDNA=SeqID_71967; Strand=-; Position=1 -54,195-206
MVVSAKNLAPGLKNLGKLKML

SEQ ID NO: 145545 - protein, 39 aa, Heterodera glycines
  Coding regions on vcDNA: vcDNA=SeqID_71968; Strand=+; Position=1 -45,100-174
MAPPPPPPKSKSSIEEDQTQQHELAASPEWAQNDVPTIK

SEQ ID NO: 145546 - protein, 90 aa, Heterodera glycines
  Coding regions on vcDNA: vcDNA=SeqID_71969; Strand=-; Position=1-305
GGRCAIDLLFLREFLNLYSIPEKWLSLFLINFIHIQMRLSMIRRAVHNRHFISQRIFIFRGYPRKMAISFFDKFYTHTNALEHDREGGAQ

SEQ ID NO: 145547 - protein, 69 aa, Heterodera glycines
  Coding regions on vcDNA: vcDNA=SeqID_71970; Strand=+; Position=1 -57,178-330
MSSDVKPIFVHIFTLNKQKPGFCGVLAFHRNCGINPAGSPPTKIMSYNPSTGSELLDRGRTCYDLSEIF

SEQ ID NO: 145548 - protein, 139 aa, Heterodera glycines
  Coding regions on vcDNA: vcDNA=SeqID_71971; Strand=-; Position=1 -57,143-431,503-576
MRDVEGLPDIWTVMSFDSKVFTENQLKYFMLIISLLTVLMKKTLKIISSVKNAKFFNFHIVPLAKTHYTKEKKMEIIRTFNKEKEKQPNLTNAQLAKRLKVNYNYIYKWKQQFKKESKHALSLTDSPFDDNFLGLESHN

SEQ ID NO: 145549 - protein, 128 aa, Heterodera glycines
  Coding regions on vcDNA: vcDNA=SeqID_71972; Strand=+; Position=1-387
MKIYKWIKEFGLQKQTQKSYKSKTDEEKIEIVQKFIEMSNEFKRKRKYSRKEWKQNYAEICKKIGVSHGTINKWKKQFGIRCKRITENGKMEKIKIYWQIKKANQKMSDETIAKTMEINRNIFLKWKK

SEQ ID NO: 145550 - protein, 70 aa, Heterodera glycines
  Coding regions on vcDNA: vcDNA=SeqID_71973; Strand=+; Position=1 -63,1206-1355
MKKKQIDQFLEEIYDKCGEEKSSWVLNTRKKEEELNLKMESEINISPNNVSDFDPVHFTPEENTWSNASI

SEQ ID NO: 145551 - protein, 384 aa, Heterodera glycines
  Coding regions on vcDNA: vcDNA=SeqID_71974; Strand=+; Position=1 -220,337-773,987-1484
MDTFETKEKFIEVEEEIGKVSNHMERYETFTKVRFGKIVGKLKEEVRKITENLDVLKGRVHLLEFEQDNPERLAPFLGGITPLEGYDGNPSVSFSRWVARFEDMLTLYPQYSEVQKLSRLRILLSGQARADFDSSEPSPVSLSDVLNHLKRKFENENTRSIARQAMASCRKAPGERVYEFANRLNEVVRTALSGENEETIRKRLLEEFLEKLTPELQFERQEKGRRKERTWWSKGPTVYGERKWNYERNEREHRHRHFSPHDRPTMEEMRGNTDNGTSHPHNRPSHGRNNHRSPIAYEGMEYENERTQSPGRRVQFGGHRIGAARIASPIFLALMVILSLLGANFATNSVESPMICHPDSPATLWSIPIDPVCPSWTQRNCLWQ

SEQ ID NO: 145552 - protein, 279 aa, Heterodera glycines
  Coding regions on vcDNA: vcDNA=SeqID_71975; Strand=+; Position=1 -68,637-1340,1771-1838
  Homolog annotation: Hit_ID=AAO27306.1; Match level="QueryCoverage =98%, HitCoverage=21%, E-value=3e-47, Identity=35%"; Hit description =TyB3p [Saccharomyces paradoxus]
ILKIHRHPVEINCVPLTERWLSKTKPYPAPEKYERKLKSQIGKMLEAGVITESFTPCAHNVVLVKKSNGQLRPCVDFQPLNKITIPDPYPIPRMDKTILRVAGQPFYSTLDLASGFWQIPLDSESSYKCGIVTPWRLYQMVKLPFGLRNAPSIFQRTMDKALEGIRNVTVYIDDIMVHTNTEEEHLETLEKVFCRLNEFGLKLKREKCELLKNECTYLGHILNGKGYRPSLNNQEVIEGFPEPKNAREVKRFLALFNHDLQKIRRCAHRRTPPFPTICA

SEQ ID NO: 145553 - protein, 52 aa, Heterodera glycines
  Coding regions on vcDNA: vcDNA=SeqID_71976; Strand=+; Position=1 -66,124-216
MPISFCEKFSMQHTLSNMKRSAKNGYLFFGEMFYAPIALVQEAKCGATCPFY

SEQ ID NO: 145554 - protein, 78 aa, Heterodera glycines; identical to SEQ ID NO: 128403
  Coding regions on vcDNA: vcDNA=SeqID_71977; Strand=-; Position=1 -86,158-308

SEQ ID NO: 145555 - protein, 146 aa, Heterodera glycines
  Coding regions on vcDNA: vcDNA=SeqID_71978; Strand=-; Position=1 -101,216-555
MPLLRCNSRPVGVTFLVRSVPMLNKMPMAINSNSAEARLLTAATTATAVNSRQTPQMPTSPGAKAVPARAPTPRVEQILTELLGEVHNFTGQFAHFAGQFSRFFAHVKKNTIPPPLLNGDDEEEEEEAESDQEEGEVEKENGQKDD

SEQ ID NO: 145556 - protein, 17 aa, Heterodera glycines
  Coding regions on vcDNA: vcDNA=SeqID_71979; Strand=-; Position=1-65
TFYEMYKNNFIILNIIL

SEQ ID NO: 145557 - protein, 205 aa, Heterodera glycines
  Coding regions on vcDNA: vcDNA=SeqID_71980; Strand=-; Position=1 -93,579-760,1235-1358,1410-1514,1603-1710,1746-1751
  Homolog annotation: Hit_ID=CAE74907.1; Match level="QueryCoverage =46%, HitCoverage=22%, E-value=4e-11, Identity=34%"; Hit description =Hypothetical protein CBG22776 [Caenorhabditis briggsae]
MTRFSHFRKDGGASTTTDDDDGVHVLIAKIRASRKHLVLSNNIKKIKNFGLKDELINPLRRMNAQNIDFACLKAILLLQPDVAEMSEQAKNWILQNRDGLLRAILVAGNSTTEASVCLARMLLLLPALFTIGQAIAQNKWMAEMLGIEPKGVANLDVSNSNSSPEARPAQNVVKENKIAEKIDETAQNDTDVVVVEANKMPINNF

SEQ ID NO: 145558 - protein, 165 aa, Heterodera glycines
  Coding regions on vcDNA: vcDNA=SeqID_71981; Strand=-; Position=1 -113,418-521,588-707,772-906,1054-1080
  Homolog annotation: Hit_ID=NP_741860.1; Match level="QueryCoverage =95%, HitCoverage=30%, E-value=6e-18, Identity=35%"; Hit description =nuclear Hormone Receptor (nhr-14) [Caenorhabditis elegans]
RFTNVCRVDKERRNACRSCRFRKCVANGMRPDAIQNERDRIGSTRRIMKQVLDDAQTSPTTISDGITDELIGDSNSENNHNSKSPLNVVQHQKHYSFVGQMGTNSKLILEQLLEIESGVQFAPVLHSSTAIRDRTFQYLNKWSNSLHGFSELKFNDKITFKLIFF

SEQ ID NO: 145559 - protein, 165 aa, Heterodera glycines
  misc_feature (9)..(9): Xaa can be any naturally occurring amino acid
  Coding regions on vcDNA: vcDNA=SeqID_71982; Strand=+; Position=1 -340,642-770,936-962
  Homolog annotation: Hit_ID=CAE62158.1; Match level="QueryCoverage =90%, HitCoverage=63%, E-value=2e-45, Identity=37%"; Hit description =Hypothetical protein CBG06205 [Caenorhabditis briggsae]
NENPNPPKXSFSPHVKVVVASAVRELSFIVAGLFSGHEYDFRVSACNTNGQGPPLMSEKPIVARLPFGVPSPPVLPGVVDVGWDYAVLSWQRPERDGGGRLRGYMVEKKEEGTEYWQKCTQAPSPSTSLSVTNLIDGRKYSFRIIAVNDAGDSEPAHLINVLYKM

SEQ ID NO: 145560 - protein, 490 aa, Heterodera glycines
  Coding regions on vcDNA: vcDNA=SeqID_71983; Strand=-; Position=1-1472
  Homolog annotation: Hit_ID=NP_920205.1; Match level="QueryCoverage =93%, HitCoverage=29%, E-value=3e-44, Identity=30%"; Hit description =putative DNA helicase homolog [Oryza sativa (japonica cultivar -group)] gb|AAP52492.1| putative DNA helica
MHMQLHRCSYSWCGPSDPIYGRCKKGFPAPYSKCTILRPDRPAMYFRPSPTDGGAQLEVNGLIYDNSHVVPYNPYILLRYRVHHNVLFAYGNKANIKYALKYPFKGPGHCYVECKEESGNKIKIDEPAQYAKMNFRGATEAYAIVHSMPFARLSHHVVKLAIHLPNQQPIVYRAFQLVSKAQQIQQGELPETQCSAYWKQWQNEWKNDPKFKDILFEKVPERFRWAKDKWVLYKRQQIKRPPIGRIVPVPPSDPERFALYSLMRHFPGDPDHLKMVNGLLCTSFTEAAIMHGLLEDDKIWDKTLAEAALSRWPDQMRWLYVSILLYGQPSNAIELWNKYKDQMYNPQGIITPAQHKVAEDRALADIDWRLHNFGYSCVHFGLPDPPTSIAKNTGAAIEEFFFGDDDLNLPPGQPNPRPQPNTPPPLNSDQQKVFDAVLLAIQSNPRDSTVPRRFFIYGDGGTGKTFLFGQIIRRLRKAPYTYKVLATAST

SEQ ID NO: 145561 - protein, 79 aa, Heterodera glycines
  Coding regions on vcDNA: vcDNA=SeqID_71984; Strand=+; Position=1-240
MLITNSIPALVNLEDQSLQFLNQSLHDAEMVIAVYGGHDEDDHDDAEQQQQQHQQMAKEYLLVFQKLGIYVDGQGQPEQ

SEQ ID NO: 145562 - protein, 159 aa, Heterodera glycines
  Coding regions on vcDNA: vcDNA=SeqID_71985; Strand=+; Position=1-479
  Homolog annotation: Hit_ID=NP_001004509.1; Match level="QueryCoverage= 99%, HitCoverage=10%, E-value=4e-09, Identity=27%"; Hit description =si:busm1-180o5.3 [Danio rerio] emb|CAD60788.1| novel protein similar to DNA polymerases [Danio rerio]
SGFPADCAVDDIDEEERERRKQQYIDNPWKGCTVRLDANNIKPNPGMRYLSKLCLNSLWGRFALRNRLTKTEIIDCHADLAKFLNDVKIDISSIDQLTEKFWMVCYKAKDEHVVEHDTSNVAIALWTTAAARVHLLNSLQLVYRQQDLVQRYDTRILYM

SEQ ID NO: 145563 - protein, 35 aa, Heterodera glycines
  Coding regions on vcDNA: vcDNA=SeqID_71986; Strand=+; Position=1 -94,575-588
MHWQCFRASRFAVGTNCSMAMGWEWATSDQNRLIE

SEQ ID NO: 145564 - protein, 15 aa, Heterodera glycines
  Coding regions on vcDNA: vcDNA=SeqID_71987; Strand=+; Position=1-48
IESHPLPAGLGTAKH

SEQ ID NO: 145565 - protein, 84 aa, Heterodera glycines
  Coding regions on vcDNA: vcDNA=SeqID_71988; Strand=-; Position=1 -39,297-387,876-1000
MSFNDFECKIVTKNNSQLNILNETAQILNARHKSVVEMLASKSVRIFPSKSAAPAQCCKCRVGQNGRRFFVPKALQNVARIFGG

SEQ ID NO: 145566 - protein, 43 aa, Heterodera glycines
  Coding regions on vcDNA: vcDNA=SeqID_71989; Strand=-; Position=1-130
ICQKLLCSTSPACVKLPKMWFIRSSKTENNVVKAFINGNFLLL

SEQ ID NO: 145567 - protein, 61 aa, Heterodera glycines
  Coding regions on vcDNA: vcDNA=SeqID_71990; Strand=+; Position=1 -58,375-502
MTTAKMSSSQAQNSSGGSSDAFKLNDLVGRLKSVSRIQSLSAKSRLESEQNLNNSERPPGP

SEQ ID NO: 145568 - protein, 52 aa, Heterodera glycines
  Coding regions on vcDNA: vcDNA=SeqID_71991; Strand=+; Position=1 -31,348-475
MSSSQAQNSSDAFKLNDLVGRLKSVSRIQSLSAKSRLESEQFREAPRAMKWI

SEQ ID NO: 145569 - protein, 59 aa, Heterodera glycines
  Coding regions on vcDNA: vcDNA=SeqID_71992; Strand=-; Position=1 -82,551-671
  Homolog annotation: Hit_ID=CAE70979.1; Match level="QueryCoverage =72%, HitCoverage=86%, E-value=3e-09, Identity=67%"; Hit description =Hypothetical protein CBG17796 [Caenorhabditis briggsae]
GGGSYDRCDPKLVQLAKSFRWDKLICRNCYARLPLRASNCRKCGSSDLRKRKTMLSKPL

SEQ ID NO: 145570 - protein, 229 aa, Heterodera glycines
  Coding regions on vcDNA: vcDNA=SeqID_71993; Strand=-; Position=1-690
MKGCLLISSLFAFLITILISNNNVGSEKKKMEQKTFDEIFGEKWEEKRNEEQKKREIIGKFYQIKEKIKQKGRKYSAKEWSQIERKIAKKLGTNRQYIYEWIKELGLNQKNCYKSKTEEEKIEIINKFIEMQNEFKQKRKYSRKEWNKNYEEICKKIGVSLFIIKKWMKQFGISRKITEKEKMEKMKIYWHIKKEKPKMSDKEIGKMLKIHINTIGNWKKQFVNGLMED

SEQ ID NO: 145571 - protein, 27 aa, Heterodera glycines
  Coding regions on vcDNA: vcDNA=SeqID_71994; Strand=-; Position=1 -31,514-566
MDQRKSSKERMFKCCHLHEEQTDVDFA

SEQ ID NO: 145572 - protein, 37 aa, Heterodera glycines
  Coding regions on vcDNA: vcDNA=SeqID_71995; Strand=-; Position=1-112
MCRFQCDQQCCPSKQTYTAKDKLKTEEQQFSRNKNVK

SEQ ID NO: 145573 - protein, 47 aa, Heterodera glycines; identical to SEQ ID NO: 139606
  Coding regions on vcDNA: vcDNA=SeqID_71996; Strand=+; Position=1-141

SEQ ID NO: 145574 - protein, 117 aa, Heterodera glycines
  Coding regions on vcDNA: vcDNA=SeqID_71997; Strand=+; Position=1 -46,129-194,238-572
RGFIGPKIIYIFLPIIASQLDVSIKLETLRNSESVCQSQLANLQQRKLGGCTIKLGMEFHEIFHFFYSQSGFVISSFDVPCPKRCPAETKRHSEKPRECSGWLNIGILRCDRTAIRC

SEQ ID NO: 145575 - protein, 21 aa, Heterodera glycines
  Coding regions on vcDNA: vcDNA=SeqID_71998; Strand=-; Position=1 -54,578-589
MRTRPIWQVKQRLLTSQKKGF

SEQ ID NO: 145576 - protein, 107 aa, Heterodera glycines
  Coding regions on vcDNA: vcDNA=SeqID_71999; Strand=-; Position=1 -93,150-290,343-432
MCVICEYLRGTDGLAGFISSQQSLPTLNTLKKMPPREGQSNNAGNDAPGHRQPPFAEQLVNDAQLRDIMNVLQQHGVLVGLNGTPQQIVEALRQLAQGQLDDRRRQN

SEQ ID NO: 145577 - protein, 19 aa, Heterodera glycines
  Coding regions on vcDNA: vcDNA=SeqID_72000; Strand=+; Position=1 -10,372-421
MCFAARILEMYKNKENNKR

SEQ ID NO: 145578 - protein, 58 aa, Heterodera glycines
  Coding regions on vcDNA: vcDNA=SeqID_72001; Strand=-; Position=1 -125,2462-2513
MEYVLKLRGLTLNYDVINNQGFRYKNSKSNVMLKQERLNQLIVWCQSLERYWLLAGQA

SEQ ID NO: 145579 - protein, 68 aa, Heterodera glycines
  Coding regions on vcDNA: vcDNA=SeqID_72002; Strand=-; Position=1 -114,239-331
MAEQSAFQSKLMLLRLKKVTHLPIDTDIKGNGEKEAEFPLTDFTSIMMYLILENIWDNRSIDVMAIED

SEQ ID NO: 145580 - protein, 63 aa, Heterodera glycines; identical to SEQ ID NO: 130392
  Coding regions on vcDNA: vcDNA=SeqID_72003; Strand=+; Position=1 -97,317-411

SEQ ID NO: 145581 - protein, 152 aa, Heterodera glycines
  Coding regions on vcDNA: vcDNA=SeqID_72004; Strand=-; Position=1-461
  Homolog annotation: Hit_ID=CAB40395.1; Match level="QueryCoverage =100%, HitCoverage=61%, E-value=1e-30, Identity=43%"; Hit description= TATA binding protein of transcription factor IID [Guillardia theta] gb|AAK39780.1| TATA binding protein o
PTIKNCVSVVDLKIPLDIEKIYLISPSTKYNPRKIHAVIMKVYNPNATAIIFSTGKFVCTGAANEKECKQAAEQVTERIRQFGYYEARIHEFVVKNLIATADVGFHIRLGPLSDFLGEYCSFTPELFPGLVYRNKNPTVSIICFSRGKLNIT

SEQ ID NO: 145582 - protein, 107 aa, Heterodera glycines
  Coding regions on vcDNA: vcDNA=SeqID_72005; Strand=+; Position=1 -122,1081-1164,1234-1351
MVNGAQLAFGTTDSTFPKGIFMTLSEALVRNALKRMINDPPILADKFMKHKESAERLDNFELVNPNEFRGEGCCNLVISAKGRHDGTRLGPTFSNLVAQFIRNSLVF

SEQ ID NO: 145583 - protein, 82 aa, Heterodera glycines
  Coding regions on vcDNA: vcDNA=SeqID_72006; Strand=+; Position=1-247
MGLPGLPSDYSYTQQASFLNDARLLMDFFGAEQSKQWTPIQLVLQQIRKLNSDQRAAFDRIITALNGRGEHRCFFIEGAGGC

SEQ ID NO: 145584 - protein, 88 aa, Heterodera glycines
  Coding regions on vcDNA: vcDNA=SeqID_72007; Strand=+; Position=1-267
MGLVLSGKQCFSHGQVYVAMSRVTSMEGVRICSPQTCRGENNYIHNVVFHELLDQSFNAPSQQFFHLDTHTATLQEKLCSDEESDLPC

SEQ ID NO: 145585 - protein, 196 aa, Heterodera glycines
  Coding regions on vcDNA: vcDNA=SeqID_72008; Strand=+; Position=1 -251,305-342,384-547,655-792
MSTQICVKFFWKNAKNFHEEREADRQNLLLELGKVTFDAIQNMDYAGAKSQLKIEAIQGRLIPLRENYENEKKKLDFYYTLQTPTKHHLKAAAIQSAAVTTAGANLSLEQKKVEIEVNAELQRNSNETTRFWAIQRMPIQQLCKDFFDRWTEEILPETQAGASSEKRVRSESPNSAKSVSSDKEVGKDNDTPLTEI

SEQ ID NO: 145586 - protein, 113 aa, Heterodera glycines
  Coding regions on vcDNA: vcDNA=SeqID_72009; Strand=+; Position=1 -266,993-1068
MDDYGLWDVQLQAGAEEDAEAFPFILSYIIFIFSLNTIIRFRLLLCCELSRSCTTLDPQGVVTIAVPLGIVLESVPEVDLGDKTGKGDCAHRALVIRTKMIIDTVSLTPTISR

SEQ ID NO: 145587 - protein, 24 aa, Heterodera glycines
  Coding regions on vcDNA: vcDNA=SeqID_72010; Strand=-; Position=1 -6,171-239
MQRRGFFGVLNMDIIKSRACAITS

SEQ ID NO: 145588 - protein, 281 aa, Heterodera glycines
  Coding regions on vcDNA: vcDNA=SeqID_72011; Strand=+; Position=1-844
  Homolog annotation: Hit_ID=NP_702063.1; Match level="QueryCoverage =97%, HitCoverage=6%, E-value=6e-21, Identity=20%"; Hit description =hypothetical protein PF14_0175 [Plasmodium falciparum 3D7] gb|AAN36787.1| hypothetical protein [Plasmodium
QHFNRTQPNSILITGTQPNRISITGTQPNSILITGTQPTNISIGLNPPTFQSLGLNPTGFQSLGLNPPTFQSLGLNPTGFQSLGLNPPEFQSLALNPPAFQSLGLNPPTFQSLGLNPTGFQSLGLNPPTFQSLGLNSPAFQSLALNPPTFQSLGLNPPAFQSLALNPPAFQSLGLNPPAFQSLGLNPPTFQSDSTQQHFNHWDSTQQDFNHWDSTHQNSNHWHSTHQHFNHWDSTHQHFNHWDSTQQDFNHCDSTHQHFNHCDSILLHLNHWHSTHQHLNH

SEQ ID NO: 145589 - protein, 106 aa, Heterodera glycines
  Coding regions on vcDNA: vcDNA=SeqID_72012; Strand=+; Position=1-321
MEEVIAVFQFHCHPNLRGWHGQYPMEFPCHGRFSDQKEGIVSLQIEKFSEFAQEKAWSSRLSEGIYIKGLPWKICAEIRTKNNSTEKWLGFHLLCTAPKGGNKSPI

SEQ ID NO: 145590 - protein, 64 aa, Heterodera glycines
  Coding regions on vcDNA: vcDNA=SeqID_72013; Strand=+; Position=1-195
YVPWRQITFTGRLFDVGEGRATTLLFLLKCLIYMALDIVIWVALTFLSYKLLVWTFFTPFERGL

SEQ ID NO: 145591 - protein, 211 aa, Heterodera glycines
  Coding regions on vcDNA: vcDNA=SeqID_72014; Strand=+; Position=1-636
MTNMKTSPWTTTTWAPMTTTRQRWTPTTSASTWTTRRTRIQYVTKSRSQQTDATTPPNTIKSAKSAKRDLGTNRDGADVFWCSDRGSTIWELKGPENSPFCRPPPSLTAEWHSLAIELYAKSIRPEQIDSAWHCSVKRTTENYYTNLLGDKFVTIVKEFPPVNKRICKQMALHQECPYAKSEMINHEGQLWSTNDELNVNFPGPISGLFKG

SEQ ID NO: 145592 - protein, 476 aa, Heterodera glycines
  Coding regions on vcDNA: vcDNA=SeqID_72015; Strand=+; Position=1-1431
  Homolog annotation: Hit_ID=CAE56861.1; Match level="QueryCoverage =61%, HitCoverage=21%, E-value=5e-10, Identity=22%"; Hit description =Hypothetical protein CBG24691 [Caenorhabditis briggsae]
MLSPVHQVQNCQYSAEFCQLPNNTTLIWKSTCSGDECKMCDYDRAEIISGKFTAAYGETVATWISDDHQKALTFAKKAPELIACDGVRIVLSEQNFGIAKDQYDDIVSTMRRWKRGIRPEQLASQLSASQVATSVALNQLYIRECQRNTRAANPTLQARKLLRQANIQARWIGETTMEVFPCVNISLQDISYRPMNDCRLYIPVTAHFPDRAIAAFLDPEVRIISLTAQQASCNSYRINHLQLRSNPNIWLRIDSRTGTARRLPKDYVHELYETTINQTNSNLELHPLIFHAWQLDNESDATRFPHINEFINSEQFKDKLEQHITARTEALGALKGGIEGFTMRWLKGLIDEAITWWIRVACVYSTFLMLRDIVLPCTLAYLLNPIRVTLLSLVGVRPHPTFRPTVSKPLGIEEGMPLRELPRTPKPPARRAEHRSMSPIKLDMIARTARYQQPRTQSHLDPTEDSPFGRPRRKEF

SEQ ID NO: 145593 - protein, 292 aa, Heterodera glycines
  Coding regions on vcDNA: vcDNA=SeqID_72016; Strand=+; Position=1-879
  Homolog annotation: Hit_ID=EAL39955.1; Match level="QueryCoverage =86%, HitCoverage=88%, E-value=3e-15, Identity=23%"; Hit description =ENSANGP00000014227 [Anopheles gambiae str. PEST]
MLLTALRSSEDASLRQRILIKLAADKNGITYDSMVEDLINFQTTIAEAKLIEQPSAFKNVSALKRGKEREQQQMPSNSRFANNSQNASTAQRKCWRCAGDHRADDCRHKLEKCPKCKFPGHIASRCESVQQWRRKFAKKPIQRKQIGSLSVGMATKQINATSLLKVGVFVNKKKTKFVADSGTEVNIIDEDAYDKIGRPKIQECEEKGKLFDGTKVAFIGKGVATFQFGDIAIDQEFYVAKRGSLNLLSISTMDAFGLLDDLKRKISNSAINLCVNINSSATFKSKTTNTIY

SEQ ID NO: 145594 - protein, 92 aa, Heterodera glycines
  Coding regions on vcDNA: vcDNA=SeqID_72017; Strand=+; Position=1 -88,189-379
  Homolog annotation: Hit_ID=CAE72714.1; Match level="QueryCoverage =91%, HitCoverage=18%, E-value=9e-17, Identity=51%"; Hit description =Hypothetical protein CBG19951 [Caenorhabditis briggsae]
MIQSILQLCEAPIDYEFMDKLPAVQYGFPCGYRRDFHAERAKIPEALFDLKHATDISETERATLMSVSQVALTSCNTCDIDIRPVSTYRMHI

SEQ ID NO: 145595 - protein, 53 aa, Heterodera glycines
  Coding regions on vcDNA: vcDNA=SeqID_72018; Strand=+; Position=1 -71,190-280
MKLLCAGFIHWMFFICEPSKIGIMATGVSNLTNSLKVEGWKYVKYFRLSIYFV

SEQ ID NO: 145596 - protein, 91 aa, Heterodera glycines
  Coding regions on vcDNA: vcDNA=SeqID_72019; Strand=+; Position=1 -137,216-354
  Homolog annotation: Hit_ID=CAE75435.1; Match level="QueryCoverage =97%, HitCoverage=27%, E-value=4e-21, Identity=58%"; Hit description =Hypothetical protein CBG23428 [Caenorhabditis briggsae]
MRKETGYSYVKCRKALVACGGEQNYEQALRWIKEAAVKEGWDKAAKLSGRKASQGLIGFASLSDNVSVLVELNCETDFVARSAEFKNLVFI

SEQ ID NO: 145597 - protein, 320 aa, Heterodera glycines
  Coding regions on vcDNA: vcDNA=SeqID_72020; Strand=-; Position=1-961
  Homolog annotation: Hit_ID=XP_447783.1; Match level="QueryCoverage =79%, HitCoverage=29%, E-value=2e-11, Identity=23%"; Hit description =unnamed protein product [Candida glabrata] emb|CAG60730.1| unnamed protein product [Candida glabrata CBS1
IQSLGLNTPAFQSLGLNSPAFNHWDSTHQHSNRWDSTHQHSNHWHSILLHFNHWGSTLQHSITGTQPTNIPIKGTQPSSIQSLGLNPPTFQSKGLNPPAFNHWDSTLQHSITGTQPTNIPIKGTQPTSISISGTQPTNIPINRTQPSSIQSLGLNPPAFQSLGLNPPAFQSLALNSPAFQSLGLNPPAFNHWDSTHQHSITGTQPSSIPITGTQPTFSILITGTQPTSIPITGTQFSCISITGAQPSSIQSLGLNPPAFQSLGLNSPAFNHWDSTHQHSNQRDSTLQHSITGTQLSSIQSLGLNPPTFQSKGLNPPAFQS

SEQ ID NO: 145598 - protein, 45 aa, Heterodera glycines
  Coding regions on vcDNA: vcDNA=SeqID_72021; Strand=+; Position=1 -66,123-194
MAIYFFEKFSMQQTLSNMKRSAKNGYLFFFEIFYATNAVAILFFK

SEQ ID NO: 145599 - protein, 52 aa, Heterodera glycines
  Coding regions on vcDNA: vcDNA=SeqID_72022; Strand=+; Position=1 -66,123-191,248-271
MAIYFFEKFSMQQTLSNMKRSAKNGISFFEKFSMQQTLSNMKRSAKNGYLFF

SEQ ID NO: 145600 - protein, 502 aa, Heterodera glycines
  Coding regions on vcDNA: vcDNA=SeqID_72023; Strand=+; Position=1 -499,577-842,926-1669
  Homolog annotation: Hit_ID=CAE72649.1; Match level="QueryCoverage =39%, HitCoverage=23%, E-value=3e-10, Identity=23%"; Hit description =Hypothetical protein CBG19856 [Caenorhabditis briggsae]
MAMHYFEGRIKANGLKNKDMKSLLIGFFEFFNCFPFRTHVISERGEWEERRHHKEFPEDRQSIFIENPYNKRNVASSVREDGFKKICEEFEMTANEFGLPLVREVNVLEELGIDLEKEWVEKTSVSSDEKSEMLERANQSRETEELSDEMVKLKVILNEPVSQHEQVFILSMISTTIPNPMLCHHRAQKNYVRIDRDTTQCKLIANLFDEPQRELEVDIYQPNSEPFTFKAHRCLKVKQSQKFWTNLLNDKFSDPWSFKLAISYKPRIANSLFLVEIRKRQIRRNNCYHAVITLIGKPGSESLGSPTEEVSKCKFSKGSCRLGDNAILIWNLDSTEHQSACLYNKVTTENGKFTKRMWISKNSQFAISFQENAKSVESCGHTLKLSDQGFAVPSWQFRIITGKTTHRIKREQWWPKEKPLDQNEKSSTAAAQLTARAIYQNKETKELFQKMVNLICGILQNANPKQDLSHLNPTQLMREKTGTELVKAKWISPNVLEWWPCS

SEQ ID NO: 145601 - protein, 190 aa, Heterodera glycines
  Coding regions on vcDNA: vcDNA=SeqID_72024; Strand=-; Position=1-573
  Homolog annotation: Hit_ID=CAE73999.1; Match level="QueryCoverage =56%, HitCoverage=13%, E-value=9e-10, Identity=29%"; Hit description =Hypothetical protein CBG21634 [Caenorhabditis briggsae]
CKFSKGSCRLGDNAILIWNLDSTEHQSACLYNKVTTENGKFTKRMWISKNSQFAISFQENAKSVESCGHTLKLSDQGFAVPSWQFRIITGKTTHRIKREQWWPKEKPLDQNEKSSTAAAQLTARAIYQNKETKELFQKMVNLICGILQNANPKQDLSHLNPTQLMREKTGTELVKAKWISPNVLEWWPCS

SEQ ID NO: 145602 - protein, 57 aa, Heterodera glycines
  Coding regions on vcDNA: vcDNA=SeqID_72025; Strand=+; Position=1 -155,237-255
MATVGKRLAQQEKASYRSIGVKKKSYSDKAIFRINQSCLSNAIFIEFSQWPYVPNFP

SEQ ID NO: 145603 - protein, 166 aa, Heterodera glycines
  Coding regions on vcDNA: vcDNA=SeqID_72026; Strand=-; Position=1 -444,486-539
MQIFYIQLIEHREIDPYRIVVFDLETMQHHALDPLQPEKREHQPNFIAARIACPGCIENGNWRRGTAGCQICGPHRMVAFCQRRFADTIVDKQIVGENPLEAFVDWLVYKLPKKYETYAYSHFGGRFDMVLVFRELFRIGFNPEMLRRGNKMYEMKIRKQKQRNPN

SEQ ID NO: 145604 - protein, 47 aa, Heterodera glycines; identical to SEQ ID NO: 133631
  Coding regions on vcDNA: vcDNA=SeqID_72027; Strand=-; Position=1-411

SEQ ID NO: 145605 - protein, 24 aa, Heterodera glycines
  Coding regions on vcDNA: vcDNA=SeqID_72028; Strand=-; Position=1-127
KFLDFLFISLFDSESIREPYLTFN

SEQ ID NO: 145606 - protein, 80 aa, Heterodera glycines
  Coding regions on vcDNA: vcDNA=SeqID_72029; Strand=+; Position=1-243
MNNRLSLNPNDFPNTMEFVLFNAVQQGNVDNPDIERLLERLRNRQPPPSPFKNDRLLWDVFDDPEIANAPQMTIKVISAF

SEQ ID NO: 145607 - protein, 95 aa, Heterodera glycines; identical to SEQ ID NO: 133575
  Coding regions on vcDNA: vcDNA=SeqID_72030; Strand=-; Position=1-554

SEQ ID NO: 145608 - protein, 267 aa, Heterodera glycines
  misc_feature (161)..(161): Xaa can be any naturally occurring amino acid
  misc_feature (186)..(186): Xaa can be any naturally occurring amino acid
  misc_feature (202)..(202): Xaa can be any naturally occurring amino acid
  misc_feature (227)..(227): Xaa can be any naturally occurring amino acid
  misc_feature (231)..(231): Xaa can be any naturally occurring amino acid
  Coding regions on vcDNA: vcDNA=SeqID_72031; Strand=+; Position=1-817
  Homolog annotation: Hit_ID=T02995; Match level="QueryCoverage=100%, HitCoverage=49%, E-value=1e-63, Identity=54%"; Hit description =unspecific monooxygenase (EC 1.14.14.1) - common tobacco dbj|BAA10929.1| cytochrome P450 like_TBP [Nicotiana
MYRPSQTPRLTLSSARVGVARLNTKMDTLSGALPFYRLSKESMKVVVFHWRLAAPTYATPLMILHKVRLESSSTGSSFPAKFAKPVPLAVVSLDSRRDSGNLVDPFVRVGKPTRHLATLRESCYSPVYPRLIKFPWLNIQSTGQKSDTVNVHKDHPSPLFXLDSRIPRVRASSKLVVQRQPKCIPXRAYTQLKRSTSSSHHXSTHHPRKNSTQPRAKAACFTQQPGXPDLXSQFFSRSYESNLPTSLTYIILSTRGCSPWRPAADIG

SEQ ID NO: 145609 - protein, 349 aa, Heterodera glycines
  Coding regions on vcDNA: vcDNA=SeqID_72032; Strand=-; Position=1 -149,836-999,2019-2035,2391-2429,2478-2572,2740-2882,3347-3389,3450 -3563,4265-4343,4711-4914
  Homolog annotation: Hit_ID=NP_492715.1; Match level="QueryCoverage =75%, HitCoverage=51%, E-value=1e-68, Identity=47%"; Hit description =carboxypeptidase a2 precursor family member (1K935) [Caenorhabditis elegans] emb|CAB00065.2| Hypothetical
MALQLDFWKAPTNVGSFVDVMVAPEFVSSLSELLDKQRIQYNTIIEDVQSMIVQREKATGGRHHHHKGNLSESLLLSQFKLFGKRMRDDASPSFVSRNKAVYGFGMHAREWASIHTALWFIDQLISLYGVDPQVTAYMDTLNFYVLPLANPDGFEYSRSDVNPQTRFWRKNRGQQVCKKDRWRRERCCGGVDLNRNFDFHWGETGSSSDMCSDIYQGAYAFSEPESRAIRDKMMSSELYGKVDAFLTLHTYSQMCSDDWAKSKAGVKYVYLLELRPGEEEWVVIDAVMQRAKGLQPWRSTTTTTTTTTTVTTTPIPQRPPAPVVTPPAAPPRAVLPDLPPQTVPTNARL

SEQ ID NO: 145610 - protein, 30 aa, Heterodera glycines; identical to SEQ ID NO: 130616
  Coding regions on vcDNA: vcDNA=SeqID_72033; Strand=-; Position=1 -52,124-164

SEQ ID NO: 145611 - protein, 36 aa, Heterodera glycines; identical to SEQ ID NO: 134159
  Coding regions on vcDNA: vcDNA=SeqID_72034; Strand=-; Position=1-155

SEQ ID NO: 145612 - protein, 36 aa, Heterodera glycines
  Coding regions on vcDNA: vcDNA=SeqID_72035; Strand=-; Position=1-155
KPKLFGLFKKQLKFLKILFISLFDSESIREPYLTFN

SEQ ID NO: 145613 - protein, 328 aa, Heterodera glycines
  Coding regions on vcDNA: vcDNA=SeqID_72036; Strand=-; Position=1-987
  Homolog annotation: Hit_ID=NP_494302.1; Match level="QueryCoverage =83%, HitCoverage=20%, E-value=1e-49, Identity=39%"; Hit description =predicted CDS, putative protein of ancient origin (2C878) [Caenorhabditis elegans] gb|AAB95006.1| Hypothe
MSFENIRYLNSSVSMASMNPMRYQFKHNRGPYCFRIFGQILDKIKIALNPDSDELPSNGQLFIIDTGEAMNFLRKSNPKIDDDLLNSIYSLIKSENPFAQAFIMMKDEEEYEKEKAKEEGREPAELKLLFGLSPDMDKNRYKLPRANEVAVVFVPGADGEVPESKIVVREKGKELRVLNSLDKNVTPMCYPLFFPRGTTGWHPEMKQKNGIKNLTRLQYASYCIAVRNEFNPLLYGAKLFQQWCVDEYVKIEGDRIRWIRNNQKKILADSYKNVDSFLLKKSQETGLPIDAKLFYQLLLLDHHVILKNTFKMQCQLFEDLANPIYLLR

SEQ ID NO: 145614 - protein, 148 aa, Heterodera glycines
  Coding regions on vcDNA: vcDNA=SeqID_72037; Strand=-; Position=1-448
  Homolog annotation: Hit_ID=AAP92584.1; Match level="QueryCoverage =81%, HitCoverage=24%, E-value=5e-34, Identity=63%"; Hit description =Ab2-057 [Rattus norvegicus] gb|AAP85373.1| Aa1262 [Rattus norvegicus] gb|AAP85367.1| Aa1011 [Rattus norveg
AWPFLVRGAICLVYSDNERDSSLLNSWLIASGHNFLEGFSVFSRTKLSNNRSVMPLDVRGCTRATLAKSACLPSPKGVGKPVKICRDWDRTLQLLSVNEEFLVGASHQLALNTSLPFVHTARRCPGLSHFEKFGGRLVFPASVGMQTG

SEQ ID NO: 145615 - protein, 83 aa, Heterodera glycines
  Coding regions on vcDNA: vcDNA=SeqID_72038; Strand=+; Position=1 -162,670-759
MIQQQVHLQLPCYDFCPVQATAIKSVPVCIPTEAGNTNRPPNFSKWLSPGQRRALCNHTSPGTGRLSFPGSSPPGRINPPADR

SEQ ID NO: 145616 - protein, 56 aa, Heterodera glycines
  Coding regions on vcDNA: vcDNA=SeqID_72039; Strand=-; Position=1-168
MFSSSKSAAVLRMRGATGAMARRWKGGDEQKNVPVPSPKEMAQRPAEFDELTHTGQ

SEQ ID NO: 145617 - protein, 38 aa, Heterodera glycines
  Coding regions on vcDNA: vcDNA=SeqID_72040; Strand=-; Position=1 -36,99-179
MKVLQNMGDGHMMRTKPSDSDEGGAGKGNGVIDSPFLF

SEQ ID NO: 145618 - protein, 123 aa, Heterodera glycines
  Coding regions on vcDNA: vcDNA=SeqID_72041; Strand=+; Position=1 -104,146-242,283-453
MTVTSNTEFRLIECVPILEEVAREFGCITPLPNLGSHRDYRVSGCMMIRTLTSLNRLYIFDAEDCIEVKGFLRQEDGTSQKVVNEYYEKYDGLNGFTEFLRNWAFNFFCLHAFDDDDDTSDEH

SEQ ID NO: 145619 - protein, 57 aa, Heterodera glycines
  Coding regions on vcDNA: vcDNA=SeqID_72042; Strand=-; Position=1 -120,261-314
MATSAGSAWLLQLLLLIRCGGYVLADLLAAQHNALGMLKNTFSASARNLLFVHSVKK

SEQ ID NO: 145620 - protein, 30 aa, Heterodera glycines; identical to SEQ ID NO: 145359
  Coding regions on vcDNA: vcDNA=SeqID_72043; Strand=+; Position=1 -52,257-297

SEQ ID NO: 145621 - protein, 183 aa, Heterodera glycines
  Coding regions on vcDNA: vcDNA=SeqID_72044; Strand=-; Position=1 -349,434-636
  Homolog annotation: Hit_ID=XP_331323.1; Match level="QueryCoverage =32%, HitCoverage=15%, E-value=3e-10, Identity=58%"; Hit description =hypothetical protein [Neurospora crassa] emb|CAD70992.1| conserved hypothetical protein [Neurospora crass
MASQDTPPGDENVADAQPFDDTLTVYGGDENVAQAQPVDNTLTVYGGNENVAQAQPVDNTLTVYGGDENVAQAQPVDNTLTVYGGDENVVQAQPVDNTLTVYGGNENVAQVQLGTTGFSLFKGVAVAETTKEKANEKKDKKADEKKDKKADKTKDKKVDEKKDKKADEKKEKPEKVSKKNVEK

SEQ ID NO: 145622 - protein, 176 aa, Heterodera glycines
  Coding regions on vcDNA: vcDNA=SeqID_72045; Strand=+; Position=1-531
MAEKMSKGSYNACDAETVFGRENVCDRTRLKPTRTAFISSIFNADRDGMRLNFEDLKPYNQEKTVEEVLDRLDVEVCPQMVYRMGRSSDEKRKGPRLVKVVLPASTFQRFALMQWGRRRTELKKRAGWERLLVRSSLTKEELEIEREQRQKKWMEFGQKKTDENITTRRGGNEKNF

SEQ ID NO: 145623 - protein, 21 aa, Heterodera glycines
  Coding regions on vcDNA: vcDNA=SeqID_72046; Strand=-; Position=1 -54,579-590
MRTRPIWQVKQRLLTSQKKGF

SEQ ID NO: 145624 - protein, 75 aa, Heterodera glycines
  Coding regions on vcDNA: vcDNA=SeqID_72047; Strand=-; Position=1 -58,115-284
MVESGTDTPLLQLCNSIEKCLQHLRALKNHVIVAHNLLSEKMALATRTEEPSQIDFESVKNVLEKAGVQIADEYK

SEQ ID NO: 145625 - protein, 15 aa, Heterodera glycines
  Coding regions on vcDNA: vcDNA=SeqID_72048; Strand=-; Position=1-47
MAIGTALRLYASAFV

SEQ ID NO: 145626 - protein, 92 aa, Heterodera glycines; identical to SEQ ID NO: 125147
  Coding regions on vcDNA: vcDNA=SeqID_72049; Strand=-; Position=1-304

SEQ ID NO: 145627 - protein, 75 aa, Heterodera glycines
  Coding regions on vcDNA: vcDNA=SeqID_72050; Strand=-; Position=1-228
MIGRAVRNRPFIFEGIFKFILNPRKMSISFFEKFYTSQKRLRRDGGLCTIAILFHRGFLYLEVIPEKWLSLFLIN

SEQ ID NO: 145628 - protein, 104 aa, Heterodera glycines
  Coding regions on vcDNA: vcDNA=SeqID_72051; Strand=+; Position=1 -58,133-389
MPNSPSSSSASMPQHQQNGVSANVGTELRLDGTNAVQQQSSAGSNSARLSPDGSLRNAAAAGYAAAAATMNGLGGAVPSASTMNSAALMHSLGAAQQMHYGIDP

SEQ ID NO: 145629 - protein, 41 aa, Heterodera glycines
  Coding regions on vcDNA: vcDNA=SeqID_72052; Strand=+; Position=1-128
RSVRIEVGNELKQRCEKEIKTIWLEIVDQQRIDELSMESQL

SEQ ID NO: 145630 - protein, 70 aa, Heterodera glycines
  Coding regions on vcDNA: vcDNA=SeqID_72053; Strand=+; Position=1-210
MRLFPFNYLDTYRTVTEIMHELEQFQQHNQPPTKIHGQQIVYTVNISCGELNEQSSEVISAAIENALSFQ

SEQ ID NO: 145631 - protein, 21 aa, Heterodera glycines
  Coding regions on vcDNA: vcDNA=SeqID_72054; Strand=+; Position=1 -54,323-334
MRTRPIWQVKQRLLTSQKKGF

SEQ ID NO: 145632 - protein, 188 aa, Heterodera glycines
  Coding regions on vcDNA: vcDNA=SeqID_72055; Strand=+; Position=1 -478,974-1068
  Homolog annotation: Hit_ID=XP_479365.1; Match level="QueryCoverage =96%, HitCoverage=12%, E-value=1e-36, Identity=43%"; Hit description =helicase-like protein [Oryza sativa (japonica cultivar-group)] dbj|BAD32013.1| helicase-like protein [Ory
LQEMTALFIVPEYLNTLYTTSLPRHELRLKNAVIVMLVRNLNIKEGLCNGTRFRILKMLDKVLHCEILTGNKAGTKVLLPRITLTDDETFPFSISRHQFPLKLSFSLTMNKSQGQTFNKIGIDLRNNVFQHGQLYVGFSRTRSWDGLKVRLHPKNRDHKDLIQLFFKILNMTLTKIKIKIFLLFFCMF

SEQ ID NO: 145633 - protein, 88 aa, Heterodera glycines
  Coding regions on vcDNA: vcDNA=SeqID_72056; Strand=-; Position=1-266
MSGRGRNGGGGGGCGGAQRTGAGENGSGGQLLDQLAHEVRVVGRGAGGQHVHGHHEKRVGVEQSEQRRREDGSGRIGSGKENGGGSED

SEQ ID NO: 145634 - protein, 111 aa, Heterodera glycines
  Coding regions on vcDNA: vcDNA=SeqID_72057; Strand=+; Position=1 -192,917-1060
MSYYSDQQQNQRMSSGGNAENGDKSADDGGAAERQRRTFREVRKSIVQATQRHGSKKVTDLEMQLLRHLTCPQTAVLRPLRPFHHKKRHFLSRPPSPQLFDISEENDEQQQ

SEQ ID NO: 145635 - protein, 49 aa, Heterodera glycines
  Coding regions on vcDNA: vcDNA=SeqID_72058; Strand=-; Position=1-147
QESPKNDQNEAMSKKLEDINSLMTRLTLHNRSLAQLFALNQLGLFFSIF

SEQ ID NO: 145636 - protein, 126 aa, Heterodera glycines
  Coding regions on vcDNA: vcDNA=SeqID_72059; Strand=+; Position=1 -238,422-564
  Homolog annotation: Hit_ID=NP_112263.1; Match level="QueryCoverage =96%, HitCoverage=82%, E-value=1e-42, Identity=64%"; Hit description =ubiquitin-conjugating enzyme E2D 2 [Rattus norvegicus] ref|NP _082778.1| RIKEN cDNA 1700013N18 [Mus muscul
MDDGKDMFHWKAAIKGPPESPYEGGTFHLDIVFHRDYPFTPPVVKFETPVYHPNVNKQGGICLDVLKTTHWAPSLTISKVLLSISSLLCDPNPNSALEMDIAIIYRNDREQYNRNAREWTQKHAMK

SEQ ID NO: 145637 - protein, 33 aa, Heterodera glycines
  Coding regions on vcDNA: vcDNA=SeqID_72060; Strand=+; Position=1-100
AISFFDKFYTHTNALEHDRGGRCAIDLLFLREF

SEQ ID NO: 145638 - protein, 92 aa, Heterodera glycines
  Coding regions on vcDNA: vcDNA=SeqID_72061; Strand=+; Position=1-304
MIGRAVRNRPFIFEGIFIFIVYPRKMAISFFEKFYTSQKRLRMRRRAVHNRHFISQRIFIFIGYPRKMAISFFDKFYTLTNALAYDREGCAQ

SEQ ID NO: 145639 - protein, 62 aa, Heterodera glycines
  Coding regions on vcDNA: vcDNA=SeqID_72062; Strand=+; Position=1-189
YVDQHVVQFLHRIRRLFDSVPTNLYIATAALAETVYRLKHFVRSCEAIRQHILPLLRANVRA

SEQ ID NO: 145640 - protein, 105 aa, Heterodera glycines; identical to SEQ ID NO: 143140
  Coding regions on vcDNA: vcDNA=SeqID_72063; Strand=-; Position=1-330

SEQ ID NO: 145641 - protein, 85 aa, Heterodera glycines
  Coding regions on vcDNA: vcDNA=SeqID_72064; Strand=+; Position=1 -197,498-560
VQQQQQVQAVQQPRLRTVRDDRRYEIAAIVCSRRAADGQTRELRIHCRSFSYHYDTYEAEASIQRGTPAAEEAALIFDPMQPQAA

SEQ ID NO: 145642 - protein, 97 aa, Heterodera glycines
  Coding regions on vcDNA: vcDNA=SeqID_72065; Strand=+; Position=1 -221,362-434
MFAVLLMPIELTNGFTGERLSLMKLNGKYLVIRCPISRDETKWKKWEQEAIECDLDNQLNTIHIGICDDDIGDGLLDDGTPGPSDQQNRIVENDRST

SEQ ID NO: 145643 - protein, 124 aa, Heterodera glycines
  Coding regions on vcDNA: vcDNA=SeqID_72066; Strand=-; Position=1 -151,204-427
  Homolog annotation: Hit_ID=CAE63308.1; Match level="QueryCoverage =70%, HitCoverage=19%, E-value=2e-15, Identity=43%"; Hit description =Hypothetical protein CBG07697 [Caenorhabditis briggsae]
MPRSDSSVQPAVDSSALTAANGAPAAISDRNVNNANCIDQRSDCPFLASIGNCESVFSTSFMLVHCARTCRKCGGINDNASSSSAQQCDDQLPMCRRWAANGLCELFIFQQYLLNNCALSCGGC

SEQ ID NO: 145644 - protein, 106 aa, Heterodera glycines
  Coding regions on vcDNA: vcDNA=SeqID_72067; Strand=+; Position=1-321
MTVGGVGGGFPQLFLNRDWCPIDGLKGIVGSTEDVFDSVLVEGHELSGRVGFDWNSGGGGGGGGGGGGDATELAAVSTDCLCCGDATELAAVGTGGNCWGGAGGLC

SEQ ID NO: 145645 - protein, 85 aa, Heterodera glycines
  Coding regions on vcDNA: vcDNA=SeqID_72068; Strand=-; Position=1-255
MADLNFSINQQSPPAPPQQFPTVPTAVNSANESKYPNENIGGFSQNTPFFAQNPTLATRHQPPPRPPPVTNNVMHSMNDFGSHQQ

SEQ ID NO: 145646 - protein, 101 aa, Heterodera glycines
  Coding regions on vcDNA: vcDNA=SeqID_72069; Strand=-; Position=1 -93,166-376
  Homolog annotation: Hit_ID=NP_078997.2; Match level="QueryCoverage =74%, HitCoverage=1%, E-value=3e-09, Identity=41%"; Hit description =zinc finger homeodomain 4 [Homo sapiens] gb|AAP20225.1| zinc finger homeodomain 4 protein [Homo sapiens]
SINWAPIPSQEKSRETPPPPTPPTVIQQQKEQFPPVPTAASSVASPQQRQSVLTAASSVASPPPPPPPPPPPPLFQSKPTLPDNSWPSTSTESKTSSVDPT

SEQ ID NO: 145647 - protein, 109 aa, Heterodera glycines
  Coding regions on vcDNA: vcDNA=SeqID_72070; Strand=-; Position=1 -290,343-381
AFTNASSPANFIVVIWFPSYFDQSSVEPFDLTNELTREQLALKRTNNNRRFLLIRSPIARDVNKWAEWEEEAIGWKFIDQCDQIDIQINDEHEIGDGLLATTPGPSDQQ

SEQ ID NO: 145648 - protein, 37 aa, Heterodera glycines
  Coding regions on vcDNA: vcDNA=SeqID_72071; Strand=+; Position=1-117
KRGDPFVLQNFFKIKNHDNFLSGVIKVANHESEMYFD

SEQ ID NO: 145649 - protein, 92 aa, Heterodera glycines
  Coding regions on vcDNA: vcDNA=SeqID_72072; Strand=-; Position=1 -71,115-320
MTDNRKEAAEEEMAKVEAKMEKAIFISGDCWLAVFDLLPAYQLGLRISMISHRFNIYVDEHFKTRKWGLDFLRIGSKIDENGTKEMEIVNYD

SEQ ID NO: 145650 - protein, 146 aa, Heterodera glycines
  Coding regions on vcDNA: vcDNA=SeqID_72073; Strand=+; Position=1-441
MEKPVKVSKENKKGEGKSKEVNKEENEYNEFCKSTTKNIDESIVHVQFFAEFESSFKSIFYVPETLTADEFQNQNLAFSSGTMENSREEKKIGSSETDKKNGLMRIWRFENCSVKADGRILADRAKWLKTWIFIKIPDKILLDKTH

SEQ ID NO: 145651 - protein, 47 aa, Heterodera glycines; identical to SEQ ID NO: 133631
  Coding regions on vcDNA: vcDNA=SeqID_72074; Strand=-; Position=1-461

SEQ ID NO: 145652 - protein, 36 aa, Heterodera glycines
  Coding regions on vcDNA: vcDNA=SeqID_72075; Strand=-; Position=1-147
FINIFSERALKHTKLYLQVSLGTLMLFLSKREMNKI

SEQ ID NO: 145653 - protein, 60 aa, Heterodera glycines
  Coding regions on vcDNA: vcDNA=SeqID_72076; Strand=-; Position=1-183
VTVPPTFDSFDIGGEQFLCQSRKVEDAGFTEVLSWLAVPESNTKAMDALSKLSIGDKLRI

SEQ ID NO: 145654 - protein, 52 aa, Heterodera glycines
  Coding regions on vcDNA: vcDNA=SeqID_72077; Strand=+; Position=1 -67,240-279,517-567
LVFGSFTMSALYADSTKYLHLGGILSSALFCMLIVLLFAPYTPFERSFMLWA

SEQ ID NO: 145655 - protein, 64 aa, Heterodera glycines
  Coding regions on vcDNA: vcDNA=SeqID_72078; Strand=-; Position=1 -52,196-338
MTIHFSSFYTFFDHSVLSVGVSNFAFFRSVYAQFVTFERILHLIMQQGWAKSENKMREMRNLRK

SEQ ID NO: 145656 - protein, 82 aa, Heterodera glycines
  Coding regions on vcDNA: vcDNA=SeqID_72079; Strand=+; Position=1 -83,133-298
MVILLFLAVFFGFLPFLHSLDKAYVTEPFLLTGGKIGKFSVPYFAFDQCKPYHSITHDLKVESRNFGLYFMMKHRGGHCDEG

SEQ ID NO: 145657 - protein, 153 aa, Heterodera glycines
  Coding regions on vcDNA: vcDNA=SeqID_72080; Strand=+; Position=1 -109,278-414,511-726
MAWHQSVHETDKLIKSAFGTRNDPGDFIDKSEVEILGQPFHDEEFDLAEQYAKQMGYGPFLEQHVGLWLLGMDMLPWMAEEFFTRPTDENDPIEPIVPSAGSSQCPMKQMDETFELGQLDAQHLQADLVFTVLTDEKWQNFTVELLQGEKGVS

SEQ ID NO: 145658 - protein, 137 aa, Heterodera glycines
  Coding regions on vcDNA: vcDNA=SeqID_72081; Strand=+; Position=1 -12,228-404,734-790,841-1008
MGKAYSGWNKTYKVERTNTTIQTTNSNVFEFFLNFTDVIMFNGEHILQNYTDDIPFCHIKYVKVTGDAILLDSPKLNVPPPIVKKGEQIILAVKEFLNFGDLIVISNYKQKANETIVVKLLHGPPECSKNCKVLSYI

SEQ ID NO: 145659 - protein, 54 aa, Heterodera glycines
  Coding regions on vcDNA: vcDNA=SeqID_72082; Strand=-; Position=1-165
AKYFNDEKLRKMNQYFETIEKNPKISDKIIAKKLEIGSANLKRWKKEICFNLEK

SEQ ID NO: 145660 - protein, 43 aa, Heterodera glycines
  Coding regions on vcDNA: vcDNA=SeqID_72083; Strand=-; Position=1 -82,787-834
MIAKNIQIWDVASQKQLEALPYKVRVDDLGYAQQSAELPEDIP

SEQ ID NO: 145661 - protein, 68 aa, Heterodera glycines
  Coding regions on vcDNA: vcDNA=SeqID_72084; Strand=+; Position=1 -94,185-297
MHTFCARAIHHRACQSKAKQQRCCFERIKGIESVNRLLEKYICNLSKILRSEIEMINFTIQTNFRCSN

SEQ ID NO: 145662 - protein, 239 aa, Heterodera glycines
  Coding regions on vcDNA: vcDNA=SeqID_72085; Strand=-; Position=1 -11,63-158,206-364,419-869
MNRRWICNDVWMDIFPSFDRPQLGLKLALLSPRFNASIGISKDKGPEPKLDSVTNPKLSVRIDDKFVEFPLPDDRPLPSKIRFKSLEIYYIDHSVIAFLRLNHQIFDKRGTNLQLFWISSPHTTDGQRIWDILTREIWPIFSTNIRCLGFSRGDHLDNLLRQISPTILIDLNQLVSIHSFGRLPAAIGDDFDGPNSTISAGQALSKWLHSPRKDGQPKRLRCEDYNAQANTDWINNFKE

SEQ ID NO: 145663 - protein, 796 aa, Heterodera glycines
  Coding regions on vcDNA: vcDNA=SeqID_72086; Strand=+; Position=1-2391
  Homolog annotation: Hit_ID=NP_507780.1; Match level="QueryCoverage =87%, HitCoverage=47%, E-value=2e-66, Identity=27%"; Hit description =predicted CDS, DNA polymerase type B, organellar and viral family member (5T899) [Caenorhabditis elegans]
MRHYSLYKRGTITQDRWRWINKNQTTVLQQKALQLLREAGIPTTETEYDAEVYIHQVQGLWNVKYPGEYKIFIFNDYQIRPITKSDVTDYQFPILLYHNNNHFDGIKTISKFFNKKNYCLSCESPYYKKIAHSSNCSSLCHGCREVGVDYPCEPQQGYIKKCDHCNNTFYNNSCYERHLHKDLCTKFQRCEDCGVIYNIMVHGSVGHKCGEQFCKLCKQFHIKEDDDDGMNPCTKCFIQPLKQQRIKPYRIIVYDFEATQDKKVENRFEHEVNFAAATIICTDCIINGDWNKSLQGKKCQICGPHRSITFSPFDYMETTVDQKVVTQQPLCEFVQWLLFDHNKKFPTVAFAHFGGRYDMTMIIKEVLAQGIHNPDIIKQGNRLYELKIRENEHGPLTIFHDSYNLMPIKLSGLIKSFGLHIKDKQHFPHMFNKSANYFNVLPHLPPRDDYCPNQKKKADLQKFDDWYNNNLCQKFNLKEKLPEYCCNDVKILTHALVELRREFKQLTQRNGKHGGIDILWQAMTIASACVKNFALNHLKPNSLAIVPEKGYTPQQNQSALAIKYLDWYSHVNNVNIQTAHSRYGEYVFKREGQVYQVDGYIKGTDGRRDKIIEVNGCLWHGCEECFDDLGDETRMPNGKTLREIREREEKKHEILSRYVDLEVVWEHEINEKLKKDKQMREFFANWKDHSPIKIRDAFHGGRTGPMKLLHTAKPGQKISYKDFTSLYPWTNFTTNYPLGHPKIVSVPPNEQTVNWRTPSDNPYKGLLKVLLLPPNNNVSVTVMPVKFDQRLLFPPL

SEQ ID NO: 145664 - protein, 303 aa, Heterodera glycines
  Coding regions on vcDNA: vcDNA=SeqID_72087; Strand=+; Position=1-912
  Homolog annotation: Hit_ID=NP_507780.1; Match level="QueryCoverage =98%, HitCoverage=18%, E-value=7e-27, Identity=27%"; Hit description =predicted CDS, DNA polymerase type B, organellar and viral family member (5T899) [Caenorhabditis elegans]
MALKIHATGFPSTCGSERQKDEYIEECWRNFGIHLEKEKMKPEPGKRYIAKLCLNSLWGRFSMRNLLSKAVINNDPCVLRQYTDDKKIDLMDIELMDEDNDVFMLTYKPKEEFVDENKYSNVVISLYTTSMARLYLYEVLKKVANTPGCEILYYDTDSIIYVHTEGNDPLPTGKGHLGELTDEKPDHNILEFISAGCKNYGLKLERKDNGEIEYDLKIRGITLDEQTVQTIHYDSVKDQIMRYGSDDPADPIIVTYPHFIRPNLIQGKVYTQSLTKHYQPVFTKGIINNAFQVLEFGYRNSRL

SEQ ID NO: 145665 - protein, 188 aa, Heterodera glycines
  Coding regions on vcDNA: vcDNA=SeqID_72088; Strand=+; Position=1 -192,945-1198,1381-1501
MGVHVHRGPPTDELLSSLKKPLLLILDDLLTIIDEKSLSELFIKKAHHLNIGVIFITQNLFERKELRRFLKLRKEIEDKPVKVELTDGSLMVFNPKQRERNMKIIPTQIVNDEGLDETGSMPTLEDPYTTAEESDAELTTTTTPKARPLARANIETVTRECSIAGWYKSVRATTEKRPEDQRNIKTKL

SEQ ID NO: 145666 - protein, 323 aa, Heterodera glycines
  Coding regions on vcDNA: vcDNA=SeqID_72089; Strand=+; Position=1 -310,422-1083
  Homolog annotation: Hit_ID=AAA93301.1; Match level="QueryCoverage =91%, HitCoverage=90%, E-value=4e-42, Identity=32%"; Hit description =HASI
MDKKKLLNKLYNDPNSPACYAGQERLYEEALKYDSSITRKDVEHFLEGDRTYTLHKPRRVRFKRSRTVPAGFMTDVQVDLADFQKLSRENSGFNYILLGIDVLNRGTEFENREIHKYFKDMNIQKHKAHTSTVKAALAERCIRTLKQRLYRYFSQKHTIKWVDVLPKLVNALNNSKSRITGMKPVDINPDNAQKIWERVYGDEHAQTTYRKPRFKEGDHVRLAKYKSSFEKSYLPNYSDEIFQVYDVKRGNPHRYGIKDDNEEPFDTRFYAEDLTKTRKDAETTYRIEKVLKTRTKKSGQKEHLVKFYGYKEPEWIKDRDIER

SEQ ID NO: 145667 - protein, 78 aa, Heterodera glycines
  Coding regions on vcDNA: vcDNA=SeqID_72090; Strand=+; Position=1 -131,457-562
MSIKNDQNRIICPIYYISKRKTTHISIKNGNAAVVEADDVFRLGLNMKNDTFELPLFFVRIDPGSGIDRMDGCRIPDR

SEQ ID NO: 145668 - protein, 53 aa, Heterodera glycines
  Coding regions on vcDNA: vcDNA=SeqID_72091; Strand=+; Position=1 -42,153-272
MKLPLPVCLVPVPPHLFICISGQVAKPSDFIISRLGSIPHLDRIFLTFSLPLF

SEQ ID NO: 145669 - protein, 225 aa, Heterodera glycines
  Coding regions on vcDNA: vcDNA=SeqID_72092; Strand=-; Position=1 -450,2193-2367,2476-2525
  Homolog annotation: Hit_ID=NP_701277.1; Match level="QueryCoverage =78%, HitCoverage=9%, E-value=1e-34, Identity=48%"; Hit description =hypothetical protein PF11_0418 [Plasmodium falciparum 3D7] gb|AAN36001.1| hypothetical protein [Plasmodium
MEEKVEEEQKVEEKVEEEQKVEEEQKMEEKVEEEQKVEEKVEEEQKVEEKVEEEQKVEEKVEEEQKVEEEQKMEEKVEEEQKVEEKVEEEQKVEEKVEEEQKVEEKVEEEQKVEEKVEEEQKVEEKVEEEQKMEEKVEEEQKVEEKVEEEEFYDQCSLSVKQQIWIRNESLFSEAIEPVLDAYIYEKERLLLSAANGTDKQTNFFTSEKLVSMVGQRDILYGRIT

SEQ ID NO: 145670 - protein, 52 aa, Heterodera glycines
  Coding regions on vcDNA: vcDNA=SeqID_72093; Strand=-; Position=1 -93,150-213
MVTDSKEDIVFFARVCEKARRYDDMTEAMKKMIQADANLNREERELLGTAYK

SEQ ID NO: 145671 - protein, 26 aa, Heterodera glycines
  Coding regions on vcDNA: vcDNA=SeqID_72094; Strand=+; Position=1-78
ALYLSRPTTVFTPSLHTLFCVVQNLK

SEQ ID NO: 145672 - protein, 22 aa, Heterodera glycines
  Coding regions on vcDNA: vcDNA=SeqID_72095; Strand=+; Position=1-69
PLYGTGANTLCVVNFMLILALF

SEQ ID NO: 145673 - protein, 56 aa, Heterodera glycines
  Coding regions on vcDNA: vcDNA=SeqID_72096; Strand=+; Position=1 -35,399-534
MTVLLTEFRSKRTILIESFKASCPYFWISKMQISQATSRRNAKAFNSGDANFTESQ

SEQ ID NO: 145674 - protein, 197 aa, Heterodera glycines
  Coding regions on vcDNA: vcDNA=SeqID_72097; Strand=+; Position=1 -261,963-1292
  Homolog annotation: Hit_ID=E86336; Match level="QueryCoverage=74%, HitCoverage=35%, E-value=2e-23, Identity=43%"; Hit description =hypothetical protein F14O10.11 - Arabidopsis thaliana gb|AAF88160.1| Contains weak similarity to an unknown pr
MFYLPWYLFKTKVVRTKDILVAQVNGHLLPYRTIEQMVGNWHYQFKALMEEEWHNANAEENANANNDEEDAQLEQQLPNPCEEAKLREQRTNTGNKLTMRMTNLEMRNGREGEEEEKCDDEAQGQDEEEEEEAEDEAEEEEEAEDEAEEEEEEEEEAEDEAEEEEEAEDEAEEEEEAEDEAEEEAEDEDGGEKGIAA

SEQ ID NO: 145675 - protein, 38 aa, Heterodera glycines
  Coding regions on vcDNA: vcDNA=SeqID_72098; Strand=+; Position=1-116
MEIDGIFPGIILTAPSPLRCAKRRLHFLSLSAIAPPHP

SEQ ID NO: 145676 - protein, 122 aa, Heterodera glycines
  Coding regions on vcDNA: vcDNA=SeqID_72099; Strand=-; Position=1 -90,384-662
MQLIGLKEAECGREWDKGLRGSLKSPVAQSSLLPLNSNIINNSILRLPPLHPLHHLRCSTNNNNLCWSSNSKTKWVVSRERHFWWFAEFWHFWWLSDFNGISSPHLFITTFFLFYFVVPRGA

SEQ ID NO: 145677 - protein, 67 aa, Heterodera glycines
  Coding regions on vcDNA: vcDNA=SeqID_72100; Strand=+; Position=1 -73,122-252
MITLTFCIHSRHGRLANRPEGADHPICSATPRPMALRFAVPKLKGEEIVPNFKRTVKEKRIFNYLEL

SEQ ID NO: 145678 - protein, 47 aa, Heterodera glycines
  Coding regions on vcDNA: vcDNA=SeqID_72101; Strand=-; Position=1-398
FLKLHYFIFLAKLIHKYFFRNCSETHQILITSYFRHSDAFNIKKGDE

SEQ ID NO: 145679 - protein, 92 aa, Heterodera glycines
  Coding regions on vcDNA: vcDNA=SeqID_72102; Strand=+; Position=1-304
MIGRAVRNRPFIFEGIFKFILYPRKMAISFFEKFYTSQMLLSMRRRAVRNRHFISQRIFIFRGYPRKMAISFFDKFYTHTNALEHDREGGAQ

SEQ ID NO: 145680 - protein, 38 aa, Heterodera glycines
  Coding regions on vcDNA: vcDNA=SeqID_72103; Strand=+; Position=1-114
KIPSKIKGLLRTALPIMLKSICMCIKFIKKRDSHFSGI

SEQ ID NO: 145681 - protein, 74 aa, Heterodera glycines
  Coding regions on vcDNA: vcDNA=SeqID_72104; Strand=-; Position=1 -67,489-646
MPTRLSTFWTKDAFSVRDCSASHPGPHLVRRPQRQGTARTFTVAGGIGTSGRHLQGEHGKGKFEKTKMSTIHFG

SEQ ID NO: 145682 - protein, 42 aa, Heterodera glycines
  Coding regions on vcDNA: vcDNA=SeqID_72105; Strand=-; Position=1 -60,537-605
MKSPSPGFSLAYLFVFLAFLIEIAEGICLNEKGLTFLQIKDD

SEQ ID NO: 145683 - protein, 82 aa, Heterodera glycines
  Coding regions on vcDNA: vcDNA=SeqID_72106; Strand=+; Position=1-249
MKNVKGLARLNYRTVSMLKFKFDAIDVDISFVSIPDKKKLPNILSEEFVQKYLDKFNSEENGKFEKQNRSLSSNFITKSKGN

SEQ ID NO: 145684 - protein, 152 aa, Heterodera glycines
  Coding regions on vcDNA: vcDNA=SeqID_72107; Strand=-; Position=1 -108,170-417,464-566
  Homolog annotation: Hit_ID=NP_502882.1; Match level="QueryCoverage =77%, HitCoverage=23%, E-value=4e-16, Identity=39%"; Hit description =DNA polymerase like family member (4Q408) [Caenorhabditis elegans] emb|CAB60306.1| Hypothetical protein Y
MERMKDWSKAEGHEPISAFVEWILKAWDNKYQTFIWAHNASRFDGHFVLKYLGETKRRPEVIMNGLKIFEFRLQHSRRHSKLTWRDSCLLMPIRLEEMPKTFSLSCADKPFFPYAFNRRENYNVHLQNLPDKEDYCPGSMKRDKYEKFIKWC

SEQ ID NO: 145685 - protein, 57 aa, Heterodera glycines
  Coding regions on vcDNA: vcDNA=SeqID_72108; Strand=-; Position=1-287
VSLFAFRLSHYSHFLAFRISLFTFRFLARNATFTPLRIGLNSHKIFQNFTYKLANFQ

SEQ ID NO: 145686 - protein, 119 aa, Heterodera glycines
  Coding regions on vcDNA: vcDNA=SeqID_72109; Strand=+; Position=1-494
VSILQQITLQIAEIVLIPYPFKKHTVSLTYTFCFPNFALRNSVFSSHSLHFSSHSLVVRWECHFLLLRRLCHRQRRRLFLAIRRSLLSHHFYSSQPLSTVLFVPEFSLNSMHNYYFLFI

SEQ ID NO: 145687 - protein, 71 aa, Heterodera glycines
  Coding regions on vcDNA: vcDNA=SeqID_72110; Strand=-; Position=1 -118,210-307
MCLNVNGKKKDKGKKHHGTEQAEDDVEEEEEENGEGKGRAIQQITYYTKHYDYFWESINIIMNSMNNCVII

SEQ ID NO: 145688 - protein, 58 aa, Heterodera glycines
  Coding regions on vcDNA: vcDNA=SeqID_72111; Strand=-; Position=1 -122,320-374
MPFVQKTTQKTEADKSELPPRVIAELYACLNLTCLLHYFGGRIVGTRSVSHQPEYELK

SEQ ID NO: 145689 - protein, 184 aa, Heterodera glycines
  Coding regions on vcDNA: vcDNA=SeqID_72112; Strand=+; Position=1 -301,350-475,535-661
MISPHLSHIPPHYSHVNKISNPTPPPPPLRQLRQQRLVAAVQRKTEATAAKGRWLYELDAKKYAKNALRQQRINLKNGPLYCAGCHALGNHVISDCPMDKGRYAAASEDAAHQAEDCVLFCRCQCCKLRGHKPKDCETLMAWREHLAMASAGKKHTFLLGHKRFSSRTYMEEHAVSAASAWEGH

SEQ ID NO: 145690 - protein, 94 aa, Heterodera glycines
  Coding regions on vcDNA: vcDNA=SeqID_72113; Strand=-; Position=1-285
MVPKNIGSETHLGNETTPAIKRLAMKRRAMKRLTMKGRQRNGGNESSPTGKWEEKRNDQNQNKEETREIIIRKFNKIKEKIKKKGKKYSTKRME

SEQ ID NO: 145691 - protein, 112 aa, Heterodera glycines
  Coding regions on vcDNA: vcDNA=SeqID_72114; Strand=-; Position=1 -47,561-653,962-1160
MRSHFGGTRNQQIGRWSSFRHAQKCRHNSTDANGAEWQAEFTCETKRHKTPTASSPYEKQPENTEECIPAPLACNSYADCADNEADLHPRRQLAHGCQRKLIHIPINSIMAK

SEQ ID NO: 145692 - protein, 71 aa, Heterodera glycines
  Coding regions on vcDNA: vcDNA=SeqID_72115; Strand=+; Position=1-558
RRILAPHTLFESPQTTSVKNKIYFRFRGSPPDPMPPRFMGSLESFGNSFPIVCTLILRWIFAPHKCLSTPN

SEQ ID NO: 145693 - protein, 41 aa, Heterodera glycines
  Coding regions on vcDNA: vcDNA=SeqID_72116; Strand=+; Position=1 -55,914-984
MPNTFNLYVNIQMFNGLDKKTSGEHEKAGEVENNQINDESP

SEQ ID NO: 145694 - protein, 177 aa, Heterodera glycines
  Coding regions on vcDNA: vcDNA=SeqID_72117; Strand=-; Position=1 -307,347-573
  Homolog annotation: Hit_ID=NP_504186.1; Match level="QueryCoverage =92%, HitCoverage=21%, E-value=3e-12, Identity=25%"; Hit description =vglm uuk m polyprotein like family member (5E780) [Caenorhabditis elegans] gb|AAB63927.1| Hypothetical pr
MPDLVHSGAEVISIQSTSEDCERQSNGSVCRVSGTTELTILPAGQKVSLALKDDKGKIMGSLELILQFLRLHCNQQTLKWLRSYKINVISKRRCPTMGSCTKKMEDYENFPGTNFCKKGDAIWGHKCALPSSECFFYRTYAEPTSNTIWELIRCTGWDYELKMRLTLTIGNDTKSKI

SEQ ID NO: 145695 - protein, 183 aa, Heterodera glycines
  Coding regions on vcDNA: vcDNA=SeqID_72118; Strand=+; Position=1 -241,396-563,670-812
MEMQHFLLNALVYEHDSTVRQQSAQMAFKIATDCVDFKSKLITLFNEMAPKVKYGIVHLYRLFLCLKIDQRELDLQFIGNDDGLKILFTRTKLEQGELSILYKSELVDFLSYCVEVNEKLLQFGGSDCEAQCVTVSELHLLFENFSSSTEDGENDDEFLFWSDTQKKQLSIYSNGIIVNTWHF

SEQ ID NO: 145696 - protein, 150 aa, Heterodera glycines
  Coding regions on vcDNA: vcDNA=SeqID_72119; Strand=-; Position=1 -390,454-516
MWPNIDPTEWQTMLWHFDQNLANAAMDAEEGQKEANEGGIEDGKGEGEEEEEQNEDQEIKLLRELGEKEGQGRAQFGDRERHAELGKKFSLLKKSTTNDGAAHGMVNFCVIYRPFLVFGSQSVDILLFIRGLLEGHFNAKTMDDYLENGK

SEQ ID NO: 145697 - protein, 26 aa, Heterodera glycines
  Coding regions on vcDNA: vcDNA=SeqID_72120; Strand=+; Position=1 -3,259-336
MEEQSLILDWIEHKKTEIEANKVKNK

SEQ ID NO: 145698 - protein, 67 aa, Heterodera glycines
  Coding regions on vcDNA: vcDNA=SeqID_72121; Strand=+; Position=1 -69,158-292
MKRTKFYLHVSLGTLMLFLSIMESNLLKTVQNSIKITFTVRKMGFDKFIGEKKTLQNNTPGRREWET

SEQ ID NO: 145699 - protein, 24 aa, Heterodera glycines
  Coding regions on vcDNA: vcDNA=SeqID_72122; Strand=+; Position=1 -52,293-315
MEKACKIWRDYIDFSALELLELAS

SEQ ID NO: 145700 - protein, 78 aa, Heterodera glycines
  Coding regions on vcDNA: vcDNA=SeqID_72123; Strand=-; Position=1-235
MAFCQNCFVACAKAANAMQTTIVMSAFSHWIYSGRPPLNGAIEIVHFWIELFSKRTATNDIRRMCRWPEIDKNLFRRI

SEQ ID NO: 145701 - protein, 26 aa, Heterodera glycines
  Coding regions on vcDNA: vcDNA=SeqID_72124; Strand=+; Position=1 -14,330-396
MNVFCLFIWFLCSLREIIMPMLRLNV

SEQ ID NO: 145702 - protein, 197 aa, Heterodera glycines
  Coding regions on vcDNA: vcDNA=SeqID_72125; Strand=+; Position=1 -371,724-782,993-1119,2008-2044
  Homolog annotation: Hit_ID=NP_001004509.1; Match level="QueryCoverage= 88%, HitCoverage=10%, E-value=2e-12, Identity=29%"; Hit description =si:busm1-180o5.3 [Danio rerio] emb|CAD60788.1| novel protein similar to DNA polymerases [Danio rerio]
MWSGQEHGTTLTNCPLLKVWVIPPRKCDVPVLPVKVNERLCFPLCMQCCLDYPKGGVDFDYHCEHDDQQRGWVTTCTSIELDAALNEGYRVTKVFRVLRYKHGDDKLFRPYIAEFMSQEIEASGHLTLDNIKVTPSAVESDAEVWTQTPGNGQDEFVLKLRGITLNYDVMQNQSLCYDTFKEEVLRIFWGVQIVMKD

SEQ ID NO: 145703 - protein, 29 aa, Heterodera glycines
  Coding regions on vcDNA: vcDNA=SeqID_72126; Strand=+; Position=1-89
VPIPVPVFGKTEIPVPVLPVPVPAGLNKH

SEQ ID NO: 145704 - protein, 95 aa, Heterodera glycines; identical to SEQ ID NO: 129573
  Coding regions on vcDNA: vcDNA=SeqID_72127; Strand=-; Position=1-819

SEQ ID NO: 145705 - protein, 55 aa, Heterodera glycines
  Coding regions on vcDNA: vcDNA=SeqID_72128; Strand=+; Position=1-168
LLIIQYNAFKPRREAGQFQNFVPHFTVESPSTLLDNYVSMSTVAFGQLCTISFQN

SEQ ID NO: 145706 - protein, 107 aa, Heterodera glycines
  Coding regions on vcDNA: vcDNA=SeqID_72129; Strand=-; Position=1 -197,560-683
  Homolog annotation: Hit_ID=P11084; Match level="QueryCoverage=45%, HitCoverage=15%, E-value=3e-13, Identity=71%"; Hit description =Serine/threonine protein phosphatase 4 catalytic subunit (PP4C) (Pp4) (Protein phosphatase X) (PP-X) pir||PARB
METENDATASPNRPLSAASVATSTALRDGGEADNSDAQQHQQATRELDEAVTLAAGRGARITDLDRQIETLMRCECLTEQEVKVLCAKAREILLQEGNVQRIDAPVT

SEQ ID NO: 145707 - protein, 330 aa, Heterodera glycines
  Coding regions on vcDNA: vcDNA=SeqID_72130; Strand=+; Position=1 -156,463-544,598-632,782-821,977-1085,1128-1280,1385-1436,1493 -1577,2471-2631
  Homolog annotation: Hit_ID=CAE60870.1; Match level="QueryCoverage =91%, HitCoverage=45%, E-value=6e-72, Identity=48%"; Hit description =Hypothetical protein CBG04581 [Caenorhabditis briggsae]
KTGQRPTHCFCGTARLQKASASLTQILWVVLIILIGVFFTVATTIGNALVMLSICVDKKLQTISNYFLFSLAAADLTVGIVSIPLMTLYTGIVSIPLMTLYTAQSWGFGYALCQFWLCIDYLMCNASALNLLLISFDRYFSVTRPLTYRPKRTTRKALSMIAGSYLLSLLLWPPWIKRTTRKALSMIAGSYLLSLLLWPPWIVLWPYLEGRFIVEESAICVVQVVIINQLVTVATAAAAFYIPVTMMIIMMIILYYKVYLETKLRRKELRKLQDGQATRRSLHRPRQSLKIGQSVKKRPKLSRVGQHLSPTQSTFGRYFQFIRNTYNKSY

SEQ ID NO: 145708 - protein, 354 aa, Heterodera glycines
  Coding regions on vcDNA: vcDNA=SeqID_72131; Strand=-; Position=1-1079
  Homolog annotation: Hit_ID=XP_318550.1; Match level="QueryCoverage =98%, HitCoverage=37%, E-value=3e-93, Identity=47%"; Hit description =ENSANGP00000020240 [Anopheles gambiae]
QCSVNRLLRWSLILLAYDFKIEYVKTTDFGQADALSRLIAKGGEEENERVIALVTAEPILEESLHSASKNLPIKFEDLVIASKNDANIQNVIKFIRQGWPTEKQIEKESDIKLFHRRKSDLTILKGCLMYGERVVIPRIFQAKILRLFHKGHPGMKRMKQLARQYIFWPKLDKEIEDYVQNCEPCQLAAKAPIKTDLHSWPKPTGPWQRIHIDFAGPFFGKTFLIVVDSFSKYPEVFEMANSSATSTIEKLRYLFTRHGIPETIVSDNGTQFSSSEFAKFVAANGITHLFSAPYNPMSNGQVERFVDTFKRAFRKLKGEGKPNKEIIDIFLISYRTTPTNLKGPAELLLGRRPR

SEQ ID NO: 145709 - protein, 332 aa, Heterodera glycines
  misc_feature (1)..(1): Xaa can be any naturally occurring amino acid
  misc_feature (10)..(10): Xaa can be any naturally occurring amino acid
  Coding regions on vcDNA: vcDNA=SeqID_72132; Strand=+; Position=1-1019
  Homolog annotation: Hit_ID=NP_912739.1; Match level="QueryCoverage =84%, HitCoverage=23%, E-value=1e-42, Identity=36%"; Hit description =unnamed protein product [Oryza sativa (japonica cultivar-group)]
XISPGPAKSXAASNAPLPLNSDQQTVFDAVVKAIQSDPRDATVPRRFFIFGDGGTGKTFLFGQIIRRLRKDTYKVLATASTGCAAILLPYGKTAHSTFRLGREVSLDKLPSIPLESFFARRIREAQLIIIDEITMLHNTVIEVIDRVCKEMASPAQGLLFGGKTVIFSGDFKQSLPVVPHEGLTAQVTACFQTNPLFGQFTTMKLTINQRLGQGQQAYLQMCRQIGLGETGEHFWIPPQFLVKSRELIDFVYPNFQQLLGNDKELLNRLILAPHIDTCDEINEIMMANVPGQVREYLSSDKRLTSVHWTSTESEVAALNRRTDSGMLPHVCD

SEQ ID NO: 145710 - protein, 59 aa, Heterodera glycines
  Coding regions on vcDNA: vcDNA=SeqID_72133; Strand=+; Position=1 -133,409-455
MRKFRSPHSLLVGIAVGVFLGLCISLLDNKSKIYIAFTEEDTQKVKRMLSRPTNYCATR

SEQ ID NO: 145711 - protein, 92 aa, Heterodera glycines
  Coding regions on vcDNA: vcDNA=SeqID_72134; Strand=+; Position=1-304
MIGRAVRNRPFIFEGIFKFILYPRKMAISFFEKFYTSQKRLRMRRRAVHNRHIISQRIFIFRGYPRKMDISFFDKFYTHTNALEHDREGGAQ

SEQ ID NO: 145712 - protein, 18 aa, Heterodera glycines
  Coding regions on vcDNA: vcDNA=SeqID_72135; Strand=+; Position=1-56
YREAIPEGFGLPINLGAS

SEQ ID NO: 145713 - protein, 81 aa, Heterodera glycines
  Coding regions on vcDNA: vcDNA=SeqID_72136; Strand=+; Position=1 -102,184-327
MCANISYLWDQERIIVEIEKLVALHGTNHRESREENVWPFEMERQAKAALGIVEITDPYAYNKTANTINSAVSERGPEKYL

SEQ ID NO: 145714 - protein, 32 aa, Heterodera glycines; identical to SEQ ID NO: 127531
  Coding regions on vcDNA: vcDNA=SeqID_72137; Strand=-; Position=1-244

SEQ ID NO: 145715 - protein, 144 aa, Heterodera glycines
  Coding regions on vcDNA: vcDNA=SeqID_72138; Strand=+; Position=1 -407,759-786
MANDLLNANQAFDQLRSQLATAPANDLNPKINHAKNGLNDDEEDERFSLIEDQEFPPRDGFDLDQLSAVDRGLINIASKLFKFLPRIAGKIGQLFSKNVHYIVNSASNLVIFKLNEEQQKKYNLPERLEVPLTPGNTAVAKIAE

SEQ ID NO: 145716 - protein, 226 aa, Heterodera glycines
  Coding regions on vcDNA: vcDNA=SeqID_72139; Strand=+; Position=1 -517,562-725
MIKTFSKVFRVIKRMKLISKREKEKVIKIELNERNENSQSAVDQMGEEMENDPNDQQKTEIIQKFDAIKEKLREKGKFEWKNQSKIERKIAKLLGTNRQLIQKWKNELNLNKNKIKKEFYEMKKSEFIERFDEFKELYGQGKQKEFAKELGICERTFRIWKKELAQKYHKSQKHHTNNDKLKKMKHYLQIKEANPKISDELIANKLGIGWTTLKRWKKECSHPFDQ

SEQ ID NO: 145717 - protein, 147 aa, Heterodera glycines
  Coding regions on vcDNA: vcDNA=SeqID_72140; Strand=+; Position=1 -171,905-1177
MTTWTRERLEEERRLHSVVVVNLPESEETVPSARVNSDFVNAQSMLDTCEIECRPCQINGAKRLRIALLYRPPNTSASLTKKILNLIGNYLEENFIIMGDFNLNAKDITWTSGTPFAKSEKGNIFCEFFNVWLIPYDERTNSRQCLA

SEQ ID NO: 145718 - protein, 104 aa, Heterodera glycines
  Coding regions on vcDNA: vcDNA=SeqID_72141; Strand=+; Position=1-438
NGVSKNRNYAQKAPQTILALPIPSTIAFIHPIMSAKIIRVPKIACHLSLAKNGVSKNRNYAQKAPQTILALPIPSTIAFIHPIMSAKIIRVPKIACDLSLEKMV

SEQ ID NO: 145719 - protein, 21 aa, Heterodera glycines
  Coding regions on vcDNA: vcDNA=SeqID_72142; Strand=+; Position=1 -54,424-435
MRTRPIWQVKQRLLTSQKKGF

SEQ ID NO: 145720 - protein, 77 aa, Heterodera glycines
  Coding regions on vcDNA: vcDNA=SeqID_72143; Strand=-; Position=1-234
MKNFQSVDLSLFARPNKAKAREPSLCAPPHSNSSRGQTEVWTKLLDGPSVGYCSYSDEQYEGGGIAVFEVVGAIVQR

SEQ ID NO: 145721 - protein, 86 aa, Heterodera glycines
  Coding regions on vcDNA: vcDNA=SeqID_72144; Strand=-; Position=1-263
RDSRLLIPGNTPPVVIKILYIFNTANATQRNDSEANDRRRRNGGGARDDEWHKRSNRRHSEQKEGNQRHTVVIDDDGRMNQLFAQF

SEQ ID NO: 145722 - protein, 182 aa, Heterodera glycines
  Coding regions on vcDNA: vcDNA=SeqID_72145; Strand=+; Position=1-548
  Homolog annotation: Hit_ID=XP_345024.1; Match level="QueryCoverage =93%, HitCoverage=87%, E-value=2e-14, Identity=26%"; Hit description =similar to SPAC23A1.17 [Rattus norvegicus]
AFQSLGLNSAFQSLALNPPAFQSLGLNPPAFQSLGLNPPAFQSLALNPPAFQSLGLNSAFQSLALNPPAFQSLALNPPAFQSLGLDSAFQSLALNPPAFQSLGLNPPAFQSLGLNSPAFQSLVLNSPVFQSLGLNPPTFQSTGLNPLAFQSLGLNPPEFQSLGLNPPAFQSLGLNPPTFQSL

SEQ ID NO: 145723 - protein, 47 aa, Heterodera glycines
  Coding regions on vcDNA: vcDNA=SeqID_72146; Strand=-; Position=1 -127,281-297
MPSSPKHSSLPSSPKHHSSEDETEVKQSPPHHHSSSDSEKEEQKLHA

SEQ ID NO: 145724 - protein, 46 aa, Heterodera glycines
  Coding regions on vcDNA: vcDNA=SeqID_72147; Strand=+; Position=1 -10,329-459
MFLSSSEEDEEECLGDDGFTAGDDEEGCCGDCARPWTSNFFIKYKK

SEQ ID NO: 145725 - protein, 180 aa, Heterodera glycines
  Coding regions on vcDNA: vcDNA=SeqID_72148; Strand=+; Position=1 -61,123-190,981-1100,1406-1525,1634-1807
  Homolog annotation: Hit_ID=AAL78211.1; Match level="QueryCoverage =58%, HitCoverage=100%, E-value=2e-32, Identity=76%"; Hit description= putative salivary proline-rich glycoprotein precursor Hgg-15 [Heterodera glycines]
MRTFLFIAVVGLVLAVIMESVNATGNNSPTKGDDDKLLFTIINDKLRLAVRKVGTAATNRQRRRTVPVRHTARSMVTNRTMLPDKRRLAVRKVGTATTNRQRRRTVPVRHTARSMVTNRKMLPSATGPGIFAKTGTGTCRNLRSRDRDLDFFSGPGPGPQEKPGTGTNREILKIQKNFKN

SEQ ID NO: 145726 - protein, 19 aa, Heterodera glycines
  Coding regions on vcDNA: vcDNA=SeqID_72149; Strand=-; Position=1-59
KNSNFNLYQVKIIQNYLVF

SEQ ID NO: 145727 - protein, 54 aa, Heterodera glycines
  Coding regions on vcDNA: vcDNA=SeqID_72150; Strand=+; Position=1-162
FLFSSFFSMQICTTLGNFIEVVKVSKGTIAVYRITYLPANVGTSHKCFSTSTSV

SEQ ID NO: 145728 - protein, 87 aa, Heterodera glycines
  Coding regions on vcDNA: vcDNA=SeqID_72151; Strand=+; Position=1 -94,185-241,595-707
MHTFCARAIYHRACQSKAKQQRCCFERIKGIESVHRLLEKYICNLSTILRKSVHRLLEKYICNLSTILRSELEMINFTIQTNFRCSN

SEQ ID NO: 145729 - protein, 177 aa, Heterodera glycines
  Coding regions on vcDNA: vcDNA=SeqID_72152; Strand=+; Position=1 -50,483-675,718-1008
MRNKNDGSAPFRNTQNRTPIIARAIIRDDKLFFTKAEHHNDCMAHSLEFLESEQIELSQRRKILECTEIWQNVDPKSLWAEGRGIAMKKDVELGKDIENDTSYSLNYPTWQNIRRTYLRRKDRAIAHGQTVKEDPFDIPEKLQLTRFGSLKLMLGKSIASNDLYDYFNQGFPCKIIP

SEQ ID NO: 145730 - protein, 87 aa, Heterodera glycines; identical to SEQ ID NO: 129152
  Coding regions on vcDNA: vcDNA=SeqID_72153; Strand=-; Position=1-576

SEQ ID NO: 145731 - protein, 92 aa, Heterodera glycines; identical to SEQ ID NO: 127421
  Coding regions on vcDNA: vcDNA=SeqID_72154; Strand=+; Position=1-304

SEQ ID NO: 145732 - protein, 198 aa, Heterodera glycines
  Coding regions on vcDNA: vcDNA=SeqID_72155; Strand=+; Position=1 -427,808-979
  Homolog annotation: Hit_ID=EAL44741.1; Match level="QueryCoverage =59%, HitCoverage=82%, E-value=1e-14, Identity=34%"; Hit description =hypothetical protein 244.t00012 [Entamoeba histolytica HM-1:IMSS]
EEDEEDDEMENGGGAGSQAASSLYHHRARENSSTSMDRLQRERTASGGGSGRRGGVGSSAAERSTQAASAVAAASAAGDDDDEEEEAMGTNNEEEQEQQHDIGAVEDEHDEEDEDARQGGGGRGDWGGREEEEQAVHLFCKSEHEMEEDEEDEPYFDVHDDEDDDDDDDDDEDDDDDDASSVKIFQPSEKNFHIYVFF

SEQ ID NO: 145733 - protein, 150 aa, Heterodera glycines
  Coding regions on vcDNA: vcDNA=SeqID_72156; Strand=+; Position=1 -147,806-1109
MVSPWAGTERDEIGGAQPSATGTGGALGSTSTSTTTNAIDAQQQFPGGGQHRPISRHPGTGPGAGVAGGTGATNSSIAAAAIAAATGADTAAAQQRRFRKKGDAGGGGGGGRKPPGASGSADSDVAEHGAARADFFAYFMSLMRSYSAES

SEQ ID NO: 145734 - protein, 79 aa, Heterodera glycines
  Coding regions on vcDNA: vcDNA=SeqID_72157; Strand=+; Position=1 -105,158-290
  Homolog annotation: Hit_ID=CAE70749.1; Match level="QueryCoverage =97%, HitCoverage=10%, E-value=2e-22, Identity=66%"; Hit description =Hypothetical protein CBG17495 [Caenorhabditis briggsae]
MTQRTPVKPKTVNPLFQSKFNFFVKQPEGQELKIRAVDEGTKRDIGELSIPLAAVMREPMMEMSQQSFYLTHGVHSSPN

SEQ ID NO: 145735 - protein, 300 aa, Heterodera glycines
  Coding regions on vcDNA: vcDNA=SeqID_72158; Strand=+; Position=1-902
  Homolog annotation: Hit_ID=AAF36548.1; Match level="QueryCoverage =97%, HitCoverage=92%, E-value=2e-29, Identity=35%"; Hit description =82-kDa surface lipoprotein precursor [Mycoplasma hyorhinis]
VEQHEDDANATTVSSSTEETAGTAKLLEQEDDANATTASSSTDETAVTAKVELQEDDANATTASSSTEETAVTAKVEQQEDDANETTGSSSTEETAVTAKIEQQEDDVNATTASSSTEETAVTVKVEQQEDDANTTTASSSTEETAVAVKVEQQEDDANTTTASSSTEETAVTVKLEQQEDDANATTASSSTEETAVTAKMEEQEDDANATTASSSTEETAVTVKLEQQEDDANATTASSSTDETAVTAKVEEQKDDANATKASSSTQETAVTAKMEEQEDDANATTASSSTEETAVTAK

SEQ ID NO: 145736 - protein, 25 aa, Heterodera glycines
  Coding regions on vcDNA: vcDNA=SeqID_72159; Strand=-; Position=1-77
MHGTFIQSEQNEECKWGRSRRIMTH

SEQ ID NO: 145737 - protein, 981 aa, Heterodera glycines
  Coding regions on vcDNA: vcDNA=SeqID_72160; Strand=-; Position=1-2946
  Homolog annotation: Hit_ID=ZP_00089267.1; Match level="QueryCoverage =30%, HitCoverage=65%, E-value=6e-09, Identity=23%"; Hit description =COG0810: Periplasmic protein TonB, links inner and outer membranes [Azotobacter vinelandii]
MPVKSGRSESFDQAEIDTNCTIECSGGKSKFRVKGHLIYVPIQQQIEMGVRISDTLKSPKGIGWPDLNFDWIDIIRFMAGFPNIIVIILAGILAGAVIILIIRCNPAFIVWRRIARWIMLILMIQMMEESREYGENEFLKVPPGGMGVAHRTFSNIKYVAESDWLEVPLKGHGKTDPHSFYSILIFSPKMNSNISSDSNLLYILSRHVKMQPHLLARAIRGIPGTRTQIEEKLESIQESGAKLVTTHLKPENANMILFGTTITAHGADELGAFNGRGPTVIQYFRTRHNRNLMFPEAPCLCEKGGRNHVSYYPLELIEVRETFDRDPPFDFGTRMPWDDNPETVNTGPQEGEKSPKRLSISSKGSSITVEYHGTPQSGAGNPMEGISPDNHSVIIQEIDSNSPTGNPVEMRGDPPRSEERSIVMNVPANSKIELIGPLKCKIILLVLSAFIMIHSVGAKELPSALIHLPSRGPSSLKMREAPMNQIFLHGFGGDVHPGSEEEAVNHGPMSAVDGDASFRMKGTNMSHPFLCAYGMNQGHKIVSSALWRQLYKEEGNGQKVTYISLFLPLISTELLPNMDIEKLLDESEEFVQQQQQHHQQQQQQQQQQQQKQQVVRFVKIDEESDNEALRIDISESESEEEDDDDEEEAAAALEAAVASAAPSPVVQEAKKPRIQGPMEAPKTKRVAAAEGPFVKRARIEGPLNAQKSRCNKCGLLGHLSGDEARCPKTNALVKAEMDRKKAAAFAKRAEATMECSAPPIIQLPVKGGGQARAARAGGVAASMVAGGRASAEGAFRASKERARQELMAAMEKPKAAAISLAEKKAAARPGLQVPMETNAVLNGLSEIGARIDRERDNHLSMAEELQQRGKRAVAALDEVIAQGAQIGQMYVEWTRKLGEVLKANEQERADRDALEHRQAAAFMQSLRLKISVLRRELSSPPGVSPLATERVEIGGQPGGSLGGQPGGPLGGPFGGPPGGKK

SEQ ID NO: 145738 - protein, 63 aa, Heterodera glycines; identical to SEQ ID NO: 134588
  Coding regions on vcDNA: vcDNA=SeqID_72161; Strand=-; Position=1-502

SEQ ID NO: 145739 - protein, 927 aa, Heterodera glycines
  Coding regions on vcDNA: vcDNA=SeqID_72162; Strand=-; Position=1-2784
  Homolog annotation: Hit_ID=NP_508324.1; Match level="QueryCoverage =93%, HitCoverage=31%, E-value=1e-106, Identity=31%"; Hit description= predicted CDS, peptidase family A16 and RNA-directed DNA polymerase and Integrase, catalytic domain and
MTSCKDAGEVLKKYREGKALFAEAQMNLRELICNSMKAMEQIPEEDRLNKPGTKVLGIPWDIQKDELSIGFPPTNEAGKISKRIVLKTLASIFDPLGMVAPCLLQAKLFLQRLWDRTLGWDEILPADETAEWFAVIREWKTEPFKFPRRSVLQDEMVQLHAFVDASKDAYAAALFIRSQKGEETNVQLLYAKSRLKPRKAEVTIPRMELLAMLIGARMLKFAENQLRIPINEKFIWGDSKPVLSWIESKDSQPRFVENRLREIRRISENARFLHIRTHENPADVASRGCTPEELRSHHLWWNGPTWLREPMKSWPIDFEVTPKGAMKDGQESSELDNVVAVSATTSEDNPWIDPCRFSSWTKLRRTVVWFLRAINKMRKTRIFEISEGVPMSSEDYQYAEILLVKMAQKCWPMWKKQPQELVKTSRKNGLVRLSTRLAMSNASEDMVNPIILPENCPITRLIAQSVHESLAHSGVESTLTEFMGKYWTPRARLTIKKVIRACGRCRRIQCPAYKLPTMPPLPEDRVRRTAPFESIGIDYLGPTNTKINGELQKAWIALFTCLSTRAIYLEPVLDLSAEAFLQVFRRFTSRRGTPKRIITDNGTQFVLAAKVAAALEAGKTPTCPLEEHLANEGIKWRFNPSLRPWSNGFLERQVAGVKAAFKRVLGRRILPYDQLRTFVAEVEATINQRPITYVDEGPNAVQPLRPVDFIMPKAILSLDVRRNQQSSDTEFENEPKNLQKQLQMRWEGTLATLDEFWTRWKKEYLLMLRNRLQWEHKGPRSCLADQPKIGEVVIIEEEKTPRNCWPLGRIVELQGSDNIVRSAKLKIPKANGERISWREISRPINRLYRLEVPKVDESEDQEEEEVPNGKIGLQEPIPKKDGKQAERARNVQQGQIRNHGMMTRSMTKAASILGLMFMLVIWTTFVL

SEQ ID NO: 145740 - protein, 354 aa, Heterodera glycines
  Coding regions on vcDNA: vcDNA=SeqID_72163; Strand=-; Position=1-1065
  Homolog annotation: Hit_ID=GNVUUK; Match level="QueryCoverage=78%, HitCoverage=27%, E-value=3e-10, Identity=22%"; Hit description =glycoprotein precursor - Uukuniemi virus
MEMSLIPGITFKWKEVKLTPVAVSQAPVPILGHKFLSDGTSFSMVDQVNTNLLCQDREIASNFSGCTLSKEACPKCWVDEEAQRVDCQCRDSILEKEFNNPEKRLPLSLRNLNIRYKDGEIFSETHYTPIQVMVQFEGLRLGIEEDFTKCWAQTKTLKGCYKCQSGAQLKLRCWTEYGSALADVYCVDGTRFTVPCRSKAEDQNVILSFDQAEIDTNCTIECSGGKSKFRMKGHLIYVPIQQQIEMGVRISDTLKSPKGIGWPDLNFDWIDIIRFMAGFPNIIVIILAGILAVAVIILIIRCNPAFIVWRKIARWIMLILMIQMMEESREYGENEFLKVPPGWDGRGPSNILEH

SEQ ID NO: 145741 - protein, 124 aa, Heterodera glycines
  Coding regions on vcDNA: vcDNA=SeqID_72164; Strand=-; Position=1 -275,556-655
MAKILGEMQNAKIFVRPSDPKILLSVLLLLTNRNEQFTEETQISVKENYCSLANFVKNLLEKANVVEYLQKNDENIEHFFIRYSTELCTVERIMHEFSNNTIDANFFEHIEFNLNLTNGIVCCR

SEQ ID NO: 145742 - protein, 56 aa, Heterodera glycines
  Coding regions on vcDNA: vcDNA=SeqID_72165; Strand=-; Position=1 -53,231-348
MAGKLIVTVLPSSGERYLTSALYSDIRAEMEAMSHVETLEDNLKRLLKVEDANSKQ

SEQ ID NO: 145743 - protein, 235 aa, Heterodera glycines
  misc_feature (7)..(7): Xaa can be any naturally occurring amino acid
  misc_feature (195)..(195): Xaa can be any naturally occurring amino acid
  misc_feature (219)..(219): Xaa can be any naturally occurring amino acid
  Coding regions on vcDNA: vcDNA=SeqID_72166; Strand=-; Position=1 -27,1417-1542,1729-1803,1926-1964,2009-2056,2151-2220,2337-2594
  Homolog annotation: Hit_ID=XP_469737.1; Match level="QueryCoverage =80%, HitCoverage=51%, E-value=2e-54, Identity=56%"; Hit description =cysteine synthase [Oryza sativa (japonica cultivar-group)] gb|AAK71541.1| cysteine synthase [Oryza sativa
LRQSVSXQNRTLLRAFNAELVLTDPALGVKGSVERAEQLAAAIPNSFIPMQFANEANPEIHYRTTGPEIWRQTHGKVDACVFGIGTGGTITGSGRFLREKNPAITGSGRFLREKNPAIKFYAVEPVFYAVEPVESPVLSGGKPNPHKIQGIGAGIVPPILDTKMYEEVVLVHSDEAIAMAKRLAREEGLLSGNTXNFLKINYFCKIHIYKNEFILFKTXFEYVIKYVTNFSYLHY

SEQ ID NO: 145744 - protein, 54 aa, Heterodera glycines
  Coding regions on vcDNA: vcDNA=SeqID_72167; Strand=+; Position=1-218
ARGNIKGIFVFSDPENPKNPKLDSFCFYKFEKFWTFRGFLLFWTFRGLDTLWGC

SEQ ID NO: 145745 - protein, 31 aa, Heterodera glycines
  Coding regions on vcDNA: vcDNA=SeqID_72168; Strand=-; Position=1-96
NSGTPSRQAAAPGKQNKNTPEARTNGQSPKK

SEQ ID NO: 145746 - protein, 21 aa, Heterodera glycines
  Coding regions on vcDNA: vcDNA=SeqID_72169; Strand=+; Position=1 -54,579-590
MRTRPIWQVKQRLLTSQKKGF

SEQ ID NO: 145747 - protein, 76 aa, Heterodera glycines
  Coding regions on vcDNA: vcDNA=SeqID_72170; Strand=-; Position=1-231
EKNIYETKKSIFSSVRLGYSNIYGEQKSTQNKVQAIGKLFPKDRSPHKSGRIGSGGLPRKQKKSIFSSVRLGYSNI

SEQ ID NO: 145748 - protein, 158 aa, Heterodera glycines
  Coding regions on vcDNA: vcDNA=SeqID_72171; Strand=+; Position=1-474
  Homolog annotation: Hit_ID=YP_049525.1; Match level="QueryCoverage =97%, HitCoverage=21%, E-value=3e-45, Identity=62%"; Hit description =tyrosine-protein kinase [Erwinia carotovora subsp. atroseptica SCRI1043] emb|CAG74329.1| tyrosine-protein
SHDAYELSYSGDKILEGVVGKLATGHGVSILVSDFRGSDGTGFTLKKRPRLDAINDLVDRLTVADKGKDTGILALSLTGDDSVQIRKILNSIINNYLQQNVERKSEEAGKSLEFLKAQLPQVRQNLDLAENKLNQFRQQNDSVDLSLEAKSVLDTMVA

SEQ ID NO: 145749 - protein, 18 aa, Heterodera glycines
  Coding regions on vcDNA: vcDNA=SeqID_72172; Strand=+; Position=1-57
CVCGTLTIMGSKNPMQNY

SEQ ID NO: 145750 - protein, 254 aa, Heterodera glycines
  Coding regions on vcDNA: vcDNA=SeqID_72173; Strand=-; Position=1 -220,1659-1852,1949-2107,2594-2645,2740-2879
MPLGVSSSSDSVVTSVSDETVAAASPSASFVDKLGKRWTFLAKLAVFGGAAGGGSSASPPPNFNTSGGSRSTRNTDQSAYDSDHSAAYRPRTKRTAFGNNFEVRIKRSAFVKARASISSGVQADQQPELKIVTKTDEGSPSVYKFASKNWHFLTDSIWNKKSLTDFCKENMLRVAGGIITNTYRNRLLCVRSGCPFRALWLNRQGLVYVPPVVKEELIDGEFKLADLEKEIQALAKRLSLLFRIEKSVKIWHLN

SEQ ID NO: 145751 - protein, 160 aa, Heterodera glycines
  Coding regions on vcDNA: vcDNA=SeqID_72174; Strand=-; Position=1 -243,597-836
MARVRFSDLCHKSSEDEKFEMEENGGKEREEEEEEERTMLEEDMEEEEERMEEEEDNAKEQIRPNSTARQRTPKGAVRGKKRNGHFRYWLPLGKISGAIDEVCREVCQLHYVHKSGIAKNGKFYFRCSNVKCNYKWVLGRPQIERERESYLINFCCQNNR

SEQ ID NO: 145752 - protein, 92 aa, Heterodera glycines; identical to SEQ ID NO: 125147
  Coding regions on vcDNA: vcDNA=SeqID_72175; Strand=-; Position=1-304

SEQ ID NO: 145753 - protein, 92 aa, Heterodera glycines
  Coding regions on vcDNA: vcDNA=SeqID_72176; Strand=-; Position=1-304
MIGRAVRNRPFIFEGIFKFILYPRKMAISFFEKFYTSQKRLRMRRRAVHNRHFISQRIFIFRGYPRKMAISFFDRFYTHTNALEHDREGGAQ

SEQ ID NO: 145754 - protein, 43 aa, Heterodera glycines
  Coding regions on vcDNA: vcDNA=SeqID_72177; Strand=-; Position=1 -117,354-368
  Homolog annotation: Hit_ID=CAA33463.1; Match level="QueryCoverage =97%, HitCoverage=0%, E-value=1e-11, Identity=76%"; Hit description =twitchin [Caenorhabditis elegans]
MWSVGVLAFILLSGLSPFGGENGDEPLENVKKCAWNMIDRFFF

SEQ ID NO: 145755 - protein, 53 aa, Heterodera glycines
  Coding regions on vcDNA: vcDNA=SeqID_72178; Strand=+; Position=1 -123,542-580
MAFPRRRIFVFQLGYFEFEQIADQKPDLVDYGPWMADMDIQTKKSSIFGLEFF

SEQ ID NO: 145756 - protein, 19 aa, Heterodera glycines
  Coding regions on vcDNA: vcDNA=SeqID_72179; Strand=+; Position=1-58
GPGSRSRVLKSSGPGPGRA

SEQ ID NO: 145757 - protein, 162 aa, Heterodera glycines
  Coding regions on vcDNA: vcDNA=SeqID_72180; Strand=+; Position=1 -79,238-647
  Homolog annotation: Hit_ID=AAM12418.1; Match level="QueryCoverage =87%, HitCoverage=46%, E-value=1e-12, Identity=31%"; Hit description =spliced leader 30 kDa protein [Ascaris suum]
MSDIQKAIQALEREYAEQKELFEKWKEENASEADTEPYNAYVEQFRGWEKDVMDNLKELRASIARQPVAPEPELPMVDLDTQLNKCCTSCIDFTLFLFSNSLLDRVDTPQFIMAFMSMSQQDPTFLAKAFEVIHLRQINFYLGSVWIRPWDNVKDFVFTIFY

SEQ ID NO: 145758 - protein, 96 aa, Heterodera glycines
  Coding regions on vcDNA: vcDNA=SeqID_72181; Strand=+; Position=1 -179,229-342
  Homolog annotation: Hit_ID=XP_417427.1; Match level="QueryCoverage =100%, HitCoverage=4%, E-value=1e-16, Identity=50%"; Hit description =PREDICTED: similar to Uridine kinase-like 1 [Gallus gallus]
AAAMMAIRILLDHDVLEEDIVLLSLLMAERGVHSLAYAFPRVQLLTISVDKQINEHYRTPLSMPDENCVGPDCEVVQLVASDDDPDEDGDDDSSSS

SEQ ID NO: 145759 - protein, 204 aa, Heterodera glycines
  Coding regions on vcDNA: vcDNA=SeqID_72182; Strand=+; Position=1 -36,549-1124
  Homolog annotation: Hit_ID=AAA59875.1; Match level="QueryCoverage =98%, HitCoverage=70%, E-value=2e-34, Identity=45%"; Hit description =mucin
MSNSSFVFLPSNESPPHHEEDDEGPIEESPPHYDEEQNDTVTAPVTPKVPVPAPVTSPAKPTTVKTPATPSVTTPAPPTTAKLPVTVPSPTTKPITPTPPPTTTTPTSTTKLTTGPPPTTTTPTPTTKSTTSPPPTTTVPPAITKPSTGPPPTTTVPPPITKPSTGPPSTEKPITTVPAPPKTTTTSTPAIRAVPSPSVKPTIP

SEQ ID NO: 145760 - protein, 57 aa, Heterodera glycines
  misc_feature (12)..(12): Xaa can be any naturally occurring amino acid
  Coding regions on vcDNA: vcDNA=SeqID_72183; Strand=+; Position=1 -132,184-223
SLAKAETTTGTXDFFSASCVFRHTICARHFASSFLPSAKTNEQSRRGHRENWKFYKS

SEQ ID NO: 145761 - protein, 210 aa, Heterodera glycines
  Coding regions on vcDNA: vcDNA=SeqID_72184; Strand=-; Position=1 -243,292-437,484-660,722-787
  Homolog annotation: Hit_ID=CAE67305.1; Match level="QueryCoverage =39%, HitCoverage=12%, E-value=2e-12, Identity=49%"; Hit description =Hypothetical protein CBG12758 [Caenorhabditis briggsae]
QTEELHERRDGTQRHHPVPNSLCCRIRTRAAARRPNSGMYYILFSASSSFYVPYVIVIFVYVRIYKAAMNATKSTYGGMVQVAENANKKKAEKTATNGLNDKNSPCSRLKLPRLFISRTAQLREKHHLEMHRFSMDPPRTVPISINCNSSPSVYAQINGSCGNLDVANIKLSADFARRRSEDQCLLEDRSEASQNLTSERPSEMIYESQD

SEQ ID NO: 145762 - protein, 50 aa, Heterodera glycines
  Coding regions on vcDNA: vcDNA=SeqID_72185; Strand=-; Position=1-151
MALLGGSLQHFRDHWTKECPSPSVKGQGEPEGPVFRGRRNVMPEGTEKGE

SEQ ID NO: 145763 - protein, 92 aa, Heterodera glycines; identical to SEQ ID NO: 125147
  Coding regions on vcDNA: vcDNA=SeqID_72186; Strand=+; Position=1-304

SEQ ID NO: 145764 - protein, 57 aa, Heterodera glycines
  Coding regions on vcDNA: vcDNA=SeqID_72187; Strand=-; Position=1 -49,211-335
MHLSAVLQRSFSAPFIGHLIFRDLICTSNEVITNVQQQYCFGIFIFGTTVCISRYTD

SEQ ID NO: 145765 - protein, 401 aa, Heterodera glycines
  Coding regions on vcDNA: vcDNA=SeqID_72188; Strand=+; Position=1 -40,96-206,247-426,475-595,790-1169,1241-1397,1439-1459
  Homolog annotation: Hit_ID=NP_510116.2; Match level="QueryCoverage =95%, HitCoverage=42%, E-value=1e-62, Identity=29%"; Hit description =ADAMTS family member (162.6 kD) (adt-1) [Caenorhabditis elegans] emb|CAA90302.2| Hypothetical protein C02
ELSPVNDGGQWGDWQPCSVSCGIGFQFRERLCADDWQPCSVSCGIGFQFRERLCADGPCANSGKQARTCNVQDCSRVLGMPVWDCSRVLGMPVWSGWSLWSVCSRTCGQGIQQRFRRCLNGLCPPGEALREQKRCVLGPCPQAWSNWSQWTNCASCSVWSNWSQWTNCASCSVFETRKRHRQCVVKVATANGQQEETECSCSCPGSTNETSVRGRRNKWTNENREREKNDRPNTDHHQFTTGAPIEFDNCERFCAENEFAKVRGEMRSQSNGNESLAEKGTEWGEWSPCSVSCGEGIRRRERKCEMGETGECKTGGGDGTAEEKSTQDTSSSNSASTQDTSSSNSASSSSVRRFPTWSDWSEWSACSCFSLTRYRRRFCRVHDPVEGFCVGSIEGFCVGSI

SEQ ID NO: 145766 - protein, 88 aa, Heterodera glycines
  Coding regions on vcDNA: vcDNA=SeqID_72189; Strand=+; Position=1 -163,238-339
MAQKGAKAEKEEEKQEDIKQEENTPTEEGEEREGEQFEGHPMTLARELRIRTRSGFSGSLIMNITSVKCSQKQLEHQKMVILYRYEYK

SEQ ID NO: 145767 - protein, 278 aa, Heterodera glycines
  Coding regions on vcDNA: vcDNA=SeqID_72190; Strand=+; Position=1 -167,255-333,379-504,562-907
  Homolog annotation: Hit_ID=CAE67355.1; Match level="QueryCoverage =96%, HitCoverage=67%, E-value=3e-48, Identity=41%"; Hit description =Hypothetical protein CBG12818 [Caenorhabditis briggsae]
SVFDLDFFSIDNSEWMRNGDLPPTRFNCQQEAVRALVLLKLRNNPENAVGLLSLADRIDVLNSLTTEDRKLMVRLHSLEILGVSKVFDGIRTAYLALKHRKGVSKVFDGIRTAYLALKHRKNRNHRQRIVVFVGSPLDPLLEEFIKFAKKLKKEKVSVDFVLFIKFAKKLKKEKVSVDFVLFGEATAENNKIIADFVDLLNGAEEGNSHLLVVMVGDTKLYDVLLRSPIFAGSGAALGAGGEFGINEEDDPELAMALRISLEEQRLRQQQQQGGEGTV

SEQ ID NO: 145768 - protein, 80 aa, Heterodera glycines
  Coding regions on vcDNA: vcDNA=SeqID_72191; Strand=-; Position=1-243
  Homolog annotation: Hit_ID=AAP92535.1; Match level="QueryCoverage =93%, HitCoverage=37%, E-value=4e-14, Identity=44%"; Hit description =Ab1-042 [Rattus norvegicus]
MEEEEKKERAMEKEKEEQMEEEKEEEKEEQMEKEEEEKKEEERKSKWKRKRKSKWKRKRKSKWKRKRKRKERANGRGIGE

SEQ ID NO: 145769 - protein, 56 aa, Heterodera glycines
  Coding regions on vcDNA: vcDNA=SeqID_72192; Strand=+; Position=1 -66,767-871
MVESLGLGVLALGFRILVSGLGGNIVGYVLDKMEEEMEDDEPHGHITSLAVKRTFR

SEQ ID NO: 145770 - protein, 46 aa, Heterodera glycines
  Coding regions on vcDNA: vcDNA=SeqID_72193; Strand=-; Position=1 -78,141-327,371-416
MSIARRVLLVADLHSISTGRHEPAQLRLNCFRTLATLLACGVSIGR

SEQ ID NO: 145771 - protein, 187 aa, Heterodera glycines
  Coding regions on vcDNA: vcDNA=SeqID_72194; Strand=-; Position=1-564
EHGGVGGSGNGRLPYAKGAGGPSPERENGNEGKDRTTPAKKPKKEGDKGGGATSAQNAAAQEANRAKQGKKATEKHPRTQSEGKRQQKAGKNGRRGGDAKPRSASGTGDHRKHFHPVYSIFRDFPAKFALPKLPSAKCVAPSVCPAVTASVPIVCSLSPRKTCPTTLLRSNAPFVASNAPQIELCSL

SEQ ID NO: 145772 - protein, 82 aa, Heterodera glycines
  Coding regions on vcDNA: vcDNA=SeqID_72195; Strand=+; Position=1 -70,370-548
MFRIELEQNKYYIRNLRLKKPIEIESHRPKCDRLSQPFWPACRQMSDYIFPSIRAVIACCTYDVQLLPQALEKYECHGSECQ

SEQ ID NO: 145773 - protein, 126 aa, Heterodera glycines
  Coding regions on vcDNA: vcDNA=SeqID_72196; Strand=+; Position=1 -249,1275-1406
MMFSDLNQPSDEFTKSEAEFKLVACTKHRADFIAVCFSCDELLCKDCVDSGEHYAHKWSFLNSEVDILCRQTLQELGQQAEQKIHKLFAGEGHCDGAVPEQEQSASAVEAVDSFDAGRKRGSRLGL

SEQ ID NO: 145774 - protein, 202 aa, Heterodera glycines
  Coding regions on vcDNA: vcDNA=SeqID_72197; Strand=+; Position=1 -171,264-485,966-1113,1175-1239
  Homolog annotation: Hit_ID=XP_312621.1; Match level="QueryCoverage =26%, HitCoverage=6%, E-value=8e-10, Identity=55%"; Hit description =ENSANGP00000015377 [Anopheles gambiae]
SRFGADSFPGFRTPTGGGLTSPDAMVMGGQQFCDPTNPMFPDTNNYLSGSQSKLWAGQFNSPSMFSQFDSTPAHQRPRELMESRFTMGEFGAGGYGNSSCDLSAGMRSRSSLCNTPSMDQFVTASSIASQQMTLCKHFNADKNNGADTFNTPQGICLGLDSEIAIADTNNHRCIVVNFNDGTFVRSIGSSGTEEGSVYYPKK

SEQ ID NO: 145775 - protein, 101 aa, Heterodera glycines; identical to SEQ ID NO: 137698
  Coding regions on vcDNA: vcDNA=SeqID_72198; Strand=+; Position=1-306

SEQ ID NO: 145776 - protein, 29 aa, Heterodera glycines
  Coding regions on vcDNA: vcDNA=SeqID_72199; Strand=-; Position=1 -75,251-265
MALIEQRNERKKAIRTEKVLEEAEKTKNS

SEQ ID NO: 145777 - protein, 24 aa, Heterodera glycines
  Coding regions on vcDNA: vcDNA=SeqID_72200; Strand=+; Position=1-72
MCSKNDSSVRIDLKRCPCIHSLAQ

SEQ ID NO: 145778 - protein, 292 aa, Heterodera glycines
  misc_feature (164)..(164): Xaa can be any naturally occurring amino acid
  misc_feature (189)..(189): Xaa can be any naturally occurring amino acid
  misc_feature (205)..(205): Xaa can be any naturally occurring amino acid
  misc_feature (230)..(230): Xaa can be any naturally occurring amino acid
  misc_feature (234)..(234): Xaa can be any naturally occurring amino acid
  Coding regions on vcDNA: vcDNA=SeqID_72201; Strand=+; Position=1-886
  Homolog annotation: Hit_ID=T02995; Match level="QueryCoverage=92%, HitCoverage=49%, E-value=2e-62, Identity=53%"; Hit description =unspecific monooxygenase (EC 1.14.14.1) - common tobacco dbj|BAA10929.1| cytochrome P450 like_TBP [Nicotiana t
MYRPSQTPRLTLSSARVAGHRVARLKHQNGHPSGALPFYRLSKESMKVVVFHWRLAAPTYATPLMILHKVRLESSSTGSSFPAKFAKPVPLAVVSLDSRRDSGNLVDPFVRVGKPTRHLATLRESCYSPVYPRLIKFPWLNIQSTGQKSDTVNVHKDHPSPLFXLDSRIPRVRASSKLVVQRQPKCIPXRAYTQLKRSTSSSHHXSTHHPRKNSTQPRAKAACFTQQPGXPDLXSQFFSRSYESNLPTSLTYIILSTRGCSPWRPAADIGTIRQEIQIASVAFSRAVWSARD

SEQ ID NO: 145779 - protein, 53 aa, Heterodera glycines; identical to SEQ ID NO: 125524
  Coding regions on vcDNA: vcDNA=SeqID_72202; Strand=-; Position=1 -47,231-345

SEQ ID NO: 145780 - protein, 44 aa, Heterodera glycines
  Coding regions on vcDNA: vcDNA=SeqID_72203; Strand=+; Position=1 -84,445-495
MDIRREFDEKIFENKNGSWGYCNFIYFVVPVLPIIPASRTTVIA

SEQ ID NO: 145781 - protein, 68 aa, Heterodera glycines
  Coding regions on vcDNA: vcDNA=SeqID_72204; Strand=+; Position=1 -99,189-298
KFAYSVSPSLTPLFAAILFGWCENWIFEKKAKARIFSDTHFLKSDSNISRETGLFLFPNFRSTQGIKI

SEQ ID NO: 145782 - protein, 88 aa, Heterodera glycines; identical to SEQ ID NO: 124691
  Coding regions on vcDNA: vcDNA=SeqID_72205; Strand=+; Position=1 -96,135-305

SEQ ID NO: 145783 - protein, 199 aa, Heterodera glycines
  Coding regions on vcDNA: vcDNA=SeqID_72206; Strand=-; Position=1 -546,861-914
MCLTYAAKGAEAMNIVANHFIFLLTARHLDYEIAVHFKNVKKIDGSMAETILTRFEIVDQSNKAKERPSICEESFVIDITAIESGKQRKKLAGKGRRPDFNIPYSICDGTTFELTNNDNFCLFRAFEFLRVKHELRDRHQRFTEYKRNSQWQLNDITTLCQTCEINMRLPFYSIEEYGERIQCEMPYSHQNQHNSKCKW

SEQ ID NO: 145784 - protein, 438 aa, Heterodera glycines
  Coding regions on vcDNA: vcDNA=SeqID_72207; Strand=-; Position=1 -99,173-296,357-982,1026-1235,1462-1719
MSSDDEMPPVLDGPYTPVRDGDEPFEEAPPLVEILEDVKGKNEHGIKERLNLEEFNGEHFKCLDAAQAESGRFKAYRFLGRFMLDYIWNADYPEAVLKSLFLMCLSYALKGASAMNITANHLIFLLTSRHLDYEIAVHFKNFKKIDDKMAETVLTRFEIVDQSNKAKERPSLLEESFVIDITAIDSGGKRQKMAGKGGRRRDFNVPYDLLEGATYGLENNDAYCLFRAFEFLRMKHVMPHPRFSEYKRDEGQQLNNVTSLFRECDIQMGLQFYSIEEYGNQIQEYYNEMHPGMFRLFCFDTFGKMKPVWKSAMSDYRYELCVLYKEGDDGAVGHYDAIKSIGKIFGSKNYCFGTFQSKECYDHHKKITPCKVKKGKETKTIERCICNTSKRCNACGVGYMTFRLLDISPTKLKTFILPTNPKSVISPTVISPTIHFAY

SEQ ID NO: 145785 - protein, 20 aa, Heterodera glycines
  Coding regions on vcDNA: vcDNA=SeqID_72208; Strand=+; Position=1 -22,440-480
MSRTPAIVNFLSKKAIILKN

SEQ ID NO: 145786 - protein, 283 aa, Heterodera glycines
  Coding regions on vcDNA: vcDNA=SeqID_72209; Strand=+; Position=1 -21,266-1099
  Homolog annotation: Hit_ID=NP_508646.1; Match level="QueryCoverage =98%, HitCoverage=14%, E-value=4e-44, Identity=37%"; Hit description =predicted CDS, RNA-directed DNA polymerase  and Integrase, catalytic domain containing protein family mem
LKEMHWDVKHLWSLESIGIRDPLDSNDDELASDLFRDSVKFKEGRYEVGWPWRPGGKIKLSNNFFLAYSRLSGLSQKLRSNSEFREKYQATIMEQFKKGIIEPAVRTGGNEHFIPHHAVVTKKLRIVYDASAHEKGKASLNEMIIPGPNLVPELAGVLLRFRSSAFPVLGDIQKAFLAVGLRDEDREVAKFLWLKDPSLPLTHENLVVYRFKRIAFGVNSSPFLLASVLQHHLTLNGDPLGERNFYVDNLLLCSETATEAAKAVHIARQVMTRAGMHLHEFVA

SEQ ID NO: 145787 - protein, 80 aa, Heterodera glycines
  Coding regions on vcDNA: vcDNA=SeqID_72210; Strand=+; Position=1-244
QALIPLLQMWYERLPMIIAAVSIPAFCTSDYYPLHWYGTNGCKHHRVLKGHEQSALLIRDRELTGYEYNLMGIDSIPEED

SEQ ID NO: 145788 - protein, 72 aa, Heterodera glycines
  Coding regions on vcDNA: vcDNA=SeqID_72211; Strand=+; Position=1 -99,163-282
MIIPFNRFYQRTAGQAKNCPLRTHYFSIKFTARTPANNYPTNAKTADIKTPKDVQDAFAPDGYRGTYCPFFL

SEQ ID NO: 145789 - protein, 15 aa, Heterodera glycines
  Coding regions on vcDNA: vcDNA=SeqID_72212; Strand=+; Position=1-47
MGHLQAECAEMLGVA

SEQ ID NO: 145790 - protein, 16 aa, Heterodera glycines
  Coding regions on vcDNA: vcDNA=SeqID_72213; Strand=-; Position=1-49
EAIPEGFGLPINLGAS

SEQ ID NO: 145791 - protein, 59 aa, Heterodera glycines
  Coding regions on vcDNA: vcDNA=SeqID_72214; Strand=-; Position=1 -86,333-426
  Homolog annotation: Hit_ID=CAE58560.1; Match level="QueryCoverage =100%, HitCoverage=14%, E-value=5e-18, Identity=67%"; Hit description= Hypothetical protein CBG01722 [Caenorhabditis briggsae]
MGPARSGTAIHIDPLGTSAWNALIVGQKRWCLIHPSTPKQLVKTLKEERNFHSDEAITW

SEQ ID NO: 145792 - protein, 230 aa, Heterodera glycines
  Coding regions on vcDNA: vcDNA=SeqID_72215; Strand=+; Position=1 -681,828-839
MLITFVRNDHKMQISEYSKQKYGAYLGIVYFIRKNWQCDKISEELEEYKRTEYQKNRRYLDILYEYLSREYAGFPTVKPIFVIKNRIEIEAPIIYAIYCLVRISQFCFKSKWGNFYEYKLNKFFNNDYEPKMLNEERLNYAFKLENEPKMPINEIILQLAIDTANECQTNERLDGIIRQNFDEFLRKMFKKAEGRVKNYDDRLRVAKINNDKHKIIVGSKFDDKWTWKFN

SEQ ID NO: 145793 - protein, 164 aa, Heterodera glycines
  Coding regions on vcDNA: vcDNA=SeqID_72216; Strand=+; Position=1-8,66- 189,263-364,557-676,719-859
MASSFLNYQSDTVRAEFLHALALRHEQDRDDANKYIKRNPTPRNQKEPAKTENYGFPYDFHSILHYAAVKTSGSVILKKIAKTLKTNAKREDIPTQRIATNACARWDTVEKNAKWSKMMEIAKLTGQMELKQIGKSNVEAKSELHKKDESCGCHWQIRQHLYEI

SEQ ID NO: 145794 - protein, 158 aa, Heterodera glycines
  Coding regions on vcDNA: vcDNA=SeqID_72217; Strand=-; Position=1 -97,390-427,509-688,775-933
  Homolog annotation: Hit_ID=NP_497420.1; Match level="QueryCoverage =100%, HitCoverage=21%, E-value=4e-54, Identity=60%"; Hit description= rna helicase (3C636) [Caenorhabditis elegans] gb|AAK27888.1| Hypothetical protein Y67D2.6 [Caenorhabditi
MSLQQQRQRLPIAKCRNHLLYLCEHFQTVVVVGETGSGKSTQLPQYLTEFGWAENGRRICITQPRRVAAISLASRVADEMMCRLGDAVGYSVRFDECISARTHIKFVTDGILLRELMSDPLLQAYSVVIVDEAHERSVNTDLIIGFLRKIVAIRDDLR

SEQ ID NO: 145795 - protein, 273 aa, Heterodera glycines
  Coding regions on vcDNA: vcDNA=SeqID_72218; Strand=+; Position=1 -330,366-535,589-912
PTDVLTEKELLAIYQFHALPNCICISNGFFPMQFPTNGRISDRKEGTLLLDIENVSEFAREAVGNSRHSEKVYINAFPWKILAQIKTKNGSTDNEKWFGFFFSFDTTKKATINHHLDSHWRCCVRSATFRIISHRKKAENSNGTFCDRVFDNKSTGWGFENFISFAELLDPRNGFYSEEDYKVTLAIDVILKDEKMEKFILNQSEAKGKLFMDIEKVSEFAREIKGSERKSKIVHIKGFPWKLWTKIEKKNESADNKELGIYLLYDGPNEGAN

SEQ ID NO: 145796 - protein, 79 aa, Heterodera glycines
  Coding regions on vcDNA: vcDNA=SeqID_72219; Strand=-; Position=1 -208,318-349
MRILLQLIALAMRKFLSKIFANLLKLVFDFSWNLTLTTEGRQRIGTFIRHCSKKHAKSLKNWRKFQLKTAPISTIAKYG

SEQ ID NO: 145797 - protein, 217 aa, Heterodera glycines
  Coding regions on vcDNA: vcDNA=SeqID_72220; Strand=-; Position=1 -505,574-722
METEKSENAIIWVDIMAIANEIEDKLKVIEQIGKLNFVNYDFMEGKLLENLKEKWQKIKENENYEKLKRKMFKFLNEILIHSEMRGHFIQNCEENSEENENQKLLGRIHQKNLANAIKKDEFKQKWHGMATGDKEEKLIHLFKNNIFIISKLEKHAINAQKMMAQIEIDQNLLNQIMANGLTNEFACCLSPSFPKISQQLIRDEFDEQNSQIVANWP

SEQ ID NO: 145798 - protein, 85 aa, Heterodera glycines
  Coding regions on vcDNA: vcDNA=SeqID_72221; Strand=+; Position=1 -65,136-328
MRWIGRTVHSSADAFGGGVAKSAFGEAKRSFAFLGHVRALAYSLLGFPNTLTADDMNELSQMIKHLRLRRNSDGSEGEDRDEEEK

SEQ ID NO: 145799 - protein, 60 aa, Heterodera glycines
  Coding regions on vcDNA: vcDNA=SeqID_72222; Strand=+; Position=1-181
MDRHRQLDRSCTFSGAPVKGNLNKRANPSSRSIRYTSQPQRSCDSALDSSQFTRRYYGNP

SEQ ID NO: 145800 - protein, 145 aa, Heterodera glycines
  Coding regions on vcDNA: vcDNA=SeqID_72223; Strand=+; Position=1 -202,851-911,972-1147
KRIYKKWLNTLGIKTKPNQSYPVTYLEKSRQFGPFCTRPEPVVTDLLLVFEIGKTFPFFGQLDNNDKCIQLITLIIIHFEKIALCIQLHAIQMGDKMMRYSVQPFARLKLINEEFVFARAIIYSHMGQNDPPFFKCFIILSVAKA

SEQ ID NO: 145801 - protein, 48 aa, Heterodera glycines
  Coding regions on vcDNA: vcDNA=SeqID_72224; Strand=-; Position=1 -56,282-372
MCRLRWWPNFLSIPALQLWPLKAAMWTREMHTLCSTNAQIQSLPNEMK

SEQ ID NO: 145802 - protein, 130 aa, Heterodera glycines
  Coding regions on vcDNA: vcDNA=SeqID_72225; Strand=+; Position=1-393
MDEKPALIDSKLFSYESFVVVAENPIVSEAVTHKRAVMARVQVAMMSLRKRKRGRMINDVIQIATDQNHSTHHNCNAGIERKLGHQRSRHIGRKVFAQAEVVQRERNGHVLFDVSALKWFIDEALEANDL

SEQ ID NO: 145803 - protein, 154 aa, Heterodera glycines
  Coding regions on vcDNA: vcDNA=SeqID_72226; Strand=-; Position=1 -231,299-532
MFNDATTRNADSSENEEENDDEDEDDFDEDDDDEPSDEETLRDIPLDKIDIWCFMRLFKDKDEDGQGDRLICISLAQRFTDESHCIMGASDAGQLPMDVPLISINHCLADFIKPEDIEGSRCAQCSNATPPPSAPPTLVKQLMFTRLPDILVIN

SEQ ID NO: 145804 - protein, 130 aa, Heterodera glycines
  Coding regions on vcDNA: vcDNA=SeqID_72227; Strand=-; Position=1 -137,198-297,633-674,731-778,929-994
MSTPSKADDKKKEVGGILNIGNTCCMGAALQALANVTALSNFLMKNENRLSNIKLVMEYVQMIKSILVLRQPAAPFELKHWRNEVLAPKKGSVIFDLFAGQSVSELRCPSSLEKETPSNVRPMKYAFHSP

SEQ ID NO: 145805 - protein, 73 aa, Heterodera glycines
  Coding regions on vcDNA: vcDNA=SeqID_72228; Strand=+; Position=1 -123,320-415
  Homolog annotation: Hit_ID=CAE73810.1; Match level="QueryCoverage =83%, HitCoverage=4%, E-value=3e-22, Identity=81%"; Hit description =Hypothetical protein CBG21360 [Caenorhabditis briggsae]
MVKMQLVPDGTFRKVRNNIDRLFDKNLTDLIRGIRNNKENEARYIAACIDEIKVELRQDSIFVKANAIEKLAY

SEQ ID NO: 145806 - protein, 95 aa, Heterodera glycines; identical to SEQ ID NO: 130684
  Coding regions on vcDNA: vcDNA=SeqID_72229; Strand=-; Position=1-702

SEQ ID NO: 145807 - protein, 95 aa, Heterodera glycines; identical to SEQ ID NO: 130684
  Coding regions on vcDNA: vcDNA=SeqID_72230; Strand=-; Position=1-673

SEQ ID NO: 145808 - protein, 88 aa, Heterodera glycines; identical to SEQ ID NO: 143614
  Coding regions on vcDNA: vcDNA=SeqID_72231; Strand=-; Position=1 -96,135-305

SEQ ID NO: 145809 - protein, 358 aa, Heterodera glycines
  Coding regions on vcDNA: vcDNA=SeqID_72232; Strand=+; Position=1 -697,736-1077
  Homolog annotation: Hit_ID=NP_502797.1; Match level="QueryCoverage =95%, HitCoverage=95%, E-value=5e-56, Identity=35%"; Hit description =HASI (4P602) [Caenorhabditis elegans] emb|CAB16520.1| Hypothetical protein Y57G11C.19 [Caenorhabditis ele
VEKILSKIYFNLKSPASFAGIQKILNEAKKIDPKITTDDVNKFLEKQKTYTIHKPIRKRFPRLKTIPSGFHTDWQCDLCIFDQLKKHNDGYKYLLVCIDVLSRMIFSAPAKSKKSEDMIEAFDRVFEKSKIIPMKIYSDSGLEFQAGKIKNILRKNFIKNVMYSPDLHAGVVERANRTIKERLYRYFTKKDTLRWVDVIDKIITNINNSVNRTLGAKPSSINLKMPVRSGKKKFKIGDIVRITKEKKFKIGDIVRITKEKGKFSKGYLPNFTEELFKIVVANSTTPDSYRIEDLEGNLIKGIFYNQELVKTWMIFTLYYLRTHQGRRTLRQNSQFTPRDFGIGHKLVSSSLINYLPLL

SEQ ID NO: 145810 - protein, 132 aa, Heterodera glycines
  Coding regions on vcDNA: vcDNA=SeqID_72233; Strand=+; Position=1-399
MDDFYIVLPSNTPGQENTTSKFTVRLPETLELGTNWSVALSSIIYPYSFTALGINGQEFIKVWENDISVPTQVYLPDMNFKTAGGLGNKINEAFTHHYKIKKQRGKREAKAEDTKIQKLMSQRGPQNAPGET

SEQ ID NO: 145811 - protein, 244 aa, Heterodera glycines
  Coding regions on vcDNA: vcDNA=SeqID_72234; Strand=+; Position=1 -256,302-780
  Homolog annotation: Hit_ID=NP_502799.1; Match level="QueryCoverage =94%, HitCoverage=38%, E-value=9e-10, Identity=24%"; Hit description =putative nuclear protein, with 2 coiled coil-4 domains (4P607) [Caenorhabditis elegans] emb|CAB16521.1| H
MVEMGTEIQTSRNELKSFQEEVDKAKNITLEHVEKNDMKEAKKSADVAKGIARQAKTKYTSTLEEYNDKSEKGFSGMVVRLNEALEAEKGPQKRERLANEDVQFNYDSIDQKFIVYLSSAVTHIDLSKHLAYVLGFKNTRLFHAEEATYMPDLTGGVRQLYIYAPNLIENTIIGNQMAPLLRIVNVVDDPGSISEVIYSTEYFHRLQSKRISEITIEIHTPFGEFVKFHWGSCILTLHFKKSIF

SEQ ID NO: 145812 - protein, 387 aa, Heterodera glycines
  Coding regions on vcDNA: vcDNA=SeqID_72235; Strand=-; Position=1 -180,892-1167,1213-1412,1458-1850,1896-2010
  Homolog annotation: Hit_ID=NP_001004509.1; Match level="QueryCoverage= 84%, HitCoverage=23%, E-value=2e-35, Identity=29%"; Hit description =si:busm1-180o5.3 [Danio rerio] emb|CAD60788.1| novel protein similar to DNA polymerases [Danio rerio]
MNDSILGLIGEGVETFNGIPDMNKIKEQEKPILLILDDLMLNMQNTFLDLLFTRGSHNWNAKAFECGYRVDRFCRAWHYEATDDDLFKGYVRLFLKLKEESSGFPKGVESDEQKRQWAEEYKEKYGIAIELSRVQKNPGLRYISKLMLNSLWGKFSMRNSLSKNAVIDRESAFYELACDHKVELCDIVEYSGDAMRVIYRDKEEFVTEHKSSNIVVSLWTTSMARLKLLEFMMEAERNGGEILYTDTDSIFVFHDRGVEPITTGKYLGEMSEEYGGYEIEEFCCGGAKQYGLKIRSKETGEVDYVMKIRGVTFDVDNRKALHYDAFKEMVLNYGKGEVDPAFFVYKNDFGPTRESKVVTRERHKMYKPVCQKGIIDEELNVMPFGFC

SEQ ID NO: 145813 - protein, 594 aa, Heterodera glycines
  Coding regions on vcDNA: vcDNA=SeqID_72236; Strand=-; Position=1 -77,123-593,776-875,919-1074,1522-1775,2185-2740,2785-2955
  Homolog annotation: Hit_ID=NP_001004509.1; Match level="QueryCoverage= 38%, HitCoverage=16%, E-value=2e-22, Identity=30%"; Hit description =si:busm1-180o5.3 [Danio rerio] emb|CAD60788.1| novel protein similar to DNA polymerases [Danio rerio]
MSFKRVNSVQPTAVPMAKKWDFRSIGNNFPMEPFKLIDHQTTKCEKFGFTKNITEFVINPDVERPDETLREAIDIMIKNSISKTEETMGRKVKMFGVALTGAGLGHPIWLPYRPFPQNNADVVMEEINKLGQSGGEEGEEDKRTILLSESIKMKVTCVALPAGEGPRNVHKFDFGFKEQQRIKQREAAFELLLNSGVQRNESGYGLEHLVMVQAHWDDLNPGKYRIVAFEKSADPRKSIRVLWKGPMAREKVVPIFLEGNHWDGLKNYDSETSQDTIYKEDQMEHVINYISVRVTCTECCDDKERTNCNICGEEREKDWSEAEGHEPTKDFVEWILTAFVKYDTYIFAHNAGRYNENMETSFYLPEELKNYCRNDTEILLGAVVEFRRILINEITKGFDPLPRSCTNAGIAMNIFKAMFLLEEQLSIVPERGYERNDRASVVAIKYLEWRSKRDAVEIRHAGNGGEMKMGKYKLDGFISQMDGRDKCIEVMGCYIHGCLSCYDPSADLVGGRTAQELNDETQERLAELRQILDVEEIWGCQIEKELKGDKEMQEFFDDRGNEKGPIDPRMAYAGGRTGPLRLFAQSDEKKKISV

SEQ ID NO: 145814 - protein, 82 aa, Heterodera glycines
  Coding regions on vcDNA: vcDNA=SeqID_72237; Strand=-; Position=1-249
MNAPPYEGDSDYGPTPKRHRPMPFFEEENFPIGGSDDLRQHTQRFDQSFDQSPYEQQEGAELTRKIYGGVNEGSSIHKLSLF

SEQ ID NO: 145815 - protein, 108 aa, Heterodera glycines
  Coding regions on vcDNA: vcDNA=SeqID_72238; Strand=-; Position=1-327
MTGSHEQSDKMGGNSANDVEEGELPEEGEIMDEEEQQHKGKVITMKTEAEESDRAMPTPQQQNTPSNSKTESGSKDSRGDAGGSSWRRCRDKPNSKEQMINQNIRFQR

SEQ ID NO: 145816 - protein, 247 aa, Heterodera glycines
  Coding regions on vcDNA: vcDNA=SeqID_72239; Strand=-; Position=1 -148,195-437,629-759,812-937,989-1084
  Homolog annotation: Hit_ID=CAE68269.1; Match level="QueryCoverage =99%, HitCoverage=52%, E-value=6e-78, Identity=56%"; Hit description =Hypothetical protein CBG13946 [Caenorhabditis briggsae]
MLREADKIACREFVTADDVAKGNYKLNLAFVANLFNKFPALPEPGADEIPQITEVTEETREEKTYRNWMNSLGVDPFVNHIYSDLQNGLVIFQVILTFNSKHYRSEYILRSVQNVSVVRMHSSWNCPVEAALVWQLMRAYTLTILAQCTQSGESLATEKEIIVWVNKKLEESGKTSRLKSFQDQTIADGRVLIDLIDAIKPGTINYDLVKNDVSAESNLENAKYAITSGRKIGAKIYALPEDIVEVD

SEQ ID NO: 145817 - protein, 24 aa, Heterodera glycines
  Coding regions on vcDNA: vcDNA=SeqID_72240; Strand=+; Position=1-73
MALRIVNVLLFAVTYFAWFCAFIA

SEQ ID NO: 145818 - protein, 246 aa, Heterodera glycines
  Coding regions on vcDNA: vcDNA=SeqID_72241; Strand=+; Position=1 -282,324-382,440-622,665-878
MAKVNENVTDQFELLVPIIETIHNDWDGDWRADEVFFFFGYFHLKMLKPIKIEIRVAFRHKTNSNSSPSFSLNFTAFSYALFFDVKLEKRTLVELKGTPIFGKIQSKNPFNEIHVIGSMDFVQRNFLPAFGNLTFAQWSAQFSADGFPSKSSPEEIDWQMRKWSMEQNFSIVLGRKIERVRMTTHQRLGGGILCQFVFHIRISEQTLQYRFTWNLVLDYIIFIQNQCLGDGQMGVGTVLGSVCRCT

SEQ ID NO: 145819 - protein, 254 aa, Heterodera glycines
  Coding regions on vcDNA: vcDNA=SeqID_72242; Strand=+; Position=1 -170,265-511,1180-1527
MLDRYEFVNDLCDLLPEFANFSMEQPQTFRALLILISQFLDVVTQNLFIARKVAHIFTTLKESANECFEDLVNCHHHRSTVLTIFGILHAIVIDCPSALVWTPFESNELAEGLQSKFKPDRNGNSKSMERESVQNSVAWNDCLDITIRVLINWAVTSEREGTHRGLIVAHLLKMHVNFAQNDNKKPPFGHGFSSLQELLVDCLNREWANPNGKAIANSAVRAAEFANLMLLFYELQRFGTNLHYFKFVATKFAF

SEQ ID NO: 145820 - protein, 72 aa, Heterodera glycines
  Coding regions on vcDNA: vcDNA=SeqID_72243; Strand=-; Position=1 -40,1119-1297
MGKCQVKSGNPQVDFSSNFPQFLPCTITMFGNAVENNGALVAHVPIGFNLFNGQMDDKTFMKTEKTKKIIEW

SEQ ID NO: 145821 - protein, 22 aa, Heterodera glycines
  Coding regions on vcDNA: vcDNA=SeqID_72244; Strand=+; Position=1-70
VGVNSVWPTPSQQCSKSYNFFL

SEQ ID NO: 145822 - protein, 33 aa, Heterodera glycines
  Coding regions on vcDNA: vcDNA=SeqID_72245; Strand=+; Position=1 -3,236-334
MRTLSTAVRQRSSKIYSMPQILWAGHAKYLKLG

SEQ ID NO: 145823 - protein, 24 aa, Heterodera glycines
  Coding regions on vcDNA: vcDNA=SeqID_72246; Strand=-; Position=1-80
RTLSTAVRQRSSKIYSMPQILWAG

SEQ ID NO: 145824 - protein, 24 aa, Heterodera glycines
  Coding regions on vcDNA: vcDNA=SeqID_72247; Strand=-; Position=1-80
RTLSTAVRQRSSKIYSMPQILWAG

SEQ ID NO: 145825 - protein, 68 aa, Heterodera glycines; identical to SEQ ID NO: 142082
  Coding regions on vcDNA: vcDNA=SeqID_72248; Strand=+; Position=1 -94,186-298

SEQ ID NO: 145826 - protein, 53 aa, Heterodera glycines
  Coding regions on vcDNA: vcDNA=SeqID_72249; Strand=-; Position=1-403
LLGNELFFEVSLFPIGALLCREPVCNGWLSICKKLDWQYVVVKNFWVMNYFLK

SEQ ID NO: 145827 - protein, 67 aa, Heterodera glycines
  Coding regions on vcDNA: vcDNA=SeqID_72250; Strand=+; Position=1 -120,1023-1106
MLYLVNVATQFFVLNTFIGRNNRMWGFEVLENLFNGEKWQPLFPARTAQGRSEYVAWWCCTVWMHVY

SEQ ID NO: 145828 - protein, 41 aa, Heterodera glycines
  Coding regions on vcDNA: vcDNA=SeqID_72251; Strand=+; Position=1 -51,130-204
MILQLCFLNERKHGKPIFDEAYESECGPKLKKAFLIYGFCF

SEQ ID NO: 145829 - protein, 113 aa, Heterodera glycines
  Coding regions on vcDNA: vcDNA=SeqID_72252; Strand=+; Position=1 -36,83-388
  Homolog annotation: Hit_ID=EAL29450.1; Match level="QueryCoverage =79%, HitCoverage=9%, E-value=8e-19, Identity=50%"; Hit description =GA20829-PA [Drosophila pseudoobscura]
MAKYVGVRGRGGRGILYEDPDYGPNQIQLHFTNNIEVPIQWLRPQQIVDHPQFINQMPEPRDVNQGSLGDCWMLAAASILAQHGHLFYRVVPPDQGFAMGYAGKNFVLNKNKN

SEQ ID NO: 145830 - protein, 58 aa, Heterodera glycines
  Coding regions on vcDNA: vcDNA=SeqID_72253; Strand=-; Position=1-174
MDDIVSIDSVQPIDQLSFWCLTLSAMLKLVAVGVTLFTLPFNEWILLQGAQFGGVKII

SEQ ID NO: 145831 - protein, 36 aa, Heterodera glycines
  Coding regions on vcDNA: vcDNA=SeqID_72254; Strand=-; Position=1 -35,421-496
MPAKLGEIYLLGITGVSIIAVLFLVFLMLSQNLVRF

SEQ ID NO: 145832 - protein, 86 aa, Heterodera glycines
  Coding regions on vcDNA: vcDNA=SeqID_72255; Strand=-; Position=1 -540,711-973
KNRFIFVFGAVPPNRCAQIYGETESFGNSFPIACTLILRWIFAPHNCLSTPNGHLKKSIFLFSGQSPRPDAPRFMGRPNPSGVSSL

SEQ ID NO: 145833 - protein, 81 aa, Heterodera glycines
  Coding regions on vcDNA: vcDNA=SeqID_72256; Strand=-; Position=1-246
MFVLPSVLLLLLAPFAFCQNALLPMLFQAPPQPQEQLPQKTPRGHTPHEKMKMCCAKLDQADADCKNRFCDWNALSSNTVN

SEQ ID NO: 145834 - protein, 112 aa, Heterodera glycines
  Coding regions on vcDNA: vcDNA=SeqID_72257; Strand=-; Position=1 -263,730-805
MPFSSSSFSSSSSLLCFFLFLFVLPHFSFVSSADANAKLKKCCLTLTSEKDDKDCVARFCDFDAISQANVSGESNEFVSPIKFEMNLRACVDYFDHIRDCFKAHLENKKEEK

SEQ ID NO: 145835 - protein, 103 aa, Heterodera glycines
  Coding regions on vcDNA: vcDNA=SeqID_72258; Strand=+; Position=1-312
MGNVEKIGRPAEAVDYFCVQRGGVPIRRSVRPKLNSDRMIPQFLPKNASNPSSTDAKPSGDLLHEHSLPSPRETTRGGGSEISVVPRGQVETNLDGQLPNAIE

SEQ ID NO: 145836 - protein, 19 aa, Heterodera glycines
  Coding regions on vcDNA: vcDNA=SeqID_72259; Strand=+; Position=1-59
MRKRDSYFWSRIFLFAFQI

SEQ ID NO: 145837 - protein, 75 aa, Heterodera glycines
  Coding regions on vcDNA: vcDNA=SeqID_72260; Strand=-; Position=1 -42,111-191,236-340
  Homolog annotation: Hit_ID=NP_610315.1; Match level="QueryCoverage =88%, HitCoverage=24%, E-value=5e-17, Identity=57%"; Hit description =CG1406-PA [Drosophila melanogaster] gb|AAF59207.1| CG1406-PA [Drosophila melanogaster] gb|AAL49138.1| RE5
MVRISVDVVNDAYQFINPCKQREISLRNLQIPTIENLGVIRDQFDVIDLTDNNIRKLDNLPRLKRLGGDTFKDGE

SEQ ID NO: 145838 - protein, 128 aa, Heterodera glycines
  Coding regions on vcDNA: vcDNA=SeqID_72261; Strand=+; Position=1-387
MPFEFLRPDENPKFVANSEWEMVPPIPANCPINVSDEKGKLVVKSAEQMEYERDDQRQSGGQPAVKVSGKLLRVAFRVNQMPKNITIQLEDKQKKPILTLFIGAKHIILNSEQVNGARRHGTRRDGKG

SEQ ID NO: 145839 - protein, 87 aa, Heterodera glycines
  Coding regions on vcDNA: vcDNA=SeqID_72262; Strand=-; Position=1-261
MQMNRQANSSVLCDCETNPPPAVPIYSPPPPPPMFLPSPPATEGALAPPPPATEGALAPPPPGGLVITGYPTANPDGYFGNNAHEDK

SEQ ID NO: 145840 - protein, 46 aa, Heterodera glycines
  Coding regions on vcDNA: vcDNA=SeqID_72263; Strand=-; Position=1 -31,155-264
MNSNANGGGGDGPTLKRTMSALGVAALTLGAVPSVEAGRPLGTIMV

SEQ ID NO: 145841 - protein, 232 aa, Heterodera glycines
  Coding regions on vcDNA: vcDNA=SeqID_72264; Strand=-; Position=1 -36,284-508,826-1263
MCWVIDIALSLQLLVAHVKAFAPCTSNLDPYLRKTIREQRGGEPIIDLSESQEDDDVAQQQDPFGPLKETIGPEAEFVFQDPMVWASVPLGDWTLVKLLIESLRKWKPFSTQSLCSPPDTNSNSVADPVVVVQPQQQKHLVQHHDNGEFGQQNEQRMALLRRIEEEGNGQTMMNNGETEEEKRRKSTKSGEKEEKERRETEEREEEMNSVASVAGSSEQRSLLRSSTSPPKD

SEQ ID NO: 145842 - protein, 278 aa, Heterodera glycines
  Coding regions on vcDNA: vcDNA=SeqID_72265; Strand=-; Position=1 -413,721-920,1004-1135,1674-1765
  Homolog annotation: Hit_ID=NP_502057.1; Match level="QueryCoverage =88%, HitCoverage=17%, E-value=6e-50, Identity=47%"; Hit description =kinase D-interacting substance of 220 kDa like (4L811) [Caenorhabditis elegans] emb|CAA92996.1| Hypotheti
MGPAVAGNNEPISENVKIFYSNDESDSVAVPSNVYEYFQSIENGRFPFFNNTHVHVSAMRNLNGETLLITASRLGHAEIVARLVADIDVEETDNDGWTALLNAAHHGHAAVARALLTAGASVDNPDLVMIQLIYLFSGFFRYCVFCLGRGFTEVARLLLASGAQVNTSDKFGSTALIWAARKGFRQIVEQLLNSGAELDAVGMYGSTALMLATRGNHAHVVEMLLSRDPNVNVVDYNGLSALGIASREDVLLALLDKKPNLELKNRDGETALIRAVGF

SEQ ID NO: 145843 - protein, 236 aa, Heterodera glycines
  Coding regions on vcDNA: vcDNA=SeqID_72266; Strand=-; Position=1-710
  Homolog annotation: Hit_ID=NP_608540.1; Match level="QueryCoverage =98%, HitCoverage=63%, E-value=3e-29, Identity=35%"; Hit description =CG2839-PA [Drosophila melanogaster] gb|AAF51469.2| CG2839-PA [Drosophila melanogaster]
MEEEEGREEEEWEGRERRGKRKKSGSREERKKSRKKGRWEEEERKKNGVGRERRGKRKKSGRRKSGRRMGWKEKEEESGRRVGGGRAEEEWGGKRKKRKAEEEWEEEERKKNGVGRERRGKRKKSGRRKNGRRMGGKRKKRKAEEEWEEEERKKNGVGRERRGKRKKSGRRKSGRRMGWEEKEEESGRRVGGGRAEEEWGGKRKKRKVEEEWEEEDRKKNGREEKEEGTPRCVGGV

SEQ ID NO: 145844 - protein, 37 aa, Heterodera glycines
  Coding regions on vcDNA: vcDNA=SeqID_72267; Strand=+; Position=1 -61,727-779
MLKVYLIDDKNKFLAFVVFQGKNENRCIFDFSRKFAN

SEQ ID NO: 145845 - protein, 127 aa, Heterodera glycines
  Coding regions on vcDNA: vcDNA=SeqID_72268; Strand=-; Position=1 -25,933-1291
MSLRKRIIDSKDKLTANFNALLNVANEIKQLFQKAGENSNYMTFFNSLDNANIFFGNIGEGANKSHHIQKWIEEIHTDFNTLIIENDLLEIWNDIKDKFSFQENVCNKLAKIRTDISDDDKGFIVVH

SEQ ID NO: 145846 - protein, 166 aa, Heterodera glycines
  Coding regions on vcDNA: vcDNA=SeqID_72269; Strand=-; Position=1 -179,284-420,489-550,590-712
MKYCVRQTYTKKLPMKAASVLSCCLRQNSKREQRQRLVIGTYELATDEAPIGDKKSGSERCGGICIIDPTDLLPIERYIRLPSGVFRLVKVPTNAITPLLTSEVNAAVATLTDGRLALFTTDHFDSIADDSATFLPFSTTLSGGMMLDCAVNSDGRLLCSDNLGNV

SEQ ID NO: 145847 - protein, 95 aa, Heterodera glycines
  Coding regions on vcDNA: vcDNA=SeqID_72270; Strand=-; Position=1 -131,180-261,317-390
  Homolog annotation: Hit_ID=NP_741716.1; Match level="QueryCoverage =93%, HitCoverage=14%, E-value=8e-21, Identity=50%"; Hit description =putative protein, with at least 10 transmembrane domains, of ancient origin (68.2 kD) (XB658) [Caenorhabd
MTMFKELTNRQLVAIVMLAISNLCSTVVVSCIGPIYPGEAKRRGMSEAQIGLVFGLFQLVMFISAPLLGKYMHVIGSKWMCIAGLQIASLAAIAF

SEQ ID NO: 145848 - protein, 76 aa, Heterodera glycines
  Coding regions on vcDNA: vcDNA=SeqID_72271; Strand=-; Position=1 -188,600-642
MTKKHLPPAPFEYLSTSESENEMENCGQTEASKLAQKFSSRKDLSPSERMAAILKLISSKSEDICLIYVGRVGFLF

SEQ ID NO: 145849 - protein, 16 aa, Heterodera glycines
  Coding regions on vcDNA: vcDNA=SeqID_72272; Strand=-; Position=1-49
EATPEGFGLPINLGAS

SEQ ID NO: 145850 - protein, 214 aa, Heterodera glycines
  Coding regions on vcDNA: vcDNA=SeqID_72273; Strand=+; Position=1 -81,282-354,406-472,583-746,907-1156
  Homolog annotation: Hit_ID=NP_509820.1; Match level="QueryCoverage =97%, HitCoverage=30%, E-value=9e-82, Identity=71%"; Hit description =histidine ammonia lyase (74.6 kD) (XL512) [Caenorhabditis elegans] emb|CAA91982.1| Hypothetical protein F
RRTLVLDGNSLQAQDLVDCMHDKCKLQLAESSRQRIREARIFLEKVAAEHRVVYGVYGITTGFGTFSNVVIPPEELKQLQLNLIRSHATGHGSPLEPAKARMLLALRINVLAKGYSGISLGNVDKLVNAFNAFCVSYVPEQGTVGCSGDLCPLAHLALGLIGEGQMWSPRTGWTDASDVLAVNGLEPMALGYKEGLALINGTQLVSALGALGNY

SEQ ID NO: 145851 - protein, 43 aa, Heterodera glycines
  Coding regions on vcDNA: vcDNA=SeqID_72274; Strand=-; Position=1-505
VKHPISALLCREPVGNGWLSICKKLDWQYVVVKNFWVMNYFLK

SEQ ID NO: 145852 - protein, 259 aa, Heterodera glycines
  Coding regions on vcDNA: vcDNA=SeqID_72275; Strand=-; Position=1 -147,189-351,427-896
MSTRRSSRRSSAAKGSREGSVAGKSKPSETAISDSKKPSNSSPEKAQETGKMEEEKKLEPVTETEPELSTEDEEKSIVDEKKTTPEKKQEEVGPAVEQPLEIYVEHTVKTEKLHGIVQEQSQAKDSASSDAPIENGQQQKNEATINEEEIVDEDAFIITNESDPAATHKIQVYTLSDSGIPNEQKATPSGSKALVSAKPMLGEEGKGDEITVVKDEGQQPSGSVVDTVGSSEGNAHVTTNGQNKESAETVVATVTLDEE

SEQ ID NO: 145853 - protein, 297 aa, Heterodera glycines
  Coding regions on vcDNA: vcDNA=SeqID_72276; Strand=+; Position=1 -124,176-475,537-989,1503-1519
MGKRNLPRKLNCKKALKEREKKREERKAQTAKAIQARLAKKTAPQPNTDAETPQPSEEEPSTSEAPARDNDGRPPSTPTPMTPQEMDVPSVEMVDTDVQIPSTPADEDQQAEPVPSTSTARCDFMATPSTSKCAGAFGLDDVHMFDELRRRHVWIEEELQRQRRSNAVLRKQLKAQRDRSTSLERSASSCRQRKALSDVTNNPQEDKRLSAANDLLITLDAGISFKAREALKRSFAGQGHDVWAPTWAVKRLKRELAEGANFEWVGEEQTRALVCTDVRALVEGRLQALAKSATLFS

SEQ ID NO: 145854 - protein, 52 aa, Heterodera glycines
  Coding regions on vcDNA: vcDNA=SeqID_72277; Strand=-; Position=1-193
IKIFINFKASLFYFLAKLIHKYFFTNCSETHQILFTSYFRHSDAFTIKKGDE

SEQ ID NO: 145855 - protein, 96 aa, Heterodera glycines
  Coding regions on vcDNA: vcDNA=SeqID_72278; Strand=-; Position=1 -161,485-614
KEKRNTVIKALVDEKRKHQKQKEELEEMEKKKKEKEEEEERNKKKKQKQMAVNDCVKHVAELDKEIAKIQSELQRSSNKMANLHTGKMSTPAKKGN

SEQ ID NO: 145856 - protein, 117 aa, Heterodera glycines
  Coding regions on vcDNA: vcDNA=SeqID_72279; Strand=+; Position=1 -198,471-626
MRNLRVPILLVLLSPVIIFILKFLLHENMPTKITINPVAGNFMQRRILFFDSDVNTPKLLLGMNTQFIPSLKLAGCLIAKNSNVFLESLFCYLTNMNKINTTNIDYELFNLFVFNYL

SEQ ID NO: 145857 - protein, 85 aa, Heterodera glycines
  Coding regions on vcDNA: vcDNA=SeqID_72280; Strand=-; Position=1-258
MVQKITGNSFKKTRNKSLNWGHALMRPFSKAVIHWSGLLSLKHCSQSEGETTETDTTPKEQIQIKIPLPLAIQHNTVTQHNKTSF

SEQ ID NO: 145858 - protein, 25 aa, Heterodera glycines
  Coding regions on vcDNA: vcDNA=SeqID_72281; Strand=-; Position=1-74
EFSGTVCADCGASCPSWASLNHGVL

SEQ ID NO: 145859 - protein, 58 aa, Heterodera glycines; identical to SEQ ID NO: 138265
  Coding regions on vcDNA: vcDNA=SeqID_72282; Strand=-; Position=1-437

SEQ ID NO: 145860 - protein, 150 aa, Heterodera glycines; identical to SEQ ID NO: 142473
  Coding regions on vcDNA: vcDNA=SeqID_72283; Strand=+; Position=1 -94,243-451,534-683

SEQ ID NO: 145861 - protein, 75 aa, Heterodera glycines
  Coding regions on vcDNA: vcDNA=SeqID_72284; Strand=+; Position=1-228
VQPSSKLINPFHSQYIYFYTARYCKNEYGLSKEQLSMLAHFVPLLRKVRLQLDSDYSKEKFDEMEPGRKLLINYN

SEQ ID NO: 145862 - protein, 129 aa, Heterodera glycines
  Coding regions on vcDNA: vcDNA=SeqID_72285; Strand=+; Position=1 -128,219-480
MVTRFDAERDEKRAEKANEWLKKCQENGTKNKTAERTMRQFIDQNYNIGKVSELLDNFEKQHFNLTNDALYRNIAILRDYGSIDRCGITVSSNDRPSDNHTANAAAMVDYYFAGSFWRACESYAIYFYT

SEQ ID NO: 145863 - protein, 275 aa, Heterodera glycines
  misc_feature (263)..(263): Xaa can be any naturally occurring amino acid
  misc_feature (271)..(271): Xaa can be any naturally occurring amino acid
  Coding regions on vcDNA: vcDNA=SeqID_72286; Strand=+; Position=1 -25,220-403,572-697,752-784,849-965,1048-1351
  Homolog annotation: Hit_ID=CAE61940.1; Match level="QueryCoverage =93%, HitCoverage=8%, E-value=2e-48, Identity=40%"; Hit description =Hypothetical protein CBG05938 [Caenorhabditis briggsae]
RNWPPRALQTTEGGGSVQQFVQQHYPKTAPKVAHSVALLCSSTDKAELGTALQELMDKTPLASYLIVREILFRLKNLCFEGPKNDPLNQQLLRNMRAYEILLEFLSIPFDKKNDFEMPRLIRKNDFEMPRLIRLSHLSHEFLRSFCRNNRENQARLAARIATAEGGATDAAGAVKAEDCATIVAIYRNNAELCENVPEQLIAHIVSLIEQKQRNAVFLELLQVIVSSCEKGLNECQVKVVEEVGRPREKPRSAHTDQQTIRDXSTIVRNRXDHSR

SEQ ID NO: 145864 - protein, 65 aa, Heterodera glycines
  Coding regions on vcDNA: vcDNA=SeqID_72287; Strand=-; Position=1-196
TDNISHAAGEQQQQQQQHDQTENKVKFQEQKKSENYAMACFFFTRLYRKLAGMLETPFYGKKPSN

SEQ ID NO: 145865 - protein, 31 aa, Heterodera glycines
  Coding regions on vcDNA: vcDNA=SeqID_72288; Strand=-; Position=1-96
NLELLVDGLRVHVNAAQPAAVAGWDWYQSTT

SEQ ID NO: 145866 - protein, 197 aa, Heterodera glycines
  Coding regions on vcDNA: vcDNA=SeqID_72289; Strand=-; Position=1 -335,429-687
MNKLKIFFEKLDKKYLEKLKELKESLSGHLLEILKNIHTDYTKASQREASKNGGILLTNYRKEMLRFGQILYETMKKNLAKNMEYDENKQLLTFTLSFAKHLLGRLFEFVERNFKENFKVSDDMDFVQTIRAVASNNEELVAEKRQKSISAGVNVKLSKLLFSLAIRLCLLIDGQEFREKYVPKFVFALKMCSTNTG

SEQ ID NO: 145867 - protein, 92 aa, Heterodera glycines; identical to SEQ ID NO: 124679
  Coding regions on vcDNA: vcDNA=SeqID_72290; Strand=+; Position=1-704

SEQ ID NO: 145868 - protein, 113 aa, Heterodera glycines
  Coding regions on vcDNA: vcDNA=SeqID_72291; Strand=+; Position=1 -81,534-590,720-764,848-977,1825-1847
  Homolog annotation: Hit_ID=NP_508601.1; Match level="QueryCoverage =99%, HitCoverage=22%, E-value=1e-30, Identity=62%"; Hit description =GLutamate Transporter, Sodium-dependent, ATP synthase subunit (53.4 kD) (glt-2) [Caenorhabditis elegans]
VLEWLRKNALVGATLVSVLLGALLGTVIRYANPSLQTIMLLTFPGELLMHMLKMMIIPLIVSSSLISGLAQLDAKQSGRVGSLAVAYYLATTAIAVITGIILVININPCQDTT

SEQ ID NO: 145869 - protein, 27 aa, Heterodera glycines
  Coding regions on vcDNA: vcDNA=SeqID_72292; Strand=-; Position=1 -42,157-198
MAGRVHHDCLARLICWFCNIRMEIRFK

SEQ ID NO: 145870 - protein, 26 aa, Heterodera glycines
  Coding regions on vcDNA: vcDNA=SeqID_72293; Strand=+; Position=1-80
MALTISRARQSWWTRPAMLDTLTRSA

SEQ ID NO: 145871 - protein, 81 aa, Heterodera glycines
  Coding regions on vcDNA: vcDNA=SeqID_72294; Strand=+; Position=1 -148,179-276
MRLWAASLGFYVSIVIFCEILRGFAYRFELHTQIGGEHHQQFTSLIYEVAFVKLRIEKAQVLAASNTSDQLLSFSRSICLI

SEQ ID NO: 145872 - protein, 15 aa, Heterodera glycines
  Coding regions on vcDNA: vcDNA=SeqID_72295; Strand=+; Position=1-49
LKAIHCLPVLGTAKN

SEQ ID NO: 145873 - protein, 241 aa, Heterodera glycines
  Coding regions on vcDNA: vcDNA=SeqID_72296; Strand=+; Position=1 -251,547-707,768-1079
MEPLCPIHIINASEGEPFEYQSGTNETEDTDDLDAQINQTKRDELLEVHKKTMYKSTKFWEVFRDDYLLALREKEKAKNVDEQRKNWKKNGADFWTCNLIPARIPNLDAKVSTQRGSLKIQVGVGNILNGSGYLNTFEQKQNQFLEAELSQLGKPVKDQVSVFRGVSETHPFSDQFTHHFPNQEKSDIGTSLNLAERSEQRICDKAVNESGTIGRDGAIERVKKGTKEDGANGEKGDNDEI

SEQ ID NO: 145874 - protein, 380 aa, Heterodera glycines
  Coding regions on vcDNA: vcDNA=SeqID_72297; Strand=+; Position=1 -72,128-223,581-694,1321-1582,1878-2050,2138-2220,2274-2391,2877-3101
  Homolog annotation: Hit_ID=CAE72571.1; Match level="QueryCoverage =55%, HitCoverage=10%, E-value=2e-22, Identity=34%"; Hit description =Hypothetical protein CBG19758 [Caenorhabditis briggsae]
MSKQLEEYGEQKSTSISTAKRLAEFLGADIVRSKGSLACSFVISRFPLGDSVSERTLPLAIFDAAPKERVKFLRKWTKANSLGEEFGSDKCLKESANAPASVVVRPMPTTPGSAGRKSRGASVHLTPWSLKKKQQHQQQSPLTPTAAATTASRRKRPLLATSVDGDEQQQQQCPDGASGNGVSSKRICASADVVVELLEDEEAENAENRRPPPAHQPTGPMDLVALDTLLEQQGHNQQPQTEQERRAEAVQKTAKMDKKKSAAQLKREAKRAAVLQHAGRAFPRRCYAAMSQPTKRSWHSDGFMPWALLERAMEAADDAQAAAGTDADSDAVRIGTSAGGGAVVHLSTATAAALSLARRESTWHILQVHNAHTQSKHYRT

SEQ ID NO: 145875 - protein, 76 aa, Heterodera glycines
  Coding regions on vcDNA: vcDNA=SeqID_72298; Strand=+; Position=1-231
MPTCAARTVPSVHQREGSGTARARAAERVEMGAHGAGAAVHADQPTDAGRAVQGVHHSVWGSIFTRKNGDGTKSRR

SEQ ID NO: 145876 - protein, 23 aa, Heterodera glycines
  Coding regions on vcDNA: vcDNA=SeqID_72299; Strand=+; Position=1 -36,170-205
MQHFFNSFTFLKTKFKNAIIIII

SEQ ID NO: 145877 - protein, 126 aa, Heterodera glycines
  Coding regions on vcDNA: vcDNA=SeqID_72300; Strand=-; Position=1 -22,211-569
MTQHFHCDTKSVFVRRFVCFQRTCSPGQDILDFGATLNAKCERADMNLSKAEIKCLIFVTGLGEMHRDLRPECLRQMENARKTTPPRDIKLELLLEECRSIQSLQHSAAALANPGQVHAIPSKPKI

SEQ ID NO: 145878 - protein, 62 aa, Heterodera glycines
  Coding regions on vcDNA: vcDNA=SeqID_72301; Strand=+; Position=1 -76,188-300
MGGPVGIAAGSLVAGIAAAVGGAFAGLYGGRVLQRKVKQSTAVDSQQSVVVGNGAAQNANGR

SEQ ID NO: 145879 - protein, 105 aa, Heterodera glycines
  Coding regions on vcDNA: vcDNA=SeqID_72302; Strand=-; Position=1-315
MRCPRCSGPHPIGYPCFIQPLKDETSSGRRSERRMRQPNHHIDNNNNDDADNSVNDRGHDDDDGNEVEEEEQEDDDDANESKKAVRLCFFDAETSQDLPLQLRTK

SEQ ID NO: 145880 - protein, 46 aa, Heterodera glycines
  Coding regions on vcDNA: vcDNA=SeqID_72303; Strand=+; Position=1-273
FFLFLDILIVLIFVVFDSPNNNPLQSKSHVNFLNCLIIGGTLFGVH

SEQ ID NO: 145881 - protein, 221 aa, Heterodera glycines
  Coding regions on vcDNA: vcDNA=SeqID_72304; Strand=+; Position=1-666
MKRSNTTKDTPPQPKRSMASAPDSGPNTAALAEQERQRTLVLIGLPESNAVRPSQRVKEDREAVTKILDHLDVEAEPTAVFRLGRFNPQRTTPRPLKVVMPTPTHQHMALGGWKRERAQLRSQQNLARLFVRPALTKEQLKEENEARVRKRQQIPAPMAPAAQLPQTNVPTPVNENGSEQKEAANGYISKPQNPVEEEILLDKAISQMQSFRKQFPQLFNK

SEQ ID NO: 145882 - protein, 34 aa, Heterodera glycines
  Coding regions on vcDNA: vcDNA=SeqID_72305; Strand=-; Position=1 -15,174-263
MVLIKIDAEILQMVYGPNSGAVAVARQRNSHNAQ

SEQ ID NO: 145883 - protein, 190 aa, Heterodera glycines
  Coding regions on vcDNA: vcDNA=SeqID_72306; Strand=+; Position=1 -13,230-789
MIHLKTIFNYAKNGIAAKFGSGGRGFGRRFGRKWRKNGRDGRLETIREGTYGRDTAIEQNGERAGHGTVQRGGRRRGVTVRRNEMQRQEQSIGQSDFRLKAISGQCDFQWQPIGWDDVFQREIARGNSFVTSFGRIDEERAEKPQQSVRGRGGGRGRSANGGRGRRGNGAGRGWSRGASRNFDQGGRTDH

SEQ ID NO: 145884 - protein, 43 aa, Heterodera glycines
  Coding regions on vcDNA: vcDNA=SeqID_72307; Strand=+; Position=1-214
HSLRKRFSFSKSFFRYQICSFLLGMKRIMADQNKKYKKGIYQC

SEQ ID NO: 145885 - protein, 83 aa, Heterodera glycines
  Coding regions on vcDNA: vcDNA=SeqID_72308; Strand=+; Position=1 -101,153-507,550-599
MNKPPPPVVRLLFCRCFLYFFTHFTSYFGSLYCSIAKLSLPFGNRPTKTFSLIALLTNLGTKMREKMPKQRQIMPKISRAMTE

SEQ ID NO: 145886 - protein, 224 aa, Heterodera glycines
  misc_feature (13)..(13): Xaa can be any naturally occurring amino acid
  Coding regions on vcDNA: vcDNA=SeqID_72309; Strand=-; Position=1 -30,449-642,690-881,970-1161
  Homolog annotation: Hit_ID=CAE59815.1; Match level="QueryCoverage =93%, HitCoverage=40%, E-value=4e-41, Identity=44%"; Hit description =Hypothetical protein CBG03281 [Caenorhabditis briggsae]
NLKIFKSPQFSVXFQIVADHLVELKKHLSPIAAQKGLSKLSFMPIFVKATSLALTKFPRLNASFDPSHEQLILKRFHNISLAIDTPDGLAVPNRFHNISLAIDTPDGLAVPNIKNCQKKTIWEIASDFEKLCSRAREGRLSLEDLSGGTFALSNVGSIGGTYMIGGTYMSPLLLPPQLVIGAIGSIRKIPRFDGNGNLVATHVVTFSWSAAHRVSVDIGRKFTF

SEQ ID NO: 145887 - protein, 51 aa, Heterodera glycines
  Coding regions on vcDNA: vcDNA=SeqID_72310; Strand=-; Position=1-156
  Homolog annotation: Hit_ID=CAE70800.1; Match level="QueryCoverage =100%, HitCoverage=7%, E-value=5e-17, Identity=78%"; Hit description =Hypothetical protein CBG17560 [Caenorhabditis briggsae]
VHRVRPHHGQNLVAGRLRALLHSDLNRSEIAESHRHCGKVQDAYTLRCVPQ

SEQ ID NO: 145888 - protein, 36 aa, Heterodera glycines
  Coding regions on vcDNA: vcDNA=SeqID_72311; Strand=-; Position=1 -97,723-736
MIRRGTPEIRRGTTVIGRGTTVIRRGTTMIRREILE

SEQ ID NO: 145889 - protein, 126 aa, Heterodera glycines
  Coding regions on vcDNA: vcDNA=SeqID_72312; Strand=-; Position=1 -160,244-464
  Homolog annotation: Hit_ID=XP_522969.1; Match level="QueryCoverage =100%, HitCoverage=83%, E-value=1e-13, Identity=34%"; Hit description= PREDICTED: similar to putative protein family member (XC187) [Pan troglodytes]
MIRRGTTVIRRGTTMIRRGTIVIKRGTTEIKKGKTVIRRDTTVIRRGTTEIKKGTIVIRRGTTVIRRGTTEIRRGTTVIRRGTPEIRRGTTVIGRGTTVIRRGTTMIRRGTIVIKRGTTVIEEVQL

SEQ ID NO: 145890 - protein, 94 aa, Heterodera glycines
  Coding regions on vcDNA: vcDNA=SeqID_72313; Strand=-; Position=1-8,55- 331
MGSFIDFGFAVKQQTKLDEEIFDHKGNYAYESDGEIWISGEGKGINAEYSYGAGDTVGIAINLSTRQIIFTKNGLRLGWFASVFHYSSDPWKMK

SEQ ID NO: 145891 - protein, 49 aa, Heterodera glycines
  Coding regions on vcDNA: vcDNA=SeqID_72314; Strand=+; Position=1 -114,213-248
MFAEKLWFLEFRDSDPEVSGPVNRQSRATLLQISSVFNRFIVQLVNIRL

SEQ ID NO: 145892 - protein, 69 aa, Heterodera glycines
  misc_feature (32)..(32): Xaa can be any naturally occurring amino acid
  Coding regions on vcDNA: vcDNA=SeqID_72315; Strand=-; Position=1-208
LFEIKVPIPTFWHFLCPVLFSKIPVPNYSFFXNNLCIFKSDPSFFDPTEPCPPAQFKPSVAIVGNQRIF

SEQ ID NO: 145893 - protein, 56 aa, Heterodera glycines
  Coding regions on vcDNA: vcDNA=SeqID_72316; Strand=-; Position=1 -80,448-538
  Homolog annotation: Hit_ID=AAW24417.1; Match level="QueryCoverage =100%, HitCoverage=13%, E-value=6e-19, Identity=85%"; Hit description= paramyosin [Brugia malayi]
MQNLQRVRRYQRELEDAEGRADQAESSLHLIRAKHRSSVVTNKSNSPKVYVLEDEQ

SEQ ID NO: 145894 - protein, 193 aa, Heterodera glycines
  misc_feature (162)..(162): Xaa can be any naturally occurring amino acid
  misc_feature (182)..(182): Xaa can be any naturally occurring amino acid
  Coding regions on vcDNA: vcDNA=SeqID_72317; Strand=-; Position=1 -94,281-367,508-573,618-660,704-893
  Homolog annotation: Hit_ID=NP_497982.1; Match level="QueryCoverage =81%, HitCoverage=11%, E-value=2e-29, Identity=41%"; Hit description =latent transforming growth factor beta binding protein like (3F865) [Caenorhabditis elegans] emb|CAA86058
FQLAVIVGNNACFAHNIFSKLPKSVKAMVINSKMPKFLMLPGSGTSDSSQLTEKSNMGIPGEWLMRIDEEQIFLCGAGFRGIECVDSCLPTQCVDSCLPTQWHLDCSRQCHCADGSACNVVTGECPWHLDCSRQCHCADGSACNVVTGECPNGKCNPGKNGXKIIVTVENFYIPIIFWVNHXLICMNHKRNFK

SEQ ID NO: 145895 - protein, 44 aa, Heterodera glycines
  Coding regions on vcDNA: vcDNA=SeqID_72318; Strand=+; Position=1 -98,622-658
MSPQLLHPAILSRLVLTPAILHPTVMSPTVLSPEQFISRFPFSV

SEQ ID NO: 145896 - protein, 104 aa, Heterodera glycines
  Coding regions on vcDNA: vcDNA=SeqID_72319; Strand=+; Position=1 -117,541-735
MSKSFINIIIQFLFLLCLFYNFAKSFGEKSAPNPQQSPNFQQIPSDVLSVLSKDVAAQLEAIQNNGTLTVHEKAEQIDQIMTEQPSEVLDKIPDPPNFGTLPMN

SEQ ID NO: 145897 - protein, 56 aa, Heterodera glycines
  Coding regions on vcDNA: vcDNA=SeqID_72320; Strand=-; Position=1-321
LISSQKSCQLKTAKKAEFSKFFISIFFYSSKFSVIFSRLIEPVKSFRMISRLFDSV

SEQ ID NO: 145898 - protein, 38 aa, Heterodera glycines
  Coding regions on vcDNA: vcDNA=SeqID_72321; Strand=+; Position=1 -68,145-193
MRWNMNCLILFKIAHNHNIFWQSPLGFFEKSFGYFSSD

SEQ ID NO: 145899 - protein, 27 aa, Heterodera glycines
  Coding regions on vcDNA: vcDNA=SeqID_72322; Strand=+; Position=1-82
YYFNRVIVTRVRPGPGSRPGFFLDPGP

SEQ ID NO: 145900 - protein, 20 aa, Heterodera glycines
  Coding regions on vcDNA: vcDNA=SeqID_72323; Strand=-; Position=1-146
CARGGTVHPPPRHRPPPSVV

SEQ ID NO: 145901 - protein, 234 aa, Heterodera glycines
  Coding regions on vcDNA: vcDNA=SeqID_72324; Strand=+; Position=1 -436,488-583,638-733,940-1016
MKYFMNIFICFIHFYECQTIEEDIFEELWKHINKVDHKFESESVLPKVKEEPIEIAKNGVPTIKTEPYELPMNYGKTVVKNEPCENEMPKTKNDQQIQREKTHLTNYGRIVKVKKEKFNAEEPLYKEEDNRDLKCENECYENSSTDTTDDNYEIEESANDDYDNSEDDADINNVPNEDSSLTDSEQEKRVHLTKKRLRGIFTKKDGPKNAKLFRAMSSTEEKVRLAQAKATKST

SEQ ID NO: 145902 - protein, 94 aa, Heterodera glycines
  Coding regions on vcDNA: vcDNA=SeqID_72325; Strand=-; Position=1 -175,220-328
MGKSFYEEKKKEFIERFDEFKDLYAHGKQKEFVKELGISEVTFWKWKKELAPKYDKSKKRRTDEDELMKMKRYFEIKEANPKMSDELIPKKWEW

SEQ ID NO: 145903 - protein, 65 aa, Heterodera glycines
  Coding regions on vcDNA: vcDNA=SeqID_72326; Strand=-; Position=1 -39,154-312
MYLDPALYFSWIQRSFAPPAGGKNIALNYKLHAFTIKVKINGLEKKPMLAYYSPVEAVCFKVEKS

SEQ ID NO: 145904 - protein, 199 aa, Heterodera glycines
  Coding regions on vcDNA: vcDNA=SeqID_72327; Strand=-; Position=1 -442,488-645
MGNDPIDQMNGLNDQNILKSVQSYKKNETDQQKRETVKKFDAIKEKFREKGKYQRKDQSKIETKIAKLLGTNRKLIQKWKNELNLNKSKIKKRFYDAKKRKFIERIDEFIELNGQGKQKEFMKELGICEFTFQKWKKELLPKYYKSQKNHNNEDRLEKLKKYYEIKEKNPKMSDVIIAKELEISRNTLINWKKQLATTN

SEQ ID NO: 145905 - protein, 98 aa, Heterodera glycines
  Coding regions on vcDNA: vcDNA=SeqID_72328; Strand=-; Position=1 -139,1260-1417
MQQQIENGQPLQPPLEAQQQGQQRSLLPSTADYEEHDDDLMRNNAEPINLISTKMLLWHFIFSIIFFVYKIESAKIRPNFDEIFGDGWDKDGSDQTVK

SEQ ID NO: 145906 - protein, 72 aa, Heterodera glycines
  Coding regions on vcDNA: vcDNA=SeqID_72329; Strand=+; Position=1 -166,430-482
MTRLRHSGEEAGSKPKLAKMAVPTEVAMEADGCANGSGDGIANGCADGSGDGCAGENKSIKEIGTEIGDHMD

SEQ ID NO: 145907 - protein, 103 aa, Heterodera glycines
  Coding regions on vcDNA: vcDNA=SeqID_72330; Strand=-; Position=1 -26,682-967
MFMTLNKHWAKRIGEAGPNAICHWAVSGCGMYVANIDDSISNNISSYDDDCTAERRPSIESRAEIVDAVEVGAGTRRGPFVLDAKSQAITRLLAAAEYKNGAF

SEQ ID NO: 145908 - protein, 176 aa, Heterodera glycines
  Coding regions on vcDNA: vcDNA=SeqID_72331; Strand=+; Position=1 -45,98-311,407-678
  Homolog annotation: Hit_ID=AAS16456.1; Match level="QueryCoverage =47%, HitCoverage=42%, E-value=2e-14, Identity=51%"; Hit description =HMW glutenin subunit [Thinopyrum bessarabicum]
MHFLFLSVFSLFLAKHCSNAIPIGAGNQRDVRRSMVIDLLNANQEFDQLRSQLATASANDLNAEDRVFGDLFKKIGNIAGNIGNYFDRKKPGNGEPLQPPQEPPQPGQGQWQPQPGQGQGQGEGQQYPGQGLQQPGQGQWQPQPGQGQQYPGQGLQQPGQGQWQQRSLLPSAADYE

SEQ ID NO: 145909 - protein, 49 aa, Heterodera glycines
  Coding regions on vcDNA: vcDNA=SeqID_72332; Strand=-; Position=1-154
FCLPLYTFIVLMQQFACILNLFGNSIDGSVRALPSLLSHVRPFFIVGAD

SEQ ID NO: 145910 - protein, 129 aa, Heterodera glycines
  Coding regions on vcDNA: vcDNA=SeqID_72333; Strand=-; Position=1 -94,159-188,307-511,637-665
  Homolog annotation: Hit_ID=CAE64344.1; Match level="QueryCoverage =98%, HitCoverage=64%, E-value=2e-36, Identity=55%"; Hit description =Hypothetical protein CBG09030 [Caenorhabditis briggsae]
HKMPGFVPPVQSKCPKCGKSVYAAEKMVAGGYDWHKFCFKCEDWHKFCFKCELCNKLLESTNVAPHEAELYCTKCHARKYGPKGVGFGVGAGALTMDCGAKFGNQRVEMTLVLQYATSSCSKTAATTTT

SEQ ID NO: 145911 - protein, 84 aa, Heterodera glycines
  Coding regions on vcDNA: vcDNA=SeqID_72334; Strand=-; Position=1 -120,178-312
MSQSGTTPVSAATRTTPGQMLDLYYTSLCQPAFPSITENPVNPLGMYPSHYLLEQYNQHLSQQQQQQGNNGGTSNASANGGGRF

SEQ ID NO: 145912 - protein, 269 aa, Heterodera glycines
  Coding regions on vcDNA: vcDNA=SeqID_72335; Strand=-; Position=1 -72,130-867
  Homolog annotation: Hit_ID=NP_649942.1; Match level="QueryCoverage =38%, HitCoverage=60%, E-value=6e-13, Identity=38%"; Hit description =CG8481-PA [Drosophila melanogaster] gb|AAF54446.1| CG8481-PA [Drosophila melanogaster] gb|AAL25278.1| GH0
MDFSLVPLAHKPELIDQCIDLLNEEWPRSQKARIVGLKRLLCTSPPMAYVFIENGSGELVGHLRLSPLGMGSARECWIESVVIRKGIRGQGIGRKMMEMVETEARLNQIMERFVRIYASPISKKNGTRKTHRAKLNVSFTSGSTVSTRFDSRMTVKTPTPISKRQICCSTTDKIDFYRRCGYKQSDRPIQNCGSSAPLLERFGLTSLLRNIEQNDELSIKQTGTTTPTECQAKKQSDPAKNVPIPPAPPLFFSGPHKITKKTFVFKQLE

SEQ ID NO: 145913 - protein, 50 aa, Heterodera glycines
  Coding regions on vcDNA: vcDNA=SeqID_72336; Strand=-; Position=1 -21,93-224
MKIKPQFTKKVASAHCRLLALFGIRDPCSTSRKTASPKRCGRLSEKGVFN

SEQ ID NO: 145914 - protein, 50 aa, Heterodera glycines
  Coding regions on vcDNA: vcDNA=SeqID_72337; Strand=+; Position=1 -85,212-281
SRPHRFGEAVLRLVEQGSRIPNSASSRHRKSLLVREDLVLDWRPVNEALH

SEQ ID NO: 145915 - protein, 71 aa, Heterodera glycines
  Coding regions on vcDNA: vcDNA=SeqID_72338; Strand=-; Position=1-502
EKIDFFVFGAVPPNRCAQIYGETESFGNSFPIACTLILRWIFAPHKCLSTPNGHLKKSIFLFHKYFFQKVL

SEQ ID NO: 145916 - protein, 64 aa, Heterodera glycines
  Coding regions on vcDNA: vcDNA=SeqID_72339; Strand=-; Position=1-756
SIPSFMRHQLHSFLVLPNCLKCIPKNALKMIKPVFSRISCQYFPIRNDTVNSFASLIHSCFASD

SEQ ID NO: 145917 - protein, 95 aa, Heterodera glycines
  misc_feature (90)..(90): Xaa can be any naturally occurring amino acid
  misc_feature (93)..(93): Xaa can be any naturally occurring amino acid
  Coding regions on vcDNA: vcDNA=SeqID_72340; Strand=-; Position=1-578
IIFIQKIFFWVFGAVPLNRCAQIYGETESFGNSFPIVCTLILRWIFAPHNCLSTPNGHLKKLIFLFSGQSPRTDAPRFMGRRNPSGIASXIAXYF

SEQ ID NO: 145918 - protein, 42 aa, Heterodera glycines
  Coding regions on vcDNA: vcDNA=SeqID_72341; Strand=-; Position=1-126
MDNCCIGRVREGSQRVRTASNISFILGVILPHCTSFVGLITQ

SEQ ID NO: 145919 - protein, 24 aa, Heterodera glycines
  Coding regions on vcDNA: vcDNA=SeqID_72342; Strand=-; Position=1-80
RTLSTAVRQRSSKIYSMPQILWAG

SEQ ID NO: 145920 - protein, 42 aa, Heterodera glycines
  Coding regions on vcDNA: vcDNA=SeqID_72343; Strand=-; Position=1-128
KFIIFINNREGVRYSKHGNSVLCLLLNNEKIQLQKIIFNCPS

SEQ ID NO: 145921 - protein, 85 aa, Heterodera glycines
  Coding regions on vcDNA: vcDNA=SeqID_72344; Strand=+; Position=1 -45,98-217,1009-1099
MGSDSPAARNYAYTYIINQRLKLPKIEVIPLPPADQIHPADLNAMNVLRQNLYIEKNGEQLGCTVHWVPKKLANEQLLTMVRVKF

SEQ ID NO: 145922 - protein, 249 aa, Heterodera glycines
  Coding regions on vcDNA: vcDNA=SeqID_72345; Strand=+; Position=1-890
LLASVAKRRYYSRLVKTDSFSRNNSVSAQACAWAAKATEQVVMTQRWPGIRASRTWEEPSRRWTQLRGQCTGTHTSTPDFPVRTLPQAKGLRSLMSRVFSNASTLVPRQGVPIHELIGLVNHGNTPLTRIPTPPPTLGSASPVLSSPQHLCLRQHLHKSINSPNFFNTQTSCMFYSFRQLPIAGETEATTKVAPQQQPSPFNAEHKRKQALKPRRPRSPQRNRFFFPATISQKRPNHHTHPRQLTNAKH

SEQ ID NO: 145923 - protein, 38 aa, Heterodera glycines
  Coding regions on vcDNA: vcDNA=SeqID_72346; Strand=+; Position=1 -21,194-277,369-380
MREWEKREFLSATSSVNFIICFTSFCIATRPRSGRKLL

SEQ ID NO: 145924 - protein, 69 aa, Heterodera glycines
  Coding regions on vcDNA: vcDNA=SeqID_72347; Strand=+; Position=1 -84,533-658
MDPIQARPSNYDDSELISLIQFHSIDIILLTLLAAADLCTSLGIFVLGLMRKALYEQVMETSRIPIEVW

SEQ ID NO: 145925 - protein, 138 aa, Heterodera glycines
  Coding regions on vcDNA: vcDNA=SeqID_72348; Strand=+; Position=1 -60,210-397,457-625
MAMLSINNNNPSDELQSARQNRSAHGTLSAEGAGAAEAIQSLNELGKDDEERDELGNNNGNRQMMDGGGGGGLSQEEDLNEFNLYYSMAEDGARLDYFQFAYEGVSESDEPDSVTCSRRNSQESEEEKGWNGRVMDTV

SEQ ID NO: 145926 - protein, 185 aa, Heterodera glycines
  Coding regions on vcDNA: vcDNA=SeqID_72349; Strand=+; Position=1 -150,238-505,693-831
MLNALPLPSNREHVEKAAAAGPGRWSPVPKRARTVEENMALIESRWQYLEELRLEREETAKKEGEKGEEDGDNLFRLDLSEVAATDENGNSEEQQRQMAEERMDDEENGVSGDNDKNANNTDNNNNNEDGFPMECVDGMGAGVLLDSLFEALSRLTEHTFATNLQLIGAFNELFAYSQPLLTTYL

SEQ ID NO: 145927 - protein, 18 aa, Heterodera glycines
  Coding regions on vcDNA: vcDNA=SeqID_72350; Strand=+; Position=1-57
WRKKRMRRLKRKRRQAKK

SEQ ID NO: 145928 - protein, 91 aa, Heterodera glycines
  Coding regions on vcDNA: vcDNA=SeqID_72351; Strand=-; Position=1 -85,516-706
MAGKCFMPNESAKTGGISLRFSADCSVSPCLMRAVLRGSTNSPAADEACLVEKDGAKKCAFNVGQSFDAVAVSCNGCPSQKVLKCAEYMAR

SEQ ID NO: 145929 - protein, 24 aa, Heterodera glycines
  Coding regions on vcDNA: vcDNA=SeqID_72352; Strand=+; Position=1-80
RTLSTAVRQRSSKIYSMPQILWAG

SEQ ID NO: 145930 - protein, 16 aa, Heterodera glycines
  Coding regions on vcDNA: vcDNA=SeqID_72353; Strand=+; Position=1-49
EAIPEGFGLPINLGAS

SEQ ID NO: 145931 - protein, 30 aa, Heterodera glycines
  Coding regions on vcDNA: vcDNA=SeqID_72354; Strand=+; Position=1-3,59- 148
MIIICLVKFLCKFGEYFCFDWFHFFSYKFD

SEQ ID NO: 145932 - protein, 154 aa, Heterodera glycines
  Coding regions on vcDNA: vcDNA=SeqID_72355; Strand=-; Position=1 -231,611-844
MQLAFTIISTRTEFNENSKLEVTLANADRIGKALLGISEPIEHKFLEYLKISKIFLLADSLGADETALIEAECKNLEKFITNFVPIRASSAEETNKIGKNNLKFYVHFFKEMQQLLDSIKHIVKSGLKELWKKLIAFVEKFEEKLETFAKSTKN

SEQ ID NO: 145933 - protein, 282 aa, Heterodera glycines
  Coding regions on vcDNA: vcDNA=SeqID_72356; Strand=+; Position=1-846
MQKPIPSNRPNSSVSKTLACGLEKMVNASGNEPLTVPVLADRSDPLGLKSVQPDPVPMESAEAGTKEMEVMEVDEMSGEKGKKGEMGKEKVKSGGIEEEEESEGSEGELLGDGGFGNLQLNPSLRAGNKAVEKEDKGKPYLVAQVRSDGVIAARMKLFWDFPELVFVPFSLFDNAQPIEIGDLFRLHKCEWTNSGTGWEERGDWLYEATGRLNYQATATDVSQLRQRIPTQAVGILVDVQRARDRHVKVAMVSAPELSCVMRAYRRHFPADFTDNDIRYRSV

SEQ ID NO: 145934 - protein, 71 aa, Heterodera glycines
  Coding regions on vcDNA: vcDNA=SeqID_72357; Strand=-; Position=1 -96,500-619
MIYFRALLEPGVRSLPYRPLREDNGVAVGLRAGPFERIDDPLNFAIRLEDGVDVAICVQIFVIKMSISGLG

SEQ ID NO: 145935 - protein, 25 aa, Heterodera glycines
  Coding regions on vcDNA: vcDNA=SeqID_72358; Strand=-; Position=1-74
SKWGIEPRRKIMKGRKLTTTPHVHV

SEQ ID NO: 145936 - protein, 20 aa, Heterodera glycines
  Coding regions on vcDNA: vcDNA=SeqID_72359; Strand=-; Position=1-62
KKTRLFTIGQKWVVKCVFSP

SEQ ID NO: 145937 - protein, 16 aa, Heterodera glycines
  Coding regions on vcDNA: vcDNA=SeqID_72360; Strand=-; Position=1-48
MQKFNYFNEKRFNVVK

SEQ ID NO: 145938 - protein, 142 aa, Heterodera glycines
  Coding regions on vcDNA: vcDNA=SeqID_72361; Strand=+; Position=1 -253,300-475
CEFKNSTNKCNGRIWTDLHDQFIRLATPHTCPADASRVDAQMVTTAIKRRAIATFEPPSVIRAEALQNVPSPSAILVSKQAAKDLIKRARREVNAPPVVPANLEQLIISPAYQTYTPTDGIDEEFLLGDSGVYYERGNENPQ

SEQ ID NO: 145939 - protein, 43 aa, Heterodera glycines
  Coding regions on vcDNA: vcDNA=SeqID_72362; Strand=-; Position=1-505
CFAVPRTGRQWMALNLQEIRLAISGCKKLLGNELFFEVSQTPY

SEQ ID NO: 145940 - protein, 53 aa, Heterodera glycines
  Coding regions on vcDNA: vcDNA=SeqID_72363; Strand=-; Position=1 -90,143-213
LIEDTGLSNDTNNVQLVEKEKRYSPGSKFLKPNLFGMIKLGLFKLGRDREVPH

SEQ ID NO: 145941 - protein, 747 aa, Heterodera glycines
  Coding regions on vcDNA: vcDNA=SeqID_72364; Strand=+; Position=1 -360,782-2662
  Homolog annotation: Hit_ID=NP_510849.1; Match level="QueryCoverage =93%, HitCoverage=61%, E-value=1e-136, Identity=41%"; Hit description= predicted CDS, zn-finger, CCHC type and RNA-directed DNA polymerase and Integrase, catalytic domain cont
MYPDIRPKAKPAPAEINAMAIPQPTHKISDLESLTKALQTDFSEVFGPGLGHCTKAKAHLILKSDAHPTFCKARPVPHGALNAVNEELDRLLQIGAIKPIEFSHWAAPILAVMKKNGKTRPELLFLGHVISAKGIRPDPGRSEAIRQMPPPHDLSTLRSFLGALNYYGRFIKSMREIREPLDQLLRKDVKWEWTDEQQNAFQKAKEIMLSDLLLTHFDPSLPIVVAADASKDGIGATISHIFTDKSEKVIEHASCTLNDAQKNYSQIKKEALALVFAVQKFHRMLFGRKFTLLTDHKPLLAIFGSKKGIPIYAASRLQRWALIMSNYEFNIKYINTSSFGQADVLSRIIANYPRPEEDILIANICTETDCYIKTILQTATDQLPITKAEISEWTPKDDVLRKISDHTKNGWPQKCTDPDLSPYFPKRKEILEIDGCLLYGKRVIVPTKLRERIIKALHMAHPGIVRMKALARQHVYWPGLDLEIERMVRQCEDCQSAQKSPPKAPLAPWTSCSRPFQRIHIDFAGPCSDGHSYLILIDSFSKWPEVYRMDRISTPATLQVLRSIVYRLGFPEEIVSDNGTQFHAAEFEEFCSEFGIKHTFTPPYHPQSNGQAERFVDTFKRAMKKCAKDGKFWAEKMLLAYRTTPNSALNGLSPDQLFFGRRLRTQLSLLHPKEEQAEVIDPAKIRKSQADYARKMARQFDQHHGSKSVEFLTKDPVLLLNFNRGKRFWLNGTIIKRLEKSPTYRVH

SEQ ID NO: 145942 - protein, 217 aa, Heterodera glycines
  misc_feature (36)..(36): Xaa can be any naturally occurring amino acid
  Coding regions on vcDNA: vcDNA=SeqID_72365; Strand=-; Position=1-649
  Homolog annotation: Hit_ID=NP_510849.1; Match level="QueryCoverage =100%, HitCoverage=16%, E-value=1e-56, Identity=48%"; Hit description= predicted CDS, zn-finger, CCHC type and RNA-directed DNA polymerase and Integrase, catalytic domain cont
MDQIVSGIPGAFAYLDDGIIASKTLEEHIFSLYKLXKRIQEFGLKIQLEKCKFLQPELLFLGHVISAKGIRPDPGRSEAIRQMPPPHDLSTLRSFLGALNYYGRFIKSMREIREPLDQLLRKDVKWEWTDEQQNAFQKAKEIMLSDLLLTHFDPSLPIVVAADASKDGIGATISHIFTDKSEKVIEHASCTLNDAQKNYSQIKKEALALVFAVQKFH

SEQ ID NO: 145943 - protein, 72 aa, Heterodera glycines
  Coding regions on vcDNA: vcDNA=SeqID_72366; Strand=+; Position=1 -145,300-373
MTWDNPLTTAQAKKGNYGERTKSADSPAPNNWSPDSPKPSKQKTEAPLVALSDSGIAIRTNVLRERGEWALC

SEQ ID NO: 145944 - protein, 21 aa, Heterodera glycines
  Coding regions on vcDNA: vcDNA=SeqID_72367; Strand=-; Position=1-62
QLHGVRHLNVQQTALVPVRLP

SEQ ID NO: 145945 - protein, 79 aa, Heterodera glycines
  Coding regions on vcDNA: vcDNA=SeqID_72368; Strand=-; Position=1-302
GNFLNLYSIPEKWLSLFFEKFYTSQKRLRMRRRAVHNRHFISQRIFIFRGYPRKMAISFFDKFYTHTNALEHDREGGAQ

SEQ ID NO: 145946 - protein, 33 aa, Heterodera glycines; identical to SEQ ID NO: 136332
  Coding regions on vcDNA: vcDNA=SeqID_72369; Strand=-; Position=1-101

SEQ ID NO: 145947 - protein, 111 aa, Heterodera glycines
  Coding regions on vcDNA: vcDNA=SeqID_72370; Strand=-; Position=1 -72,210-473
MLSMLTIVVCPPSLFLLLLHLFPSSRRHKEEEQLQQQQKTTATIEANECQTEGRENGGMEAKLPKIVAQNIDGEEEAVLPIESDNDDDEEAEQKEDNSFAKKEVGNCMPMG

SEQ ID NO: 145948 - protein, 102 aa, Heterodera glycines
  Coding regions on vcDNA: vcDNA=SeqID_72371; Strand=-; Position=1 -98,706-916
MAIDSKDLSAEERFQFSMRKLEFLEELGNDAGSVTPQQLVPQQQQHHQRLNNNNILINSNNIKMEHDDVLNGMNSIKVENDYVGIGGTTSIKVRKRRHSASR

SEQ ID NO: 145949 - protein, 19 aa, Heterodera glycines
  Coding regions on vcDNA: vcDNA=SeqID_72372; Strand=+; Position=1 -35,251-275
MAKTNSKEMPGKKLKFFQF

SEQ ID NO: 145950 - protein, 130 aa, Heterodera glycines
  Coding regions on vcDNA: vcDNA=SeqID_72373; Strand=-; Position=1 -60,111-188,271-445,498-577
  Homolog annotation: Hit_ID=CAE63460.1; Match level="QueryCoverage =72%, HitCoverage=84%, E-value=2e-17, Identity=50%"; Hit description =Hypothetical protein CBG07924 [Caenorhabditis briggsae]
MSFQQIFSTSAVLFGLVFITSTLSAPAPKPQNQQQHPAEKQPFNAYLNPGFDKRSFDSFTGPGFTGLDKRAAFDTGFTNYDKRAFDSFTGPGFTGLDKRFEPFDGYGFNGFEKRSFDSFTGPGFTGMDRK

SEQ ID NO: 145951 - protein, 64 aa, Heterodera glycines
  Coding regions on vcDNA: vcDNA=SeqID_72374; Strand=+; Position=1 -53,111-252
MVVLSVYTVSIYMCLSLLRSNSCNDMKKTELSKISLSMSFELKMKGANGNLFILKSVRKRKRAA

SEQ ID NO: 145952 - protein, 33 aa, Heterodera glycines
  Coding regions on vcDNA: vcDNA=SeqID_72375; Strand=+; Position=1-100
MFHLRFVVLLLLVIVGLFIGPNFVSADCDKKVA

SEQ ID NO: 145953 - protein, 82 aa, Heterodera glycines
  Coding regions on vcDNA: vcDNA=SeqID_72376; Strand=+; Position=1-249
MDKCLNRKDVLMCRELADEAKGAFEIVKQYRLDAGTAYRNAYTQSDLGIGELAEKVKETMKEYLSRPGLSSRPTFNDEFISA

SEQ ID NO: 145954 - protein, 62 aa, Heterodera glycines
  Coding regions on vcDNA: vcDNA=SeqID_72377; Strand=-; Position=1-247
PYIWLYRFAFGGFAWNSGIMRTRPIWQVKQRLLTSQKVRCRDETNQHCLPRGTRHGPPKEWI

SEQ ID NO: 145955 - protein, 42 aa, Heterodera glycines
  Coding regions on vcDNA: vcDNA=SeqID_72378; Strand=-; Position=1-127
MFLDEQPIAQSIHNAFTDWQRFVWQMLSVQKGGGRCPNGVEE

SEQ ID NO: 145956 - protein, 64 aa, Heterodera glycines
  Coding regions on vcDNA: vcDNA=SeqID_72379; Strand=-; Position=1 -183,382-393
MPPFGAFSHLLFFFLLFLLFVVPTTVPSILRLFLRFFIFKFVVRFLCRPRLLLFQFFIVFVRVC

SEQ ID NO: 145957 - protein, 136 aa, Heterodera glycines
  Coding regions on vcDNA: vcDNA=SeqID_72380; Strand=-; Position=1 -96,916-1230
MLTLNEFARWTGLTLFEMDLHSAALFLTSLLFQFPSFSIPGQNSRFLIVPSWSVFNLICLLRLITSSSCSDLSAPLSSLLSDSLPILNAAGSGFSSSSAAEGGELEDEGRLFGWVGEANGGENWADQSLLNDAKGT

SEQ ID NO: 145958 - protein, 18 aa, Heterodera glycines
  Coding regions on vcDNA: vcDNA=SeqID_72381; Strand=-; Position=1-55
SDGLGRVSSGRRNSLSCC

SEQ ID NO: 145959 - protein, 165 aa, Heterodera glycines
  Coding regions on vcDNA: vcDNA=SeqID_72382; Strand=+; Position=1 -25,77-282,548-811
  Homolog annotation: Hit_ID=CAG88281.1; Match level="QueryCoverage =74%, HitCoverage=24%, E-value=2e-09, Identity=35%"; Hit description =unnamed protein product [Debaryomyces hansenii CBS767] ref|XP _460025.1| unnamed protein product [Debaryomy
MTLCDRQKGNGGDGFQLLADSLLTYNENNEKLKKKKPRTTQKTNDEFENKKAQKEAENGRNGGGHDEQQEEEEEEEEIQRLRRVHRIFTWGHNIPRPISDFASLPLPDKFRANLRDFIQPTPVQMQGIPIGLLHRDHLITAPTGLCSNFAFQMLNFYFIMAFNSM

SEQ ID NO: 145960 - protein, 153 aa, Heterodera glycines
  Coding regions on vcDNA: vcDNA=SeqID_72383; Strand=+; Position=1 -451,502-690
RKKQKPVKCRMFGYVPFASFSNDWSAQFSPPFASPTQPKSRPSSSNSPPSAAEEDENPLPAAFRIGNESESSDESGAERSEHEEEVIRRSKQIRNRERWELLKYKMLISSCCTPSKNPSKNDNELPANCKHETAEEEEQWDEEREREFVFSLL

SEQ ID NO: 145961 - protein, 99 aa, Heterodera glycines
  misc_feature (68)..(68): Xaa can be any naturally occurring amino acid
  Coding regions on vcDNA: vcDNA=SeqID_72384; Strand=-; Position=1 -146,203-248,328-432
LSRHFLFSLTILHLFAPLFVASALNFYFLVIIFVRTVIEDGSPKRAIAGNALHFFRVTMVALFEMILXHKLQDEFERGNQQKSIETTYFMIMMPLWALL

SEQ ID NO: 145962 - protein, 267 aa, Heterodera glycines
  misc_feature (255)..(255): Xaa can be any naturally occurring amino acid
  misc_feature (259)..(259): Xaa can be any naturally occurring amino acid
  Coding regions on vcDNA: vcDNA=SeqID_72385; Strand=+; Position=1 -38,368-552,627-760,1043-1166,1978-2073,2133-2306
  Homolog annotation: Hit_ID=CAI25508.1; Match level="QueryCoverage =92%, HitCoverage=36%, E-value=9e-51, Identity=44%"; Hit description =DEAD (Asp-Glu-Ala-Asp) box polypeptide 52 [Mus musculus]
IEPTKILAKQVGPYLSSSGDILVTTPNRFIFALEKLSDDGQMENLQWLLLDECDRMFEEGEASFRVQLSKILRLCNGKETLSKILRLCNGKETRRGFYSATFSYEVEEWCKEHLEEVVMACIGPRNSANELVKQELLFVGWEQAKVSAVRDIVRRGFDPPALLFLQSKDRAKQLFVELSESCNSIPIGLISGELTEEECEVTIGRFRSGCEVTIGRFRSGKIWLLICTEMMGRGIDFQEVNMVINFDLVINYPSXLTLXPFLCFSSQ

SEQ ID NO: 145963 - protein, 49 aa, Heterodera glycines
  Coding regions on vcDNA: vcDNA=SeqID_72386; Strand=-; Position=1-149
  Homolog annotation: Hit_ID=AAA16375.1; Match level="QueryCoverage =100%, HitCoverage=11%, E-value=3e-21, Identity=100%"; Hit description=yejA [Escherichia coli]
MPWPSSDLQISWSSEYINSTYNAPGVQSPVIDSLINQIIAAQGNKEKLL

SEQ ID NO: 145964 - protein, 46 aa, Heterodera glycines
  Coding regions on vcDNA: vcDNA=SeqID_72387; Strand=-; Position=1 -91,419-468
MRSTVSSSMALLFLLRLPASSKMRRTSEAQNMLSSTSTTSLVKRDN

SEQ ID NO: 145965 - protein, 76 aa, Heterodera glycines
  Coding regions on vcDNA: vcDNA=SeqID_72388; Strand=-; Position=1 -84,347-493
MPDLVHSGAEVISIQSTSEDCERQSNGSKWKIMKIFHETISVKKETQFGVINAHSHHRNVSFIELTQNQHQTQFGD

SEQ ID NO: 145966 - protein, 108 aa, Heterodera glycines
  Coding regions on vcDNA: vcDNA=SeqID_72389; Strand=+; Position=1 -47,109-388
MSDNRNEAEEKMAKAIFISADCWLCVYDLLPASQLGLGIAMISHRFDFYVDEHFKTRRWNLGSMKIKMKFEADGTKEMDVVNANLESFGIAQKPLPKRVVGFKAISLK

SEQ ID NO: 145967 - protein, 38 aa, Heterodera glycines
  Coding regions on vcDNA: vcDNA=SeqID_72390; Strand=-; Position=1 -64,189-238
SGSAMCEFVKPTKRHLAKYTHSQYPAAKSFHWHSAHFA

SEQ ID NO: 145968 - protein, 157 aa, Heterodera glycines
  Coding regions on vcDNA: vcDNA=SeqID_72391; Strand=-; Position=1-474
MLYMSQYSLHDFNIDFVLFLQNFKYHVEFMKVEEEREELRLWMDPMRNIEYLIRDFKNNLQENSDAKSQAYMLIVRKTQNDLNFNTNLIMSHPFKALSDQQLLIELIREHKNSGIRTENKTITQQQGQVERRQFEKAQSQRPIRPLKIVFRFVINAM

SEQ ID NO: 145969 - protein, 164 aa, Heterodera glycines
  Coding regions on vcDNA: vcDNA=SeqID_72392; Strand=+; Position=1 -66,119-217,298-627
DLTTSAEMQPIALDNNNSNNNMNPQISSSASSSRRRNNANAGRGRGRGGGTRRRANARQQTQSERIQSSQPQTVQILSPSVVQHGQGLTREQCDSILPNLEVNEAMVRNDERCVICQIGFDLGSLNATELPCKHLYHLSCARDWLMHQNRCAICMRRFVLDSDA

SEQ ID NO: 145970 - protein, 75 aa, Heterodera glycines
  Coding regions on vcDNA: vcDNA=SeqID_72393; Strand=+; Position=1 -54,98-271
MSTIGVDEIFKLSQKDHQPPEKRSKLSDGSTQIVPSVAAAKNGGDILEALEKSEDTSELNEIDEASVKRICFQVQ

SEQ ID NO: 145971 - protein, 86 aa, Heterodera glycines
  Coding regions on vcDNA: vcDNA=SeqID_72394; Strand=-; Position=1 -99,159-296,590-613
MNITELINGLCVKGAGCVNSMNFVFFLFIFMAQVCIFWAILLNVPARLRCIERLRPRRPPVSNNDEGHPRTLRFLVRREADEAVEN

SEQ ID NO: 145972 - protein, 60 aa, Heterodera glycines
  Coding regions on vcDNA: vcDNA=SeqID_72395; Strand=+; Position=1 -119,737-802
QINENVVKEAVDSIEEYEDNSAYIEVAKKCNEIVHWEDLYTKKCAKNKQPIPLGFLREKV

SEQ ID NO: 145973 - protein, 111 aa, Heterodera glycines
  Coding regions on vcDNA: vcDNA=SeqID_72396; Strand=-; Position=1-336
VKIKYTDEAKRKCCWVMLAICIICVSLRFYFIKSEKNFPLPQPFVTLFMLTFMSMILLLSTNLKILSFLSFLPPEVLLIVVILAGLSSQTASVVSLMLCFHKSYFGKIFGH

SEQ ID NO: 145974 - protein, 126 aa, Heterodera glycines
  misc_feature (9)..(9): Xaa can be any naturally occurring amino acid
  misc_feature (14)..(14): Xaa can be any naturally occurring amino acid
  misc_feature (43)..(43): Xaa can be any naturally occurring amino acid
  Coding regions on vcDNA: vcDNA=SeqID_72397; Strand=+; Position=1-730
GSNTHLFVXTADMXKSNEVHLLFVDGIEWGMGNSACHLIPTSXDIVFCPNWGRDIRKSITKFQIQYVGHHFYKTFVWHRRIVNKPHLFVLFYLKCQSPLLFRSLFRLILTIGIRVCRCPVPVGSAR

SEQ ID NO: 145975 - protein, 80 aa, Heterodera glycines
  Coding regions on vcDNA: vcDNA=SeqID_72398; Strand=+; Position=1-242
MPSNGANEPKMWAREGIDALNGTVQLQSPPGYGSFPFLDGRRFQRENGSKIWYFVYAVEPMTDKAKDGLPKQSLTKCLSE

SEQ ID NO: 145976 - protein, 16 aa, Heterodera glycines
  Coding regions on vcDNA: vcDNA=SeqID_72399; Strand=+; Position=1-48
MAIVHSPPSLRKRFCE

SEQ ID NO: 145977 - protein, 97 aa, Heterodera glycines; identical to SEQ ID NO: 143380
  Coding regions on vcDNA: vcDNA=SeqID_72400; Strand=+; Position=1-304

SEQ ID NO: 145978 - protein, 278 aa, Heterodera glycines
  Coding regions on vcDNA: vcDNA=SeqID_72401; Strand=+; Position=1 -77,122-302,417-556,612-1050
MKECFADGTFSITPKPFQQVYAILARRNRWVMPVCYCMLSNKTHTTYERMFRMLVAVWPDFNPYSVSMDFETAAITALNVVFPFTERYQNDPTFAEMARCVTSLAFLPIGDLTPGIIALDMALPDELTPVLDWFIMNYTGRLKHDVSRTRPRFDPNIWSVYTRTLQGDDRTNNHSEAANRRLQCAFACSHPSIWHFIYLLRKDQKLSDDDFAKCSTGQEPPQKAKKYREADRRILTMVQNYLPLNNVDTNIFPIHQPFNHHFIIAFLIGISRNYEMRP

SEQ ID NO: 145979 - protein, 89 aa, Heterodera glycines
  Coding regions on vcDNA: vcDNA=SeqID_72402; Strand=-; Position=1 -66,327-530
  Homolog annotation: Hit_ID=NP_500480.1; Match level="QueryCoverage =65%, HitCoverage=30%, E-value=4e-23, Identity=91%"; Hit description =ubiquitin conjugating enzyme (21.5 kD) (ubc-1) [Caenorhabditis elegans] gb|AAC02561.2| Ubiquitin conjugat
MIPLPEFAEHRQRLPLPLPSPENQWSPTYDVAAILTSIQSLLDEPNPNSPANSLAAQLYQENRREYEKRVQAIVEQASLGPTWEFSHEV

SEQ ID NO: 145980 - protein, 230 aa, Heterodera glycines
  misc_feature (44)..(44): Xaa can be any naturally occurring amino acid
  Coding regions on vcDNA: vcDNA=SeqID_72403; Strand=-; Position=1 -225,417-624,1032-1059,1246-1318,1734-1792,1838-1885
  Homolog annotation: Hit_ID=CAE66995.1; Match level="QueryCoverage =73%, HitCoverage=65%, E-value=2e-45, Identity=47%"; Hit description =Hypothetical protein CBG12393 [Caenorhabditis briggsae]
PPPPLSMYAWGLYFSTARLKRRVSFNGTAGGGGLYYRNISIKHXIISFSTASVILCFSLLIGGIMGLVFRQKVRIQTPLHLKMNTSLKELYGLSDMTAITLAWDSLQREFRCCGVNGTEDFTIWRTSKWHMHHREPKPAFPQSCCVPERLAECMTNFTGSEAAAFYTNTCYMPFRTDLLSVVHVAAWLSISCSFYLLVPAFFATFFAKLVKKYLLVPAFFATFFAKLVKK

SEQ ID NO: 145981 - protein, 91 aa, Heterodera glycines
  Coding regions on vcDNA: vcDNA=SeqID_72404; Strand=+; Position=1-276
MYHDWGNAGFGSRWCMCHLEVRQMVKSSVPLTPQHRNSRCKLSQANVIAVMSDKPYNSFNDVFIFKCRGVWTNLIVKQPFIFNFCIGIDVY

SEQ ID NO: 145982 - protein, 27 aa, Heterodera glycines
  Coding regions on vcDNA: vcDNA=SeqID_72405; Strand=+; Position=1 -45,88-126
MDVQKNFIKLIEYFMNKKGHENHENDL

SEQ ID NO: 145983 - protein, 49 aa, Heterodera glycines
  Coding regions on vcDNA: vcDNA=SeqID_72406; Strand=+; Position=1 -82,131-198
MVFMLWILLNFVTDFLNMADIVMQTRREYFVDGILIRNAKLTQKRYILR

SEQ ID NO: 145984 - protein, 75 aa, Heterodera glycines
  Coding regions on vcDNA: vcDNA=SeqID_72407; Strand=+; Position=1-228
MIGRAVRNRPFIFQGIFKFILYPRKMAISFFEKFYTSQKRLRMRRRAVHNRHFISQRIFIFRGYPRKMAISFFDK

SEQ ID NO: 145985 - protein, 67 aa, Heterodera glycines
  Coding regions on vcDNA: vcDNA=SeqID_72408; Strand=+; Position=1-230
NGYLFFENFYTSQKRLRMRRRAVHNRHFISQRIFIFRGYPRKMAISFFDKFYTHTNALEHDREGGAQ

SEQ ID NO: 145986 - protein, 59 aa, Heterodera glycines
  Coding regions on vcDNA: vcDNA=SeqID_72409; Strand=+; Position=1-214
SKPRKKWSSKNRNYAQKASQTILTLPIPSTIAFIHPIMSAKIIRVPKIACDLSLEKNGL

SEQ ID NO: 145987 - protein, 16 aa, Heterodera glycines
  Coding regions on vcDNA: vcDNA=SeqID_72410; Strand=+; Position=1 -11,491-530
MLVCIPAKFGALLISF

SEQ ID NO: 145988 - protein, 267 aa, Heterodera glycines
  misc_feature (161)..(161): Xaa can be any naturally occurring amino acid
  misc_feature (186)..(186): Xaa can be any naturally occurring amino acid
  misc_feature (202)..(202): Xaa can be any naturally occurring amino acid
  misc_feature (227)..(227): Xaa can be any naturally occurring amino acid
  misc_feature (231)..(231): Xaa can be any naturally occurring amino acid
  Coding regions on vcDNA: vcDNA=SeqID_72411; Strand=-; Position=1-815
  Homolog annotation: Hit_ID=T02995; Match level="QueryCoverage=100%, HitCoverage=49%, E-value=4e-64, Identity=54%"; Hit description =unspecific monooxygenase (EC 1.14.14.1) - common tobacco dbj|BAA10929.1| cytochrome P450 like_TBP [Nicotiana
MYRPSQTPRLTLSSARVGVARLNTKMDTLSGALPPHRLSKESMKVVVFHWRLAAPTYATPLMILHKVRLESSSTGSSFPAKFAKPVPLAVVSLDSRRDSGNLVDPFVRVGKPTRHLATLRESCYSPVYPRLIKFPWLNIQSTGQKSDTVNVHKDHPSPLFXLDSRIPRVRASSKLVVQRQPKCIPXRAYTQLKRSTSSSHHXSTHHPRKNSTQPRAKAACFTQQPGXPDLXSQFFSRSYESNLPTSLTYIILSTRGCSPWRPAADIG

SEQ ID NO: 145989 - protein, 724 aa, Heterodera glycines
  Coding regions on vcDNA: vcDNA=SeqID_72412; Strand=+; Position=1-2174
  Homolog annotation: Hit_ID=XP_318187.1; Match level="QueryCoverage =82%, HitCoverage=71%, E-value=1e-121, Identity=39%"; Hit description= ENSANGP00000016242 [Anopheles gambiae]
MLEEANKNGTQVTLKQIEEELRTIQLVKDSALTLANPPVATHAIHTRPQQWRDPKGKTPQQPKRANNAKEQPARPPNTNYGKASRGSPTHPCGSCGESDHWRTDCRFKDATCHKCQGQGHIAKACRRSSNQAKNRRERSVHTVVVKSHCMGIGTAAGRWWRLTFIINGIKILMNIDTGAQATILTLKTWKKLGSPKLDKPDIETRNCNEVPFNIEGKFVCDVCQPNQAPKKLVAYVSSEINYDLFGLPWIEALEVIPREIMHPDIHPKAQPAPAEINAMAIPQPTHKILDLESLTKALQADFSDVFGPGLGHCTKAKAHLILKPDAHPIFCKARPVPHGALNAVNEELDRLLQIGAIKPIEFSHWAAPILAVMKKNGKTRVCIDFSTGLNNSLELNRHPLPRPEDIYTAISGSVYFSNLDLRDAYLQMELDEESKHLCGINTHRGLFQCQRLPFGVKSAPSIFQHLMDQIVSGIPGAFAYLDDGIIASKTLEEHICFLYKLFKRIQEFGLKIQLEKCKFLQPELLFLGHVISAKGIRPDPGRSEAIRQMPPPHDLSTLRSFLGALNYYGRFIKSMREIREPLDQLLRKDVKWEWTDEQQTAFQKAKEIMLSDLLLTHFDPSLPIVVAADASKDGIGTTISHIFPDKSEKVIEHASCTLNDAQKNYSQIEKEALALVFAAPKIPPNAIWSEIYSSHGPQAIVGDFWLQKGNTDLCGESSSRWALI

SEQ ID NO: 145990 - protein, 517 aa, Heterodera glycines
  Coding regions on vcDNA: vcDNA=SeqID_72413; Strand=+; Position=1-1554
  Homolog annotation: Hit_ID=NP_510849.1; Match level="QueryCoverage =85%, HitCoverage=32%, E-value=1e-74, Identity=35%"; Hit description =predicted CDS, zn-finger, CCHC type and RNA-directed DNA polymerase and Integrase, catalytic domain conta
MSNFEFDIKYINTSSFGQADVLSRLIANYPRPEEDILITNICTETDCYINTILQTATDQLPITKAEISEWTPKDEVLRKISDHTKNGWPQKCTDPDISHYFPKRKEILEIDGVLLYGKRVIVPTQLRERIIKALHMAHPGIVRMKALARQHVYWPGLDLEIERMVRQCEDCQSAQKSPPKAPLAPWTSCSRPFQRIHIDFAGPCSDGHSYLILIDSFSKWPEVYRMDRISTPATLQVLRSIVYRLGFPEEIVSDNATQFHAAEFKEFCSEFGIKHTFTPPYHPQSNGQAERFVDTFKRAMKKCAKDGKFWAEKMLLAYRTTPNSALNGLSPDQLFFGRRLRTQLSLVHPKEEQAEVINPAKIRKSQADYARKMARQFDQHHGSKSVEFLPKDPVLLLNFNRGKRFWLNGTIIERLEKSPTYRVHVPALGRNVHRHANQLRRRYPLEEDGNDTVRIPPQAQEEQDWTHRRSASLLRNRHQFDGLRQSDDLRVLLWPRVDRNANGKRRSASRQTPEGSA

SEQ ID NO: 145991 - protein, 150 aa, Heterodera glycines
  Coding regions on vcDNA: vcDNA=SeqID_72414; Strand=-; Position=1 -217,368-474,534-747
  Homolog annotation: Hit_ID=CAE61272.1; Match level="QueryCoverage =83%, HitCoverage=94%, E-value=8e-24, Identity=45%"; Hit description =Hypothetical protein CBG05087 [Caenorhabditis briggsae]
MFPLFTQLPFPSLLLFLSNFPSFAISFRLQGVGVKGVLLCNGAFAAHTNLAIFDVDRNPGDSDDLLDKGHTDGKGRFVLDGTTRELSQIEPELRIIHDCADDIKPCHRLFVIKVPPEFIHSGRAQKIFDIGTLDLEKKREDEQRTCQNNF

SEQ ID NO: 145992 - protein, 103 aa, Heterodera glycines
  Coding regions on vcDNA: vcDNA=SeqID_72415; Strand=-; Position=1 -114,180-377
MPKFCPRFLEWLNLNKLDQILRLRCKTFSCCDYEPFDQLDVQFNLKHLQTEIMDKANGTIFSDELLHLLFNGNPHIKAFSTRWVINCGDDFTDRLIEVEIQIN

SEQ ID NO: 145993 - protein, 193 aa, Heterodera glycines
  Coding regions on vcDNA: vcDNA=SeqID_72416; Strand=-; Position=1 -241,340-498,648-829
  Homolog annotation: Hit_ID=NP_491754.1; Match level="QueryCoverage =99%, HitCoverage=20%, E-value=3e-49, Identity=59%"; Hit description =HAlF transporter, PGP related (90.8 kD) (haf-9) [Caenorhabditis elegans] gb|AAK39394.1| Half transporter
MDTQQGYETDVGEKGGQMSGEREHSEDIPNFAVTGGQKQRIAIARALVREPAVLLLDEATSALDSESEHLVQEAIQKNLKGRTVLLIAHRLSTVENADKIVVVSAGRVVQQGVHRELIAQEGLYKQLVQRQMLGAEVNDDFPVRPAPMPQSRQSQRRGSRARSKSKTIRSDSPSQQSVTAQSFLGSSLASSYL

SEQ ID NO: 145994 - protein, 325 aa, Heterodera glycines
  Coding regions on vcDNA: vcDNA=SeqID_72417; Strand=-; Position=1 -213,261-361,576-1236
  Homolog annotation: Hit_ID=NP_871810.1; Match level="QueryCoverage =100%, HitCoverage=39%, E-value=5e-68, Identity=49%"; Hit description= HAlF transporter, PGP related (haf-9) [Caenorhabditis elegans] gb|AAO12389.1| Half transporter (pgp rela
MSNTLSLYMNVFWSVCLCCLITPMDHFSRNIVMLFGSLIFMFSLSWRLSVITFIAVPIIFLISKVFGVYYDRIAEENQHSVANSNDVAEEVLSSIRTVKSFACERSSKWESSRWYSSTEDIWSSKERFVHAVMNFMSFSETDATQIWHCVIRKSCQWPLINQPLFLIRSARDCSSPLCSTNSNWAKTSEFNSEQKKGSEELIIKELGEVWNGLMQAVGASRKVFELIDRRPLVQNDGRIAPDGRNAKIEGRIEFRKVRFRYPTRPNVPVLNVSGGQLPTHLITSLEDLSFTVEPGQAVALVGPSGSGKSSCIGLIEHFYEPDSGE

SEQ ID NO: 145995 - protein, 105 aa, Heterodera glycines
  Coding regions on vcDNA: vcDNA=SeqID_72418; Strand=+; Position=1-318
MSRQAKQQAKPRACPGEYQEDDSTMASKNGKRTSGEKQQKEEAADLRKSDQTKESGRKVSSKRKKKSDRSDRAKKSNVSVRPFPPHPKYSPPSTSQFSVVRQSSE

SEQ ID NO: 145996 - protein, 248 aa, Heterodera glycines
  Coding regions on vcDNA: vcDNA=SeqID_72419; Strand=-; Position=1 -78,133-237,284-523,565-747
  Homolog annotation: Hit_ID=NP_871810.1; Match level="QueryCoverage =99%, HitCoverage=29%, E-value=2e-43, Identity=41%"; Hit description =HAlF transporter, PGP related (haf-9) [Caenorhabditis elegans] gb|AAO12389.1| Half transporter (pgp relat
ESSSWYSPGQALGLACCFACLDILVNVLGLAWDGRFFTIDNIYHWFDFVLGLAWDGRFFTIDNIYHWFDFRYYNFTLNPVDFLAVAILRVCVLLAVAILRVCVLLGGALGVYFNPKGGAEACATFSNLTFAFVLVIVAFSPIKLLAFYEHEEMQFAVGDWILMVWCIVAALFVQGIWVTVFAKVRESMVTRGGIWVTVFAKVRESMVTRGDVLEQVDNEYFAEMQKRESEMDAQKRETMAMLWRLFGY

SEQ ID NO: 145997 - protein, 191 aa, Heterodera glycines
  Coding regions on vcDNA: vcDNA=SeqID_72420; Strand=-; Position=1 -95,416-758,941-1023,1100-1154
  Homolog annotation: Hit_ID=NP_741101.1; Match level="QueryCoverage =71%, HitCoverage=56%, E-value=2e-24, Identity=43%"; Hit description =putative protein family member (27.5 kD) (3E152) [Caenorhabditis elegans]
MNSSKKFFVLILVLALIAEPFVVCKRSGTYGRISSALGRNSGSNYPIGGYGRDRGGGITGRLFGHKNRHNYGGYDRYGTGKYGGKGAGLLGGGGRGAVGRGVAGGGLLGGLSRSRHRGLGGGGGGYKTSMFRNSGMGSRSRSNTFKNMIVGAAAGFLAYKAGKAIIRNVAAPMMWNNRQYYWGNKQLALPH

SEQ ID NO: 145998 - protein, 97 aa, Heterodera glycines
  Coding regions on vcDNA: vcDNA=SeqID_72421; Strand=+; Position=1-293
MKPLKIDVDFPSNSHPTSQELNQDCIPLYEMLEFEELQFPNYYLSEQLGRGAHATVMPCHFHGKPAAAKLFNANVDFKTIQKEAKLLHEFRHENIIE

SEQ ID NO: 145999 - protein, 332 aa, Heterodera glycines
  Coding regions on vcDNA: vcDNA=SeqID_72422; Strand=+; Position=1 -192,452-521,701-814,1633-1805,1854-1911,2203-2399,2539-2659,2734-2807
  Homolog annotation: Hit_ID=CAA74206.1; Match level="QueryCoverage =97%, HitCoverage=98%, E-value=3e-49, Identity=35%"; Hit description =serine proteinase [Heterodera glycines]
MLSKVCFPKCLLLLLFSCIIGNKFSLCDQILSPQTTEEKDYSECGISVFDPFNERSEENTEISHVFKGQTVDDDRALPWMATLLRRPFEIVQNATVYEPFCTATIVGPRHILTALHCVADINLFADNYKILFGAVQSSKQTHKLRIKRVHYHENATYLVLNDKLNPASGVYGEIVHPDFALIESVEPIQFSSRVRPICLFGIGSSNLKYSFSEKISAQHFNNSRPFVVAGWCYTEPICSKGTHRTSDQLMYGTMRMVSKDACPLAYGNGDSGSPLLSKIGDKNWVQVGVLYGGGGCSEKHPFSTSRRHSLYTPIDCDWISRVTNDEVKCKGW

SEQ ID NO: 146000 - protein, 209 aa, Heterodera glycines
  Coding regions on vcDNA: vcDNA=SeqID_72423; Strand=-; Position=1 -50,101-248,294-390,440-656,703-820
MLFIGIDRMLGIVFGEMHSKCKIRLYLATITIICSALNFSFCITIYQSIELNGDQMITGTYADFFMGSSLYSILWLFLIIITIFIYLFVGLIIRIKSAGLPSADQINYRTFRSLFCIIVVNVGGYCTNLIYLILIKPSIASPITAWFGLVISGISLNIGAASNAPILCFTSTEYRQAFQTAFPFVFKRFSNANQVIPLQNGHPLGTTQY

SEQ ID NO: 146001 - protein, 24 aa, Heterodera glycines
  Coding regions on vcDNA: vcDNA=SeqID_72424; Strand=+; Position=1 -48,391-417
MANLMEDFKKGTKCQEIKQRMAKC

SEQ ID NO: 146002 - protein, 365 aa, Heterodera glycines
  Coding regions on vcDNA: vcDNA=SeqID_72425; Strand=-; Position=1-1098
  Homolog annotation: Hit_ID=DAA04499.1; Match level="QueryCoverage =98%, HitCoverage=23%, E-value=7e-34, Identity=27%"; Hit description =TPA: pol polyprotein [Schistosoma mansoni]
MMKAKELKGRLEKYQVTLQSFELEIIYRPGKKNKVADFLSRYNIPGNEKDPEPKQEENSDEFDLQPKILSAKNINENLIAENDGILNENPKITLKTVIEAQTKVKELAKIFYILKTGKCPNDVLKWKRVVSDYSLINGAIYFIKGKENMERPKLIIPHSLRQKLFIIFHSEGHFGFEKTWHEIKERFYWIGMKDDVKLLIEACEKCQVRKIQPGQAKSAPSVPIEPSNGPFQRIHCDLMGPLKKTERGNLYIFLAIDSFSKWVMAKAIPDQKANTVSEIFVEIVVHQHSTPEIVVTDQGRQFTSGIFNDLAKIYGFEHVTTTPYHQQSNGMAEGAMRIMANIISQMVNEKGNNWDEILPHAIFYH

SEQ ID NO: 146003 - protein, 18 aa, Heterodera glycines
  Coding regions on vcDNA: vcDNA=SeqID_72426; Strand=+; Position=1-54
MRTRPIWQVKQRLLTSQK

SEQ ID NO: 146004 - protein, 47 aa, Heterodera glycines
  Coding regions on vcDNA: vcDNA=SeqID_72427; Strand=-; Position=1-146
PSNPIVISDITSDVFEAMLNFIYTDNLCAVNGENVAEMLYAGKIKFK

SEQ ID NO: 146005 - protein, 106 aa, Heterodera glycines
  Coding regions on vcDNA: vcDNA=SeqID_72428; Strand=-; Position=1 -198,280-399
MCQLLAVRCCWHLLTCIKQITAGPRLIEHSRGIKWRLKLFARNKIGRNGHIQPKLWHTVGKHNLCTGGHLHIEKADISMDGEKLTYYRKSSHHLDYSTHPSTNSIV

SEQ ID NO: 146006 - protein, 198 aa, Heterodera glycines
  Coding regions on vcDNA: vcDNA=SeqID_72429; Strand=+; Position=1 -24,339-514,1006-1402
MARQTSARVIKRLRRDENAPRTEPLNLEQLEIPNTYRIYKRTEIDKKHFLLADTGVFQIQGQNGPQRFLDNYMGRMRFNVPMAAPLFHPHEWNVHQRTLDGADRTNNFAEAFHRKLQRQFSCTHPTIWRFIDTIRCEQKAIDADISRCVMGESAPQKKKKYREADARILRLVHRYNDINNQGFFFYVNTCFFPGFSIA

SEQ ID NO: 146007 - protein, 46 aa, Heterodera glycines
  Coding regions on vcDNA: vcDNA=SeqID_72430; Strand=-; Position=1-140
MNAEHVECQRLVTGLKRRAAEMCEAPATISCSSAAKNMHTCASSFP

SEQ ID NO: 146008 - protein, 51 aa, Heterodera glycines
  Coding regions on vcDNA: vcDNA=SeqID_72431; Strand=-; Position=1-155
QNQNMKFETYFSFGPRLKNPRLFPRRSNNIVNDKYLVNISKDMVPPAKGVG

SEQ ID NO: 146009 - protein, 114 aa, Heterodera glycines
  Coding regions on vcDNA: vcDNA=SeqID_72432; Strand=+; Position=1-345
MNGQLQQRIRHSGVAGTTNNAALTTLSMALCRSQQQPAVPPPPPEFFIDHRTTTLLNGGNGSSTLSSTTVAITSSNGGCHANGTAVVSAAQQLAPSNVTTPALLLKAYEAAVCD

SEQ ID NO: 146010 - protein, 150 aa, Heterodera glycines
  Coding regions on vcDNA: vcDNA=SeqID_72433; Strand=-; Position=1 -11,105-383,443-605
  Homolog annotation: Hit_ID=AAL78214.1; Match level="QueryCoverage =68%, HitCoverage=53%, E-value=1e-10, Identity=34%"; Hit description =putative esophageal gland cell protein Hgg-20 [Heterodera glycines]
MNRRWICGDVWMDILPSFDHAQLGLKMALISDRFDALVDTHFDAKTTEFRIWREIRIRKDNGTKAKLSVRIDGNFVDFPLPDHPLPNIIRIKDLQIYYIDHSVIAFLRANKHDLGQNGHRFGVVYFKCPSRFGMFLSEKFGQFLRQTFAV

SEQ ID NO: 146011 - protein, 70 aa, Heterodera glycines
  Coding regions on vcDNA: vcDNA=SeqID_72434; Strand=-; Position=1-211
MHPTGPVVVVYEAPPQQQTSPDNATQRETKQPKETGKNGNEIVDMLRSSIVKMCVKQKDEKRRRTPTIDE

SEQ ID NO: 146012 - protein, 107 aa, Heterodera glycines
  Coding regions on vcDNA: vcDNA=SeqID_72435; Strand=+; Position=1 -123,355-555
MFKKALAGEGSWLDGRVRLQRFEQIFNGRTSPGNCRIGGHLEVTFGEHLTDKLRKAHPLTRHKRSKSFGHVAIVGAIKVQEKPMGQFNVKADADLIFLLKSEKYSDD

SEQ ID NO: 146013 - protein, 23 aa, Heterodera glycines
  Coding regions on vcDNA: vcDNA=SeqID_72436; Strand=-; Position=1-70
MNNFGVGQKDSQRQQIGRVSVLI

SEQ ID NO: 146014 - protein, 89 aa, Heterodera glycines
  Coding regions on vcDNA: vcDNA=SeqID_72437; Strand=+; Position=1 -178,231-271,320-463
IVPKMNNVLAFSADYLPELVAQRLKERLGIKMPKNKNQQKTKRILAEPIKGTEAKGARTFKKLTKVLAEASKGSHSIASLFGSNKTDKK

SEQ ID NO: 146015 - protein, 18 aa, Heterodera glycines
  Coding regions on vcDNA: vcDNA=SeqID_72438; Strand=-; Position=1-56
PYRDRDLSFSKPGTGNRD

SEQ ID NO: 146016 - protein, 26 aa, Heterodera glycines
  Coding regions on vcDNA: vcDNA=SeqID_72439; Strand=-; Position=1-99
LTHRPLRRKNQLNCTWSPKLNRRVLL

SEQ ID NO: 146017 - protein, 42 aa, Heterodera glycines
  Coding regions on vcDNA: vcDNA=SeqID_72440; Strand=+; Position=1-131
GTTTITKCMTGRFESCGSITNGAAYGYRPAHFTVSRRICATA

SEQ ID NO: 146018 - protein, 77 aa, Heterodera glycines
  Coding regions on vcDNA: vcDNA=SeqID_72441; Strand=+; Position=1-258
IFKFILYPRKMAISFFEKFYTSQKRLRMRRRAVHNRHFISQRIFIFRGYPRKMAISFFDKFYTHTNALEHDREGGAQ

SEQ ID NO: 146019 - protein, 286 aa, Heterodera glycines
  misc_feature (285)..(285): Xaa can be any naturally occurring amino acid
  Coding regions on vcDNA: vcDNA=SeqID_72442; Strand=+; Position=1 -195,246-399,441-538,2542-2675,2743-2872
  Homolog annotation: Hit_ID=CAE67649.1; Match level="QueryCoverage =97%, HitCoverage=39%, E-value=4e-60, Identity=44%"; Hit description =Hypothetical protein CBG13209 [Caenorhabditis briggsae]
VWMCGGSIEVVPCSHVGHIFRAGHPYNMTGPGGNKDVHGTNSKRLAEVWMDDYKRLFYVHRMGLKDVEVGDLDVEVGDLSARKALRERLGCKSFKWYLDNVIPEKFVPDENVNAYGLVCSEIQYGKLCLDTLQRLENKGTVILGVWSEIQYGKLCLDTLQRLENKGTVILGVWECQTGGSSSQAFSWSKDGELRRESTCVDVQKSSAADARSKRKAILRECSRHQISQLKHLSSGLCLDVQSLLKHLSSGLCLDVQSLNAGDDIYFAQCHNEKQSQPWQFGTYFXA

SEQ ID NO: 146020 - protein, 412 aa, Heterodera glycines
  Coding regions on vcDNA: vcDNA=SeqID_72443; Strand=-; Position=1 -269,319-693,734-1032,1081-1155,1198-1362,1406-1461
MPIFFARPLPAEKKLPILNKTPEPTESQKDTLSDDGQDNQDSGASTSSQTNLIKNVRILRKEAAETSLEPYIQFQCFAHFAISRKCVNELYKLWFDFWFSHCQDDFPRLPRIGFSCLSLQELYEDRALLSEKNATPDQLSFIQLVRFVDNGLNEIPNWLLVAPKRGQIFTISLDLADGNGVRVSNLKQQFETNRLLRLFKVRFSFGSVSPTPWYSVRYPPYKSDFSLVIEVDKKAVLRRSYEESSTLSILSSCGLLERKLKARLLKSGWTAEEREAQWDSGEQRAEVNIGLNTELVKGECVMCLEPNSDTLFYPCCHLNVHRKCLRDENVEECYACREKCEELISIRQRDIDCQFCHPNECREFNSFFYPCGCSIGCMDGFTKVSQKMDINCPGCGNVIQNVLKIFISNAST

SEQ ID NO: 146021 - protein, 24 aa, Heterodera glycines
  Coding regions on vcDNA: vcDNA=SeqID_72444; Strand=-; Position=1-80
RTLSTAVRQRSSKIYSMPQILWAG

SEQ ID NO: 146022 - protein, 24 aa, Heterodera glycines
  Coding regions on vcDNA: vcDNA=SeqID_72445; Strand=-; Position=1-80
RTLSTAVRQRSSKIYSMPQILWAG

SEQ ID NO: 146023 - protein, 92 aa, Heterodera glycines; identical to SEQ ID NO: 127421
  Coding regions on vcDNA: vcDNA=SeqID_72446; Strand=+; Position=1-304

SEQ ID NO: 146024 - protein, 92 aa, Heterodera glycines; identical to SEQ ID NO: 127421
  Coding regions on vcDNA: vcDNA=SeqID_72447; Strand=+; Position=1-304

SEQ ID NO: 146025 - protein, 48 aa, Heterodera glycines
  Coding regions on vcDNA: vcDNA=SeqID_72448; Strand=+; Position=1 -49,138-235
MGDEFTVNAANLDTNEAGVLTLTSYDESALIRHNDKAITYELTEIEYP

SEQ ID NO: 146026 - protein, 31 aa, Heterodera glycines; identical to SEQ ID NO: 142022
  Coding regions on vcDNA: vcDNA=SeqID_72449; Strand=-; Position=1-93

SEQ ID NO: 146027 - protein, 95 aa, Heterodera glycines; identical to SEQ ID NO: 128210
  Coding regions on vcDNA: vcDNA=SeqID_72450; Strand=+; Position=1-658

SEQ ID NO: 146028 - protein, 56 aa, Heterodera glycines
  Coding regions on vcDNA: vcDNA=SeqID_72451; Strand=+; Position=1 -120,935-985
MVPKHEERLVPLFRCVDELFDNGLEFRNSRCEEDDDDVGNRLHFPPISTVSSVVPS

SEQ ID NO: 146029 - protein, 176 aa, Heterodera glycines
  Coding regions on vcDNA: vcDNA=SeqID_72452; Strand=-; Position=1 -287,737-980
MALLLPMLLLILAQLHQHISEAYIRRLSDIVPSSYNTNRWLASNNGAEGEHGDGTADSRQLLLLVPTEAQIMQQQQENEELKPQQQYINSPLLPMRRPCYFSPIQCLLRTQGQHEMFVHHPAINEFRADLDLSRSDQSKESVDPVVIGGSTSQHQQVSSRSLFGTSTMLAQNFIFK

SEQ ID NO: 146030 - protein, 45 aa, Heterodera glycines
  Coding regions on vcDNA: vcDNA=SeqID_72453; Strand=+; Position=1 -27,164-274
MYNDEKRKKKINVRHVTKQEDCFMCRQPIKCQKGTHFGTSNKFRA

SEQ ID NO: 146031 - protein, 158 aa, Heterodera glycines
  Coding regions on vcDNA: vcDNA=SeqID_72454; Strand=-; Position=1-477
MSQSFLKRPLISNSPNQIPQKRQQFVDEVTSMNLDISTLDDEQTISPAARAIISQLNNLLKIAVSIVNNSVSDIDYAAEMERRRSVVITGLPENQSETPSFRAISDNNAVTSFLDQLGVKTRSVVCYRIGWYNTDRANNGAWRPVKVVLPALLICQQN

SEQ ID NO: 146032 - protein, 159 aa, Heterodera glycines
  Coding regions on vcDNA: vcDNA=SeqID_72455; Strand=-; Position=1 -223,356-492,641-758
  Homolog annotation: Hit_ID=NP_610120.1; Match level="QueryCoverage =100%, HitCoverage=39%, E-value=8e-38, Identity=50%"; Hit description= CG11628-PA [Drosophila melanogaster] gb|AAF57230.2| CG11628-PA [Drosophila melanogaster] gb|AAL48944.1|
SAIGDFLGEKDDFNLEVLQHFVRLQPLRSLPLVQAMRGFLSRFRLPGESQQIERIMEYFSGHYHVQNPGIFEHQDNCYTLCYAIIMLNTSLHNPSVKERMSLDNFLNITNSLNLPPALVTDIYNSIRSEAFKFPDDNLQEQFSAALFQQSEKQGWLEKQ

SEQ ID NO: 146033 - protein, 16 aa, Heterodera glycines
  Coding regions on vcDNA: vcDNA=SeqID_72456; Strand=-; Position=1-49
EAIPEGFGLPINLGAS

SEQ ID NO: 146034 - protein, 272 aa, Heterodera glycines
  Coding regions on vcDNA: vcDNA=SeqID_72457; Strand=-; Position=1 -418,459-826,1059-1091
  Homolog annotation: Hit_ID=NP_507780.1; Match level="QueryCoverage =82%, HitCoverage=15%, E-value=1e-27, Identity=32%"; Hit description =predicted CDS, DNA polymerase type B, organellar and viral family member (5T899) [Caenorhabditis elegans]
MSEFVDWILGFKRFETVAFAHYAGRFDSHFVLKELTERGVETELMMADLKIYQMKARGVYFRDFWLLSQNKLADLPKTLGLKTLAKLYFPHKYNKNVNFGKKLTHLPPLEDYCPDNMKEEECAKLVKWHNENYRMEFELGEQLKVYCENDVEILMEAILKFRQLFLEITDGMDVLKDSVTIAGVVMRIFRTKFLRENHLPIIPEGGYERAENQSKIAVKYFEWLAQSKRVRLRHACNGGEVEIGGLKVDCIIGAEKKIIEFQECDVKENLKK

SEQ ID NO: 146035 - protein, 109 aa, Heterodera glycines
  Coding regions on vcDNA: vcDNA=SeqID_72458; Strand=-; Position=1 -58,392-663
MSEFLIFLLGFSFAMLLMLCIFYALEFAKLYQTVGREISRDKFRHIMKTGKKQHELALVLMEKAGINTQEKTFGLKHLEFVQNFWDKEFPDIFRIVAFDMVNEHFLNCL

SEQ ID NO: 146036 - protein, 63 aa, Heterodera glycines
  Coding regions on vcDNA: vcDNA=SeqID_72459; Strand=-; Position=1 -84,992-1099
MPYNALRAPQHPIRFPIVNVPPLPLPPQAPPIVNPLGQNPQQMIRWPRQQWIGRPIDPRSPPH

SEQ ID NO: 146037 - protein, 61 aa, Heterodera glycines
  Coding regions on vcDNA: vcDNA=SeqID_72460; Strand=+; Position=1-184
KIDFFVFGAVPPNRCAQIYGETESFGSSFPIGCTLILRWIFAPHKCSSTPNGHLKKSIFLF

SEQ ID NO: 146038 - protein, 143 aa, Heterodera glycines
  Coding regions on vcDNA: vcDNA=SeqID_72461; Strand=+; Position=1 -103,300-418,751-960
MQPPQLSIEQQQQYKWMQVKRATATPRGMPTSPGVAEQREEQSRHRGRIRGTESAVAGGNRTNFTYQQLTELEKMKKQKKEHDFLLSSSSSTAAASLWPNSAAFANPHPPSSNANNSSDGLSTAQLSSSASSAEGPSPSPKRH

SEQ ID NO: 146039 - protein, 202 aa, Heterodera glycines
  Coding regions on vcDNA: vcDNA=SeqID_72462; Strand=+; Position=1 -21,832-1419
MISGETELSDLLSQKRAALKRAQDELAEAERTNRRPTPAPAGRPLPLAAICPSSPKKSAFANRNATEAAPDDLRAILHRQFARLATDQEAAAQWTECRKREIAEEAERMLKRLKEVIVDSIDIQRQLLNEQAVAFRSMRRSMEEAPDTEDEVLSVKSVSSSAGLPGLCAGSVAKATKEKKDKMKKIVLIGLWPVIQFVCLRI

SEQ ID NO: 146040 - protein, 878 aa, Heterodera glycines
  Coding regions on vcDNA: vcDNA=SeqID_72463; Strand=+; Position=1-2637
  Homolog annotation: Hit_ID=XP_318550.1; Match level="QueryCoverage =97%, HitCoverage=86%, E-value=0.0, Identity=41%"; Hit description =ENSANGP00000020240 [Anopheles gambiae]
MPSDWKTENEPYIERHVRLNGKVHKMVVDSGSKLTIVRKAIWVKLGQPFLTETKLKGRSFTGNIFTFMGNFKVQAALDDGMPLDLECFVIDSKDTLDLMGLPWIKAFERAYKQVVATTLSIENVADSRWCNRSNSTSTQLEMDLQNTFPRIFEKTLGLCTKIRAHLKIKENSSPVFCAARPIPIGVKQEVDKELDRLIDMGVLKKTDYSSWAAPIVAVRKANGKVRLCFDFSTGLNAALEPHHHPLPRPEQLFAQLSGAKVFSQIDFKDAYLQIAVDEQSRKLLGVNTHRGLFECSSLAFGIKSAPGIFQWVMDQLSNGIPGVLGYMDDFIIASRSIKEHYRTLYQFFQRIQEFGFHIQLGKCKFLVQQIKFLSQIVTPNGIKPDSERTKALQDMPPPHDVSTLRSFLGAINYYGKYIKNLHEIRAPLDSLLKKGAKWEWTREHQKSFDEAKSVLLSDLALTHFNPDLTIIVTADASNKGIGATIRHRFNDGKEKVFQHAARTLTKTEQAYSQIEKEGLGLIFAIQKFHQFIFGRKFILRTDHRPLLGIFGSKSGIPIFSASRLQRWALILLNYDFSIEFVRTDCTGQADALSRLISDQRSSSKDEDVVIAQLLADTEADVAHVFNTQTEQLPLTAREIAEAQRSDPLIREVLDCTMGRWLNKGINPEIKPYFTVRNNLSIISDCLVFNGRTIIPQALRDRILKALHLAHPGIVRMKSLARELVYWPSMDADIESLVKRCVPCQEAAKQPTKHPLQPWPSTTSVFERVHIDLAGPCSNGRTYLVVIDTYSKWPEIFQLNNTSSHSVISQLQWLFDRYGVPKTLVSDNGPQFSSSVFKEFCKNNGIKHIFSPPYHPQSNGAAERYVDYFKRQLKKCSGD

SEQ ID NO: 146041 - protein, 121 aa, Heterodera glycines
  Coding regions on vcDNA: vcDNA=SeqID_72464; Strand=+; Position=1-364
MRRKCGRFALRSVCPADFPGAGISHLRTHRPFYGRFSPTSVRFWGVNPKASFTDYCSFVRCDFMVKKEVLNEFRIPPELDEALNRKYNGQKGEGGGEREEKAVSRRAPMVEKGQQQQGEGE

SEQ ID NO: 146042 - protein, 15 aa, Heterodera glycines
  Coding regions on vcDNA: vcDNA=SeqID_72465; Strand=-; Position=1 -5,121-163
MPRHWSSRRANLNEI

SEQ ID NO: 146043 - protein, 95 aa, Heterodera glycines; identical to SEQ ID NO: 124528
  Coding regions on vcDNA: vcDNA=SeqID_72466; Strand=-; Position=1-819

SEQ ID NO: 146044 - protein, 16 aa, Heterodera glycines
  Coding regions on vcDNA: vcDNA=SeqID_72467; Strand=-; Position=1-49
EAIPEGFGLPINLGAS

SEQ ID NO: 146045 - protein, 18 aa, Heterodera glycines
  Coding regions on vcDNA: vcDNA=SeqID_72468; Strand=+; Position=1-57
YREAIPEGFGLPINLGAS

SEQ ID NO: 146046 - protein, 85 aa, Heterodera glycines
  Coding regions on vcDNA: vcDNA=SeqID_72469; Strand=+; Position=1 -16,51-292
MPISLDNDKRRITTALAFVVYLLSLVIVIGPCWGPVVPKHAAGGFEKYNTQIVSRQNEILFRYEFKSGISTNLVRISFVSAFNFY

SEQ ID NO: 146047 - protein, 15 aa, Heterodera glycines
  Coding regions on vcDNA: vcDNA=SeqID_72470; Strand=+; Position=1-48
DFLGDSHSSIFDAGA

SEQ ID NO: 146048 - protein, 37 aa, Heterodera glycines
  Coding regions on vcDNA: vcDNA=SeqID_72471; Strand=+; Position=1 -60,112-179
VREWTQLDHNHFEARLDMETLTHGMQEHTVIVYTKVM

SEQ ID NO: 146049 - protein, 84 aa, Heterodera glycines
  Coding regions on vcDNA: vcDNA=SeqID_72472; Strand=-; Position=1 -184,226-296
MDLFLSSAQILKLHSLILIDSFIFDIIFMAEERQHGQQSRDQRDRYSSIFSEAVDAETDWNEISVKVSSQKWSKTKAPLTTSRN

SEQ ID NO: 146050 - protein, 127 aa, Heterodera glycines
  Coding regions on vcDNA: vcDNA=SeqID_72473; Strand=+; Position=1 -236,442-588
DHMSIKLIEANESIALLRRQLESRDEEIEQLRRAESVAGERVADAQREAIRWRTEAERGLRRVSSGRNLAASAESGEFAGFDKLLLSDYRSALSKYRTWSLFADKQLQTMKQLLEECGGWTEPNRYK

SEQ ID NO: 146051 - protein, 95 aa, Heterodera glycines; identical to SEQ ID NO: 129573
  Coding regions on vcDNA: vcDNA=SeqID_72474; Strand=-; Position=1-908

SEQ ID NO: 146052 - protein, 18 aa, Heterodera glycines
  Coding regions on vcDNA: vcDNA=SeqID_72475; Strand=+; Position=1-56
YREAIPEGFGLPINLGAS

SEQ ID NO: 146053 - protein, 18 aa, Heterodera glycines
  Coding regions on vcDNA: vcDNA=SeqID_72476; Strand=+; Position=1-55
TVFSLIIPQSPLIPQSPI

SEQ ID NO: 146054 - protein, 204 aa, Heterodera glycines
  Coding regions on vcDNA: vcDNA=SeqID_72477; Strand=-; Position=1-615
  Homolog annotation: Hit_ID=NP_883539.1; Match level="QueryCoverage =93%, HitCoverage=45%, E-value=2e-90, Identity=87%"; Hit description =hypothetical protein BPP1224 [Bordetella parapertussis 12822] emb|CAE36526.1| conserved hypothetical prot
MESLVPEYDVAGVVRERTGGALPGIVPSNTYTTRDDQNIVIAGNGDAIFHRLMLAIGRDDLASDPDLVRNDGRARRVAEIDGAIQQWCDGRGIEEALNTLKAADVPVGKIYSVADMFTDPQFLARRMIEQHQFADGSPVKLPAVVPKLSETPGGTRWIGPSLGEHTEEVLKSLGYDSAAIDKLAQTGAIGIPAPKETTHVSHSS

SEQ ID NO: 146055 - protein, 297 aa, Heterodera glycines
  misc_feature (17)..(17): Xaa can be any naturally occurring amino acid
  misc_feature (270)..(270): Xaa can be any naturally occurring amino acid
  misc_feature (277)..(277): Xaa can be any naturally occurring amino acid
  Coding regions on vcDNA: vcDNA=SeqID_72478; Strand=+; Position=1 -57,460-524,552-647,699-847,898-1002,1047-1214,3374-3416
  Homolog annotation: Hit_ID=XP_305985.1; Match level="QueryCoverage =99%, HitCoverage=38%, E-value=8e-36, Identity=32%"; Hit description =ENSANGP00000024114 [Anopheles gambiae]
KIICSREFLHTFPNSDXWDDSKHFVDRPLLKDAKKVVEEFNKFAVSEMSEAQVDKLAKFVQQNFGKVVEEFNKFAVSEMSEAQVDKLAKFVQQNFGMADEALIEHVPEDWVESPPNFKEHVPEDWVESPPNFKEIKDEKLAKWATELNKMWKEMSKKMPKDVKLIIKLYSLIHLSNPSLIHLSNPFSFSGGRFREFRYWDSYWMARGLIASGMTKSLKNMQNFAEMVNRMTKSLKNMQNFAEMVNRFGLCPPGGRIYYNKRSQPPFLTLXIKLHIFXLNDNKYSAPSPKKLKKEFTG

SEQ ID NO: 146056 - protein, 89 aa, Heterodera glycines
  Coding regions on vcDNA: vcDNA=SeqID_72479; Strand=-; Position=1 -121,278-426
MTTQQRIFGNQLLFLCIFLIGVVFFLFSAAVANGAHLVDSSVDQIGRVQHNHNGDINIRRGIERFNDNRMAQNGKEKWRKYEFKRRKSG

SEQ ID NO: 146057 - protein, 216 aa, Heterodera glycines
  Coding regions on vcDNA: vcDNA=SeqID_72480; Strand=+; Position=1-653
  Homolog annotation: Hit_ID=NP_982067.1; Match level="QueryCoverage =53%, HitCoverage=26%, E-value=4e-12, Identity=40%"; Hit description =surface layer protein [Bacillus cereus ATCC 10987] gb|AAS44910.1| surface layer protein [Bacillus cereus
TVDSDKGNADKSQGADTDGKNPEKPKESQEVEEDGPNPKESTKSQEVEEDGPNPKESTKSQEVEEDGPNPKEPTKSQEVEEDGPNPKEPTKSQEVEEDGPNPKEPTESQEVEEDGTNSDEDELTERQEAEVDRMRVRAGATSMHGLDKLAPTPPPSATSTNAIAIRVATTRWISDTHWRNCDTIRHQQIMRASYPILFLWEGKVRAGNYVQGGQML

SEQ ID NO: 146058 - protein, 36 aa, Heterodera glycines
  Coding regions on vcDNA: vcDNA=SeqID_72481; Strand=-; Position=1-108
MTSENERRFREKLSILNENFLRFLQKAYSKNPDADF

SEQ ID NO: 146059 - protein, 89 aa, Heterodera glycines
  Coding regions on vcDNA: vcDNA=SeqID_72482; Strand=+; Position=1-270
ILFRNDPAQYREEVRRRVERASASTPRARSSSTPPPVAQPPGEQQQGTPPQPPDGQGMQPPGEQQQGTPQPPATPPQGQEAPQQGEWYL

SEQ ID NO: 146060 - protein, 20 aa, Heterodera glycines
  Coding regions on vcDNA: vcDNA=SeqID_72483; Strand=+; Position=1 -37,929-954
MTMTAGSMTMTAGSVKYDEE

SEQ ID NO: 146061 - protein, 87 aa, Heterodera glycines
  Coding regions on vcDNA: vcDNA=SeqID_72484; Strand=-; Position=1 -137,225-351
MSICFNFVFGWFNLSAFTLYHIARPAGYIFYVLGHCSSAPVLFFTSSVYRKAYQSVFWSNNNQVAPVQNLQRQPIITNNIRTYMNTR

SEQ ID NO: 146062 - protein, 205 aa, Heterodera glycines
  Coding regions on vcDNA: vcDNA=SeqID_72485; Strand=-; Position=1 -281,297-631
  Homolog annotation: Hit_ID=NP_498959.1; Match level="QueryCoverage =72%, HitCoverage=6%, E-value=1e-15, Identity=35%"; Hit description =zn-finger, CCHC type and RNA-directed DNA polymerase  and Integrase, catalytic domain containing protein (
MTDASKVGISAILCQHDDEMKLRPIYFASRQCSKYESRYAATELEALAVRFGAKKFAQFITMLPTRVLTDHKSLVPMFKSKAETGNARVDKWLIFMLKVEYQPGKMNVIADLLSRSFQPNNEGIAEPPLEEDKALIGMIKVLTAEEVEASIVEKREAWSHASEESEMKHIYAFLKKKIFPNDPRQAQNLKETSTKYTLLDGLLYL

SEQ ID NO: 146063 - protein, 240 aa, Heterodera glycines
  Coding regions on vcDNA: vcDNA=SeqID_72486; Strand=+; Position=1-720
MKEYYDKRTNVSKRDKHKVGDRCMVLYPGANARSPHKKLLWNNYGPYKIVEMSTSSAKLVPVDKTASEPINVPLERLVKVPSEIPNVSTLPKGKNMYKNTLKAILCPNDWSEKGGQNDGEILEREQNSPKTVFQLRTIENLDGGMETDDFCELSWLMSCQGKDHEKCDKLTCSELDPVVDASSELGMTSVRSPLQALLTAFLLKSNAAVSASSGRDLAELILDSEPGMELVIYEGERRDN

SEQ ID NO: 146064 - protein, 179 aa, Heterodera glycines
  Coding regions on vcDNA: vcDNA=SeqID_72487; Strand=-; Position=1 -50,157-317,745-936,1043-1179
MNFFNVLLFLANFVLSIGAFSCGEFLETNSMKFKQTLDPDNIRHPSVNLGNYCGAPDMTMCYGIGCSSPDGKEKLIQLDCMHAIDKVNICNDIEVKLKNATQLPAVYCECQFGNEGEEKSNANFYEKYFKNRTQDLSADGATRHLGICDLGPDNWTSRNLETSTFGTWAFGGKTTFRDL

SEQ ID NO: 146065 - protein, 38 aa, Heterodera glycines
  Coding regions on vcDNA: vcDNA=SeqID_72488; Strand=-; Position=1-114
MSFFWSTTNAIVSSLLPVLPAFVMSSSHRRDLEAFSSK

SEQ ID NO: 146066 - protein, 108 aa, Heterodera glycines
  Coding regions on vcDNA: vcDNA=SeqID_72489; Strand=-; Position=1 -20,84-210,272-451
MPSVNKILFLILLVSNNSMGAPTAYDICLAACGNSELCVSACWAGLKAEMFVGACPPVFGPFCILGCPSACLPFLPFLPAWALCMSACIGAQPPPVFSELRIFYKNYI

SEQ ID NO: 146067 - protein, 20 aa, Heterodera glycines
  Coding regions on vcDNA: vcDNA=SeqID_72490; Strand=-; Position=1 -45,813-830
MSPGFVIGPFKWSNGEITGK

SEQ ID NO: 146068 - protein, 106 aa, Heterodera glycines
  Coding regions on vcDNA: vcDNA=SeqID_72491; Strand=-; Position=1 -159,344-395,669-778
MMGPHLFPEQIYKMDTKNGNFLNKKSMLLFQIMTAIDLCGTMPHFQILETNDHANRGHLGLPNDTKIVAFGSFTELYYNSIIFTVWTLLFIKSQFTNRPKHPEQCV

SEQ ID NO: 146069 - protein, 110 aa, Heterodera glycines
  Coding regions on vcDNA: vcDNA=SeqID_72492; Strand=+; Position=1 -233,276-407
ELVGVLKCAEEATKRFTAEPISFVIPQARALHDELYEMKIVNRTVETIRTTLYFAVERRFFGLANLKEYALATFLDVRFKDKVLTENSATFRARVTVWIKNELKEWEIDN

SEQ ID NO: 146070 - protein, 75 aa, Heterodera glycines
  Coding regions on vcDNA: vcDNA=SeqID_72493; Strand=+; Position=1-228
MVWGNGGEGNKLAAAPKNGPSPVVGERGQGGDGRPANSFILSCHCSLLFFLRGLKPPEMFFMGICVGEQNKTKHK

SEQ ID NO: 146071 - protein, 153 aa, Heterodera glycines
  Coding regions on vcDNA: vcDNA=SeqID_72494; Strand=-; Position=1 -96,135-252,467-714
MPKQNEIVIKYSFLDLTWFLDIEAVFYAISKTKKCLVVKTIFHISLHNFVSSARIETGIRPLERAARALQEVKKLFEFLQFCFHNFRKLFGIIMPKQNEIVLKYSFLDLTWFLDIEAVFYAISKNGIPNPRFLNPGFQKKCLGGENNISHFTP

SEQ ID NO: 146072 - protein, 92 aa, Heterodera glycines
  Coding regions on vcDNA: vcDNA=SeqID_72495; Strand=-; Position=1-276
  Homolog annotation: Hit_ID=E86336; Match level="QueryCoverage=96%, HitCoverage=32%, E-value=7e-11, Identity=43%"; Hit description =hypothetical protein F14O10.11 - Arabidopsis thaliana gb|AAF88160.1| Contains weak similarity to an unknown pr
MFVKEEKQRKSEVNEKEQKKGERQMNSDTLQLQSELEKMLAHLGGTIKKEEEKEEEEEDENGEELEEEEEEESEEDEEEEEEQGRGRAEAHE

SEQ ID NO: 146073 - protein, 124 aa, Heterodera glycines
  Coding regions on vcDNA: vcDNA=SeqID_72496; Strand=+; Position=1 -67,113-369,1146-1196
MSAKIIRVPKIACDLSLAKNGVALPIPSTIAFIHPIMSAKIIRVPKIACDLSLAKNGVSKNRNYAQKASQTILALPIPSTIAFIHPIMSAKIIRVPKIACDLSLAKNGSHIINFNNFGEENANL

SEQ ID NO: 146074 - protein, 25 aa, Heterodera glycines
  Coding regions on vcDNA: vcDNA=SeqID_72497; Strand=-; Position=1 -13,91-155
MPAKLTYYQGTDLFLMRSNFAIQID

SEQ ID NO: 146075 - protein, 75 aa, Heterodera glycines
  Coding regions on vcDNA: vcDNA=SeqID_72498; Strand=+; Position=1-228
WSLCAIFSIWLVLSTLADEETFGQPQVYYSMISRYNSDIVIILNYVLLALVLLTMMANIAIMVQNRKMQMRSRKR

SEQ ID NO: 146076 - protein, 24 aa, Heterodera glycines
  Coding regions on vcDNA: vcDNA=SeqID_72499; Strand=+; Position=1 -52,295-317
MEKACKIWRDYIDFSALELLELAS

SEQ ID NO: 146077 - protein, 150 aa, Heterodera glycines; identical to SEQ ID NO: 138771
  Coding regions on vcDNA: vcDNA=SeqID_72500; Strand=-; Position=1-1345

SEQ ID NO: 146078 - protein, 75 aa, Heterodera glycines
  Coding regions on vcDNA: vcDNA=SeqID_72501; Strand=-; Position=1 -26,220-287,674-807
MYQLFRALGFVISGPQKRWSRVSRTSPTFVHVLAELLLGQPFFPGDSGVFVLLLFELFISFVKAFSGFMGKPHIF

SEQ ID NO: 146079 - protein, 48 aa, Heterodera glycines; identical to SEQ ID NO: 134709
  Coding regions on vcDNA: vcDNA=SeqID_72502; Strand=-; Position=1-284

SEQ ID NO: 146080 - protein, 178 aa, Heterodera glycines
  Coding regions on vcDNA: vcDNA=SeqID_72503; Strand=+; Position=1 -238,290-588
MDFTTTDNTTNTDLTTMDKATDVDLAYEDAATQTEQLNKQLKEQEQTISFLRLQLRNRDAMIADLRRQLEEQAQTNPPTPSTRCKKNATTLERTSRRNLVEKIVDVIDRDRSRSVSRCSLQTLHREVRHKFGHYTPMKKEQLLQQQTIHGEDGLLLLSQLGTQKAYVKMFCDQSNLTG

SEQ ID NO: 146081 - protein, 24 aa, Heterodera glycines
  Coding regions on vcDNA: vcDNA=SeqID_72504; Strand=-; Position=1-81
LTHRPLRRKNQLNCTWSPKLNRSV

SEQ ID NO: 146082 - protein, 59 aa, Heterodera glycines
  Coding regions on vcDNA: vcDNA=SeqID_72505; Strand=-; Position=1 -117,1739-1786,2017-2031
MARKGKMPKWWDDRKGIRVNAKCAEGKACTVITESDVAKMELDAAAVAWTNAFWPTIRI

SEQ ID NO: 146083 - protein, 22 aa, Heterodera glycines
  Coding regions on vcDNA: vcDNA=SeqID_72506; Strand=-; Position=1-66
HLLNTQSSLSREGPAPHICCTL

SEQ ID NO: 146084 - protein, 113 aa, Heterodera glycines
  misc_feature (23)..(23): Xaa can be any naturally occurring amino acid
  Coding regions on vcDNA: vcDNA=SeqID_72507; Strand=-; Position=1 -77,280-436,532-636
  Homolog annotation: Hit_ID=AAH87506.1; Match level="QueryCoverage =93%, HitCoverage=49%, E-value=5e-37, Identity=72%"; Hit description =LOC398475 protein [Xenopus laevis]
FDGFYHRSFFAKSKNYITVDHHXRENSKKKLEVAAKDKLNELQLRVRQLLDQVEQITKEQNYQRYREERFRQTSESTNSRVLWWSVGQTIVLLLTGAWQMRHLKGFFEAKKLV

SEQ ID NO: 146085 - protein, 140 aa, Heterodera glycines
  Coding regions on vcDNA: vcDNA=SeqID_72508; Strand=+; Position=1 -98,524-845
MVNFMNKLRGENDQTIKQLRSVIAELKDQVANHQNFKNRRICTQQDWSFNSVRGVVTDLTNKQRCSLIEAFRARIISKEDWMVWDDVGGREIEFMEAEKMRIVSIEEDFYKTDPNSGERVTLANAAMFQNIWPIRCGMKK

SEQ ID NO: 146086 - protein, 27 aa, Heterodera glycines
  Coding regions on vcDNA: vcDNA=SeqID_72509; Strand=-; Position=1-81
HYGSSPVLDKILITPNSVIGVNFCALI

SEQ ID NO: 146087 - protein, 62 aa, Heterodera glycines
  Coding regions on vcDNA: vcDNA=SeqID_72510; Strand=+; Position=1-187
MRRNVDNDSGANNGANISSNPKIARDAEIAHVVDTGNGANDALGDGMDIGHCPNCSWHCNVC

SEQ ID NO: 146088 - protein, 207 aa, Heterodera glycines
  Coding regions on vcDNA: vcDNA=SeqID_72511; Strand=+; Position=1 -75,334-879
  Homolog annotation: Hit_ID=NP_491240.1; Match level="QueryCoverage =86%, HitCoverage=13%, E-value=3e-38, Identity=39%"; Hit description =zn-finger, CCHC type and RNA-directed DNA polymerase  and Integrase, catalytic domain containing protein
MGVLKKTDYSSWAAPIVAVRKANGKWVMDQLSNGIPGVLGYMDDFIIASRSIKEHYRTLYQFFQRIQEFGFHIQLGKCKFLVQQIKFLGQIVTPNGIKPDSERTKALQDMPPPHDVSTLRSFLGAINYYGKYIKNLHEISAPLDSLLKKGAKWEWTREHQKSFDEAKSVLLSDLALTHFLTIIVTADASNKGIGATISHRFNDGKEK

SEQ ID NO: 146089 - protein, 51 aa, Heterodera glycines
  Coding regions on vcDNA: vcDNA=SeqID_72512; Strand=-; Position=1 -121,170-201
MGQTLVWPSQMNTYADHNYGQLFKKFLIFRNTAFRMGPDIGIPHLEWAQTQ

SEQ ID NO: 146090 - protein, 33 aa, Heterodera glycines
  Coding regions on vcDNA: vcDNA=SeqID_72513; Strand=-; Position=1 -89,181-193
MSVWPTFSHRLPSAYCAACPWIVPLQWFTRHVI

SEQ ID NO: 146091 - protein, 74 aa, Heterodera glycines
  Coding regions on vcDNA: vcDNA=SeqID_72514; Strand=+; Position=1 -76,129-202,256-327
  Homolog annotation: Hit_ID=CAE63591.1; Match level="QueryCoverage =94%, HitCoverage=36%, E-value=3e-27, Identity=77%"; Hit description =Hypothetical protein CBG08082 [Caenorhabditis briggsae]
MGQSMGKPHNKLKGDDVKKLAKQTYFTEKEIRQWHKGFVRDCPNGMLTEIGFQKIYKQFFPQEGPSDFAAYVFK

SEQ ID NO: 146092 - protein, 64 aa, Heterodera glycines
  misc_feature (3)..(3): Xaa can be any naturally occurring amino acid
  Coding regions on vcDNA: vcDNA=SeqID_72515; Strand=-; Position=1-195
YDXLKRKQKKFLTKNGYLFFLIFLPQTWYQQLPSLVWPYQTILRYLKRKQKKFLTKKWLSLFSH

SEQ ID NO: 146093 - protein, 86 aa, Heterodera glycines
  Coding regions on vcDNA: vcDNA=SeqID_72516; Strand=-; Position=1-642
KNRFIFVFGAVPPNRCAQIYGETESFGNSFPIACTLILRWIFAPHNCLSTPNGHLKKSIFLFSGQSPRADAPRFMGRPNPSGIASL

SEQ ID NO: 146094 - protein, 29 aa, Heterodera glycines
  Coding regions on vcDNA: vcDNA=SeqID_72517; Strand=+; Position=1-87
MRIMRKAKCEKRNLGPSLFCTYLMLLVPS

SEQ ID NO: 146095 - protein, 18 aa, Heterodera glycines
  Coding regions on vcDNA: vcDNA=SeqID_72518; Strand=-; Position=1 -13,947-990
MTDPGGTQANMKMNFDKI

SEQ ID NO: 146096 - protein, 30 aa, Heterodera glycines
  Coding regions on vcDNA: vcDNA=SeqID_72519; Strand=+; Position=1-92
MGQKESRHAFVNCALIRREEFEDKIQELNK

SEQ ID NO: 146097 - protein, 18 aa, Heterodera glycines
  Coding regions on vcDNA: vcDNA=SeqID_72520; Strand=+; Position=1-56
YREAIPEGFGLPINLGAS

SEQ ID NO: 146098 - protein, 15 aa, Heterodera glycines
  Coding regions on vcDNA: vcDNA=SeqID_72521; Strand=+; Position=1-49
LKAIHCLPVLGTAKH

SEQ ID NO: 146099 - protein, 103 aa, Heterodera glycines
  Coding regions on vcDNA: vcDNA=SeqID_72522; Strand=-; Position=1-310
MTDCEHHSVPPSVPPVDFCPSSPPPSYVSSPTAPRNNANDGQQQNTAKGCFLPSCKNAKRATKENDAGGTEPSQPTSAAVVVPMAKDKVTILCLGHNSQCECR

SEQ ID NO: 146100 - protein, 23 aa, Heterodera glycines
  Coding regions on vcDNA: vcDNA=SeqID_72523; Strand=+; Position=1 -66,192-197
MWREWNIGGEGEGKRGGESEGEF

SEQ ID NO: 146101 - protein, 19 aa, Heterodera glycines
  Coding regions on vcDNA: vcDNA=SeqID_72524; Strand=-; Position=1-58
INLRQISSEQHRTARSFYY

SEQ ID NO: 146102 - protein, 284 aa, Heterodera glycines
  Coding regions on vcDNA: vcDNA=SeqID_72525; Strand=+; Position=1 -203,265-685,738-968
MISHRFDFYVDEHFKTRKWTLKIMEIGQEIGENGTKEMEIVNLDGNLLPIPQIQVPRKVIGFEAISIRYIDHNVIAFVHHFRQLFAASPINLSIEITNDRRISESILHNIWPLLEKNIQSIRLSDENFRRLRKLVPSFLSDCPSLRFVFSHFVDIFIEFPADDNAMASDGQALAKWLFIARPDDVPKVFNCSLAKTLNWASKIEALKAAFASASSPVNFIAVISFFHLSAQHSVVPFVLTNELTREQFALKRIDNCYRFLLVRCPIARDESKWTKWETEAIGKR

SEQ ID NO: 146103 - protein, 119 aa, Heterodera glycines
  Coding regions on vcDNA: vcDNA=SeqID_72526; Strand=-; Position=1-361
  Homolog annotation: Hit_ID=CAE61720.1; Match level="QueryCoverage =63%, HitCoverage=39%, E-value=1e-16, Identity=50%"; Hit description =Hypothetical protein CBG05670 [Caenorhabditis briggsae]
AVDACQQPLNVGVGPSNLVRWFFFAPSAQCQSFTYKGLQGNENNFLSRFDCEQICQGNQMTVNRLNCLSPSKSMCCGHAFARPTRTDWLLLSHSAEHLPHWLLLPCRRRRQDEFMLSND

SEQ ID NO: 146104 - protein, 18 aa, Heterodera glycines
  Coding regions on vcDNA: vcDNA=SeqID_72527; Strand=-; Position=1-55
EAIPEGFGLPINLGASVR

SEQ ID NO: 146105 - protein, 183 aa, Heterodera glycines
  Coding regions on vcDNA: vcDNA=SeqID_72528; Strand=-; Position=1 -45,90-594
  Homolog annotation: Hit_ID=XP_392480.1; Match level="QueryCoverage =66%, HitCoverage=14%, E-value=1e-43, Identity=68%"; Hit description =similar to ENSANGP00000012524 [Apis mellifera]
MRNCIGKELTRIPIPVNFNEPLSMLQRITEDLEYSYLLDRAAEKQDICERLAYVAAFAVSCYSATAVRTTKPFNPLLGETFEFDRRADLGWRSLVEQVSHHPPAAAHHVEGVNWHLNQVDTLFWFYAFSLHIIYYQPEGIYGQFTLSWQIYERDSHWPYPRVLSGRKGALYVSKGGHDCAQHH

SEQ ID NO: 146106 - protein, 182 aa, Heterodera glycines
  Coding regions on vcDNA: vcDNA=SeqID_72529; Strand=-; Position=1 -231,343-481,700-878
MRKHISPTFLFDCPNLVEIVSPVLPERPTVDNSAAPETSSRDLYMWLHTTRVDRLPLVYKLLKWNNRWDQFVNELMMSFNTASVPVNYMVFTSFEFIYTRREQMVNMLTEERLTMLTNVHPKRDRCLQIVLRPCRETDRAENRSNAQTVDQQQMSPKHNQWPLGWNYLIIIFSQNVNFPSND

SEQ ID NO: 146107 - protein, 179 aa, Heterodera glycines
  Coding regions on vcDNA: vcDNA=SeqID_72530; Strand=-; Position=1 -116,165-245,293-505,631-760
MGSVISYEFVCRHYLHGHIDKRRATKVTGIGGSSKTQGRLTIVVRIGDAKVRVTFDVIKGLPLDMLIGQNVMDALCANHCRQTDQLTYLYKGQRLAVPLLENSDTTKTKEKTWMDHLQCLMNITSYSLNDWMALEQRKIANGGENMPLSDLECGGSTELNGMAIGTSDKMPNGGDKKSQ

SEQ ID NO: 146108 - protein, 61 aa, Heterodera glycines
  Coding regions on vcDNA: vcDNA=SeqID_72531; Strand=-; Position=1-185
FFAALLNTLKQDVIKREFRQRRVKKRKKRGKKKVKPNDFFCLQRLLIYTLTQRNASAMGQL

SEQ ID NO: 146109 - protein, 16 aa, Heterodera glycines
  Coding regions on vcDNA: vcDNA=SeqID_72532; Strand=-; Position=1-49
EAIPEGDGLPINLGAS

SEQ ID NO: 146110 - protein, 106 aa, Heterodera glycines
  Coding regions on vcDNA: vcDNA=SeqID_72533; Strand=+; Position=1-321
MTQIKLLNEEEINISEIKVEKKVENSLSKMQKTNAFFDQSSEIANLRTEFEQKMEKLCERTKENAKEEKAKMEKTKANAADEGHRLGTELHFLSKFGTFISSPFFR

SEQ ID NO: 146111 - protein, 22 aa, Heterodera glycines
  Coding regions on vcDNA: vcDNA=SeqID_72534; Strand=-; Position=1 -16,239-291
MDLNHGLPYLFLSYYIVKTKLQ

SEQ ID NO: 146112 - protein, 25 aa, Heterodera glycines
  Coding regions on vcDNA: vcDNA=SeqID_72535; Strand=+; Position=1-78
HPIPSTIAFIHPIMNAKSIRVPKIA

SEQ ID NO: 146113 - protein, 104 aa, Heterodera glycines
  Coding regions on vcDNA: vcDNA=SeqID_72536; Strand=+; Position=1-438
NGLSKNRNYAQKASQTILAHPIPSTIAFIHPIMNAKIIRVPKIACDLSLAKNGVSKNRNYAQKASQTILALPIPSTIAFIHPIMSAKIIRVPKIACDLSLEKMV

SEQ ID NO: 146114 - protein, 48 aa, Heterodera glycines
  Coding regions on vcDNA: vcDNA=SeqID_72537; Strand=+; Position=1 -101,522-567
MFEGLTSKASAINGMITDQLNMLIPWVKQLSPILAAKNMARKVAKICA

SEQ ID NO: 146115 - protein, 276 aa, Heterodera glycines
  Coding regions on vcDNA: vcDNA=SeqID_72538; Strand=+; Position=1-844
  Homolog annotation: Hit_ID=DAA04499.1; Match level="QueryCoverage =99%, HitCoverage=20%, E-value=4e-65, Identity=47%"; Hit description =TPA: pol polyprotein [Schistosoma mansoni]
TSLVEHVIDTGDATPIRSRMRPVPYAYREKVSEMLRDYLGRGLIRPSNSPWASPIVLVPKRDGTLRFCIDYRAINSVTKKDAFPLPNIDYILMALGGKRYFSTLDFMSGYWQIRMHENSVQKTGFITEFGLHEFTVLPFGLCNAVATYQRFMTNLFDGMINDFVIYVDDILVASETWEEHLVHLKEVFERVGRAELKLKIGKCHFAAEELPFLGHILTRNGIKMDADKTRTIIGLPIPATKKQLQSFLGFMYFKEFIGFGSLAPLLIKENTPFVWV

SEQ ID NO: 146116 - protein, 75 aa, Heterodera glycines
  Coding regions on vcDNA: vcDNA=SeqID_72539; Strand=+; Position=1 -112,623-738
MRQLREIRGCYTRISRYLEDQRMFKKLLKEADFYEQRVFLAHKNPSSSHYLNSQNLEIFGRFYFSTFVFCVGALD

SEQ ID NO: 146117 - protein, 295 aa, Heterodera glycines
  Coding regions on vcDNA: vcDNA=SeqID_72540; Strand=-; Position=1-886
  Homolog annotation: Hit_ID=XP_320889.1; Match level="QueryCoverage =88%, HitCoverage=31%, E-value=6e-33, Identity=32%"; Hit description =ENSANGP00000012033 [Anopheles gambiae] ref|XP_313651.1| ENSANGP00000013044 [Anopheles gambiae] ref|XP_314
TADGIAKCDGGQTEAAAHETNARKGTKFRTKLERVCWRCGKFHHAPSECPSIKTVCRKCNKAGHLEAQCEKHHEWLNRNKNGKFQGKRACTLRIGGVMVNIVNHPTRLIEITVEMNGRKVIFVLDSGAEVTVINEETHCLIGKPQLRRCQEQAAYHDGSKCTLLGRGEAKFKFGDATKNGTYYVSKSGSLNLLGIEMLDAFGLLDDIRQKVNSTLHLNAIGRGNGDEATIMEELKKKFPEIVADGLGHCKKVKAHLSLKPNATPIYCRPRPVPFNTKSVVEAELERLQSMNVIRP

SEQ ID NO: 146118 - protein, 67 aa, Heterodera glycines
  Coding regions on vcDNA: vcDNA=SeqID_72541; Strand=+; Position=1 -130,422-456,865-903
MPTLVVFKIFRNSDFFINYLFFAKLIHKYFFRKCSETHKTLFTERALKHTKLYLQKCSKAHQILFTT

SEQ ID NO: 146119 - protein, 74 aa, Heterodera glycines
  Coding regions on vcDNA: vcDNA=SeqID_72542; Strand=-; Position=1-482
FISIFSERALKHTKLYLQVSLGTLMLFLSKREMNKIFNSFLNRPKSLGLTFFSETDQKRTKLCRDTERKSNNLF

SEQ ID NO: 146120 - protein, 39 aa, Heterodera glycines
  Coding regions on vcDNA: vcDNA=SeqID_72543; Strand=+; Position=1-120
SRLIRSSPNFAGNLLRTLQMLINFLRIFCLEEHSSSHLP

SEQ ID NO: 146121 - protein, 118 aa, Heterodera glycines
  Coding regions on vcDNA: vcDNA=SeqID_72544; Strand=+; Position=1 -14,77-419
  Homolog annotation: Hit_ID=CAE64562.1; Match level="QueryCoverage =99%, HitCoverage=6%, E-value=2e-16, Identity=43%"; Hit description =Hypothetical protein CBG09312 [Caenorhabditis briggsae]
MTERAILGRLTSKDPDAVAGQSPLPPPGPFVTPMAQSRFSGIQPKFAALLKPKHQSKKENLPEKDGNDKQNQEETRPSKEEKRTDADVEKTSDRSTKEAEGSCKEEAEPVQDDTVKEG

SEQ ID NO: 146122 - protein, 442 aa, Heterodera glycines
  Coding regions on vcDNA: vcDNA=SeqID_72545; Strand=+; Position=1 -517,589-983,1032-1265,1460-1642
  Homolog annotation: Hit_ID=AAC60129.1; Match level="QueryCoverage =79%, HitCoverage=93%, E-value=4e-19, Identity=29%"; Hit description =antifreeze glycopeptide AFGP polyprotein precursor pir||T44768 antifreeze glycopeptide AFGP polyprotein pr
MAAQRMKVCYRLGSSAVAGSSTGANGSAAYGRASAVGSAAVASGPSADAVAGGAAPPPLMAAPLIAAAAANAAAVAAAAQPSAQQRAVAAAAPQQPQQPQTAAVQLALSAADFSHLFQHYQSAIGQLQPSMGSAAAAVAANQAAAAQIAAAAAAAPYVCQPLAATAATVLPYGSARHQPPPQFSAVTAPQAQSLSQFVPTAMHPFVDPLIAAATGAANAAVAAAAHQHSHAGTMVTGSSAGGNASTASHVGPQQNGAVPQGWPTQQQQQGSANATAQNQAATLAQNANTTAALFPWAIAAAAQQAALLPGAGNNPAGAAADLFLPANAAAAAAVQRQMAAAAAALQFPHLFSAPVQAAAQQTAKNYSQQLQLLAQMQQQQQQEEWAAQVLNGVRPMNAQQQQMLQQQQQQQQAMIARLKNDAAILMQNSLAEHYLLERLGKK

SEQ ID NO: 146123 - protein, 184 aa, Heterodera glycines
  Coding regions on vcDNA: vcDNA=SeqID_72546; Strand=-; Position=1 -46,208-439,604-719,764-921
  Homolog annotation: Hit_ID=NP_956607.1; Match level="QueryCoverage =98%, HitCoverage=17%, E-value=1e-36, Identity=47%"; Hit description =similar to chromodomain helicase DNA binding protein 1-like [Danio rerio] gb|AAH50498.1| Similar to chrom
MQRFLDIVYDIMSLRGYICEQLDGTVSQPDRQKAIQNFQRPDSDVFAFLLTTKAGGLGLNLTAADTAIFLDSDFNPQNDKQAAARCHRIGQDKPVKSIRLVAKHTVEELIKQRSVKKLKLSENVLGTDEKEGPSLMFDLSKLLLEGLTDLEKEQKKHTQFHILTDKQLEERLGQTDQNGHWQIK

SEQ ID NO: 146124 - protein, 48 aa, Heterodera glycines
  Coding regions on vcDNA: vcDNA=SeqID_72547; Strand=+; Position=1 -79,158-225
MFRILSNFVFYCSYEYDWIKSSAYWRCNFVFKIFGIRKNLAHGFQFSP

SEQ ID NO: 146125 - protein, 317 aa, Heterodera glycines
  Coding regions on vcDNA: vcDNA=SeqID_72548; Strand=-; Position=1-954
  Homolog annotation: Hit_ID=AAP47138.1; Match level="QueryCoverage =40%, HitCoverage=16%, E-value=1e-14, Identity=37%"; Hit description =chaperone protein GP96 [Danio rerio] ref|NP_937853.1| tumor rejection antigen (gp96) 1 [Danio rerio] gb|AA
MRTSSTNLHPLVYESYEVLKKHANVDNRLTYSLRRLDNFTRLNFLMEVERKGKTKIQEGKEEDAYILYSRAMTIYLMISESIDDEFRQGRGGQLFYETSQRLGVDFDKVAVSLQQRFMDGKGELPKFCDPLGLRWAEIVEEPISENLECGKDSNSLDAQNKIQSILPKNETALPTTEEFSIKIKGNNKKQISHMTDPAIVGTLEKSEKVEKLIEESGEAKKETKEKEEAGEKQKEEKNDEEARPNLKLVEQTLEWQKVNSMKPIWTRRHAELEKNEHTKFYNSITKDFDMPFGHLRFSENAMPKYILYVPKTLVAHP

SEQ ID NO: 146126 - protein, 40 aa, Heterodera glycines
  Coding regions on vcDNA: vcDNA=SeqID_72549; Strand=+; Position=1 -94,183-211
MGRDHALCGHTALRQTGGRGGRAPTRAAKRQKTALKRTKC

SEQ ID NO: 146127 - protein, 40 aa, Heterodera glycines
  Coding regions on vcDNA: vcDNA=SeqID_72550; Strand=-; Position=1-205
FISIFSESALKHTKLYLQVSLGTLMLFLSKREMNKIFKNF

SEQ ID NO: 146128 - protein, 99 aa, Heterodera glycines
  Coding regions on vcDNA: vcDNA=SeqID_72551; Strand=-; Position=1-658
MFEYPKRTLEKIDFFVFGGVPPNRCAQIYGETESFRSSFPIACALILRWIFAPHKCVSTPHGHLRKSIFLFSGESPRTDAPRYMGRENPSGISFLYTVL

SEQ ID NO: 146129 - protein, 286 aa, Heterodera glycines
  Coding regions on vcDNA: vcDNA=SeqID_72552; Strand=-; Position=1 -148,196-290,470-645,1339-1780
MNQQQVIKTKRNNDKLVHDGALYVFHKFSNDGLKKFWRCEFHGPADQCKGRLHTDLNNVVQKLVGVHSCDMNAAHVECQRLVIKRLRRDENAPRVEPLNLEQLEIPNTYRVYKRTEIDDEQFLLADTGVFQIHGQNGPQRFLDNYTGRMRFNVPMTAPLFDPHEWSVHQRTLDGADRTNNFAEAFHRKLQRQFSCTHPTIWRFIDTIRCEQKALDADMARCMMGEAAPQKKRKYRDADSRILRLVQRYNDVNIVPQNDHNYANPNVNPENINNFFAGISRNYEMRP

SEQ ID NO: 146130 - protein, 62 aa, Heterodera glycines; identical to SEQ ID NO: 138919
  Coding regions on vcDNA: vcDNA=SeqID_72553; Strand=+; Position=1 -21,139-306

SEQ ID NO: 146131 - protein, 25 aa, Heterodera glycines
  Coding regions on vcDNA: vcDNA=SeqID_72554; Strand=+; Position=1-79
KERTPSDIPIFPFHNWPKATVLIDT

SEQ ID NO: 146132 - protein, 62 aa, Heterodera glycines
  Coding regions on vcDNA: vcDNA=SeqID_72555; Strand=+; Position=1-226
FSYIFHNLFQKTKKNDSILKRNSAQKGGMVRRKEEFLEKSAPHLIFPFFRSTTGQRRLCSLT

SEQ ID NO: 146133 - protein, 27 aa, Heterodera glycines
  Coding regions on vcDNA: vcDNA=SeqID_72556; Strand=+; Position=1-81
MHRIIAAVKKLVVGSVLAVRCTLCVLL

SEQ ID NO: 146134 - protein, 308 aa, Heterodera glycines
  misc_feature (19)..(19): Xaa can be any naturally occurring amino acid
  misc_feature (171)..(171): Xaa can be any naturally occurring amino acid
  misc_feature (228)..(228): Xaa can be any naturally occurring amino acid
  misc_feature (241)..(241): Xaa can be any naturally occurring amino acid
  misc_feature (245)..(245): Xaa can be any naturally occurring amino acid
  Coding regions on vcDNA: vcDNA=SeqID_72557; Strand=-; Position=1 -177,209-251,309-612,791-972,1011-1099
  Homolog annotation: Hit_ID=EAA17111.1; Match level="QueryCoverage =91%, HitCoverage=64%, E-value=7e-38, Identity=40%"; Hit description =hypothetical protein [Plasmodium yoelii yoelii]
FVRLNTENPSKQLCPQKQXANYLVGRVSLVIGINQTNRHELRTAMHHHPPNHEKAINLFPVLSQIKPQAPFPVLSQIKPQAPLLNRKTFVSGKLPTRANKSNRKTFVSGKLPTRANKSRRIASWHRLRSELGRYLIAFEPLTFFLINEDILAKCFRCSPSCYGPRISPLTXQYEWPRLSLLTIISVSKTNNRTEILFYYSIFLTAAIILCILRAGITAAAGTRLALSXILVKGFKLYPFRXPASXEIGLVISRHYLLALRVAISQAPSPESNPYPPLPVISQAPSPESNPYPPLPVITMVVRYTTIES

SEQ ID NO: 146135 - protein, 112 aa, Heterodera glycines
  Coding regions on vcDNA: vcDNA=SeqID_72558; Strand=-; Position=1 -211,258-382
MLCKCGECFECEDEKRRLKRNRELNTRKEQIKNCTGNHLAPAMMELKRRNMELFKKAYRPVKGVINKITGGPWNVECEVCHETFTYFMVEWENSRTDFSWGPGRNMVEADNI

SEQ ID NO: 146136 - protein, 301 aa, Heterodera glycines
  Coding regions on vcDNA: vcDNA=SeqID_72559; Strand=-; Position=1 -156,235-346,624-683,733-1310
  Homolog annotation: Hit_ID=AAS54428.1; Match level="QueryCoverage =31%, HitCoverage=8%, E-value=1e-09, Identity=38%"; Hit description =AGL062Cp [Ashbya gossypii ATCC 10895] ref|NP_986604.1| AGL062Cp [Eremothecium gossypii]
MDSAADSIRQLQRAVREQQQMIFLLRSQIVDQRAVLLQNMMRIESTEGYLANSRGNQRFSPRYSPMAGVELSLLGRRLEERERRQQSRLESNVAGPSTASNGGDDERENGPVLSAVIEGHMNRSRMRLIRDEMVHRAVQQQLEHQHHLLLQQAQQQQQREERERQQHFDQQMEEAELLHEQLQAAEQENDENIEPQPPQQQPQPQPLIRHQQLQFERNVRLQLRESQRFERGVASSVLVPPAQLYWETECIICTSNRAHFYSRNCGHIYLCSTCAVNAVIHKVATCMLCRVRIDGIYPFVR

SEQ ID NO: 146137 - protein, 109 aa, Heterodera glycines
  Coding regions on vcDNA: vcDNA=SeqID_72560; Strand=-; Position=1 -58,109-254,301-426
MSTSSNKNYLPKNQCPNCDDDEVDTDPSPEEVEKWTPEQVIEWDQRCYGKMPAEEELWQEFLDKGEANVLREFFGGKGALEVEKSLREYAKKKERRDAILIEKRNEYKK

SEQ ID NO: 146138 - protein, 180 aa, Heterodera glycines
  Coding regions on vcDNA: vcDNA=SeqID_72561; Strand=+; Position=1-543
MVLLTEKIAKILNCRVSELRDRLNHPSDCETVVKALTGHRVKTTYKDRNGYTKSFAFGGITAQGAAITMAYGRLGRPFNVNVAAHFYVRHRIKLRHPFLHCAVESFPEGQEDRFYPLELCEMEDGPNEPDWLGRIFTEIRNDNYTDSMSPANREVLTPEDTSMSREGRDECSQNISYTLW

SEQ ID NO: 146139 - protein, 347 aa, Heterodera glycines
  Coding regions on vcDNA: vcDNA=SeqID_72562; Strand=-; Position=1 -24,87-366,415-702,743-834,878-1237
  Homolog annotation: Hit_ID=NP_001004509.1; Match level="QueryCoverage= 84%, HitCoverage=19%, E-value=2e-25, Identity=30%"; Hit description =si:busm1-180o5.3 [Danio rerio] emb|CAD60788.1| novel protein similar to DNA polymerases [Danio rerio]
MTDKEAGLLNAALEEGYRVTELLRVLEYHKSDNKLFRPYMSEFVVEKLHASGFDEQIKGNFEAEEQFIAECWDQFGIKIDRTKMVPNKGKRSLAKLAVNNLWGRFSLRNYGLSQTLITDDPSELGNYLDNKKIEISGLDMLTPERILTSYQLKKDWIKEHPCSNVVISLFTTSAARLHLLKSMQKVVRSPGCTLLYTDTDSLFLVHPEDSNPLQTGVHLGQLTDEFPKHDILEFVSGGAKQYGLKLRKKGTADEFEYVLKLRGIRLNYDVTENQGLRYNTFKQSVLEFARSGKTDPIKVLYPNFLRPAVIQGNVTSAPLQKIYKPYVGKGIVCSNDFRVLDFGHISP

SEQ ID NO: 146140 - protein, 234 aa, Heterodera glycines
  Coding regions on vcDNA: vcDNA=SeqID_72563; Strand=-; Position=1 -42,85-364,413-700,741-832
  Homolog annotation: Hit_ID=NP_001004509.1; Match level="QueryCoverage= 97%, HitCoverage=16%, E-value=3e-22, Identity=30%"; Hit description =si:busm1-180o5.3 [Danio rerio] emb|CAD60788.1| novel protein similar to DNA polymerases [Danio rerio]
MTDRGWISTCTSLELNAALEEGYRVTELLRVLEYHKSDNKLFRPYMSEFVVEKLHASGFDEQIKGNFEAEEQFIAECWDQFGIKIDRTKMVPNKGKRSLAKLAVNNLWGRFSLRNYGLSQTLITDDPSELGNYLDNKKIEISGLDMLTPERILISYQLKKDWIKEHPCSNVVISLFTTSAARLHLLKSMQKVVRSPGCTLLYTDTDSLFLVHPEDTNPLQTGVHLGQLIDEFPK

SEQ ID NO: 146141 - protein, 929 aa, Heterodera glycines
  Coding regions on vcDNA: vcDNA=SeqID_72564; Strand=-; Position=1 -564,605-1092,1131-1326,1425-1904,1948-2231,2277-2630,2672-3095
  Homolog annotation: Hit_ID=NP_507780.1; Match level="QueryCoverage =63%, HitCoverage=41%, E-value=7e-44, Identity=25%"; Hit description =predicted CDS, DNA polymerase type B, organellar and viral family member (5T899) [Caenorhabditis elegans]
MSKSPPSKRARRFFIEELLREPYNELSPPQKSAKDYVRKLDSEIEHVPKFQWVKNKSRFVIEDVPADPEGLLIGIFQHCMDEAIGDSRLKGVQPTHLGCIISSQLLTSDIWIPIRQMTPDTINTILNRFNDVAQSKKQDGVTLWGDAFTVIVTTVNRNGLPEKMKLKGGAARKLAPVHHRIHEQCLIKIKNFNGDNYCLFYAMQATMVRAVGAMTRQQFYGYLNGIDGMRGKLRTETTELMEAVQAPLGQPNYDAEIYVPRIVDWWNNEKFAGQWKFKAFIFGAMGHYKPLFKYGPEEYIVPIILYFDDGHFNGVQKSGNLFGKPYCLSCEKTYDRPKRHIASCKSRCIKCSQMGPQFPCKPIAGVRQKCKDCNKMFFNNACYQYHLSSNFCQMSKECKYCGVVWDMRKNCDNGRERGCFIRPLEPNKKKETNGWRLVTFDVETMQHEPADPHFPERKKHQVNFVTAKVACPNCISTGKWKESLLGKFCKICGYHRTITFSQMPFRETTVDRQTIDRHPLVAFVKWLLYKLPKQYETIAYSHFGGRFDMVLVFRELFMEGLNPSMIRKGNRLFEMRVKSRKNLNPNVTFRDSWNLIPGPLASMVPMFGLDVQDKPFFPHMANKPDNYGCQIFPSKADYLADGMNPEKRKQFDQWYQQNKNIPFLLDESLASYCKNDVDILMAGLIAFRGEFLEMTKRPAGIDGKADRAAYKTPHNGIDPVRHCVTIASACMRHFRTNHLKPGHLALVPEKGYDSCGDNQSELALNFMQWYAEKHGVRIQNAFSADGEKRVGNFRLDGWIESQQKGLEIHGCVWHACAKCYPDDNEVLPCGKSAGRIRELNQKRMDFILGKIPNVEVFWQCEIEAMLARDRQMRQKFSEFNGDGGPIDIRSCFMGGRTGPLSFITKRQRARKLATMTLPASILLSSEYLS

SEQ ID NO: 146142 - protein, 167 aa, Heterodera glycines
  Coding regions on vcDNA: vcDNA=SeqID_72565; Strand=+; Position=1 -30,245-404,929-1242
  Homolog annotation: Hit_ID=CAE60056.1; Match level="QueryCoverage =86%, HitCoverage=53%, E-value=1e-37, Identity=53%"; Hit description =Hypothetical protein CBG03570 [Caenorhabditis briggsae]
MVKDRLMEFQAEDDHLVASQSQFMEDFFEQVEEIRASIDLIATSVEEVKKKHSAILSNPINDPTIENNLDHDENGGQANVDLRIRKKPSVNFRIRIKKASADQRIRKTQHATLARKFVEVMTDYNKTQTDYRERCKGRIQRQLDIGQWEGTRLTTDSLLGPLYLVRN

SEQ ID NO: 146143 - protein, 75 aa, Heterodera glycines
  Coding regions on vcDNA: vcDNA=SeqID_72566; Strand=-; Position=1 -87,221-362
KNIYVHARLKACLEGYFHWQLIWNQARLRLHDSSGMRSVWMGQFDERHRSVTRKQKHSEQPYRSDLRRSNVPGRH

SEQ ID NO: 146144 - protein, 187 aa, Heterodera glycines
  Coding regions on vcDNA: vcDNA=SeqID_72567; Strand=+; Position=1-564
MSNGQTIELVSANGFHFSDGVQNVEEVSSEGTSSSCGGSRLTHNYPPTTLLSTAEVFSPQQVEPVYVNEKQYARILKRRAARAKLEMEGRIPKQRRVGRRKGRISVQMPFNRNICTNRGIGMLRIGPDVLEESLTRDSLGRTPPLQFKAQREETKRVRRKTEANRWTDKCQKTAQTNDHKTFYTLKE

SEQ ID NO: 146145 - protein, 76 aa, Heterodera glycines
  Coding regions on vcDNA: vcDNA=SeqID_72568; Strand=+; Position=1-231
MSFVKNSSHNYEKILTGQRNNSRKLREKGDSCQHVVAQLRIILWSINKLTPNMRKKDATCQEIWRQNVNMSQLLTK

SEQ ID NO: 146146 - protein, 29 aa, Heterodera glycines
  Coding regions on vcDNA: vcDNA=SeqID_72569; Strand=+; Position=1 -74,884-899
MFFIDTYMGGIGCPKGDKQKADGRRKYTS

SEQ ID NO: 146147 - protein, 28 aa, Heterodera glycines
  Coding regions on vcDNA: vcDNA=SeqID_72570; Strand=+; Position=1-87
TMGANISKRSKSIFGIALNKNVTERMII

SEQ ID NO: 146148 - protein, 151 aa, Heterodera glycines
  Coding regions on vcDNA: vcDNA=SeqID_72571; Strand=-; Position=1 -167,241-375,741-896
TEDVQKLADEIFALTSSTWDIISKLRHVSKHAITFVRVASQIGSLIAAGADLAFKPESEEFKAIQKLHHFVEAKFAALSRHVEHQTNELKFFLTETDYYASVTRPLNGIQSSYSGITDPFSNRTQYKSDFISRCTDRSSPYDVLLVIIVIN

SEQ ID NO: 146149 - protein, 16 aa, Heterodera glycines
  Coding regions on vcDNA: vcDNA=SeqID_72572; Strand=+; Position=1-49
EAIPEGFGLPINLGAS

SEQ ID NO: 146150 - protein, 128 aa, Heterodera glycines
  Coding regions on vcDNA: vcDNA=SeqID_72573; Strand=-; Position=1 -373,426-439
  Homolog annotation: Hit_ID=XP_522969.1; Match level="QueryCoverage =96%, HitCoverage=73%, E-value=5e-13, Identity=36%"; Hit description =PREDICTED: similar to putative protein family member (XC187) [Pan troglodytes]
MVIRRGTMVIRRGTMVIRRGTMVIRRGTMVIRRGTMVIRRGTTVIRRGTMVIRRGTMVIRRGTMVIRRGTMVIRRGTMVIRRGTMVIRRGTTVIRRGTMVIRRGTMVIRRGTMVIRRDTMVIRREFLE

SEQ ID NO: 146151 - protein, 82 aa, Heterodera glycines
  misc_feature (82)..(82): Xaa can be any naturally occurring amino acid
  Coding regions on vcDNA: vcDNA=SeqID_72574; Strand=-; Position=1-281
PGLKCPAEAKNFFYFREKIEIFPKKIPVDRARKTMFWKWSPFFWENSLKNPKIQKPENRFLGLARKILKNFEILKSGKIGLX

SEQ ID NO: 146152 - protein, 53 aa, Heterodera glycines
  Coding regions on vcDNA: vcDNA=SeqID_72575; Strand=+; Position=1-159
MPFLFPSIVNTNNTAFNRINDKSANVRQKLDMMETALVHLTTNKCQLNFSAEK

SEQ ID NO: 146153 - protein, 24 aa, Heterodera glycines
  Coding regions on vcDNA: vcDNA=SeqID_72576; Strand=+; Position=1-76
ITGVSIIAVLFLVFLMPSQNLVRF

SEQ ID NO: 146154 - protein, 75 aa, Heterodera glycines
  Coding regions on vcDNA: vcDNA=SeqID_72577; Strand=+; Position=1-228
MFLIAKIVRGRRLLHQLEQEEEKEKAQKEREKIMATKAGGGGEKGQGTKGLRRKVPKEKRAMAFLGTETESAEKG

SEQ ID NO: 146155 - protein, 131 aa, Heterodera glycines
  Coding regions on vcDNA: vcDNA=SeqID_72578; Strand=+; Position=1 -215,348-528
MPLIMDKVCLSPRHLSPAKVPAHLVATTSVLLAGLGASASGRWRRSFNDLARLDFGGVQQQQDKEEDDEHSRRAVRQRTDSSLPSVDEELTAYSNHNAKMRRTSSMPSVVESDTHGKEAFAIVKKGNRLAD

SEQ ID NO: 146156 - protein, 78 aa, Heterodera glycines
  Coding regions on vcDNA: vcDNA=SeqID_72579; Strand=-; Position=1 -33,97-171,297-413,754-765
  Homolog annotation: Hit_ID=CAE62925.1; Match level="QueryCoverage =96%, HitCoverage=18%, E-value=6e-18, Identity=58%"; Hit description =Hypothetical protein CBG07125 [Caenorhabditis briggsae]
MSMDLAIEHTKVRQAFGKSISQFQWTQFKLAEMATKLVTSRLLLREACHHLQEDTPNASAMSAMAKMYITDEAFTIRL

SEQ ID NO: 146157 - protein, 87 aa, Heterodera glycines; identical to SEQ ID NO: 129152
  Coding regions on vcDNA: vcDNA=SeqID_72580; Strand=-; Position=1-713

SEQ ID NO: 146158 - protein, 16 aa, Heterodera glycines
  Coding regions on vcDNA: vcDNA=SeqID_72581; Strand=-; Position=1-49
EAIPEGFGLPINLGAS

SEQ ID NO: 146159 - protein, 117 aa, Heterodera glycines
  Coding regions on vcDNA: vcDNA=SeqID_72582; Strand=+; Position=1 -148,228-287,347-490
DRLALWDRLMVLASKVQKVINLSSKISSVQNTDHMMQQPTEEQRQRIYQTDKAKSALLHLLLTDCLAKNDETTVFDRFKMLKEENNCKIAPEMFSNLPLARLLVKFGKGMTMRRGLA

SEQ ID NO: 146160 - protein, 55 aa, Heterodera glycines
  Coding regions on vcDNA: vcDNA=SeqID_72583; Strand=+; Position=1 -58,117-227
SFEQQKMYEEAKLSGLSTLQWLERQRSLNKRGKKRKQEVDTKASKGRKIRYVEIP

SEQ ID NO: 146161 - protein, 102 aa, Heterodera glycines
  Coding regions on vcDNA: vcDNA=SeqID_72584; Strand=+; Position=1 -157,621-772
  Homolog annotation: Hit_ID=CAE72285.1; Match level="QueryCoverage =90%, HitCoverage=53%, E-value=3e-15, Identity=41%"; Hit description =Hypothetical protein CBG19413 [Caenorhabditis briggsae]
MKLFLISLIVLGILLTNLEAFRQQTVGIRGRLMCGNQPLKDANVKLWNKNTLGSDDQLAANRTDNHGNYELQGGVGQLTKMNVHFKVYHDCDDGIKVEEIKI

SEQ ID NO: 146162 - protein, 41 aa, Heterodera glycines
  Coding regions on vcDNA: vcDNA=SeqID_72585; Strand=-; Position=1-125
MALQFRAPAAQPTTMRRCCCAKCARTKPAAFTTAFSLARDA

SEQ ID NO: 146163 - protein, 17 aa, Heterodera glycines
  Coding regions on vcDNA: vcDNA=SeqID_72586; Strand=-; Position=1 -41,437-449
MSSALCTIFSLYLFRII

SEQ ID NO: 146164 - protein, 24 aa, Heterodera glycines
  Coding regions on vcDNA: vcDNA=SeqID_72587; Strand=-; Position=1-80
RTLSTAVRQRSSKIYSIPQILWAG

SEQ ID NO: 146165 - protein, 143 aa, Heterodera glycines
  Coding regions on vcDNA: vcDNA=SeqID_72588; Strand=+; Position=1 -108,515-836
MLKRAREFEKANNWQNGNKKYYSIIWNSPFYDGVSKVEDRAFVAFVKGRSTFDTFCTEFADELAKICYEMTEEQQQPTFDQQKEYLAQKYAAHIGVVYLMRENWHCAKIIGSELGSDGQQKECQKLHKYFDIFYKYLFCVYAE

SEQ ID NO: 146166 - protein, 80 aa, Heterodera glycines
  Coding regions on vcDNA: vcDNA=SeqID_72589; Strand=+; Position=1 -47,95-172,562-678
  Homolog annotation: Hit_ID=NP_724808.1; Match level="QueryCoverage =95%, HitCoverage=20%, E-value=9e-14, Identity=53%"; Hit description =CG1827-PB, isoform B [Drosophila melanogaster] gb|AAM71075.1| CG1827- PB, isoform B [Drosophila melanogast
VSTWDSFDFQAAAQKAFDIFRQGPVGWNTSSSYRRLNAIVEGLSECEKRRCDRTVGFGGSPDERGETTLDALVMDGPGHK

SEQ ID NO: 146167 - protein, 38 aa, Heterodera glycines
  Coding regions on vcDNA: vcDNA=SeqID_72590; Strand=+; Position=1-122
SAPSCSNLTLFRFVLIFCCWSILYNLNSLNLVYKLIKL

SEQ ID NO: 146168 - protein, 32 aa, Heterodera glycines
  Coding regions on vcDNA: vcDNA=SeqID_72591; Strand=-; Position=1 -40,88-144
KYNVSYEFSFICNHAKTATRKRPLPKRPGPYK

SEQ ID NO: 146169 - protein, 75 aa, Heterodera glycines
  Coding regions on vcDNA: vcDNA=SeqID_72592; Strand=-; Position=1 -57,119-148,361-501
MSSFKTLQAALLLVDVIQQAARLVYVVQQNKQRQRLIVSGNTNEEIDNALQPIGHAVKFCWKLGLKAGQLRLSQV

SEQ ID NO: 146170 - protein, 27 aa, Heterodera glycines
  Coding regions on vcDNA: vcDNA=SeqID_72593; Strand=+; Position=1 -9,255-327
MVNLDESSNQEDEVFVEAHPMQPVTAD

SEQ ID NO: 146171 - protein, 28 aa, Heterodera glycines
  Coding regions on vcDNA: vcDNA=SeqID_72594; Strand=+; Position=1-85
IFFVCVSNIVRLFDRARQEKATVGTKFA

SEQ ID NO: 146172 - protein, 72 aa, Heterodera glycines
  Coding regions on vcDNA: vcDNA=SeqID_72595; Strand=+; Position=1-216
MENLKIQIVTVVFKNDADPFTVKGFDQNNAELYSATTQSGTFNNETWQFVKMNVNHWEGLDAGMITFKDGNE

SEQ ID NO: 146173 - protein, 61 aa, Heterodera glycines
  Coding regions on vcDNA: vcDNA=SeqID_72596; Strand=-; Position=1 -79,360-466
MLNLDASRKSYGVDKLIIFMVIIIQPSLSQDFFGALYFSHKNVIVWENKIINRNYKYGQQI

SEQ ID NO: 146174 - protein, 126 aa, Heterodera glycines
  Coding regions on vcDNA: vcDNA=SeqID_72597; Strand=-; Position=1-668
KKSTFWFSGQSLRIDAPEITGEPESFRNSFPIACTLILRRISAPHNCFEYPNRTLEKIDFFVFGAVPPNRCAQIYGETESFGNSFPIACTLILRWIFAPHKCLSTPNGHLKKSIFLFHKYFFQKVL

SEQ ID NO: 146175 - protein, 37 aa, Heterodera glycines
  Coding regions on vcDNA: vcDNA=SeqID_72598; Strand=-; Position=1-112
IKVNVEASNQVETAFFMLNISKLVRRKKRHMLQNAVS

SEQ ID NO: 146176 - protein, 28 aa, Heterodera glycines
  Coding regions on vcDNA: vcDNA=SeqID_72599; Strand=+; Position=1-89
RPGGGALLSLATFNFFNNSRGMVEAVQI

SEQ ID NO: 146177 - protein, 49 aa, Heterodera glycines
  Coding regions on vcDNA: vcDNA=SeqID_72600; Strand=+; Position=1 -106,450-493
MPADNEARLYFGTFTSGCANAMASNVRADSLIVFGAYYWYNYSHSQYSI

SEQ ID NO: 146178 - protein, 78 aa, Heterodera glycines
  Coding regions on vcDNA: vcDNA=SeqID_72601; Strand=-; Position=1-262
MPAQNFVTNQQRKNDYAADHQTMLNTLNPPPKTIKLSARTLDAIALAHPEVNVPKYSRASLSAGIVHFGVGNFHRAHQ

SEQ ID NO: 146179 - protein, 173 aa, Heterodera glycines
  Coding regions on vcDNA: vcDNA=SeqID_72602; Strand=+; Position=1-520
  Homolog annotation: Hit_ID=NP_702063.1; Match level="QueryCoverage =86%, HitCoverage=3%, E-value=2e-11, Identity=23%"; Hit description =hypothetical protein PF14_0175 [Plasmodium falciparum 3D7] gb|AAN36787.1| hypothetical protein [Plasmodium
ISITGTHSIHQHSNHIPISGTQSTNSPINGTQSTSISITGTQFYCISITGTQPTNIPINGTQPTNISLGLNPQTFQSLGLNPPTFQSTGLNPPTFQSLGLNPPTFHSTGLNPPAFQSLGLNPPTFQSLALNSPTFQSLGLIPPTFQSLGLNPPAFQSLGLNPPTFQSTGLNPP

SEQ ID NO: 146180 - protein, 74 aa, Heterodera glycines
  Coding regions on vcDNA: vcDNA=SeqID_72603; Strand=-; Position=1 -119,156-261
MGYETADGHQRKRNIAMPTLGFFISSTRYNAINNNLVPKMDGIPRPKDFRKLEIGIPSLKNFGRSEFLKLYKIN

SEQ ID NO: 146181 - protein, 66 aa, Heterodera glycines
  Coding regions on vcDNA: vcDNA=SeqID_72604; Strand=+; Position=1 -58,142-284
MLSFRMIASLLDLDAAKEKIGFATTFGWTFSHLLTMLNSDSKWHFFRHVLMRWWTNISMANQNFQF

SEQ ID NO: 146182 - protein, 47 aa, Heterodera glycines
  Coding regions on vcDNA: vcDNA=SeqID_72605; Strand=+; Position=1-141
MKFKAMYGTCREMLPSYCAEHMWRQFNGKKTLAAFNNMIYHIAFYYP

SEQ ID NO: 146183 - protein, 25 aa, Heterodera glycines
  Coding regions on vcDNA: vcDNA=SeqID_72606; Strand=-; Position=1-75
MKLSMEQISQIPELRTNQFKERICQ

SEQ ID NO: 146184 - protein, 84 aa, Heterodera glycines
  Coding regions on vcDNA: vcDNA=SeqID_72607; Strand=+; Position=1 -80,130-169,373-507
MNFLFINFIFFTALFNSVNSQCFSPEESNDTQLDKCCGEKLVYTLNINESCSIRGKKFNCSLAWLLERYKLSDKYTIEANTEVK

SEQ ID NO: 146185 - protein, 99 aa, Heterodera glycines
  Coding regions on vcDNA: vcDNA=SeqID_72608; Strand=+; Position=1 -163,224-360
MALLCAAEPDCIVPIGQTKECLYTRIAPNLTCHRQHQSLLDTLLYNMEYRKQIADPSFLPHTSAKHPRWSAKFIGSFRIKHSRSFVGNAEEWLSNVKCC

SEQ ID NO: 146186 - protein, 54 aa, Heterodera glycines
  Coding regions on vcDNA: vcDNA=SeqID_72609; Strand=-; Position=1 -67,143-240
MSFLLLLNFRFCPIGWLVEAGPVFFSPILAISDILNHQTKFNSVIFIVGMALCQ

SEQ ID NO: 146187 - protein, 59 aa, Heterodera glycines
  Coding regions on vcDNA: vcDNA=SeqID_72610; Strand=+; Position=1 -98,281-362
MPASVDSSSPPKSKSEGNLEHQQKDEAKKNGGGSKDDYEQKEQQLKKTEEKQVEEESDG

SEQ ID NO: 146188 - protein, 63 aa, Heterodera glycines
  Coding regions on vcDNA: vcDNA=SeqID_72611; Strand=-; Position=1-508
LTLKNNSLPKSFLQPLIANIISCRFKAIHCLPVSAQQSTNRVFDSLQKIIPYPKVFYNHILPI

SEQ ID NO: 146189 - protein, 28 aa, Heterodera glycines
  Coding regions on vcDNA: vcDNA=SeqID_72612; Strand=+; Position=1-85
IFFVCVSNIVRLFDRARQEKATVGTKFA

SEQ ID NO: 146190 - protein, 67 aa, Heterodera glycines
  Coding regions on vcDNA: vcDNA=SeqID_72613; Strand=+; Position=1 -21,78-256
TANLVPTVAFSCLALSNNLTIFETQTKKILDQKMAISFFSFFYRKLGTNSCLLLSGPIKHLFSHFFT

SEQ ID NO: 146191 - protein, 87 aa, Heterodera glycines
  Coding regions on vcDNA: vcDNA=SeqID_72614; Strand=+; Position=1 -81,223-532
LCCTMLLSPAVRRDSSKILYHILLWKVQVPYWTTTCQLAQSPLASCGTENGNIRWGALFSKNSSFRLTIPPFCALFRFKIESFFLAF

SEQ ID NO: 146192 - protein, 95 aa, Heterodera glycines
  Coding regions on vcDNA: vcDNA=SeqID_72615; Strand=-; Position=1-288
MNFLLYRRQQLLAQILDATHRINVFDANLATGNMGTEEREQAIADREQLFEFVRELLRQLDVVREDERRMRQRQRDDDNDNNSEVYSHWFWVPLV

SEQ ID NO: 146193 - protein, 75 aa, Heterodera glycines
  Coding regions on vcDNA: vcDNA=SeqID_72616; Strand=+; Position=1-228
MSVFSSVAEMSVFSSVAEMSVFSSVAEMSVFSSVAEMSVFSSVGVGASGVGIGVVVVVVVVVVVVDLKESRLKKN

SEQ ID NO: 146194 - protein, 44 aa, Heterodera glycines
  Coding regions on vcDNA: vcDNA=SeqID_72617; Strand=-; Position=1 -19,566-599,749-830
MKQNEIEKSFIGIKSLHLVKRMLKSEKRKKKMIEDKKKEIYYVC

SEQ ID NO: 146195 - protein, 92 aa, Heterodera glycines
  Coding regions on vcDNA: vcDNA=SeqID_72618; Strand=+; Position=1 -14,278-542
  Homolog annotation: Hit_ID=AAU06531.1; Match level="QueryCoverage =86%, HitCoverage=96%, E-value=4e-17, Identity=51%"; Hit description =unknown salivary protein [Culicoides sonorensis]
MAEKISASSSSSFVIILTLLLLFLHPALGGPAAYGICQAGCSALVVACYAAAGAVFGTVTTGIGTPPAIIACNAAYGTCQAACWAALHAPTL

SEQ ID NO: 146196 - protein, 281 aa, Heterodera glycines
  Coding regions on vcDNA: vcDNA=SeqID_72619; Strand=-; Position=1 -456,508-897
MAKIRSLIMGLQTDFGTLFAEISMKKIEKCKWTSKMFPCIVAKINQIVAFAEQSGSYCDLSPFERATEMLNDLISRKELANPSKEQAQRIVDELVVEMKMGIWLNEMKTKMINFEKPFVDIKGFFKFSSDLSAELAEINAAICKWPNSMNKKEELKGKIGKLISIAMEKSHFLKQLIVQKLDGLLKKATNAFEELKSELEETKEAEENFMKFNRKIIDIYSDKAMHMPDDVDFAVFGILERTKRGELLLPTAFEELQKVIEHEKRSAIEAFENKEGQSEKC

SEQ ID NO: 146197 - protein, 249 aa, Heterodera glycines
  Coding regions on vcDNA: vcDNA=SeqID_72620; Strand=+; Position=1 -255,302-796
LLWEFQRRKLAELETAQMTLFLNPSNLCGKKKAEEGQFFGESKWHETAEKVREQISQACEEGEESAAVEGGESEGTTKKTSEDIQSEVTNYMETARLELGQPSTSGNCVDPSSPPLVTHFNSMAELLFWWRINAERFPRLVQLARQFCAVPMANSSDQRKALSNDNAEEEKVTRRYAAEQMAEDGDMAQLESGRTEQLQLLTQLMTVRMALREGATETNENGKKRNECMAPNEEITTIEPIRETSEIKI

SEQ ID NO: 146198 - protein, 18 aa, Heterodera glycines
  Coding regions on vcDNA: vcDNA=SeqID_72621; Strand=-; Position=1-54
MRTRPIWQVKQRLLTSQK

SEQ ID NO: 146199 - protein, 43 aa, Heterodera glycines
  Coding regions on vcDNA: vcDNA=SeqID_72622; Strand=+; Position=1 -24,89-196
MTEYASVAVLLNAFYDLSFFLGVLSYKKTKKEFHFLRKTLGLI

SEQ ID NO: 146200 - protein, 96 aa, Heterodera glycines; identical to SEQ ID NO: 139205
  Coding regions on vcDNA: vcDNA=SeqID_72623; Strand=-; Position=1 -144,241-387

SEQ ID NO: 146201 - protein, 166 aa, Heterodera glycines
  Coding regions on vcDNA: vcDNA=SeqID_72624; Strand=+; Position=1 -142,816-1174
MLFEDLSAGQKSAVFFQKRLIMTTMPNLKFEKSFFSRDLSETIYLFVNGESTTAPTPLASATEAEEEEQPILLNYLDTLAQSICVMAMEQSANKLFERQIQLFYQFADGLANDVIHSVLRLADEEPSDFDDDEVEQEEQAFEDVHSAEEEAEMMPKDDKNAFLAEK

SEQ ID NO: 146202 - protein, 146 aa, Heterodera glycines; identical to SEQ ID NO: 143902
  misc_feature (135)..(135): Xaa can be any naturally occurring amino acid
  Coding regions on vcDNA: vcDNA=SeqID_72625; Strand=-; Position=1-445
  Homolog annotation: Hit_ID=AAP92584.1; Match level="QueryCoverage =82%, HitCoverage=24%, E-value=5e-34, Identity=63%"; Hit description =Ab2-057 [Rattus norvegicus] gb|AAP85373.1| Aa1262 [Rattus norvegicus] gb|AAP85367.1| Aa1011 [Rattus norveg

SEQ ID NO: 146203 - protein, 108 aa, Heterodera glycines; identical to SEQ ID NO: 134591
  Coding regions on vcDNA: vcDNA=SeqID_72626; Strand=+; Position=1 -96,135-365

SEQ ID NO: 146204 - protein, 106 aa, Heterodera glycines
  Coding regions on vcDNA: vcDNA=SeqID_72627; Strand=+; Position=1 -91,316-342,637-699,2528-2667
MAILLKCVLLLSIMAIFCDCMDPGKKGKSKDPIPIPKQEGKPSSSAANSPTVTKGTPKRGDKKALQKERQEERKQKERERENRFLRTKSTAGAKNGYPTFEDNPAI

SEQ ID NO: 146205 - protein, 94 aa, Heterodera glycines
  Coding regions on vcDNA: vcDNA=SeqID_72628; Strand=+; Position=1 -113,459-628
ALKAKTAALCFIFEKTTKNDCSCKDLEKELLQLGLPSAPSLTVVCKEQVPTAADPSVKSDYFRLDTTSSDGSTATLLIHRDELVQLRTCKIAVA

SEQ ID NO: 146206 - protein, 204 aa, Heterodera glycines
  Coding regions on vcDNA: vcDNA=SeqID_72629; Strand=+; Position=1 -111,266-336,378-457,514-565,611-630,784-902,954-976,1019-1053
  Homolog annotation: Hit_ID=CAE65756.1; Match level="QueryCoverage =97%, HitCoverage=33%, E-value=3e-58, Identity=64%"; Hit description =Hypothetical protein CBG10845 [Caenorhabditis briggsae]
IEKLPDRCLQLIFSYLSPTQMLSVGRVCRRWKGIAYSPVLWSSVSFRVNHGGIQVTSKHSQLFAQMIGVLFAQMIGVRFTELRLCELSTDLITPIVLHVLHELASRCPKLQFLTLDFSTAMQFSTAMQLHDFNDLQSFPSRLRSLTLCLSENIFLEGFLRKVYTFISSVEILHIIGVEILHIIGTYEKVEDEEETYEKVEDEEE

SEQ ID NO: 146207 - protein, 15 aa, Heterodera glycines
  Coding regions on vcDNA: vcDNA=SeqID_72630; Strand=+; Position=1-48
SWTFRGSAIRPWGNP

SEQ ID NO: 146208 - protein, 24 aa, Heterodera glycines
  Coding regions on vcDNA: vcDNA=SeqID_72631; Strand=+; Position=1 -52,295-317
MEKACKIWRDYIDFSALELLELAS

SEQ ID NO: 146209 - protein, 45 aa, Heterodera glycines
  Coding regions on vcDNA: vcDNA=SeqID_72632; Strand=-; Position=1-135
EREQRFREFEQNYLGTRDDIEAQIKQETEANLKAMDSNVAKNKQQ

SEQ ID NO: 146210 - protein, 39 aa, Heterodera glycines
  Coding regions on vcDNA: vcDNA=SeqID_72633; Strand=+; Position=1-124
LMAQNTAQIEEFVRLVLSSWPSYQFAIKNQLAGSLTSAK

SEQ ID NO: 146211 - protein, 19 aa, Heterodera glycines
  Coding regions on vcDNA: vcDNA=SeqID_72634; Strand=+; Position=1-61
LLNFGLLRDQRIHKNIQQR

SEQ ID NO: 146212 - protein, 31 aa, Heterodera glycines; identical to SEQ ID NO: 133797
  Coding regions on vcDNA: vcDNA=SeqID_72635; Strand=-; Position=1-96

SEQ ID NO: 146213 - protein, 38 aa, Heterodera glycines
  Coding regions on vcDNA: vcDNA=SeqID_72636; Strand=-; Position=1 -52,124-188
MEKACKIWRDYIDFSALDFLFISLFDSESIRETDLTFN

SEQ ID NO: 146214 - protein, 50 aa, Heterodera glycines
  Coding regions on vcDNA: vcDNA=SeqID_72637; Strand=-; Position=1 -49,260-364
EAIPEGFGLPINLGASVTDWGTQTIMGSKNPTQNYRTGYREAIPEGSGSP

SEQ ID NO: 146215 - protein, 364 aa, Heterodera glycines
  Coding regions on vcDNA: vcDNA=SeqID_72638; Strand=+; Position=1 -18,135-336,378-931,975-1295
  Homolog annotation: Hit_ID=NP_001004509.1; Match level="QueryCoverage= 97%, HitCoverage=24%, E-value=4e-52, Identity=35%"; Hit description =si:busm1-180o5.3 [Danio rerio] emb|CAD60788.1| novel protein similar to DNA polymerases [Danio rerio]
MGRESKECDVKEELKKNKEMKKFFESVPDKGPINPRDAYAGGRTMPFCLYAKTTEEIEISMFDIISLYPFVNYDTPYPVGVPKIVVSRNFNVNWTAPDDVPYDGLLKVKVIPPKNLLYPLLPVHIDEMLLFPNCWSCARRAKNEFVMTKDVKKCNHRPAQRAFLGTFTSIELRKALELGYRIVGFYRAYHFEQFDSQLFKGYVRMFLKIKVEASGWPAEVKSEDGKRAFIEMYKAKYDIGLDYDKIGFNPGLRMIAKLGLNSLWGKFSMRNTLSNTEIVGSMERWMELGRDNTIEFGRPVKISEEISRVVYRKKEEFIREHKVSNIVLSLWTTSAARLKLYEYMEQVYKKEGCKLLYCDTGEKE

SEQ ID NO: 146216 - protein, 295 aa, Heterodera glycines
  Coding regions on vcDNA: vcDNA=SeqID_72639; Strand=+; Position=1 -165,343-809,849-915,1075-1179,1585-1668
MSREAEPGWKIEKISVDLYCSALSDPVIIPARPFQQSNPDIVFNEFMHRQQSFGEEALEKEDFFWQKNRAEVEALLIEASNYKIIIHRDYESRYSDYIATYHRTPLFCFCMIERNLRFFYDTGTGTPIGRVTTVLHVTVEASYTGEGFISPMFSFWFYWEGRSQTTNESFTSRLYLYTVSMLRAMGKAWGRELLLNPVEVLIDMFYQRIDRDLVGSWSLFYRLPPSLFDTSRRKMQTIAEIKNFEIVDGGRIFVVRARIENVMEAEYRFGSCWSERKVVAFQKKKKSNLPVPEEL

SEQ ID NO: 146217 - protein, 152 aa, Heterodera glycines
  Coding regions on vcDNA: vcDNA=SeqID_72640; Strand=+; Position=1-459
MNFHKSEKANAILLEAAKRETERAWKDVVALEEEVSDFAKSSRETLNRAIKSREKAPYANGVREFYIKISDSIWEIFTILDKINVESEKAEAVWRELEKCKDFELATKFEEKSINALTEAHRLHFESRRVHNKIRAYENRLQNIVWEFIGQV

SEQ ID NO: 146218 - protein, 121 aa, Heterodera glycines
  Coding regions on vcDNA: vcDNA=SeqID_72641; Strand=+; Position=1-366
MSMQQNQGSDDVLPMWAVPDFDEMGQMPQRQKQKKIPTLKEFRNQWKERRLLWEREEAEKKDPKTWKKRTDEMKKICEERLEQSKGAGGSNKRQEPDKYTWNWGELQRQEREYLDGGLWGK

SEQ ID NO: 146219 - protein, 299 aa, Heterodera glycines
  Coding regions on vcDNA: vcDNA=SeqID_72642; Strand=-; Position=1 -591,890-1198
  Homolog annotation: Hit_ID=AAK35072.1; Match level="QueryCoverage =71%, HitCoverage=86%, E-value=8e-09, Identity=28%"; Hit description =zinc finger transcription factor pacC [Trichophyton rubrum]
MAFAQNEQFGLQTAETLRQTDAQLLTTKHAFSPTETSADSLFKSVVAAVTAQATSHQPSTSSSQLPTQQNLASASIPQPPQQQQSISIIHPQQQLQSQLLTQQSLVSTSPPSPPPQQPSASSMSQQQPSQIRQHQPRQFIDSEGRLTAHVFIDEDEETETQQHQNQQYSPISDSPLEGVPPPDNDNQITGLMTSILNRIPSSSGSSASTTNTSKSGHELRKHIRALYAELGEKHAEQRDRAKNAIDSKIGTSSTCSTEGGQKRSTTNTDKIKKKVIQHLKFKHSHTCLLCDLIHAGYQK

SEQ ID NO: 146220 - protein, 345 aa, Heterodera glycines
  Coding regions on vcDNA: vcDNA=SeqID_72643; Strand=-; Position=1 -45,92-277,355-470,1330-1399,1932-2060,2254-2743
MDLHIDDYLNPFYDSHRNEPFLCDIELSLSSFAVWTNLYNRFDVGIQPREYLSDIFANAKLHMQSMKKVMAMPETDSECLRVSFAWQPLLNADECANEKCRREFLSRIERRVHCQWPVKNMKVHVDKYLQTLTSVGILLDLLVPHVEEEQTRDAVPLHIFDFVCLASKSATVREALLQFSDKLWVALTTSPSSSPTVSSPSTTCNDAAISVDDDKSEEDKEDEQEGKERQKDGGDDEQRRRQHGQEQKQRPGGRRRMGGVRNIGNTCYLGAAIQTLANVSLLSGFLLSKWFIGLIFEFIFPFFAPPNSEQQFRHLPLVRHYVQMLRSLLVAKETASPVEFKVFPE

SEQ ID NO: 146221 - protein, 53 aa, Heterodera glycines
  Coding regions on vcDNA: vcDNA=SeqID_72644; Strand=+; Position=1-160
MMDAGAILIAISTLPNMAMSYAGDDSAYGVTNNPHDTRRITGKHFNPISVNEG

SEQ ID NO: 146222 - protein, 88 aa, Heterodera glycines
  Coding regions on vcDNA: vcDNA=SeqID_72645; Strand=+; Position=1 -76,707-894
MASHPALVDSAKMCIPTVAIVDSNSDQKGKKSFKELQQLHDKNGPLRLIRIDVSDDRSIRTAFGQVQKQLVDKGGLNLLINNAGILLK

SEQ ID NO: 146223 - protein, 83 aa, Heterodera glycines
  Coding regions on vcDNA: vcDNA=SeqID_72646; Strand=+; Position=1 -90,145-306
MFATLKTTSSSRHLLPILFIFCCCYRAFSNFGDAAIVPLSALGRYKVSLGELNELLTEQQRSADAVPSTGDKLPNYATVGQKK

SEQ ID NO: 146224 - protein, 62 aa, Heterodera glycines
  Coding regions on vcDNA: vcDNA=SeqID_72647; Strand=+; Position=1 -176,249-261
MCQPFSLPLLGGGIVPLPTARPSQIGVGLQFQAELPENDDEQLQKERPKAPDEEDPYFSILN

SEQ ID NO: 146225 - protein, 53 aa, Heterodera glycines
  Coding regions on vcDNA: vcDNA=SeqID_72648; Strand=+; Position=1 -40,667-788
MRNSKILNLRLSRGPPPLQHVQLLSPKRTARFGTIRCQLHQCNCEHKMDTRHG

SEQ ID NO: 146226 - protein, 197 aa, Heterodera glycines
  Coding regions on vcDNA: vcDNA=SeqID_72649; Strand=+; Position=1 -29,363-927
MCQPCELYARKQKKHRPVQLLLENDPNYADDLSKQRNEHDNAGTTAVVGADTTGAKAAEVAPRRHYPCHDDRNCMLACEAATRVRVQQQQRASWHFNIKEEVPMTPEDKAGAVAIEQSDDEAADGSNVAEGEARNENGGVGIGGGGEQYNNGDKCLQQEEEREMKQRWAQGKDDSSNSFSKRSQILGKMNSKAFKKL

SEQ ID NO: 146227 - protein, 32 aa, Heterodera glycines
  Coding regions on vcDNA: vcDNA=SeqID_72650; Strand=-; Position=1-99
DYFSKHLVDWGIIGDYGINRDWAIIRAYTVFS

SEQ ID NO: 146228 - protein, 45 aa, Heterodera glycines
  Coding regions on vcDNA: vcDNA=SeqID_72651; Strand=-; Position=1 -82,124-179
MFRINIIVCERIKNFPLASVLTRFRNIAFEPPTKGIDCINIFILS

SEQ ID NO: 146229 - protein, 34 aa, Heterodera glycines
  Coding regions on vcDNA: vcDNA=SeqID_72652; Strand=+; Position=1 -74,175-205
MSGAVPFLKNKIINTRVQLKLFSLINLALLLIND

SEQ ID NO: 146230 - protein, 135 aa, Heterodera glycines
  Coding regions on vcDNA: vcDNA=SeqID_72653; Strand=+; Position=1 -124,185-468
MRGEEKHIGKNIKEIEQNIVNYQEKIMNFGEEVNLNLNFKEEILKFILPSLIAECITSNLLYGKKIEWKMLEMALEKIGKKELWEEIEKIYNEWKTKFEKKSKNDDNVMEKMEKMKEKLEELKDEIEEEKEEKKK

SEQ ID NO: 146231 - protein, 628 aa, Heterodera glycines
  Coding regions on vcDNA: vcDNA=SeqID_72654; Strand=-; Position=1 -1267,1474-2092
  Homolog annotation: Hit_ID=NP_502797.1; Match level="QueryCoverage =29%, HitCoverage=52%, E-value=7e-26, Identity=33%"; Hit description =HASI (4P602) [Caenorhabditis elegans] emb|CAB16520.1| Hypothetical protein Y57G11C.19 [Caenorhabditis ele
MPTKVEMSKGISVLLRRGGEDEDGEVVDTPPRPPAPPPPPPPPPGKCPPRGPNPPAPPPPPPPGRRPPRPPSPPSPPGSPPPRPQRPPRPCRAAAPSRRGGLIEQWRKRRYDIQLRRPVVRDLLAEAAAAPLPESDDEYDYMLESGFALPAPSQYYGDLPVLPDNADEIEEMDTVQRRIATRRRLKKDLADDDDDDEVDLQRKRNRIYHPSPPRLPSPPRKSEPRPPPTAKREHQKQTKAELKSSTSKKTGHPTPTPRPKREPEFGLDPRPSTSRQAGYNPPPSTPKIKHDPTKRPKPYRIPKREPKIERTPQQQQQRQPPPAAIVEEMPLIPPPRRGTKRRHPVNDDDGDGEVRIRKRVRQPRRVRVQYSPEPGPSTSAQSDEQQQQQQQQQRELFAIPSNQLTMTQRIERLYIKINNYAEQQNHPDGTGNQEGISPEKMELINTTLDKLYNNPSSPAAFAGVTALWKEARKKIKHLRKKDVQHYLDGHRTYTLMRPRRVRFPRAKTIAAGFMTDVQVDLADFQALSRHNRGHRYLLVAVDVLSKRLFVVPLRNKRAEEMLEAFKQLIDQMPMAPHRVFSDKGTEFKNRLLKEFFEEREIEKHEPVHSTVKASIAERAIRNVKQRLY

SEQ ID NO: 146232 - protein, 59 aa, Heterodera glycines
  Coding regions on vcDNA: vcDNA=SeqID_72655; Strand=+; Position=1 -97,355-437
MENSQGELEQFYSTAVKVLDRLSFFLLKLDCKASETDASAVLEIISNKGLKLFSHLNHY

SEQ ID NO: 146233 - protein, 48 aa, Heterodera glycines
  Coding regions on vcDNA: vcDNA=SeqID_72656; Strand=-; Position=1 -111,638-673
MSNRPTEISGGDEDADEEEIDGWSGDEEDELEPINPNGHSLRFHYILP

SEQ ID NO: 146234 - protein, 25 aa, Heterodera glycines
  Coding regions on vcDNA: vcDNA=SeqID_72657; Strand=-; Position=1-75
TCTCGVVVKLSTFHNFSPGFNSPLG

SEQ ID NO: 146235 - protein, 47 aa, Heterodera glycines
  Coding regions on vcDNA: vcDNA=SeqID_72658; Strand=-; Position=1 -34,97-142,211-513
  Homolog annotation: Hit_ID=NP_496469.1; Match level="QueryCoverage =97%, HitCoverage=11%, E-value=1e-15, Identity=80%"; Hit description =DNaJ domain (prokaryotic heat shock protein) (45.0 kD) (dnj-13C) [Caenorhabditis elegans] emb|CAA91333.1|
LGGNGIVDDYQVMRHMVNLESVNTYEGTHDIHALILGKAITGHQAFQ

SEQ ID NO: 146236 - protein, 26 aa, Heterodera glycines
  Coding regions on vcDNA: vcDNA=SeqID_72659; Strand=+; Position=1-77
VHTATGEETVVEQAKVGWRARENGRT

SEQ ID NO: 146237 - protein, 47 aa, Heterodera glycines
  Coding regions on vcDNA: vcDNA=SeqID_72660; Strand=+; Position=1-143
RCSEIEHFSACQIRHKFVRLCGNAFHGFGFRRQTASPSHHSCQFARH

SEQ ID NO: 146238 - protein, 190 aa, Heterodera glycines
  Coding regions on vcDNA: vcDNA=SeqID_72661; Strand=+; Position=1 -93,233-712
MGLKYELINQRQGFVEKCDGCYFNVFHSNVQFPPIVWPPPEGASEDVVSQHLKPFHDVLRFISANCLTIVQHPELYDQAKKTLDAVNLLNGVLDQHRRQQQGQGQQQQYTGMTVLENSDNNRRQTNNGDEEIYISDADDDDDGIPFLVRRFLNANIADEQTVTAAEQPDYANGETSMFCDDVAEMECQQN

SEQ ID NO: 146239 - protein, 154 aa, Heterodera glycines
  Coding regions on vcDNA: vcDNA=SeqID_72662; Strand=+; Position=1 -112,206-288,348-617
MSDPKKYNIEQALQNTERAIEPSLDWQGPTQQQLEEKSMQEENSPTAPSPFQHQLAQQKQQPSRLGQHNSSQGQHPQMLPTPLHPPLELFEEGLRYTATWTFAAMFNKPLEAERIATTLSDASMLLNMCVQILNRRPQRLQHGLQHPTSSSQQH

SEQ ID NO: 146240 - protein, 172 aa, Heterodera glycines
  Coding regions on vcDNA: vcDNA=SeqID_72663; Strand=+; Position=1 -172,225-542,746-774
MFKKMVKMFSKNKDKMKVQEENQLEEKYRNLNSLKETDPAMAQIMEKLQMHIKEVKSGKISEPLKQYFIFVIQFLAKRHHISVAEIVPIQNMKTKKVLTELVKLVLEEKRKNKQKNGKNKDTNGQNCQSENKFKSNKAKEERMLRLLLTALDNVNGTINLSMDGLFHYFFVN

SEQ ID NO: 146241 - protein, 23 aa, Heterodera glycines
  Coding regions on vcDNA: vcDNA=SeqID_72664; Strand=+; Position=1-70
MHRIIAAVKKLVVGSVLAVRCTL

SEQ ID NO: 146242 - protein, 34 aa, Heterodera glycines
  Coding regions on vcDNA: vcDNA=SeqID_72665; Strand=+; Position=1-105
GAFGGLTQLWGAKIPRRIKVQAIGKLFPKDSGSP

SEQ ID NO: 146243 - protein, 18 aa, Heterodera glycines
  Coding regions on vcDNA: vcDNA=SeqID_72666; Strand=+; Position=1-56
YREAIPEGFGLPINLGAS

SEQ ID NO: 146244 - protein, 83 aa, Heterodera glycines
  Coding regions on vcDNA: vcDNA=SeqID_72667; Strand=-; Position=1 -108,208-351
MMVQWNSLLSQVVTEVDHPQPILEHIKETAEFSVKQFRDACLGMISELTRTSVDWQLNFPNEMAEQVISVSSILGTRLMQNNV

SEQ ID NO: 146245 - protein, 46 aa, Heterodera glycines
  Coding regions on vcDNA: vcDNA=SeqID_72668; Strand=-; Position=1-139
VTLRQIRKRAAEMRRRMTRTTDSHVQVDTKDRGTIIRPLDASFSQP

SEQ ID NO: 146246 - protein, 87 aa, Heterodera glycines
  Coding regions on vcDNA: vcDNA=SeqID_72669; Strand=-; Position=1 -180,885-966
  Homolog annotation: Hit_ID=NP_989688.1; Match level="QueryCoverage =75%, HitCoverage=20%, E-value=2e-10, Identity=47%"; Hit description =Machado-Joseph disease protein [Gallus gallus] gb|AAD21923.1| Machado-Joseph disease gene product ataxin-
QVGRMCAQHALNMLLQGDYFTPDSLASIAQELDQRERAMLRDESEFQSQNYDDSGYFSIQTADEELFGAATPVISQAEELDIQERLT

SEQ ID NO: 146247 - protein, 34 aa, Heterodera glycines
  Coding regions on vcDNA: vcDNA=SeqID_72670; Strand=+; Position=1-105
HSRSIIFNPLNPTIRILGSRCSLASIHPPPQQQQ

SEQ ID NO: 146248 - protein, 90 aa, Heterodera glycines
  Coding regions on vcDNA: vcDNA=SeqID_72671; Strand=+; Position=1-273
MPSFGKMPLCSISAAPLSFSLTPSTAPARALALTLRQSDRTAHIRHSRTDDLETNICTDITTMKADGTTDIDEEMPSEHRLTKVIAKQIS

SEQ ID NO: 146249 - protein, 77 aa, Heterodera glycines
  Coding regions on vcDNA: vcDNA=SeqID_72672; Strand=-; Position=1 -102,154-285
MRPQRRRLRPIQLFQLVLLSLFGILLFAKVIYKTLFSQEMDSEKGGIVFFAIFMFIIIILCIREVYKGIDNNLFIFN

SEQ ID NO: 146250 - protein, 152 aa, Heterodera glycines
  misc_feature (143)..(143): Xaa can be any naturally occurring amino acid
  Coding regions on vcDNA: vcDNA=SeqID_72673; Strand=+; Position=1 -163,340-371,445-521,810-988
  Homolog annotation: Hit_ID=NP_497941.1; Match level="QueryCoverage =95%, HitCoverage=47%, E-value=1e-50, Identity=65%"; Hit description =lipase, class 2 family member (3F705) [Caenorhabditis elegans] emb|CAA84650.1| Hypothetical protein F10F2
PNCPSPRRFLEAVLAYTAAPKIDVITHSVGVVLARKAIKGGELIATDGNCSLGNLSDRVDTFLGIAGPNIAGPNYGLCMCQLAQTMPAWCNALDGLYPGYSCEDQLLCGYTQTPCDQVNYSAFLEKLNRDPSREADYVFAFWXKTAELILNL

SEQ ID NO: 146251 - protein, 253 aa, Heterodera glycines
  Coding regions on vcDNA: vcDNA=SeqID_72674; Strand=+; Position=1 -174,223-495,635-754,809-950
  Homolog annotation: Hit_ID=NP_491281.1; Match level="QueryCoverage =97%, HitCoverage=23%, E-value=1e-72, Identity=56%"; Hit description =alanyl tRNA Synthetase (106.8 kD) (ars-2) [Caenorhabditis elegans] gb|AAB52339.1| Alanyl trna synthetase
LDFQKCTGRLLRIRSGSQFVDKIESGTEGALLLDRTCFYAEQGGQIYDTGVLSKTDDDDTWFSVDTWFSVTNVQVRAGYIFFFGIAEGTLHVGDELNQQFDEDRRWLIMKNHTGTHVLNFALQKVLVSVDQKGSLVASDRMRFDFTSKQALGAEQVKKVEEEAQKLIDTNESVFSRPCVLTEARDISGLRAVFEEAYPDPVRVVSVAYPDPVRVVSVGVPVDRLLEDPKSELGHGTSVEICGGTYVRNQILNF

SEQ ID NO: 146252 - protein, 105 aa, Heterodera glycines
  Coding regions on vcDNA: vcDNA=SeqID_72675; Strand=+; Position=1-318
MALKTGDEEPIRLLGKRVNEFEQVGFGNQGLVFDCLCQELNSQLLPYWRRDNLREQVKQLRMAMKKLKKAFKKSTKDEENGTETAEEKRSKGKSGAKKKAEAVEN

SEQ ID NO: 146253 - protein, 225 aa, Heterodera glycines
  misc_feature (221)..(221): Xaa can be any naturally occurring amino acid
  Coding regions on vcDNA: vcDNA=SeqID_72676; Strand=-; Position=1 -211,262-376,427-726
  Homolog annotation: Hit_ID=T37314; Match level="QueryCoverage=83%, HitCoverage=29%, E-value=5e-39, Identity=40%"; Hit description =probable kexin (EC 3.4.21.61) - Caenorhabditis elegans  (fragment) gb|AAA98752.1| endoprotease
CVEHCEEGFYADGDKCKRCATDCETCSQAELCDKCHDAKLLIDVKHYGHLDHGRCVATCPEGLVADCKRGTIQAKCVLRTIQAKCVLRRNSCSAGYFESAQSVCLECDKSCATCHGPGPLQCDECAQGFANPLQCDECAQGFANHTMGYCRQCCSPDQLTQKDLHCEDCSKSYPEFPTKSHLSFLFWPTFSQSLASSFASFLFVSPIDLLLFDWSQWKSFXSRVN

SEQ ID NO: 146254 - protein, 124 aa, Heterodera glycines
  Coding regions on vcDNA: vcDNA=SeqID_72677; Strand=-; Position=1-657
LFEYPKRTLEKIDFFVFGAVPPNRCAQIYGETESFGSSFPIACTLILRWIFAPHNCLSTPNGHLKKSIFFVFGAVPPNRCAQIYGETESFGNSFPIACTLILRWIFAPHNCLSTPNGHLKKSIF

SEQ ID NO: 146255 - protein, 45 aa, Heterodera glycines
  Coding regions on vcDNA: vcDNA=SeqID_72678; Strand=+; Position=1 -67,150-220
MHHHPPNHEKAINLSILTVSGPALQPYFPPEPEDFRFREAPHQGE

SEQ ID NO: 146256 - protein, 181 aa, Heterodera glycines
  misc_feature (4)..(4): Xaa can be any naturally occurring amino acid
  misc_feature (170)..(170): Xaa can be any naturally occurring amino acid
  Coding regions on vcDNA: vcDNA=SeqID_72679; Strand=-; Position=1 -104,919-1367
  Homolog annotation: Hit_ID=AAP92584.1; Match level="QueryCoverage =86%, HitCoverage=31%, E-value=3e-38, Identity=58%"; Hit description =Ab2-057 [Rattus norvegicus] gb|AAP85373.1| Aa1262 [Rattus norvegicus] gb|AAP85367.1| Aa1011 [Rattus norveg
NGGXGFDSGGGLIWPLRLRMAAGAQITHSQREEAWPFLVRGAICLVYSDNERDSSLLNSWLIASGHNFLEGFSVFSRTKLSNNRSVMPLDVRGCTRATLAKSACLPSPKGVGKPVKICRDWDRTLQLLSVNEEFLVGASHQLALNTSLPFVHTARRCPGLSHFEKFGDGXCSGRSVCRLEP

SEQ ID NO: 146257 - protein, 121 aa, Heterodera glycines
  Coding regions on vcDNA: vcDNA=SeqID_72680; Strand=+; Position=1 -66,115-362,446-494
MSKDCFGVERLFEKEIRRRNRLERFARSAANSSSSFGGRIGSDENLQNPNKEGQHKLAQQQQLTMKISHPKMLTKNENAEDREWTPREEAKKRRSEGGYRFFGVRKPMAQKARDEMIKLRE

SEQ ID NO: 146258 - protein, 132 aa, Heterodera glycines
  Coding regions on vcDNA: vcDNA=SeqID_72681; Strand=-; Position=1 -32,494-860
MNLYTSTHKKNKVIKLFVKNPELPYFTKPPALLFHSLRHTHVELFGDKEACANISLGEFGILDGFAGPVPTNKTALFRNRSFWGYLLCMEEPITALSYDMLAGLPQQGGKLGVIGHKDNDKCPFAIRLVMMP

SEQ ID NO: 146259 - protein, 69 aa, Heterodera glycines
  Coding regions on vcDNA: vcDNA=SeqID_72682; Strand=-; Position=1-210
MASPSLMNRLIFPFLLGVLLQNSNNIVDGSGIVDWTTGKQLNSVESRKAPVVITESGEMCANKFKLLRS

SEQ ID NO: 146260 - protein, 75 aa, Heterodera glycines
  Coding regions on vcDNA: vcDNA=SeqID_72683; Strand=-; Position=1-228
MGGNAKEKMLRFNDTVKIGEATADYDRKTLPNDEVVPLLTEQYKADAHNVMEMYMEDKKMTCMLLRFNQKNLDKL

SEQ ID NO: 146261 - protein, 104 aa, Heterodera glycines
  Coding regions on vcDNA: vcDNA=SeqID_72684; Strand=-; Position=1-438
NGVSKNRNYAQKAPQTILALPIPSTIAFIHPIMNAKIIRVPKIACDLRLEKNGVSKNRNYAQKASQPILAHPIPSTIAFIHPIMNAKIIRVPKIACDLSLEKMV

SEQ ID NO: 146262 - protein, 413 aa, Heterodera glycines
  Coding regions on vcDNA: vcDNA=SeqID_72685; Strand=-; Position=1-1242
  Homolog annotation: Hit_ID=NP_920205.1; Match level="QueryCoverage =78%, HitCoverage=21%, E-value=2e-37, Identity=33%"; Hit description =putative DNA helicase homolog [Oryza sativa (japonica cultivar -group)] gb|AAP52492.1| putative DNA helica
MHREIRETMHMQLHRCSDSWCGPSDPIYGRCKKGFPAPYSKCTILRPDRPAMYFRPSPTDGGAQLEVNGLIYDNSHVVPYNPYILLRYRVHHNVLFAYGNKANIKYALKYPFKGPGHCYVECKQESGNKIGIDEPAQYAKMNFRGATEAYAIVHSLPFAKLSHQVVKLSIHMPNQQPIVYRAFQLVSKAQQIQQGELPETQCSAYWKQWQNEWKHDPKLKDMLFEKVPEHFIWAKDKWNKRKYNLTKRPPIGRIVPVPPSDPERFALYSLMRHFPGDPDHLKMVNGLLCTSFTEAAIMHGLLEDDKIWDKTLAEAALSRWPDQMRWLFVSILVYGQPSNAIELWNKYNDQMYNPQGIITLAQHKVAELEALADIDWRLHSCFNLSCVHFSLPDPPTSIAKNTDAAIEEFFLWR

SEQ ID NO: 146263 - protein, 28 aa, Heterodera glycines
  Coding regions on vcDNA: vcDNA=SeqID_72686; Strand=-; Position=1 -32,240-294
MTNSGILHPQNLILNIELMLNLIWMRLD

SEQ ID NO: 146264 - protein, 21 aa, Heterodera glycines
  Coding regions on vcDNA: vcDNA=SeqID_72687; Strand=-; Position=1-64
GPGSRSRVLKSSGPGPGPGRA

SEQ ID NO: 146265 - protein, 19 aa, Heterodera glycines
  Coding regions on vcDNA: vcDNA=SeqID_72688; Strand=+; Position=1-59
KNSNFNLYQVKIIQNYLVF

SEQ ID NO: 146266 - protein, 125 aa, Heterodera glycines
  Coding regions on vcDNA: vcDNA=SeqID_72689; Strand=+; Position=1 -229,538-661,754-773
  Homolog annotation: Hit_ID=CAE68383.1; Match level="QueryCoverage =88%, HitCoverage=4%, E-value=1e-42, Identity=77%"; Hit description =Hypothetical protein CBG14139 [Caenorhabditis briggsae]
YYQSLNTFGISYKLCLFLFKYTEKSPREVSMKKGDVLTLLNASNKDWWKVEVSDRQGFVPAAYVKRIEPGSQHHHQGQPMNTINAKQSQIEDQYKRLLMLGEQRKRKLEEACKAYQVMRREANDL

SEQ ID NO: 146267 - protein, 79 aa, Heterodera glycines
  Coding regions on vcDNA: vcDNA=SeqID_72690; Strand=+; Position=1 -115,573-658,1914-1952
MAFSLVSLLRRFLPPYHQNLVYVICGAHILYGSIALAVHIFMAILCIIPQFCKVEVSEGNRVQELDLCINLARIYLSNA

SEQ ID NO: 146268 - protein, 39 aa, Heterodera glycines
  Coding regions on vcDNA: vcDNA=SeqID_72691; Strand=-; Position=1 -45,409-483
MTFGGKYNGERDNAKGSYRPKSASKDWYADLQGHNGENS

SEQ ID NO: 146269 - protein, 23 aa, Heterodera glycines
  Coding regions on vcDNA: vcDNA=SeqID_72692; Strand=+; Position=1 -4,684-751
MDEFLRNFLGVYILRTAVDFDTE

SEQ ID NO: 146270 - protein, 58 aa, Heterodera glycines
  Coding regions on vcDNA: vcDNA=SeqID_72693; Strand=-; Position=1 -71,325-430
MGEGRAWPLLFCLLSQAVLAHNTFGDTFPARSTYQVAALPKNGRVEIEAVAIIEDTKH

SEQ ID NO: 146271 - protein, 82 aa, Heterodera glycines
  Coding regions on vcDNA: vcDNA=SeqID_72694; Strand=+; Position=1 -114,178-312
MLHNGQYCSPTNTTLNGAFGRMMSTRKWAKRWLLTLSAGPIDNPDELGEIYDSISYAKSNSIIRMRFNHLGEAISKRPFGIT

SEQ ID NO: 146272 - protein, 103 aa, Heterodera glycines
  Coding regions on vcDNA: vcDNA=SeqID_72695; Strand=-; Position=1 -36,360-635
MSKVEIEFFECTRVVHFVFFFCFCVYQFCAAAGYESLLSVAHNASVPRVAQQKAENAQFDGDVAGHGPLQGTDQEILQHSEFGSGNFMNIYFAFPIIGHFNIN

SEQ ID NO: 146273 - protein, 39 aa, Heterodera glycines
  Coding regions on vcDNA: vcDNA=SeqID_72696; Strand=-; Position=1-117
MYYKEPLAKQRQVTNLVETILCHVVEKMSSIEVRRVCEE

SEQ ID NO: 146274 - protein, 182 aa, Heterodera glycines
  Coding regions on vcDNA: vcDNA=SeqID_72697; Strand=+; Position=1 -3,415-521,1070-1209,1688-1778,1839-1875,2194-2361
MFRVCAENAFGRSDPLNTDVDRPGLPEGPITYPATTNKEVSVQGPSVVPLKSQRANEKEKDAMQTRTPKTAQPSSAHGIGPSLDSSDQPLSSTARRRQPRRQKSARKDATDMQCCSKNLPPRHKNTERTASGGGRQRVGSTAADRPAQAAAAAYAGDEEAPNEEEVADSEGEQQLLDMTTVE

SEQ ID NO: 146275 - protein, 183 aa, Heterodera glycines
  Coding regions on vcDNA: vcDNA=SeqID_72698; Strand=+; Position=1 -87,493-556,609-698,750-831,1104-1167,1449-1528,1652-1670
  Homolog annotation: Hit_ID=CAE59250.1; Match level="QueryCoverage =99%, HitCoverage=40%, E-value=1e-51, Identity=61%"; Hit description =Hypothetical protein CBG02576 [Caenorhabditis briggsae]
DDNPKDDINGVITGDLLIVMAQIIVAIQMVWEQKYLMQYDVPPLLAVGLEGLFGMIVLGSLMVPMLFGMIVLGSLMVPMYYIRVPATFSRDPEHRLEDVFHALEDVFHAFAQIHQRPIILAPLFLTITSIAFFNFAGVTVTKRLSATTRMVLDSVRTLLIWAFSIPFFGERFIPLQVSLFQLP

SEQ ID NO: 146276 - protein, 257 aa, Heterodera glycines
  Coding regions on vcDNA: vcDNA=SeqID_72699; Strand=+; Position=1 -156,205-305,375-481,545-954
MENAKISLLYQLEQRKVSKLERENRALRERINGLLEKQDDERIELLVADRTRRKLVQLRAITERTIKSLESGINEFRAFVTDINEAMDEEENKGAIQPLKLVDISNESDRILRNFSPKLKRIPESPMVLSAISTSKSGSNSQSESFRTGLEEEEEERANGMEEVVNETPHLDMMETSGTGTEVENASNSKGKIEQRKSAIAPICSITLRQRSSAMKFAPSEMKRTHSGHYHIKAGKKQEIDLGNLGFMDNILTCYFE

SEQ ID NO: 146277 - protein, 231 aa, Heterodera glycines
  Coding regions on vcDNA: vcDNA=SeqID_72700; Strand=+; Position=1-696
  Homolog annotation: Hit_ID=CAE66074.1; Match level="QueryCoverage =89%, HitCoverage=85%, E-value=2e-13, Identity=31%"; Hit description =Hypothetical protein CBG11288 [Caenorhabditis briggsae]
MQKNAPEPEKLTSKPIGTLNETKKMEETNATKAGNRSQEPFMKPTTIVGDHSNETEHTQKPILTYTPEPSPEDTDEPEESDKTEQPTTKNSTSEPIENSTTSTDRHDETETYKPIVTETTKMPSSKPIEKLTTTTDDYDVETSESTTEKKEKIRSGKPTKSTRKTTKSTKSVTAHSTETLTNTTTASAMPDNGTTTEPSEGTALPPEQSTAAKFIFGFEFGRIFFKYLKVG

SEQ ID NO: 146278 - protein, 122 aa, Heterodera glycines
  Coding regions on vcDNA: vcDNA=SeqID_72701; Strand=+; Position=1 -79,236-525
MRILGIGIGVDEKCADATHAQKRLHADGLVGLRCRQFDNGASAGAVPLRSSLTGRSTLAVNPSHKAGAVVPVDQSVVAVPSYDDDDDVTHQLSLTVDCIINIYLRHSSHEYGNKETTHKNCG

SEQ ID NO: 146279 - protein, 235 aa, Heterodera glycines
  Coding regions on vcDNA: vcDNA=SeqID_72702; Strand=+; Position=1 -75,128-182,225-320,378-467,515-577,650-679,727-823
  Homolog annotation: Hit_ID=NP_509897.1; Match level="QueryCoverage =99%, HitCoverage=15%, E-value=2e-54, Identity=51%"; Hit description =guanylyl cyclase (gcy-9) [Caenorhabditis elegans] emb|CAA91488.1| Hypothetical protein ZK455.2 [Caenorhab
SDIRGFSPMAANSTPYQVVAFLNDMFSGFFSGFDAIIAKHDAFKVETIGHTYMVVSGVPIGHTYMVVSGVPRENGNAHVQHIGDIALKMRTFVSNFKVTHRPEEIIMVRIGFFVSNFKVTHRPEEIIMVRIGFHSGSVAAGVVGLAAPRYCLFGDTVVGLAAPRYCLFGDTVNMASRMESTGMANKIQESTGMANKIQISEPSISEPSYNLIKCFYPPFIVIERGKVEIKVNKKG

SEQ ID NO: 146280 - protein, 15 aa, Heterodera glycines
  Coding regions on vcDNA: vcDNA=SeqID_72703; Strand=+; Position=1-49
LKAIHCLPVLGTAKH

SEQ ID NO: 146281 - protein, 47 aa, Heterodera glycines
  Coding regions on vcDNA: vcDNA=SeqID_72704; Strand=-; Position=1 -24,281-400
MTLRPEFLLRVLPRSKSMMAMKFRSLKTLLKQYSYQSNMIRLAMINS

SEQ ID NO: 146282 - protein, 46 aa, Heterodera glycines
  Coding regions on vcDNA: vcDNA=SeqID_72705; Strand=-; Position=1 -10,59-189
MLAGLYLYLEELQKLATFQYQLFPVQSPLNNSLGFDLSAGWPADLL

SEQ ID NO: 146283 - protein, 95 aa, Heterodera glycines
  Coding regions on vcDNA: vcDNA=SeqID_72706; Strand=-; Position=1-829
LFEYPKRTLEKIDFFVFGAVPPNRCAQIYGETESFGNSFPIASTLILRWIFAPHNCLSTPNGHLKKSIFLFSGQSPRTDAPRFMGRPNPSGVASL

SEQ ID NO: 146284 - protein, 125 aa, Heterodera glycines
  Coding regions on vcDNA: vcDNA=SeqID_72707; Strand=-; Position=1 -316,893-954
MDLNNGFYDREEDKVKLTIDLTTVDEPKVDKFNLDQSNSKGTLFMEIEKVSEFAREIIGSERKSETVHIKGLPWKIWAGIEKKNESTEKNEKWMGFLLLCDAPKEGQCLQFFGLGFIALILLGFT

SEQ ID NO: 146285 - protein, 78 aa, Heterodera glycines
  Coding regions on vcDNA: vcDNA=SeqID_72708; Strand=-; Position=1-237
MPFSTNGRISDRKKGTLLMDIEKVSEFAREEVGSSRYSEKVYINGLPWKIEAELNGLVDSEKWLSIYLLCDATEKGAN

SEQ ID NO: 146286 - protein, 273 aa, Heterodera glycines
  Coding regions on vcDNA: vcDNA=SeqID_72709; Strand=-; Position=1 -63,163-255,484-636,710-848,976-1349
  Homolog annotation: Hit_ID=BAB55143.1; Match level="QueryCoverage =40%, HitCoverage=36%, E-value=2e-14, Identity=39%"; Hit description =unnamed protein product [Homo sapiens]
MSMDRMKHLLSTGEHSDVHFLVLPAHQLILKSVSDVFEAMFRFDAINYCCLINFANCCLAYIGKNADTLLKSDAFLQIDQKLLCEILECDELQIRGEISIWNAALRWADEKCRENGIDCSAENRRQMLGPALFKIRFPLLSNEEFTKKIVPFGVLSKDEVISVYQFKSLPNCHGISDGIFPMQFPTNGRISDRKKGTVLMDIKKVSEFAREEVESSRYSEKVYINGLPWNILAKIKTKNGGTDNEKWLGIFICCDTSKKGAKLLIVNIYINNN

SEQ ID NO: 146287 - protein, 174 aa, Heterodera glycines
  Coding regions on vcDNA: vcDNA=SeqID_72710; Strand=-; Position=1-522
MSAKIIRVPKIACDLSLAKNGVSKNRNYAQKASQTILAHPIPSTIAFIHPIMNAKIIRVPKIACDLSLAKNGVSKNRNYAQKAPQTILALPIPSTIAFIHPIMSAKIIRVPKIACHLSLAKNGVSKNRNYAQKAPQTILALPIPSTIAFIHPIMSAKIIRVQKIACHLSLAKNG

SEQ ID NO: 146288 - protein, 95 aa, Heterodera glycines; identical to SEQ ID NO: 128262
  Coding regions on vcDNA: vcDNA=SeqID_72711; Strand=+; Position=1-762

SEQ ID NO: 146289 - protein, 68 aa, Heterodera glycines
  Coding regions on vcDNA: vcDNA=SeqID_72712; Strand=+; Position=1 -56,500-650
MDAISEEELMAQNAVEIARELQAIRGLTDSSDSGVHLQQQQQHELQLRHRRPFPAQQQIHPNGANGGI

SEQ ID NO: 146290 - protein, 41 aa, Heterodera glycines; identical to SEQ ID NO: 129572
  Coding regions on vcDNA: vcDNA=SeqID_72713; Strand=+; Position=1-162

SEQ ID NO: 146291 - protein, 41 aa, Heterodera glycines; identical to SEQ ID NO: 139690
  Coding regions on vcDNA: vcDNA=SeqID_72714; Strand=+; Position=1-163

SEQ ID NO: 146292 - protein, 70 aa, Heterodera glycines
  Coding regions on vcDNA: vcDNA=SeqID_72715; Strand=-; Position=1 -43,99-269
  Homolog annotation: Hit_ID=NP_509299.1; Match level="QueryCoverage =98%, HitCoverage=21%, E-value=1e-11, Identity=48%"; Hit description =calponin (44.8 kD) (XI306) [Caenorhabditis elegans] gb|AAB52603.2| Hypothetical protein C53C9.2 [Caenorha
HPFDKYKKKFEERESHKEDSTPQREESFTVPKVEVEQPKVEEEEAAAEEEVEEEEVEEEEEDEEEEEEEE

SEQ ID NO: 146293 - protein, 66 aa, Heterodera glycines
  Coding regions on vcDNA: vcDNA=SeqID_72716; Strand=+; Position=1-199
MDQKETLTAEQLQKVLLDAEKSGEYSYEELLPIWEEAKGMIENEEQMVSLYTTFIYMSRRFAEREK

SEQ ID NO: 146294 - protein, 77 aa, Heterodera glycines
  Coding regions on vcDNA: vcDNA=SeqID_72717; Strand=+; Position=1 -62,116-182,587-691
MHFQRYEIFSVTRKRPIPFKPPQVVQRHVAEGLFVAIVFQRKLKNASSRDADILSYEQFDLFVADLDESDLFNVTIF

SEQ ID NO: 146295 - protein, 62 aa, Heterodera glycines
  Coding regions on vcDNA: vcDNA=SeqID_72718; Strand=+; Position=1-272
SLSQMESARTLSQCLSEMARHANNETEPQRNVIKRKTSCSSGDLQQNQPSFASEQMDDNDTA

SEQ ID NO: 146296 - protein, 757 aa, Heterodera glycines
  misc_feature (121)..(121): Xaa can be any naturally occurring amino acid
  Coding regions on vcDNA: vcDNA=SeqID_72719; Strand=-; Position=1 -2249,3614-3662
  Homolog annotation: Hit_ID=NP_500640.1; Match level="QueryCoverage =99%, HitCoverage=85%, E-value=1e-114, Identity=32%"; Hit description= reverse transcriptase family member (4F533) [Caenorhabditis elegans] gb|AAK39265.1| Hypothetical protein
LIIHNIYIPPNSSCNNSKNINGFLSGNQDTLIVGDFNAHHTTWDAISPEDERGVDFAESIDQHPFVILNDEDTPTRVDSTILSSPDISLISDSLATSTTWKTTAALGSDHLPITISIHQIXWSHTPRRTFINFSKANWNNFADEVDSLLKTLPKPTNIVHGERRLRSAILTAPAHHIPAGRIPKIRPSFPSDMVHLANERDHLQLTDPANHRIHDLTNTITKRVCQFRREKWLEHLKRCPRNSRQLWKTIKSLNNNTKEQNIPLHFNNLPCYDNSKAASLLNAAFHPRPSGRPSKVNRQANRHIDKAMRNSAEFASWTATTVQLAISNTKNSTALGPDNISSSHIRHLGPVAVKYMADLFNLTITSGIIPQLWKNARVIPIPKPGKDTTNPSNYRPISLLSPVAKVLERLLLPHLNAHLPPPANQHGFRRGFSTVTALHSIHKYITDGLNRQAPVERSVAVSLDLSKAFDTVDHRLLIHDISNTTLPPIIKRWIRNYLGGRQAQVVFRGKTSSHRTIRMGVPQGSVLSPALFNFYTATIPTPPGIHIVTYADDITILARATSIAIASDKINAFLQDPRIHTIDGPIPFLCNPKLLGITFDPLLTFNAHSVELRSKIQKRNNILRALAGTTWGQSKEVLLTTYKAIARSLLNYAAPIWSPQLADSNWSILQRCQNSALRTITGCVSISSADHLHAETSILPVKDHNFLLSRQFLLATRQPGTPPTHPARRKWSQLFKTVNPKRKPPVLFIFNSLSMDN

SEQ ID NO: 146297 - protein, 106 aa, Heterodera glycines
  Coding regions on vcDNA: vcDNA=SeqID_72720; Strand=+; Position=1-319
  Homolog annotation: Hit_ID=NP_500640.1; Match level="QueryCoverage =98%, HitCoverage=11%, E-value=5e-13, Identity=34%"; Hit description =reverse transcriptase family member (4F533) [Caenorhabditis elegans] gb|AAK39265.1| Hypothetical protein
RIHTIDGPIPFLCNPKLLGITFDPLLTFNAHSVELRSKIQKRNNILRALAGTTWGQSKEVLLTTYKAIARSLLNYAAPIWSPQLADSNWSILQRCQNSALRTITGC

SEQ ID NO: 146298 - protein, 48 aa, Heterodera glycines
  Coding regions on vcDNA: vcDNA=SeqID_72721; Strand=+; Position=1-145
HGERRLRSAILTAPAHHIPAGRIPKIRPSFPSDMVHLANERDHLQLTD

SEQ ID NO: 146299 - protein, 353 aa, Heterodera glycines
  Coding regions on vcDNA: vcDNA=SeqID_72722; Strand=-; Position=1 -49,2125-2422,2628-2834,2887-3059,3117-3301,3357-3423
  Homolog annotation: Hit_ID=NP_493337.1; Match level="QueryCoverage =98%, HitCoverage=42%, E-value=3e-74, Identity=40%"; Hit description =eukaryotic DNA topoisomerase I., TOPoisomerase (94.0 kD) (top-1) [Caenorhabditis elegans] emb|CAB07640.1|
VSLGPADCSSSSSPFRKEETSNEKKKEKKAEEVMPKKSKESTSKSRKKNESSGEEEDFDDDSDGEEEEYQPKVRRREGKRMKKDDILQKKKQKSDPSPAKKSDSKKSTKTTKVTKSSSQGSPSKKRVKKQEEEEEVWRWWEEDESNAGVKWQTLVHKGPVFAPAYVPLPKHIKFKYDGKEMDLSLPAEEVASFYAKMLDHDKEMDLSLPAEEVASFYAKMLDHDYTSKPVFNQNFFKDWVKVMTKAERGEIKDLAKCDFRQMHAFQMHAFYVSESEKRKARSKEEKKAEKEEKEGEGKVYGFAMLDGYKQKIGNFRIEPPGLFRGRGDHPKMDHPKMGSLKKRVQPEDVVINC

SEQ ID NO: 146300 - protein, 233 aa, Heterodera glycines
  Coding regions on vcDNA: vcDNA=SeqID_72723; Strand=+; Position=1 -108,159-472,674-953
MPNSNGKEKALNECAESIEVISLKEQKANELNIDKMKTDVANTTRKNVLEFQFIDAFSLGKEKYCKFVDRSVQVESDMDFANLKVEGIEKEDENLVESVSAASIYNGKESSISTTANSTNSTEMSVGEVNGRKVARILAMSCATSNKCNHSLAEERRIVITSRRQSPQAEDDELVEVLSAKTLTEERMAHSGGGQKSGKNGQRKGRNGEEDEEQSTLDQVTPIPTTLELSNST

SEQ ID NO: 146301 - protein, 109 aa, Heterodera glycines
  Coding regions on vcDNA: vcDNA=SeqID_72724; Strand=+; Position=1 -223,344-450
MCSYTMFLAMCLLFAAVTLATSNGSEEIIADANNGDLAMTVRVVVDLWLSFFWPWLLSILKNDKILLVYKIKIGGCECNSWNALEEICFVQHPFELVQPVHVQPMLQWM

SEQ ID NO: 146302 - protein, 130 aa, Heterodera glycines
  Coding regions on vcDNA: vcDNA=SeqID_72725; Strand=-; Position=1-393
TEEDLFADLWKNLLIPMKPQKLAINYERHGIKRENWIHQNIHNFDKSLLTTSLKAEDVSSERQNEEDIKPKILEEIKKETFSDEEQNAMNVRTKLKFPKKEIYDEMISDGIDEKQAGDQSNSCSSKTDDL

SEQ ID NO: 146303 - protein, 51 aa, Heterodera glycines
  Coding regions on vcDNA: vcDNA=SeqID_72726; Strand=+; Position=1 -145,569-579
MASAHQQPFLEAPNDKMSTPLFQLISAAVQPKAAIGKRGETFNLDLNKLCT

SEQ ID NO: 146304 - protein, 260 aa, Heterodera glycines
  misc_feature (254)..(254): Xaa can be any naturally occurring amino acid
  Coding regions on vcDNA: vcDNA=SeqID_72727; Strand=-; Position=1 -181,233-402,657-851,1037-1222
  Homolog annotation: Hit_ID=ZP_00195010.1; Match level="QueryCoverage =89%, HitCoverage=60%, E-value=5e-78, Identity=61%"; Hit description =COG2008: Threonine aldolase [Mesorhizobium sp. BNC1]
KMINLSSDNWTGCHSAISDALSRHSTGADAAYGDSELDKKVERRFCEIFETELAVFLVGTGTAANALSMAYVNRAGGIITAANALSMAYVNRAGGIIFAHRHAHLIEDECGAPEYFTGGARLVGVSGAEGRIEPEALEEAIQRYPPKSVHAGRPMAVSITQSTESGTLYSLAQIRRIANIAHSHGIPLHMDGARFANAMAALGCTAAEMSWKSGVDILSFGASKNGCWCAEAILVFNDLQQVISDGTSLSHGFXASKYPF

SEQ ID NO: 146305 - protein, 18 aa, Heterodera glycines
  Coding regions on vcDNA: vcDNA=SeqID_72728; Strand=+; Position=1-56
YREAIPEGFGLPINLGAS

SEQ ID NO: 146306 - protein, 306 aa, Heterodera glycines
  Coding regions on vcDNA: vcDNA=SeqID_72729; Strand=+; Position=1-922
TSITRDSILLLFITWTQFLCIPITGTHSPAFQSLGLNPPAVQSLGLNPPAFQSLGFCSPAFQSLGLNSPAFQSLGLNPPAFQSLVLNSLAFQSLGLNTPAFQSPGLNSPGLQSMGLSFYAFQSLGLILLHFNHWDSTLQHFNHWYSILLHFNHWDSTHQHFNHRDSILQDFNHWDSTLFSSIPITGTQHTSISITGTQFSRTSITGTLLYSPAFKSPGLSFYAFQSPGLILLHFNHWDSTLQHFNHWDSIHQHSSHWDSTHQHFNHRDSILQDFNHWDSILLRFITRTQFLCIPITGTHSPAFQSL

SEQ ID NO: 146307 - protein, 42 aa, Heterodera glycines
  Coding regions on vcDNA: vcDNA=SeqID_72730; Strand=-; Position=1-128
MARKDFRFPTFLGSEFRLPKFLMKSRKFFKFFFQKTSKFCTI

SEQ ID NO: 146308 - protein, 249 aa, Heterodera glycines
  Coding regions on vcDNA: vcDNA=SeqID_72731; Strand=-; Position=1 -331,954-1173,1394-1516,1792-1867
MECLLSDDQRRRSHEQFRRGRTQATAEGFYCSHPSVWRFIETLQKQQKLRDSEVSKCLAGFDPPQKAKRYREADRRILTLTRNYHLLNIGDPDRLNVDNYNLHTIINFLAAICLECQANGKLKYEYQLAKGTVKTLHTHLHAIHENSEFTEKLNSLESKAEKDKTKTEDNLRLSVFQQTAYFRLKTALPIVYQRVRQKIKDELKESAFITLTTDCWSGSTCNLLWLSSRGMKTKIAFCQCRTDLALLIY

SEQ ID NO: 146309 - protein, 53 aa, Heterodera glycines
  Coding regions on vcDNA: vcDNA=SeqID_72732; Strand=-; Position=1 -51,260-370
MGLGQNLTFNFSYIVFYGGGKTRKYQNFNVEMLFLSPFLHSICAEKYVNPYNL

SEQ ID NO: 146310 - protein, 78 aa, Heterodera glycines
  Coding regions on vcDNA: vcDNA=SeqID_72733; Strand=-; Position=1-421
STGYREAIPEGFGLPINLGASVRGDCPENKNKSIFSSVRLGYSNNYGEQKSTQIKVQAIGKLFPRIRSPHKLGASGRG

SEQ ID NO: 146311 - protein, 60 aa, Heterodera glycines; identical to SEQ ID NO: 144770
  Coding regions on vcDNA: vcDNA=SeqID_72734; Strand=+; Position=1-321

SEQ ID NO: 146312 - protein, 30 aa, Heterodera glycines; identical to SEQ ID NO: 126994
  Coding regions on vcDNA: vcDNA=SeqID_72735; Strand=+; Position=1-248

SEQ ID NO: 146313 - protein, 134 aa, Heterodera glycines
  Coding regions on vcDNA: vcDNA=SeqID_72736; Strand=+; Position=1-405
MFPCQHALRSICEYVEENRRWAISTLLTDPTGFARITFRIPNIHARKVGPNLFRVWPCVQINSTDYSFAPLEEINPGKTKCFDKIPIRFKTAGKERFAYLDPSSMIVSPTAKMAPCTHFRKQVLRISGDVMEVD

SEQ ID NO: 146314 - protein, 154 aa, Heterodera glycines
  Coding regions on vcDNA: vcDNA=SeqID_72737; Strand=-; Position=1-463
MDIPDNPKGVRRTTSACGHNTVYELRNEEEMSEMTISVINRKFWSGKTAVKVSDLEAAHNELVKLEDGMNRSIRALNRCMDKKTKWVSEVVSNANSNFEIVKAQIETLVDRIDDLERANDGTDADSTVREQDDSSQFEMPSKDNKGTNRGLLST

SEQ ID NO: 146315 - protein, 61 aa, Heterodera glycines
  Coding regions on vcDNA: vcDNA=SeqID_72738; Strand=+; Position=1 -71,153-210,265-321
MARQMSLPLFKRTKPTVSIFTLASNGDLVCRFADDVFSSVVPLMANGTDVPWHFVNETKDG

SEQ ID NO: 146316 - protein, 60 aa, Heterodera glycines
  Coding regions on vcDNA: vcDNA=SeqID_72739; Strand=+; Position=1 -67,124-239
MCLRNSQLRTTRRWPIQPMDNQTESSPLPNCPQLTGPDGAMTLLNTIKMGVTQKPSNKFF

SEQ ID NO: 146317 - protein, 95 aa, Heterodera glycines; identical to SEQ ID NO: 125597
  Coding regions on vcDNA: vcDNA=SeqID_72740; Strand=-; Position=1-662

SEQ ID NO: 146318 - protein, 24 aa, Heterodera glycines
  Coding regions on vcDNA: vcDNA=SeqID_72741; Strand=+; Position=1-76
ITGVSIIAVLFLVFLRPSQNLVRF

SEQ ID NO: 146319 - protein, 80 aa, Heterodera glycines
  Coding regions on vcDNA: vcDNA=SeqID_72742; Strand=-; Position=1-325
SKNCNYAQKASQTILAHPILSTIAFIHPIMSAKIIRVPKIACDLSLAKNGVSKNRNYAQKAPQTILALPIPSTIALYIPL

SEQ ID NO: 146320 - protein, 16 aa, Heterodera glycines
  Coding regions on vcDNA: vcDNA=SeqID_72743; Strand=-; Position=1-49
WAKLGLALEAEAEGEA

SEQ ID NO: 146321 - protein, 107 aa, Heterodera glycines
  Coding regions on vcDNA: vcDNA=SeqID_72744; Strand=-; Position=1 -101,175-397
  Homolog annotation: Hit_ID=BAD62488.1; Match level="QueryCoverage =72%, HitCoverage=83%, E-value=2e-16, Identity=55%"; Hit description =putative glycine-rich protein 1 [Oryza sativa (japonica cultivar -group)] dbj|BAD62129.1| putative glycine-
MKNHSALQFSWAFLRLFLCWLTDKAQKTEGGQKNPAIARPKRGHGYGYNNWGGNGGYGYGGGWGNNGGWGNGGWGNGGYGYGGGWGNNGGWGTGGYGYGGGYGYGWK

SEQ ID NO: 146322 - protein, 90 aa, Heterodera glycines
  Coding regions on vcDNA: vcDNA=SeqID_72745; Strand=+; Position=1 -107,163-205,540-662
MSVLHKISAAKSRRNSLSEQFHMAEEICEVLEEAKIFIQRQNSTGFPPSDDFLLLCSLRDLLENSLVLAKSAAEQTNFERRSNETCKLFF

SEQ ID NO: 146323 - protein, 63 aa, Heterodera glycines
  Coding regions on vcDNA: vcDNA=SeqID_72746; Strand=+; Position=1 -113,238-317
CIRDNNLDHQLGTQLCGYPSTVRHRLTGTINSYVDNHSWEYEIVRAPHFPIPPALFFKLRDMH

SEQ ID NO: 146324 - protein, 130 aa, Heterodera glycines
  Coding regions on vcDNA: vcDNA=SeqID_72747; Strand=+; Position=1 -63,137-466
MAVLENLFCAAIPTVKQPQKEANHWHGQWQQKMLANSLFQLRTAQNGDEIGKNNAQKTKEFERTTEEKFKKGFEKAANNRVKHSDWFKRRLAKNATISSENFVPTKMPAVKRAVVVVLCQWLNRMGSANN

SEQ ID NO: 146325 - protein, 122 aa, Heterodera glycines
  Coding regions on vcDNA: vcDNA=SeqID_72748; Strand=+; Position=1-613
YSKVKLSCAEDELCTGGSFCGENSICMCAPGESVQIENGKAKKCMLQLEEKARDSSQPVKAEPGQLCVEGGMECSGGAKCQNGICSCPEGTSAFGTTIGHSSVVPLPFLSSLFFFRPHSLPQ

SEQ ID NO: 146326 - protein, 1053 aa, Heterodera glycines
  Coding regions on vcDNA: vcDNA=SeqID_72749; Strand=+; Position=1 -284,330-716,770-1372,1534-2350,2814-2913,2963-3224,3279-3434,3485 -3668,3904-4147,4201-4322
  Homolog annotation: Hit_ID=CAE68840.1; Match level="QueryCoverage =16%, HitCoverage=16%, E-value=1e-11, Identity=28%"; Hit description =Hypothetical protein CBG14801 [Caenorhabditis briggsae]
MGKSIHYQHRSLLIGHPRHQVLPGARCDTQKGLDCVGESHCFYGICVCLYGLVNIGNECANANVLEKVAPGKRCLPGQHCLGMSKCVKSKCQCEKGQKLDSKLRRCIKVANAATVTTPLLAFPSGAEVVVGPTSIVEIPLGNSADGISQSDGARERPTKFIYAIPAALAAAAEEGKFQQILTANQMSINLMDGEMRSLISKLIEQQKQSNETVVKRQNICGGESGPTNCQHFPPIVTSKLPFSKPIQQQFFQSVPKSASSLQNPFQSIQLAASFNSPHLQGQPGFFCAAGNVCYGGAICLANLCICRPGFRPIDGFCQIAKVNLGEQCFLDEQCKANGFCIDGVSFTIACHSVPFSAFCYAIAVPNSVPCVALSFAMFSIGTVAQRGPSLPWAKTVPKRKRADGTQSAEHSVECANVQLAWKVIRSLGLSSSDCHKFAFCDNGFCSCKIGFERIAGFCLPPARPVVDDPKAYFDPEKMNKNANHLDVEKDNSEGQFWPSKRISPIEVFQAENRREKAGGSWTDEQRMDDSPNLGDNGRNSAETAFANAENASPFPSQQSKTFAFSRHFPFANSQLRFVSSEGNEFLSPNSKGQFQQLMLLPPTIGASFQHFPAHSKGKKATEKAKRKSAKDKAKEKQKSGKQKQNGGNEVAKPGEYCGTNEKQCAGNSKCLSGWCQCGEGAHVQTEGMCVEEPGKSLPGERCRPPSVICDFGAICGEESICKCPAHRKLLTGLCVRLALPGESCANGEFCADAAICAPGLNACVCQVGWNVRNGKCQKGETLRKLMTEGGETWNGQREGQIRPKSHMASSVAKLSLLLTANSTQTVPTFATPIVRLSHGNAPVKTAFPSCIRPFVFLRTKSNCRAMSAFRVPTFVVGSRGAKTDDVLALGGTLKLWKGDVCAKRAKRGQFGEIPRGDSQWQRHWTAQRTGKEKKEQKMERRRRKEGTEAEVGEEEAEGEADLERDYALGEPKSVAAPKTEAIVGGAALITAAANSSAMPCHFCRALFVTRLVSQRLAFLNGVTKCVAEEEKKGKGAEKKTERRKRGEMIGETE

SEQ ID NO: 146327 - protein, 181 aa, Heterodera glycines
  Coding regions on vcDNA: vcDNA=SeqID_72750; Strand=-; Position=1-545
MNGSTPRGQKLDSKLRRCIKVANAATVTTPLLAFPSGAEVVVGPTSIVEIPLGNSADGISQSDGARERPTKFIYAIPAALAAAAEEGKFQQILTANQMSINLMDGEMRSLISKLIEQQKQSNETVVKRQNICGGERSAEGRRTEERPSFGFISVVQQIVSIFLQLSLQSFHSVNQSSNNSS

SEQ ID NO: 146328 - protein, 98 aa, Heterodera glycines
  Coding regions on vcDNA: vcDNA=SeqID_72751; Strand=+; Position=1 -82,178-392
MTKTLAEGRESGRNGTETEKGTAPKAIAERRTNQTPNEPTNVPTADPLKNVSKSEPTPNVPIAADPRSPLTDVRSLRIFNQNLTGRETVSHACNVDFV

SEQ ID NO: 146329 - protein, 536 aa, Heterodera glycines
  Coding regions on vcDNA: vcDNA=SeqID_72752; Strand=-; Position=1-1610
  Homolog annotation: Hit_ID=NP_507780.1; Match level="QueryCoverage =88%, HitCoverage=32%, E-value=4e-33, Identity=24%"; Hit description =predicted CDS, DNA polymerase type B, organellar and viral family member (5T899) [Caenorhabditis elegans]
MRQIRAPLDLDAYDADTYVPLVINHWNNAHQQQHRFAVFIFGTTGHYKPLYKCGHDNYDTPLALYFNNSHFDGVHFLSGLFGGKKYCLECEKPYKKPSEHNQSCKAHCLMCSRVGPAFPCPSEPDFFRKCKECHKNFNNAGCYNHHLQSNYCTRSKKCKDCGVIWNVADNSRRKRKGHVCGEKFCLLCNNFHNTERGCYIAPFEPKEEMDAYRFVAFDLEADPHLPERRNHEPNFIAAKVSCPACIENGRWKQGTAGCWVCGPHRTVAFCQRPFTDTPVDKQVVTDNPMQAFVGWLINDLPIKANTFAYSHFGGRFDMVITFRELFRRGYNPEMIRRVSMFLHIFYSDKQIKGNKMYEMKLRAQKNRHPNIVFRDSFNLMPCALGQLVPAYGLDVEEKPFFPHMVNRPDNYGREIFPTPDDYLAHGMMPEKRRQFDNWYEQHRSEPFFLDEALASYCTNDVEILMAALVAFRREFLEITRRQEPVDGRETHNGIDVLKQCMTIASACMKHFRTNHLPADHLAIVPERGYDNAQNQS

SEQ ID NO: 146330 - protein, 93 aa, Heterodera glycines
  Coding regions on vcDNA: vcDNA=SeqID_72753; Strand=+; Position=1 -170,217-328
MQLRRQFEEIRQSIGNSQRVTNASDPDNAKTFWASWDGTRDGAIRRHHYMQLGEEGRGAKRETAVGTGLSIGPCEEMRQEGYVCIPFKTSPST

SEQ ID NO: 146331 - protein, 36 aa, Heterodera glycines
  Coding regions on vcDNA: vcDNA=SeqID_72754; Strand=+; Position=1-108
MAGFLMKQMVGNKFDEVTNKLGGDDEQKTVDGEDPE

SEQ ID NO: 146332 - protein, 50 aa, Heterodera glycines
  Coding regions on vcDNA: vcDNA=SeqID_72755; Strand=-; Position=1 -68,201-285
MTYEELKFCDRSLGTIGCEFIHKNGNHHIEEMLLDYNCEVLNLSIGHSTF

SEQ ID NO: 146333 - protein, 36 aa, Heterodera glycines; identical to SEQ ID NO: 134159
  Coding regions on vcDNA: vcDNA=SeqID_72756; Strand=-; Position=1-160

SEQ ID NO: 146334 - protein, 85 aa, Heterodera glycines
  Coding regions on vcDNA: vcDNA=SeqID_72757; Strand=+; Position=1-818
GSYSRGIRSPHKSGRIGSGGLTENKKIDFFKCPFGVLKQLWGAKIQSRIKVQAIGEAIPEGFGLPINLGASVPGGLPPKTKKSIF

SEQ ID NO: 146335 - protein, 31 aa, Heterodera glycines
  Coding regions on vcDNA: vcDNA=SeqID_72758; Strand=-; Position=1-95
MLMDAWGYLPGGDRLAIPLNDSRLNSDCPFG

SEQ ID NO: 146336 - protein, 88 aa, Heterodera glycines
  Coding regions on vcDNA: vcDNA=SeqID_72759; Strand=+; Position=1 -141,219-275,583-651
MRDFDFLKEMQRAEMETNKGFRQMVDLTENCYKDGFKQPLIWFCQRADYMTHQSEENDEKKLELKQKTEKNIEFHPSASEYLRGGESR

SEQ ID NO: 146337 - protein, 244 aa, Heterodera glycines
  Coding regions on vcDNA: vcDNA=SeqID_72760; Strand=+; Position=1-735
MDQGFKCKNMCGRLLEIENDRKICVFKTENILRQCSRIKEVVKENWDMNVFIQGSIYNGLGRKEVMINSKGIPNDWTKDDSCQFFDKLRKKLRESGMALTRTLIIPSRNVSILEITINSDDQEINAQISCNNLIGLINSKWLACCVQLDVRFKTLYFAILEWADVLPNLIKILPEIFEIRNVTYTKKQIFEVLKQKLIWETTNSQSISSLLIGFFEFYTKINLEESRLNMNEGKIDFWEKVLRK

SEQ ID NO: 146338 - protein, 92 aa, Heterodera glycines; identical to SEQ ID NO: 124679
  Coding regions on vcDNA: vcDNA=SeqID_72761; Strand=-; Position=1-704

SEQ ID NO: 146339 - protein, 68 aa, Heterodera glycines; identical to SEQ ID NO: 134950
  Coding regions on vcDNA: vcDNA=SeqID_72762; Strand=+; Position=1-206

SEQ ID NO: 146340 - protein, 59 aa, Heterodera glycines
  Coding regions on vcDNA: vcDNA=SeqID_72763; Strand=+; Position=1-177
MSASNALWKAPDGTVGGNGIRNLMNDFNDFNITTKAVQLGRRAGRARAVFWPVRMPKLA

SEQ ID NO: 146341 - protein, 52 aa, Heterodera glycines
  Coding regions on vcDNA: vcDNA=SeqID_72764; Strand=-; Position=1-193
ASMKYAPVTSCDVERSFSIYKSILADNRMSFTPEHLEMYLICNCFREIDKDC

SEQ ID NO: 146342 - protein, 52 aa, Heterodera glycines; identical to SEQ ID NO: 146341
  Coding regions on vcDNA: vcDNA=SeqID_72765; Strand=-; Position=1-193

SEQ ID NO: 146343 - protein, 44 aa, Heterodera glycines
  Coding regions on vcDNA: vcDNA=SeqID_72766; Strand=-; Position=1-173
AQKASHPILAHPIPSTIAFIHPIMNAKIIRVPKIACDLSLEKMV

SEQ ID NO: 146344 - protein, 95 aa, Heterodera glycines
  Coding regions on vcDNA: vcDNA=SeqID_72767; Strand=+; Position=1 -131,195-264,734-819
  Homolog annotation: Hit_ID=NP_500734.1; Match level="QueryCoverage =70%, HitCoverage=3%, E-value=2e-15, Identity=55%"; Hit description =LAMinin related (lam-1) [Caenorhabditis elegans] pir||T15099 hypothetical protein W03F8.5 - Caenorhabditis
YQCRAFTLGLTPAQQMPAECLQYVCVVAGEIFQKAHECECDLTGSVSGICEPMGGQCECKPNVIGRRRATNSLANASVANAASPGASATNVNQDS

SEQ ID NO: 146345 - protein, 119 aa, Heterodera glycines
  Coding regions on vcDNA: vcDNA=SeqID_72768; Strand=+; Position=1 -159,203-313,365-454
  Homolog annotation: Hit_ID=NP_490973.2; Match level="QueryCoverage =100%, HitCoverage=47%, E-value=4e-42, Identity=69%"; Hit description= electron transfer flavoprotein (27.6 kD) (1C986) [Caenorhabditis elegans] gb|AAD03129.2| Hypothetical pr
MVAGYLNWPQATFASKIEEDGAYIKVTREIDGGLDTVKLKLPAVVTADLRLNEPRYATLPNIMKAKKKPLEKKTAQEFGIDMTNQTETLEVSDPPVRQAGGFVDDVPGLVSKLKEKGVI

SEQ ID NO: 146346 - protein, 49 aa, Heterodera glycines
  Coding regions on vcDNA: vcDNA=SeqID_72769; Strand=+; Position=1 -90,139-203
MFQKVFLVLLFLLAFTVSNLRSDEGIGEMDANQKPLNSARILASKFTLS

SEQ ID NO: 146347 - protein, 16 aa, Heterodera glycines
  Coding regions on vcDNA: vcDNA=SeqID_72770; Strand=-; Position=1-49
EAIPEGFGLPINLGAS

SEQ ID NO: 146348 - protein, 255 aa, Heterodera glycines
  misc_feature (252)..(252): Xaa can be any naturally occurring amino acid
  Coding regions on vcDNA: vcDNA=SeqID_72771; Strand=-; Position=1 -146,259-342,393-476,564-831,876-935,1125-1149
  Homolog annotation: Hit_ID=NP_501862.1; Match level="QueryCoverage =87%, HitCoverage=44%, E-value=3e-72, Identity=60%"; Hit description =GABA TransAminase (53.1 kD) (gta-1) [Caenorhabditis elegans] emb|CAA93517.1| Hypothetical protein K04D7.3
LAPVVNQSSIASLIRSSIASSEPDAPSMLTQIPGPKSKALKEEMEQVHQTTSINFFADYERSFGNYLIDADGNALLDLFTDLFTQISSLPLGYNHPELIKLATDARLITTAVSRPTTAVSRPALGAFPRSDFAQLVARSLHSVAPRGLRHVQTMLCGSSANENAIKTAFIHYQTRLRGGSPPTAQHLSSCMRNEAPGTPQLSVLGFNGSFHGRTLGVLSITRSVYVLGFNGSFHGRTLGVLSITRSVYLEVXDLP

SEQ ID NO: 146349 - protein, 307 aa, Heterodera glycines
  Coding regions on vcDNA: vcDNA=SeqID_72772; Strand=-; Position=1 -144,193-300,351-400,455-695,878-1118,1173-1314
  Homolog annotation: Hit_ID=CAE59916.1; Match level="QueryCoverage =79%, HitCoverage=65%, E-value=2e-61, Identity=49%"; Hit description =Hypothetical protein CBG03401 [Caenorhabditis briggsae]
MPEDGIALGQVGGCASLLDLLEENLILPLRLISANIKIPSSLYSPPKGVLLHGPPGCGKTLIARAIAKEIDAFFINFDISLLSDMWYGETAKLTKALFTLAGKIQPCVIFIDEIGTQYVSTINSVRLFVCSLDSVLRDRHKLDHEVTAVMKTQFMALWDGFLSSNSAVIIIGATNRPQDVDNAILRRLSLKIHVPLPDVNAREQILRVILKDENLEDNFDFEKIAQASDQRSGADLKEVVRLSFLSSYRSVVKELFISGGRGKCVREVELSHNDVILALRQFNGCLNDSQKAHCSKNYLTEEVFEVD

SEQ ID NO: 146350 - protein, 45 aa, Heterodera glycines
  Coding regions on vcDNA: vcDNA=SeqID_72773; Strand=-; Position=1 -66,195-267
QLNVKLTDGESNFAYNVLLMERLCPMVNKMGVAANKSNLIMQPLE

SEQ ID NO: 146351 - protein, 52 aa, Heterodera glycines
  Coding regions on vcDNA: vcDNA=SeqID_72774; Strand=-; Position=1-174
ELLVLFDSSMCLLLICKISKILVKFQKSYGQKELKNPVNGLFFCSDFLCINK

SEQ ID NO: 146352 - protein, 95 aa, Heterodera glycines
  Coding regions on vcDNA: vcDNA=SeqID_72775; Strand=+; Position=1 -120,367-534
  Homolog annotation: Hit_ID=NP_493982.1; Match level="QueryCoverage =94%, HitCoverage=17%, E-value=3e-12, Identity=41%"; Hit description =solute carrier family 2 member 3 (2B799) [Caenorhabditis elegans] gb|AAK31540.1| Hypothetical protein H17
MTFQICTLPFCPESPKFSLVFKDNALAAERGLKKLRGRDNVKEELEQILSESSSAEKGTSNNFQFFDLFKKPLNWPLTLAIFMHLSQQFSGINAG

SEQ ID NO: 146353 - protein, 33 aa, Heterodera glycines
  Coding regions on vcDNA: vcDNA=SeqID_72776; Strand=+; Position=1 -66,418-453
MGALSTHQISFGNLTDTWGPSFDTVNTVTMIRL

SEQ ID NO: 146354 - protein, 66 aa, Heterodera glycines
  Coding regions on vcDNA: vcDNA=SeqID_72777; Strand=-; Position=1-217
RSRKNVVSRNVVERIFRPLLFSFSTKLNILGIIRKHSKNAISLQIFKYFYLCTKKSEQKKFQLLGF

SEQ ID NO: 146355 - protein, 181 aa, Heterodera glycines; identical to SEQ ID NO: 124594
  Coding regions on vcDNA: vcDNA=SeqID_72778; Strand=+; Position=1 -96,135-252,468-628,667-837

SEQ ID NO: 146356 - protein, 236 aa, Heterodera glycines
  Coding regions on vcDNA: vcDNA=SeqID_72779; Strand=-; Position=1 -229,341-614,876-1081
MGDTSIGQITDRSKELKLGSPKEQFNQRRIKSKGQKAYSPTGQMNDELQFVSSKTQHFPIETCLNMLKQIRIEKFSDFLNDLLLANFYKFYLENITDEKCTIYLHIAMLIRTIEAKLEMSNALGFKIPNFKQKWHTFKCRTAASEEEPQFLLEKLFFVQNNLDDFAFCSANSKRCMEQSAVALLDSVKMRRVGKNVEAEVTEDAFFDGNLIYSLIDQSAVTDDDALSSLSLGTSSS

SEQ ID NO: 146357 - protein, 33 aa, Heterodera glycines
  Coding regions on vcDNA: vcDNA=SeqID_72780; Strand=-; Position=1-99
TPQRNNSWPGLTAHVPKCLNSVRGWVQIRTWCR

SEQ ID NO: 146358 - protein, 249 aa, Heterodera glycines
  Coding regions on vcDNA: vcDNA=SeqID_72781; Strand=-; Position=1 -301,346-580,625-838
  Homolog annotation: Hit_ID=NP_502882.1; Match level="QueryCoverage =44%, HitCoverage=21%, E-value=2e-20, Identity=40%"; Hit description =DNA polymerase like family member (4Q408) [Caenorhabditis elegans] emb|CAB60306.1| Hypothetical protein Y
MNTDKFCLFYARMSSINYLTMDKYSFIRFMKNLARQKEAAVELLRNCGIDGNEIAFEKSADPRKSIRVLWKGPMGRENVVPIFLENGHWDGLKKYVCFFNLQNSKKHSMLIWRDSCLLMPVKLESLKATFNLDCEDKPFFPYYYNKKENYGIRLEHLPPMEDYSPGSMNKAKFIKFEKWYNENKETPFYLDEELRNYCRNDTEILLLSIIEFQRILINDITKGFDPLPRSCTNAGVAMNIFKAMFLLTE

SEQ ID NO: 146359 - protein, 160 aa, Heterodera glycines
  Coding regions on vcDNA: vcDNA=SeqID_72782; Strand=-; Position=1-9,65- 539
SIGNNFTEEMENYKLIDERSMICEKFGFTKNITEFRINSDVRRPDVAMRDAIDTMIKMALKTTEEKMKRKVRMFGVAITGAGLASPVWVPYRAYPQNNADVIMQEINKLGQSGDGDENKKTLLLSEPIMMKITFVTLPSGEGPRNVHKFDFGFKEHQRIR

SEQ ID NO: 146360 - protein, 142 aa, Heterodera glycines
  Coding regions on vcDNA: vcDNA=SeqID_72783; Strand=+; Position=1-429
MAHLELKHSTPGFRVKQPWLHTHLEFENRLRTFRPPSPLIIRFTEYNCLPSSSYPGGNFGGNQLLDGSISLSPLYPSQTIDLHVRIASDFHPEFPLASSCSGIVHHLSGLSAYALSPPHRMRSRRDYVAPQHRSARDHTSAP

SEQ ID NO: 146361 - protein, 20 aa, Heterodera glycines
  Coding regions on vcDNA: vcDNA=SeqID_72784; Strand=-; Position=1-64
KLHLRLNTATSPIANKYREG

SEQ ID NO: 146362 - protein, 324 aa, Heterodera glycines
  misc_feature (9)..(10): Xaa can be any naturally occurring amino acid
  Coding regions on vcDNA: vcDNA=SeqID_72785; Strand=-; Position=1 -217,265-366,420-569,614-719,771-1019
  Homolog annotation: Hit_ID=CAE58778.1; Match level="QueryCoverage =94%, HitCoverage=11%, E-value=3e-68, Identity=48%"; Hit description =Hypothetical protein CBG01975 [Caenorhabditis briggsae]
TLTLVRKNXXLIKTLLFSTNCNQVNKKATLLEFGQILHKVSLQFPHINTRGGAVKQFHAINDLENNLMKELQGFFDGPAVKKRIERKQIVNMKELQGFFDGPAVKKRIERKQIVNINRTFGARLSYEISVRFGENGLPISVRFGENGLPEGHRLELDLIGAAGQSFCAFLANGITVRLEGEANDYVGKCLSGGKCLSGGKIVIRPYRNSIYASEQNTLIGNVALYGATSGTAFFRGIGGERFATAFFRGIGGERFAVRNSGATAVIEAVGDHGCEYMTSGRVVVLNSIGRNFAAAMSGGLAFVYDKSGGEETALKRATTKWERG

SEQ ID NO: 146363 - protein, 256 aa, Heterodera glycines
  Coding regions on vcDNA: vcDNA=SeqID_72786; Strand=-; Position=1-770
  Homolog annotation: Hit_ID=EAK89729.1; Match level="QueryCoverage =100%, HitCoverage=96%, E-value=6e-18, Identity=26%"; Hit description= uncharacterized glycine-rich low complexity protein [Cryptosporidium parvum]
RLGLNPPTFQSPGLKPSVFQSLGLNPPAFQSLGLNPTSISITGTQSTSISITGTQPTSIPITGTQPTNIPINGTQSTSIQSLGLNPPTFQSPGLNPPVFQSLGLNPPAFQSLGLNPPTFQSLGLNPPTFQSTGLNPPAFNHWDSIHHIQVTGTQPTNIPIAWTQPTSISITGTQPTSIPITGTQPTNISITGTQSTNIPINGTQSTSIQSLGLNPPTFQSPGLNPPVFQSLGLNPPAFQSLGLNPPAFQSLGLNPP

SEQ ID NO: 146364 - protein, 428 aa, Heterodera glycines
  Coding regions on vcDNA: vcDNA=SeqID_72787; Strand=+; Position=1 -136,183-440,501-628,678-852,1270-1548,1593-1662,1708-1948
  Homolog annotation: Hit_ID=NP_477352.1; Match level="QueryCoverage =82%, HitCoverage=18%, E-value=5e-40, Identity=28%"; Hit description =phosphatidylinositol 4-kinase, catalytic, alpha polypeptide isoform 2 [Homo sapiens] gb|AAD13352.1| phosp
MTINAVLSCTERETVNSLIHVTGGSATNLQVLHAAADTGSVGSLAGSDLSSATSPLDISTYLSAINLRAGYLGQIKGMFEMLRDTHNSEEIAHQLLSDHLEKLLDSAIKSSDPDSISKPLHLMTAYCNFCSQINQRILHAVIWAPLRSFTEQTMRNCIICWNWILVSMKDIQIDFLQQMTSCWRIVSQQNLGLFSREYDSFACPLSSQNCGQRPTPNAIPHNIWINVRFLGAALISRNIVAVGPRFRLLSSALTMVQGETSGCRISKNILRHRIYAVAFDYFSIGPQTPLYGGASLQNDIRSIVTFWQALYADSKYIRKESFSTNDNEILFNGLPPQFYGGQHTSEAAKNQTWHGSTPISGGWMTSTAIANRTLMGTVGQNPLSNLRIQAKINEENAQMIDRQMKNILRKRQLLLILLVIGISFYYYD

SEQ ID NO: 146365 - protein, 87 aa, Heterodera glycines
  Coding regions on vcDNA: vcDNA=SeqID_72788; Strand=+; Position=1 -94,185-241,437-549
MHAFCARAIYHRACQSKAKQQRCCFERIKGIESVNRLLEKYICNLSKILRKSVNRLLEKYICNLSKILRSELEMINFTIQTNFRCSN

SEQ ID NO: 146366 - protein, 46 aa, Heterodera glycines
  Coding regions on vcDNA: vcDNA=SeqID_72789; Strand=+; Position=1 -13,69-155,470-510
MFCNEPKATKHLLNMIRDLSTFCAKIWRILVTLALDIAFLENFVIS

SEQ ID NO: 146367 - protein, 68 aa, Heterodera glycines
  Coding regions on vcDNA: vcDNA=SeqID_72790; Strand=+; Position=1 -39,246-412
MWGITETLVANIARDKEKIAEPMGVVAAAVYLIFVFAFIPVPFYEWLSQNILFAGAADNRHGKGTQIE

SEQ ID NO: 146368 - protein, 26 aa, Heterodera glycines
  Coding regions on vcDNA: vcDNA=SeqID_72791; Strand=-; Position=1-80
EAIPEGFGLPIIAGLFLVFWTALAKS

SEQ ID NO: 146369 - protein, 95 aa, Heterodera glycines
  Coding regions on vcDNA: vcDNA=SeqID_72792; Strand=+; Position=1-288
  Homolog annotation: Hit_ID=P35549; Match level="QueryCoverage=60%, HitCoverage=16%, E-value=7e-09, Identity=50%"; Hit description =Fibrillarin gb|AAA67420.1| fibrillarin
MGRNGGGEKREKKQKGDKEEAQEEKGGKSGGKGGERGGGKGGERGGGKGGERGGGKGGFFHRRRVKRAPFAERTDNNQITQTIKLYFAFDTYEQN

SEQ ID NO: 146370 - protein, 57 aa, Heterodera glycines
  Coding regions on vcDNA: vcDNA=SeqID_72793; Strand=-; Position=1 -152,1017-1038
MALSKDMRAQFMRTIHKTVRFFWKGNAAGTTISTRALQTVADSNQYSSQIRKRKNHF

SEQ ID NO: 146371 - protein, 128 aa, Heterodera glycines
  Coding regions on vcDNA: vcDNA=SeqID_72794; Strand=+; Position=1-386
MVAQIRPLLADFVGENQVDNIFKILGIPTILEGSNDALLLVDTEREENVESNKKSTTKKKKPKKKQLNTEENGGEEADKTATSDKLSQKGVANESEQSDKVSANISGEQLTTDKQPINDDGDGIIKTN

SEQ ID NO: 146372 - protein, 29 aa, Heterodera glycines
  misc_feature (2)..(2): Xaa can be any naturally occurring amino acid
  Coding regions on vcDNA: vcDNA=SeqID_72795; Strand=+; Position=1-89
LXRAQIGAINEAYRRQPSFRGDLNNNRNK

SEQ ID NO: 146373 - protein, 71 aa, Heterodera glycines
  Coding regions on vcDNA: vcDNA=SeqID_72796; Strand=-; Position=1-216
MDLILATDWINNAYPEMDLEDANKDNKEPTKKQEEEAEDPSWISLIDEEMKREPLAPIGEEAPATSYFCCH

SEQ ID NO: 146374 - protein, 86 aa, Heterodera glycines
  Coding regions on vcDNA: vcDNA=SeqID_72797; Strand=-; Position=1 -160,364-464
MALRVLPIVILALFFIFDGTFAKTEDEIKQTQLLKILSTKTTKNSSVQTEDIEDAIAYMKLTNEEGYESRMTKGTGAKQVKNLLHH

SEQ ID NO: 146375 - protein, 236 aa, Heterodera glycines
  Coding regions on vcDNA: vcDNA=SeqID_72798; Strand=+; Position=1-712
  Homolog annotation: Hit_ID=XP_447783.1; Match level="QueryCoverage =96%, HitCoverage=26%, E-value=8e-10, Identity=21%"; Hit description =unnamed protein product [Candida glabrata] emb|CAG60730.1| unnamed protein product [Candida glabrata CBS1
TQPYSIQSLGLNPPTFQSTGLNPTAFNQWDSTHQHSINRTQPYSIQSVGLNPPTFHQQDSTLQHSISGTQPTNIPINRTQPYSIQSVGLNPPTFQSTGLNPTAFNQWDSTHQHSINRTQPYSIQSVGLNPPTFQSTGLNPTAFNQWDSTHQHSNQQDSTLQHSISGTQPTNIPSTGLNPTAFNQWDSTHQHSNQQDSTLQHSISGTQPTNIPINRTQPYSIQSVGLNPPACHRTNH

SEQ ID NO: 146376 - protein, 146 aa, Heterodera glycines
  Coding regions on vcDNA: vcDNA=SeqID_72799; Strand=+; Position=1-443
  Homolog annotation: Hit_ID=CAE71741.1; Match level="QueryCoverage =86%, HitCoverage=24%, E-value=2e-24, Identity=45%"; Hit description =Hypothetical protein CBG18725 [Caenorhabditis briggsae]
RSKLGARVGIPGLDRCHDCGLRGTVEIDETCIVRRKYNRGQLRGNVNEWLFGGIERGENGQRAFMVPVLRRRAQDLLPLIEQYIAPGSIIHSDMWAAYGGIPNLPQRYHHTVNHNENFLNPNDPNVHTQNIEGMWSTYKRKFRPNL

SEQ ID NO: 146377 - protein, 124 aa, Heterodera glycines
  Coding regions on vcDNA: vcDNA=SeqID_72800; Strand=-; Position=1 -42,630-863,4475-4572
  Homolog annotation: Hit_ID=NP_492998.1; Match level="QueryCoverage =79%, HitCoverage=7%, E-value=7e-25, Identity=58%"; Hit description =VAB-10A protein family member, Variable ABnormal morphology VAB-10 (vab-10) [Caenorhabditis elegans]
DDPLPLLQPPPLRRKQFNDLQNQGAALINQRHPAGEVIEVYLRKMQNQRDWMLNLSKCLEGHLRDACNAKAFVEESEQVEQQMQQQLVSLANLFKTKNFSAEKWGGAPRRDHNSALLPKNSNLL

SEQ ID NO: 146378 - protein, 183 aa, Heterodera glycines
  misc_feature (171)..(171): Xaa can be any naturally occurring amino acid
  Coding regions on vcDNA: vcDNA=SeqID_72801; Strand=-; Position=1 -120,460-588,888-995,1155-1316,2037-2071
  Homolog annotation: Hit_ID=CAE69591.1; Match level="QueryCoverage =88%, HitCoverage=12%, E-value=4e-55, Identity=66%"; Hit description =Hypothetical protein CBG15813 [Caenorhabditis briggsae]
LGLSQGARYVTERYSTASSGTRGNAFRRVEDAIQWIRDRMHKLNSMQFSETLEVLEQIFEQHKLDNRDIQDFRQTVDECIARQAEVSAEDSYDYCELLKMMESEYQQLRELSAGRMVDLDSLIAFIRAAQLELCFHRRREALEVKRNRSDLGRLDIPMLKIYLKQVVGRAXLRTGEKNDHHHQ

SEQ ID NO: 146379 - protein, 283 aa, Heterodera glycines
  Coding regions on vcDNA: vcDNA=SeqID_72802; Strand=+; Position=1 -139,1032-1306,1720-2157
MPIKQKPSSQTGRSGSKNGSTKTGSASPHSWPSKTGAAEPKGPIATGLRTGILQNPAQDPVLRRSLVTTTLKYQPPRPTTSPKAEPPKPIVVAPKVTSPVTTQTVQPTSPPEGQPKSRNRGRFRTRYVMHRNQSEPEKQFVEARAHQAEEVNTNVLNVNTTESLVVVAACTSVVQQPIEHLKYRSQLLKRKISWTWATKRYFVNDAKFSETKKTELDEALEALILSQVPPPEERELKQKTFDAIGRISRRNLEGIRNLHRWVHAGKHCPKKWGFAHRSEAQVQ

SEQ ID NO: 146380 - protein, 60 aa, Heterodera glycines
  Coding regions on vcDNA: vcDNA=SeqID_72803; Strand=-; Position=1-351
ETGNFKFADPVAGLEFKIFYRTGSGRINPANPAILQILHLKSAGSCAGLRIFGNFEKILY

SEQ ID NO: 146381 - protein, 67 aa, Heterodera glycines
  Coding regions on vcDNA: vcDNA=SeqID_72804; Strand=-; Position=1 -42,211-372
MSHRRSHADNVETMAQLIAGLLPPLALEARISGGNALGDQLVTQLGLSVQAAQNVDMAILGRAKLKI

SEQ ID NO: 146382 - protein, 31 aa, Heterodera glycines
  Coding regions on vcDNA: vcDNA=SeqID_72805; Strand=-; Position=1-93
MGSKNPKQNYSTGYREAIPEGFGLSINLGAS

SEQ ID NO: 146383 - protein, 50 aa, Heterodera glycines
  Coding regions on vcDNA: vcDNA=SeqID_72806; Strand=-; Position=1-150
MAQGGVHHKLADNYYLERDGRREVRPPKPIYKALGETPLWEKAERWAIAD

SEQ ID NO: 146384 - protein, 43 aa, Heterodera glycines
  Coding regions on vcDNA: vcDNA=SeqID_72807; Strand=-; Position=1 -52,612-691
MEKACKIWRDYIDFSALEITGVTIISSAFSCVFLMPSQNLGRF

SEQ ID NO: 146385 - protein, 45 aa, Heterodera glycines; identical to SEQ ID NO: 124527
  Coding regions on vcDNA: vcDNA=SeqID_72808; Strand=-; Position=1-138

SEQ ID NO: 146386 - protein, 95 aa, Heterodera glycines; identical to SEQ ID NO: 130684
  Coding regions on vcDNA: vcDNA=SeqID_72809; Strand=+; Position=1-677

SEQ ID NO: 146387 - protein, 153 aa, Heterodera glycines
  Coding regions on vcDNA: vcDNA=SeqID_72810; Strand=-; Position=1 -261,758-862,1999-2092
MPTNNAVDRPEFGSLVGTTATIGAAVGAPIGVLVGGFIGSTAFPLLGTAAGASIGFAVGGAIGTLVGAAVGVFVGGIIQAAKDIVCYDKCPARTACVYYDSPDSYLCCKKRYKRECVKDFAEVEAMFSTTTTTTTTTTTTTTTPTPAPREPKA

SEQ ID NO: 146388 - protein, 40 aa, Heterodera glycines
  Coding regions on vcDNA: vcDNA=SeqID_72811; Strand=+; Position=1 -98,342-366
MLGFRSSDFPIQGLVIHGSCVVRGSDSQLLINCIWSYLII

SEQ ID NO: 146389 - protein, 92 aa, Heterodera glycines; identical to SEQ ID NO: 125147
  Coding regions on vcDNA: vcDNA=SeqID_72812; Strand=+; Position=1-304

SEQ ID NO: 146390 - protein, 33 aa, Heterodera glycines
  Coding regions on vcDNA: vcDNA=SeqID_72813; Strand=+; Position=1-101
MIGRAVRNRPFIFEGIFKFILYPRKMSISFFEK

SEQ ID NO: 146391 - protein, 136 aa, Heterodera glycines
  Coding regions on vcDNA: vcDNA=SeqID_72814; Strand=-; Position=1 -148,262-524
MVKRFCGEFSDEEDMEKDAAVDQNGAELNQQKEDDDDDSFVRGSDEEIPDDDDISMDEQPSGCPPPSRWDEKRAKKTTTTATTIAAVPGAAMPRFARFVEELLEGTIYALWPEASLTLPRFLADRKFFDALMVANF

SEQ ID NO: 146392 - protein, 61 aa, Heterodera glycines
  Coding regions on vcDNA: vcDNA=SeqID_72815; Strand=-; Position=1 -54,328-459
MHHNVIMIQSANGIRMKKHVKEPTRENNILDLVFSQPKELIYNVKVGSPFSILIIILFGLI

SEQ ID NO: 146393 - protein, 270 aa, Heterodera glycines
  misc_feature (1)..(1): Xaa can be any naturally occurring amino acid
  Coding regions on vcDNA: vcDNA=SeqID_72816; Strand=+; Position=1 -210,256-347,409-575,654-850,1024-1079
  Homolog annotation: Hit_ID=NP_499692.1; Match level="QueryCoverage =98%, HitCoverage=59%, E-value=1e-59, Identity=47%"; Hit description =cation Diffusion Facilitator family member (cdf-3) [Caenorhabditis elegans] emb|CAA16328.1| Hypothetical
XFNENFRKKKSPDIVLWLVVAISALHITAQLVGGVLANSLSIIADSGHILTDLVSFLISIFMIRISVANSNRRFTFNRRFTFGYLRAEFIGALASIFIIWTITILMIVFATQRIISGQMTVDIVFATQRIISGQMTVDTRIMLITALVGIVFNFVMVLFLKWSTGGAHFSHGHSHFTKNVNVRAAFNVNVRAAFIHVLGDFIQSIGVLSAALLIRWTDFQLADPLCTYFFSLVVLCTSVPIARDIFLVLMESTPSFLDFDAVRSDLNGIS

SEQ ID NO: 146394 - protein, 24 aa, Heterodera glycines
  Coding regions on vcDNA: vcDNA=SeqID_72817; Strand=+; Position=1 -52,295-317
MEKACKIWRDYIDFSALELLELAS

SEQ ID NO: 146395 - protein, 22 aa, Heterodera glycines
  Coding regions on vcDNA: vcDNA=SeqID_72818; Strand=+; Position=1-66
MLCEILERDELQIREEISMWNA

SEQ ID NO: 146396 - protein, 31 aa, Heterodera glycines; identical to SEQ ID NO: 135070
  Coding regions on vcDNA: vcDNA=SeqID_72819; Strand=+; Position=1-93

SEQ ID NO: 146397 - protein, 38 aa, Heterodera glycines
  Coding regions on vcDNA: vcDNA=SeqID_72820; Strand=+; Position=1-114
MVFGWTFSSFDRPQLGLKLALFRPVSKRWWTNISTAEG

SEQ ID NO: 146398 - protein, 31 aa, Heterodera glycines; identical to SEQ ID NO: 135070
  Coding regions on vcDNA: vcDNA=SeqID_72821; Strand=+; Position=1-93

SEQ ID NO: 146399 - protein, 31 aa, Heterodera glycines; identical to SEQ ID NO: 135070
  Coding regions on vcDNA: vcDNA=SeqID_72822; Strand=+; Position=1-93

SEQ ID NO: 146400 - protein, 179 aa, Heterodera glycines
  Coding regions on vcDNA: vcDNA=SeqID_72823; Strand=+; Position=1-540
MEAQELGNSAIIEESNEENEEEEADEGNKNRVGCKKRDDNDRRGPRGGGAGAGGSGSGARGGEGLGGGTNGGGRAERRDAGTGAGIYERGKEGRKTANNDVIIDEQRCRTVENDDDEEDGCAEVDLPELEFEKKVNETDCCAVGLLIADLEGSAFGLMIADLEGTAFGLLDQKSEWYLI

SEQ ID NO: 146401 - protein, 134 aa, Heterodera glycines
  Coding regions on vcDNA: vcDNA=SeqID_72824; Strand=+; Position=1 -99,389-526,668-835
MAIEAEAERKAREEKENLDREEQRLKVANNTLQNVSEEFLELLTLKRTNRAYSMDMQISLQDERIQKQVRKHQEKRRRSIIHQRRRKFSKGLRDVDFVGFEATEDIQDMHAEKEDEEMEQLSDLDSGDDPSGQT

SEQ ID NO: 146402 - protein, 39 aa, Heterodera glycines
  Coding regions on vcDNA: vcDNA=SeqID_72825; Strand=+; Position=1 -21,198-296
MVQQLLMNILSIFLNILNKQYEVIDETVAIIHPIKMMAT

SEQ ID NO: 146403 - protein, 177 aa, Heterodera glycines
  Coding regions on vcDNA: vcDNA=SeqID_72826; Strand=+; Position=1 -396,907-1044
MIYLFIKDQSDLISCYKYLMSAGQPISKSDQKLLIVNATYYKMKALINGALSTTKQIKSGGRKHNNKLRRMANDIEMTAQKAHLLENPKNFDEKLVKICYLCSFWTHVISNRNLYKESEIWRTFLAYRFGGEEMPPFAQVPWRRRHNGTIHCEKVKSSEVCSIAEVTTSATRTNCAA

SEQ ID NO: 146404 - protein, 40 aa, Heterodera glycines
  Coding regions on vcDNA: vcDNA=SeqID_72827; Strand=-; Position=1 -51,556-627
MKFTKKGKKENVPDRKRVFPVPTNESRAAMGPGHFAGVRM

SEQ ID NO: 146405 - protein, 80 aa, Heterodera glycines
  Coding regions on vcDNA: vcDNA=SeqID_72828; Strand=+; Position=1 -90,404-490,687-749
ADSILHSELLMGSPDSNNYIKNGFLANWITSDTQCSGQNYDNLLESNHDGVHVWVGGHMSMLETAPMDPIFFMHHCFMDY

SEQ ID NO: 146406 - protein, 72 aa, Heterodera glycines
  Coding regions on vcDNA: vcDNA=SeqID_72829; Strand=-; Position=1-502
FLAVLKPSIACRFSAQQSTNRVFDSLQKIIPYPNFFTTTYCQSNFLQIESHPLPAGSRHSKALIGCLTYFKK

SEQ ID NO: 146407 - protein, 91 aa, Heterodera glycines
  Coding regions on vcDNA: vcDNA=SeqID_72830; Strand=+; Position=1 -146,201-330
  Homolog annotation: Hit_ID=NP_491552.2; Match level="QueryCoverage =86%, HitCoverage=2%, E-value=3e-19, Identity=56%"; Hit description =lethal protein 363, LEThal LET-363 (305.8 kD) (let-363) [Caenorhabditis elegans] gb|AAN84886.1| Lethal pro
MAGVCQSTGYVVEPYKDYPELLDALLKLFKTELSSSMRRLTMKVLGVIGAFDPYTHKVYLGKVHSHSKSRSLALTLPNSGETAEHCKHFFT

SEQ ID NO: 146408 - protein, 35 aa, Heterodera glycines
  Coding regions on vcDNA: vcDNA=SeqID_72831; Strand=-; Position=1-105
MDFMELHVQANGSSQSVDQRNQKHLQKGLKVKAKI

SEQ ID NO: 146409 - protein, 87 aa, Heterodera glycines
  Coding regions on vcDNA: vcDNA=SeqID_72832; Strand=-; Position=1 -132,265-396
MNCALASSFSPVGKHFAAVVADKKGMRADLYVNGEELVERLGSCLHCEISSVKIGAGRVNLEAILTTPIKRRSSETLEPIKKSQKNG

SEQ ID NO: 146410 - protein, 88 aa, Heterodera glycines
  Coding regions on vcDNA: vcDNA=SeqID_72833; Strand=-; Position=1 -53,98-242,290-358
MLTTLEELKATPCGTQLASFCGQIVSILPSEKKLTALLACASGENVVLAEFKSVSSKFSKICSLGIVVKFYMLKAQRFQERFDGKIGL

SEQ ID NO: 146411 - protein, 44 aa, Heterodera glycines
  Coding regions on vcDNA: vcDNA=SeqID_72834; Strand=+; Position=1 -47,98-185
MNFFYAQLKSYSILKRNWYSTSLSAMSSISCSILTSLTYCFASH

SEQ ID NO: 146412 - protein, 24 aa, Heterodera glycines
  Coding regions on vcDNA: vcDNA=SeqID_72835; Strand=-; Position=1 -52,295-317
MEKACKIWRDYIDFSALELLELAS

SEQ ID NO: 146413 - protein, 39 aa, Heterodera glycines
  Coding regions on vcDNA: vcDNA=SeqID_72836; Strand=+; Position=1 -37,532-614
MSIKTKKDLLIVVKNPIFLKKGMVAIMFCLCQKKRQLVH

SEQ ID NO: 146414 - protein, 28 aa, Heterodera glycines
  Coding regions on vcDNA: vcDNA=SeqID_72837; Strand=-; Position=1-87
KETPPSAAGDGVAVPSERVVDEQQKEDE

SEQ ID NO: 146415 - protein, 153 aa, Heterodera glycines
  Coding regions on vcDNA: vcDNA=SeqID_72838; Strand=-; Position=1 -55,176-587
FSHFFTANLVPTVAFSCLALSNNLTIFETQTKKILDQKWLSLFSHFLPQNWYQQLPSLVWPYQTILRYLKRKQKKFLTKKWLSLFSHFFTANLVPTVAFSCLALSNNLTIFETQTKKILDQKMAISFFAFFYRKLGTNSCLLLSGPIKQSYDI

SEQ ID NO: 146416 - protein, 75 aa, Heterodera glycines
  Coding regions on vcDNA: vcDNA=SeqID_72839; Strand=+; Position=1-225
MVKISRYSIIDSNNLPLLGFPTLDDINLRWLFSQNSEEILQFLAHNGLIQNKMMCLICSNNMALTKRSQIKDGFE

SEQ ID NO: 146417 - protein, 320 aa, Heterodera glycines
  Coding regions on vcDNA: vcDNA=SeqID_72840; Strand=+; Position=1 -225,267-579,623-1047
  Homolog annotation: Hit_ID=CAE71161.1; Match level="QueryCoverage =81%, HitCoverage=71%, E-value=3e-24, Identity=29%"; Hit description =Hypothetical protein CBG18017 [Caenorhabditis briggsae]
MVKISRYSIIDSNNLPLLGFPTLDDINLRWLFSQNSEEILQFLAHNGLIQNKMMCLNCSNNMALTKRSRKKDGFEWRCQQCQSFFHNSALSLTQMFTIIYMWIEDYRNKNAVKELDMATYTIVNFFNFCRQQCSKQAKIGGKNKVVEIDETCWTKMKHHRGKTKKGSQIWMFGAIERGEGGQAFCVQVKNRKRRTLFRQIRKWIRPGTVIISDEWPAYLKMSLHLPQYEHLLIRHKKTTGGGFSKIITLPNGTEFNVNTNKCEGMWAQLKQKTKRIHGTSIKLTESYMHEQIFRLNARAKGLSVFKAFVDLLHFNYNFND

SEQ ID NO: 146418 - protein, 278 aa, Heterodera glycines
  Coding regions on vcDNA: vcDNA=SeqID_72841; Strand=+; Position=1 -259,580-773,821-1032,1102-1261,2242-2253
  Homolog annotation: Hit_ID=NP_503037.1; Match level="QueryCoverage =78%, HitCoverage=18%, E-value=1e-26, Identity=35%"; Hit description =intersectin 2 (4S71) [Caenorhabditis elegans] emb|CAB55138.1| Hypothetical protein Y116A8C.36 [Caenorhabd
MAYPFCLVGDIEVKNNEIVQNGNQLSKESVSTVPYEQQHGQVIGQVKTVKYKALFEFNARSGDELSIQPGDLILVFEGHQSEPGWLAFTKSVSFTDSATIGKAAAALTKGNSMSASPSVSAALYDLPPADTETVVKLTNTTIPSPTATIEPSSVPLYELPPDNGKMPPSKASVADSMVLSVGVALYQWKARNEQEMTFGRGDVIEVLEQSEMRWRGRLQKNRQITGWFPKSYIKISAPSEQQKDESATTDLYQTGQSAAKNGGKARVGESGEWFIKFC

SEQ ID NO: 146419 - protein, 72 aa, Heterodera glycines
  Coding regions on vcDNA: vcDNA=SeqID_72842; Strand=+; Position=1 -90,351-423,752-805
MSDHEGDLAAVAEARAAARAREAAANANVLLGAEQGVGGEQQRERGAGNNDNQQIAALHARMDILEHQQIQN

SEQ ID NO: 146420 - protein, 84 aa, Heterodera glycines
  Coding regions on vcDNA: vcDNA=SeqID_72843; Strand=-; Position=1 -48,257-463
MPGQSFQNRIIQLVAESQGRRERSASNTKLRWQTEARQMSNKERTIARGSDHWLVEGQSISDGQQQQNGRETFAGELLANGLIN

SEQ ID NO: 146421 - protein, 366 aa, Heterodera glycines
  Coding regions on vcDNA: vcDNA=SeqID_72844; Strand=+; Position=1 -21,168-305,467-553,606-767,831-1007,1408-1584,1673-1768,1819 -1874,1933-1962,2014-2055,2117-2231
  Homolog annotation: Hit_ID=NP_496203.2; Match level="QueryCoverage =97%, HitCoverage=77%, E-value=3e-81, Identity=43%"; Hit description =leucine-rich repeat containing protein (2K499) [Caenorhabditis elegans] emb|CAA88748.2| Hypothetical prot
MHLPISFGIVSVTLRQNKLVCLELVGIPLLTSNALKAVNSNRLRSVDLSGCRKIASEGIFYLVFNNPSIVSLCLNGCRGLDEQALYDIARCIGERLFRLELDQLHNSNMAEHTEAISSLSRHCPNISRLSLCQFFPEDEQQEEQPPCLIEGTGLRDVDLYGGNGTKCHPNQTNGISLKATSSANFPAFPSPFIQFLISQIPSLSHLALDVAFLNAHFLRRLFAGGVHSPGAGLRSLRLCRLRITYRALFSIGRWARSLVDLETSHMPAVDDRFLVLLGKNCKYLQNVNFNGCKWVTDKGVASLARNCKLREVRIRGTSCTDKSVYAFAQFCPTLEWIAHADFSGRPNFSDKALKCLRDSCIQRVIC

SEQ ID NO: 146422 - protein, 76 aa, Heterodera glycines
  Coding regions on vcDNA: vcDNA=SeqID_72845; Strand=+; Position=1 -164,235-301
MFAFVCRFVLPLFLFALLALPPANGIGLPMQKMECCQQQQMCCAAPMQCTPSCGGPPFSRCSEGKKRRAHRRSGNS

SEQ ID NO: 146423 - protein, 33 aa, Heterodera glycines
  Coding regions on vcDNA: vcDNA=SeqID_72846; Strand=-; Position=1-118
LDECHCHLTAPPTDRRLTIDHFLSDFCPSISAK

SEQ ID NO: 146424 - protein, 526 aa, Heterodera glycines
  Coding regions on vcDNA: vcDNA=SeqID_72847; Strand=-; Position=1-1579
  Homolog annotation: Hit_ID=AAN75564.1; Match level="QueryCoverage =42%, HitCoverage=9%, E-value=9e-26, Identity=34%"; Hit description =adhesin FhaB [Bordetella avium]
MANKFLLVPQEIYRGLTSASDTGVINLDAVRHDLERARRERTNPTTKNVRYNQQLRRYLQMRRELADRPTKVELTKGLSVLLKRDGGVDDDDGEVVNTQPRPPAPPPPPPPPPPPHQYHRHHPSPPDQQSSSSDDSHPPRPPRPPRPQRTKKNHQSSIKHGRLNQWKQRRRDLQQQPVVRDLLAEAAAAPLPESDDDDEQMLEGGYLLPTPSQNYGDMPILPDYADEIEEMDTAQQRLASRRKIKGEEGIDKNKKYKIYYSPPPSPTLPPVYKRPDHPPPPPRSIPKVELKRDPQPTKLKKSASPPPPPLPPHRAKREPKIELAPPPPPRTVSKREPKVELAPPPPPPRHFTKKEPKFEVDPRPSTSKQAGYFPPPKIKTEPKHELQPTKRPVPYRIPKKEPKIEEKPLQQQQQQPPPPPAVVVEEMPYIPPPRRGTKRTYPQNDDDEVHIRKRVRQPRRVRVQYSPEPGPSTSAQSEEEQQQQRELFAIPSNQLTMTQRIERLYLKCNHYADRMGVRVNTINTAN

SEQ ID NO: 146425 - protein, 64 aa, Heterodera glycines
  Coding regions on vcDNA: vcDNA=SeqID_72848; Strand=-; Position=1 -86,464-572
MEMEAFEWKFEDETNQITIELADDDTEEGGILYLVNYSLNEYVRVIYVQNSRLITIREIFGPLE

SEQ ID NO: 146426 - protein, 77 aa, Heterodera glycines
  Coding regions on vcDNA: vcDNA=SeqID_72849; Strand=-; Position=1 -95,352-490
MTLDIMTRDIMTRDIMTAGHYDAGHFDSAPNRRLIEPVKSFRMISRLFDSVNNFKSYIDSKLAQTELARRSWPVPQC

SEQ ID NO: 146427 - protein, 42 aa, Heterodera glycines
  Coding regions on vcDNA: vcDNA=SeqID_72850; Strand=+; Position=1 -47,82-163
MSDNPEKVEKQMEKQINREPIKNMLAFSAQFVQKAALLMETN

SEQ ID NO: 146428 - protein, 43 aa, Heterodera glycines
  Coding regions on vcDNA: vcDNA=SeqID_72851; Strand=-; Position=1 -64,286-353
MSDKKCVCEAKRFAILRKQTYINILIIIIIVIIIIRKGNQHHH

SEQ ID NO: 146429 - protein, 160 aa, Heterodera glycines
  Coding regions on vcDNA: vcDNA=SeqID_72852; Strand=-; Position=1 -104,338-563,1868-2020
MIEQQNKKQLAGNVLDYINHPLTGRVIGFEEIEIKYISQQVMEFLNKWRTTVFNLCPLYVSIPKGSDRMLEFVSLNILPLFSRTTNGLAFNNDVIRVIPSILTDCPPLHSHFGGRTIHRQFKWPATAKVMNDAAISVGISSDLMPVYRLSDTLQMANKTN

SEQ ID NO: 146430 - protein, 89 aa, Heterodera glycines
  Coding regions on vcDNA: vcDNA=SeqID_72853; Strand=-; Position=1 -172,748-844
MSSPQMSGPQMSNPQMSGPQKSGPQMSGPQMSSPQMSGPQMSSPQMSGPQMSSPQMSDSMNINNLKLCLALLLVGFCLQLFIGGTDAGG

SEQ ID NO: 146431 - protein, 85 aa, Heterodera glycines
  Coding regions on vcDNA: vcDNA=SeqID_72854; Strand=+; Position=1 -192,317-382
MSGPQMSNPQMSGPQKSGPQMSGPQMSSPQMSHHGIIYPKSEFALFVAFLVRQLVEQVRPAQSRVLFRFGATDSNRCEFLWPEDC

SEQ ID NO: 146432 - protein, 208 aa, Heterodera glycines
  Coding regions on vcDNA: vcDNA=SeqID_72855; Strand=-; Position=1 -148,195-337,573-905
  Homolog annotation: Hit_ID=CAE56191.1; Match level="QueryCoverage =91%, HitCoverage=32%, E-value=2e-13, Identity=30%"; Hit description =Hypothetical protein CBG23814 [Caenorhabditis briggsae]
MTALTAPLCLVAPCLIESWGRRPLFLLITALSTLELTLLTVAQLLYDVLGGGGIFVSSMALIGCTMGQASVNLGLFNMTPILVGELFPHPARARATQGTTAKKKKIEKKLSRNIGEYRVPFAQVALLLPNFVVVGIVLAYPSLIVSIGALFFLPLAAFSSLVLLLMLKLLPETKGRPVDDIFRRLADSRTNSVTDYGAIGDDGAMPTK

SEQ ID NO: 146433 - protein, 79 aa, Heterodera glycines
  Coding regions on vcDNA: vcDNA=SeqID_72856; Strand=+; Position=1-240
MVKHCGLFGLLLGTVADVQLLGRLWEMGGAEQMKHGHEETAGWQQPPGPTVAEQRRQAQRGGQQQHEVGTGANCGRGPA

SEQ ID NO: 146434 - protein, 133 aa, Heterodera glycines
  Coding regions on vcDNA: vcDNA=SeqID_72857; Strand=-; Position=1 -271,782-912
MFDVLINFDFRIFPILNRHRREYFNLPPGKAASNSPTVQEHILSGIEEQKIELDGNAAKEETAESGDEFEEVKQRKTETTAEEGNEHEQLVRHAKFYHAGDESLLLDQRDLFWGKLREACSRLFRIHKNEVDH

SEQ ID NO: 146435 - protein, 124 aa, Heterodera glycines
  Coding regions on vcDNA: vcDNA=SeqID_72858; Strand=-; Position=1 -213,471-572,1045-1101
  Homolog annotation: Hit_ID=NP_505497.1; Match level="QueryCoverage =50%, HitCoverage=22%, E-value=5e-15, Identity=50%"; Hit description =C2H2 type zinc finger containing protein (5K172) [Caenorhabditis elegans] emb|CAA94802.1| Hypothetical pr
MHTVLYLKLSFDSRNGKKAKQNSNAFANYHIICLFVFSLNKMSLTAKCSLCSDEFSSIDDLEAHISADHFNCLPFECEKCKFAKFPTEFAIKRHYEEDHGLSEYFVRNRVCREIYEEEAKGPRM

SEQ ID NO: 146436 - protein, 73 aa, Heterodera glycines
  Coding regions on vcDNA: vcDNA=SeqID_72859; Strand=-; Position=1 -44,168-345
MRALTPTDPSFSLPRHVVFGKVLEGMNIVREIEDGETAGGDRPKKDVVIVDSGGNSQMFSDLKSIKFFRANSQ

SEQ ID NO: 146437 - protein, 47 aa, Heterodera glycines
  Coding regions on vcDNA: vcDNA=SeqID_72860; Strand=+; Position=1-141
MPWKLGDFHGKYGQKSKANMKEIRNGWAFTFTTMTIKMVNKKTLMLF

SEQ ID NO: 146438 - protein, 74 aa, Heterodera glycines
  Coding regions on vcDNA: vcDNA=SeqID_72861; Strand=+; Position=1 -103,1965-2086
MAQTDPPQTSRSPRGEIEWTYILAQLGWTLDRMWVYASFLILQFHPFGFIDKQIQILCYLCSLIPISLLFLSSI

SEQ ID NO: 146439 - protein, 78 aa, Heterodera glycines
  Coding regions on vcDNA: vcDNA=SeqID_72862; Strand=+; Position=1 -114,294-389,448-476
DLDLWRELDLLFAETEKEEPEEADDNILQQFPPKSVECWFEASYKRPSWTVIEEAADAEIQANGVQLSFGPTKNTVYV

SEQ ID NO: 146440 - protein, 335 aa, Heterodera glycines
  Coding regions on vcDNA: vcDNA=SeqID_72863; Strand=+; Position=1 -39,3754-4719
  Homolog annotation: Hit_ID=NP_500013.1; Match level="QueryCoverage =81%, HitCoverage=19%, E-value=7e-50, Identity=38%"; Hit description =predicted CDS, polyprotein family member (4B673) [Caenorhabditis elegans] gb|AAC02594.1| Hypothetical pro
SEENCIFFKIFPITIAKAFLSNCYLKFGGCTELISDNATAFTSEFFKEFCSMLYINKTYAIPHWSQGNAVTERSFRTFHNILSKYITKEDPDFDEFLDFASFCYNTSCHSSTSESPFFLVFGRDPIFCVDQILDARIHSQVQQAEETDFKQKLVSSLRKAWKSAADANEAAQQKIKEQYDRTVRQPQICVGDRVLLRNYAGKVGTSKKFHLPWKGIFRVIEIDGIYATIVSCISPQQNPKRVHLNQIKKCFENFGPNCTLPKLPIDEEESLDKMHATNLDNFPGHNHFPRTNRQPSKENPEQENDSQNLAEKTDCQEEDGNNSLDESIKPKKGPE

SEQ ID NO: 146441 - protein, 278 aa, Heterodera glycines
  Coding regions on vcDNA: vcDNA=SeqID_72864; Strand=-; Position=1 -108,277-423,466-654,699-1091
MTVTSNTEFRLIECVPILEEVAREFGCITPLPNLGYTFKSRECYDHHTKVTKCKVKRGTEVATIEKSICKSSKKCIDCGVIYQIRHHKQKAHECGQKFCKVCLGFHVPRECYIPYRPKKKTEKRIIFFDFECTTDFKPDPELLRFKHQVNFCYAHVTCTECIAKGIWDQPLDRSCGICGLTRTFAWAPFEFYNTEVETAYVVDDPLTAFTKWLLHFEADVLGLDPAEKRRKRKRANGDNNNKARNPAANAFIDMEAEDDDSDDNDAENNFKGHVTITC

SEQ ID NO: 146442 - protein, 108 aa, Heterodera glycines; identical to SEQ ID NO: 138046
  Coding regions on vcDNA: vcDNA=SeqID_72865; Strand=-; Position=1-327

SEQ ID NO: 146443 - protein, 46 aa, Heterodera glycines
  Coding regions on vcDNA: vcDNA=SeqID_72866; Strand=+; Position=1 -21,460-579
MLKKEEQAQLCAQSIDELCITINSVADDQSKLAAATGAYNGKFYKN

SEQ ID NO: 146444 - protein, 55 aa, Heterodera glycines
  Coding regions on vcDNA: vcDNA=SeqID_72867; Strand=-; Position=1 -30,90-227
MNIYSDCMPKLKSELSKQLPPLVKPIFYNSAESISESLIEVVKKLNDYSKYFWQR

SEQ ID NO: 146445 - protein, 64 aa, Heterodera glycines
  Coding regions on vcDNA: vcDNA=SeqID_72868; Strand=-; Position=1 -144,598-648
MLIAFVRNDQKMQISEFTKQKYEAHLGIYCFMRMNWQSKWINGPIIYVNEDALFLEFIKGLATI

SEQ ID NO: 146446 - protein, 50 aa, Heterodera glycines
  Coding regions on vcDNA: vcDNA=SeqID_72869; Strand=+; Position=1 -148,456-460
MSGPLTKLQVRLGFLLGLRLWQCQLHDELALGFQLEQKLLNSFEPFESIG

SEQ ID NO: 146447 - protein, 56 aa, Heterodera glycines
  Coding regions on vcDNA: vcDNA=SeqID_72870; Strand=-; Position=1-249
GPERLGPRFWAPAFGPPFLGPGVVWAPFFGPRGRLGPNPKIEKCAFLKIKILKTKP

SEQ ID NO: 146448 - protein, 173 aa, Heterodera glycines
  Coding regions on vcDNA: vcDNA=SeqID_72871; Strand=+; Position=1 -119,170-312,932-1020,1184-1354
KIHPTIDEGQAVEHNRETEGQREHQQQQTQQPKNRRFSRGGTILEHPPNIEFYRNTLEKEENGTVRPTMFDLVEGDKQQQPQQQRRETDGTLFRSADRWALNLVVPLALFFPLPMPSLDGDINDIRIIALVACAVLVVIILVGLSFESKMQVNTLNAEEEGEGHNWPLISVNY

SEQ ID NO: 146449 - protein, 216 aa, Heterodera glycines
  Coding regions on vcDNA: vcDNA=SeqID_72872; Strand=+; Position=1 -145,209-360,542-747,828-960
  Homolog annotation: Hit_ID=EAL30895.1; Match level="QueryCoverage =98%, HitCoverage=17%, E-value=5e-40, Identity=41%"; Hit description =GA18131-PA [Drosophila pseudoobscura]
LLPPLPLPSDALRFQTRVKHGTIDVWWLYDDGGLTLLIPYLLTQQKSYQNAKLNAKLRVFTLAGQGKNLQQEHHGLVTMLKKFRITADQVMKKGIEGNPLDFQSDNENEETNVGQAEGLITETELNAQQAINQSFVSISQICLKFLQARTWRHLRIAELLRRYSSDSDLVVVTLPVPRRGLINAALYLAWLEAMSAELPPTLMLRGNQQSVLTFYS

SEQ ID NO: 146450 - protein, 165 aa, Heterodera glycines
  Coding regions on vcDNA: vcDNA=SeqID_72873; Strand=+; Position=1 -91,192-306,521-691,1218-1339
  Homolog annotation: Hit_ID=CAA33463.1; Match level="QueryCoverage =80%, HitCoverage=2%, E-value=6e-31, Identity=52%"; Hit description =twitchin [Caenorhabditis elegans]
RANDEQETESSDVDEDEYVVESDDDIPAVEPKEREERWVDPLPEKLQFQQQVNKIAELKCKYSRANAKVHWYKDRKKLFSDGLKYKILIDKQSVTLIINNPDPDDSGKYTCEANGVPTNSFVTVEDSPDQQPLSSTARRRDSRRPKSARKEATALTPLDAMQWLV

SEQ ID NO: 146451 - protein, 233 aa, Heterodera glycines
  Coding regions on vcDNA: vcDNA=SeqID_72874; Strand=+; Position=1 -289,828-976,2128-2388
  Homolog annotation: Hit_ID=CAE62158.1; Match level="QueryCoverage =100%, HitCoverage=52%, E-value=4e-35, Identity=28%"; Hit description= Hypothetical protein CBG06205 [Caenorhabditis briggsae]
VAGVKPQHTYEFRVAAVNVAGRGEWSKNSVPIAATWSPCKPLITMGPLACDMTVLVGEQAKLLVPYAAKPRPKFEWSKNGEAMDPRDDPRVKEEKSDILIQLCYQKCEQSDTGNYSIRIVNDFGSDSVDLRLKVVDRPAPPEGSLKVRCADERLLAKAPLNVPVRPGPPKPLYTTDKSIMLQWTRPLRDRGTPITDYELEIRERGTKLWGKATTNAELWEKDAFGNVPDTRFK

SEQ ID NO: 146452 - protein, 76 aa, Heterodera glycines
  Coding regions on vcDNA: vcDNA=SeqID_72875; Strand=-; Position=1 -216,331-345
MRPVSKCQCAERDMGKKHTYKEQMARKDVNNYDEFDEALLPMFRMIFDEIKKLSMAMMAAKKSKFFLMRNNTRIYA

SEQ ID NO: 146453 - protein, 199 aa, Heterodera glycines
  Coding regions on vcDNA: vcDNA=SeqID_72876; Strand=-; Position=1-636
  Homolog annotation: Hit_ID=CAE62309.1; Match level="QueryCoverage =47%, HitCoverage=6%, E-value=2e-36, Identity=76%"; Hit description =Hypothetical protein CBG06373 [Caenorhabditis briggsae]
SGQKEYLTRERLLQFLNEEQRDPRLNEILFPHFDQERVQQLIAKYESDESYIAQGKMSGDGFLRFLLSDENAPVFLSWNERYQDMDQPLCHYFINRWRRMAMNILWLLGVRILAFLGGFLKIFCAAEILRHENSAISDFVGHVRILVSDFFLSSEFRFRIFFKPQNFDSGELLTISEFLKILFTDILRMVCAQKCTNFN

SEQ ID NO: 146454 - protein, 320 aa, Heterodera glycines
  Coding regions on vcDNA: vcDNA=SeqID_72877; Strand=+; Position=1 -104,526-813,1371-1522,2014-2045,2119-2283,2409-2515,2941-3025,4625 -4644
  Homolog annotation: Hit_ID=CAE62309.1; Match level="QueryCoverage =98%, HitCoverage=21%, E-value=1e-141, Identity=76%"; Hit description= Hypothetical protein CBG06373 [Caenorhabditis briggsae]
EREDLDATLFTFEKFLRLYHKICPRTEVQELFVRLSGQKEYLTRERLLQFLNEEQRDPRLNEILFPHFDQERVQQLIAKYESDESYIAQGKMSGDGFLRFLLSDENAPVFLSWNERYQDMDQPLCHYFINSSHNTYLTGRQYGGKSSTEIYRQVLLSGCRCIELDCWDGTGENKGEPIITHGKAMCTDVFFKEVLEVLYQIKETAFTRTDFPVILSFENHCSKSNQLKMAKYCLEIFGDMLLSKPLDEYPLEPGVPLPSPNRLRRKILIKNKRLKKEEERRQMEAFFSQGRLLDEEEAQEEQQPVAQPAAMPSTGGKWFT

SEQ ID NO: 146455 - protein, 120 aa, Heterodera glycines
  Coding regions on vcDNA: vcDNA=SeqID_72878; Strand=-; Position=1 -345,546-563
MYQNDDSMPNTIMGGDTTWDNIGSMLARLLGDDEEAVDNVCLLQRLLVADPGATGGEQRHSAKSKDRANSALFAGGVPNGEAPIGAKNGEDGFLWCPTQHIMPKFDGGLMPPKFGSRAWH

SEQ ID NO: 146456 - protein, 113 aa, Heterodera glycines
  Coding regions on vcDNA: vcDNA=SeqID_72879; Strand=-; Position=1-595
  Homolog annotation: Hit_ID=NP_001004509.1; Match level="QueryCoverage= 100%, HitCoverage=8%, E-value=8e-11, Identity=32%"; Hit description =si:busm1-180o5.3 [Danio rerio] emb|CAD60788.1| novel protein similar to DNA polymerases [Danio rerio]
GCAWHGCKKCYPSDNMLLPNGKSAGEVRERDAKRLEFIHSQVAHVDVYWECEIQCMLSRSKEMRQKFAEYVDDGPLLIRDAFMGGRTGPLTLYHEARDGEKISYFDFTSLYPY

SEQ ID NO: 146457 - protein, 89 aa, Heterodera glycines
  Coding regions on vcDNA: vcDNA=SeqID_72880; Strand=-; Position=1 -127,171-296,478-494
MSPIKRKQDLIVVSKKPRLCRPLTRQMLDEIINWIPFMFLFGVALCKPKPKKLKARRRLPAELVYEMFNFVPVMQLYGGTTPVTKTAVT

SEQ ID NO: 146458 - protein, 841 aa, Heterodera glycines
  Coding regions on vcDNA: vcDNA=SeqID_72881; Strand=+; Position=1 -627,670-1845,1891-2613
  Homolog annotation: Hit_ID=NP_507780.1; Match level="QueryCoverage =61%, HitCoverage=35%, E-value=5e-36, Identity=24%"; Hit description =predicted CDS, DNA polymerase type B, organellar and viral family member (5T899) [Caenorhabditis elegans]
MSNRQYPKFFISNILGPSQPKKPRQGFLINQLLGIVQQQGEGVSSSSSAQKKANEYVKKLDNSLEHLPGFNYSKVKSRFSIEDVPENPETLLTAIFTHCIDEAKTDSSDRGIVPTHLGCVISSQLLTAGDLFIPIRQITDNTVDTILNLFLKVSQSKKTEGVTLWGEPFTVTVTTVNRDGLPAKRQLKGGARRRIAAVHHRIHDQSLIKIRNPDDRNYCLFYSLQATMVAKTRGWPRWKFYDYLHSQHGQRDKFLSDTLSLMRTVGIQMDLNGYDADTFVPRIINHWNNTQQNHRFAVFIFGSNGQYRPLYKYNDNTYDTPLLLYFNDNHFDGVQAQGGLFGRKYCLECERPYRRDSEHNKSCKARCLLCSRVGPAFPCPAAAGFFKKCDGCNKKFRNNNCYTHHLRTNFCNKSKLCKHCGVIWDVKPNNTNERKGHVCGEQFCTLCNNYHNTERGCFIKTLEPKEQDPYRIVAFDLETMQHQPVNPQQLDRRSHQPNFISAKVICPDCIENDTWKRGTAGCAVCGPHRTVAFCQRPFNNTVVDQQVVTDNPLEAFVEWLIFQLPKQYDTFAYSHFGGRFDMVIVFRELFRRGFNPEMLKKGNKMYQMKVRKQKKRNPNVVFRDSFNLMPMALASLVPSFGLDVEDKPYFPHLSNRPENYGQQIFPTSDDYLANGMMPDKRRKFDMWYEQHRDVPFLLDEELASYCTNDVEILTAALVAFRQEFFEISQRQEGVVAERAASDEHHDGIDVLRECMTIAGACMRHFRTNHLPADHLAIVPERGYDNAQNQSLLALRFFKWFAEEHGVVVQTAHSPEGEKRIGQYSLDGWIQAERRAIEVNGN

SEQ ID NO: 146459 - protein, 424 aa, Heterodera glycines
  Coding regions on vcDNA: vcDNA=SeqID_72882; Strand=+; Position=1 -299,349-920,969-1160,1209-1418
  Homolog annotation: Hit_ID=NP_001004509.1; Match level="QueryCoverage= 95%, HitCoverage=28%, E-value=3e-53, Identity=31%"; Hit description =si:busm1-180o5.3 [Danio rerio] emb|CAD60788.1| novel protein similar to DNA polymerases [Danio rerio]
MLLPNGKSAGEVRERDAKRLEFIHSQVAHVDVYWECEIQCMLSRSKEMRQKFAEYVDDGPLLIRDAFMGGRTGPLTLYHEARDGEKISYFDFTSLYPYVNFVTRYPVGHPKVHVFNEDVTWTHSGDNPYPLALLKVFVVPPKKCDVPVLPVRINERLCFPLCHRCAQDYPMGDVDPDYHCEHTDQQRGWVSTCTSIELNAALDEGYRVTKLFRVLEYEQSDDKLFRGYIAEFMAQKIQASDFAANIKGNNELEEQFVNECHEMFGITIDPEQMAVNKGKRSIAKLCLNNLWGRFSLRNFGLAQTVITDDPAVLAEYLDNKSIDVMSIDELNETTILISYMQKKEWVEEHECSNIVISLWTTSAARLLLLRAMQMVVRTPGCRLLYTDTDSLIFAHLIANCPLQTGPHLGQFTDEYPDHEIVEYC

SEQ ID NO: 146460 - protein, 176 aa, Heterodera glycines
  Coding regions on vcDNA: vcDNA=SeqID_72883; Strand=-; Position=1-530
MVLVSEYCAQFFGCSPKTLRDRLNHPEDRERALKELTGKKVQTTYKDRNGMRKTFFIDGITEKGAAFVPAYGRLRQPFNINVAAHFYARHRVKLHHPYIPCIVERFECGENRNYPMELLEIVKEGQQPIGQWLGNLFKERDDICSSSSTLSDKTLVLRDEEDTGRDQCSQKSPEFY

SEQ ID NO: 146461 - protein, 108 aa, Heterodera glycines
  Coding regions on vcDNA: vcDNA=SeqID_72884; Strand=+; Position=1 -172,216-370
MLSTQSSRNERKEMEGQEEQCENSPTKKQKLDKPKVYDSMLWKILKGKYMISMYLCADDWRKLFENREKVQRSANDRVRISFDMCEECARVNCRMTDLIAPPKKNLIL

SEQ ID NO: 146462 - protein, 35 aa, Heterodera glycines
  Coding regions on vcDNA: vcDNA=SeqID_72885; Strand=-; Position=1 -38,305-374
MTTWASLELKWNSLRMKSAPREETHAIKRLLFCFA

SEQ ID NO: 146463 - protein, 240 aa, Heterodera glycines
  misc_feature (206)..(206): Xaa can be any naturally occurring amino acid
  Coding regions on vcDNA: vcDNA=SeqID_72886; Strand=-; Position=1 -165,224-379,807-877,1057-1321,1831-1885
  Homolog annotation: Hit_ID=CAE62148.1; Match level="QueryCoverage =98%, HitCoverage=34%, E-value=3e-45, Identity=45%"; Hit description =Hypothetical protein CBG06194 [Caenorhabditis briggsae]
FEIYYHKGCVVQCAVNLFRRKKFSFTDQFVLSYGGLRGAIAFGLVMSTNNSADARSMFISARSMFISTTLAVIFFTVFVQGISIRPLLFWLKVEKSGLDGPMMSNKIFERYTDHTMSGLEAIIGHKGTHSLRDAFERFNNTVLTPFLMRSGEQQRKTYEASPIVRAYHKITLQEALQLAQSGSKISKLEIILKFELKINQIIFFAXISNSNKQFVLSLEKQKFLSNRENVELLYLMFSRM

SEQ ID NO: 146464 - protein, 79 aa, Heterodera glycines
  Coding regions on vcDNA: vcDNA=SeqID_72887; Strand=-; Position=1 -165,215-289
  Homolog annotation: Hit_ID=CAE57797.1; Match level="QueryCoverage =96%, HitCoverage=21%, E-value=2e-09, Identity=43%"; Hit description =Hypothetical protein CBG00821 [Caenorhabditis briggsae]
MFVTTTLAVIFFTVFVQGISIRPLLFWLKVERDDDTARPAAEEKKDDNPDEKLDRYTDYAMAGLETITSGAGKHFLRKA

SEQ ID NO: 146465 - protein, 174 aa, Heterodera glycines
  Coding regions on vcDNA: vcDNA=SeqID_72888; Strand=-; Position=1 -159,692-803,855-1108
MNRSGIASSIDVKVRQCLQMSYYLVFVLFLTFCVYPLIKLARERLALYILISKYQFRFSSLLVISLYTWPYLIVSSSLYVAIAIRLAWIKAHNRSWNSEGASAQSSDKDSGRITATCFAIHIQAWAYVGANSAANYKWYSDFINCHPIGQIAFFPIQLFVCIYVIADEAIKIKI

SEQ ID NO: 146466 - protein, 28 aa, Heterodera glycines
  Coding regions on vcDNA: vcDNA=SeqID_72889; Strand=-; Position=1 -55,596-627
MCGMLELSSMHENAAFSFDYELDIFVHN

SEQ ID NO: 146467 - protein, 138 aa, Heterodera glycines
  Coding regions on vcDNA: vcDNA=SeqID_72890; Strand=-; Position=1-414
MTSNKQRQLVHKDVKLRHQFKQKHSSMQLTARFRKQIHMSSTIEEVQQRMNHNRPQPRRSQQRGLRPTQAPKICQSGMAQYKQGRGIRLHTASSAMALTGPRRRLSEQPLQQEQGHESSTSPGRERRPRKSQRHAPDR

SEQ ID NO: 146468 - protein, 239 aa, Heterodera glycines
  Coding regions on vcDNA: vcDNA=SeqID_72891; Strand=-; Position=1-719
MSGPIQKGIINALKALDNAKSATSLILHPDPDLSNWENAVNLEAQFDRVVKEIRTMEMQMDSLRDSSNAWIELLARLTGDDKDNGEKEYIKFDKNEKIADRYDAATTKLRDLRDLEATLSAAAKLHRGRADREAKADQLANPQQQPPMPPAMAAPMTMPTFTAPLYQFQPIQLDKFFGQKRKWPEFYESFKSAIGSQSISKAQKLNLLRNLLGGEARELIAGFRLEDANYETVLQLSHK

SEQ ID NO: 146469 - protein, 41 aa, Heterodera glycines
  Coding regions on vcDNA: vcDNA=SeqID_72892; Strand=+; Position=1 -42,206-289
MTLCMYNESMNILLHFMTLCIMYPKSQKMGRLQFIWSYYCL

SEQ ID NO: 146470 - protein, 77 aa, Heterodera glycines
  Coding regions on vcDNA: vcDNA=SeqID_72893; Strand=+; Position=1 -118,770-886
LIEKKLGYRMKLSTQNLVACKQSYAMLMLNEQNYWQRKTLILRTALEWWFYDASAKSSGSAFLNILFPALAERNFNN

SEQ ID NO: 146471 - protein, 141 aa, Heterodera glycines
  Coding regions on vcDNA: vcDNA=SeqID_72894; Strand=-; Position=1 -145,915-1195
MAKDSYARFLKSEQYLELLNNNNNNNGNNNNENDGGEHMQQPKGLLRYGLPVPVRDVPSQPSHCHHCPAPVAAEVRHCRRAAAALAPGVGTRAGTLAHRPQRQCQCWPAPTQKRAPPALAIMAQYPPTFCPAAVASAVRHR

SEQ ID NO: 146472 - protein, 160 aa, Heterodera glycines
  Coding regions on vcDNA: vcDNA=SeqID_72895; Strand=-; Position=1-482
ASLQHHYSPMRVHRGGGGGTNGGNRSSPQKVGPTSPLKQQQASSAELVDPYNNTNALQQQQQQSPTTKRRGGGGRLRSALAATTDNTMVRRVASFTFSPPLRAGSLQHNQLQHQLQQQNFLSALDKHCSSNSAAGALRLDKRNSVATGGGGTDKLQRRMA

SEQ ID NO: 146473 - protein, 167 aa, Heterodera glycines
  Coding regions on vcDNA: vcDNA=SeqID_72896; Strand=-; Position=1 -135,278-646
MPKTRDRDPHKLDIFLEWRRSPFLGTWVGDNPEKWPNPGKGLTMPLTRPPPISHQAALPPRPQQIVALFKCSSDTSTTNSFQQWHRAPSKHRRHWPTVSAAVVPRSVPAARTLAAVRRRRMSHHPLPHPRRPHRLWSNCPQILLAKQSQQHQQMDNNNSSEKCGGME

SEQ ID NO: 146474 - protein, 351 aa, Heterodera glycines
  Coding regions on vcDNA: vcDNA=SeqID_72897; Strand=+; Position=1 -129,799-1485,1807-2046
MAVGPGPNPIKELTDKFHQKAFYNTERSDAGASSSRALITNTVKQRSPSSQSPSENFVVGTLPMDRDFSPILNPTIGQSSLMRRRQHPGREEKQLNQSGEASTEKTGETTDELVVRAIATSIRAVGKPTRQLRFGFVASGSGPFPYALDADVKSIVKLISDRKMESALKAEHLMGQMKEMANERIDKILVQIGDESSEFHAKIRRKSQKQRELSVLFFFVRLWRKLGTLLVLENLDINSTEFHEQILGCLNALRAEIWKEFASSCEAAKNGKAFQWVESLNRFDDAIELTNFGILLLFTPPIVQAAEMVNRPTTQNEFFNTHSPQFIVQEGTDDNYSTELADQMTWKQLSN

SEQ ID NO: 146475 - protein, 503 aa, Heterodera glycines
  Coding regions on vcDNA: vcDNA=SeqID_72898; Strand=-; Position=1 -120,541-746,791-1012,1063-1143,1188-1496,1564-1659,2076-2239,2597 -2645,2687-2850,2898-2999
  Homolog annotation: Hit_ID=XP_452473.1; Match level="QueryCoverage =100%, HitCoverage=44%, E-value=5e-26, Identity=32%"; Hit description= unnamed protein product [Kluyveromyces lactis] emb|CAH01324.1| unnamed protein product [Kluyveromyces la
YPELIDGFNTFLPHGYEVRVHGSHIFIFEPNGSSSMINNSFAIGGDLIEDGMELAVAAASPQIPLPSSSSVPTIQSHSVSKPNTAISESPTGIGQSVRYVHVHHQIENPLTTIPMEVENEMVRPSIDGGSQRISQEGTQTQQKVLSCESEHNIQNQQSQQQTTKTGQLIHFSEALGYLNRIKGRFADRPDVYREFLNILGNYQQCEGDQKWSEAEVYQRVSRLFHNELDLMRDFKSFLPDAKLDFIEHQSEQQKPKLEEEGKREVMEQKQKQQKEQQQPMQTAQNAKPTAAKSADIVHKRQFGKEQANLNAKKAKASVNKITYDVGVAEILEEIPLRDFVIFEKTTTLANSTASATVAYPRTAFVLFVRDAVLSATKCSTIRTSHFPNGKPYHFTEMIMSPYEDLMYRTEDERFEVDIFIEVNSAAITALECARRKIESMGHEDAKKFMSEEDLGCSPTFLTRAVKKLYGEHGGKILFALKENPLVAVPMVLRRLREKDVECR

SEQ ID NO: 146476 - protein, 486 aa, Heterodera glycines
  Coding regions on vcDNA: vcDNA=SeqID_72899; Strand=-; Position=1 -186,743-1687,1739-1850,2126-2197,2249-2391
  Homolog annotation: Hit_ID=A43427; Match level="QueryCoverage=82%, HitCoverage=93%, E-value=1e-22, Identity=24%"; Hit description =neurofilament triplet H1 protein - rabbit (fragment) gb|AAA57152.1| neurofilament-H
MNICSRNWAFGEPYDEANGRERCAMLNIKLDANIDDIDCDMSAGPELSYRFVCERTHEKHIEHESLNNPLWKKLEDILNFFGIRGAQQDDTNRTSGLEEEGYWDRVLGKSDAFKKRNSAELQERSEKQINAKASEPENQQQNANAQQSAKSSEPEQQSAKASELAQQSAKASEPVQQNAKASEAAIQQQKANAQQNAKASEDVQQNAKASEPAIQQQNAKASEDVQQNAKASEAAEQNAKASEPAIQQQNAKASEDVQQNAKASEAAEQNAKASEPAIQQQNAKASEAAEQNAKASEPVQQNAKASEPAIQQQNANAQQNAKMENITSKDAPNAKSDTSINKQSMNGSDTNEKNAMETNFVVPSSIESRVIEPVREKHPVDHAKSLMLDNTPNSLIAASTDTVGTSVEGVQRMDDLDGQNGTNKFRAFRTQFNENRLTEKTKNDGKKEVKKEVKEKAEEKEEEKSKNEERKEEQKPAEEKREEGKE

SEQ ID NO: 146477 - protein, 718 aa, Heterodera glycines
  misc_feature (376)..(376): Xaa can be any naturally occurring amino acid
  misc_feature (393)..(393): Xaa can be any naturally occurring amino acid
  Coding regions on vcDNA: vcDNA=SeqID_72900; Strand=-; Position=1 -75,1153-2162,2193-3098,3389-3512
  Homolog annotation: Hit_ID=XP_320889.1; Match level="QueryCoverage =97%, HitCoverage=93%, E-value=1e-104, Identity=31%"; Hit description= ENSANGP00000012033 [Anopheles gambiae] ref|XP_313651.1| ENSANGP00000013044 [Anopheles gambiae] ref|XP_31
FQLSPAAGKMKMRRMTASINTIDHNEYKRSCLPDGITAFNFNETKTRLMKLFARPPSLAIDRYECLKATRKEGEEFSVFVNRLKSLFRKFRYSELNEDQFKCLVLLTSLKSSSEAKLRQHILSRLTTEETKNSNAEIFQNISEEIMTMLKTEAEVKILEQAKPKINAFSQNKPIRKKENSGKPSQNIGNKGKTPPNNCFRCGEMNWAQNCPKLNYVCKKCNQKRHIEKATESRPTIKPKGQESEVEHDSNFCRSHQKNGTSKIIRISIIMNGKTIKFIADSGSDINIIDEIAYKCIGSPPLEESDEEGILFDGRRCQFIGKMCYLQIQRIKVKQPFYVAKAGALNLHGAATMDKFGFLANSINQITSKNNETKIRXNSINQITSKNNETKIRXAIKELQSKFEQVFLEGLGLCTKMKASLMLKSDTKPVFRRARPVPYSSLPIVNNELDRLEKINVIRPVEHTEWAAPILVVKKANGSTRLCADFSNGLNDCLQLNKHPLPLPSDIFPTLNGGKFFSQSIMDNMLSDYPFAIAYLDDIITVSKSMEEHCEHLDKLFARLQEWGLKVHIEKCSFFQKEIKYLGVTINQNGRNPDYNKIAAIAEMPAPSNLNKLRSYLGMVNYYQEFVKNFRFIRQPLDDLLKKDKIWDCTSACQKAFDKIINMLQFVAADASQSGIGGSDIDFDRFRIPDLNSNKSRKFIFHLNHFMLESEQNSGPGFG

SEQ ID NO: 146478 - protein, 125 aa, Heterodera glycines
  Coding regions on vcDNA: vcDNA=SeqID_72901; Strand=+; Position=1-378
MSDGSGNGCLFSWRQSFRPFEKSAHNLVDPLAFFTTKIGAAHSVCSTGLMTLIFSNRSNSLFTIGRDEYGTGRARRNTGLVSDLSIREAFILVQRPRPSKKTCSNFDCNSLIAYRIFVSLFLEVI

SEQ ID NO: 146479 - protein, 149 aa, Heterodera glycines
  Coding regions on vcDNA: vcDNA=SeqID_72902; Strand=+; Position=1 -171,841-915,1269-1471
MSVFLFVLIQAHRQQLIREVLELIPIFVRFVNIAVPRHIRGHKLYNKELVEEFHWAQEPGLFIFGRHFTPCSDELGLQTSQAEVLCASVDSLVRKAKFVAEYHLPLIVEKQRAQQTEAKQPQQVPSSSSSTAAATAEENKSTGRSDEAS

SEQ ID NO: 146480 - protein, 108 aa, Heterodera glycines
  Coding regions on vcDNA: vcDNA=SeqID_72903; Strand=+; Position=1 -180,457-551,762-813
MLENRDLSFYISDDDDAQAICLMSRRIADKYNPGLKYTIFTKRVPAPFETISFSNRQIIENNSLRTLDFLSCLVYAAPNVVELDLANNAVSEAIHQFFPRVTYLVLYK

SEQ ID NO: 146481 - protein, 80 aa, Heterodera glycines
  Coding regions on vcDNA: vcDNA=SeqID_72904; Strand=-; Position=1-390
LISSQKSCQFKTAKKAEFSKFFISIFFYSSKFSVIFSRLIEPVKSFRLISRLFDSVNNFKSYIDSKLAQTELARRSWPVP

SEQ ID NO: 146482 - protein, 246 aa, Heterodera glycines
  Coding regions on vcDNA: vcDNA=SeqID_72905; Strand=-; Position=1 -11,58-336,391-838
  Homolog annotation: Hit_ID=AAL78214.1; Match level="QueryCoverage =76%, HitCoverage=95%, E-value=7e-12, Identity=30%"; Hit description =putative esophageal gland cell protein Hgg-20 [Heterodera glycines]
MNRRWICNDVWMDIFPSFDRAQLGLKLALLSPRFDALVDKHFDGKSELTIWRPIEIRRKDKGPEPKLSVRIDYEFVPFPLPDRPLPSKIRFKNLRIDYIDHFVIAFLRLNHQIFEKRGTDLYLWISSSHSTNGQPIWDVFVREIWPIFSTNIRCLGFTGGDHLDHLRRRTSPTILTDLNQLNSICSCDLSPAAFGDDFDGPNSIISAGQALSKWLHSPRKDGQPKRLRCEDFKGQTDFDWANNFKE

SEQ ID NO: 146483 - protein, 34 aa, Heterodera glycines
  Coding regions on vcDNA: vcDNA=SeqID_72906; Strand=+; Position=1-104
MSGDNSALIAAEQAAYGPFFGSLGVTAAMIFTAA

SEQ ID NO: 146484 - protein, 121 aa, Heterodera glycines
  Coding regions on vcDNA: vcDNA=SeqID_72907; Strand=+; Position=1 -86,850-1129
MGLYPKTGLAGVASVGRCSVVPIRFETVGWICNDVWMDIFPSLDHAQLGLKLALLSPRFNALVDKHFDGKSELTIWRTIEISKDKGPEPKLSVRMDDKFVPFPLPDRPLPSKILFKRLRIE

SEQ ID NO: 146485 - protein, 148 aa, Heterodera glycines
  Coding regions on vcDNA: vcDNA=SeqID_72908; Strand=+; Position=1-449
SWTITPGDRGSGALTVPRFAPEEWSVHKRTLDGGDRTNNYAEAFHRKLQRAFDCTHPTVFHFINTIRCEQKSIDADISRCIAGEVPPLKKPKYCAADERILRLLQGYNAINNNPAIQNDHNYHANVNVNPDNINHLLVGVSRNYEMRP

SEQ ID NO: 146486 - protein, 60 aa, Heterodera glycines
  Coding regions on vcDNA: vcDNA=SeqID_72909; Strand=-; Position=1-269
FGPRGRLGPNPKIEKCAFLKIKILKTKPEGSLATWHKLGLITFAHFLQFYLFQILLFFNS

SEQ ID NO: 146487 - protein, 336 aa, Heterodera glycines
  Coding regions on vcDNA: vcDNA=SeqID_72910; Strand=+; Position=1-1011
MLNEARKNSDEERMRSKIWYDSQPKVTANKFEAGQRVMVAFPGLNRRSRHKKLLWSHFGPYLILEINESSAFLVPIDNRNAEPIKVPIERLIRIPPGIPDISTLPKGKNPFKNALKSLIVSILSSFEVCESDGQMAHYEQLGAIANLKGGEGMIRKMEKAAQSREIPFSEMEIDNEDEAEDTFGWNAKCDVGQGEHEFCAILRVAELDPALGNAELGSITVKTPLQALLAVFLLKAGTVKSMTAARSFVKSIIEGAPKEELSLFVTKKGDYVATGQCPTEEDQMKALECWFEKCSVAKHALEESGFKKIGMDEPVGLNHLADSEKKKWEEAMGETP

SEQ ID NO: 146488 - protein, 325 aa, Heterodera glycines
  Coding regions on vcDNA: vcDNA=SeqID_72911; Strand=-; Position=1-978
MDEPVGLNHLADSEKKKWEEAMGETPWVLEKLRAKIIHKATKLIALPRVIIGDSTAHQLAEILDQTAVIGPKNGTLAETVRSLKPVVLSSKVKAALIIVGRDSLLGGETIEVMMEQYEMIANLCRRFPQVKFFWTCPPYVHDKHDEYEELIESLVPMMSQKPFLPVWVTEKGRSLHEVFRFANSFDNQRVTTDGLMQEAGLRALKAWLFTQSDFPGDQKLKIRSIRSTVRAVATIGLGDHRQASTSSLAVNDSIGLGDRRRHTIGSVGHRDRDQRRQSLGSIGLGDHRRHTFGEVPSRERHHPYSRWNNRAVMPYRGRGPSHSRR

SEQ ID NO: 146489 - protein, 491 aa, Heterodera glycines
  misc_feature (460)..(460): Xaa can be any naturally occurring amino acid
  misc_feature (479)..(479): Xaa can be any naturally occurring amino acid
  Coding regions on vcDNA: vcDNA=SeqID_72912; Strand=-; Position=1 -96,155-276,332-495,576-754,805-882,927-988,1035-1109,1155-1291,1359 -1399,1451-1530
  Homolog annotation: Hit_ID=NP_506259.1; Match level="QueryCoverage =95%, HitCoverage=41%, E-value=2e-88, Identity=42%"; Hit description =kinase-like protein (5N518) [Caenorhabditis elegans] emb|CAB01444.1| Hypothetical protein W07G4.3 [Caenor
EPCPLDYYLGQTSLNSTQRELFVSWGLYQVLNCLKFLHNEAKISHNNLRNNCLKFLHNEAKISHNNLRNAIFITESGDWKLASFHLSGTFSSPQCDLTDLADTLNRIFRPNSPQCDLTDLADTLNRIFRPNSSADSTLPKRVQPLFRRFNARGRSVMAVADILNECRSVGGFMKNKFVDTLLFLDEFQLRDAAERQSFFMQLNSNLDLFPDDISCNKILPKLIHTYEFGDAGAHILVPMFKTYEFGDAGAHILVPMFKLGRLLDENEYQQRIVPCLVKLFSSTDYQQRIVPCLVKLFSSTDRTTRVKLLERIDEFSSHLRPQVVNRTTRVKLLERIDEFSSHLRPQVVNEKIYGNLITGFMDSNSAVRESTVKAEKIYGNLITGFMDSNSAVRESTVKAIVSFADKLNHSNLNTDLMKHLARLQGSDPEPSIRTNTTSDPEPSIRTNTTICLGKIGCFIXPSRIISAFICLGKIGCFIXPSRIISAFTRAL

SEQ ID NO: 146490 - protein, 447 aa, Heterodera glycines
  Coding regions on vcDNA: vcDNA=SeqID_72913; Strand=+; Position=1 -120,168-341,426-677,885-1161,1754-2029,2075-2317
  Homolog annotation: Hit_ID=NP_491750.2; Match level="QueryCoverage =62%, HitCoverage=29%, E-value=2e-23, Identity=31%"; Hit description =phosphatidylinositol glycan (1G638) [Caenorhabditis elegans]
MTQTGDHGGDSPAEITTALLVYAKGLNILTNLSDILTVHQVDIVPTLSLLLGVPIPFSSIGLAIDSLLPQNSLHELRLNSFQLIRYAQQYFHHYPPMQVKLRYIIRQYETAADDFHSNLFVIKSIQKLLRLSLDQFHFSVCVVGLISLLESVLFNGFLLLDNADEWISIRLWVFRSALLFLQLSLVFAAEPSVDTVFFSVTSLAVSLCSQTVVLSYKIFAAVTNKYSPFPSSPCLTLFANFVLSLLPLSNSFVIYESDVLRFSLQSVICVLLLYRLIESASTDFVVSLGNIRLIESVSLRLAQFVYFAFFVHLLAFRWLSVSASAWVWPHFHALAVPLVMLSGYSYGQIISVIVFAFAVSDPLTSSESVWTGAFLLHLIALLSFYATGHHQTLNSIPWHAAFVGLPGNFPFKWLSALLIFFNMFSGKMLASLLAFTREREDTIKGPL

SEQ ID NO: 146491 - protein, 298 aa, Heterodera glycines
  Coding regions on vcDNA: vcDNA=SeqID_72914; Strand=-; Position=1 -104,157-328,430-502,549-593,648-745,1548-1667,1741-1937,2119-2205
QANGLVVRKRPEYLLMYNPKYGLSILLPKYANVQSACEFDEKFSLGEFYSCAFIRVAEREARRLTYEWMCKGDFKLHEPMLKTRLIMDRFVHVHVNCEFTKEKITKLHGDHYVLKTDLGNVRFGKEFLTHNDLYDKSANVWVTFVKETEGCHWEIVQDSWGSLLDDEPPPQMLTTSQPEQSVVAQQQNLQNQLVEQLRSKLYCQAGYVDFLFGSEVCDGLGGERTAAQRYGMANDSDGDGESDSDDFRQVDNWDDSASTTDDGIDADLNNDSEYDSDAEEKRMRIIGGASPPRPRHFQ

SEQ ID NO: 146492 - protein, 242 aa, Heterodera glycines
  Coding regions on vcDNA: vcDNA=SeqID_72915; Strand=-; Position=1 -78,593-868,1186-1558
MSIFTDEYKCRWMAFAMEKQNDVYQKVVNVLGVTIGNEQDEKVSVIATSYGIARQPKRLELGTWVEATIQVESDEQAVRTLAYDSFMHEHTYRVLYSKKISPPMSTRVVNKSGAEKLLLCGDVKCVVNCLRNDYLGRVEDTKQHIRTKPGESYLVEIGINRQPENRRNCFWNVLKSHGKSVKSVHKVPLQVITFFVFGFSQFHLFYPFKLSIYSVEDGKTCDDAHRILIDQVFDARDNTWDT

SEQ ID NO: 146493 - protein, 138 aa, Heterodera glycines
  Coding regions on vcDNA: vcDNA=SeqID_72916; Strand=-; Position=1-414
MSLFGRLAEFALSSNSDAIKRPPLANASDLLNSPTTSSSSVDGHKCQIMNNKKSTISWPMPNGAVVDQNVPSVPATVISPSKISKRYRQLKRQCANTGKLFIDTEFPPDNTTLFITDENGDGSAERAAELEIEWKRPG

SEQ ID NO: 146494 - protein, 34 aa, Heterodera glycines
  Coding regions on vcDNA: vcDNA=SeqID_72917; Strand=-; Position=1-101
KSAKGMNGRKVFDFRNSYIYGEFLSISLVSYFLS

SEQ ID NO: 146495 - protein, 32 aa, Heterodera glycines
  Coding regions on vcDNA: vcDNA=SeqID_72918; Strand=+; Position=1 -31,794-861
MEDKSEGTPYKANNSIKFRRRQLKMDSNTKIS

SEQ ID NO: 146496 - protein, 44 aa, Heterodera glycines
  Coding regions on vcDNA: vcDNA=SeqID_72919; Strand=-; Position=1 -76,833-891
MHRMYRRRRNRTTKVGEKTLKEKKVGFKGRFSGAYFSEIFWVDS

SEQ ID NO: 146497 - protein, 445 aa, Heterodera glycines
  Coding regions on vcDNA: vcDNA=SeqID_72920; Strand=+; Position=1 -1090,1136-1383
  Homolog annotation: Hit_ID=AAC06263.1; Match level="QueryCoverage =90%, HitCoverage=56%, E-value=6e-47, Identity=32%"; Hit description =pol [Schistosoma mansoni]
MEKVNYLPCPKNSKSGKPSRLSSDFPAMFCFQNLEENIAGKIKNFVEKNNLLPNCQHGFRKAHSVTTQLLEVVDDFSFALENKKSIDVIYFDLAKAFDTVPHNRLISKLKSIGINNSLLKWIQNYLENRKFFVKSGSDFSDEYPCLSGVPQGSILGPLLFLIYIYDLPKFCETENVKIKLFADDLKAYHVLSNISFSPLQNFINKFNQYCKFNGLKIASNKCLTLHLGHKNQKINYFIDDFQIPKNPGNEPVRDLGIYFTNDLKWAQHIDIISKKALRSAFAILKSIKTRDTKILVNLFNIYCRPILEFGSPIFNPYLKKDIEKLENVQKTFLRVIFRRNNYTVDLPNYAELLNIYDQKSLESRKINLQNNESFSFSKNPVKNEFIIRTAYCSTNARYNSFFIRTSRLFRLLPKETRLLNPNEFAKLLERSDLNLLISLPPQLQK

SEQ ID NO: 146498 - protein, 126 aa, Heterodera glycines
  Coding regions on vcDNA: vcDNA=SeqID_72921; Strand=+; Position=1 -114,155-250,571-653,1454-1491
  Homolog annotation: Hit_ID=NP_741816.1; Match level="QueryCoverage =98%, HitCoverage=15%, E-value=5e-29, Identity=54%"; Hit description =g-protein-linked acetylcholine receptor, muscarinic (76.8 kD) (gar -1) [Caenorhabditis elegans] gb|AAL3220
ATSNGECYAPFLANPFVNMGMYLAYYWTTLVAMLILYKGIHKAAKKLEKRSRAREGIHKAAKKLEKRSRAREHRHIALLLTQRLGTQVGVGLMLHAKRYQEEARHEQQTAETDNENGAQQVTEENR

SEQ ID NO: 146499 - protein, 297 aa, Heterodera glycines
  Coding regions on vcDNA: vcDNA=SeqID_72922; Strand=+; Position=1 -203,626-1313
  Homolog annotation: Hit_ID=EAL01802.1; Match level="QueryCoverage =64%, HitCoverage=42%, E-value=6e-25, Identity=32%"; Hit description =hypothetical protein CaO19.4330 [Candida albicans SC5314]
MLLLSFGLIVLLFACANCSTEGGTTEHPSSSPPPATDRNGDKPSPVHPVLKKFTNARDAVKKHVEAAHKVVVPAVNKYFDKYLLPNAKKVGETATRGFRNFRRKFLRPTVNNVVERSHSLGERLASMKKWESSDDEETEKQKDKGGEKEDEEKKKMNGKNDKKEERMKENEHAKRHGEKKEHHAEKEGKEVKKHEEKEEKEEKKHEAKKEHHAEKDGKPKNEVGLGEEKKHETKNEFEEEKVHKEKREHEEKKEQEERKDEEKKKECEENREQEHDNHEAKKESKSDEINSIEEKLN

SEQ ID NO: 146500 - protein, 23 aa, Heterodera glycines
  Coding regions on vcDNA: vcDNA=SeqID_72923; Strand=-; Position=1-73
TRRSRVPEREALSPQQQNSIDNV

SEQ ID NO: 146501 - protein, 59 aa, Heterodera glycines
  Coding regions on vcDNA: vcDNA=SeqID_72924; Strand=-; Position=1-208
VYKLGCPVGYGVHAWLGNIWPSFVILKHTKHYQLSSVAVGKALRAQGRGFAASLEIDVI

SEQ ID NO: 146502 - protein, 115 aa, Heterodera glycines
  Coding regions on vcDNA: vcDNA=SeqID_72925; Strand=-; Position=1 -78,134-403
MIEERPLIECAVIGPTNSGGAEKNAAIFEFRTKEGCTVLKTLTELEQLFEHFRNLLPQGTEKMPKKKFLVPEQKLMEKRKNWAEALVTHLVANHSEKWEKGGGKEKGPIRKGGEI

SEQ ID NO: 146503 - protein, 103 aa, Heterodera glycines
  Coding regions on vcDNA: vcDNA=SeqID_72926; Strand=-; Position=1 -64,110-210,257-555
AETEETKAIDSLGTQSFCGPKIPSNELRSPSKQQRMLSPLKLLFANSQPHPDAVSSNSVGPGGVFFPPPGDSFLSLDPPFEENDPYCPLFMNDQNTSLNSLFG

SEQ ID NO: 146504 - protein, 597 aa, Heterodera glycines
  Coding regions on vcDNA: vcDNA=SeqID_72927; Strand=+; Position=1 -207,346-624,734-976,1339-1737,1899-2565
  Homolog annotation: Hit_ID=XP_453995.1; Match level="QueryCoverage =93%, HitCoverage=31%, E-value=2e-09, Identity=18%"; Hit description =unnamed protein product [Kluyveromyces lactis] emb|CAG99082.1| unnamed protein product [Kluyveromyces lac
PWSIRAKLVPGQHDLLRLVASSRPTSTGDELGGGPSTSSQPEEVPSSSSFSVFADGAQQSSPLKKDNTADPVPSSSPSVKETAAASKNGENSSRMAKISAIFDRQWTEWKRLYHSLADPPPSGQAQTTDSVPHSAAPSPQTNAQATTARSTATTTNASGLTGRNSGGGDGAWDAAGQHQKQQQALPRLVMVEVNGHRMLYPSQFVAVLADELLPIVRRERAPSEQTTKEEEEQADGETEAAAGMSNSASTSTDSCGQTVPKSGHNNALPSSSSVTQRPLFLHRMRRRSAAAIGQCAARCSFEDALLRARGSGVATAVKRELQQQQQQQFQNVQQQQHITGTTTVRTLDEFNYDYARREFCYCRICHGGRRNGGGLAPSSTATTPLATTTAVGLNSPSSTASTTVVAAGGPLTPTAATTAIAAPATAATVLHSPCSCAAHPAAPFHHRHGNDGNYDPYSSPATQQYIQAVHDEPQHAHKTSSSSLKKAVPSLATGKRASSKFNGTTKSGTDDAAHNTHQQHSSSQQQQQQNRWARGCATNAATSSSSTTSATEWPTVPEWDLLKTGSVLANRRKTQQQLLALSKTKEGGQQHEIAATT

SEQ ID NO: 146505 - protein, 259 aa, Heterodera glycines
  Coding regions on vcDNA: vcDNA=SeqID_72928; Strand=-; Position=1 -93,854-1115,1159-1319,1374-1506,1841-1971
MCSLGVKRGSINGCSEQNKSAGESDSERHLEQKVLDPLEVFGPPPPLPSTEPPPLNDELVSAFNRFSADHVGTSSTTKAKEQQPILQSVSFVSMASGGTLGDGRPNRRSASSSSSTTSDEEDICLAAQRSKIRQMQIRPLNDSQQPKLNASVDELRTAIGQISLPKCKGSESDPWGGGPTQSVTTQLPSGFFSNSHQEGPIRAALTGDEHLRRKYHGIFKKNLIAVEPALNKSIEYYIAKELVRIGIRTHTQVGTGTGH

SEQ ID NO: 146506 - protein, 284 aa, Heterodera glycines
  misc_feature (5)..(5): Xaa can be any naturally occurring amino acid
  Coding regions on vcDNA: vcDNA=SeqID_72929; Strand=-; Position=1 -159,203-281,382-536,750-854,927-1053,1105-1217
  Homolog annotation: Hit_ID=NP_493947.1; Match level="QueryCoverage =98%, HitCoverage=24%, E-value=5e-40, Identity=34%"; Hit description =antennal specific membrane protein AMP like (108.5 kD) (2B609) [Caenorhabditis elegans] gb|AAD47126.1| Hy
QMNAXGDKHIGYSVLYENMKKGEESVHELLTFLKERVNMEDDLFKSLGKSLHRVNGYISNKSGFVDAWKLAKETLELWRVNGYISNKSGFVDAWKLAKETLELWTEIQSSTIQSSTLRNLNDLLKEVARYQEELARMRKRAKDADTLETINLMQTTTTCLQKARDTFNQRSTEVVSLKQSNKEWTAASTKEYLRVLTAHEEAHEEYKQYMDKYSQIRDTFEERVNQAARSFQEHDRLHLLQMKSFFTQFFTQMAKCLENAHGANAQVSATLRQRVEHINVEQMM

SEQ ID NO: 146507 - protein, 316 aa, Heterodera glycines
  Coding regions on vcDNA: vcDNA=SeqID_72930; Strand=-; Position=1 -157,216-509,579-617,665-888,933-1068
  Homolog annotation: Hit_ID=CAE59703.1; Match level="QueryCoverage =97%, HitCoverage=52%, E-value=1e-102, Identity=61%"; Hit description= Hypothetical protein CBG03134 [Caenorhabditis briggsae]
FSWIFPMGFGRIQGKYIYEHGSKFGKRVQSNMGAKNHGVILPDANREHTLNQVAAAAFVAAAAFGAAGQRCMALSTAIFVGDARGWVSDLVERARKLRVGPGWEAGTDIGPVISQKAKERICELVESALEEGADVPLDGTNVTVKGFEKGNFVGPTVITGVVITGVKPEMLCYKEEIFGPVLCVLETETLEEIFGPVLCVLETETLDEAMDLINKNPYGNGTALFTRSGIAAHRFVSEIDVGQVGINVPIPVPLPMFSFTGSRGSFLGDANFLGDANFYGKAGLNFYTQIRTVTQLWRSEDASTEAKPQLSFPQFK

SEQ ID NO: 146508 - protein, 633 aa, Heterodera glycines
  Coding regions on vcDNA: vcDNA=SeqID_72931; Strand=-; Position=1 -83,144-413,775-967,1052-1261,1316-1465,1511-1634,1677-1795,1855 -2044,2090-2247,2293-2696
  Homolog annotation: Hit_ID=CAE66001.1; Match level="QueryCoverage =85%, HitCoverage=76%, E-value=4e-96, Identity=44%"; Hit description =Hypothetical protein CBG11192 [Caenorhabditis briggsae]
MEPPAVTSCGVGGHSASGLNDGTGGLQKRDLSTVAGFIQIDPQISFNTTSRHFEELPENFLETISPQQGHSSVGHHQLIAGLGGLHHESGGNVSHVTTTPQLASLTTVSMAGTADGNSFGNGPAGLLSPLHLEGTRRGDPEGSLGLLSSVSVSHLHRPNGGSRTSDLLNGIRRSSNNVAYIKEEINPSNELGGYHSAASVSHHHEAYGDAGPYTLQGPTAQELERMANAETPPALSNVEITSSILASLSRESPSPNIQQQSPHQPTHFIVHQMSRQPQQLEHQIVQRHPITSTPSTTARRSKVKQQSLSQNLGQNSQNSDQQIILASNGSGTQSGYGPMGPGAGIPRTTYSTTDTTDPLNAEIDDEIYIDTKDLCKRVAYELKQHSIPQAIFAERILCRSQGTLSDLLRNPKPWNRLKSGRETFRRMFNWLQQPLHIRLSILDMYKGPMASGVIPPPTPAQNSRHHHRNRRTSDTNEEGNPPQKRPRLVFTDIQKRTLQAIFKETQRPSREMQQTIAEHLRLDMSTVSNFFMNARRRSRNGNGMGDEPAPYQQVNCDFIKEKLPNNLKDEITQQFPSMENGPMLDLTMGGNNNAFGYFPTNGVFNHNINENNDQLLASIYGQHAINMASQYGQ

SEQ ID NO: 146509 - protein, 99 aa, Heterodera glycines
  Coding regions on vcDNA: vcDNA=SeqID_72932; Strand=-; Position=1 -195,355-469
  Homolog annotation: Hit_ID=NP_496505.1; Match level="QueryCoverage =70%, HitCoverage=13%, E-value=9e-14, Identity=54%"; Hit description =ALDH6A3, ALdehyde deHydrogenase (56.5 kD) (alh-8) [Caenorhabditis elegans] emb|CAA88946.1| Hypothetical p
MRLAISPSIKLNIVGKTVVPFFGSVVHCPSWSVRFVSTVPNWIHGQRVESKTKEWIELTNPATNEVVCLVPESTLDEMQLSVHSCKKAFLTWRHSSVVT

SEQ ID NO: 146510 - protein, 62 aa, Heterodera glycines
  Coding regions on vcDNA: vcDNA=SeqID_72933; Strand=+; Position=1-187
MPAFLAQQLVRLSDQTIAGLRLFPVDERHVSVNSEESNAGTLLRLLPDKFRENVLSIQPDDS

SEQ ID NO: 146511 - protein, 40 aa, Heterodera glycines
  Coding regions on vcDNA: vcDNA=SeqID_72934; Strand=+; Position=1-123
KILVDNDKTYPPCLIRPNRPIQWFLDEEAVKEMAAAMNVA

SEQ ID NO: 146512 - protein, 155 aa, Heterodera glycines
  Coding regions on vcDNA: vcDNA=SeqID_72935; Strand=+; Position=1 -119,306-367,435-543,587-714,767-816
  Homolog annotation: Hit_ID=CAE70599.1; Match level="QueryCoverage =74%, HitCoverage=35%, E-value=6e-41, Identity=68%"; Hit description =Hypothetical protein CBG17273 [Caenorhabditis briggsae]
MTFTFIKFFYARPRPHSQTGRIKTTLGSVDLSRPGATLFRKGIFSPELTVERLWKAKHLYESAYHPMSDQKMLPFGRMCAQVPCNMVLIGGMLSFYKSPLAVVFWQWTNQSFNAVVNYTNRSGDSVSTDQLLKAYACATGGALTAALGLNAAAKV

SEQ ID NO: 146513 - protein, 219 aa, Heterodera glycines
  Coding regions on vcDNA: vcDNA=SeqID_72936; Strand=-; Position=1 -162,484-577,637-678,733-867,1040-1265
MAYISVVGGGLFRFFCSVRNNLCSSRSGCAFLTLVSRSCAQQAIRKMHHSQIFENSQLLTASGTETLANLVTLLQQPNVISLLEAARVIQSAQNVTSSADLLLKMDQNRQQNLFKMPTLLPPNLNQGALLGLSQGLLLQQSAVGASPLGHSALNLSVPSAIHSVLPTTPPNLPIISPSCSIVSRMTPANPSYPIDKYNRGPDGCNLFIYHLPQDFADTD

SEQ ID NO: 146514 - protein, 200 aa, Heterodera glycines
  Coding regions on vcDNA: vcDNA=SeqID_72937; Strand=+; Position=1 -272,508-838
MAYLSWTTTTLKTTTMLLNLTLFCQCVHSLVIHPRLCSTSAAVAARQIGAGPERTAVEDEQLQHLLDISNSRNSNTKRMRWYGAEAKQMLRHLDEIRLRTETAQQRKAVAKVGKVSLLDKLFALFTDKPDDEGPKHDCFFSAFNCPVNPARNIPGVRRVRITADERQKLLAAKQRAATIGSSGGGITERHWRRPRHHHHQ

SEQ ID NO: 146515 - protein, 259 aa, Heterodera glycines
  misc_feature (258)..(258): Xaa can be any naturally occurring amino acid
  Coding regions on vcDNA: vcDNA=SeqID_72938; Strand=+; Position=1 -69,941-1565,1607-1658
  Homolog annotation: Hit_ID=AAC06264.1; Match level="QueryCoverage =83%, HitCoverage=31%, E-value=5e-43, Identity=45%"; Hit description =pol [Schistosoma mansoni]
FRNKLQKRHNPQRADKECHSYVLKNCKENLVRPLFHIFSFSLMTAKIPEIWKKSIICPVPKIQNPVNPVDFRPISLLCSVSKILEENIAGKIKNFVEKNNLLPNCQHGFRKAHSVTTQLLEVVDDFSFALENRKSIDVIYFDLAKAFDTVPHNRLISKLQNIGINNSLLKWIQNYLENRKFFVKIGSYFSDEYPCLSGVPQGSILGPLLFLIYIYDLPKFCETENVKIKRDRKLFIILSKMDDRKLFIILSKMDQILXY

SEQ ID NO: 146516 - protein, 158 aa, Heterodera glycines
  Coding regions on vcDNA: vcDNA=SeqID_72939; Strand=+; Position=1 -59,364-589,903-1094
MKIGVKGKQLRNYHKYILSNTGFYRVPRAGLKFGPFSEPGDKGYCRGYQKKKMGAYCKHFPLTIKFNGGELEAFCATTDQSKNFMADAYALGLRRTGRDRDPAGFLRDPAGFLRDPDLGIRPERFFKFIGIDWDRDFIGIPNLDPSRPFYQSRGIPRD

SEQ ID NO: 146517 - protein, 151 aa, Heterodera glycines
  Coding regions on vcDNA: vcDNA=SeqID_72940; Strand=+; Position=1 -155,737-1037
MFEIDRDRDSVGIQSGSRLGIPPTPVVRSLICPMPKNSLIIFLSINNSLKISVIAFLKNPSYLAQQHEKKLLGVELFSRMLCLPYANKELATWDEAMRFYGRTQFGKLIANLITILIERAHGPDPFQISLSEHFVLAELPFIRPLIKVKNS

SEQ ID NO: 146518 - protein, 159 aa, Heterodera glycines
  Coding regions on vcDNA: vcDNA=SeqID_72941; Strand=-; Position=1 -3,141-617
MFYFIFLFLVSLIFELFLLTPGLPFKIDRIFRESRQCSRKSFGLPSRLAHIFYGSLIKEKIRKKKLCLGKTRMKKRKDMDRLANDEQVRLFGLNCESETIKGICNICLLAVFASADSGQVFLGPQIRVLRVFLIFAEFRVFPNYPINHVVKNGNEGFVK

SEQ ID NO: 146519 - protein, 71 aa, Heterodera glycines
  Coding regions on vcDNA: vcDNA=SeqID_72942; Strand=+; Position=1 -18,212-408
MAYATEPVSARFADHAAILGLWPQGQCVYLLPLSEDGTAGPHGEHYAGVRPAARQTVADAQRTPCGLVVQT

SEQ ID NO: 146520 - protein, 184 aa, Heterodera glycines
  Coding regions on vcDNA: vcDNA=SeqID_72943; Strand=+; Position=1 -102,473-550,679-786,1254-1520
  Homolog annotation: Hit_ID=O02623; Match level="QueryCoverage=70%, HitCoverage=43%, E-value=3e-20, Identity=36%"; Hit description =[Pyruvate dehydrogenase [lipoamide]] kinase, mitochondrial precursor (Pyruvate dehydrogenase kinase) gb|AAB525
MLDLRCFNTRIPDQQISVPLVPLHLYYIVFELLKNSMRATIEHHHRVKGFDADSSDDLAEISDRGGGVPSAKLANLFHYLYSTAPKPSRDDSNTPFAVPSQACELLPVYGASSRRFITMAREAPDYCFQKPTAITAPALDSTTSADISAVPVKAVKPKLVPETTTTKTKSISSSSSGKAERVAI

SEQ ID NO: 146521 - protein, 42 aa, Heterodera glycines
  Coding regions on vcDNA: vcDNA=SeqID_72944; Strand=+; Position=1 -73,413-468
MRLARLRQSQLAAKREFERNMQMKANNAAQSPASNCFDRAPW

SEQ ID NO: 146522 - protein, 163 aa, Heterodera glycines
  Coding regions on vcDNA: vcDNA=SeqID_72945; Strand=+; Position=1 -64,163-272,513-622,926-1043,1120-1209
MPQIFENLCHCCVSIVNKTIPKHDPSKSAAKAPKYEPKIDRNNTPVDYDGKEKKCKVEANIDVMSEELKNILKEKGADKRDINAAEDGCGLKEYAWHSTVVVAIMLPKSTASKKRSQPKTSTTWTSSTSMASCTHNVEKTGIVGHFRQLLAIFRPNFGNVLRQ

SEQ ID NO: 146523 - protein, 339 aa, Heterodera glycines
  Coding regions on vcDNA: vcDNA=SeqID_72946; Strand=-; Position=1 -95,394-449,648-948,1038-1194,1238-1334,1390-1615,1663-1750
MKKANKNVFCGVFFQKNFLKQFLDFELILRKKYIHIICAFRKLIMAISMFGQFTDFQKSFLKLEKQAVLPFPIRSFRGSVNILLAFYSLSEMLNLSGNFISVYTVFSGHYFMPFQMLYRLSLIPFIGASCAMILMFFTGVERLFIVLFPLKKFNQKLFLGIALTFNLIAIFVIASSTKYFDQKTNSLEVFANYYEIGSLICKLEQSFILSLSGLITVIISVSVYALIAVALQCQKVPSISNSTQLTNQRIFRSLFTIVVVNIGGYLIVFLNNLVIVPIFGNNLLAWHATQIGGILMHISASSNGPILYWRNLEYRKAFHKEFAFVLKIFCKRSSAVVPQ

SEQ ID NO: 146524 - protein, 133 aa, Heterodera glycines
  Coding regions on vcDNA: vcDNA=SeqID_72947; Strand=+; Position=1 -79,327-583,666-731
  Homolog annotation: Hit_ID=NP_496279.1; Match level="QueryCoverage =99%, HitCoverage=88%, E-value=2e-36, Identity=50%"; Hit description =gene producing two messages overlaping 3' 5', encoding DNA-directed RNA polymerase subunit K/omega and a
ALWDRYRAMFALRNLNNDRATKALADEIFNFVYNYSPLSQGLLCDDSSALFRHEVAYVLGQIQSPVAIPALSARLQMHGENGMVRHECAEALGSIATDECQRLLRQFVGDEERVVRESCEVALDIAELNRTDE

SEQ ID NO: 146525 - protein, 89 aa, Heterodera glycines
  Coding regions on vcDNA: vcDNA=SeqID_72948; Strand=+; Position=1 -156,663-778
RIYGGRCRKIVQSAQQSDERIECQKENAGVLRKTIGHVARMRLALPSANARRIENNERLRMDKGGKDAEEKAFDGHCRNGKQTNDGIHF

SEQ ID NO: 146526 - protein, 41 aa, Heterodera glycines
  Coding regions on vcDNA: vcDNA=SeqID_72949; Strand=+; Position=1-125
YEIHFQFFDSVRRFDKDGFRFAISRSTFGNWSRIFSAITCN

SEQ ID NO: 146527 - protein, 66 aa, Heterodera glycines
  Coding regions on vcDNA: vcDNA=SeqID_72950; Strand=-; Position=1-200
METEPIESTAETAEPNVVDTDQHGNAELRERFLRFLQLLPGRSVDVKLYGDIQVGGKFVAAEPSSF

SEQ ID NO: 146528 - protein, 112 aa, Heterodera glycines
  Coding regions on vcDNA: vcDNA=SeqID_72951; Strand=-; Position=1 -178,228-282,345-588
  Homolog annotation: Hit_ID=NP_491624.1; Match level="QueryCoverage =97%, HitCoverage=38%, E-value=4e-26, Identity=49%"; Hit description =ribophorin II (31.1 kD) (1G118) [Caenorhabditis elegans] gb|AAB42275.1| Hypothetical protein M01A10.3 [Ca
MSPKSSHVNYDLLPEISHTFRSPEPRPSVLVSDMFSVLCASPLIILFLLWLRIGINFGKFKFSLSALGFHLGLCAVFGLYVFFWLELNMFQTLKWLAVIGVPTLFLGSRLSF

SEQ ID NO: 146529 - protein, 505 aa, Heterodera glycines
  Coding regions on vcDNA: vcDNA=SeqID_72952; Strand=+; Position=1 -45,115-236,592-715,799-983,1075-1166,1581-1708,1881-1989,2232 -2405,2482-2636,2805-2915,2993-3130,3453-3587
  Homolog annotation: Hit_ID=NP_989577.1; Match level="QueryCoverage =92%, HitCoverage=90%, E-value=3e-80, Identity=40%"; Hit description =transforming growth factor, beta receptor I (activin A receptor type II-like kinase, 53kDa) [Gallus gallu
MTTNCYANAIILRPAEGVASYVGEQYMDVCRPGRGGYCSRVVFLNADGTIREVITSCLKREQLVPRELPFVCQNSTTPQWNKLVNCCKSESFCNDIQFPIELGLRNGFLPESFDGLPSVFLTLLISLVLVLLFALSICVAISCCCFPRKRAVVDRCIGCSKADCEMDSESLCGAPMGQLAEAATFSTGSGSGVPMLAPRTISYQISLQTVIGKGRFGEVTLGEWRGEKVAVKIFESREVASFDRETTIYRDNMLRHQNLLRWISSDTVDTGEGIMHWLVTDYCPNGSLLDHLENNTLNTQQCLQFIRSIAHGIDYLHTSLTGNKNFFKPSIAHRDLKPGNILIKNDWTCCIADLGMCVRLKSDGIIDRPEGGDRGGTARYLAPEFLDKSYSNDSITSYIRMDIYALALVIWEICRVSALDYQVPYQEYELTSTHPSPDAMKQIVCVEGLRPTIPKEWSKTKILTEFTRVIKECWNAMPQSRLTALSIRCTIDRICTEENIIITTT

SEQ ID NO: 146530 - protein, 132 aa, Heterodera glycines
  Coding regions on vcDNA: vcDNA=SeqID_72953; Strand=+; Position=1-3,87- 299,665-847
  Homolog annotation: Hit_ID=NP_113997.1; Match level="QueryCoverage =91%, HitCoverage=8%, E-value=1e-11, Identity=29%"; Hit description =cyclic nucleotide-gated channel beta subunit 1 [Rattus norvegicus] emb|CAA04133.1| cyclic nucleotide-gated
MVETVIQQQFDDQAKLEKRREKRRRQRKRKRMEQQEKEGDDKKEGEKEEEQTEDEADPFDDENYTVKQFEEEAERMRKKRMGTELDEDEREIRHLEAKLRKKGRKKGKKELEEDGDELDELEKAILGGGEND

SEQ ID NO: 146531 - protein, 80 aa, Heterodera glycines
  Coding regions on vcDNA: vcDNA=SeqID_72954; Strand=+; Position=1 -66,268-444
  Homolog annotation: Hit_ID=CAE61596.1; Match level="QueryCoverage =91%, HitCoverage=13%, E-value=1e-22, Identity=65%"; Hit description =Hypothetical protein CBG05511 [Caenorhabditis briggsae]
MFKKFDSADDVVGSQQLKGSVQKSIRAKLVEQYPSIEPYMDAILPKKENFKLVKCKDHLELIADANGTVHFVKVGIFNLK

SEQ ID NO: 146532 - protein, 108 aa, Heterodera glycines
  Coding regions on vcDNA: vcDNA=SeqID_72955; Strand=+; Position=1 -70,267-371,452-505,690-785
  Homolog annotation: Hit_ID=AAH70753.1; Match level="QueryCoverage =95%, HitCoverage=56%, E-value=3e-34, Identity=63%"; Hit description =MGC83767 protein [Xenopus laevis]
DLANYFPTLRLLHKYPFMLPHQQVDKGAIKFVLNGSHIMCPGLTSAGGRLLDDCNEGAVAIMAEGKQHAMGIGQMKLSSANVRSQNVGIAIDNVHFMNDGLWRLTTVQ

SEQ ID NO: 146533 - protein, 123 aa, Heterodera glycines
  Coding regions on vcDNA: vcDNA=SeqID_72956; Strand=-; Position=1 -90,716-786,1598-1808
MAMVGTTTTNSSSDCSSTATRPFVHINVNTVEYAVPSEYQFVDYLGGGNYGNVMMTIGLDFLTYFFFHIMALRLGFSRHFSFSFDGICATLFCWQLHCVRIRWRQPKAGVGPTKTVGPIADQP

SEQ ID NO: 146534 - protein, 248 aa, Heterodera glycines
  Coding regions on vcDNA: vcDNA=SeqID_72957; Strand=-; Position=1-747
  Homolog annotation: Hit_ID=YP_024435.1; Match level="QueryCoverage =50%, HitCoverage=76%, E-value=1e-11, Identity=33%"; Hit description =hypothetical protein KgORF4 [Staphylococcus phage K] gb|AAO47450.1| ORF4 [Staphylococcus phage K]
MNFDEHGQINVMSSEHAYFMLKAAHFGDMASFHHIRHEPTPAAAKRLGRHIMPFVEQKWHVVRFELMCRALRAKFAVEPLRSALRTTGYGQLVEASRDEYWAAGREMHDVGLTATANWLGQNALGEALMIIREEVRTHPPTPNNLVRHYVVAQASAEDYVIVAAAFDHEPFFVRVGNDMLQGLGLQRNLAVGDTLVLVGYYWRAAFEQVAQIGHPTLPGWLHQGQLCVKRRRSRCRMSSWCHLSSCQE

SEQ ID NO: 146535 - protein, 965 aa, Heterodera glycines
  Coding regions on vcDNA: vcDNA=SeqID_72958; Strand=-; Position=1-2898
  Homolog annotation: Hit_ID=CAE74761.1; Match level="QueryCoverage =46%, HitCoverage=39%, E-value=3e-17, Identity=21%"; Hit description =Hypothetical protein CBG22588 [Caenorhabditis briggsae]
RPLLPGDKVLVNGYEYISGKEFLDKSKWIYAGLIQCQAVVTKVTKVRFAKHHEQYGIVVDLTRRGRASEATIGSISVTAYGMVRAMALYERQPLPDTHMASLKKAQIIKLNLAKVPEAWYVGPNYVLPPKSPVRSGMELFADFGTMIPATADLFDRDWLRMDSMGIPVIFPFVPEYTDEEVKIAERIVAAALVAASEYEEMLKLVTQFVGVVRPQWDQNADADGNEEFPKYFWLKFQTKDRKLVKQLVKQWTTDSPVTAKMEFDAKAFAYGQVILIKKSSEKTEEGSDIFFVSVKVRLGHHESDGQISNFRKMVNGEETIIQSVGASVGFSDHADCFGTNEPSRLAEEDSPRGEIMKALLARPGRSGLKVTTQKLIDYGLGQKTAMPSVARLNEEQQQTLALIACDLPLVVLQQAPPGTGKTLTLATAIDLLLSEKNEETVIVATATSNLSVTKMVEETRAVGVSEEHLALFSGTARVRYGEQIQPLERSLLRPRLTQTFLEEVKDKKDVKQFEDYKKHVFNTPLRVREAKVAESYLKYDKRKVIFLTTHMAGRVKGTINCATHLLLDEATQASFTTVVSLACGAPNLKKMMVTGDVRQLGVHLSELQEVLWSGFGLESITDQLLKSPRMEETVLKRCYRSHGSLVECVSFASYVPHGEVLLPVEAVTKARTSLTTSAINLPMAGIPLVLIHSEGRIQMDETSFSLSNVEHRRIAQEVVMILDANLPKSNTIVIICLYLYEKEQLASAMREAREKKMLSRTIEVHTVDSYQAKEADLVIVVTTKTAATADQNPFGSSRISGFFQDSHRATVALSRAREGMFLIADFNTLMGCKVWGRFVEKAKEMVPIFNEEYLRMMESTKIKRVDGILANLNGYSPIPSSGKFTNPTDARNPAGGPVRGRSVGWRAFAPSQIRASHSERPRPSNRGQNSFDQGIFSRQGTQNITRGACFNCKKSGHWSRECPSK

SEQ ID NO: 146536 - protein, 358 aa, Heterodera glycines
  Coding regions on vcDNA: vcDNA=SeqID_72959; Strand=+; Position=1 -366,492-610,725-1012,1375-1678
  Homolog annotation: Hit_ID=CAE74359.1; Match level="QueryCoverage =87%, HitCoverage=98%, E-value=3e-85, Identity=48%"; Hit description =Hypothetical protein CBG22082 [Caenorhabditis briggsae]
MQTPADTTTTIVLREMLVDQQQSDDNSSAPWPSIVTTTDHAHPSLLVFPMGVLTVLALLANTALTVYIVWRRLYHNYVSSQFILHLCLTNIVGLSVLVPLFCVNLWSGNNLWENNHLMCRMQTFMMCSVWTVIHFMTLCIAGVHLLTFARIHYAQLFGLPPGSLCALAWIAAFAVALPSLTNSHIVVYDPALRHCVWGSTDYSYKFLAYMLILCVLIPSILSYFCYIKVLKILYHSPIVFQSIGLYKSRFLVYAFLMGPLYQAPFYIITMSGTWRFGHGSVMPVLAMFLGYAPSMVAPFVYGLSLFQMKEEDMAMTARAHKTMNTATYHHQHQHNQQQQLNNCSNNRGATQEARAQLL

SEQ ID NO: 146537 - protein, 69 aa, Heterodera glycines
  Coding regions on vcDNA: vcDNA=SeqID_72960; Strand=-; Position=1 -64,281-426
MSPVHLYLLGVLSKMQSSNRLASVGEPTLHLPPDSEERRKLIGTRVGDHRNEQLKKRGPEIGSIAYIVQ

SEQ ID NO: 146538 - protein, 112 aa, Heterodera glycines
  Coding regions on vcDNA: vcDNA=SeqID_72961; Strand=-; Position=1 -168,766-936
MFQSLAFFICLNELTNIGSSLALKILFAHPAFPPFNSHFAFGLSLAKSLANDGHDVHMLATIRAEGQKLSNESADKLTMHYKMTKSKPLEMGSGKLENDTTNIGKIKLKIGN

SEQ ID NO: 146539 - protein, 53 aa, Heterodera glycines
  Coding regions on vcDNA: vcDNA=SeqID_72962; Strand=-; Position=1 -105,1011-1067
MQTIRELENQRQKITAMITDSSDLKMGLVISILDWKYIHFIFFAYTFYIKRIA

SEQ ID NO: 146540 - protein, 22 aa, Heterodera glycines
  Coding regions on vcDNA: vcDNA=SeqID_72963; Strand=+; Position=1-68
MMVYPPSELIDILLANSRGGLE

SEQ ID NO: 146541 - protein, 201 aa, Heterodera glycines
  Coding regions on vcDNA: vcDNA=SeqID_72964; Strand=-; Position=1 -442,489-652
MKMEQKEQKEQNDNSAAVDQMGEEMGNDPNDQRKREIIKKFDAIKEKLREKGKYQLKNDTKIEQKIGKLLGTNRSKIYKWKNELNLNKIKRMEKSFYEQKKKEFIGRFAEFKSLYGQRKQKEFVKELGISEFTFWKWKKELVPKYNKTPYSNEEKFKKMKQYFKLKKRNPKIIDKKIAKKLEIGYETLRKWKKKFASISEM

SEQ ID NO: 146542 - protein, 277 aa, Heterodera glycines
  Coding regions on vcDNA: vcDNA=SeqID_72965; Strand=+; Position=1 -177,1134-1303,1480-1687,1732-1942,2115-2182
MAAAAAKQSAAQMEQNATTKSDNAKTEQQQQQQQQKLIGEEAEMIKQLKLADLKFEDLKALPPEVLDESEHQFSSENLPLNVSAFREVPPFANGAALDPPEVAKAALGLKSGKCSPEPTTPIADEQQPIAAANGLMNPLEPPNGVPLPKTAEERKQYKPMPDTEFELLMDAVERIKRDNLAKQQKKSPHLGEELDELEKYRPQDSACREFELEVQRQKPLYDADFAWESRYQIGPDTLLIPTRGARFNARVRDYRLYQGSVSSLNGKDILEIRPSHL

SEQ ID NO: 146543 - protein, 170 aa, Heterodera glycines
  Coding regions on vcDNA: vcDNA=SeqID_72966; Strand=+; Position=1 -124,283-419,463-605,904-1011
MHLLALCRDDPSKRWMLCLQLLPSATIKWQTVSQQQQSPAKVEFPEVSYKQSASTRIYWTDQHGIQSDVQRLQRLLKRTDRSEQFRQELRRIATYATALGYHNFASVFAEVIERRVGGIPEENRVTLQTAAKVLSPIYGIKTIKAENEKFEQCYWVETLIGTGFGHHKCA

SEQ ID NO: 146544 - protein, 285 aa, Heterodera glycines
  misc_feature (260)..(260): Xaa can be any naturally occurring amino acid
  Coding regions on vcDNA: vcDNA=SeqID_72967; Strand=-; Position=1 -134,209-325,379-478,579-712,800-920,978-1120
  Homolog annotation: Hit_ID=NP_500723.1; Match level="QueryCoverage =88%, HitCoverage=89%, E-value=6e-53, Identity=40%"; Hit description =tenascin (4F858) [Caenorhabditis elegans] gb|AAB92018.2| Hypothetical protein C02B10.3 [Caenorhabditis el
VLSIFCFQLPFATAVRNKEIDDEYQRLIPLRNIPQGSTTPKAYFQYGFVGGGLEKCQYGFVGGGLEKCQVWRASEEESHYERYKCKHLKGHFNEEKGKCECKEHWHFNEEKGKCECKEHWKGPICNGGQTKARRDQRFPISCTPNNCQHEGELALGSKHIECICKAPWDGRFCERLACWRMAVAENERRWRNSGEHCRCADNYEGTNCETVVSCQNGELVGGRCQCAEGWKGEVCDRKCQCAEGWKGEVCDRKCIPNQTXGANIFELITIIRLKDKEIIVILFSL

SEQ ID NO: 146545 - protein, 104 aa, Heterodera glycines
  Coding regions on vcDNA: vcDNA=SeqID_72968; Strand=-; Position=1 -36,269-547
MNKIYFHYFKLTRNNPGVLIFINLEVHIQKSIAARNPDFQHQIPVIFVPWNFGFPFRKFLGSRNAIQLITRARVIYGSSPTIWEKKSGNWYQIPRELSIRLKKF

SEQ ID NO: 146546 - protein, 85 aa, Heterodera glycines
  Coding regions on vcDNA: vcDNA=SeqID_72969; Strand=+; Position=1 -139,187-303
MINKIWRTSVPTLSAVPITYKIFLRIRETSNFFQSSESDYETANESDSNESVEVDESQSAQDEYSLNIGGSHGVTRVPGGEQPGP

SEQ ID NO: 146547 - protein, 97 aa, Heterodera glycines
  Coding regions on vcDNA: vcDNA=SeqID_72970; Strand=+; Position=1 -16,276-553
MGKSRDVLMHLALKPSFLLLNNTSVFNHTSSNLKEIKIILLKAYMRFNQQHKTAEAGHNSDGDEEILNNFANRENCEKVMKLAEEYKKSKTLKGYFF

SEQ ID NO: 146548 - protein, 23 aa, Heterodera glycines
  Coding regions on vcDNA: vcDNA=SeqID_72971; Strand=+; Position=1-70
MSSNGESDVTLPSKGAFCHVMEK

SEQ ID NO: 146549 - protein, 294 aa, Heterodera glycines
  misc_feature (2)..(2): Xaa can be any naturally occurring amino acid
  misc_feature (7)..(7): Xaa can be any naturally occurring amino acid
  misc_feature (49)..(49): Xaa can be any naturally occurring amino acid
  Coding regions on vcDNA: vcDNA=SeqID_72972; Strand=+; Position=1 -153,201-352,407-559,627-820,870-947
  Homolog annotation: Hit_ID=CAE59500.1; Match level="QueryCoverage =86%, HitCoverage=46%, E-value=7e-50, Identity=45%"; Hit description =Hypothetical protein CBG02886 [Caenorhabditis briggsae]
IXEKNKXNMSIVRYDRSLHSATSNAVFDHNPAAFQSQPPRPTQQFNVSXKYILDHHPNSVPPMLLELILDHHPNSVPPMLLELISFLRVHGLKTEGIFRRYAPVTNIKELQHRINMGESIDFSNDESIDFSNDLMFHGDIQSSVTHAAVLFKTFLRSLGEPLITNKLYPELTLLNGIEKINRTDEIRRFVIEKINRTDEIRRFVHKLPPENYLLLLKVIEFLVEVAQHSHQNLMDANNLSVVFGPNLTWPTDQQVPMVQLNNLNSFCYVPMVQLNNLNSFCYSLIKDFDEIFVD

SEQ ID NO: 146550 - protein, 56 aa, Heterodera glycines
  Coding regions on vcDNA: vcDNA=SeqID_72973; Strand=-; Position=1-235
LMMMMRSVCSFGHQFQLKCPDIKLLGSAEFEKESDDGRPMASVDGPSDRLPKLTKL

SEQ ID NO: 146551 - protein, 348 aa, Heterodera glycines
  Coding regions on vcDNA: vcDNA=SeqID_72974; Strand=+; Position=1 -219,345-620,912-971,1023-1260,1311-1520,1569-1612
  Homolog annotation: Hit_ID=CAE59280.1; Match level="QueryCoverage =99%, HitCoverage=37%, E-value=2e-40, Identity=38%"; Hit description =Hypothetical protein CBG02612 [Caenorhabditis briggsae]
MQNLGQRASALFSDATTEQLLSAGDGALVRDALHRLGLKDIPQKALPSDEIGLPLLSSGYLVAARDLTILDIPGMTYGKVLGYAGPSLIFHRSDHQPSLNQDNNNDDQNVPSDQLLPVEVRRRRDGLPETTQQHRFEVEPFFQQLATKRLGQVLLYVPVCGTTMEHITAVSVASAVSKLLKDEIPDFPIRLKWPNDIYYERSYKLGGLVVQVSHCGPNYCCTVGVGLNVANAKPTICINDMLPMHSNRQLTVEEVLAGTMNEFEYFVNVFEKKGRAEFLKSYYRFWMHSHEEVQVLHTENGGRREKVVIRGLDEYGYLEVRSKETGQIMNVMDDGNTFDLFHGLIVPK

SEQ ID NO: 146552 - protein, 94 aa, Heterodera glycines
  Coding regions on vcDNA: vcDNA=SeqID_72975; Strand=+; Position=1 -115,229-398
MVNLALLMLLFRQRSLSIPSGGYGASAAFSCQDTAWNCFQFAPMCAYSLRMVYLCPRTCGLCPSLGFGTAMFGNGMQTQIALANALGSSAIGKK

SEQ ID NO: 146553 - protein, 133 aa, Heterodera glycines
  Coding regions on vcDNA: vcDNA=SeqID_72976; Strand=+; Position=1 -268,379-512
SSLFSPPPFSLFLWHFPLPLRPISFRPYVFFSFFNYSFSPSPFSACIGDQCPPTCPGVCTCVGRRDCCTDRNAGGGGDGIAVDLISGGGASLPRLLLALLLGTGRPGLPSLQLALCRDNALNCPLFLSYCQLP

SEQ ID NO: 146554 - protein, 71 aa, Heterodera glycines
  Coding regions on vcDNA: vcDNA=SeqID_72977; Strand=-; Position=1-216
MPKGKCQREKRVPKTNSNPPPDIKSTAMPSPPPPAFRSVQQSLLPTHVQTPGQVGGHWSPMQAEKGEGENE

SEQ ID NO: 146555 - protein, 105 aa, Heterodera glycines
  Coding regions on vcDNA: vcDNA=SeqID_72978; Strand=-; Position=1 -167,240-390
  Homolog annotation: Hit_ID=NP_508019.1; Match level="QueryCoverage =75%, HitCoverage=17%, E-value=5e-17, Identity=49%"; Hit description =putative protein family member (5V297) [Caenorhabditis elegans] emb|CAB07409.1| Hypothetical protein T03D
MPSSHFVHFAQSVVPSNVEKSKRRLQQQAEQQFGTFYNVICGTGFFSYIAHTDEFCLMAVHDMNCYVFSPVCASGQMPTEEKEKRKSARVFNANSSRRRRRRRST

SEQ ID NO: 146556 - protein, 484 aa, Heterodera glycines
  Coding regions on vcDNA: vcDNA=SeqID_72979; Strand=+; Position=1-1452
  Homolog annotation: Hit_ID=NP_001002887.1; Match level="QueryCoverage= 99%, HitCoverage=23%, E-value=4e-39, Identity=29%"; Hit description =paternally expressed gene 3 [Bos taurus] gb|AAR97556.1| paternally expressed gene 3 [Bos taurus]
ASEEEAQKKTTTTTSDSTKGKKEEKPTRTSETDTAAQKKPTVTSSKASEEEAQKEDHDDYIRSDERKEGREAGQNIRDGQGSAEEDHDDYIRCDERKEGREAGQNIRKKDKAAQKKTTTTTSDPTKGKKEEKPAKTSETDKAAQKKPTVTSTKASEEEAQKKTTTTTSDPTKGKKEEKPAKTSETDKAAQKKPTVTSTKASEEEAQKKTTTTTSEATKGKKEEKPAKTSETDKAAQKKTTTTTSDPTKGKKEEKPAKTSETDKAAQKKTTTTTSDPTKGKKEEKPAKTSETDKAAQKKPTVTSTKASEEEAQKKTTTTTSDPTKGKKEEKPAKTSETDAAAQKKPTVTSTKASEEEAQKKTTTTTSDPTKGKKEEKPAKTSETDAAAQKKPTVTSTKASEEEAQKKTTTTTSDPTKGKKEEKPAKTSETDKAAQKKPTVTSTKASEEEAQKKTTTTTSDPTKGKKEEKPAKTSETDEAAQKKTT

SEQ ID NO: 146557 - protein, 197 aa, Heterodera glycines
  Coding regions on vcDNA: vcDNA=SeqID_72980; Strand=+; Position=1-594
  Homolog annotation: Hit_ID=NP_813896.1; Match level="QueryCoverage =90%, HitCoverage=25%, E-value=4e-17, Identity=25%"; Hit description =cell wall surface anchor family protein [Enterococcus faecalis V583] gb|AAO79968.1| cell wall surface anc
MVAFTIIPHLLLFTVFMSIILVILSQCCGCTPSKKKQTATSTKAAKDEAHKKTTTTTSEAMKGKKEEKPAKTSETDKAAQKKTTTTTSEAMKGKKEEKPAKTSETDKAAQKKTTTTTSEAMKGKKEEKPAKTSETDKAAQKKPTVTSTKASEEEAQKKTTTTTSDPTKGKKEEKPAKTSETDAAVETDERSKYFKKM

SEQ ID NO: 146558 - protein, 394 aa, Heterodera glycines
  Coding regions on vcDNA: vcDNA=SeqID_72981; Strand=+; Position=1 -217,256-831,879-1153
  Homolog annotation: Hit_ID=NP_502797.1; Match level="QueryCoverage =98%, HitCoverage=97%, E-value=3e-44, Identity=30%"; Hit description =HASI (4P602) [Caenorhabditis elegans] emb|CAB16520.1| Hypothetical protein Y57G11C.19 [Caenorhabditis ele
MDEKINKIYTDPANPGGFAGASALYAAVKKKHPKLKRTDFDDFLQRNTTYTLFKPKREKFRRLRTVPGGFMTDVQADLADFQALSRKNSGYRYLLLAVDVDVQADLADFQALSRKNSGYRYLLLAVDVLSRRMFGSPVKSKRPADVKRAFEEVFGQMPKLPETLYTDRGLEFVAKPMQEFFAENGIKKYETSSKKKAAVAERAIRTLKTRLYKYFSAKNTSAWVDVLPKFLSAINNSVCRATGLRPNEISDGVYGEGLVPADKSPKIKAGETVRIPEPKHIFEKGYIPNYSDHVYTVDAARATKYIPNYSDHVYTVDAARATKPQHYLLKDYYGTKMNRKFYLPELTKVQVDENTMYRIEKKYKERMRDGKKEILVKFIGFPEKYWVTDEDFEK

SEQ ID NO: 146559 - protein, 418 aa, Heterodera glycines
  Coding regions on vcDNA: vcDNA=SeqID_72982; Strand=-; Position=1 -286,541-1019,1068-1188,1238-1608
  Homolog annotation: Hit_ID=NP_507780.1; Match level="QueryCoverage =97%, HitCoverage=25%, E-value=1e-27, Identity=28%"; Hit description =predicted CDS, DNA polymerase type B, organellar and viral family member (5T899) [Caenorhabditis elegans]
MFTNYPVGHPKVIQMDKDVNWTAKEHIVDDDGVKMEGIIKCFVVPPRHCLYDIPVIPMRRNNRTLFPLCRKCAEMYPKGLVDPGYNCPHFEDAERANGFPADCAADDIDEEERERRKQQYINNPWKGCTVRLDANNIKPNPGMRYLSKLCLNSLWGRFALRNRLTKTEIIDCHADLAKLLNDVKIDISSIDQLTEKFWMVCYKAKDEHVVEHDTSNVAIALWTTAAARVHLLNSLQLVYRQENLVQRYDTRILYMDTDSIFYDFKTALGDPLKGGNQLGELADEYPNHTIVEFICAGPKAYALWLRNNATGEDEYKLKLRGITLDSNACTRINFEKMKEMVLEKWGTPGNHVRFDYPTKNFRITKQGDILTVPITKQFNPTVNKGVLRDRGLKVVPFGYSSWDYCKAHNPYDCLCKRE

SEQ ID NO: 146560 - protein, 37 aa, Heterodera glycines
  Coding regions on vcDNA: vcDNA=SeqID_72983; Strand=-; Position=1 -8,395-500
MNRHFAVRSEAEMSSLGVEVRTGVPQSAINNDLISFS

SEQ ID NO: 146561 - protein, 86 aa, Heterodera glycines
  Coding regions on vcDNA: vcDNA=SeqID_72984; Strand=+; Position=1 -117,554-697
MPVSGPVWHFQNDRFPGPASEKPVKPEFSLKPPDRFPGPCFYPTEACDNFTIFKQNAETTELNADNETKWIQLNDLPTGEGCLPSM

SEQ ID NO: 146562 - protein, 122 aa, Heterodera glycines
  Coding regions on vcDNA: vcDNA=SeqID_72985; Strand=+; Position=1 -58,111-194,245-471
MEEEIGGPQRSSTPNQNSDDAPSLSLNDDTTPSLNGSGSFLDITADENFNRLIPASSQLEKRDIAIGVLSSQLDVLNSQLEKKDIAIGVLNSQLEKKDIAIGVLSIAVVGMGATIIYLLNRR

SEQ ID NO: 146563 - protein, 310 aa, Heterodera glycines
  Coding regions on vcDNA: vcDNA=SeqID_72986; Strand=+; Position=1 -121,650-1101,1453-1812
MEMQQLRSPPSAFVSGGQFEHIHHVQSSSSTSYDLYYDDQAATQQYSMVSRPMHSSAMNLGGDGQPIQQQLDHHQQQQQMYHQHGHASAETRGFVRRVTAPTAKTPFEEEEEEEEDEDEEEEEKEVQMGGNETKEEMGGGGGSIGRRASAGSGSGRGRRTILLDDSAPLPLPPTMTKGGKIVPDNKHPLQQSSNRGAALDEENKQKVRRRKQEFEKSTTANKPIVGESPSKTSTATAVFGSAGGVKVEVKYDDGTTGNKKGTKTKQQQHQSDGTAPVIEETSPTTKNLMHEQLINLTIHNYSFLHGTLKA

SEQ ID NO: 146564 - protein, 37 aa, Heterodera glycines
  Coding regions on vcDNA: vcDNA=SeqID_72987; Strand=-; Position=1 -22,215-306
MPHIRKLGNFNKSVTDLNKFFVNVMPNFDSDIIITFF

SEQ ID NO: 146565 - protein, 149 aa, Heterodera glycines
  Coding regions on vcDNA: vcDNA=SeqID_72988; Strand=+; Position=1 -141,205-326,805-991
MPPGHMQRPTPQIPLHQQQSQYRGGMMGSSGGAQMGKFGRGMENLFRWKLVPVDDVITLVVSGSKSQSKNVEATRIRGVMEAICLPEISLPISDIDENDYKQHQNETTDHMPKIIPHEMITGQSISTLFLLGKQPVFADALFRHRTLKL

SEQ ID NO: 146566 - protein, 77 aa, Heterodera glycines
  Coding regions on vcDNA: vcDNA=SeqID_72989; Strand=-; Position=1 -142,558-931
FSACDQSSHFGAACSHSRQCPILPMLFSATVFPQMFGIKSLFHPKLTFLADKWPPSLRECASLRRSSTDFCCPKQPK

SEQ ID NO: 146567 - protein, 109 aa, Heterodera glycines
  Coding regions on vcDNA: vcDNA=SeqID_72990; Strand=-; Position=1 -90,1052-1142,1200-1348
MSSSLVDRMKLMLSTGEGADVHFLVGKEKELFKAHKCVMMFASAVFGSMFRFDDKNSKTKTSADCPHVIEVTDVEAEAFKVMLSFIYAEDLSELNGQNAMAVLYAGENV

SEQ ID NO: 146568 - protein, 453 aa, Heterodera glycines
  Coding regions on vcDNA: vcDNA=SeqID_72991; Strand=+; Position=1 -39,345-408,470-598,683-792,878-1030,1093-1231,1519-1851,1912 -2057,2107-2355
  Homolog annotation: Hit_ID=CAH68989.1; Match level="QueryCoverage =50%, HitCoverage=46%, E-value=4e-27, Identity=33%"; Hit description =novel BTB (POZ) domain containing protein [Danio rerio]
MLSTAEDADVYFLCASDVFEAMFRFDSQNGKAENASAVSPIVVPDIEEAVFRVMFNFIYAQDSSGLNGHNAMALLYAAKKYNISGLIKACLDYPIGQLSNVFLAIDHARFLSEHDFALRCLDFIDRNAKILLQSEEFAQIDQNLLCEILESDQLRISDELTIWNNALRWADEKCRQNAIECSAENRRSALGPALFKIRFPLITYEEFTQNIVPSGVLTSEESVGICQFHLPGLLSPVAFPNHARISTWNNTPKGNAGTLALEITKFSRFARRDEGKCRLSNGKVHIKALPWKICAKINTTKNENGTTEKCLGFFLQCTAPRADPKWSCKCSATFRIISQKRGTEHLIGKRNDHIFNNKMNILGFSNFITFSELMDPSRGFYDKDGDKVTLAIDVIVKEEKADKLDYSNPNKTNGKIVMEIGKLTEFSREICLSERSSEIKQIKGLSWKIGTDN

SEQ ID NO: 146569 - protein, 167 aa, Heterodera glycines
  Coding regions on vcDNA: vcDNA=SeqID_72992; Strand=+; Position=1 -210,260-553
MLTDCPALRHVHFCGTLLPEFPPDDSANASDGQVVTKWLFTPHFDNLPKAFNIVKLTVDQWTTIVEQIKAAFSSASSPVNFGISVLFPPSSSLSVVVPFELINEFTQEKLTLSKEDEDEEEAEDPKYFYLIRSPIVPEDQKKQKINEMGGQWNKIDIVATDDEFINR

SEQ ID NO: 146570 - protein, 76 aa, Heterodera glycines
  Coding regions on vcDNA: vcDNA=SeqID_72993; Strand=+; Position=1-228
MSSASSFSPTNSASENSTIRFALPINQAKQLLHCLEQLQIDGGSDGGCAGNSDPLNVHQQRLSGPLFGFKKSAFYL

SEQ ID NO: 146571 - protein, 460 aa, Heterodera glycines
  Coding regions on vcDNA: vcDNA=SeqID_72994; Strand=+; Position=1 -29,303-326,390-426,479-542,593-655,724-887,1213-1358,1574-1609,1715 -1811,1864-1932,2321-2362,2432-2574,2676-2756,3152-3184,3631-3822
  Homolog annotation: Hit_ID=NP_499023.2; Match level="QueryCoverage =99%, HitCoverage=72%, E-value=1e-144, Identity=59%"; Hit description= EATing: abnormal pharyngeal pumping EAT-4, NOse Touch response abnormal NOT-1, putative sodium-dependent
AFRSRSDTWVALVQIAQGLVQGLAYPAMHGGLVQGLAYPAMHGVWCHWAPVWCHWAPPLERSKLATTAFTGSYAGAVFGLSYAGAVFGLPLSALLVSYVHWSMPFYISMPFYIYGVAGVIWSVFWFSMTFEKPAFHPTITVQEKQYIEAQIGPVNQSHPTVRTIPWRAILTSKPVWAIIVANFARSWNFYLLLQNQLTYMRDVLGLRISDSGLIAALPHAVMGCVVLIGGRLADYLRSNKILSTTAVRKLFNCGGFGCEAFGCEALFLLFVAYTKSERTAMIAFIFHFIFSGFAISGFNVNHLDIAPRYAAILFNVNHLDIAPRYAAILMGFSNGIGTLAGLTCPFVVESLTSRNANGWVTVFLLASLIHFTGITFYAVYASGELQEWAEPKPNEEESSTDFHQSTAQNQNGGTAATNPFMPIGATTFTTLGASGNKSFGTAYGGQPQQHAVDDDYYQQQ

SEQ ID NO: 146572 - protein, 98 aa, Heterodera glycines
  Coding regions on vcDNA: vcDNA=SeqID_72995; Strand=-; Position=1 -79,433-650
MPSIILSFCGIPQFFFPFATYPIKVKVQWMYMFWVRQFGTIMTNQHLLLIISFARGKRGPMTNRSIDACDLWAEPTDARPQKAQQQRKARAQNRAEIH

SEQ ID NO: 146573 - protein, 204 aa, Heterodera glycines
  Coding regions on vcDNA: vcDNA=SeqID_72996; Strand=+; Position=1 -95,139-239,306-595,725-853
  Homolog annotation: Hit_ID=NP_494398.1; Match level="QueryCoverage =96%, HitCoverage=80%, E-value=9e-54, Identity=53%"; Hit description =putative protein of eukaryotic origin (2D204) [Caenorhabditis elegans] gb|AAF60412.1| Hypothetical protei
MTGESAYELVLLVKPEVFIYKIPPLTGNKGYKAADWKLDSPDWVGRLRLISIGDKLEIRLEDKTSGELFAKAPIGQLNSVDYESVSDSSRYFVVRLRNDNAQTAFVGIGFADRADSFDLNVAIQDHFKAVKKCDDSAEDNAETVPKLDLSFKEGQTITVNIGKKTITSNNNSSSAVPNLRTSLGGSSAVPLLPPPPASGNKIRK

SEQ ID NO: 146574 - protein, 176 aa, Heterodera glycines
  Coding regions on vcDNA: vcDNA=SeqID_72997; Strand=+; Position=1 -139,190-230,408-478,621-745,1264-1420
  Homolog annotation: Hit_ID=NP_871922.1; Match level="QueryCoverage =67%, HitCoverage=68%, E-value=2e-40, Identity=55%"; Hit description =ubiquitin-conjugating enzymes (2D184) [Caenorhabditis elegans] gb|AAO21404.1| Hypothetical protein Y110A2
FLLFSVAMGGATVTAVTRLKKDYQKLVRDPVPYAIAAPLPSNILEWHYVVTGAPDTPYEDMITPSGRFQTNTRLCLSISDFHPDTWNPSWSVSTIIMGLISFMNENSPTLGALVSTDEEKRVFALNSRHDSSSLTANLLMVRSIQFIISLIFIVKVAGVVILFFAVRYVILNATTV

SEQ ID NO: 146575 - protein, 174 aa, Heterodera glycines
  Coding regions on vcDNA: vcDNA=SeqID_72998; Strand=-; Position=1 -34,545-1035
MEQCQRDFHDEAPIAKRKKTMAFAQNEQFGLQTAETLRQTDAQLLTTKHAFSPTETSADSLFKSVVAAVTAQAPSHQPSTSSSQHQQHQSQLPTQQNLASASIPQPPQQQQSISIIHPQQQLQSQLLTQQSLVSTSPPSPPPQQPSHQHHQCRNSNHHKYANINRGNLSIVKEG

SEQ ID NO: 146576 - protein, 256 aa, Heterodera glycines
  Coding regions on vcDNA: vcDNA=SeqID_72999; Strand=+; Position=1 -49,133-518,636-804,1085-1176,1574-1648
  Homolog annotation: Hit_ID=AAG51656.1; Match level="QueryCoverage =48%, HitCoverage=16%, E-value=1e-12, Identity=39%"; Hit description =hypothetical protein; 92104-88279 [Arabidopsis thaliana] pir||E96636 hypothetical protein T7P1.21 [importe
MPKKQMAIRSGGPPKHPLFPPPVAAAVQLEVGLETPPPPPAAAAASTFTPPTPPPFPTPFHKHFSFLTPSPPPPATVDLDQIPLPPTPPATFSLDFWLPPAPPPPPAATVHLDMNPTSSSKAAAADEIERENRKKRRGNRWNSTQKRQTVRVKKGGVPAKVVPRHPEPDLSDDEYVVKAILAYCEVKSRGVTSKCYYIDWAVRRRMVGVNAAPICRQHFAFHTCVTKDQFDKAERLYKELLVREGLIEDPPSHGAQ

SEQ ID NO: 146577 - protein, 114 aa, Heterodera glycines
  Coding regions on vcDNA: vcDNA=SeqID_73000; Strand=-; Position=1 -332,654-666
MLKVKPTIVSLWDDLVSVERKLLSVLEVAFVERQERIRSLCTSASDLTPGNPNGVQQQQLWATLASQQTMGQGQMPNNGSNHQQQGAGGGTHFASPLLSVDDSGIDMERLSIFI

SEQ ID NO: 146578 - protein, 412 aa, Heterodera glycines
  Coding regions on vcDNA: vcDNA=SeqID_73001; Strand=-; Position=1 -125,317-527,588-688,730-868,926-972,1020-1053,1098-1144,1190 -1220,1290-1359,1406-1474,2701-2730
  Homolog annotation: Hit_ID=CAE59022.1; Match level="QueryCoverage =96%, HitCoverage=20%, E-value=1e-91, Identity=50%"; Hit description =Hypothetical protein CBG02299 [Caenorhabditis briggsae]
VGRQRRGGGHSDAMANKEIQFEYEVDSNRERIVLGRGTYGTVYSARDITTQRSIVVKEVEVKNEEEVQPLMEEIQLHSTLSHDNIVKYLGSVEKREAGSFFLIFMEHVPGGSLSSLIRSSLSSLIRSKWGPLDNEQTMAFYARQILEGLKYLHSQKIVHRDIKGENVLVNQYSGLKYLHSQKIVHRDIKGENVLVNQYSGLCKISDFGTCKRLAGLNPVTDTFKGTLQYMAPEVITGGQRTLQYMAPEVITGGQRGYGPPADIWSFGGYGPPADIWSFGATLIEMVTGKPPFIEATLIEMVTGKPPFIELGLPEAAVLGLPEAAVFKVGMHRIHPPIPTHLSGMHRIHPPIPTHLSESASNFIKSCFNPDPADRSSAAELCFNPDPADRSSAAELLGDPFIQHFLHSTEGGR

SEQ ID NO: 146579 - protein, 185 aa, Heterodera glycines
  misc_feature (178)..(178): Xaa can be any naturally occurring amino acid
  Coding regions on vcDNA: vcDNA=SeqID_73002; Strand=+; Position=1 -27,206-301,378-467,614-676,733-762,818-965
  Homolog annotation: Hit_ID=NP_509897.1; Match level="QueryCoverage =95%, HitCoverage=12%, E-value=1e-54, Identity=64%"; Hit description =guanylyl cyclase (gcy-9) [Caenorhabditis elegans] emb|CAA91488.1| Hypothetical protein ZK455.2 [Caenorhab
KHDAYKVETIGDAYMIVSGVPRENGNAHVQHIAEIALKMRMFVTNFKLFVTNFKLAHKPEEIMMVRIGFHSGPVAAGVVGLAAPRYCLFGDTVNMASRMESTGMANKESTGMANKIQISENSYNLLKCFYIQFVVVEISENSYNLLKCFYIQFVVVERGKVEIKVGEKSERNATMAFXKHLIKLI

SEQ ID NO: 146580 - protein, 232 aa, Heterodera glycines
  Coding regions on vcDNA: vcDNA=SeqID_73003; Strand=-; Position=1 -523,583-758
MNRAFGPLFLLFPILFTSFPICNCMNRENTQTAAKSKNMNAGGTGSEQSAQKELLRLLMTSTDYLQLTPGQQFSTFKWLTDDIASRGGGITDQKQLCAMLHLLRQYEQNIRWDAERVALLERMLAEPEYSELSQEAQWHIYKSLKDGAPAVPNRAENGGQSQQRQQPSLSGQPTEITPMATSGAEWLAQNQKTKKRAKTSQPNFASQKHSSDKGWTNNSINQYLRYDQLQSN

SEQ ID NO: 146581 - protein, 70 aa, Heterodera glycines
  Coding regions on vcDNA: vcDNA=SeqID_73004; Strand=-; Position=1 -114,584-682
MGPSPPLRFVRRSFFTLLVVLVLLQLFVFADWVDDVIEIIEKKIEMHQKKLKKLMLKVVGNATFVSKKRN

SEQ ID NO: 146582 - protein, 572 aa, Heterodera glycines
  Coding regions on vcDNA: vcDNA=SeqID_73005; Strand=-; Position=1 -778,1165-1614,1915-2402
  Homolog annotation: Hit_ID=AAM51140.1; Match level="QueryCoverage =76%, HitCoverage=51%, E-value=1e-20, Identity=28%"; Hit description =SD27140p [Drosophila melanogaster]
MRQWNVEHIEGQSNPADVASRGTSPEDLQTNELWWKGPPFISLKNTQWPQTIREFDPNVWADQNQEVTVCELANPARERNQRKLGSFLTVYVNHFSKWKRIRNTVAYIRRIYKGPLQFVQQIEPIQERKLLKARSETIKRIKPLTAIELREAEEVIIKEMQENFPPDENTRRNLQMFTDDNGILRCKGRIEEGGFDYDTVNPIYLSHQIPILDLLISDAHLETEHGRKSQTLNYLRKKFWIPKCRRMITMVIKKNPYTKYQTKGIRRKEKWSMIMNEREVQELTANKGITWQFASPLAPWRSGFFERLIGLVKHHLYRGLGKKLLDYEELLTYLIQVERIVNERPITYIENDEIMEPLCPIHILNASEGEPFEYQSDTNETENTDDLDSQINQTKRDELLEVHKKTMYKTLTMEDTVSLASMEEEWYEIDEVQPTEQPSSTTTPTALFEDDIYHDDEPAVKVIKAPILILGQGEEDGGVLRNCLINADARQFCHFPEEWDAHLFSKELQIESVQSIIVWRKGATLDDLGFLQTLLTAQQLYNDRLLFWILDAKVSTQRGSLKIQVGVGNRDA

SEQ ID NO: 146583 - protein, 212 aa, Heterodera glycines
  Coding regions on vcDNA: vcDNA=SeqID_73006; Strand=-; Position=1 -126,480-628,866-974,1070-1324
MKIAPYKNIRCEQTGNGANEELENFMDTISDIVVGENITIDSANTNGEHQESEMDHAWRPNQNIVLHDEFQNALALNMDVENNNLEEENSESMGDHHSFANSVQNGQQGAFRLPPIEIFIDGSLPEKTPRIGSIQGINNPAIRSLDHCGGVKRISGLIYEENRTVPIVRENEPTFNEEIGPQDGNVSELSVCATDKSSHGRAPRLELIGSDV

SEQ ID NO: 146584 - protein, 53 aa, Heterodera glycines
  Coding regions on vcDNA: vcDNA=SeqID_73007; Strand=+; Position=1 -78,403-486
MWKLPNAKENKSELQKFFGGGHNGPTSVQCAVVLAPWSGRFHLTFYEDMDDRE

SEQ ID NO: 146585 - protein, 138 aa, Heterodera glycines
  Coding regions on vcDNA: vcDNA=SeqID_73008; Strand=+; Position=1 -80,127-199,863-952,1007-1180
  Homolog annotation: Hit_ID=NP_491890.2; Match level="QueryCoverage =88%, HitCoverage=21%, E-value=1e-32, Identity=53%"; Hit description =trehalase (66.9 kD) (tre-1) [Caenorhabditis elegans] gb|AAB96724.2| Trehalase protein 1 [Caenorhabditis e
MVNRFGFVPAGGRIYYNKRSQPPFLTPLVYEYFGATGDIEFLKEIMPTLEKELLFWQTKRSVKVKVKGTMKMFYQYRADTKLPRPEAFCQDVGLVKNISDPMEKAKIWHEIASASESGWDFSCEKEKRGKMNTIYLLF

SEQ ID NO: 146586 - protein, 71 aa, Heterodera glycines
  Coding regions on vcDNA: vcDNA=SeqID_73009; Strand=-; Position=1 -204,364-375
MFPGEHFPPFLYGGCYLTTPSTIKAVLEQAHKTNSFYLEDVLYTGILAELANVTVSDQLSHFYGNGLQLFI

SEQ ID NO: 146587 - protein, 70 aa, Heterodera glycines
  Coding regions on vcDNA: vcDNA=SeqID_73010; Strand=-; Position=1 -188,584-608
MVRFIRLELNLTELVRRMNLIGYGRDEIMLITLHSADQLNAPDGYTQTCFNQKKAVPTKHLTSFFLNPQN

SEQ ID NO: 146588 - protein, 79 aa, Heterodera glycines
  Coding regions on vcDNA: vcDNA=SeqID_73011; Strand=-; Position=1-240
VSDALSAVEAFPARHCQYEQLGAISARLFKLSPCIQAKVPEMNLEVVANLSTVDDVCHWNEQGKHLPNARDDHALSIGK

SEQ ID NO: 146589 - protein, 165 aa, Heterodera glycines
  Coding regions on vcDNA: vcDNA=SeqID_73012; Strand=+; Position=1 -213,644-838,980-1069
MPALTTPMNGTAKGQQRNFWLPNELIYELLLWVRPSYFWRVRQMLTTSLILCRLLTGGKHAITWHEPYDVWHLESTFSDRKFGPTKVCAYLCRNHSLLLPRNFLNYLHCSEDYVTLYVLIVLDSSKFSSLAQLALARQGFDGRGPCRDTGLCESGSFVYCPDEVR

SEQ ID NO: 146590 - protein, 36 aa, Heterodera glycines
  Coding regions on vcDNA: vcDNA=SeqID_73013; Strand=-; Position=1 -96,260-274
MDEQKYRKKVKKMVTMMMMTAKQFNICQLWQTIASL

SEQ ID NO: 146591 - protein, 792 aa, Heterodera glycines
  Coding regions on vcDNA: vcDNA=SeqID_73014; Strand=-; Position=1-2379
  Homolog annotation: Hit_ID=NP_498959.1; Match level="QueryCoverage =40%, HitCoverage=14%, E-value=6e-43, Identity=33%"; Hit description =zn-finger, CCHC type and RNA-directed DNA polymerase  and Integrase, catalytic domain containing protein
MDILDVGPSQSNKKYICVIVDHFTKYLVAEPIPDKSAESVAKVFVEKFILVYGTPQKIHSDRGKEFLNATMEEISKVLDIKRSFTAGYDPQANGLAERINRIIIGILKKSTASNWTWDERLAYGVFAYNITPSNVTGYSPFLLMFGRNAKFPLDKHVPFPVNPVYTIDSGKYIQLFRENLLNMLEEAQKNSEEAREQSKIWYDSRPKVTANKFQKGEKVMVVFPGQNRRSPHKKLLWSHFGPYLITEIGDSSANLVPIDKKEVTPIKVPIERLVKVPKGVPDISTLPKGKNPFKNDLKLLSMYAGIRSEICEMTGNKCREIGGKSESQLGTIASDCLGGNWKSDSFSEPMDVGSVSAGFGWTSECSGGGSGHELCEKITLGSIDPVLNMSNLGSAVVKTPLQALLSIFLLRTGVASSLTAAQTLVQTIVGAEPKLELCMYTGKRGDQISTGKYPTEEDQRQALEKWVGSCFVARQALTESGYKPLSMQMPEGVNSLPDSEKNKWHEVFKDSSWALERVRATIVHKASRFLAHDRVLLGDSSAEMLAKHINSSYCIGGESSMADLIRQFQPIVLSSRVKALLILAGRDSLMQGETEKSIAAQFEMIVSLCQRFPHVQIFWCPPPYVHAKATECEELITKMHAIITKSPITPIFTTDKGRSVLEIFRFGENFNKHTVSEEGKMCNNGCKMLKAWIFSQTKFPGDQDLKIRTVNSAVVSTSNRADSRMNPTVVVAPNVTARDRVDPCRIGPFPPQNRRGTSTRHHPYAGQWRNTNRYGPPMNRRSDPSDSRPFRR

SEQ ID NO: 146592 - protein, 475 aa, Heterodera glycines
  Coding regions on vcDNA: vcDNA=SeqID_73015; Strand=+; Position=1 -75,117-389,970-1006,1053-1103,1269-1441,1609-1928,2098-2596
MGQKVRLNSVGEEICYDELVGNASDGSFTFNPIQSVFENETEMEFTPTQNYDLGKKVKKRLFTTNFVMSDYLRSLPSMVVNGLFPLLHFAKRLLKSKQPEVIEGITRPRHLVKEFQSVKQPPKDDKRKMKRHGAVEETVQKKTLKKKNAGTPLTPANGPILVGGLPLSTHLHTPSSSGSFNPMGEIVKLGQKPMQSAWRKASNMAKPPPPTHIHQLKKRFDYSSTTTNNNTMDGGGHHNEADNAFDEFATQQKGTEEGGAGQQNATVADDAAFTTQSTSSFGTFCKERKMGSQSDGGNGTFAFTNCHAFGPVSHAFTPSNNNRSNNQWNNGNFGGNSHWNNGKSANGTAANLAETTNGTTANLGGTTHGTAATISGAAEVSVANNRTNRHRRNPPAAPSANSRAHHETTRLGGTTTNGTPATISGAAEGSVTNHHPAEEGSVTNQHRTSSHSNPSAAPSTNCITFLKCLLATNKI

SEQ ID NO: 146593 - protein, 205 aa, Heterodera glycines
  Coding regions on vcDNA: vcDNA=SeqID_73016; Strand=-; Position=1 -261,714-1070
MKISSLATNFSIENLLSKPHTSPTPPPNASDTAPPIVPMPMFLPFPAAMPTPETVPAATIFPPPSSMLWPVHGWQFFTPIATAPGTKQNVKTMTTPPSSSSTTTGTAPTASNDNNHHQQQQKLTAAATASEMDRKTGNEQMPKLAPKMPTNPNNAHGDDDHHDDKEDHHHHLGKIPSNNSAFSSLKKACSATVATQFYGNSKMLF

SEQ ID NO: 146594 - protein, 47 aa, Heterodera glycines
  Coding regions on vcDNA: vcDNA=SeqID_73017; Strand=+; Position=1 -51,346-438
MIGEIGKCHRKMPFFCQLFVTRVDRAYNVNCFYREQRQDVSVDFGVK

SEQ ID NO: 146595 - protein, 55 aa, Heterodera glycines
  Coding regions on vcDNA: vcDNA=SeqID_73018; Strand=-; Position=1-165
  Homolog annotation: Hit_ID=NP_490686.2; Match level="QueryCoverage =100%, HitCoverage=3%, E-value=7e-17, Identity=76%"; Hit description =multidomain oxidase/peroxidase Duox, Multidomain putative peroxidase/NADPH dual oxidase, localised in the
MQSTQNSCPLEMHKIPVERCDPVFDKACEGRTEIPFTRAKYDKTTGHGLNSPREQ

SEQ ID NO: 146596 - protein, 104 aa, Heterodera glycines
  Coding regions on vcDNA: vcDNA=SeqID_73019; Strand=-; Position=1 -199,766-881
MLSIWHKNSSWHVPVDNGPHVGRFWLRGSLPSRHHHRHQGPKKHSVHWKKMFSRYQEWGIGVIREKYVFSFQKYVKTIETKANTNNELDNFINTYCNLQHTNPW

SEQ ID NO: 146597 - protein, 58 aa, Heterodera glycines
  Coding regions on vcDNA: vcDNA=SeqID_73020; Strand=-; Position=1 -82,284-378
MLQIFLTISFLLIIGSAISNGTDEVKRVEISLRALVDDAINWAHHIGMAWRADKKFPR

SEQ ID NO: 146598 - protein, 60 aa, Heterodera glycines
  Coding regions on vcDNA: vcDNA=SeqID_73021; Strand=+; Position=1 -100,263-345
MPFFLIFLLIPFSHSFFLYFLFIMLLQMSTEILFSWSALFLHWSITFAATFCSWIQFDQM

SEQ ID NO: 146599 - protein, 213 aa, Heterodera glycines
  Coding regions on vcDNA: vcDNA=SeqID_73022; Strand=+; Position=1-642
MKLFPLLLLIILFLIDKIGSEKKKLQQKSFGEIFGEKWEEKEEEKRNELKKREIIGKFYKIKEKIKQKGRKYSKKEWGKINLKIAKKLGTNRKYIYEWIKEFGLQKQMHKNYKSKTDEEKLEIVQKFIEITNEYKQKRKKYAEICKKIGVSEFTIMKWKKQFGIRGKITDEEKMGKMKIYWEIKKENPKMSDNQIAKTLRISLNSIIRWKKQF

SEQ ID NO: 146600 - protein, 388 aa, Heterodera glycines
  Coding regions on vcDNA: vcDNA=SeqID_73023; Strand=-; Position=1 -147,425-633,681-725,807-941,1008-1149,1437-1670,1722-1973
  Homolog annotation: Hit_ID=NP_502118.2; Match level="QueryCoverage =100%, HitCoverage=33%, E-value=3e-75, Identity=39%"; Hit description= Gon-Two Like, TRP subfamily (gtl-2) [Caenorhabditis elegans] emb|CAC81666.1| putative TRP homologous cat
MAKFFWQYGEEPMAKALVAIRLYKCMSREAAHDYTEVEVSNQLRECANAFRDWSLELLHNCHQQDSQLTMRLLTAELPNWGHRTCLSLAVIANNKRFLAHPCCQILLAELWHGGLRFRSQSNFKVVLGILFPPSILLLDFKTNSFDNFHSNADTSLEEEEEVYEEEESNSDEEKEEGTDKMSEMSEEREEEQLMEERRRRAGERQQQFVRCQCLGNRKEMQLPMAHCQRRVLCRPTFPICRLLSKFVLFYCAPITSFWTWSISYATFMLALIFVLLIEFPSEVSPVEWFLFVYVLSFAMEHFRKLFVLESSSLIEKLSVFYSRYWNILTTVAVLSFFVGFLFRLNPSTVHTLSRTVLASNSVLWHMKLFDFLSVHPRIGPYITMAGKM

SEQ ID NO: 146601 - protein, 450 aa, Heterodera glycines
  misc_feature (10)..(10): Xaa can be any naturally occurring amino acid
  Coding regions on vcDNA: vcDNA=SeqID_73024; Strand=-; Position=1 -215,337-406,451-532,660-805,854-938,979-1040,1090-1202,1232 -1360,1403-1491
  Homolog annotation: Hit_ID=CAE62037.1; Match level="QueryCoverage =98%, HitCoverage=23%, E-value=5e-75, Identity=38%"; Hit description =Hypothetical protein CBG06053 [Caenorhabditis briggsae]
RRAAGERHSXCEEKSPGVSREGRDDLRENRDLFQRRVRQPPSYAWIERVFQRRDCIKFIPVGDHSDRCHCGRVSASHSQLAFRALPLQLSNEERARWTIGGCTAPNNEERARWTIGGCTAPNPTDAYGVIQFQGGPHVHKARYVRLSFDSEPADVFRLLVREWGLSMPRLVITVHGGMADFEVPERVGKVFREGLLKAAETTGAFEVPERVGKVFREGLLKAAETTGAWVLTAGVDSGVVKHIGRALDEAGISARWVLTAGVDSGVVKHIGRALDEAGISARMRSRIVTVGIAPWGLLQHRERLLMRSRIVTVGIAPWGLLQHRERLLGRNVQVPYDRHSSGSSSGGLVLNDRHSYFLLSSGGLVLNDRHSYFLLADNGTVGRYGADIVLRRRLEEFLASRGGRSNRIPIVSVVLEGGLCTGRSNRIPIVSVVLEGGLCTLNLIHRHLTG

SEQ ID NO: 146602 - protein, 56 aa, Heterodera glycines
  Coding regions on vcDNA: vcDNA=SeqID_73025; Strand=+; Position=1 -83,427-514
MIYRRSPTEEEVPFLHKAMHKLMSMVFWYWVFYTIYWHHQEQFTVRAGTVSTNKFS

SEQ ID NO: 146603 - protein, 44 aa, Heterodera glycines
  Coding regions on vcDNA: vcDNA=SeqID_73026; Strand=+; Position=1-135
GEWYFPYHYEWTDEELGVPPDDAPDPEERQFWGHPGELIGTYRA

SEQ ID NO: 146604 - protein, 110 aa, Heterodera glycines
  Coding regions on vcDNA: vcDNA=SeqID_73027; Strand=+; Position=1 -79,260-378,451-585
MRTSARAFDRVDRGVHSAGGAFGGCGGMSAARRNRQPVSAPTPLILPAMLAGVSLRPTGVNLTVDRAEGQRRADGTDEEPVYDEVPLDTVEQRRDEENGEEDEEEDDSDF

SEQ ID NO: 146605 - protein, 243 aa, Heterodera glycines
  Coding regions on vcDNA: vcDNA=SeqID_73028; Strand=+; Position=1-732
MSDKKALFKRVIAEVDLTISTGGITLSGPRLSVPRFIPFEENGRCRACKGTEAEVDTMVTKEGITLWCTRIEKAQFVPFDIVYELPGHCFFRVKNKARVFSVPYSELPSSDKCAQSLPPPVKHQRTPDDEEEKNLRRKAKVALDLVEAGLAADAMMQDGTRWKKAKTAINVLANLLLAESLTDVSPTFDQQQQQQQQQLSSKEEEKEECINNSSAGAATESAPDGDVMDDFVNSIQAATSNMQ

SEQ ID NO: 146606 - protein, 192 aa, Heterodera glycines
  Coding regions on vcDNA: vcDNA=SeqID_73029; Strand=+; Position=1 -246,626-955
  Homolog annotation: Hit_ID=CAB62280.1; Match level="QueryCoverage =24%, HitCoverage=62%, E-value=9e-10, Identity=64%"; Hit description =hydroxyproline-rich glycoprotein DZ-HRGP [Volvox carteri f. nagariensis]
MERYKRQQQQQQQAKVSQLIKENANWLCALSKAKCVKRCGRLIRKANTDQLLSLVEVCLNIVASRFRLTTRQKKRLMPYVDTMRKEHADRPTKVELTKGIRVLMNRGGEEGEVVDTPRRLLAPPAPPPPPGRPPRRPPPSPPGPGGPSPPTSPPPRPQRSSRPSRTSRRSGRMEQWRKRRYDIQQQRQPPPL

SEQ ID NO: 146607 - protein, 54 aa, Heterodera glycines
  Coding regions on vcDNA: vcDNA=SeqID_73030; Strand=-; Position=1-162
  Homolog annotation: Hit_ID=CAE66281.1; Match level="QueryCoverage =100%, HitCoverage=9%, E-value=1e-11, Identity=60%"; Hit description =Hypothetical protein CBG11527 [Caenorhabditis briggsae]
MKILIIGAGASGLPALKTALEYGLDAVCMEKSLDIGGLWRYKENPGQGEGTVMK

SEQ ID NO: 146608 - protein, 490 aa, Heterodera glycines
  Coding regions on vcDNA: vcDNA=SeqID_73031; Strand=+; Position=1 -106,149-228,283-414,475-552,768-932,978-1062,1112-1162,1268 -1311,1356-1408,1478-1618,1713-1798,1840-1898
  Homolog annotation: Hit_ID=CAE60636.1; Match level="QueryCoverage =93%, HitCoverage=72%, E-value=1e-112, Identity=49%"; Hit description= Hypothetical protein CBG04280 [Caenorhabditis briggsae]
FSFSNSVEYEEANESDEITDPLPGLSFELNFKHFSGFLQVSPTHFLHYWFVTSQFLQVSPTHFLHYWFVTSQKDSSKDPLVFWFNGGPGCSSLDVFWFNGGPGCSSLDGLVNEMGPYLVNPDGQTLRENPFSWNKFASMVYIEAPAGVMVYIEAPAGVGFSYATDGNTTTNDDLTSLENYEAIKQFFAKHPSFRNHSVFITGESYGGVYVPTLTARIVDGQAEFPINLKGMAIGNGYMNANLNIDTSARFAYLKGMAIGNGYMNANLNIDTSARFAYGHGIIDEKIWNELEQRCCRGCIDEKIWNELEQRCCRGCIDGCDLTALKDSCERMVDDIFEFLWHGGLNPYDVDDIFEFLWHGGLNPYDLYRDCDPSPGRNSIRMEYRDCDPSPGRNSIRMEVLKNGLVPPKMLRRFFSNVTRNFRRRLQVFVGKTIEKRIKMVFECLLDTDLTTYMNLPEVRKALNIPDSVGWDIRKALNIPDSVGWDICRLA

SEQ ID NO: 146609 - protein, 114 aa, Heterodera glycines
  Coding regions on vcDNA: vcDNA=SeqID_73032; Strand=-; Position=1-345
MEEMGGGHLQKALRGPIIGKRCQRLARKVLEVQFEAEPGQRVGDFVRFIRFFVFHRIRKTEGIAMVELRTDQDEQQMNQQQTEKHIQRDGGEKRPKERKMANLKEEKTNKYTIA

SEQ ID NO: 146610 - protein, 363 aa, Heterodera glycines
  Coding regions on vcDNA: vcDNA=SeqID_73033; Strand=+; Position=1-8,62- 340,388-814,883-1166,1232-1325
  Homolog annotation: Hit_ID=AAL78214.1; Match level="QueryCoverage =50%, HitCoverage=94%, E-value=2e-09, Identity=27%"; Hit description =putative esophageal gland cell protein Hgg-20 [Heterodera glycines]
MKRWIRNDIWMDIFPHFDRPQLGLKLALLSPRFDELVDKHFDGKTELTIWRPFKIEKIGTEAKIAVETKRKAKIVHFPLPDRPMHNKIRFNRLQIEYIDHSVVTFLRTNQQMFDKGTNLDLYIEAKDVKPIWDVFVRQIWPIFAPNIRHLGFVRDNHFDYLRRLISPSILTDLTHLDSIDAAYLLPTVIADDGPNATDRQALSKWLNIPTKDGKPKQLICCATTTTSGTIELINNFKEAFLHATTPAANYIIQLQLFEPTPIEPFELTNEQTNEKLTVKKEDGDENMEKEDEDDYIVVVKRCQIGATVRWEDKKTNNFSNINFWPLNGKYCIGRMSPPKSGQKNTKNRLKMNPGPSGQQQKKE

SEQ ID NO: 146611 - protein, 84 aa, Heterodera glycines
  Coding regions on vcDNA: vcDNA=SeqID_73034; Strand=-; Position=1-770
TRRAIISSIKIHNDRSEFLISQQFIHSFFCCCPLGPGFIFRRFFVFFWPDFGGDIRLNEIKCLNLIFKAKTVSLIRLTQYSICH

SEQ ID NO: 146612 - protein, 611 aa, Heterodera glycines
  Coding regions on vcDNA: vcDNA=SeqID_73035; Strand=-; Position=1 -189,235-786,1093-1780,1822-2019,2063-2271
  Homolog annotation: Hit_ID=NP_958786.1; Match level="QueryCoverage =87%, HitCoverage=11%, E-value=3e-15, Identity=21%"; Hit description =plectin 1 isoform 11 [Homo sapiens] gb|AAR95684.1| plectin 11 [Homo sapiens]
MPSKFCIFRNQSPSSYALKRLHNYDGVDDNCPNCHRRIASPLSVDAATAPAKDDRSDSSEHSDEPIEPENQQLSEAVDHALNINEEIYTPIKAEYDNTSIAYFAVYNAMIRAKNNCYRNRPTPPPEMLAELRVCSEKEKSLFWDFNASTKRHQYAMEQMLKMKDYLKATAQAKHRQCVKEQLCDSLKEATNNKAPIIREQHCLLIQALEEQLYDIIKQFLLLWHSLQQICPSTATLDSMQDWLQSAELEAAIRKQEEAQNTTDEEQRPRANSIGKKRRNEDKSATCETSVKRRAKAAQAAEQRMQRPILMTAEQAKALEAERIEAQKRMAADRRVQERLRQADQFLKQHLAQQKRLKQRNLVWGRQAAYERYINERLEKLKAEVNALRKSARESMNFTEIDICQLKIIILSNSVKYLVLPTRQAVEAYCADIIRYANHHAEEDVQKAIKEHQQILERRERALDEERQRQKLLSTWRDEDRQWAYREDPVLAAELEKIRQQKEQIDVEYAEEQARLRNIRRAEEDARSRARNELLGLYDSPESEGWSDEDLFYNVRQADRMPIMQEVGVAQMPPEAIRAREVIDRRLNFQEADYVGEMTPANKGDDNRGSRE

SEQ ID NO: 146613 - protein, 319 aa, Heterodera glycines
  Coding regions on vcDNA: vcDNA=SeqID_73036; Strand=-; Position=1 -113,164-761,809-1056
MINCAILRQRKIVATSDKLLIPSSFGTTARIISKPFCCRTRRLLLALRSKSSLRREFPPSIHLFGEEVEAMEIAAPAAAPSAPIPSTSSGIEEKRSTTVTAPSIVTEEEDVFLEESLPKMESCKCCNSAVVPPALEDANVHLKQQFAYYGYISTPCCGDFHLRCFEKWSHLFFKSVQITSIFRNQSPPSYALKRLHNYDGVDDNCPNCHRRIVSTLSDDVATEHAKEERADSSEHSDEPTEPESQQLTEAVDLALNINEELYTPIKVEYDNTSIAYFAVYNAMIRAKNNCYRNRPTPPPEMLAGFEGVLRKGEKPLLGL

SEQ ID NO: 146614 - protein, 152 aa, Heterodera glycines
  Coding regions on vcDNA: vcDNA=SeqID_73037; Strand=+; Position=1 -172,228-371,436-578
MPISKTLPCGNYNHEQFAKLKNEIVNEIKEKFVKNSQFEESERKCFEELKSKLKVLADYSFYAKIEGEYLIGNWTDEKEKEKEKEGPKKVDKFRQILAYLELWAKNNQILDDLMGFLNTKMLLTMLTKIFLLYPNGSMPFLVEKFFLTYSTW

SEQ ID NO: 146615 - protein, 134 aa, Heterodera glycines
  Coding regions on vcDNA: vcDNA=SeqID_73038; Strand=+; Position=1 -222,275-457
MVDRAAGLEWMAQDEALVEIIVPQMLTDERLKAQLEAVKSKYSMKVYENFWRRYFDAFNGGKEKEQFVKDFLKEETESNLTDEERWTDFSESLRKVINGTMEVVLTEKVNGKPNSSNQTGNSQAKVNGQKERHN

SEQ ID NO: 146616 - protein, 78 aa, Heterodera glycines
  Coding regions on vcDNA: vcDNA=SeqID_73039; Strand=+; Position=1-235
PDAALFGILTQFFETPLNVFKGFSKKEGPLYEFTKEVKKTLGFADNSKWEALTKRPWQLNFDTEFIFGFTGDDSSKYN

SEQ ID NO: 146617 - protein, 97 aa, Heterodera glycines
  Coding regions on vcDNA: vcDNA=SeqID_73040; Strand=+; Position=1-546
FIIASALIMFAVCLPMHEKCAAVEAVRQLVCLSSVPNSIGHSALGQTQSLPPFGIPRLHCFGRCLSFGCFSAPSSAVPLFDHLFDFEPWTAACDSFQ

SEQ ID NO: 146618 - protein, 120 aa, Heterodera glycines
  Coding regions on vcDNA: vcDNA=SeqID_73041; Strand=-; Position=1 -106,171-427
MLAVRPPTAAASALAQPLAPNYGINYGQYAFGHPSARPPTSTAFAPAQPLAPNYGTNYGQQPFGLHFGAAPSVTVASVPAQQLAANPNNGLNYGQHQFGRLPGTLSLYLIRDKSITNCRH

SEQ ID NO: 146619 - protein, 37 aa, Heterodera glycines
  Coding regions on vcDNA: vcDNA=SeqID_73042; Strand=-; Position=1-112
RDRLLRHMPFFLRTCFDILSINNAFSTWFEAPTLTFY

SEQ ID NO: 146620 - protein, 180 aa, Heterodera glycines
  Coding regions on vcDNA: vcDNA=SeqID_73043; Strand=-; Position=1 -34,87-206,734-918,1017-1220
  Homolog annotation: Hit_ID=CAE65835.1; Match level="QueryCoverage =90%, HitCoverage=39%, E-value=3e-27, Identity=42%"; Hit description =Hypothetical protein CBG10960 [Caenorhabditis briggsae]
MAPSFHEAIGICKEWKQALFGRGGLLTEIFNFVNDKRKEDLAKKQAAPNLNDKASREFSQILDALLRKAKSGNFDEEPLPEIPFIGICNRLSCADIYKALDQFRKSEFFSNFQTAIALLQDPKGLDMIGELLANPDLIENFSGPESLGEMFGSKMAQKSGTSRVEIGENVVKKSINYIAK

SEQ ID NO: 146621 - protein, 61 aa, Heterodera glycines
  Coding regions on vcDNA: vcDNA=SeqID_73044; Strand=+; Position=1 -88,793-890
MPNLTKMALLNEHTVVSIFQCLAFLTFIVASKIGNDQKGTAHFGAGLFGAVANNFFPVQPN

SEQ ID NO: 146622 - protein, 30 aa, Heterodera glycines; identical to SEQ ID NO: 136834
  Coding regions on vcDNA: vcDNA=SeqID_73045; Strand=-; Position=1-234

SEQ ID NO: 146623 - protein, 96 aa, Heterodera glycines
  Coding regions on vcDNA: vcDNA=SeqID_73046; Strand=+; Position=1 -99,444-635
MNEKNTINTNNSLKAKGGTLDEKLQPTANGETEGQNRMFPCGRCVPAVLHLIFLDVPVDVAGLPRPTESRRVVCPMDMLHFRLGQCQHDKVLLFIS

SEQ ID NO: 146624 - protein, 196 aa, Heterodera glycines
  Coding regions on vcDNA: vcDNA=SeqID_73047; Strand=+; Position=1 -197,313-460,665-915
  Homolog annotation: Hit_ID=CAE63280.1; Match level="QueryCoverage =90%, HitCoverage=12%, E-value=2e-46, Identity=54%"; Hit description =Hypothetical protein CBG07659 [Caenorhabditis briggsae]
MTFIFFHIVNLFANDAQRIFVALTFAPLVLVGPFVLIGGLVYLLFVIGVLSLLGIAVFFVFDIIQAVLGVTMVKFRNRAIAQTERRMALVGELIRCIKCIKLNGWEELFYDRVRAVRRAEQRSLGWAGYAQSLAVASGAIVPVVATIVMTLAIVLNGHDLRASDVVFGGLIFLEIFNPLSGLRINALFENRLKKKF

SEQ ID NO: 146625 - protein, 24 aa, Heterodera glycines
  Coding regions on vcDNA: vcDNA=SeqID_73048; Strand=+; Position=1-75
TPSEKTRCVPINRECQRKTLSFFS

SEQ ID NO: 146626 - protein, 420 aa, Heterodera glycines
  misc_feature (411)..(411): Xaa can be any naturally occurring amino acid
  Coding regions on vcDNA: vcDNA=SeqID_73049; Strand=-; Position=1 -59,1703-1857,2459-3517
  Homolog annotation: Hit_ID=NP_508294.1; Match level="QueryCoverage =95%, HitCoverage=34%, E-value=6e-63, Identity=37%"; Hit description =predicted CDS, endonuclease/exonuclease/phosphatase family and RNA -directed DNA polymerase (XC178) [Caeno
FTKIFFPITKQNIYIFRSYLHNMHKRLISEGLQNVSFSSQKKRNCLPFSAIEVNGLSTKSSEQTTSRKQRTFNNSETDPSNPCLGNIIEIDQCFISDINFNIIETQNLLKKLPNKNGTSPDNISYKILKICHSSLSTVITDLFRISLDICSLPDIWKESIVFPLFKKGDKNNPENYRPISLTCSLCRVMERILSKNIYNFLLKNKKISEFQFGFVRNRSTTSQLITVVEDWYEAIINGKVDSIYIDFQKAFDSVPHELLLYKLKKIGLRGKLLMWIKDFLSNRTFRVKIGDDLSSSKKVGSGVPQGSVLGPLLFLIYINDLPDALPSGVRIKLYADDVKLYICYKARTETEIMHKALHNLSEWANKWQIRISIKTFVLHLGNKNPKEIYKIGGNIINVVDTIRDLINIDKXFAFSHVTQI

SEQ ID NO: 146627 - protein, 57 aa, Heterodera glycines
  Coding regions on vcDNA: vcDNA=SeqID_73050; Strand=-; Position=1-171
RQIAMGSPRVPSHRCPVKRRPSRFAGRSVGRVCAGGGDGDGGNCFAGGGAVAGFYSR

SEQ ID NO: 146628 - protein, 344 aa, Heterodera glycines
  Coding regions on vcDNA: vcDNA=SeqID_73051; Strand=-; Position=1 -435,504-1104
CEQFVWQGEAGNENRFGTSEECEAMCKCKQRKSNAKVDDAFLSLRTVAQVPGILRPKNVVVTNARGTSKAPTVPLSADRQKSEEVGAVHGEHPQNGNERHSIGGEEAQQEQLGHENDLPLAKAASIAQTEDAEGAVGMPGPAQAIAEMPPAAFPGSAAAPSAPPQAPPPLPPAMAGSAGYALSSAYGAQPLPKFPQKVPDNLPPMLGPSPPAVIDYQTGKRCKPKEKDNPITKSIPTQLTSPKRQKHQQRWLLLLQRLLSKDCQITCHRAKSKALGGLTKKVTGKAQWHLKCIFKASATAFWSHSPKICWLTVKIKRNNRHTQFRCVRTDSVPCDTKTVIHSRI

SEQ ID NO: 146629 - protein, 98 aa, Heterodera glycines
  Coding regions on vcDNA: vcDNA=SeqID_73052; Strand=-; Position=1-294
  Homolog annotation: Hit_ID=NP_507993.1; Match level="QueryCoverage =90%, HitCoverage=3%, E-value=4e-17, Identity=46%"; Hit description =papilin (5V147) [Caenorhabditis elegans] emb|CAB07294.1| Hypothetical protein W01F3.3 [Caenorhabditis eleg
MVSAQLGVCFALGKTNFFPLGRFFNAQSGLCEQFSFGGCHGNQNNFADQDKCEAKCSRATTSVANSHQMLPERCALEKEEGTGGGYHVQWYFNVEKFT

SEQ ID NO: 146630 - protein, 601 aa, Heterodera glycines
  Coding regions on vcDNA: vcDNA=SeqID_73053; Strand=-; Position=1-1806
  Homolog annotation: Hit_ID=EAA16908.1; Match level="QueryCoverage =99%, HitCoverage=58%, E-value=4e-29, Identity=21%"; Hit description =Drosophila melanogaster CG8797 gene product-related [Plasmodium yoelii yoelii]
MEQQQHVQIPVQVGGVQIEKATEVGRKSAGQTESDRHREEQKTTVNKESEKNREGQMEEGVEYDGDMIFLETQSNGREEKRKGKQRKGDTEETDRQTKLEETLTELEPDEKEGWKESGEETEPEQVYISPAEERPAAEKEGARNNREREGQTEGKSEGREEKEKERQQNREKVQHQQQQVQEVLGEQPQQIQPVQAKKGAENIGQMENGQNTQPKQAHQGQAVQGEQPQKIQPVQVQKGFLNIGQMENGQNTQPKQAHQGQAVQGEQPQQIQWMEEKQRQNVNGGKQQRQQKKQEKITVHQHEVPAQKLAMEEGKQQQNVEEQQQQQKLNKNESLSSDQDIIRPSNPIIEQQRQHVEEGQQPQQSEQSKAHNQQKQLVPTATTAEADHFSPHSADQSVVAAVPSVSVPNSPPTVSLEGSGNGGAPPTAPSAASSASPPSASAGAPEGSLSDLFTMHHLQQLRSGGSSDVGSGREEVARKMVPVWGGLIDDSSQLQPISTTLEEEEQQHMQQNGTTEKQQREEVGGEMPTEGDDKETGGTAAGAETNPPKQRQPNGEAAQAMPEQQEKTVVVSNNGSGEKKETGEGFDDQLSAREGGKRTRE

SEQ ID NO: 146631 - protein, 310 aa, Heterodera glycines
  Coding regions on vcDNA: vcDNA=SeqID_73054; Strand=-; Position=1-930
  Homolog annotation: Hit_ID=EAA16908.1; Match level="QueryCoverage =99%, HitCoverage=65%, E-value=1e-41, Identity=36%"; Hit description =Drosophila melanogaster CG8797 gene product-related [Plasmodium yoelii yoelii]
MVGQNQKHQIVQGEEMQTEQEKKIVQTNPGQQQIRQGHRHQTEQSKTIQGQQVEQSTEEDPHEGPQAVQDVQPTEGQQNQAVQGKQQGKQTVQGQQMNQQIQVLQNQAVQGQQTNQQIQGQQNQAVQGQQQGKQTVQGQQMNQQIQVLQNQAVQGQQTNRPIQGHQNQAVQGQQTGQHNQAVQGQQTIQRHQNQAVQGQQTNQAIQEHQNQAVQGQQTGQHNQAVQGQQTIQGHQNQAVQGQQQGKQTVQGQQMNQQIQLLQNQAVQGQQTNRPIQGHQNQAVQGQQTNRPIQGQQAVQEQKPNEPQEQQ

SEQ ID NO: 146632 - protein, 91 aa, Heterodera glycines
  Coding regions on vcDNA: vcDNA=SeqID_73055; Strand=+; Position=1 -249,574-600
MVTAPTAAADVAASVAASVASAAGGGGSCTACSSSVNLAVLTREEVAAANSIRNARLAEEPVNQISTSGGCTTLTPTCPPGESLGLRGAFF

SEQ ID NO: 146633 - protein, 122 aa, Heterodera glycines
  Coding regions on vcDNA: vcDNA=SeqID_73056; Strand=-; Position=1 -284,340-424
HSHCPDCLSGIENIAIRNAVENRVGLNQVRSNEYLVDKVNKVQISIECPLCRARCLLNRQRVKNYAIEAIIASMGTVNNEQDPNNEIIAAKNILIKQLEKNEREMKRRFSEQEVRIERAFFF

SEQ ID NO: 146634 - protein, 75 aa, Heterodera glycines
  Coding regions on vcDNA: vcDNA=SeqID_73057; Strand=+; Position=1 -52,679-854
MADFWLLFLACLLAFFVVLQTDLSRLSQHRPNFVQCRCKRAMRSEHCKWPFIFGEVKTDNSFGHDPFNFNLSWLL

SEQ ID NO: 146635 - protein, 55 aa, Heterodera glycines
  Coding regions on vcDNA: vcDNA=SeqID_73058; Strand=-; Position=1 -48,156-275
MEAEQGKLAEELAGSKQQFQFCKTLRVLVGRPFTVRPLFAVPSAIVAKFFLWPTK

SEQ ID NO: 146636 - protein, 102 aa, Heterodera glycines
  Coding regions on vcDNA: vcDNA=SeqID_73059; Strand=-; Position=1-309
MKNPISKNNPTLEKGQILVISSLGTVFLYNLLECIHCKMLFIQQQNELHHWPIPLAGFDVIMCQQKVDGDTMLVAAQKNWPFVERHHFLTGELQFLSLNPDH

SEQ ID NO: 146637 - protein, 64 aa, Heterodera glycines
  Coding regions on vcDNA: vcDNA=SeqID_73060; Strand=-; Position=1 -74,1815-1935
MLYWSSQQKIDYSIRCLNKNKIYIIIYYAGQFIFLENVLKKDKNNYFILPSLDMHMYFKFFIVM

SEQ ID NO: 146638 - protein, 462 aa, Heterodera glycines
  Coding regions on vcDNA: vcDNA=SeqID_73061; Strand=-; Position=1 -188,241-313,367-588,675-769,815-1031,1122-1214,1256-1446,1538 -1766,1824-1902
  Homolog annotation: Hit_ID=NP_491994.2; Match level="QueryCoverage =81%, HitCoverage=26%, E-value=1e-131, Identity=61%"; Hit description= chromo domain and SNF2 related domain and helicase, C-terminal (1H586) [Caenorhabditis elegans] emb|CAB0
MSCSFYTFAVLQLVPPPQHMGIRGEFKGRECEGLQEGLTSTVLSSYNKQFRWRITANAKRRWTRQRADKEYIELYNCELGMNDELIEQYKQVERIIGEQASLDKISDNGEAATEYLIKWNGLPYSECTWEDEGLIRREFDHKIAEFEVREQSDTQPKKSYPSMPDFLRPVDSEMELRDYQLEGLNWLLYAWSKSNSSILADEMGLGKTIQTISFISSLFHLHDMHGPFLVVVPLSTLPSWQNEFTLWGSRLNTVIYMGDVNSREQIRIHELDVDEHAKLCKANVVITTYEICLKDKLYLGKFTWTCLVVDEAHRLKNDDSLLYQTLYSFHTNHRLLVTGTPLQNSLRELWALLSFIMPEKFNDWCEFERAHQDRDHKGISSLHRKLEPFLLRRVKKDVEKSLPAKVEQILRVDMTAQQKQYYKLVLTRNYEELSKGIYDFCFNYRVHQHNDGAEEELQPLLL

SEQ ID NO: 146639 - protein, 101 aa, Heterodera glycines
  Coding regions on vcDNA: vcDNA=SeqID_73062; Strand=-; Position=1 -131,190-364
  Homolog annotation: Hit_ID=NP_491995.1; Match level="QueryCoverage =93%, HitCoverage=15%, E-value=1e-25, Identity=59%"; Hit description =protein disulfide isomerase (54.9 kD) (pdi-3) [Caenorhabditis elegans] emb|CAB07480.1| Hypothetical prote
MADEDVVIAKFDATASEYSIHLLLFFNLQFTFLDDVPPQFEVRGFPTIFWLPKKDKANPVPYQGGREVKDFIKFIAEQSTDPLKGYGRDGKKKKKAKAEEL

SEQ ID NO: 146640 - protein, 351 aa, Heterodera glycines
  Coding regions on vcDNA: vcDNA=SeqID_73063; Strand=-; Position=1 -166,440-709,990-1172,1220-1425,1523-1750
MSFTPSNAAFIPPPPGKGKPSRNVPLVSGPSPAAAAFRTRPSGGAAAGDNATQKNFVDQSLSAMFANRQLLQSVCNNPMVQSLGKQAVVSMVRQQGKEFVGRTSTAFGGGGAAATNQKTMPQRTVMSSSNNSNGGRTASAQPTANRQLSSSQCLAEKELEDIFGPLSLGPSSNKMPSSSSTAAHPPPQWAVPCAGGSAAFADGFFTAQSAPLRPFDSAASFPAHSANAPLYPVLDRYSPPSPLIELKTPASVPLDGQCRAVALYDYDSGVPGDLKFSANDWVMVISRVNADWLRGELPNSGGNCLRGIFPVNYVQIGPKELSRLPWEDEDSGMDSTKQPKQQFLRALYDFK

SEQ ID NO: 146641 - protein, 86 aa, Heterodera glycines
  Coding regions on vcDNA: vcDNA=SeqID_73064; Strand=+; Position=1 -135,355-478
MNFSPITLFLLSSLAIFSAADAFRQQTVAVRGRLMCGDKPLTDTKRIPNIFCQFITTVTVASFRANAKLTSAFRASTSRGPAPFSD

SEQ ID NO: 146642 - protein, 132 aa, Heterodera glycines
  Coding regions on vcDNA: vcDNA=SeqID_73065; Strand=+; Position=1 -64,124-215,318-383,437-527,618-703
MSFLTNSINYGDAFTQAAAKGEVNGDAINLDNYGQLFDGKNSESITDQRQLKEFREKFARMEMELEMAKLELETKTLEQKLKQQQELIGLKEKLAKIEQEKEKNDAKYLTVHHREKERGKKLQIIRVVNYMD

SEQ ID NO: 146643 - protein, 18 aa, Heterodera glycines
  Coding regions on vcDNA: vcDNA=SeqID_73066; Strand=+; Position=1-54
MLYRWGIEPKRTVKKGRR

SEQ ID NO: 146644 - protein, 123 aa, Heterodera glycines
  Coding regions on vcDNA: vcDNA=SeqID_73067; Strand=+; Position=1 -8,117-340,431-570
  Homolog annotation: Hit_ID=XP_326902.1; Match level="QueryCoverage =95%, HitCoverage=16%, E-value=9e-09, Identity=37%"; Hit description =hypothetical protein [Neurospora crassa] emb|CAE76135.1| related to B cell antigen receptor Ig beta assoc
MKSLITFGFAVKQQNKFDGIILSHKGTYAYYNRGDIWINGKGKGRNGKYSYGVGDTVGIGVNSATRQIIFTKNGLRLDSSEFFVAQSFADDSFHPFVSIWHYGGQDQIEANFGPNFKFDLATL

SEQ ID NO: 146645 - protein, 159 aa, Heterodera glycines
  Coding regions on vcDNA: vcDNA=SeqID_73068; Strand=-; Position=1-481
  Homolog annotation: Hit_ID=NP_012097.1; Match level="QueryCoverage =91%, HitCoverage=28%, E-value=3e-14, Identity=39%"; Hit description =Yil169cp [Saccharomyces cerevisiae] emb|CAA87023.1| unknown [Saccharomyces cerevisiae] sp|P40442|YIQ9_YEA
DLSSVTEQSSTFDDLSSVTEQSSTFDDLSSVTEQSSTFDDLSSVTEESSTSEALSSVTEESSTFDDLSSVTEESSTSEDLSSVTEESSTFDDLSSVTEESSTFDDLSSVTEESSTSEGLSSVTEESSTISESCASVCSGFGWTNYNGNCYKVIEGLMNQ

SEQ ID NO: 146646 - protein, 29 aa, Heterodera glycines
  Coding regions on vcDNA: vcDNA=SeqID_73069; Strand=-; Position=1-88
SSPQIFMLVLKMLKINNIQHKLINWPHIL

SEQ ID NO: 146647 - protein, 295 aa, Heterodera glycines
  Coding regions on vcDNA: vcDNA=SeqID_73070; Strand=+; Position=1-890
  Homolog annotation: Hit_ID=NP_036922.2; Match level="QueryCoverage =99%, HitCoverage=70%, E-value=2e-38, Identity=36%"; Hit description =dentin sialophosphoprotein [Rattus norvegicus] gb|AAL79813.1| sialoprotein-phosphophoryn DSP-PP523 [Rattu
VDDSSVTDDKSSNVDDSSVTDDKSSNVDDCSVTDDKSSDVDDSSVTDDKSSNVDDCSVTDDKSSNVDDSSVTDDKSSDVDDSSVTDDKSSNVDDSSVTDDKSSNVDDCSVTDDKSSDVDDSSVTDDKSSNVDDSSVTDDKSSNVDDSSVTDDKSSDVDDSSVTDDKSSNVDDSSVTDDKSSNVDDCSVTDDKSSDVDDSSVTDDKSSNVDDSSVTDDKSSDVDDSSVTDDKSSDVDDSSETDDKASDVDDFLGTDVETSHNERSSDCESLDDLESSDDESFDDDSDDEECSDEEC

SEQ ID NO: 146648 - protein, 314 aa, Heterodera glycines
  Coding regions on vcDNA: vcDNA=SeqID_73071; Strand=-; Position=1-944
  Homolog annotation: Hit_ID=EAL42084.1; Match level="QueryCoverage =99%, HitCoverage=99%, E-value=4e-38, Identity=40%"; Hit description =ENSANGP00000025790 [Anopheles gambiae str. PEST]
PIQHSSSEHSSSSESSSKDSSSDDSKSSKDSQSEDLSLCEVSTSVPKKSSTSEALSSVSEESSTSEDLSSVTEESSTSEDLSSVTEESSTFDDLSSVTEESSTSEDLSSVTEQSSTFDDLSSVTEESSTFDDLSSVTEESSTSEDLSSVTEESSTFDDLSSVTEESSTFDDLSSVTEESSTSEDLSSVTEQSSTFDDLSSVTEESSTFDDLSSVTEESSTSEDLSSVTEESSTFDDLSSVTEQSSTFDDLSSVTEESSTSEDLSSVTEQSSTFDDLSSVTEESSTFDDLSSVTEESSTSEDLSSVTEESSTFDD

SEQ ID NO: 146649 - protein, 701 aa, Heterodera glycines
  Coding regions on vcDNA: vcDNA=SeqID_73072; Strand=-; Position=1-2106
MIMARTIKSLDIFSYSMILHQLPELKGNAGADQVNAFFRQFDAVSEDWPNERRLRALKSKCSGRAERAYNSAVANNPFRYENIRRAMKQQLDSTDAKSTCAFDELMTGVCRMNGESIDDLADRVSSLVRRAYPGHGEHLYDDYSIRHLIRSLKNPNLALTLEMARKPDMIFDEFVAMAARAEITQNAAKAAEQRDTNFCQNFEHRRQFNFRSSNQPENFVRSFKCYNCGQEGHVSRNCWYPRRDQSNYAPPQYNASATGADRIPYTNESQKSQQNFPNHTQQPRNFLRQNYLVEQTEKSPACHSNVLIGGISAVSEKVEKLFEDVKAKDAQSAKEKREIVGKILLANVSILGQHANAMLDGGAQISLISAAFLNKILNISTSSKEFLNPSRQTLRVIDINGEEVKCYGIVSLPVRRMGRTVSVRLHVAQTSFGYDLLFGTNSLSDLGFKLFDELSDTIVDFKPASNNDNKAVNIIYGLTLIQNSTPCLLGKERTEKARKNDVAISQEQKVADDNVAKIPKSQQKSSQQKNRSKWQAKNGKNSAQKGGKLEKKFGEKGSEKSRKDVECKTEKSILEVQKNGKVCRNVRGRSSQLGTIEFLEGGKELDPKKSTTGKKNGKTNPIFRNFGGSYKELGKAGHRISANFRQIGNVNENREKGGGWKRKTIYYATPSGPIPKFVGSSTADGNVSAENPSFRAESRKF

SEQ ID NO: 146650 - protein, 155 aa, Heterodera glycines
  Coding regions on vcDNA: vcDNA=SeqID_73073; Strand=-; Position=1-465
MVIPRSPHQTRQRTRQQGVILDSDGMQILREPNEEPPNFVVSEAIRPANEILESGSILGGEQFRQRHLEVNVHEFEPAANEERMSEHLALVAPMVNAGSGHLENFGRNMGERNAVEIRNLPPNGHLFGDNGNFEDGWARSPNSPLFESSRHAYLN

SEQ ID NO: 146651 - protein, 32 aa, Heterodera glycines
  Coding regions on vcDNA: vcDNA=SeqID_73074; Strand=-; Position=1 -60,367-405
MGINIPNYIGLEEKTNKTINAVHSPGNKYGSV

SEQ ID NO: 146652 - protein, 43 aa, Heterodera glycines; identical to SEQ ID NO: 145884
  Coding regions on vcDNA: vcDNA=SeqID_73075; Strand=-; Position=1-214

SEQ ID NO: 146653 - protein, 55 aa, Heterodera glycines
  Coding regions on vcDNA: vcDNA=SeqID_73076; Strand=-; Position=1 -151,318-334
MVLINNPNPICTKIICLIIIFVTIFDTNPILCANLIDDTMSEVFKHMKIHGLSII

SEQ ID NO: 146654 - protein, 108 aa, Heterodera glycines
  Coding regions on vcDNA: vcDNA=SeqID_73077; Strand=-; Position=1 -132,823-1017
MIFCGIGGSLDPTEWANFVKIIKWKSATTKNFAIAFRNLPPINLSWSGPGFLTKTGTGNFRIEKSGLFGWENREKPGTSPGQNWSKPGLGTQLYPFFQYQSRSRPALI

SEQ ID NO: 146655 - protein, 59 aa, Heterodera glycines
  Coding regions on vcDNA: vcDNA=SeqID_73078; Strand=-; Position=1-177
MPPMIFFRKLSPHIFVTITGQQFAASPRHRLELHFQVLPKALDMACMGAGDRIHKVRIR

SEQ ID NO: 146656 - protein, 86 aa, Heterodera glycines
  Coding regions on vcDNA: vcDNA=SeqID_73079; Strand=+; Position=1 -185,247-322
MVPFELVNEWTKEKLTLAKANENELDNWIMKRCKIIGEKEENWDNNCNNVFFWLVGGIDCIGPLSPPPAEETGQSITKVASSADDE

SEQ ID NO: 146657 - protein, 80 aa, Heterodera glycines
  Coding regions on vcDNA: vcDNA=SeqID_73080; Strand=-; Position=1 -146,194-290
MTFYASQQHFTRPMTFYASHDILCPWQGWHSEAPKIFGNRNSVPSLVSWYSIKFLTINFVVKPKVIMTTHTQATRTMAYC

SEQ ID NO: 146658 - protein, 64 aa, Heterodera glycines
  Coding regions on vcDNA: vcDNA=SeqID_73081; Strand=+; Position=1 -26,67-428
FGHFSEMANPIATKKQKVKLSYEGHFYTFAKMSSDGMTKFWRCEFKKSISHYLCFSGEFLATIE

SEQ ID NO: 146659 - protein, 93 aa, Heterodera glycines
  Coding regions on vcDNA: vcDNA=SeqID_73082; Strand=-; Position=1-636
LPNDEEQQKASFSNFMHIKRCDGGQVIDFIHSHFVGMTSVYSRVCLSVNCMCDGCVKKLINEDKINIRVQWESEREEERTIMMIKHFFLNFII

SEQ ID NO: 146660 - protein, 102 aa, Heterodera glycines
  Coding regions on vcDNA: vcDNA=SeqID_73083; Strand=+; Position=1 -151,296-453
MIRSLSTGGALFFNPNFFKNPTKSVYLSWAGTIGPQNLFGYFFFVNQIQHFLKIVRLIEHVKSFRIVPTILDYKEKSYSEKACWDPTVPAQLSESEQNGDFS

SEQ ID NO: 146661 - protein, 237 aa, Heterodera glycines
  Coding regions on vcDNA: vcDNA=SeqID_73084; Strand=+; Position=1 -110,174-506,621-891
MSGIILTCTRISGIILMYQNKRNDSDACKNKRNYSDAISGIILTRARISGIILRISGIILTCTRISGIILTRARISGIILTCTRISGIILMYQNKRNYSDACKNKWNYTENKRNYSDVYQNKRNYSDACKNKRNYSDVYQNKRNYSDAISGIILTCTRISGIILTCTRMSGIILTCTRISGIILMYQNKRNDSDACKNKRNYSDACKNKRNYSDACKNKRNYSDVYQNKRNYSDVPE

SEQ ID NO: 146662 - protein, 69 aa, Heterodera glycines
  Coding regions on vcDNA: vcDNA=SeqID_73085; Strand=-; Position=1 -128,275-354
ISGIILTCTRISGIILTRARISGIILRISGIILTCTRISGIILTCTRMSGIILTCTRISGIILMYQNKR

SEQ ID NO: 146663 - protein, 945 aa, Heterodera glycines
  Coding regions on vcDNA: vcDNA=SeqID_73086; Strand=+; Position=1 -150,374-502,562-753,796-1222,1261-1402,1452-1554,1606-1768,1811 -1902,1946-2217,2266-2513,2556-2661,2702-2991,3032-3193,3235 -3430,3470-3634
  Homolog annotation: Hit_ID=NP_507780.1; Match level="QueryCoverage =90%, HitCoverage=51%, E-value=4e-63, Identity=26%"; Hit description =predicted CDS, DNA polymerase type B, organellar and viral family member (5T899) [Caenorhabditis elegans]
MKPLWKSKDIVYKQELCVLFTEGDAGQAGHYDPIKSTGRLFGAKTSYCFGTFESRECFEHHAKVIKATIKKGDKEVKIEKSMCKSSRKCVKCGHQDKERGHVCGHKFCRVCLGFHAPRDCYIPYRPKKKTEKRIIFFDFECTTDFQPDPEIARFKHQVNFCYAHVTCTSCIEKGIWNQSLEQKCGICGDYRTYAWAPFDFYNTEVERRFRVDDPLASFTKWLLNFETETLGLDHNERGKKRKRTVKQNNNNNGQACFFDNEAEDDEDSDGNDVENNYMLGYDEGGEKPRSVKTYAYAHAGSRYDHVLIFGEMLRMGVRPDLVRQGNHLLEMKAHKKGAITTTIFRDSYKLIPLKLASFVKTFGLNIDGVENKKYFPHKFNKAVNYGNVLETLPPLEDYSPGSHFPEERIKLEKWHADNINTRFDLREIIADYCKTDVQILVHGVLKMRELFMAETMHDLTDSITIPSACMKYFVALSYQDNERIAIVPHLGYEKRGKQSTIARKYLKWRAGEEMRNNGWTLRFIESPGGEYKYGNYSLDGMMERPGMAKNLAIEVQGCYWHACPNCFPDEEAIVGGGETAGAIRARDAKRIKQIARDFEVEIIWECHLMRMLEEDPAMKAFFDNTPDSGPIEFRDAFFGGRTGPDWLAMGMMKPNGEKLNRSIKIKDFNSLYPSRNMFTKYPIGHPTLLKMDKNVEWTKPEHMIDNDGIPIEGIIKCFVVPPRHCLLDIPVIPFRMNNRTLFMLCRRCSEMYPKGLVDPDYNCPHFEDHERGFSTTITHIELEAALRAGYRVTRVFSAYVWRRACDWSDTLFHSYLFKFLKIKEEASGYPAKCLVDGISEEEREERQQQHIDSCYAKSKVRLEAARIKPNPGLRYIAKLCLNSLWGRFALRNRLTTTEIVDSNADLGKLLNDDKIDSVASTTDPIGSGWSAIRQRIRHVSSMTQA

SEQ ID NO: 146664 - protein, 341 aa, Heterodera glycines
  Coding regions on vcDNA: vcDNA=SeqID_73087; Strand=-; Position=1 -241,295-367,415-568,619-786,843-1018,1075-1289
  Homolog annotation: Hit_ID=NP_493386.1; Match level="QueryCoverage =98%, HitCoverage=20%, E-value=1e-101, Identity=51%"; Hit description= guanine nucleotide exchange factor (1O196) [Caenorhabditis elegans] emb|CAB60434.1| Hypothetical protein
IGLQSSDEPQIWGRCLHGFSAGIRVACLFRLAIQRKAFVQTLTKFTLLTANSSLSEIRPKNVESIKLLIQIGVENGSHLDQSWYDVLKCISQLELVHSIGTGNHADAKPHWMMVPQIPFLKDNLKSMFNIRDKSFSTVQGYLAETSSQDLVVAIDRIFQDSSKLSGEAVIEFVRALCQVLLEELCSPGGPSMYMLQKIVEISFYNMNRIRIEWSMIWSVLGEHFNLAGCSSNQDISHFALDALRQLSMKFLEKGELPNFRFQKEFLHPFEVIMSRNKSLSCREMIVSCVTHMVHSHADKIRSGWKNIFSLFTLAAGEKDERIVEAAFTTTSEIIRKDCYFH

SEQ ID NO: 146665 - protein, 849 aa, Heterodera glycines
  misc_feature (40)..(40): Xaa can be any naturally occurring amino acid
  misc_feature (553)..(553): Xaa can be any naturally occurring amino acid
  misc_feature (563)..(563): Xaa can be any naturally occurring amino acid
  misc_feature (734)..(734): Xaa can be any naturally occurring amino acid
  Coding regions on vcDNA: vcDNA=SeqID_73088; Strand=+; Position=1 -28,1469-4043
  Homolog annotation: Hit_ID=NP_494149.1; Match level="QueryCoverage =99%, HitCoverage=62%, E-value=1e-125, Identity=33%"; Hit description= predicted CDS, putative protein of ancient origin (2C297) [Caenorhabditis elegans] gb|AAF39854.1| Hypoth
LFLLKITIFSEHLNKKRKMKELFSEDNEISKNFLKNIRKXYNNSFACASLACNKFSFTSPGPSCFKISGQVYHKYNPIAPDHNSLPTNGQLYFLDSCEAQNVLHSHNLDIFLTEKIEIILRKNPFAKAYEMMRKVDEQKQLTTTNKNNETQEVKMLLSLRKGFDPNQYNLQHTNEVAAIIVCNDEEIPAANIIVVEKGSKKIKKIYPLLYPMGTKGWSFDIKIKTEKISFCDFIKFKLFYRHSYFLPHHFSNQLFQQWIFDQAARVEWDRLNYIRTHQELRACSYKGLEDYLFNKAEQTGVIIGKQVILPSFLGGPRNKYQHFIDSMAIVGENGKRDLFLTYTINPEDPDIKKCLIKNQTEDRPDIVAKIFKLKADEIFGKVIAYCWVVESQKRGLPPLHFLITLHPKDKFKNANDIDKFIRANLPDKEKEPFLRSFREETQIGEDGYALYKRPNNGDFEFVKGHRLTNQNVAPYNPYLLMRFQSHINVEFCSEINAVKYIYKYIYNGYDAATVECVKEEPNGEKIIDEVSQYLEARYLSPVEHVRLFKFEIXGKSHSIGRLXVHLENEQTIYIDKNSESDNLKEAMQKASKLTAYFNFFKEYPNAPEFKYIEMPIYCTFDHWKWPLKRTDKVIGRIYTITPNRELYYLRYLLLNKHAKSFDDLKIVNGVKSTYAEACLALGLTRDDSEWNKCLDKTSQFKFHKGLRSLFANILINCEQNTHLLWEKYKDNLSXDLKKSYTDQIAYQIALSLIEQNLLNHQKCLDDFKDMPKINQNIQNISDDQIMNPQDELNIALKKIFSEQKVIFEHIKTIFECSNELINCFYIDGPGWTKSFVQTAIYHIARGFLK

SEQ ID NO: 146666 - protein, 88 aa, Heterodera glycines
  Coding regions on vcDNA: vcDNA=SeqID_73089; Strand=-; Position=1-265
MSSMNDNVPLQAERNGIQTDSEAVNTDKVQPKPNTRSMIKKSRWGNNCAKPVQKDAEEAPAVKKRKVEDNELWVLVKGKYLLGFYLCA

SEQ ID NO: 146667 - protein, 256 aa, Heterodera glycines
  Coding regions on vcDNA: vcDNA=SeqID_73090; Strand=+; Position=1 -488,545-827
MAINMSDKKGLVKQILGEADLTITTSGITVSGPRLSTPRFIPFDESGKCRSCKATEVEVDTMVTKEGITIWCTRVDKAQFVPFDVIYDLPGHCFFRVKNKSRVFNVPYSELPSDTCADLGVSIEEKDLKRKAKVALDLVEAGMVSDAMQGGARWKKAKTAIDVFIPNEPQSRQSSQVKEETTSVSASAAGSPQTHTVEEMKEQNQEDVEKKMPPALPDPPTMSGEKKVDPKKEDLGDIDKTLDEFFESIKAATTNM

SEQ ID NO: 146668 - protein, 184 aa, Heterodera glycines
  Coding regions on vcDNA: vcDNA=SeqID_73091; Strand=+; Position=1 -202,244-371,414-608,697-726
MAVCKCKVCDECRRKQRLHEISERKKIIESCGGDHHYIKMIELRMRDLELYKRAYRRIKSVIDQVLEGPFHVKCTSKCQEEFTYYLIKWECCTEDYGRGVGCTYSEISDISQNELLAYYDRERVVGEIDPPLADNNAPLAMAGIIAELRGGKLPQGNLAQDDLTQNEDLIAAGEEAAGQDAPVK

SEQ ID NO: 146669 - protein, 25 aa, Heterodera glycines
  Coding regions on vcDNA: vcDNA=SeqID_73092; Strand=+; Position=1 -31,738-784
MKNLLPERAENFLHILPFFVKYFQI

SEQ ID NO: 146670 - protein, 68 aa, Heterodera glycines
  Coding regions on vcDNA: vcDNA=SeqID_73093; Strand=+; Position=1-207
MVRLTPTIVFVLALCCAWLLTDAQNYGAMIAKSQNKRETDQEETSATTEATTKETEVTVGEQQDEVIN

SEQ ID NO: 146671 - protein, 73 aa, Heterodera glycines
  Coding regions on vcDNA: vcDNA=SeqID_73094; Strand=+; Position=1 -47,1080-1191,1774-1836
MTQNCPFLANPLFNQSYEIALRQIDPTVALPYWDSSLEGHLPTPADSILFTENGTRNLKRFVGEMGTLPTDEG

SEQ ID NO: 146672 - protein, 434 aa, Heterodera glycines
  misc_feature (41)..(41): Xaa can be any naturally occurring amino acid
  misc_feature (179)..(179): Xaa can be any naturally occurring amino acid
  misc_feature (282)..(282): Xaa can be any naturally occurring amino acid
  misc_feature (308)..(308): Xaa can be any naturally occurring amino acid
  Coding regions on vcDNA: vcDNA=SeqID_73095; Strand=+; Position=1 -62,145-268,367-467,660-745,811-875,1267-1348,1669-1801,1998 -2071,2184-2254,2297-2392,2590-2692,2945-3072,3373-3435
  Homolog annotation: Hit_ID=CAE74225.1; Match level="QueryCoverage =89%, HitCoverage=53%, E-value=1e-103, Identity=46%"; Hit description= Hypothetical protein CBG21909 [Caenorhabditis briggsae]
VEFTHCRNGPVSKMLENSESLLAMGLRKTLAMGLRKTGVTXINKLTQFFLFIQQCASPQHFSAGPMHPFQPWQNIDGLVNKYTDNMYEFAPRPSCSMGPDCGSKYLFCDRSHGKPRCAAKVRPNGNCAGFTNGEDVCLNEDVCLNGECQYGKCVKKVAKISPPPTTPKPPPIVTVSLRXVVKKKPRKSPCFNEHECCAKWAADGQCESNSEYMSQFCKASCKKVNKCCSISSECADRHKNCKALSYQMKCDSSWMAENCRKYCNKCVKRMQTCAGGSPNFYXNILATLSYGGNNGGCKSNQCYPNFYXNILATLSYGGNNGGCKSNQCYNENICCQHWAMNGGCKKNSEWMNCNCKVSCGQCIPRNYKYGTCSDYHPKCFKWAKHGQCKSNGWVLANCRRSCNSCASIWHIKKCCAWRARRRRSRRKRKRRKRK

SEQ ID NO: 146673 - protein, 134 aa, Heterodera glycines
  Coding regions on vcDNA: vcDNA=SeqID_73096; Strand=-; Position=1 -97,695-794,921-1125
MAATPSRKGEPEHMQRKHCAVLKWKLVNKERQEFKLCRNLQENWSMPMSNLQWKKHSTGDQIRKYRHFAVQKASVIITVDALPQKHVHDDAQDEQKIEIVQKFNAMKNEYKQKGRKYSTKEWSQNYEEICKKIG

SEQ ID NO: 146674 - protein, 221 aa, Heterodera glycines
  Coding regions on vcDNA: vcDNA=SeqID_73097; Strand=-; Position=1-666
  Homolog annotation: Hit_ID=EAL50505.1; Match level="QueryCoverage =90%, HitCoverage=26%, E-value=2e-09, Identity=27%"; Hit description =hypothetical protein 21.t00051 [Entamoeba histolytica HM-1:IMSS]
MKLFLFFFLIVFLICQIEIAAEKKKLEQKTFEEIFGEKWEEKEKENEQKKREIVQKYYQIKERIKQKGRKYSTKEWNKIEWKIAKKLGTNRKKIYQWIKELGLYKYQSKLKTDEQKIEIVQKFNAMKNEYKQKGRKYSKKEWKRNYAVIGKKIGVGHDLIKKWKKQFGMNERINEKEKMEKMKMYWQMKGENPKMSDEKIAKILKINRRTIDKWKKRFGEE

SEQ ID NO: 146675 - protein, 42 aa, Heterodera glycines
  Coding regions on vcDNA: vcDNA=SeqID_73098; Strand=-; Position=1 -43,345-430
MWNCSGKPVPGRVPANMFTEFEPKMLSRNTWLNSSKFLTGLL

SEQ ID NO: 146676 - protein, 87 aa, Heterodera glycines
  Coding regions on vcDNA: vcDNA=SeqID_73099; Strand=+; Position=1 -10,1146-1399
MKFVTIIAIAKEWHFPSALRKRKIIYASMDNQNTKTNENERVNGVDKKRRANGQMEELWRKRHKKKIVKDGTEWMTQPKHDGIVCQK

SEQ ID NO: 146677 - protein, 158 aa, Heterodera glycines
  Coding regions on vcDNA: vcDNA=SeqID_73100; Strand=+; Position=1 -124,177-526
MAKRTLLRKRQTKNARHTRENKREERKAQTQRARQGRWAKKTATQPNPNAEIALQDEAGPSTSAASTEEAMEPPPPTPGPVPTPEMDEEILEFGFSLPSTSVTPIGDLVPFSTTPTAPMDTGETTPPPLAIDERSERIEQLEKQLKDRDDTIKFLREQ

SEQ ID NO: 146678 - protein, 135 aa, Heterodera glycines
  Coding regions on vcDNA: vcDNA=SeqID_73101; Strand=+; Position=1 -145,192-454
MFTSFIDSKILSAQNPRTKTINVQIFDEKIAALSSTESQKEKTMEAKNSLRLAKLEFPRPRPGSSSVQPRKYGGFLPIPAQSVLEPPAPAVVPNNRNFLANNAGTKNEQQRQGDEEMVEEPFNDEAWPTKPPVNE

SEQ ID NO: 146679 - protein, 353 aa, Heterodera glycines
  Coding regions on vcDNA: vcDNA=SeqID_73102; Strand=+; Position=1 -66,478-598,1077-1951
MGNEAVHLGHGHLHLGISGVEEGKSALWNYIIAYHEWEKKSNREASRKASFTAGGTNGESQSGEEEDEDKVSTTVGTESDDNGTPKAALVDLISSIRRMASAGGADDGDEASLSSAASSGTVAATTPTVPDWSQSLLRAANVICERISGAGGSASSSGGDIGGASDSIGDYSKKSATLPPRPPPPRPSGSSRSRQAATEAEPHPQLQQQQRRSRTPTPNSKKNAQVPAKASATATGTAAIVVEKSAQKEETREKNTETSGGGDGTPSTYRKFIYKGPPLKEMNNNNNGRRSVSSQRRTAATSAHGGGLLTNLITGTVCLLSRLVKGIIVWIRQWCYIYVVQYAVLTLINLRAL

SEQ ID NO: 146680 - protein, 170 aa, Heterodera glycines
  Coding regions on vcDNA: vcDNA=SeqID_73103; Strand=+; Position=1 -63,319-473,980-1274
MAKCHAFVTSVIQSNPFDDLGKLTNKQRVSGRTSVLTSGKARGTDIEQKQQFLPCGTPCQLGTRGGGNCAVHMDYLTEDGQVEIVMIIRLNLKEQIKSNCCPWCTDHHNLAKLVDADPNRIISHPLATDLTQKLALVIEHLNKYINNYIHPLKRQQKCTDFDGMCPVVTD

SEQ ID NO: 146681 - protein, 91 aa, Heterodera glycines
  Coding regions on vcDNA: vcDNA=SeqID_73104; Strand=+; Position=1-383
MSSPSDSKFACSTNKSSFGIPPAAVRSFLFASVLRPFASILIYCYHLPSPFYYRVPTHIHRIPFLCLSPISFIHFLKSYLVLLLFLLSFIQ

SEQ ID NO: 146682 - protein, 415 aa, Heterodera glycines
  Coding regions on vcDNA: vcDNA=SeqID_73105; Strand=-; Position=1 -62,114-248,291-345,396-492,573-739,797-879,940-1041,1093-1134,1188 -1279,1340-1422
  Homolog annotation: Hit_ID=NP_498684.1; Match level="QueryCoverage =95%, HitCoverage=33%, E-value=1e-122, Identity=62%"; Hit description= abnormal NuCLeoli NCL-1, regulator of rRNA synthesis and of cell and nucleolus size, RING finger and B-b
GSDGLAASIPMLPPPRSQIKRQKMTYHCKFGEFGVIERQKMTYHCKFGEFGVIEGQFTEPSGVAVNAQCDIIVADTNNHRIQVFDREGRFKFQFGECGKRVFDREGRFKFQFGECGKRDGQLLYPNRVSVNRVTGDFVVTERDGQLLYPNRVSVNRVTGDFVVTERSPTHQIQIYNQYGNQYGQFIRKFGASILQHPRGVCVDSQGRIVVVECKVMRVLIFDMFGNILHKFSCSRYLEFPNGVCYLEFPNGVCTTDKEEILISDNRAHSIKVFVFNYEGQFLRQIGGEGVTNYPIGVGINQLGEIVVADNHNNFNLTVADNHNNFNLTVFSQDGTLLSAFESKVKHAQCYDDGTLLSAFESKVKHAQCYDVALIDDSVVLASKDYRLYLKDYRLYLYKYQPGSSDQNRLGMGTER

SEQ ID NO: 146683 - protein, 19 aa, Heterodera glycines
  Coding regions on vcDNA: vcDNA=SeqID_73106; Strand=-; Position=1-59
LLQPPPPPPPPMPSLSSVQ

SEQ ID NO: 146684 - protein, 134 aa, Heterodera glycines
  Coding regions on vcDNA: vcDNA=SeqID_73107; Strand=-; Position=1 -133,1056-1327
MASFVINPGGPGGYVIPKRRNATEEEKKKERHGAAAATAEDDAKSASSSRAVVDNKKDSTASRGTAVPPIRNPLNVWTGSLRFEDQTVESVDLYSPFRDSAKPNGLYVFCIEFFFFCWQSAFWRNIKNRIGYFK

SEQ ID NO: 146685 - protein, 321 aa, Heterodera glycines
  Coding regions on vcDNA: vcDNA=SeqID_73108; Strand=-; Position=1 -267,1638-2333
  Homolog annotation: Hit_ID=XP_307050.1; Match level="QueryCoverage =37%, HitCoverage=85%, E-value=7e-11, Identity=32%"; Hit description =ENSANGP00000024004 [Anopheles gambiae] ref|XP_306274.1| ENSANGP00000015439 [Anopheles gambiae]
MSETHPFSDQLTQHFPNQEKLDDKANLNLAEGSDRRIGEKLDNEANLNLAERSERRIWHKAVNEGHTVGRVERVQTRTKEEWRKWREKKALIRGCASKLGALLGTEIPPDLGINALPNQCQRRLYKFRNFLNDLERVVQKIEDNLGLANEYIGKLSRDNAIRKETEMQELMQELQINEKQRAADVLIPILRDKIEALEERLDITHNTDGDTTSGIVPLSRSVPMRKNLPKTELKRFDGSPSQWIPFWDYFRTIIHEDSHVRKIDKFSYLDSCIEGKASAIIQGIPISESGYDDAIDLLLKTYGETKRLIRTVNRDLCRSQL

SEQ ID NO: 146686 - protein, 77 aa, Heterodera glycines
  Coding regions on vcDNA: vcDNA=SeqID_73109; Strand=+; Position=1-3,71- 126,510-684
MTLGNEIPKIWTKWDWTKKNASNVQIVHCVQCPICSARPISNLLVLPISNLFNASNFQFVQCQILFTCKKGKTIMKF

SEQ ID NO: 146687 - protein, 246 aa, Heterodera glycines
  Coding regions on vcDNA: vcDNA=SeqID_73110; Strand=-; Position=1 -681,1585-1644
MHGETVDQNQYDQQFDHLEVKEEQSEEISRNCDELGGQLPMPTNNGQIYDNFSKAINKKKREIVEKFHKIKEKVKQMGKKYSKKEWQKIERKIATKLGANKMKIYKWKSELGMMTNKNYSVEEKRIMLKQFDQIYGKLKMKLNGKLEGKGRKCQKIIAKHLGTNISSIQRWKKEIKVGKMVKNQKTDDEKREIVEKYLKVKIKFMQNGKHSQKEWKAFNAKIKQMFGNPNFNPVAPVGSSERPHDS

SEQ ID NO: 146688 - protein, 330 aa, Heterodera glycines
  Coding regions on vcDNA: vcDNA=SeqID_73111; Strand=-; Position=1 -937,1007-1062
MKILLIFLLLCALIFKKAINQIEAGKIIQEKSFAEIFGQRWDDGAEENICQNDQIMHGEIADQNNQFGQNVRQFDQIFDENVEVKEEESEEMSTDYDELGDQLPMPTNNGQSCDKFSNETNKNKRETVEQFHKIKEKVKQMGKKYSKKEWVKIERKIAKKLGTNQTKIYKWKREFGMMKNKNYSVEEKRIMLKQFDQIYAKLKMKLNGKLEGKREKCKKIIAKHLDTNIRTIFYWKKQLKSGKMVKKQKTDDEKREIVEKYFKIKKEFMQIGKHSRKEWKEFRAKIKQKFGVIFQTIEKWDKKIGLNQILSKGQKHYTFAEKTEKIKLIN

SEQ ID NO: 146689 - protein, 57 aa, Heterodera glycines
  Coding regions on vcDNA: vcDNA=SeqID_73112; Strand=-; Position=1 -42,116-247
MSKLDGNPFADPFKDPAVQRVVSPAASVGNNSTSQSVIEEYNPFAPSASAGQVSACF

SEQ ID NO: 146690 - protein, 84 aa, Heterodera glycines
  Coding regions on vcDNA: vcDNA=SeqID_73113; Strand=-; Position=1-255
MSEKSPNGSGELRLEDNILRPDEKNVFTEALRIYESVGEQLKEKGQRRKGLVEFEADKCYVIEWEYRIERTGLTNWGGKRPSMV

SEQ ID NO: 146691 - protein, 140 aa, Heterodera glycines
  Coding regions on vcDNA: vcDNA=SeqID_73114; Strand=-; Position=1 -164,362-620
MLFLLAGPAFDPRGAKPLCVGTAREGHRTVRAHSSGSGQRSADAFAHFGRIDRLGGEQCPDALLESSKALAKKIAEAEGLKWTGEVAHLGEDIAKPREWTKAPKMFRFRDNEFWEMNTAHPQANFTFTQKDLRYSWPIHH

SEQ ID NO: 146692 - protein, 215 aa, Heterodera glycines
  misc_feature (23)..(23): Xaa can be any naturally occurring amino acid
  Coding regions on vcDNA: vcDNA=SeqID_73115; Strand=+; Position=1 -239,318-592,1123-1256
  Homolog annotation: Hit_ID=NP_492946.1; Match level="QueryCoverage =83%, HitCoverage=4%, E-value=1e-34, Identity=39%"; Hit description =DYStrophin related (417.4 kD) (dys-1) [Caenorhabditis elegans] emb|CAB61005.2| Hypothetical protein F15D3.
RFFLRQSPGKAKRMPSMPFFTRXFLTNRTTNCYKSPSELLSGQQKTLLGMCWRLIQIYWAKFAPSPSNERKLTEALKEWCLEATASCPDVLINDFTSSFRDGMAINILIKSFDESLIDLREISELRGEDRIENALSLARRHFRVPRLIQPKEFYSEHLDMKSVACYLMMVSTTVISPLAQQTHSQNELLTHQQQQQAIIFHQQMQLQQQQQQQSQ

SEQ ID NO: 146693 - protein, 172 aa, Heterodera glycines
  Coding regions on vcDNA: vcDNA=SeqID_73116; Strand=-; Position=1 -210,456-763
ASTTEQTTTSTTVPAPSSSSSAHHQQQQLQSPPSPTASSFSCKLKLFEAQSRNGGGGAAGYPNATTAAAAKPLVCAQDLEKLKEAAEQEAAMRRRAAAAAANSNNDGKQYQQHNQQQRQNCGGGRLAENAMEMDEDNDFGDDDEEADEHRDTVHELSRLLSSSSVLDQQQNG

SEQ ID NO: 146694 - protein, 85 aa, Heterodera glycines
  Coding regions on vcDNA: vcDNA=SeqID_73117; Strand=-; Position=1-259
YAPVTTFRPTTFCPAPLTPTPLPLSLAGQVGLVHLPAGARRCGAFGRLPRGRLSAGGQWERPARPHPPRSHPMHSDGGRPLGAVH

SEQ ID NO: 146695 - protein, 123 aa, Heterodera glycines
  Coding regions on vcDNA: vcDNA=SeqID_73118; Strand=+; Position=1 -172,483-628,1022-1075
MPMPSSALFNSDNSSGVERCAITDWGRRLSTERNGRLSSTGGTVPPGAMAPVIVAFAEKRTRNYGARAFLKTARAFLKTARAFLKTARAFLKTARAFLKTANSYDYNILCWSVHIFGECFKEG

SEQ ID NO: 146696 - protein, 274 aa, Heterodera glycines
  Coding regions on vcDNA: vcDNA=SeqID_73119; Strand=+; Position=1-825
  Homolog annotation: Hit_ID=AAG50897.1; Match level="QueryCoverage =90%, HitCoverage=79%, E-value=1e-135, Identity=97%"; Hit description= bacterial IS-element [Arabidopsis thaliana] pir||D86488 bacterial IS -element [imported] - Arabidopsis tha
MPIVLVDWSDIREQKRLMVLRASVALHGRSVTLYEKAFPLSEQCSKKAHDQFLADLASILPSNTTPLIVSDAGFKVPWYKSVEKLGWYWLSRVRGKVQYADLGAENWKPISNLHDMSSSHSKTLGYKRLTKSNPISCQILLYKSRSKGRKNQRSTRTHCHHPSPKIYSASAKEPWVLATNLPVEIRTPKQLVNIYSKRMQIEETFRDLKSPAYGLGLRHNRTSSSERFDIMLLIALTLPLACSLTPVPGVPAKSRRDPGPVRALIIIYLNTGLT

SEQ ID NO: 146697 - protein, 288 aa, Heterodera glycines
  Coding regions on vcDNA: vcDNA=SeqID_73120; Strand=-; Position=1 -110,534-642,1114-1333,1720-1838,3098-3265,3750-3892
SPNHLSLDSAVQSDWVQQSIHSSAAGHDGARQFAGTFLDVAQCELRLLPPSIVRLERLRVLDLCDNYLTELVAPQNGLSRQPGAARLALQHGRPVAGRTVAVPRAAHVGHQWEPIDGTAAEHWRPAKPGRAGAVREPNPALAQLSRPIEAVGSAEGGQKQFDGADPVNLFMRTAHRFDSVRESTAGNSFQHWQFAAVTIFGPEREQFARLSANNWWMSVVGNSLTAAQPSQRVANGNWQIESTPSAGPSGQQSTVLTVHADRTVQGQNTVRPLALLQPTAAAQADHHA

SEQ ID NO: 146698 - protein, 187 aa, Heterodera glycines
  Coding regions on vcDNA: vcDNA=SeqID_73121; Strand=-; Position=1 -93,135-605
  Homolog annotation: Hit_ID=NP_492498.1; Match level="QueryCoverage =60%, HitCoverage=22%, E-value=3e-39, Identity=68%"; Hit description =uncharacterized protein family UPF0027 (1J966) [Caenorhabditis elegans] emb|CAB04121.2| Hypothetical prot
MPRTYKDELNFIERISPVEFKIKKGFVPNMNVEGRFYVNAALEKLMFDELEVSTISSAAGFLPAVKQIGNVASLPAIVKNSIGLPDVHSGYGFAIGNIAAFDSADPQSVVSPGKLLKLLRPYSCIVFLRRCWLRYKLWRTTDQNKSLRKGRSASQGTACADNVRLYSRWDRLKRNYPNQCERLRRMP

SEQ ID NO: 146699 - protein, 31 aa, Heterodera glycines
  Coding regions on vcDNA: vcDNA=SeqID_73122; Strand=-; Position=1 -84,932-943
MTKRRTQQSLLPNALKSIKNIVNQTQKKLLF

SEQ ID NO: 146700 - protein, 63 aa, Heterodera glycines
  Coding regions on vcDNA: vcDNA=SeqID_73123; Strand=+; Position=1 -18,581-754
MILNLMTICPSALSSDEQNEAQKIRNLLSSFKGNEDDLLGYLFEDCLENPKEFVADKGKNHHI

SEQ ID NO: 146701 - protein, 169 aa, Heterodera glycines
  Coding regions on vcDNA: vcDNA=SeqID_73124; Strand=+; Position=1 -23,121-482,535-659
  Homolog annotation: Hit_ID=CAC21848.1; Match level="QueryCoverage =94%, HitCoverage=56%, E-value=8e-14, Identity=33%"; Hit description =hypothetical protein [Globodera rostochiensis]
MKVTKLESFVSIGFATKEMPLDGAIGQHLNSYGYRSDGSLGCNGISRPYKMGFGTMPMPFNAAVGQQRDRRYVGSANWPFPLEFVPVPMPSDGALAFQSPAFSTGDVVGCGVCLATRQIFLTKNGRRIDDSSFFTTTPINSLFPCVSLWTGDKIEANFGPSFKFNLATL

SEQ ID NO: 146702 - protein, 151 aa, Heterodera glycines
  Coding regions on vcDNA: vcDNA=SeqID_73125; Strand=+; Position=1 -55,145-257,510-590,682-793,900-994
MSSSIGSPDTFFRSETDQEAAAGAEEVGKYEVFSWHGNLSDQLSAELFVTDQQLLKECREKLANSELRETKLLWNNGELNAENRALKAELEKQKRMTEHIELKAKVFNMEQEKQQFEKKYVSVDVFNSLVERIKQLENQQQKKEEGRNGNK

SEQ ID NO: 146703 - protein, 221 aa, Heterodera glycines
  Coding regions on vcDNA: vcDNA=SeqID_73126; Strand=-; Position=1 -25,95-190,235-576,863-975,1631-1720
MAPGSGSQWQKQTEAVPTADGEGTSTQAAEKGPSTSTPDLRPRSSPRPLSATPIRRHVRVHQKTDEKATNMDFTTTDNATHMDLTMMDKATDVDLAYEDAATQTEQLDKQLKEQEQVISFLRQQVRNRDALITALRRQLEEKMAPPMETPTTSKKDDLLILGLVGTQKAYRRPKNTIRLINAKFDVFPPLEKRRSDQREEHDEFDQPEEETDEISLINVID

SEQ ID NO: 146704 - protein, 25 aa, Heterodera glycines
  Coding regions on vcDNA: vcDNA=SeqID_73127; Strand=+; Position=1-76
THRPEKTRCVPINRECQRKTLLFFS

SEQ ID NO: 146705 - protein, 89 aa, Heterodera glycines
  Coding regions on vcDNA: vcDNA=SeqID_73128; Strand=+; Position=1 -170,454-553
MTAKSILNQMIFSRSSQGNAAVPAHCPLQALRQSSQSAQLLLPLFLIQFHHLSVLWRQLGLLTAKPLNCIMLKKCLPRLTMSRGVFNAL

SEQ ID NO: 146706 - protein, 24 aa, Heterodera glycines
  Coding regions on vcDNA: vcDNA=SeqID_73129; Strand=+; Position=1-117
KRGDPFVLQNFFKIKNHDNFLSGV

SEQ ID NO: 146707 - protein, 141 aa, Heterodera glycines
  Coding regions on vcDNA: vcDNA=SeqID_73130; Strand=+; Position=1 -99,236-344,571-680,862-969
MAERKEFRRMFDETKMPKANPHFDQLLISFKSGKYEDSVVLELEQFAKFVQLQPVFTMNQQQIGQHFGREKLLTSMAADGSMGYTENVLPVLRLFTAFLTDINKSELKSTALSEPDVQQVPVRSLRSRPIKRVVSPDNGAN

SEQ ID NO: 146708 - protein, 36 aa, Heterodera glycines; identical to SEQ ID NO: 140203
  Coding regions on vcDNA: vcDNA=SeqID_73131; Strand=+; Position=1 -66,127-171

SEQ ID NO: 146709 - protein, 169 aa, Heterodera glycines
  Coding regions on vcDNA: vcDNA=SeqID_73132; Strand=+; Position=1 -103,436-553,983-1134,1514-1636,1835-1848
  Homolog annotation: Hit_ID=XP_425887.1; Match level="QueryCoverage =96%, HitCoverage=13%, E-value=5e-10, Identity=30%"; Hit description =PREDICTED: similar to transcription elongation factor B polypeptide 3 binding protein 1; elongin A bindin
MGYLAAIPMLIKRLRDAAADGHNSHDEGGETRRRDSVSHTSVLLGRHAKTVTCGLHRAERSTLTAQHTNFTEADFYNALQDAYLLTDQQMWDNGYPRWAETSAAADKAMEEEEGQGLDTDDPIAVLSRVCDRCGKEYRLTKEGDYAAGASADQCIFHWGRAWKKRAIFG

SEQ ID NO: 146710 - protein, 85 aa, Heterodera glycines
  Coding regions on vcDNA: vcDNA=SeqID_73133; Strand=-; Position=1 -169,518-606
MAPATANNHGAGSSPAHAVTAASSADQNDTSTASQKGKCKALYEFQALNPGELDFKEHRTDDTNCALGWSTEQVKQTHLNLLIIP

SEQ ID NO: 146711 - protein, 63 aa, Heterodera glycines
  Coding regions on vcDNA: vcDNA=SeqID_73134; Strand=-; Position=1 -124,313-380
MSLSALKKQFNKANQYLNESIGTAEATKLDEEFTEMERVSGEGGHDKRTDHAGHRGYQRIFTA

SEQ ID NO: 146712 - protein, 231 aa, Heterodera glycines
  Coding regions on vcDNA: vcDNA=SeqID_73135; Strand=+; Position=1 -124,175-276,329-798
MSKKKLKQKSDVKKPVHKRWDKREEQQKKLERARQAKLAKKTVQQQQIDHGEGEAEMEQQEMDQAEQVEETYDHAMHFDFQLENDVQMSPNLAIDDQQPPTWDATAEAGVQCAIQTMEVSTQTDWNIHALLSADQIADFRATADQFRVHMLEHFRRHCSTSKFHHLVHHAPEFAENHGFWGLLSEQPVEKFHALFNDDLARKANIKDLHDILMFCARESAIRNAIFDSNEL

SEQ ID NO: 146713 - protein, 29 aa, Heterodera glycines
  Coding regions on vcDNA: vcDNA=SeqID_73136; Strand=-; Position=1-91
IFCISIEKKILNRLIRKFNAKIRPTLELF

SEQ ID NO: 146714 - protein, 126 aa, Heterodera glycines
  Coding regions on vcDNA: vcDNA=SeqID_73137; Strand=+; Position=1 -81,248-406,986-1069,1573-1629
  Homolog annotation: Hit_ID=NP_495838.1; Match level="QueryCoverage =84%, HitCoverage=7%, E-value=4e-24, Identity=43%"; Hit description =carbamoylphosphate synthetase 2/aspartate transcarbamylase/dihydroorotase; rudimentary homolog, PYRimidine
MHGKLFGAARAVVGELVFQTGMVGYIESLTDPSYARQLLVLTYPLIGNYGVPDETKKDPKWPQLPSKCFESTQIWPAALVLVLESDDPERFQFVNINEENLVAKVSRKVFSAARLCRSRRPMGFSP

SEQ ID NO: 146715 - protein, 142 aa, Heterodera glycines
  Coding regions on vcDNA: vcDNA=SeqID_73138; Strand=-; Position=1 -281,330-477
MNDDKLINEITDDLNIAMEHVNSAKSKITTVLAIQKEKEGALKRRIDTLYEENGKEKDNSTRLLKEMKKFKSFAEVTIKHGQECFSSSADITLGADLTDISGDIEETLKLTTMDGSNEVQLDQDHRNVKEGELEVEEQQILG

SEQ ID NO: 146716 - protein, 17 aa, Heterodera glycines
  Coding regions on vcDNA: vcDNA=SeqID_73139; Strand=+; Position=1 -48,477-482
MCPKLITKLKMVGPLHM

SEQ ID NO: 146717 - protein, 75 aa, Heterodera glycines
  Coding regions on vcDNA: vcDNA=SeqID_73140; Strand=-; Position=1 -160,639-706
MANGWRRRRRRNIMPMGTTTTIGTTMARMIVPFLVISAVTEAAAAAAAEQTARVPNANAMPIRLLLRRFLREIDG

SEQ ID NO: 146718 - protein, 257 aa, Heterodera glycines
  Coding regions on vcDNA: vcDNA=SeqID_73141; Strand=+; Position=1-774
MSRTPLNDITNHRSPGQNQGNAARTRSAMGRENIDPNVPIEGHNLPLFEEEIPLENPWNWRNLTESDSDSVTEIAREFSPMSLDSDPEWTWNPPRSIWPRNGREPLSQWFPRVMGNHWHERERRSAEALLRDFLRNSAFLTTNHLATNREIIFDGLSRSGAERTNIYPGFTVLNHFEGRGITINPLVPLVQECGGFSPRRGEIHMDYFPTEVVDLCYFERETEIPQQINQQLRQDDTDPGGNRNLREFSEPPVARDR

SEQ ID NO: 146719 - protein, 146 aa, Heterodera glycines
  Coding regions on vcDNA: vcDNA=SeqID_73142; Strand=+; Position=1 -132,330-638
MTKSSSSSSEGELSDASFSPNDKIPLCQRGIKGNPLELVDAARADTLPKKAEGRARLPIRGPVSIAPRKPSPPSPKVKATTESSLRRRQHSDLSGMACPDLSGLARISTDGRPGTSGYGGLAGSLRMRDPGLAGMATEPLVPSKVN

SEQ ID NO: 146720 - protein, 272 aa, Heterodera glycines
  Coding regions on vcDNA: vcDNA=SeqID_73143; Strand=-; Position=1-817
  Homolog annotation: Hit_ID=AAN87269.1; Match level="QueryCoverage =97%, HitCoverage=11%, E-value=6e-42, Identity=37%"; Hit description =ORF [Drosophila melanogaster]
KVLGLIWDIDKDDIVFEFPSVDSLKIVNRRLVLSFLASLFDPLGLMGPCIQPLKLFFQSLWEEKKGWDDALSEEDSTRWNAFQESWKDKRIRVPRRTMIQGECSLQLHAFVDASIHTFATAIYLRVESSNKIQNWLIFSKNRLKPKSASKALTIPRMELMAILIGIRGLKFIQTQLRRAIEHSYLWSDSQIALNWVASKEAQPKFIERRIKEIRTITKCSFHFVRTAENPADLATRGATPEELSTHSSWWGGPNWLTKDQNHWPHELFFEIK

SEQ ID NO: 146721 - protein, 1574 aa, Heterodera glycines
  Coding regions on vcDNA: vcDNA=SeqID_73144; Strand=+; Position=1 -2396,2731-4051,5139-6145
  Homolog annotation: Hit_ID=NP_509552.1; Match level="QueryCoverage =25%, HitCoverage=22%, E-value=4e-58, Identity=35%"; Hit description =reverse transcriptase RNase H-like protein family member (XJ813) [Caenorhabditis elegans] gb|AAA85753.1|
MSELLRITIAPIVKRLKLYIETAQENLTKDLTEEIRTDLLAERQNLCRAVSLLEKNNDKWEAVFHRVKGPALQEEEQNYKDYKPEGKAFMEWADQARGLVDTIDGALGLSEQGDDVVHPAQVQQPVQNIQPQVVVAPQRHEVMLPPISLPKFSGEPREWPLFWKLFETSVESLQIEDFKKHIYLLGCLPEKSVARRAIDLYPPSDENYPRVVEILKKRFGDEKSIVETLQSELLHLPKPSDSVQSLRQFSESIERICQQLSDFGENEQNKFMASTIKSKLPYHLLTQVVEKEMRSGGTFDCSDLRKAITSIVEVKEEVQRCTQVFRGEEKPRNFPPQMQRNNFQGRGTNFPPNQFRQGHWRPNNRNESVGMMSPQIHRSFNTVNQREQTHFSPRERGTNPLCSLCSDMGHAPSKCPKYPTPGARRRRLADQQRCFNCLMQGHNSQQCSSSKRCPKCGEKHHFMICYSEGDAPRGSTPQQTSKGGAVQKKQSSNRRGEPPRPTQNHFSALNEPLRIRENPSEISIFDGKRTNVLTSVVTKKSHAFLMTRRLRVRSSRDPRRMIKAMFLFDPASQTSYMSDPLIKKLKPHKVTSEEMEVYGFGGERNGPIRFHSPVYSVQIQRSDNKWEEILLNRTEQISTPFKMVEWNSHDYTSEEQDVFQALSFSQDEPEILISARHFWKFFQSKKEVLPGLFVIQTTLGPLVNGESDFGPNVQNPGLSMMTIDESNQEQMPATKEIEYFFNLESLGIKEDPNEDDDQTAMQLFDKSIRRENGGRYSVKWPWKKETPNLPSNYRMAFSRFISLEPEDREVTKFLWLKDTEKPLSSENLIIYRFCRVAFGVISSPFILAATLQYHLKNCRSILAKELAESLYVDNALMECETPEEALTKYKEAKAILKEGCFNLREFITNSKEVMEAIPPEDRLEKAKVKVLGLIWDIDKDDIVFEFPSVDSLKIVNRRLVLSFLASLFDPLGLMGPCIQPLKLFFQSLWEEKKGWDDALSEEDSTRWNAFQESWKDKRIRVPRRTMIQGECSLQLHAFVDASIHTFATAIYLRVESSNKIQNWLIFSKNRLKPKSASKALTIPRMELMAILIGIRGLKFIQTQLRRAIEHSYLWSDSQIALNWVASKEAQPKFIERRIKEIRTITKCSFHFVRTAENPADLATRGATPEELSTHSSWWGGPNWLTKDQNHWPHELFFEIKEEELHDPPKEDEKIFLAHTCAEPKQQLFNAKRHHSWTKLINWETTTEEADPNDKQISSSEKLAALFKATREAHESFWYKWHNEYLLLLRERSKWDHKGAHLLDKGEPKEGMIVLIHEEFTPRNQWTLGKIIELNGRPGAIRSVQLEMPIHGIKSKRYGTMPRKVVITRPVNKIFPLEVGFENLTENGKENLKVNEDETANSSTENTTPHLGNKLPNEEQENEDKNSHLGEPKANQNKHGMITRSKAKVMTVLNCLTIFCIFGLAGAYPTNQCNECKLICSNKGVLAKIPKEIRKVELCCSENCYIDENVHKLTYELPKEILLNDYQCQGHFWMDSKHMFKKDILCPAVDECVLIECYLCMEQLANPTCYPLVSS

SEQ ID NO: 146722 - protein, 84 aa, Heterodera glycines
  Coding regions on vcDNA: vcDNA=SeqID_73145; Strand=-; Position=1 -46,325-390,670-810
LNNSPPSTASHKNNKFDDVNKFICIISTMMSMLKNVTHINLHKELTCMDSSGTYRLAFPSAAALLTFIYKNCPNITTFNVSNEE

SEQ ID NO: 146723 - protein, 55 aa, Heterodera glycines
  Coding regions on vcDNA: vcDNA=SeqID_73146; Strand=-; Position=1 -99,187-255
MGMNTMLLNAINVDLPNRSAFVTGGRSKPFVTEERYANRWATLLETGTIQKYHGI

SEQ ID NO: 146724 - protein, 63 aa, Heterodera glycines
  Coding regions on vcDNA: vcDNA=SeqID_73147; Strand=-; Position=1 -102,1572-1658
MRKFQVTLIGQLLCQRRPVAFGPLWNRKGGISDGLHELNKCQIDRAKMPTNALHSNRANSIYL

SEQ ID NO: 146725 - protein, 67 aa, Heterodera glycines
  Coding regions on vcDNA: vcDNA=SeqID_73148; Strand=+; Position=1 -47,569-725
MPKALKKDAELANCMTILTFSLKMNHTQIRKAFFLGLFMYVCTNQSPTDFFVLPKTNSNDKFNIFDC

SEQ ID NO: 146726 - protein, 38 aa, Heterodera glycines
  Coding regions on vcDNA: vcDNA=SeqID_73149; Strand=+; Position=1 -82,787-821
MLLLLLLLLDMLLLLLLLFLLLVRVPLDLLDKNYPDRP

SEQ ID NO: 146727 - protein, 146 aa, Heterodera glycines
  Coding regions on vcDNA: vcDNA=SeqID_73150; Strand=+; Position=1 -291,675-824
MQWIKFNCTLCPSGLQCFYPRKYAKPVLCAHPSVRNITDFLSTGQLGEAATTTTTTTTFPTTAEVSAAATECAPPPVHLTAWIAVCTALVALLVIAEAAGQRRADGAIEEGDEPVYDEVPLDSDIVVEMRDGENGEEEEEEDDSDF

SEQ ID NO: 146728 - protein, 232 aa, Heterodera glycines
  Coding regions on vcDNA: vcDNA=SeqID_73151; Strand=+; Position=1-699
MSDKKALFKRVIAEVDLTISTGGITLSGPRLSVPRFIPFEENGRCRACKGTEAEVDTMVTKEGITLWCTRIEKAQFVPFDVVYELPGHCFFRVKNKARVFSVPYSELPSSDRCTQPLPPPPPPPMTTAKHQRTPDDEEEEKNLRRKAKVALDLVEAGLAADAMMQDGTRWKKAKTAINVLANLLLAESLTDVSSTFDQQQQQQQLSSKEEEKEECINNSSASAQLNLLPMVM

SEQ ID NO: 146729 - protein, 135 aa, Heterodera glycines
  Coding regions on vcDNA: vcDNA=SeqID_73152; Strand=+; Position=1-408
MLLILDDLMLSIEERYLSDLFTKKSHHHQFAVVFITQNLFERKIKVARLSAQYLVLMRAPNSLLSIRNIGVQLFPRQLDFFLDAYRKATARPYGYLLIDMHASSDPALRLRTNIFKEEQEEDEGTVVFIPKNGAV

SEQ ID NO: 146730 - protein, 211 aa, Heterodera glycines
  Coding regions on vcDNA: vcDNA=SeqID_73153; Strand=+; Position=1 -195,855-1292
  Homolog annotation: Hit_ID=NP_502797.1; Match level="QueryCoverage =69%, HitCoverage=41%, E-value=3e-21, Identity=35%"; Hit description =HASI (4P602) [Caenorhabditis elegans] emb|CAB16520.1| Hypothetical protein Y57G11C.19 [Caenorhabditis ele
MPYRIPKREPKVEEAPQQQQPLPAAAVVVEEMPVVPPPRRGAKRRYPVYEDDEVQIRKRVRQPRRVDLADFQALSRHNRGHRYLLVAVDVLSKRLFVVPLKNKRAEEMLEAFKLLIDQMPMAPHRIFSDKGTEFKNRLLKDFFEQREIEKHEPVHSSVKASVAERAIRNVKQRLYRYFAETETLNWVDAAQKIVDGINRSPSRAHGMRPID

SEQ ID NO: 146731 - protein, 35 aa, Heterodera glycines
  Coding regions on vcDNA: vcDNA=SeqID_73154; Strand=+; Position=1 -21,2145-2231
MCGYTLMANANSRNWGQQQQQVVIFTNAMPFNDAY

SEQ ID NO: 146732 - protein, 93 aa, Heterodera glycines
  Coding regions on vcDNA: vcDNA=SeqID_73155; Strand=+; Position=1 -172,269-378
MGFSRLILITLISCCLLPLASVVLAQCPYQGWTVSGSCQIMGYCVDPRDKCYYRSSCCRISNQQYAQTTKQNPKTGLMETNYCPLGAYRDGGH

SEQ ID NO: 146733 - protein, 118 aa, Heterodera glycines
  Coding regions on vcDNA: vcDNA=SeqID_73156; Strand=-; Position=1 -217,267-325,456-534
MFRGGSTGEEQSNYVALDIQILKVPMLQCRAVDIHTSSPLAGLGQRAIAVMDDGDFGSVDDVQQKYRRTGSAGTNILYRIRREELAQGKHPTNKTDKGRTIRTVGQVEFDGSQLNVGK

SEQ ID NO: 146734 - protein, 90 aa, Heterodera glycines
  Coding regions on vcDNA: vcDNA=SeqID_73157; Strand=+; Position=1 -46,438-664
MCWTPSQVCVNRQDCCVQSNIPVNSNPYGPTNTGPNTNYPGFNAYNPGISGEDTCRQGQGQCPLTMCQDGCEFYFLKIQINNSKQMDIYF

SEQ ID NO: 146735 - protein, 140 aa, Heterodera glycines
  Coding regions on vcDNA: vcDNA=SeqID_73158; Strand=-; Position=1 -61,221-582
  Homolog annotation: Hit_ID=AAO85452.1; Match level="QueryCoverage =100%, HitCoverage=32%, E-value=2e-60, Identity=74%"; Hit description= putative gland protein G12H04 [Heterodera glycines]
MALSALLLLLPLLLNVQNIPEPQRALAKMHWELETIQKEKPEAPPQFDLGLFSEALEVMVEMDEEAKEVKLRKDKLIEWAGGEEAKKLKEKMTEEDTVPEVRVNENGKVEVKDGAGGEGRLEVRRTKDEKGREQVVITLM

SEQ ID NO: 146736 - protein, 110 aa, Heterodera glycines
  Coding regions on vcDNA: vcDNA=SeqID_73159; Strand=+; Position=1 -154,214-266,795-920
MKHSEVAVAYLQMLHGHVLAVHLSYCLSKCQRCWPVCHKQGNCCFFFALSTVTMKFMLKYLHIKLKLKWVIFNLTFSKYEEILYTQFGKLCPKYEEGTREIEDWIWGNKE

SEQ ID NO: 146737 - protein, 56 aa, Heterodera glycines
  Coding regions on vcDNA: vcDNA=SeqID_73160; Strand=-; Position=1 -39,493-624
MASDHFWSARIALLMFRVNPQRYNERVKQCVKESNVALESDYRDIPNDGGGRRASI

SEQ ID NO: 146738 - protein, 42 aa, Heterodera glycines
  Coding regions on vcDNA: vcDNA=SeqID_73161; Strand=+; Position=1-393
RAKIYANYAIWRYEQFCLTLGLTHSVAADPQNVQPTKCPSLE

SEQ ID NO: 146739 - protein, 15 aa, Heterodera glycines
  Coding regions on vcDNA: vcDNA=SeqID_73162; Strand=+; Position=1 -15,101-133
MSLMRNLNPGNPIPA

SEQ ID NO: 146740 - protein, 56 aa, Heterodera glycines; identical to SEQ ID NO: 146737
  Coding regions on vcDNA: vcDNA=SeqID_73163; Strand=-; Position=1 -39,493-624

SEQ ID NO: 146741 - protein, 48 aa, Heterodera glycines
  Coding regions on vcDNA: vcDNA=SeqID_73164; Strand=+; Position=1 -71,223-298
MALNARQRIVVLCLVRHFSTYVFRAFKMKYNFLKILFHFLSMENIGTN

SEQ ID NO: 146742 - protein, 58 aa, Heterodera glycines
  Coding regions on vcDNA: vcDNA=SeqID_73165; Strand=+; Position=1 -68,120-228
MNLMTTFLTTKRKSWVLISFHFQNCGPEQRLLRQKRGQSDIGHRCDSERSKKGAQIPT

SEQ ID NO: 146743 - protein, 23 aa, Heterodera glycines
  Coding regions on vcDNA: vcDNA=SeqID_73166; Strand=+; Position=1-70
MHQSLPLFLPLFIFFVYATDCLN

SEQ ID NO: 146744 - protein, 140 aa, Heterodera glycines
  Coding regions on vcDNA: vcDNA=SeqID_73167; Strand=-; Position=1 -236,831-1017
MSSHSSSSSSSSGGSLKPDTLAHSGGWRNDHFCHIYEHQTAIKIRITSYDMLPIAPAPKHHCAVVTFLCKTCAKKTHVTDPKRMVEEYLCPCPCSDKTLIKIEVNKVKNTATRHVITAEVKCPCHGAPTFVTYELTAAGK

SEQ ID NO: 146745 - protein, 182 aa, Heterodera glycines
  Coding regions on vcDNA: vcDNA=SeqID_73168; Strand=-; Position=1 -210,545-699,820-1004
SSSSSGGSLKPDTLAHSGGWRNDHFCHIYEHQTAIKIRITSYDMLPIAPAPKHHCAVVTFLCKTCAKKLTLGEYGNFIKIVRTKKLRCHQTLNDVYADMPLRGYCVIWYNCQKWADDFFDNVIQKEWLKSTFARAHAQTTLIKIEVNKVKNTATRHVITAEVKCPCHGAPTFVTYELTAAGK

SEQ ID NO: 146746 - protein, 143 aa, Heterodera glycines
  Coding regions on vcDNA: vcDNA=SeqID_73169; Strand=-; Position=1 -236,825-1020
MSSHSSSSSSSSGGSLKPDTLAHSGGWRNDHFCHIYEHQTAIKIRITSYDMLPIAPAPKHHCAVVTFLCKTCAKKTHVTSYLVIQKEWLKSTFARAHAQTTLIKIEVNKVKNTATRHVITAEVKCPCHGAPTFVTYELTAAGK

SEQ ID NO: 146747 - protein, 48 aa, Heterodera glycines
  Coding regions on vcDNA: vcDNA=SeqID_73170; Strand=+; Position=1 -20,82-208
MRVRRCSAFVIQTAFFAAFFKKLFLGLGSQGGNMKFGHREVWAPEGGI

SEQ ID NO: 146748 - protein, 143 aa, Heterodera glycines
  Coding regions on vcDNA: vcDNA=SeqID_73171; Strand=-; Position=1 -236,825-1020
MSSHSSSSSSSSGGSLKPDTLAHSGGWRNDHFCHIYEHQTAIKIRITSYDMLPIAPAPKHHCVVVTFLCKTCAKKTHVTSYLVIQKEWLKSTFARAHAQTTLIKIEVNKVKNTATRHVITAEVKCPCHGAPTFVTYELTAAGK

SEQ ID NO: 146749 - protein, 119 aa, Heterodera glycines
  Coding regions on vcDNA: vcDNA=SeqID_73172; Strand=-; Position=1 -11,534-647,816-1050
MHLRLPDIWTVDITTVDIRTVKSFGQKWTFGQWTLRQWTLGQSGHLDSGHYDSEVIWTEVDIWTVDIRTVSHLDRSGHLDSGHYDSEVIWTEVDIWTVDIRTVKSFGQKWTFGQWTLRQ

SEQ ID NO: 146750 - protein, 138 aa, Heterodera glycines
  Coding regions on vcDNA: vcDNA=SeqID_73173; Strand=+; Position=1 -346,2162-2232
MVIPPLASSAAENALVTQQKRRTKRGFELFRRHDGCAGNWSTGQECAGGASIFVLSIFVIILCAFRLSHEAKLHTMSHPGTIQLIALLSLIAFCVALIIGLYMMLRGCFGAKLDGGLVRSMSAVNNSLIYAQMLDDHS

SEQ ID NO: 146751 - protein, 139 aa, Heterodera glycines
  Coding regions on vcDNA: vcDNA=SeqID_73174; Strand=+; Position=1 -155,519-655,1314-1441
MPAVNKLALSYAKLFERPILKFSLIYCHFHIFMTGVCGLVSILTYMAICVERYIVIICPLHASNWCTRSRILLVINSIWAFAIMYRLPYFDLIGTEKQRKIRQRRKVMKVLIFCFVLYFLCSFGSISLFIIWFFLYFTF

SEQ ID NO: 146752 - protein, 92 aa, Heterodera glycines
  Coding regions on vcDNA: vcDNA=SeqID_73175; Strand=-; Position=1 -15,73-234,287-385
MKPIIQLKSPNRIGYRQVQITDSVLRVQVEDRSQLISPEAEINPMLGDQPHAQRMLQNVAPEAHWDSITDLATLWPHLLVSAGREGVIKMWR

SEQ ID NO: 146753 - protein, 109 aa, Heterodera glycines
  Coding regions on vcDNA: vcDNA=SeqID_73176; Strand=-; Position=1 -24,180-290,346-445,906-965,1214-1240
  Homolog annotation: Hit_ID=CAG07219.1; Match level="QueryCoverage =98%, HitCoverage=25%, E-value=3e-27, Identity=55%"; Hit description =unnamed protein product [Tetraodon nigroviridis]
PPPPPPTDFFNFKICSFLKAFASSLNGTLATLAVLKGVGVGNEQATVTVLAAALTWILKDGVGMLARIAFAWAKGTRLDSDCKRWRLFADLLNDASFFIVTIVSSFPSE

SEQ ID NO: 146754 - protein, 41 aa, Heterodera glycines
  Coding regions on vcDNA: vcDNA=SeqID_73177; Strand=-; Position=1-123
MPKSLASQVEAIEQQQQNIVETYNGEPVHEYSFARPRGDGD

SEQ ID NO: 146755 - protein, 40 aa, Heterodera glycines
  Coding regions on vcDNA: vcDNA=SeqID_73178; Strand=-; Position=1 -61,311-372
MLNCELIYWKYIQVDEFSLKEFEFLNFVISAFFSPRKCVS

SEQ ID NO: 146756 - protein, 280 aa, Heterodera glycines
  Coding regions on vcDNA: vcDNA=SeqID_73179; Strand=+; Position=1 -102,171-260,313-410,908-1038,1084-1144,1441-1491,1557-1863
MDNNSPGPSNNVNPENKIGKTNVGGPLSDIDLFKEICGIDEPTASALLRESGGDLEAAIHQFFFTRENPEVLQNQDNEVQELRRRAIGDRARNNQQNQSLPVVSAPPNAPLISWSQWVRGIFLIPFRYLYTTAMDVFFFVFDFFFGGRPPRRPITGNNRQNNANPLARGQQDVLADRIIMREQQQAYEQALAIDKQKAEQLKMEKQRAQAEADKVNNRKAFLARKRGEVAANIGKTAAETNGTGGGTVAEEKGEDLVRIRLVFPSSARMEQNFRHSDSLE

SEQ ID NO: 146757 - protein, 205 aa, Heterodera glycines
  Coding regions on vcDNA: vcDNA=SeqID_73180; Strand=+; Position=1 -69,1007-1555
MRTLPYFIIFITSREKLLAKMAEPLNFQFLNCFFVLINLNSASSNLDLIMTEKKLLSTAPSVFFQSDEFLFEKWFQNYIFGILCAEESERKITPENYFYNFYEKAQKLRKDFCWTMKNGQSVEKATEKFGKNARKLIKELENDQKIKQSIQKAMKNKNIKKLNEAEIISVIKEFEANSAEENKNQINSLVVQWVYLALNGLWKAI

SEQ ID NO: 146758 - protein, 28 aa, Heterodera glycines
  Coding regions on vcDNA: vcDNA=SeqID_73181; Strand=-; Position=1-84
FTSEKCTWRINKERNKGRRGRNSKTTPF

SEQ ID NO: 146759 - protein, 539 aa, Heterodera glycines
  misc_feature (498)..(498): Xaa can be any naturally occurring amino acid
  Coding regions on vcDNA: vcDNA=SeqID_73182; Strand=-; Position=1 -1524,1804-1924
  Homolog annotation: Hit_ID=NP_510671.1; Match level="QueryCoverage =92%, HitCoverage=52%, E-value=3e-85, Identity=34%"; Hit description =predicted CDS, endonuclease/exonuclease/phosphatase family and RNA -directed DNA polymerase (XR69) [Caenor
NYDNSVIFSPDQKAEIFAKIFSEHYLHNSKSLPFDLSSHSPVINDIEFNVVDVGRVLKSLPNKNNTSPDGINFRLIKKCFLSFAPYVTELFRISFDTGKLPTFWKKSIIIPLFKKGDKSCLTNYRPIALTCSLCKIFEKFVVRAITSFLLKQISVHQFGFVKGRSTVTQLILTLENWFDGIYNGKNIDCVYIDFRKAFDVIPHSLLLYKVHKIGIRGKILNWISDFLANRSFLVRVENSFSSEYKMCSGVPQGSVLGPILFLIYINDLPKKIPKGIFIKLYADDVKLYSIHRTKTDKALRQLSNWSNEWCIDISINKTFVLYLGKNNPREQYKINNNTICEVDTIRDLGILIDNKLKFTEHINTVTRNAYGRMRFLFRIIKSKRISIWKNIFISYIRPLLEYAPEAWNPQLKIHINKIEKCKYFTRIALRKCNLPYNPYGQRLELFKLPTLEKRRKKFDILTTYKIIHFHVGSPSCKSPKVAPRWDQLTGSGYKQNMXHTSISSENWNKFSKFVHFRVNVITWTTNRRELKLILIQIKA

SEQ ID NO: 146760 - protein, 221 aa, Heterodera glycines
  Coding regions on vcDNA: vcDNA=SeqID_73183; Strand=+; Position=1 -337,621-799,1736-1887
SARRKISEDYKEIQLPSPVFLDDQDQTLWDKRAAKKRLLFHHSSLDVPAMGSIDTAHDDLAHRYEDMDSEAELAIQEEPPRYINDEEAEDFEEMIKLVARKMPKMEFLQVRNNPILLRDADPLTTRKKLTKRGSGKGSAASGGGGGSTLLRQHSKSRLKKLSEQSDSRTPSADATEMLAELSAMVAKSTAHSGATSPANILQFIEEQKQKASSQAVAGEQP

SEQ ID NO: 146761 - protein, 156 aa, Heterodera glycines
  Coding regions on vcDNA: vcDNA=SeqID_73184; Strand=-; Position=1 -24,74-235,449-604,679-804
MDDELNTTASREKKTEPITLIEAKEDVISNIENVKAAKLENEDQAKAENEEKGQIGGDKSEDKTAISDGQQQNEGITVKGCAAAAAADEEDDDGTVVTSSNIAAQRSLKWDDTVPDQKEEKPAATEEQKVRTNSCKDENGFTYYKCRFCGLTFNYM

SEQ ID NO: 146762 - protein, 199 aa, Heterodera glycines
  Coding regions on vcDNA: vcDNA=SeqID_73185; Strand=+; Position=1-600
MKNDKGLEISEKLEQNQEIVHKFLGIESESLEDESDEYDGTNEYEKDEASYEYENRGILSDILEMDRKKRTTVTTPDARWVKKVEKSKLRKSGGQENKNTNTRVNYALYKLNEDRKRQYDQIFTQACENSKFQLQLAKAILQISPNEGVRRIFNRDDLVAKWKGEKLEVGFCAPIIPEKIIWDKKIGKECFEWVPILPK

SEQ ID NO: 146763 - protein, 901 aa, Heterodera glycines
  Coding regions on vcDNA: vcDNA=SeqID_73186; Strand=+; Position=1 -1985,4045-4763
  Homolog annotation: Hit_ID=AAL75999.1; Match level="QueryCoverage =22%, HitCoverage=7%, E-value=3e-40, Identity=45%"; Hit description =putative polyprotein [Zea mays]
NIQNPLVLKAGALFESDSIRVEEAMMEYRKRINNLPASTFRVVKRPNISEVIKLIKAEAKETLGIVMGNTGNLLDLMRNIPEKAKEAVNYLKGMSFLLVILPILVLIAIIGFIVTKYWPIIYAGFRAGSVATRVIRRIIGMKRHRTRVAAVPTAPELADLNSVDEEAYVLDYLPPRRIAAITNDPRRLPSIRVHFNGLLTAALVDSCASVSYCRESIARKAGLTINDLNGENANLTAANDSRIQILGKANTKIRIEDQNGKCGEWEITVLVSPDKHCPGPVLLGLPILTDLKGVIAFSERKVRLGEIWANIISVVEAEKPKNVKITLENDEIFEPRTENVITAKVNESFSPDQNFLVKGTINRYPSIIVGRTLVAPGDKNFVTLQIMNAGKMPVKIYGGSHLADLELVRIKALPGDEIHPKDYIPSETRWHEKLPNLPNMAINRLPSERLNLEGTRLSGETQEKLKEIVDKYREAFVADDGKIGLYRGPIAHKIDLMPGSLPFHFRPYRYPPETQKEIERQIKIMLDQNIIRESESEFASPIVMVPKADKKSWRFAIDYRALNKMTKKRVFHLPNIQELLDLMGAKKYYTCMDMQQGFMQIPMAPEDIEKTAFISHLGIYEFIMMPFGLTAAPDTFQRVMNSLRRRLTAAMLIYLDDIIIGTILPLRESDEPLNWEKYVDDPNVEQEEAEMSEDSGKEDKKGKEIKKFSKFGFESSDEEDQSLKIFFVRNNENWDLNENEQIWEQNGEAEEENEIPCTTTEIFLDGEITLAYTSWPEANLISLTSLVPTNLIKDDWEIHTNEFGKRYITAWLFGISFELFLSDEPDRVVLGIQAQFSINDEWHSKTEGERETYWEQLGEIDGQILEIQRIPDITITYSENPLIIDYEFDQNDDQNNSPTIN

SEQ ID NO: 146764 - protein, 160 aa, Heterodera glycines
  Coding regions on vcDNA: vcDNA=SeqID_73187; Strand=+; Position=1 -118,174-292,649-894
MPATTFFITIITLVIFSHLHFLANTSSVTNGTSLLNETIVPKLRILILTTRIPITETHYVLHRKMAELLADDAEHVEKVLLLVAKPDCAETSEVPSKFHGRLLVWNRMTFGTNAAQNVEECQEMVNKIMLDMQTRPNLWEKNGTQFLPSADKPYMGNLGK

SEQ ID NO: 146765 - protein, 117 aa, Heterodera glycines
  Coding regions on vcDNA: vcDNA=SeqID_73188; Strand=-; Position=1-354
MNGTDRTNNFAEAYHCTLQLSIGQGHPTDLEIHKQFARASENNRRGLRTFPRRKCSAAESKALPCSGQTNFEDSGAYNEEKTQPQIDDDHQYGQNQNNRNLIIEMLRGISSNYQMGK

SEQ ID NO: 146766 - protein, 21 aa, Heterodera glycines
  Coding regions on vcDNA: vcDNA=SeqID_73189; Strand=-; Position=1-70
FEPVTPHFLTNSQTTKTKKPT

SEQ ID NO: 146767 - protein, 149 aa, Heterodera glycines
  Coding regions on vcDNA: vcDNA=SeqID_73190; Strand=+; Position=1-450
  Homolog annotation: Hit_ID=E86336; Match level="QueryCoverage=78%, HitCoverage=33%, E-value=4e-26, Identity=61%"; Hit description =hypothetical protein F14O10.11 - Arabidopsis thaliana gb|AAF88160.1| Contains weak similarity to an unknown pr
MANDEPTEAAKLAEEFATKNLTTKERMDAILKMISGRSGEEGAEEEEEGEEDEEGEEDEDEKMTGEELEEREEDEEEVELEEREEEDLEVMEELEEVEELEEEEKLKEREEEKEEEEEEEEGELEEKEEEEKRMEEKRREEWQRSNSLV

SEQ ID NO: 146768 - protein, 15 aa, Heterodera glycines
  Coding regions on vcDNA: vcDNA=SeqID_73191; Strand=+; Position=1-45
MAFELWLYDVSPPRK

SEQ ID NO: 146769 - protein, 61 aa, Heterodera glycines
  Coding regions on vcDNA: vcDNA=SeqID_73192; Strand=-; Position=1-186
GNPTLSAKSRVSARGPPYGCVHHPKHGERHALLIGTDPSHCEHCAFAWHSLAHGRGAIRKR

SEQ ID NO: 146770 - protein, 138 aa, Heterodera glycines
  Coding regions on vcDNA: vcDNA=SeqID_73193; Strand=+; Position=1 -267,830-979
MAQKFHSMIVSITLLVTVMAHHAHSLTTPLTAHVHPVPQYTGFPETVAVPVPPLPCKPLSAAQRAALAPAHPSAADASPQQEMLQFHRMASPAVVAIAVTVVAVAINACASVSAHHAAASAAQAAVDVKMFKFGQTFF

SEQ ID NO: 146771 - protein, 84 aa, Heterodera glycines
  Coding regions on vcDNA: vcDNA=SeqID_73194; Strand=+; Position=1 -137,196-315
PGYGCGCRRRRRRALTAPFGYPMPMFLQQLRTPIYEPRLCRELCQVRVLSERSHSIGEVHTNVNLISADDRQRMAASAAGNEKL

SEQ ID NO: 146772 - protein, 128 aa, Heterodera glycines
  Coding regions on vcDNA: vcDNA=SeqID_73195; Strand=-; Position=1 -159,341-427,479-604
  Homolog annotation: Hit_ID=NP_741631.1; Match level="QueryCoverage =100%, HitCoverage=23%, E-value=9e-30, Identity=47%"; Hit description= putative nuclear protein of bilaterial origin (5L987) [Caenorhabditis elegans] emb|CAD21703.1| Hypotheti
VVFHVVGDRQLVEQDISSRHPCINALRNVIRLAHSGINHITFPLLLVEHMTESMTISWCLSRAELVFKCLKGFLMEVCSSGNAGGANAGGAPHFNINFVLPSAISPSLFQQLVEMFSSIFHSVPSLNA

SEQ ID NO: 146773 - protein, 101 aa, Heterodera glycines
  Coding regions on vcDNA: vcDNA=SeqID_73196; Strand=-; Position=1 -151,681-835
MKANRKRRAAAAAVRQRRRRQQQQNDCDSSEKANNEPPPLAGLQASAVEEASLPRLMISTCNNDIVDDNSEFSQGAVYYTRTSSSAPNNQCTTARIYNKVM

SEQ ID NO: 146774 - protein, 31 aa, Heterodera glycines
  Coding regions on vcDNA: vcDNA=SeqID_73197; Strand=-; Position=1 -18,200-277
MKEGRGDYGSKLLKYRGESWNLFHFSAFAPV

SEQ ID NO: 146775 - protein, 43 aa, Heterodera glycines
  Coding regions on vcDNA: vcDNA=SeqID_73198; Strand=+; Position=1 -97,542-576
MHALFACRLSVARALVAHQLAHCAAAAVIKRSVTFLLNSFNPR

SEQ ID NO: 146776 - protein, 83 aa, Heterodera glycines
  Coding regions on vcDNA: vcDNA=SeqID_73199; Strand=+; Position=1 -70,121-302
MELGISKETFIKWKKELTPNYNKTQNSIEEKLQKMKQYFEIKEANPKISDEIIAGKLDIQLLENGKSFLIYNLLMYDYWFIVI

SEQ ID NO: 146777 - protein, 125 aa, Heterodera glycines
  Coding regions on vcDNA: vcDNA=SeqID_73200; Strand=-; Position=1 -111,156-422
MGEEMGTDPNGQMSEYSNQMLSKVIKIREKNQMINKKKNEKYQNKDRAKIELKIAKSLGVNRQKIYKWKKELNLNQNKKMEKSFYVEKKIEFIERFNEFKSFMEKGNRKNLWAFLKTHFGDGKKN

SEQ ID NO: 146778 - protein, 87 aa, Heterodera glycines
  Coding regions on vcDNA: vcDNA=SeqID_73201; Strand=-; Position=1 -67,242-438
MSHLLTQFYRINVDPVVSIGAAGLEFKIFCRTGSGWINNANPAILQILHFPNNAGLRTGILQNPAHDPVLLRALPLSALVHFHGFDF

SEQ ID NO: 146779 - protein, 19 aa, Heterodera glycines
  Coding regions on vcDNA: vcDNA=SeqID_73202; Strand=+; Position=1-58
YANYAIWRYEQFCLTLGLT

SEQ ID NO: 146780 - protein, 247 aa, Heterodera glycines
  Coding regions on vcDNA: vcDNA=SeqID_73203; Strand=-; Position=1 -116,181-299,589-788,854-1066,1329-1421
  Homolog annotation: Hit_ID=CAI24536.1; Match level="QueryCoverage =56%, HitCoverage=31%, E-value=6e-25, Identity=36%"; Hit description =novel protein [Mus musculus] gb|AAH18468.1| RIKEN cDNA 4933407N01 [Mus musculus]
MAILILAIALPLAYCLVDIKELEYLRALDDSISYRVVFKPFDELPEQFLPSEPTTISPTTASPKTTTAAQEPISEHEKVLQQQHEDNDNEIDGSEQQQQSQSSPLSSPSSSFSSSSATAEQPKLVKIVSADAEEYQCVLPVLASSSKKRIKSYHGPSPAELIQSIYREQICSYRIEPYWNYELCHGRYVLQYHEDKESKKRTEYFLGNFVAMNAEVEARHFDQLNPPTRKMGDERLAYYPVTYTHGT

SEQ ID NO: 146781 - protein, 230 aa, Heterodera glycines
  Coding regions on vcDNA: vcDNA=SeqID_73204; Strand=-; Position=1-693
MKRTNATNITPPRAKRSMAPALDPITAALAEQERQRTLVFIGLPESNAVRPSERVQEDREATTKILDHLEVEAEPTAVFRLGRYDPQRTTPRPLKVVMPTPTQQHVALGGWKRERARLRSQQNLARLFVRPALTKEQLKEEYEERLRKRQQTPAPLASATKFSQTTNDQTPVVAKGPNKKKTSEDISQPPEVFDKTILVCYETLNSLPPTDKIVHQIQSLKKQHPHLFNK

SEQ ID NO: 146782 - protein, 50 aa, Heterodera glycines
  Coding regions on vcDNA: vcDNA=SeqID_73205; Strand=+; Position=1-150
MTVTSTKNNSFPSSFKDITLHDVWASNLEAEFAKLRDLIDDYPFVAMDTE

SEQ ID NO: 146783 - protein, 118 aa, Heterodera glycines
  Coding regions on vcDNA: vcDNA=SeqID_73206; Strand=+; Position=1 -138,302-424,498-593
  Homolog annotation: Hit_ID=NP_499553.1; Match level="QueryCoverage =83%, HitCoverage=31%, E-value=3e-27, Identity=61%"; Hit description =yeast CCR4-associated Factor, CAF1 family ribonuclease, CCR4-NOT transcription complex subunit (33.8 kD)
MLVKLPEDEKDFFRYHRKLFPNSFDIKILLRQPGPRDAMLKGGLQELADQLHVPRIGQCHQAGSDSLLTAMTFFKLQELFFSDNWREISAKVQGHMAGLSNSQLNGGTGITTNNNGLG

SEQ ID NO: 146784 - protein, 156 aa, Heterodera glycines
  Coding regions on vcDNA: vcDNA=SeqID_73207; Strand=+; Position=1 -127,664-787,1635-1852
GDFRRRRNPTAFNRLGSVVAPTTVSAQPIWQCPVVGVFLRREQIVDHYELASCGGGRIAFGVQLATECHCPCPLPMPFSKRSFLANTDSAASSSADCSAAFDAASAAPAVELQFGAAHLLTVPGIVREAAAEVFFSAGDEEDVRSVTQMILDSVAK

SEQ ID NO: 146785 - protein, 737 aa, Heterodera glycines
  Coding regions on vcDNA: vcDNA=SeqID_73208; Strand=+; Position=1 -277,369-2305
  Homolog annotation: Hit_ID=XP_318550.1; Match level="QueryCoverage =81%, HitCoverage=61%, E-value=1e-163, Identity=47%"; Hit description= ENSANGP00000020240 [Anopheles gambiae]
MCAAHHEWLTKQKGQKLGKKMNVLRIGGLMVNILNGSTRLMEVTIWVNDIPIKFVLDSGADLTVLDEVAHKAIGKPRLTHCNEQAVYHDGTSLEEELDRLLEQKVIKPVDHTHWAAPIVVVKKANGSTRICADFSTGLNNALLLHQHPLPLPDDIFAKLNGGRIFSQIDLKDAYLQVELDEKSKEVCTIATHRGNYQFQRLPFGVKSAPGIFQSIMDSMLADCPFATAYLDDVIVVSRSSEDHQKHLEEVFKRFEKFGFRVKPEKCFFCQDQIKYLGFIIDQDGRRPDQTKIQAISEMPVPTNVSEVRSFLGMINHYQQFVKNMRFIRQPLDELLKQDKLCQWSEDCQNAFEKVIKILKSDQLLTHYDPAQEIIVSADASEHGIGAVISHRFSDGSLKAIAHASSSLSAAEKNYSQIEKEGLAIVFAVQKFHKYLFGRHFVLQTDHKPLLSIFGNKKGIKACTSNRLQRWAITLLGYDFEIEYQNTADFGQADVLSRLIAKTPVPDNEVIIANIRESNETGVLNFVAKTLPLDHNDLTNAAKSDQVIKNVKKFVCSHWPTKNKMAADIVPFHRRRDALTIEDECLLYADRVVIPASLQKDVLQLLHRGHPGMKRMKSLARQYVYWPGMDEQIENFVKMCNECTMEAKMPVKTELQSWPKADGPWKRVHLDYAGPFMGKMFLIIVDAYSKWPEVFEIVHRIPQLQSTNCGHSVPVMAFPKFWSRTTAHNSLQKNLRNL

SEQ ID NO: 146786 - protein, 426 aa, Heterodera glycines
  Coding regions on vcDNA: vcDNA=SeqID_73209; Strand=+; Position=1-1281
  Homolog annotation: Hit_ID=XP_320889.1; Match level="QueryCoverage =86%, HitCoverage=49%, E-value=3e-37, Identity=28%"; Hit description =ENSANGP00000012033 [Anopheles gambiae] ref|XP_313651.1| ENSANGP00000013044 [Anopheles gambiae] ref|XP_314
MPNLANFDCFGLGDHGESDIEGWLERFALALDCSTPNLQDELKVKLLLTKLSETAYAEYSKHCLPKKPTEFDFGKTSEMLKSLFAKHKSVWINRYECLKAEKQDEEDFRGFINRHKRLLSDFEFKKLNEEQFNCLMLLVALKSPKDAELRKRILSKLAADGDRATYESVVNDLQMFLSTISEAKVMERPSNSNILAVKRRQQPKKDNFGEKGYKQQSCWCCGREHTPLHCPHLKTVCRKCSKVGHVQSMCAAHHEWLAKQKGPKLGKKMNALRIGGLMVNILNGSTRLMEVTIWVNDIPIKFVLDSGADLTVLDEVAHMAIGKPRLTHCNEQAVYHDDTSCTPLGKGTARFSLGGKTVTGQYYVTKKGSLNLLGIDMLDAFGLLDAFRREVDKAMKVNVVKKEAKDSPNPQSKTTLTELQSKHIWL

SEQ ID NO: 146787 - protein, 262 aa, Heterodera glycines
  Coding regions on vcDNA: vcDNA=SeqID_73210; Strand=-; Position=1 -450,554-601,654-941
  Homolog annotation: Hit_ID=EAL47341.1; Match level="QueryCoverage =43%, HitCoverage=15%, E-value=3e-10, Identity=39%"; Hit description =actin, putative [Entamoeba histolytica HM-1:IMSS]
MEEKKGKTQTDVKEKANEREAEKKTETNSTEKEETEEKKETELPKEQPKKVPTEKKTKAEGAKGTKPTEEKATKMQAEGTAAPAEDEAGGSDAAKANLEVPKKEPNAKNAVAQAETVPTFTTAPTATADSKNGQAEGSSHQQHHRGRLLMVNGGGSSNSNISRMMTTPRRTLVEVNGTNSANGNANHRKPPLPARQFSMGAENGTKNKAMKKTSGDIDQIGTELFGRKKREEEEEEEEEEEEEKQKGGAEERRGSRMQIQSQ

SEQ ID NO: 146788 - protein, 174 aa, Heterodera glycines
  Coding regions on vcDNA: vcDNA=SeqID_73211; Strand=-; Position=1 -143,373-414,489-583,645-750,808-898
  Homolog annotation: Hit_ID=NP_499028.1; Match level="QueryCoverage =98%, HitCoverage=15%, E-value=6e-38, Identity=47%"; Hit description =NHL domain containing (109.1 kD) (nhl-1) [Caenorhabditis elegans] emb|CAA79562.1| Hypothetical protein F5
TMSEREKEAQMEEKQREERPKETEKNGAGGNPLERIERLLTCPICLDRYKQPKLLFCQHTFCLSCLESYVDIARPRIRCPECRGETGSKHRNVQSLPTNVQSLPTNLTLLAFLEIHLEASDVNAAEMQAYVQRFNLERCRVCEEKAFNLERCRVCEEKAELEGCAHCERKCGEC

SEQ ID NO: 146789 - protein, 359 aa, Heterodera glycines
  Coding regions on vcDNA: vcDNA=SeqID_73212; Strand=-; Position=1 -741,842-1018,1063-1224
  Homolog annotation: Hit_ID=AAC95573.1; Match level="QueryCoverage =59%, HitCoverage=39%, E-value=8e-49, Identity=34%"; Hit description =orf 48 [Ateline herpesvirus 3] pir||T42963 hypothetical protein 48 - ateline herpesvirus 3 (strain 73) ref
MPRKEEKTTKASQRQAQDRTETKAAAEKEGERREKGGGGKKEKEEKEEEDKEEKEEKEEEDKEEKEEKEEEDKEEKEEKEEEDKEEKEEKEEEDKKEKEEKEEEDKEEKEEKEEEDKEEKEEKEEEDKEEKEEKEEEDKEEKEEKEEEDKEEKEEKEESKGIENSTKERERGEREKEREGRKGKGDEREKEREGEKEREGGKGEKGKEQSSSDQQQCQTICRQLSPPIRLRTQHNRRKPRVLFTPEQVANLEQYFERQKYVNSSEREQLARDLGLTPTQIKARKTLAFCSLIAHSVQIWFQNRRYKCKRIDQDMILHRMTAQLSSVHQQLITGGRIGAMQTQNEFSRITLASIFCNQKF

SEQ ID NO: 146790 - protein, 197 aa, Heterodera glycines
  Coding regions on vcDNA: vcDNA=SeqID_73213; Strand=+; Position=1 -212,1052-1238,1563-1757
MTFHERRRDEYNLYTEKLRNDERISSIDTHIPVRINAFEMKGRCSVYVHELSFFAKYGEAEINLADGPNNDVAKETRRELHWSLWQILLAKYKKFFGGDNTKEYFCYDCENKLFSTKSIIRPGSFKEFIIDLKQTLILNSRCYDYLHKQNFVALRASLKAIGYERIGEVTITEPGCGEQSHTRKFFELLSSQKLFER

SEQ ID NO: 146791 - protein, 338 aa, Heterodera glycines
  Coding regions on vcDNA: vcDNA=SeqID_73214; Strand=-; Position=1 -127,201-400,518-667,746-949,1152-1487
MEMGVDSFHDRLYDRLAVQYDSDEQMVNAIRGLARPLVEFHNIAIHMDVNPRNYLYVEKDGHLVVKLIDFEGAKLVSTSNKNECVVIGEEHALSPEYTGPEYYGEQSQASDKVLYQNLNFGNFFQQISTKFDIWSMGIMLIEIAFDQFRAQQRETPLIEDERKSRLFAIGNLYLGFTRNRLGTQPGIFKETQIVYSAGTEWIEQHQSAIETVLHIWMKYPKTALLVTNLLNLERKKRLTAQGILNYIDGLCQIGEFKEVKTSKKLRIFNSLNFGDFLTNLRVTKWKNKFNFLKENRSELDKSYKNLKKILKKVIKKQRKEMKRLKREGTANLNDCETE

SEQ ID NO: 146792 - protein, 30 aa, Heterodera glycines
  Coding regions on vcDNA: vcDNA=SeqID_73215; Strand=+; Position=1 -7,223-308
MTWNGKMHKHQKENLYNQLILVKIDIANEL

SEQ ID NO: 146793 - protein, 403 aa, Heterodera glycines
  Coding regions on vcDNA: vcDNA=SeqID_73216; Strand=+; Position=1 -134,494-572,848-1486,1926-2282
  Homolog annotation: Hit_ID=EAK82568.1; Match level="QueryCoverage =98%, HitCoverage=60%, E-value=1e-14, Identity=23%"; Hit description =hypothetical protein UM01513.1 [Ustilago maydis 521] ref|XP _399128.1| hypothetical protein UM01513.1 [Usti
MSMFCYRRSTSSTSTNTWTALSTSAAAAAADVPVSAAAKANGGAIENWPRKRRRGGVDTLDNGHQNGGGEEFKIKKKFRRNFVLFSFPPLYSPQHRQVITLDSDSSSSSTSDNNARSAAGAIANLRISAATATAAGGVRRSSSSCSSVDGAKSAGVEFAPPPTAPARIGCYQRRRSSGSSRTGSSSSSSAAPFPSSTTTTNSSASFSSNTSLSNICFGTASHGSSNNNHAVVALCARDGDDDDDGLKDVALPPICNDEDEDDDDGELLESVGGEDDDDLDNVIEIDQSAPPTVHRHQPQQQNDASQMMEEDEELDWDWEFELVEHEGFKLQPTAASDLCSAALTVPSSCSVPAASSPCDQSASSMAASSPQNQPATSMAMNSLSPSATSIVAASSSSHLATSM

SEQ ID NO: 146794 - protein, 144 aa, Heterodera glycines
  Coding regions on vcDNA: vcDNA=SeqID_73217; Strand=-; Position=1 -403,489-713
DERAHAKWSGWRRREREGETEREREYAEVVFCILRQIFPKNFCMTKTNAGPLCGQVVNSELFPLCHTRFGSPCGDHPLISVITVLLCYMMSKKTTCLFFVCHFCFYCLTFLTKSFPNSFSNIHSHTFLIHSFPYGNYYYFYCLI

SEQ ID NO: 146795 - protein, 70 aa, Heterodera glycines
  Coding regions on vcDNA: vcDNA=SeqID_73218; Strand=+; Position=1-260
LSIGYPIFTLIFNCPTLNFLQFNPLNFLAILIFFIKISIMKYLTPNIFFDCFLIMHSSKFDQSQFFKIKK

SEQ ID NO: 146796 - protein, 67 aa, Heterodera glycines
  Coding regions on vcDNA: vcDNA=SeqID_73219; Strand=-; Position=1 -105,159-257
MLTVHELRIRDMELASERNGSKSHLSIKYGSERISGVFGVADHESDIHCDEFRIPDSNSNKKSKIKI

SEQ ID NO: 146797 - protein, 74 aa, Heterodera glycines
  Coding regions on vcDNA: vcDNA=SeqID_73220; Strand=+; Position=1-315
TVSMSLNRFSGRSKFWSNLGYANFDIPKFGDGDQAYLLQIIIWPQICTMAQKKVLTGFFPVPVKILRYSVVRVF

SEQ ID NO: 146798 - protein, 31 aa, Heterodera glycines
  Coding regions on vcDNA: vcDNA=SeqID_73221; Strand=+; Position=1 -72,380-403
MPWVWHSAGQGRRRQQQQQQHYGSIQQNFKK

SEQ ID NO: 146799 - protein, 90 aa, Heterodera glycines
  Coding regions on vcDNA: vcDNA=SeqID_73222; Strand=+; Position=1 -221,271-322
MIRHKLQNEQDVSEILFFLKAFTNNKAQILVVCRNMQKVTFLTLCPKEGENRENLFQLIKQNLLESIGPYSFVRFEEQPLSSDEEVLNLF

SEQ ID NO: 146800 - protein, 179 aa, Heterodera glycines
  Coding regions on vcDNA: vcDNA=SeqID_73223; Strand=-; Position=1 -131,1517-1924
MDSEANANGGANKPHQNVVGTKLRRRASSAEQLAVIGEASSTTDMDQQRQQQQQHSDSRGQQSSGQQQLPPPSRCVRMMPMPSSFQAQKRAAAAAGKLGASGFGGSASAEAAAPPSSCSECCCCEAADSTAVTGHCCVIGNAATPPIISSVAERFVLQQHGAGGVGVPKKKLPQHRRLR

SEQ ID NO: 146801 - protein, 51 aa, Heterodera glycines
  Coding regions on vcDNA: vcDNA=SeqID_73224; Strand=-; Position=1 -146,1876-1885
MPKKRRQNSPNLSEGEDILARLDRLEKLLEGSGNPTLNPIIELLEKLERSI

SEQ ID NO: 146802 - protein, 196 aa, Heterodera glycines
  Coding regions on vcDNA: vcDNA=SeqID_73225; Strand=-; Position=1 -39,89-345,435-560,637-805
  Homolog annotation: Hit_ID=AAH44037.1; Match level="QueryCoverage =98%, HitCoverage=38%, E-value=2e-47, Identity=50%"; Hit description =Cg8286-prov protein [Xenopus laevis]
MDVYKHTCKCNVKLGHVAEAIQECTEVLKYGDENDLDVLLDRGEAFLQNEQYEKAVEDFQKAVNAHEGSRRAKEQLNRAQKLLKLSKKKDYYKILGVRRKLAQQWHPDLFQDDAEKQRAQDKFIDIANAKDVLTDPEKRRRYDAGEDPLDPQGGGGGQQFHQWRWSGGQGGGFNPFGEGFNPFGENDGGFNFKFNF

SEQ ID NO: 146803 - protein, 43 aa, Heterodera glycines
  Coding regions on vcDNA: vcDNA=SeqID_73226; Strand=-; Position=1-129
MSENELGRTLDQCLADTALKILAGGSIGVVTALALFKGKRSWP

SEQ ID NO: 146804 - protein, 122 aa, Heterodera glycines
  Coding regions on vcDNA: vcDNA=SeqID_73227; Strand=-; Position=1 -115,163-248,291-458
  Homolog annotation: Hit_ID=AAH44037.1; Match level="QueryCoverage =77%, HitCoverage=20%, E-value=1e-18, Identity=47%"; Hit description =Cg8286-prov protein [Xenopus laevis]
MVNFNYEWLNPPLGVLGLPLPILQISYLSFISFTLIHFASSQRKEIEKHLEQGKHWLSKGQFQEALQHYHQAVALDPTDYQIYYRRATVFLASGKVNAALPDLDKVVELKPDFVAVIEKRNN

SEQ ID NO: 146805 - protein, 58 aa, Heterodera glycines
  Coding regions on vcDNA: vcDNA=SeqID_73228; Strand=+; Position=1 -16,177-337
MQSLMHTESFVSRLFETLKSGQYLPKTDALTSSEPPKLILQQTKSKIDQKSAAEHDEV

SEQ ID NO: 146806 - protein, 345 aa, Heterodera glycines
  Coding regions on vcDNA: vcDNA=SeqID_73229; Strand=+; Position=1-1038
MGNPLFAQNQIVEQVVENSHSGIRNEIQHPIGLEIERYGRPIANSSPITRMGSSHNEPHNSFENAEFEEIRQFRARQLYENPRGFREQNFVGEQRERMNEFEQNHAPVPNFERRNVFVGDPHGNQLIFGNFERNMERNFGHFENFPGLARGGNQNLNVGGPRMEQIRDPHRERNQYEERHFMPIPEPNMRQIDGQNQNLAFRQVQGQNFQENMARVMPYTEGIPDIILELHKVTLSNQYANVLREIPTLFGTEGRDKINDFFTTLELCTGDWIPEKKLEILRAKLKGKASKALNLSLRKFGHQVPFEVIKRGDNPERHRTERHHPKRHHPKRHQPKTAPLKNGTT

SEQ ID NO: 146807 - protein, 242 aa, Heterodera glycines
  Coding regions on vcDNA: vcDNA=SeqID_73230; Strand=+; Position=1 -577,1092-1243
MASFITTQKGAKKLLYDGYAYLKHKDGAGGKIYWRCDQAKSSAKCSGFAIAINDEITVTKQHNHAPSPTRIEVQTIKHSIRVTAAAQPATPPRSIVNGAIQGSSDAAKIQLPELRHMQKTASRIRKANGNFKETPKSLKDVEIPPELRRTRTASQEGFVFGDTGPEDEQRIISLASRTDIIRLSSCSVWMADGNIVDKFGHNNGVPEFLDYFERTWIGRGFATRPHCIVGPNIKSKTNVYSM

SEQ ID NO: 146808 - protein, 47 aa, Heterodera glycines
  Coding regions on vcDNA: vcDNA=SeqID_73231; Strand=-; Position=1-142
MALLQQQQQQQQQQQQAKRQQQLQQLQLVQQLAQLRQLQQSAALSSS

SEQ ID NO: 146809 - protein, 127 aa, Heterodera glycines
  Coding regions on vcDNA: vcDNA=SeqID_73232; Strand=-; Position=1-381
  Homolog annotation: Hit_ID=NP_444432.1; Match level="QueryCoverage =53%, HitCoverage=9%, E-value=4e-09, Identity=50%"; Hit description =forkhead box P1 [Mus musculus] gb|AAK69648.1| forkhead-related transcription factor 1A [Mus musculus] sp|P
RQANGGVKTEPAAVTLSPALEHGVEPLQQLNIAADGDGTVGDDANVPSALIGDGIGVRADGDAGAINGTASATLAQQQQQQQALITALAQLIVARQQQQQQQQQQQDVMMAQQQQQMLQQKQREKMA

SEQ ID NO: 146810 - protein, 131 aa, Heterodera glycines
  Coding regions on vcDNA: vcDNA=SeqID_73233; Strand=+; Position=1 -66,119-197,376-628
NNACHILRRRASEGADVAHPIALLHHFLSCAARVYALPWQYVSLYSYHGIHPVARLLVRVRRVGPVGLSLWLYQWLPSAAVRAFEDRLSALLGLSANLWRSQHVREAGRIGQDEEDVVIEETTYHCVMSVG

SEQ ID NO: 146811 - protein, 60 aa, Heterodera glycines
  Coding regions on vcDNA: vcDNA=SeqID_73234; Strand=+; Position=1-200
GLHSNLEIIYILTTRDGLLEGRRCKAGTGNGLYPLPPPHFISPIGLLPSRGALKRQWITS

SEQ ID NO: 146812 - protein, 17 aa, Heterodera glycines
  Coding regions on vcDNA: vcDNA=SeqID_73235; Strand=-; Position=1 -32,256-277
MDSVYSRWTTRSVGLSG

SEQ ID NO: 146813 - protein, 385 aa, Heterodera glycines
  Coding regions on vcDNA: vcDNA=SeqID_73236; Strand=-; Position=1 -90,133-381,434-707,754-861,916-1207,1256-1400
  Homolog annotation: Hit_ID=XP_316282.1; Match level="QueryCoverage =87%, HitCoverage=62%, E-value=6e-21, Identity=26%"; Hit description =ENSANGP00000020626 [Anopheles gambiae]
MDEGVRKAKIRKCLERHQDKLNMPKKQLILSVPTRWNSTYHMLAAFKEQKKVLFSMQFERDQRNAGLLCLSKRPRLAEMETIPASLPTIAPNDFEILRHICPVLKIFDTETQKLSREVSTASVILPTLKRLHVFLQEGKFPEIIQPFIDSLVDSLNERVKKLVQNMLIRICSLMDPRFAYDESMFSKANWNLIEEDLIDFANGKINNEDTTNFEEQNETTLSDLESLSDFNGEQSDESIKYDIWKPKSPGCVSVPSTISGTSHSTQTTRIQLQLAAYKAFDRPSVNADLFTWWREIGNQFPDLIILARIVHSIPATSVSSERLFSKAGLIYSNKLRNRLGAEMAENLLLIKANMDRVFLAPSTEPDEEEQEMLDSDNLEVIEEEK

SEQ ID NO: 146814 - protein, 285 aa, Heterodera glycines
  Coding regions on vcDNA: vcDNA=SeqID_73237; Strand=-; Position=1 -261,903-1066,1406-1571,1917-2180
  Homolog annotation: Hit_ID=NP_620614.2; Match level="QueryCoverage =69%, HitCoverage=11%, E-value=2e-17, Identity=29%"; Hit description =SWI/SNF-related matrix-associated actin-dependent regulator of chromatin a2 isoform b [Homo sapiens] emb|
MDGLDDDEPMPPTHHQQQQQQALQQQQQQKKKRGPVAGARKGSADGGPGEPGTSASTAPTTGAGGEGATVPKQRGRKRKKALPPEEEQSQADSDNDDAAPKGRRGPGGGPGKRQRVTKSPANPKLYAKLNACLNTLLNYKTSNGKKLAGPFVQLPSRREYPDYYDQIERPMDLQRIRKKIEEDNTQCWPNERRRGFARFNMDGSEIHEDSKLLNMVWRRIAEAIGGQGGKEEEDETTGRGGGAARHTPQQEEAAAAPSTSGHAKAPAEDDDVPVSAAAAGPSTSS

SEQ ID NO: 146815 - protein, 110 aa, Heterodera glycines
  Coding regions on vcDNA: vcDNA=SeqID_73238; Strand=-; Position=1 -69,884-1008,1214-1358
  Homolog annotation: Hit_ID=NP_502082.1; Match level="QueryCoverage =90%, HitCoverage=6%, E-value=2e-37, Identity=76%"; Hit description =phasmid Socket Absent PSA-4, homolog of SWI2/SNF2-related matrix -associated actin-dependent regulator of c
PRKESNWSSSIDTIFNKGTFFVWFNAPFAATGEKLELNQEETMLIIRRLHKVLRPFLLRRLKKEVESQLPEKTEYVIKCDMSALQRLLYKHLQKGLLIDSKLSEQLRDLF

SEQ ID NO: 146816 - protein, 120 aa, Heterodera glycines
  Coding regions on vcDNA: vcDNA=SeqID_73239; Strand=-; Position=1-363
MLNKWNELKKHLLGHKGIFGSPPKRDKQQKKPNQTIWEFNKEVKEQIKIDLMALIRTKSKANCMCQPCEEMKQLARNFSEKDANGEGLSAKIFKISSQNSRVIPLEIKKKGNEKRTDGKS

SEQ ID NO: 146817 - protein, 220 aa, Heterodera glycines
  Coding regions on vcDNA: vcDNA=SeqID_73240; Strand=+; Position=1 -77,121-176,217-322,366-401,449-471,813-861,964-1133
  Homolog annotation: Hit_ID=NP_510091.1; Match level="QueryCoverage =97%, HitCoverage=43%, E-value=1e-48, Identity=50%"; Hit description =zinc transporter ZnT-8 family member (XN84) [Caenorhabditis elegans] emb|CAA92193.1| Hypothetical protein
GGNRQTHGTRRQTYINVRAAFVHVLGDLIQSVGVLFDLIQSVGVLFAGLLIYWKPNWHILDPICTLLFSAIVLPNWHILDPICTLLFSAIVLSTTIYIIRDALVVLLEGRPSTIDFRRPSTIDFRHVFDALEHIEGHVFDALEHIEGVKKVHDLRIWALTMDKVAISVHLEVESAADSQQILRATTLMLRRDFNVHESTIQIEGYQPETANCGQCVVPTK

SEQ ID NO: 146818 - protein, 387 aa, Heterodera glycines
  Coding regions on vcDNA: vcDNA=SeqID_73241; Strand=-; Position=1 -855,945-1109,1154-1216,1271-1303,1347-1391
  Homolog annotation: Hit_ID=NP_012284.1; Match level="QueryCoverage =65%, HitCoverage=62%, E-value=8e-18, Identity=31%"; Hit description =GPI-anchored cell surface glycoprotein required for diploid pseudohyphal formation and haploid invasive g
MNVVQFDALGSGRPRCHGSESPSTSVDSQFLPVTKSASTTIASALGSGRSPMPTSESPSTSVDSQFLPVTKSASTTIASALGSGRPPMPTSESPSTSVDSQFLPVTKSASTTIASALGSGRSPMPTSESPSTSVDSQFLPVTKSASTTIASALGSGRPPMPTSESPSTSVDSQFLPVTKSASTTIASALGSGRPPMPTSESPSTSVDSQFLPVTKSASTTIASALGSGRPPMPTSESPSTSVESQFLPVTKSASTTIASNSSDCALTPQQKYCRKRALMEPSQHELAIIRNVLSFDDYSQYRIITVLLHRPQGINEGAVGLLLRTMAERSKPANAPFSILVHQVTGGSIASKNGHLMQGDRVFFIQHQSTVNMSVAEARSLVKSPSP

SEQ ID NO: 146819 - protein, 961 aa, Heterodera glycines
  misc_feature (157)..(157): Xaa can be any naturally occurring amino acid
  misc_feature (162)..(162): Xaa can be any naturally occurring amino acid
  misc_feature (168)..(168): Xaa can be any naturally occurring amino acid
  misc_feature (877)..(877): Xaa can be any naturally occurring amino acid
  misc_feature (904)..(904): Xaa can be any naturally occurring amino acid
  Coding regions on vcDNA: vcDNA=SeqID_73242; Strand=+; Position=1 -463,549-1341,1402-2802,2834-2986
  Homolog annotation: Hit_ID=XP_318550.1; Match level="QueryCoverage =99%, HitCoverage=99%, E-value=0.0, Identity=41%"; Hit description =ENSANGP00000020240 [Anopheles gambiae]
LKVKIRMNRKPAKLYLDTGSDVIIIDEGTHASVGHPPIKECNEIGKTFDGKRVQFIGKGTTTFELNGQSIVEEFYVAKQGSLNLLSRRAMDKFGLLRELRQKISNAAVNACTAGQNWTNYPMAHRKLTETKLKSRYYNIASPMRLLKESLFALIDRXLIDRXLFRDYXMRAITISYHMEWAAPILIAKKADGSARMFIDYSTGLNDTLLDSQHPLPIPEDIFATLNGGKIFSQIDLRDAYLQIELDDESKLLCGLATHKGNYRMERLPFGIKTAPAIFQSIMDKMLAGLNYATAYLDDIIVVSGTIEEHTQHLKEVFTRIQAYGLRVKLEKCSFFRNQIKYLGQIIDRNGRRPDSTKIKAITQMPAPINISTLRSFLGMVNHYQQFVKNMRFIRKPLDDMLKKENEWNWSENCQNAFEKLKETDASEFGIGAVIQHKFPNGQVKAIAHASKSLSPAEKNYSQIEKEGLALIFAVKKFHKMLYGRHFTLQTDHKPLLNIFGSKKGIRQCSANRLLRWSLTLLAYDFAIEYINTKDFGQADALSRLIAKDTSGEDERVIASFCVEKEIELNFDTTIEKLPIKFADLVKASEKDEIIHTSEKFIRNGWPDERQLIESEAIQLFNRRKAELSILKECLIYGERIVVPKIFQGKIMNLLHKGHPGMKRMKQLARQYVYWPKLDAEIEQFVQNCQPCQDAAKAPTKTNLHSWPKSTSPWQRIHVDYAGPFFGKEFRIVVDSFSKYPEVFEMTTKSAAATIDRLRYLFTRHGIPETLVSDNGTQFASTEFAKFMANNGITHLFSAPYNPMSNGQVERFVDTFKRAFKKIKREGTANKEVIETFLITYRTTPTESKSPAEMLLGRKPRTTLDLLKPPTKANGERXENGAKFFGPHEKVWARHRLSQNWKERXENGAKFFGPHEKVWARHRLSQNWKAGTIFKSAGVIYKVRFGDGTAGRFHANQLRRRQ

SEQ ID NO: 146820 - protein, 196 aa, Heterodera glycines
  Coding regions on vcDNA: vcDNA=SeqID_73243; Strand=+; Position=1 -449,829-970
MAANVNLQDLINLMAQQQQQMQQQQQMVQQQSQQIAQLLNQNAPNAAGLAQPNLITIIPALPDISPFESNDERSRVVEWLDRFKFALDCAAPMANDEIKVKCLMNKLSENAFSEYSRSVLPAAVTDFDFATTIQKLEKLFAKPQSIFIDRPYSEAMRKRPCVVEKDEVKEGYDKQSRSSSHWHGWNNEHPKYGAQG

SEQ ID NO: 146821 - protein, 38 aa, Heterodera glycines
  Coding regions on vcDNA: vcDNA=SeqID_73244; Strand=-; Position=1 -51,117-182
MHSQATSALAHTNNGLEKGLCHHPALSDFICEINESTD

SEQ ID NO: 146822 - protein, 111 aa, Heterodera glycines
  Coding regions on vcDNA: vcDNA=SeqID_73245; Strand=+; Position=1 -17,84-215,379-565
MNTAKKKPIELVKSFRMIPILLDLVNKEKSYDALNLAQTQLARFEFWAQYTKLKKQHKYLMNRGKMSLTMEEESNSKLIDQRQYTSNIIFSRRPNCDENKIWNESVKIETE

SEQ ID NO: 146823 - protein, 161 aa, Heterodera glycines
  Coding regions on vcDNA: vcDNA=SeqID_73246; Strand=-; Position=1 -285,423-506,1029-1142
AIDADLLNSRYHMRVLVPRIHQDPQRLAEVFATLFDYTTSSPHALVLFIINCSLLYIINVKTIYAFKSVHTNRTFYVAVAIDPALCIGDQTIIKSRNALAKAISKKVTGISFGSAKFVTLVDKKHYDVLELRYDPPISSDNEFLKHAVHQAMVQLSMSLES

SEQ ID NO: 146824 - protein, 39 aa, Heterodera glycines
  Coding regions on vcDNA: vcDNA=SeqID_73247; Strand=-; Position=1-120
FFRQYLSHIFSTKLKKQHKYLMNRGKMSLTMEEESNSKL

SEQ ID NO: 146825 - protein, 257 aa, Heterodera glycines
  Coding regions on vcDNA: vcDNA=SeqID_73248; Strand=-; Position=1-773
  Homolog annotation: Hit_ID=EAL49477.1; Match level="QueryCoverage =97%, HitCoverage=44%, E-value=2e-31, Identity=35%"; Hit description =hypothetical protein 42.t00003 [Entamoeba histolytica HM-1:IMSS]
MIAEVERLLTRKRSAPVHASFGNIDDDDEEEGEILDVSFVEEEEDNTGEAPLNPLSYLTKQSAAQQETLRHEKWAQEERKRREEEQRKQRENERRRREEEERRRKTEEEDRRKTAEKAAKEKKAKEEKEASEKKAREEKLAREKKEEQRIAKEKKGEKETKDKKAEEERVAKERKAEDERVAKERKAEEERVAKAEAERAAKAEAERAAKAEAERAENETKKKQEEEKQLEELKRQQQAIRKQKELELLKEFRPWRG

SEQ ID NO: 146826 - protein, 22 aa, Heterodera glycines
  Coding regions on vcDNA: vcDNA=SeqID_73249; Strand=-; Position=1 -3,361-426
MYGVFTFMCKECRDDNFRQGNS

SEQ ID NO: 146827 - protein, 184 aa, Heterodera glycines
  Coding regions on vcDNA: vcDNA=SeqID_73250; Strand=+; Position=1 -270,978-1262
MVCHLGSLSPIFDPAETLCHRRRRRCRFILLLVLHDQICAVKVQRCTVLAKRLGELKALLLAILIDEFESAVPLPEIVITTLFAHEREHSIMVLPLTAALSKLLNCKPENLAEYLNNPEAVNKANAYLAGKKLKTTYQGRDSKTKEVKFGTFSVKAATETYAFEGFLGKFPKIQFRSNTHAFRG

SEQ ID NO: 146828 - protein, 442 aa, Heterodera glycines
  Coding regions on vcDNA: vcDNA=SeqID_73251; Strand=+; Position=1 -315,374-662,820-1544
MLKKLPKPCLIVYDDLMGDIEAKKLADLYTKKSHHNNFSVIFLTQNLFDKSMRVPRSNAQYIFLMRAPNDMLSIRNLASQMFPREQGFLMDAYRQACALPYGYLLTTRREAFLPPKMVKREQKIGERVVHNYDYFKKLGKTTSEKKRRHLLNSAGCEELLTLVEICLNVLNGSFCLSRKQKQRLAPFAKDIRQLARVRSERARETKNDDDDIAERTNLGFVKRQVTAAVQKRKGNVSERNAMYNQQLRRYLKMRKEHKERPVRVQLSNGAQLLNKTVETGVQVRPGPDEPKDKSVMVTDEDEEEEIEVPKFLTPTSQTLGSSRSPRTNKKAAKQQKLIEKKDHLLAIIMSDPQRFGATDRGKIINPKTGREFIDSDLAWSIERLVDPRPENAPSPSGTKELKRKLAQNPLASSLLNRLFVGSGFVGQVKQTRGFVPSKWTRK

SEQ ID NO: 146829 - protein, 278 aa, Heterodera glycines
  Coding regions on vcDNA: vcDNA=SeqID_73252; Strand=+; Position=1 -147,200-370,862-933,1245-1358,1422-1571,1820-1915,1968-2054
  Homolog annotation: Hit_ID=CAE56797.1; Match level="QueryCoverage =98%, HitCoverage=63%, E-value=7e-36, Identity=32%"; Hit description =Hypothetical protein CBG24609 [Caenorhabditis briggsae]
MPLSPRIGHNPSYHVVKEVEIIREVITSGGPTIQHDKIIHLLTSPNNAQRQELLHNYRTKYGGADLAQALKEKLPPSEVATNSLYLALLDTPAEHDAKYLAKAMKVTLLLDLVEANRDESYRTDLAKAKTDAEKLYKAGEGKWGTDEDAFIKVLANQNLSQLQLMFNEYEKLGKKHTIEQAIKAEFSGDELSALLAIVSFVRNGPIGEMAEMLHKSLTKGGKDDMLIHLIVSHAELDLGDIAHEYEKRFKTPLEHAVETSGKTTTLKNALVRMIKGNK

SEQ ID NO: 146830 - protein, 153 aa, Heterodera glycines
  Coding regions on vcDNA: vcDNA=SeqID_73253; Strand=-; Position=1 -73,149-359,814-991
MSALIIIVYTFCWFFVFKFASTSQNVTENNRKLNKSLMFIIALNLIGVFTKIIIDLILQACSVANVFIHIPYSTVYSFLTIAVYSANAPVLYIMSSEYRARFDQHFPWVVKIYGKIARSTATVMPLATPPRPWIIINNGIGPAMNGGITPRHI

SEQ ID NO: 146831 - protein, 79 aa, Heterodera glycines
  Coding regions on vcDNA: vcDNA=SeqID_73254; Strand=-; Position=1 -8,237-467
MYSCLRSICNILIATESFCALVLNLGYFVSFFVVASGTKFIRYEHCFWALIVPCLFGTLAQPVMVFTGLDRVFAVACPF

SEQ ID NO: 146832 - protein, 137 aa, Heterodera glycines
  Coding regions on vcDNA: vcDNA=SeqID_73255; Strand=+; Position=1 -36,99-284,1017-1175,1768-1800
  Homolog annotation: Hit_ID=CAE63242.1; Match level="QueryCoverage =88%, HitCoverage=13%, E-value=2e-37, Identity=59%"; Hit description =Hypothetical protein CBG07607 [Caenorhabditis briggsae]
MLYGLGEFAIFWGTVFFFLEFLNYLDQLNAEPENTDQIWHKKLRSWLKNTGGSNQWDSDIVYTETGTFRAYRLQVAMKNIVEPDQHKLAAKLLREIADRQPFRLEIYHEAFPFADQYLIILPSTYRNKILNIIFLYE

SEQ ID NO: 146833 - protein, 91 aa, Heterodera glycines
  Coding regions on vcDNA: vcDNA=SeqID_73256; Strand=-; Position=1 -162,863-976
MSQDLFGHSKSEEWKDLDETGNDSDKLSQMYVGIRPVDKCLRIAYAKAMDMKHQKVIVMVENDNDFRTYDTKEVPVGEIIKCEFEFVVAKC

SEQ ID NO: 146834 - protein, 146 aa, Heterodera glycines
  Coding regions on vcDNA: vcDNA=SeqID_73257; Strand=+; Position=1 -292,934-1082
MKKFMKILRIPCKIPWNYLKWEMMLQVDNGHGFGAWAGVHSGVAQLFAHGILPNSAQKTTKAQRTTKSGGKNEFVGGKWHKKMTILKMALIRGISISAHGGLFFHLLRKGGIIRDWEIMIEGLFFKHLVDWGIIGDCGINRDWAII

SEQ ID NO: 146835 - protein, 390 aa, Heterodera glycines
  Coding regions on vcDNA: vcDNA=SeqID_73258; Strand=+; Position=1 -49,143-273,343-439,507-560,628-660,715-846,886-997,1061-1128,1178 -1265,1321-1362,1486-1575
  Homolog annotation: Hit_ID=NP_500135.1; Match level="QueryCoverage =99%, HitCoverage=85%, E-value=2e-56, Identity=36%"; Hit description =rhodopsin-like GPCR superfamily (4C542) [Caenorhabditis elegans] gb|AAK68458.1| Hypothetical protein Y41D
LSVVCEEHYDYYHPTEKWLLGVVKWLLGVVALPFILCGLCANGMSVAIFSHRQMRQQSVNWYLLVLGFSDLIVLLGAFFVLTLPRLSEILHWWRGTAISYYSTPLYYSTPLMYSLMTMAQTTSVWMTVAVWMTVAMSLHRFVGVCFPYQSGTVLATRFVGVCFPYQSGTVLATRNVKSLIVGILFVAIFFNGCRFFEVFLNQVCRMKPINVELPVLRMTALQVCRMKPINVELPVLRMTALRQNELYRKVFYEWAYTLIMIMFAIPFTILIVVNSMVILAIHKSRKIHAKMNAHNDGIRKQELKSRKIHAKMNAHNDGIRKQELAKEISTSIMLVAIVIAFLLCNTLVAIVIAFLLCNTLTFVVNLMEKFDLNELYVLLVPWSNMLVLCN

SEQ ID NO: 146836 - protein, 276 aa, Heterodera glycines
  Coding regions on vcDNA: vcDNA=SeqID_73259; Strand=-; Position=1 -297,406-644,689-833,1002-1149
  Homolog annotation: Hit_ID=NP_500018.2; Match level="QueryCoverage =76%, HitCoverage=11%, E-value=4e-70, Identity=62%"; Hit description =PLeXin A, semaphorin receptor (217.7 kD) (plx-1) [Caenorhabditis elegans] dbj|BAB85224.1| plexin A [Caeno
MTGGTERGMNMQDGQVEEKGRKRAKREGNAMAFQEKMVTEIYLTRLLTMKGTLQRFIEELLEAVFSVSSTPQCPFPPCIKYLFDFLDDQAHELGITDPEVVHAWKSNALPLRFWVNLIKNPDFIFDIQKPTKIEGSLNVVAQTLMDACSTQEQHLTKDSPSSKLLFANEMDKYREWVQRYYATIANMEPISQSDMSMLLADESQEHSQEFMLYSALNELYTYVSQNKQQLPGALQKLLDTIESPPESLAPLNGALLVDAYADSKARLVQPNAQLGN

SEQ ID NO: 146837 - protein, 108 aa, Heterodera glycines
  Coding regions on vcDNA: vcDNA=SeqID_73260; Strand=+; Position=1-327
MKRPQRRTRVGRFARVPSGGTAGTAAADKKSAGAMDRRICGGSGSTADSGQSARGGRFVGFVGDQRQIVGGGSGIVRHKCQSRFVFHRKQKKTMPKQTKGVDMPKLTL

SEQ ID NO: 146838 - protein, 250 aa, Heterodera glycines
  Coding regions on vcDNA: vcDNA=SeqID_73261; Strand=-; Position=1 -86,481-691,872-1093,1153-1257,1305-1430
  Homolog annotation: Hit_ID=CAE68298.1; Match level="QueryCoverage =87%, HitCoverage=11%, E-value=6e-62, Identity=56%"; Hit description =Hypothetical protein CBG13987 [Caenorhabditis briggsae]
MPTERRAQLSVERPMRLDFGFDLDGTLTGEKVGEASQRPRGQDPSEWLILAVAVAFLGVFLALALFVLYRRKSTSHNRQLRYLKAQMNSIEMRVAQECKEAFHELQTNINALAGSVPQGTSFIPFLPYADYAARILFPNYPGHTHPALCPLSVDQDRALAIESGLRQLHYLLQNRHFLVSFVRSIDANKYLLVKDRVYVGSLLMVILQEKMAYCTEVLKQLLKELIRRNADGKFHPKNLFRRAESVAERM

SEQ ID NO: 146839 - protein, 122 aa, Heterodera glycines
  Coding regions on vcDNA: vcDNA=SeqID_73262; Strand=+; Position=1 -107,154-414
MGASSSTAAGINGKERRKSTEESGAALLEADKRARRLLLQNGLLRRKSKAGNNTMAEDEAGGNSWQTKAHSMYDLQQMRGKSAEAEEQLQKGDDAAGHEATERQNGAGSTNGKKHRLNKIVI

SEQ ID NO: 146840 - protein, 106 aa, Heterodera glycines
  Coding regions on vcDNA: vcDNA=SeqID_73263; Strand=+; Position=1 -55,107-199,854-1026
MATNDRQTEGIFGVSGTKGGQHRNGRTFVAQIRRGARTAQMLWLQAGLLGRKECVSHRIAVARAENFRQQQTKHIEATDGAEAGEVGFAKWGERSHCGRGGQAISN

SEQ ID NO: 146841 - protein, 266 aa, Heterodera glycines
  Coding regions on vcDNA: vcDNA=SeqID_73264; Strand=-; Position=1 -287,367-505,563-627,676-793,1176-1255,1312-1423
  Homolog annotation: Hit_ID=CAE65616.1; Match level="QueryCoverage =63%, HitCoverage=70%, E-value=1e-48, Identity=52%"; Hit description =Hypothetical protein CBG10649 [Caenorhabditis briggsae]
MVLNCAMNEMEVNKAKNMSKITNIPIPQKGFIKANFRKDLRGYRCPTPTDGLPKNRGTAPQAWPNWHLSNGLGLWPKTANASFDQTTYAIRTQFGRMRNWFHLIIEHSWRRIFGLFACGFLCSWLTFGLFYFLIVQFLVEYQGLPEENQCIANVQSFASAFLFSLETQHTIGYGTRYMTEGCPLAYAVLSLQCIFGVLLQTLLRGECELIGVQDMNVGYDTGMDRVLLLWPVVIRHIIDPDSPLWEITEDKLNSWPLELIMTLEGM

SEQ ID NO: 146842 - protein, 54 aa, Heterodera glycines
  Coding regions on vcDNA: vcDNA=SeqID_73265; Strand=-; Position=1 -75,288-377
MSYAFLHIKQVNSLWLFAQFPQKHLGSGNLDSGHLYSEFVCIEEDLNSGHYASE

SEQ ID NO: 146843 - protein, 112 aa, Heterodera glycines
  Coding regions on vcDNA: vcDNA=SeqID_73266; Strand=+; Position=1 -77,329-590
MFAIAPAAARVAPLFLWCTTNSAQKMVGSDIYFNQFRTRTRAKDKFILIIGLFSNGEPTTNMSCIRLIVMKNIQLENVEKIFLAMPEDYSLVRMNEKIWANNFMDEIVKLTN

SEQ ID NO: 146844 - protein, 116 aa, Heterodera glycines
  Coding regions on vcDNA: vcDNA=SeqID_73267; Strand=-; Position=1 -116,254-449,1132-1170
MINARRSANSAAVGTDCEIVPLSPLTVIDQYYERLAEQRYSHKTIHELFNQICGTKSEAAAVIAGAEQQHSHRPSLVTVPKDLLSRWMAQFYGDATTLWMARKKLNLTQIVLCPSV

SEQ ID NO: 146845 - protein, 42 aa, Heterodera glycines
  Coding regions on vcDNA: vcDNA=SeqID_73268; Strand=+; Position=1-128
  Homolog annotation: Hit_ID=NP_491234.1; Match level="QueryCoverage =97%, HitCoverage=30%, E-value=8e-13, Identity=80%"; Hit description =light induced protein like (15.1 kD) (1E395) [Caenorhabditis elegans] gb|AAB52430.2| Hypothetical protein
MATGMIWTRYCFVIVPKNYYLASVNFFVGCTGLAQILRIAHY

SEQ ID NO: 146846 - protein, 51 aa, Heterodera glycines
  Coding regions on vcDNA: vcDNA=SeqID_73269; Strand=-; Position=1 -229,311-484
SSHFWHRTVHRPSIGCIFRLCPHIPSSPRCCCCFCYCSFSPFRGLSPSSVQ

SEQ ID NO: 146847 - protein, 97 aa, Heterodera glycines
  Coding regions on vcDNA: vcDNA=SeqID_73270; Strand=-; Position=1 -147,651-797
MNEKKKRYSAEDKGKKNLKKRTPTSGKWEKQKISRRAVGEEKGQTEEKKLTNGPSSKDGHRVAISSSNKMRKGAKTPNKKQQQKSECAEGGKRRREN

SEQ ID NO: 146848 - protein, 1101 aa, Heterodera glycines
  Coding regions on vcDNA: vcDNA=SeqID_73271; Strand=+; Position=1-3303
  Homolog annotation: Hit_ID=T13250; Match level="QueryCoverage=86%, HitCoverage=58%, E-value=1e-116, Identity=30%"; Hit description =hypothetical protein - fruit fly (Drosophila melanogaster) transposon BEL gb|AAB03640.1| unknown
MLIRFRACQVPVIADVEKAFLMVGIEEADREVCKFLWVRDPFGPLTTSNLVPYRFRRLAFGLTPSPFCLAAVVRHHLRKYGTDFAEQLIRDTYVDNVLIPADTVEEATDKAREAKRMFSEAQMNLREFLTNDRGLNDSFPEADALGKTTAKMLGLEWNAENDSLRIVFPGDTPDGAHRSSRRTVLRTIARLFDPLGLLAPATLNAKQFFQKLWDSTHSWDAPLESDDGREWDRILASWEGQSITIPRGVRAEGGRPVQLHVFTDASESAYAAVAYLRSEGQDGRAHSRLIMAKSRLKPKKAAGTYTIPRMELMGLVVGVRLAAFVRAQLHRPIAEEHMWSDSMIALHWVRNRTPQPQFVANRLAEIRKATALTFGHVPTGDKPADAATRGFSPAQLQQANLWWSGPTWLTKPCEHWPKELTFTVDSEDGGTSLDERGLTTFVARREDTPETSTERTDWLLDRCGRWTKAVRVMAWMRRFITGTHRPRDDGTGDPRCQDTSHGRCPPVLSNEELTRAKWQLIRSAQSECQAREGIRTKVDGNGVTRLISRIGWCAEAEVSRPVILPKHSRAGALIIDDIHGRLHHLGVDGTLAEFLRDWWSPSARQQVRKVLGQCRQCRRLRGMPYPLPTMPQLPMDRVRRRIPFESVGLDYLGPTVTLDANGQRQKTWVLLITCLTTRAIYVDATRDLSAQSFISVLRRFIARRGAPSRILSDNAPTFTVVGKTLSDFGMAGDDPRHFTDSRGIQWRFTPQHTPWAGGIFERAVQLVKRALQKTLGSAVLGYDSFATLLAEVEATVNSRPITYVNSKAGEPLPLRPIDFIQENGRLWVDPPDTTGQAQDERRDPPHKQLARQWRESQQRLEHFWRRWHREYLMTLREKAGWNHAQRRVNAPGTPKVGDMVLVEDKFHPRNLWAMGRIEELRGSDGHVRSVLIRMANGRIWGRPVNKICPLEEAPPKMHDQADQAVHEPCGDDARAVETQSEVRSRNELSAAPKEEENEGNVSEESAEKRGREVEAVQPDGRVNREIRNDNSLGNGPDDPDEKFDDATTTEEMAVFEKAAEVPSAAAGETGILAHPHSAPRHEKKYLGDSSTAPGLLDVPTK

SEQ ID NO: 146849 - protein, 445 aa, Heterodera glycines
  Coding regions on vcDNA: vcDNA=SeqID_73272; Strand=+; Position=1-1336
  Homolog annotation: Hit_ID=NP_504186.1; Match level="QueryCoverage =50%, HitCoverage=26%, E-value=1e-16, Identity=28%"; Hit description =vglm uuk m polyprotein like family member (5E780) [Caenorhabditis elegans] gb|AAB63927.1| Hypothetical pr
MRSTSFWQNSCGLPAPSCLFYRWAAVPSTTTVYEEYSCLEWDMQISAWVELETNSGRVESQRLTIHPGVPEQWGNMTLSVVPTSLPPMPVLSAHFITDGRAVAMGRPLPSDLHCPDEEAARGFDNCQLSISACQKCAPDHDNGTVHCHCRDLTIGRVMNDPEHRLPLDVARLHLHNSGPVVKAEFQYTPVQVHIQLNGLELVSEYSNTKCWVTSPKLSGCYRCVTGAALTASCRTDHGMALAKVKCADGTLFALHCGGNDSTTTEAIPFDRAEVFTECRVKCPAGITNFRLKGELAFLPKQQQFGFNQRDSTGGRVEPGISLSLPDWRIDPFPLLHLLLSGKGLLVAVGATAIGLAALLVFVKFSPHFRVYRSLMAMALITVVIPIVGTNSAGEVTRAKFPGTTTKAAINGLSNGELDGETMRHFQSDMGAYPHRAVAILLFGAA

SEQ ID NO: 146850 - protein, 104 aa, Heterodera glycines
  Coding regions on vcDNA: vcDNA=SeqID_73273; Strand=-; Position=1-315
MCRPLLLFVCFTVAFGILSIVAPNQALAEPVIGGPPPAPPIEGVAALAGGVQSDSLANVNNLAVDPADQPVASGVAPPKQPVVVEASQVEQAEVDQLPKSYGRK

SEQ ID NO: 146851 - protein, 35 aa, Heterodera glycines
  Coding regions on vcDNA: vcDNA=SeqID_73274; Strand=-; Position=1 -67,136-176
MLYYVYYFGLTCKPRNFHENLSVKAFARGIHFPAE

SEQ ID NO: 146852 - protein, 69 aa, Heterodera glycines
  Coding regions on vcDNA: vcDNA=SeqID_73275; Strand=+; Position=1-691
VVSKLYSFFWCLSVLPPPPPPPKLIGDLIFSDWSDLIWLRQGVKKSIVRINFIFNEILIFIYFTKRKKY

SEQ ID NO: 146853 - protein, 39 aa, Heterodera glycines
  Coding regions on vcDNA: vcDNA=SeqID_73276; Strand=+; Position=1 -9,253-363
MNSVHQLMCKKALKMKCPHNKHNEHEHFSNDQQKGQKLT

SEQ ID NO: 146854 - protein, 110 aa, Heterodera glycines
  Coding regions on vcDNA: vcDNA=SeqID_73277; Strand=+; Position=1 -60,422-577,920-1035
  Homolog annotation: Hit_ID=CAE62140.1; Match level="QueryCoverage =91%, HitCoverage=14%, E-value=2e-36, Identity=68%"; Hit description =Hypothetical protein CBG06185 [Caenorhabditis briggsae]
MVQFLDSFSFTSTCEPGGIRVRVDSRIPYTGALYGLYDFFSCRIEPKESKLFDFLFPYPHISKNCSDSIRIMGQEALLEVVLSTDGVEPLYFITADDLTYQTKCPLPEHS

SEQ ID NO: 146855 - protein, 177 aa, Heterodera glycines
  Coding regions on vcDNA: vcDNA=SeqID_73278; Strand=-; Position=1 -242,358-649
  Homolog annotation: Hit_ID=NP_494925.2; Match level="QueryCoverage =92%, HitCoverage=10%, E-value=1e-46, Identity=60%"; Hit description =neuronal SYmmetry defect NSY-1, Enhanced Susceptibility to Pathogens ESP-8, ASK (MAPKKK) kinase like (nsy
MLRARGEQFEESPELQQIAVVLNSLLGRKGALANMTDYWDVATFFEVSGFKSHFGAVKFTVYSVLAEDYNKACLAAEKMAMLKPPVWFLKSTMENIKLINQCTATLQLSPVERDKKTFLFWTEFFMESIESQHIEITSSRFPVLIQELNKMLTPSYLNVNADDVRKKEGGGGYGGII

SEQ ID NO: 146856 - protein, 143 aa, Heterodera glycines
  Coding regions on vcDNA: vcDNA=SeqID_73279; Strand=-; Position=1 -219,354-408,885-958,1276-1357
AADFSGQCLQTVVAFAGQIRRSRLNQRQLAQAEDGAGDGQKGAEMPAGSGDGMPRDRGDGGDAQRQPPSALFCFYNADIALIDFSITQQQPGTFSDRIRQALNNVTIEANAHAREKDTQDYDGIIGLIDDLERIDQKQITHAQ

SEQ ID NO: 146857 - protein, 851 aa, Heterodera glycines
  misc_feature (398)..(398): Xaa can be any naturally occurring amino acid
  misc_feature (450)..(450): Xaa can be any naturally occurring amino acid
  Coding regions on vcDNA: vcDNA=SeqID_73280; Strand=+; Position=1 -119,172-280,461-534,571-661,796-1059,1343-1595,1894-2068,2330 -2473,2736-2840,2910-3029,3102-3217,3261-3315,3528-3886,4195 -4357,4473-4542,4653-4822
  Homolog annotation: Hit_ID=NP_508471.1; Match level="QueryCoverage =98%, HitCoverage=67%, E-value=1e-153, Identity=35%"; Hit description= c2, putative phospholipid binding domain containing protein (XD240) [Caenorhabditis elegans] pir||T33337
EIQDKISSTNFNFFLIFQALVIIHQHAIQSDLTELHQHVCQWLAYLQMIEMGISFDCLFQWLAYLQMIEMGISFDCLFNVFEQLCAKWKPMELDKDEEHVFADSLIQFIEHCRSTISNHRRRSPSPKRSDLEAFGEIVRCFRRVLEHRRRSPSPKRSDLEAFGEIVRCFRRVLEKLFFQLVAQPQKNFSSELRELLAQSAVLHFDTIQANILQRYKAQIDALQALALLVQALNTTMARCAKFESIFRHYAQCDYADIAYEQFDLLLHEHIISKMMDEQRGALRMIMQICHADPCPTDNELTNVLHVHMTLNEFSTLRHARRCTKMDQLDWSEHFDKAIQRWLELALVKAFARVDFSLALDVQMPITNNDIRQTVSGLDTCHIMEQLLAVWERLSVHEXFCLIVYFLRLVRLLCKIAKHFADQLMMRRPFENMAIHQQNQPAAQTVHFICXSINSCEQVRRTLACTDRLRLDELTELYERKTKAKPNNKEFRSHNKEFRSHVERPLDACTQNMVEQIELLIDQFVRRQTALIKRAIFAIFHLVWSPAACPTDECLKPLIKLLDEELSLVHRCLMHRNFTRVMQAQNFTRVMQAQMQLLLKLFQCVNENVGLEPSFYRRLTDALAILLDFFHADGKGIAVDVFAASNEYKRFHEQISLYQMPTERLIEHFYALLLKAQDEAVKNEKTLKFCFQFVNECKYGILNLRAYYNPHSELLVIDVLSAKQIIPLDSNGLSDPYVVLELLPRVHFPDQPRLKTKVVNANLNPVFGETFEFHIPPYLPQSALVHFVIMDHDFLKANDFAGEAFLDLSEVPGFAQGGIGGSLKQFNLVLTHPSAQPSNESIVVVLASRKDD

SEQ ID NO: 146858 - protein, 80 aa, Heterodera glycines
  Coding regions on vcDNA: vcDNA=SeqID_73281; Strand=-; Position=1 -165,384-458
MPISLQFLITQPLAFQKLTTNTVPTNFASLMCANIVQNHLATAAALHTDATKKRTPFSPNLEKQRQLHQQMISQQQQQQQ

SEQ ID NO: 146859 - protein, 1010 aa, Heterodera glycines
  Coding regions on vcDNA: vcDNA=SeqID_73282; Strand=-; Position=1-3030
  Homolog annotation: Hit_ID=XP_308624.1; Match level="QueryCoverage =31%, HitCoverage=36%, E-value=4e-40, Identity=32%"; Hit description =ENSANGP00000024486 [Anopheles gambiae]
MPPLPMDRVRRRVPFESVGLDFLGPTATLDDSRQRQKAWVLLITCLTTRAIYIDATRDLSAKSFIALLRRFIARRGAPSRILSDNAPTFTIVGKTLGEFGITGDHPLEFADSRGIQWRFTPQHTPWAGGIFERAVQLVKRALQKTLGSCVLDYEGFSTLLAEVEATVNSRPITYVNGNPGEPLPLRPIDLVQENGRLIVNPPPGSSEPNGQRREPPHEQLTRQWRHSQQRLEHFWRRWHREYLMALREKAGWNHPQKRVNAPGAPRVGDIVLVEDKFHPRNLWAMGRVEELKGSGGHVRSVLLKMANGRIWGRPVNKICPIEAGPETEESDQREAPDRDPGEANEADGADKDKRESNTPFSTDERTKESTPEPEQMLGEEPPVTQRNEQLSEGRAVQGDERRKSQRNRKPRRIWSPEHRKVDKRGSKFPLVALAVMMALICPTLAWGCQPTPSLPPLEQSDPDMRTTMLPCHMECTKRGVKTSSGRRLRKAEICCPDGCWATVPTATVISYELPAEVLIHGYSCSGQCWWGSGPPFNVTQRCPAREECELINCSFCWEQLANPTCHPRWASTLFGFGAALVLAVFGCCCSLVSRFWSGATLFSRAIALGVSYPVKFINWATGRRLPQPTAERIEGKMRKGAKVARAEIRELQRRLQLGRRARAMAQAWQHPERGHGARTGVVAASLLPLLLVFGTTMATKPISVMVRSEDCSRSAEGLKCAGTAATVLTLLPSDQTNSFVIRTQQDELLGAVRLRLASITMICVPKTESWLRSYSISTTAVKRCPSAGSCRGNTCSAIRNRETIPELIALNHRPGHSFCMRSTSFWQNSCGLPSASCLFYRWAAVPTTTTVFEEFTCLEWDMQISAWVELETNNGQIDSQRLTLHPGVSEPWGNMTISVIPTSLPPMLALSAHFVTDGRAVAMGRPMPSDLHCPDEETARGFDKCQLSIGACQKCAPDHDNGTVHCHCRDLDIGRVLNNPEQRLPLDVARLHLHNHGSSIRAEFQYSPVQ

SEQ ID NO: 146860 - protein, 466 aa, Heterodera glycines
  Coding regions on vcDNA: vcDNA=SeqID_73283; Strand=-; Position=1-1401
  Homolog annotation: Hit_ID=NP_508324.1; Match level="QueryCoverage =87%, HitCoverage=15%, E-value=1e-65, Identity=36%"; Hit description =predicted CDS, peptidase family A16 and RNA-directed DNA polymerase and Integrase, catalytic domain and Z
MLIRFRACQVPVIADVEKAFLMVGIEEADREVCKFLWVRDPLGPLTTANLVPYRFRRLAFGLTPSPFCLAAVVRHHLRKYGSDFAEQLIRDTYVDNVLIPADTVEEASQKAREAKRMFTEAKMNLREFLTNDQNLNSSFSEADALGKTTAKMLGLEWDAEKDSIRMVFSGVTPAGAGGHSSRRAVLKTIARLFDPLGLLAPATLPAKQFFQRLWESTHSWDAPLDADDAREWNRIVASWDGEFITIPRVARAEGAEYCQLHVFTDASENAYAAAAYLRSEGVDGSILSRLIMAKSRLKPKKASGTFTIPRMELMGLVLGVRLAAFVKTQLHRPISEEHIWSDSTIALHWVKNRTPQPQFVANRLAEIRKSTDATFHYVPTSNNPADSATRGLSPAHLQQFELWWKGPVWLATSCATWPHELEFKVDDDEEEATPAEELTSATLVAQREGTPCQKEEWPNSLLNPLQ

SEQ ID NO: 146861 - protein, 256 aa, Heterodera glycines
  Coding regions on vcDNA: vcDNA=SeqID_73284; Strand=+; Position=1 -146,221-367,656-851,904-1185
  Homolog annotation: Hit_ID=CAE57235.1; Match level="QueryCoverage =27%, HitCoverage=18%, E-value=2e-24, Identity=70%"; Hit description =Hypothetical protein CBG00112 [Caenorhabditis briggsae]
MVIAFSLSWVWSVLYNLLRDYECLPLLISRQEFFFGILTHCIAMSSTVWNPILYALLNLQLRAAFLQLIPECAKNVLVELCGREQTQQQQRNSAEKSRLLDINNGIKESEERTKKLLSCFLTSRGSVEVSTSSEFGKMSEGKAKTAQNALKLKTVQQKKKTKKGTEKRKDENNGRGDETKWEGSDRRKGDEAETTETAQWEGSDRRKGEEAETTETAQWEGSDRRKGEEAEEEKRQQGDGHGTAADIKEMDMDEQI

SEQ ID NO: 146862 - protein, 268 aa, Heterodera glycines
  Coding regions on vcDNA: vcDNA=SeqID_73285; Strand=+; Position=1 -279,726-852,898-1136,1300-1413,1462-1509
  Homolog annotation: Hit_ID=NP_492116.1; Match level="QueryCoverage =97%, HitCoverage=63%, E-value=3e-56, Identity=56%"; Hit description =mannosidase (62.3 kD) (1I144) [Caenorhabditis elegans] emb|CAA98114.1| Hypothetical protein D2030.1 [Caen
MFLNKARDVADLLMPSFNASPFGIPMSLINLRTGRTGNYGWASGGCSILSEFGSLELEFNYLSRLTGNLTYMSKCARVREYVIELQKPDGLYPACFIAGMFALQSLQENDETTRVNTLKLAEQIGHTCHESYRKTVTGIGPEAFRFSSDAEAQATRISEAYYILRPEAVEGWFYLWRATGDEKYREWCWEAAQAIERHCRVEAGYSGIRNVNAQQIEHDDVQQSFFLAETLKYLFLIFSDSTEIPLDQWVFNTEAHPFPIAHSAQQVQ

SEQ ID NO: 146863 - protein, 217 aa, Heterodera glycines
  Coding regions on vcDNA: vcDNA=SeqID_73286; Strand=-; Position=1 -65,133-400,680-798,849-1050
  Homolog annotation: Hit_ID=NP_508216.1; Match level="QueryCoverage =94%, HitCoverage=43%, E-value=7e-50, Identity=48%"; Hit description =sorting nexin (54.1 kD) (XB751) [Caenorhabditis elegans] gb|AAF98602.1| Sorting nexin protein 1 [Caenorha
MFKSVGDVFSKIAFPMDENDRWFEQVHSQVDELEEMLTRLQTHVDSLVTHRRDLAFSDDQSSKALSMLASCEENTVLARILSKLAETHENLAIVEKHEAEQDAQQLEEVVNEHLQLLSVLKEVFYERVKGWQNWQNQQQTLTRKRETKARLDLTGKTDKAAQCREELKECENKADQMEKDFLVMSKVIREEYSRLFKQRREDIKANWGMGRNGGKNE

SEQ ID NO: 146864 - protein, 252 aa, Heterodera glycines
  Coding regions on vcDNA: vcDNA=SeqID_73287; Strand=+; Position=1 -223,480-688,891-947,997-1151,1203-1317
  Homolog annotation: Hit_ID=CAE73013.1; Match level="QueryCoverage =98%, HitCoverage=80%, E-value=4e-94, Identity=58%"; Hit description =Hypothetical protein CBG20369 [Caenorhabditis briggsae]
MGILGLPNVGKSTFFNVLTKSEAQAENFPFCTIDPNESRVAVEDTRFDWLVEHYKPLSRVPAYLTVVDIAGLVKGDVDPIRDLEIINSELRLKDQAYLVGALDKVEKLAVRANDKTKKLEHDTLLKVKELLETKFVRQHEWNEKKNKWLPKIKAWIDENDPGAVLIPFSGAFELKSVELDPEARAQFFKDTGACSALDKIIKTGYKTLCLEYFFTAGKDEVRAWTIQKGTKAPQGAGRIHTDFEKGFIMVII

SEQ ID NO: 146865 - protein, 73 aa, Heterodera glycines
  Coding regions on vcDNA: vcDNA=SeqID_73288; Strand=-; Position=1 -196,962-987
MVACFNSINQSFIRKSVTPKNKEIIMSKQSIGHFWSWGGKEINKLRSDLSRSLANSFGFSNLVSLVSQNFGKS

SEQ ID NO: 146866 - protein, 364 aa, Heterodera glycines
  Coding regions on vcDNA: vcDNA=SeqID_73289; Strand=+; Position=1-1104
  Homolog annotation: Hit_ID=NP_502721.1; Match level="QueryCoverage =79%, HitCoverage=21%, E-value=3e-49, Identity=38%"; Hit description =endonuclease/exonuclease/phosphatase family and RNA-directed DNA polymerase (4O953) [Caenorhabditis elega
KSIDVIYFFDTVPHNRLISKLQNIGINNSLLKWIQNYSENRKFFVKIGSDFSDEYPCLSGVPQGSILGPLLFLIYIYDLPKFCETDVKIKLFADDLKAYHVLSNISFSPLQNFINKFNQYCKLNGLKIASNKCLTLHLGHKNQKINYFIDDFQIPKNPGNEPVRDLGIYFTNDLKWAEHIDIISKKALRSAFAILKSIKTRDTKILVNLFNIYCRPILEFGSPIFNPYLKKDIEKLENVQKIFLRVIFRRNNYAAANYAELLNIYDQKSLESRRLKIDLKLFHEIILGKINLQNNESFSFSKNPVKNEYTIRTAYCSTNARYNSFFIRTSRLYRLLPKETRLLNPNEFAKLLERSDLNLLISLP

SEQ ID NO: 146867 - protein, 113 aa, Heterodera glycines
  Coding regions on vcDNA: vcDNA=SeqID_73290; Strand=+; Position=1 -201,598-738
MAISGSTTTMATTTTTTSSTTKTTIAKLATTMAMPQTEMPTTTMTSTEMPTTEMPTTTTKGMGQQCQYFGPNGADIDSVFGTGQISAVLSCTTAGQWAVGNVTNIVELECISG

SEQ ID NO: 146868 - protein, 54 aa, Heterodera glycines
  Coding regions on vcDNA: vcDNA=SeqID_73291; Strand=+; Position=1 -63,520-621
MPKISTHLIRTDKHEKRVFRLVSISRFFVPKNGVPNYNQSNAIGWIPLRVAIHP

SEQ ID NO: 146869 - protein, 369 aa, Heterodera glycines
  Coding regions on vcDNA: vcDNA=SeqID_73292; Strand=+; Position=1 -449,539-740,797-950,1044-1150,1442-1639
  Homolog annotation: Hit_ID=CAE71479.1; Match level="QueryCoverage =52%, HitCoverage=46%, E-value=3e-43, Identity=46%"; Hit description =Hypothetical protein CBG18398 [Caenorhabditis briggsae]
MPSDTAIYVPLLKEFPTRPPYYYRTPMSLMYRITVTTFSKLQNCAGFLTGILFGLILAASVVHFVDNFDHFVLMPKMSKELKEFREQFRKIEKTYKYTYKSKRKEVENEQSKANKNTKTENGTVAVELAKKVRVFCWIFTYEKFHESRASTAQFNLTSFVPLRHVRATWAQHCTRYLFFSSKDDPTLPAIDVGMPLGRKYIWRRTRWILKYIYDNFMNDFDWVFRIDDDAYVIMENLRLMLLPHSPDELIYFGHKLHTTIFKDHLFPQGGAGYVLSRSTLKLLVERGLNDSTKCWDGDDSEEDQGPEYCSDYAISFHYTDARMLYLLEYFIYHFDAYGARTLATDRPNYFEEAMRKAFDNVGPGDILSK

SEQ ID NO: 146870 - protein, 49 aa, Heterodera glycines
  Coding regions on vcDNA: vcDNA=SeqID_73293; Strand=+; Position=1 -86,144-207
MPSKVTVRGPTTRKLLVFTTIAAFSSSAGKKTNNYEQLAVTLDRQTLLS

SEQ ID NO: 146871 - protein, 376 aa, Heterodera glycines
  Coding regions on vcDNA: vcDNA=SeqID_73294; Strand=+; Position=1 -33,121-183,249-329,1022-1273,1322-1396,1482-1644,2606-2706,2760 -2957,3069-3233
  Homolog annotation: Hit_ID=CAE66891.1; Match level="QueryCoverage =51%, HitCoverage=35%, E-value=2e-12, Identity=27%"; Hit description =Hypothetical protein CBG12272 [Caenorhabditis briggsae]
MSTLGSAATWSSGLPTAPQDPIFFMHHCYMDYIWEQWRLRWQTRAQRETQFPSDQQVVAVARSKDSSSPEVAEHSGEKAERGAPRKAYGHSSERGGQSAEKRGQSGEQRGQSGEKRGQSGEKGGQSGEKAGGNKRKGYGYGGNNSPTTAEPPKPTTVPADEYTTLAPMYTPPKERVCYDNHECCAVWATKGACKSAPRYMNTWCPGACRYDGCLPQAVKRAAENYLFIKFIMFIKRGHFFAIFFLTTFSISKAMFMPFKVSVRLLVYDNANDIFWDLSKGTLHEESVPTLIRSAEIEIGNDRTTVREIVEKVANEFCKQQQQLLDEEGDEKPYRIMTIFEDKQLNMQIQREMDAEPNTEYTAILLLKNGQKDSVGK

SEQ ID NO: 146872 - protein, 48 aa, Heterodera glycines
  Coding regions on vcDNA: vcDNA=SeqID_73295; Strand=-; Position=1 -135,689-700
MHQSLAFKIIAILAGILALFGPIDCRATHGTCVHQGRQYREGEEWYKA

SEQ ID NO: 146873 - protein, 95 aa, Heterodera glycines
  Coding regions on vcDNA: vcDNA=SeqID_73296; Strand=-; Position=1 -73,133-344
MDWVKFSCNTTETQRNSPAANIAKDEKCLVEFIDKFAAANNSYVTWEQVVAFCSNIHEGLQRMALDTIITRLTANLTKLTRQMEALREEAPPRDK

SEQ ID NO: 146874 - protein, 196 aa, Heterodera glycines
  Coding regions on vcDNA: vcDNA=SeqID_73297; Strand=+; Position=1-592
  Homolog annotation: Hit_ID=XP_497907.1; Match level="QueryCoverage =83%, HitCoverage=65%, E-value=7e-11, Identity=36%"; Hit description =PREDICTED: similar to mKIAA1114 protein [Homo sapiens]
HQHSNQRDSIHLHFKSLGLNPPTFQSTGLNPPAFQSLGLNPPTFQSLGLNSSAFQSLVLNPPTFQSLGLNPLTFQSLGLNSSAFQTLGLNPPTFQSTGLNPPAFQSLGLNPPTFQSLGLITGTQPSNIPINGTQFTRISITGTQFSRIHITGLNLINPSATQLPGLSSPTFQSSELNLSNGIQNYLKGIQKLKYNP

SEQ ID NO: 146875 - protein, 40 aa, Heterodera glycines
  Coding regions on vcDNA: vcDNA=SeqID_73298; Strand=+; Position=1 -42,112-192
MKKMNEASRSGSKLNSGPDEKYFYLSWGKNCTDYESELKL

SEQ ID NO: 146876 - protein, 22 aa, Heterodera glycines
  Coding regions on vcDNA: vcDNA=SeqID_73299; Strand=+; Position=1 -34,92-126
MGVWVRKEKGIASVHLHKWSSG

SEQ ID NO: 146877 - protein, 126 aa, Heterodera glycines
  Coding regions on vcDNA: vcDNA=SeqID_73300; Strand=+; Position=1-381
MDQRIWSSKNAKSYKSKTDEEKIEIVKKFIELTNEYKQKRKYSHIEWQQNYAEICKKVGVSHRTIKNWKKQFGISSKLTEKEKMEKMKKYWQIKIENPKMSEKEIAKILKIDRKSITNWKKQLVLK

SEQ ID NO: 146878 - protein, 70 aa, Heterodera glycines
  Coding regions on vcDNA: vcDNA=SeqID_73301; Strand=+; Position=1 -34,895-1073
MGVWVRKEKGIALSLRNMKLHLFAFLFLIVEITKVGTKEKKLQQKSFAEIFGEKWKKKKKKKEMRRKKEK

SEQ ID NO: 146879 - protein, 96 aa, Heterodera glycines
  Coding regions on vcDNA: vcDNA=SeqID_73302; Strand=+; Position=1-291
MAKEYKQKRKYSRKEWNQNYKEICKKIGVSRETLRKWKKQFGIRSIKLTEKEKMEKMKIYWQTKKENPKMTDKEIAKIVNTSQQNISNWKKQFVAE

SEQ ID NO: 146880 - protein, 74 aa, Heterodera glycines
  Coding regions on vcDNA: vcDNA=SeqID_73303; Strand=+; Position=1 -151,596-669
MWHIPFPSQFRIPIPNASTTTALGRATGSTGWFTFVNFSSTWAEQEQRKGDRFIIWTVGNHNNDGSLLRKNYLQ

SEQ ID NO: 146881 - protein, 103 aa, Heterodera glycines
  Coding regions on vcDNA: vcDNA=SeqID_73304; Strand=-; Position=1-312
MSNEYKQKGKYSPNEWYQNYAEICKKIGVGYDTIRKWKIQFGISCKRITKKEKMEKMKKYWKIKRENPKMSDKETAKILQIDRRTISKWKKQFGGEILEDLNG

SEQ ID NO: 146882 - protein, 94 aa, Heterodera glycines
  Coding regions on vcDNA: vcDNA=SeqID_73305; Strand=-; Position=1 -42,301-441,557-658
MDMEMRLLKLEQENRAIKAKLKEQKADNKLALEHQKNEFELRMVKMEAGLNERLMKMEGEHQAFQARLVIEKLTMENHQLRMEEAKKLPLQFKY

SEQ ID NO: 146883 - protein, 164 aa, Heterodera glycines
  Coding regions on vcDNA: vcDNA=SeqID_73306; Strand=+; Position=1 -75,516-692,1059-1157,1683-1826
MWCHWMANGKGLLIQRWAVFANYQREPYIPFMEKACRLCGSAVTMLFFIFLVIALLFDIIVYRMFLIRVFMPAHFQCLFRDCLSRQRNKNANGFAKNGVKQLNVSTRTSNSDYMCSWTSLSFPAIQSEAQQMPNSVAATPCAHNPFNNNHFPQSDAEKYNNKQC

SEQ ID NO: 146884 - protein, 105 aa, Heterodera glycines
  Coding regions on vcDNA: vcDNA=SeqID_73307; Strand=+; Position=1 -89,248-299,682-786,835-906
MTNSNYNNNNCDDNKQRDNSRSSPNDTHKNSCFSAPSECPFLSRSSCLDFSQNFFRFLPFGIFDGLDELQALLGLASLQWVNLEWCPILAEAEQIEIEANGNEMF

SEQ ID NO: 146885 - protein, 57 aa, Heterodera glycines
  Coding regions on vcDNA: vcDNA=SeqID_73308; Strand=-; Position=1 -71,333-435
MFTKNVKYNSFFGFYTIKREVAISSKYHEIMKNEFPCVKFLLCSNNHKPPVVVVSVS

SEQ ID NO: 146886 - protein, 289 aa, Heterodera glycines
  Coding regions on vcDNA: vcDNA=SeqID_73309; Strand=+; Position=1 -33,137-264,316-460,508-593,699-821,878-1014,1072-1195,1475-1568
MASINTSSTDPFYLAYRFAGPSADLIVPAVALNLVALVGIVLNGTVLVVTVKSNSLRGSANFLMALICLCELVHQIGHTFFLVVVISGTNFVSLLTADLIMTPMLFASNCGLMAMFCAAFDRLFAVALPFKHSSIFAHYKFTYLLGHLLICVIYGAFTLNYVLAYAFENAGNPTTGVVAETLLGPVGYKFFAGTFIISFCSTCCYVSIFVIIRCKNGVTQQTNTRVLRSLVIILSINIGGYLTNLAMYQLLYAFGSILGIFLSSEYRRVFKKAFRALKGYFGNKNGIFN

SEQ ID NO: 146887 - protein, 46 aa, Heterodera glycines
  Coding regions on vcDNA: vcDNA=SeqID_73310; Strand=+; Position=1-203
NFFIWTSLFVTRNHYFGEFVTKIVKIHYFGVLSLFFHYFGIFWKIP

SEQ ID NO: 146888 - protein, 179 aa, Heterodera glycines
  Coding regions on vcDNA: vcDNA=SeqID_73311; Strand=+; Position=1 -138,191-268,589-833,1046-1125
  Homolog annotation: Hit_ID=CAE75350.1; Match level="QueryCoverage =95%, HitCoverage=15%, E-value=3e-44, Identity=49%"; Hit description =Hypothetical protein CBG23330 [Caenorhabditis briggsae]
PWGVNPVPITADNVAERAQLLADQYRKKAQLYGHNTLLVPLGDDFRFDEDSEWTDQYANYKLLFEFMNAKKDGALSADSPSSAASLSLLPLLSGDFFTYADRDDHYWSGFFTSRPFYKHMDRTLQHLLRAADIFYTMARWESKGNSEKGEEDGEIIPQQLSQQATSTCFSTHWFGLGGH

SEQ ID NO: 146889 - protein, 141 aa, Heterodera glycines
  Coding regions on vcDNA: vcDNA=SeqID_73312; Strand=+; Position=1 -193,239-468
  Homolog annotation: Hit_ID=CAE75350.1; Match level="QueryCoverage =94%, HitCoverage=10%, E-value=6e-13, Identity=32%"; Hit description =Hypothetical protein CBG23330 [Caenorhabditis briggsae]
GVEDNLLTESRFHLLLEHFDRFSSPPPSSSAEGTIAFHSLAAHHSSLRLHYPPISLAGQMDDAKEFKARRPFGSVLRHSFPCNFHPVTLRTLSHPTVYSPNSSSTRPRDEAALILHRFGIECRLGTSLGESSCPAGMATAE

SEQ ID NO: 146890 - protein, 191 aa, Heterodera glycines
  Coding regions on vcDNA: vcDNA=SeqID_73313; Strand=-; Position=1 -120,330-717,1001-1068
MTFCQALSCARTISACLGSHLHLILPPILSVLDDRKTEEKKWTQFSVYKENVNAALVRCRVEPMLCHEYQEQLALLQAPSYARQQQQQQQNAIGSGGGVYQQQQGTFSASTSSPLFARQVSFLPPPPTQNGGATTDTSPLPDAHNGIVGFLPGPGGSSADMSRVHRMSSGNYSMPLLCPFGLNCRSGNRTN

SEQ ID NO: 146891 - protein, 30 aa, Heterodera glycines
  Coding regions on vcDNA: vcDNA=SeqID_73314; Strand=-; Position=1-92
DPFLLTNSQTLRRKIQLNCTWSPKLKRRVK

SEQ ID NO: 146892 - protein, 622 aa, Heterodera glycines
  Coding regions on vcDNA: vcDNA=SeqID_73315; Strand=+; Position=1 -132,732-797,1142-1375,1483-1587,1663-1773,1815-1907,2037-2175,2238 -2365,2412-2468,2526-2597,2811-2969,3053-3155,3455-3633,4150-4274
  Homolog annotation: Hit_ID=NP_500253.1; Match level="QueryCoverage =97%, HitCoverage=97%, E-value=1e-155, Identity=49%"; Hit description= spastic paraplegia 3A homolog, atlastin, putative guanylate-binding protein, similar to ARL-6 interactin
VDRFPSMYFNEVQNDSRQMKMVAYLYRKKNRNVKIEGSSNFTEHEFVINSEAIKRILDDPRYADKKVCVVSVAGAFRTGKSFILNFFLRYLRWHSAPVADRTGDWLEMELTLGGFSWRGGDDRDTNGILIWPEPFLLEDRNGEQVAVVAVLLMDTQGIFDSVSTFKNCATVFALSTMVSSVQIFNIFNINKTIQEDHLQHLQLFTEYARLALDDNNSNPFQSLLFLVRDWSFPSLLFLVRDWSFPYDAEYGQIGGQRILDKRLEVTPRQHPELQQLRHHIRSSFDNIGCFLLPHPGLDVATNPHFRGELDRMELDFKAQLRMELDFKAQLRSLVPHLFYPNNLVVKQIGGQPITCRELAVYINAYFEVFSKAELPEAYFEVFSKAELPEPKTILNATAEANHLAAVVSAKATAEANHLAAVVSAKAVYMREMEESCGGDAPFMSGAELRSEHARCRAEAMRTFQTAKKMGGPELAEQFAQKLEQDITEAFESFERVNNSKNLFKSMRTPAVLVASMIALYCCQEFFQLLGLDTIASIFSLFHMLIFVALGIWTYSRYSGQFRHAQVFIDGRVHALLHNVLAPNSARVQQIGHDARHGRFSSSSRRRTSCSPPPQPLHLKLRS

SEQ ID NO: 146893 - protein, 285 aa, Heterodera glycines
  Coding regions on vcDNA: vcDNA=SeqID_73316; Strand=-; Position=1 -78,142-306,366-638,879-965,1083-1204,1262-1394
  Homolog annotation: Hit_ID=BAB15701.1; Match level="QueryCoverage =99%, HitCoverage=55%, E-value=5e-18, Identity=26%"; Hit description =unnamed protein product [Homo sapiens]
MATVLRSSAELSVESIVALFNCYVHSIFTFFCSDFDAQQQQQMFGTNFVTFRLRQFVQSIEKKMNGPGATEGGQDSVENAELSLFCRRSSLCHALDRNDSDKLFLLVERIVGVESVYVFLSVLLIFMHQNLDAFRSVFLAKQMELLRPFLEALLPKSGGGSDSNLSLDSFYRSILKQISATDWTTGEIHSQHSPYVDTIVQECSQFKQKFVRLFPYVHISDELYAAIWSMLLLCIFRILVQGYADVKKCSIEGRALQLLDVEQLCGELEEITGLRQFHNHPFILL

SEQ ID NO: 146894 - protein, 109 aa, Heterodera glycines
  Coding regions on vcDNA: vcDNA=SeqID_73317; Strand=-; Position=1 -84,191-436
  Homolog annotation: Hit_ID=CAE71390.1; Match level="QueryCoverage =44%, HitCoverage=5%, E-value=1e-09, Identity=60%"; Hit description =Hypothetical protein CBG18297 [Caenorhabditis briggsae]
MEEVKMFLESETFTLCPVPVQFTLFDLPEFFFLKELQQKQQNDEQTEEETEQNSVETFVHGKSIRFSVFRHSSEMDTEIFPYSPEQFDESVRRKAQKMDMKNFFAKRKH

SEQ ID NO: 146895 - protein, 113 aa, Heterodera glycines
  Coding regions on vcDNA: vcDNA=SeqID_73318; Strand=+; Position=1 -107,160-394
MTPPIGAWPLQGAPVFRIPQTFPPRALGTNQQFSQPTNQAMANYPFMLSASVPLPQTQTFPLPNALPFAMNSNGGSLTYPTQMNYAQMPAPAQNTHSEQVPKKKKNTSKKQTK

SEQ ID NO: 146896 - protein, 210 aa, Heterodera glycines
  Coding regions on vcDNA: vcDNA=SeqID_73319; Strand=-; Position=1 -483,571-720
MAANEFLETGKMLLDELPGNKQAENKSDDGLKPQKANGKALEAKSDNFQQKAFEFLCGIEMKAKNDEKGNDKTKKDDNLLAFKELEEKRLNFCQNWKNGKSIWKGWKEAGISIVTSVNNLKLNQQIYGESLRTLAKMEIFNSKNKEEFGNFAKLGIDLLKKMRELVHWLWLISLIMTNGKATTHHDEGKGLFMGFFAESLAWKSVFCTCC

SEQ ID NO: 146897 - protein, 128 aa, Heterodera glycines
  Coding regions on vcDNA: vcDNA=SeqID_73320; Strand=-; Position=1 -59,1441-1768
MSPLSFSSSVSMGRMNNSSSWATIGICPKQSSELGERICNRTGTYAYESDGTFWLSGSLKIRNAEYIYGADDVVGFGVDLANLKLIFTKNGQHLGFKFLKILYFTTLKHHPFVRFVFRSPIISFRFFE

SEQ ID NO: 146898 - protein, 155 aa, Heterodera glycines
  Coding regions on vcDNA: vcDNA=SeqID_73321; Strand=-; Position=1-8,83- 300,481-722
  Homolog annotation: Hit_ID=AAV34698.1; Match level="QueryCoverage =72%, HitCoverage=42%, E-value=5e-15, Identity=43%"; Hit description =IC5 [Globodera pallida]
MKDWATIGFAPKRNAKLDERIYSRIDTYAYESGGTFWISRKRQNPYEFFGNGDVVGCGIYSEKRQIFFTKNGQLLETPDFFIPPSDNDDDYDDNPLFPFVTLSKFGAKIEANFGPEFKFDLDTLKVKTAQRIFSYRTVNCKKYNKCPFFWCTVLD

SEQ ID NO: 146899 - protein, 51 aa, Heterodera glycines
  Coding regions on vcDNA: vcDNA=SeqID_73322; Strand=-; Position=1 -124,490-521
MNLKFHVFKSAQNCWDANACHDDLTITGPKCLAVIFKEFGNEKHCFSQLNN

SEQ ID NO: 146900 - protein, 31 aa, Heterodera glycines
  Coding regions on vcDNA: vcDNA=SeqID_73323; Strand=+; Position=1 -93,1188-1190
MLDLMDNEQNYGPKNLPVTFRLDPPRFLGGP

SEQ ID NO: 146901 - protein, 280 aa, Heterodera glycines
  Coding regions on vcDNA: vcDNA=SeqID_73324; Strand=-; Position=1 -228,555-654,1222-1368,1654-1744,2201-2251,4336-4434,4722-4847
  Homolog annotation: Hit_ID=NP_507870.2; Match level="QueryCoverage =34%, HitCoverage=23%, E-value=5e-16, Identity=40%"; Hit description =neurotransmitter-gated ion-channel subunit family member (62.0 kD) (5U497) [Caenorhabditis elegans] emb|C
FLCPKVRTQCKQQYKQNANSRNKNSNAKIIVAKRTPISNLLPFPIGAVLLLTISTQFYINFCAANSIAMPIGSGEAADLDEFVASSSTAPLYAPPMLASDTGSSTECQNYGDFATKIGPSPMSGVDGGPPMMISEMMYEENESDQQCVLGQAEKHATRILSDILKRYDRNLVPSIKGVDVEIELLIQKQEEGAQCLTNLSLSYRMVSYIKGVDWFMMGCVTYIFFSIVELAMVGILEKEAASDHEEDDESESHHKPSYGGGGGGGAVGNFARRTFRRNFT

SEQ ID NO: 146902 - protein, 69 aa, Heterodera glycines
  Coding regions on vcDNA: vcDNA=SeqID_73325; Strand=-; Position=1 -83,160-285
MTSTVPQIVLRLLLFAVLILNCFDCCHGRVHSKSSTVPTTTTKSPPAPKKGSILDKLPIWATIVIAVLI

SEQ ID NO: 146903 - protein, 213 aa, Heterodera glycines
  Coding regions on vcDNA: vcDNA=SeqID_73326; Strand=+; Position=1 -140,458-959
MTTTTTTTTTTTSSTPTTPKGTTTENWSESLAAAVGGKTTLVLIIVGALIAIIVLLVVVVCCCCCKKRKRRRRHTSADDDNDKEDNKKRKRRHHTSADDKKEEDHHHIDQHNKEEEQHGKEDNKSPIQSELKVSTISAVPSDYNTNKRLGATDLDVEAEEVPKTKPVPKKPKSEGGTKRKLSNFFWSTGTTEKRPSAAEHGVEVPETIRDDED

SEQ ID NO: 146904 - protein, 58 aa, Heterodera glycines
  Coding regions on vcDNA: vcDNA=SeqID_73327; Strand=-; Position=1 -47,103-232
MEGYCDAVKQYTDKDGRLAAEKKRLLSRIDAVKERIFTLLLRIRKGGTHYDCLYVLGR

SEQ ID NO: 146905 - protein, 246 aa, Heterodera glycines
  Coding regions on vcDNA: vcDNA=SeqID_73328; Strand=-; Position=1 -11,54-341,412-853
  Homolog annotation: Hit_ID=AAL78214.1; Match level="QueryCoverage =70%, HitCoverage=89%, E-value=1e-38, Identity=46%"; Hit description =putative esophageal gland cell protein Hgg-20 [Heterodera glycines]
MEQIGTFTDQIWLDTLAWLGREEIGWYFALVNARFAALVDTQLQQRRWYLTELHINKRRSRGSGAEVMVLNSEGAFFSLPLATTPMPDSVVGFNGTFNIWYLDVQVIKFLRRNRRLFSTNISLQFNHLITEFRAWQAMARHIWPLLRNGLRTLVSLKRKQLALMRKHVSPTVLFDCPNLVEILTPILPERPTVDNTNYAADTSARDLYMWLHMPRPDGRPKVFKLTKCNNGWDQFVNQLLSVGIVG

SEQ ID NO: 146906 - protein, 111 aa, Heterodera glycines
  Coding regions on vcDNA: vcDNA=SeqID_73329; Strand=+; Position=1 -155,767-946
MPQLLRLVAGVAPLALLLFVAAVCQLSALPSESLLLLLLPMMLLIVQCPVLFVTSPSTTGSTGSTMTTTTTTTTTTTSSTPTTPKGTTTENWSESLAAAVGGKTTLVLIIV

SEQ ID NO: 146907 - protein, 122 aa, Heterodera glycines
  misc_feature (80)..(80): Xaa can be any naturally occurring amino acid
  Coding regions on vcDNA: vcDNA=SeqID_73330; Strand=+; Position=1 -26,163-372,1049-1180
  Homolog annotation: Hit_ID=NP_501064.1; Match level="QueryCoverage =98%, HitCoverage=12%, E-value=6e-40, Identity=65%"; Hit description =proteasome Regulatory Particle, Non-ATPase-like, S2 (107.4 kD) (rpn -1) [Caenorhabditis elegans] gb|AAF986
FLQIVGKITRYGDAAIRRAVPLALALLNTSNPQLTIIETLSKYSHDADTETARNAIFALGLVGAGTNNARILAILRQLAXLHIQTQNTMMLLRITHGLMHLGKGTQTLNPFHSDRQLMCPAI

SEQ ID NO: 146908 - protein, 113 aa, Heterodera glycines
  Coding regions on vcDNA: vcDNA=SeqID_73331; Strand=-; Position=1 -234,288-395
MTNSSSKNAEKEGGTKQARERHLHRSNVEEAEAAVVEAEAEEEEDDDDDIHYSKFADDAKLLPALLKPAFQVEQFTLKTFFELHLEVMGRRDSRAGCLRTFNMTVGDFEPDAT

SEQ ID NO: 146909 - protein, 42 aa, Heterodera glycines
  Coding regions on vcDNA: vcDNA=SeqID_73332; Strand=+; Position=1 -41,615-702
MELLYTLKGGGGSRLELFAFGRLIEHVKSFRMIPRLMDLDNK

SEQ ID NO: 146910 - protein, 601 aa, Heterodera glycines
  Coding regions on vcDNA: vcDNA=SeqID_73333; Strand=+; Position=1 -1203,1492-2091
  Homolog annotation: Hit_ID=CAA82797.1; Match level="QueryCoverage =52%, HitCoverage=48%, E-value=3e-26, Identity=27%"; Hit description =gag protein [Ascaris lumbricoides]
MVSRINIILANEDGESLAESVKSIRIGQREKIETEGNGDNENLLNANTNFFRINNQGQRNGNGSDNVNYPKAPWPHFEGDPLMWPAFWQQFSANAGDKNIPDVQKCSYLLMSLRGRAERAVKGYLATGENYPLIVSTLKRQFGDLKVIRESLQNELLNLPTANESVMSLRPCFEELERICRQLHNSGLNEGEDSEFMLMTLKNKFPRAIVLEILKKEKDSGKKWKLGEWRRNLNDAISLREEAARCTRSLNLNPSEFRRVFSIQTSGRRPGQNSENPRTGTIPNCFLCGKTHWAANCKQVIGREARLRIITEQGRCHKCLRKGHSKNQCTGKNCIICNHNHHKVICPKGQNNHRTGANAIELGNQNNFRQSSRMSTEMRNGNIIAFTNVKNGKEILLMTRRSGEIELIDEKPDILIGMAEFWKFFKSVSPITDKLFRVNTTVGPIVCGQLDYNSETPQFGGVVATEKCEEEPNQFWNLETIGVWDNPEEKDDEIALKMFNETVERKNNRYVVSWPWKRPKGELPTNFSVAYRRLINLLNKLKLTPNELKALNDAFQENLKEEIVEESKILGFNEHFLPHHCVFASGKNRGLCMTHPPKSEE

SEQ ID NO: 146911 - protein, 31 aa, Heterodera glycines
  Coding regions on vcDNA: vcDNA=SeqID_73334; Strand=-; Position=1 -41,152-206
MTASTRGQSPAAPDRFGEKAGPARMVLNRVR

SEQ ID NO: 146912 - protein, 53 aa, Heterodera glycines
  Coding regions on vcDNA: vcDNA=SeqID_73335; Strand=-; Position=1 -49,926-1038
MNVGKSAASPRPWSSHTHSSILVHWAPRVVPLAQRHSSHCEWCRPRRVGTARA

SEQ ID NO: 146913 - protein, 89 aa, Heterodera glycines
  Coding regions on vcDNA: vcDNA=SeqID_73336; Strand=+; Position=1 -110,403-562
MDVGFIINYSENQVIKVFICKVKKNTKKIWGLNGIHILKICTYGAKLCHEDSIKNGTLELNAFIWHPPLLCTKHPIDFLYRKLTKYGKA

SEQ ID NO: 146914 - protein, 104 aa, Heterodera glycines
  Coding regions on vcDNA: vcDNA=SeqID_73337; Strand=-; Position=1 -60,406-576,883-965
  Homolog annotation: Hit_ID=CAG12231.1; Match level="QueryCoverage =66%, HitCoverage=23%, E-value=1e-11, Identity=43%"; Hit description =unnamed protein product [Tetraodon nigroviridis]
KWPTSPIRESIAPCRTVDNSNVQFPICPLCQQTVPIKRGEKPDLRVNEHIERDCRSELAKKGRWAPKCGVKNCFRREPKNVSSKSAAEQMDALFAAQLQREEYE

SEQ ID NO: 146915 - protein, 49 aa, Heterodera glycines
  Coding regions on vcDNA: vcDNA=SeqID_73338; Strand=-; Position=1-297
QWALMSPGLRTVHSPDQQKYFKVRFTRSSVKSNIFSGFIMHISQKLNHF

SEQ ID NO: 146916 - protein, 105 aa, Heterodera glycines
  Coding regions on vcDNA: vcDNA=SeqID_73339; Strand=+; Position=1 -65,348-600
MFAHCSTKTTTKPTPFSRTDKALSFVPRRPRPFRHSSRTVHTPAERTNAHKKCAGRRRFCRPSAGDSTAEGNGNETEPSQTEGLLQSDQNEVAKSMTKQQQNGQI

SEQ ID NO: 146917 - protein, 33 aa, Heterodera glycines
  Coding regions on vcDNA: vcDNA=SeqID_73340; Strand=-; Position=1 -95,413-419
MRPTECDADDGGFSAAFRLGTSGAKAPPPPYRI

SEQ ID NO: 146918 - protein, 41 aa, Heterodera glycines; identical to SEQ ID NO: 139690
  Coding regions on vcDNA: vcDNA=SeqID_73341; Strand=+; Position=1-163

SEQ ID NO: 146919 - protein, 117 aa, Heterodera glycines
  Coding regions on vcDNA: vcDNA=SeqID_73342; Strand=-; Position=1 -80,444-597,1162-1293
  Homolog annotation: Hit_ID=AAP31420.1; Match level="QueryCoverage =100%, HitCoverage=31%, E-value=3e-31, Identity=52%"; Hit description= Prion-like-(q/n-rich)-domain-bearing protein protein 89, isoform b [Caenorhabditis elegans]
PAVVVMGSCNNSRCTMYSQGRLVGTQLSLAFSVTCRGPLLGPGCDLACNSSAANPSTAICQSRRTGFFSLCRWINGGQVSDCKNCPWGIKENAYCADGEGGVLEPNHAVRKFRDFHF

SEQ ID NO: 146920 - protein, 84 aa, Heterodera glycines
  Coding regions on vcDNA: vcDNA=SeqID_73343; Strand=+; Position=1-254
MPPPPPPFIHRHNEKKPVRRLWQIAVDGLAAELLHAKSQPGPKSGPRQVTENANDSLFGEINGWYKKCHGMSKKKRKMPMNNGT

SEQ ID NO: 146921 - protein, 22 aa, Heterodera glycines
  Coding regions on vcDNA: vcDNA=SeqID_73344; Strand=-; Position=1-66
MAISFFEKFSMQQTLSNMKRSA

SEQ ID NO: 146922 - protein, 29 aa, Heterodera glycines
  Coding regions on vcDNA: vcDNA=SeqID_73345; Strand=-; Position=1 -66,123-146
MAISFFEKFSMQQTLSNMKRSAKNGYLFF

SEQ ID NO: 146923 - protein, 29 aa, Heterodera glycines
  Coding regions on vcDNA: vcDNA=SeqID_73346; Strand=-; Position=1 -66,123-146
MAISFFEKFSMQQTLSNMKRSAKNGYLFF

SEQ ID NO: 146924 - protein, 29 aa, Heterodera glycines
  Coding regions on vcDNA: vcDNA=SeqID_73347; Strand=-; Position=1 -66,123-146
MAISFFEKFSMQQTLSNMKRSAKNGYLFF

SEQ ID NO: 146925 - protein, 69 aa, Heterodera glycines
  Coding regions on vcDNA: vcDNA=SeqID_73348; Strand=+; Position=1 -140,250-319
MWHGTAAAGQQRLDKSVHNSDSVRLVQRAVHVDLWAQIMHNDGDGTLFLPTKLDNLVIIRKPLIRRSLF

SEQ ID NO: 146926 - protein, 206 aa, Heterodera glycines
  Coding regions on vcDNA: vcDNA=SeqID_73349; Strand=-; Position=1 -241,284-663
MDKNLKELQNEFCKSFKTGNFQNAMEMFQTTKIEKKEFDKSQMDTVLAKDQILNENNKRMFAKFVNFSSKMIEILQNLIESIKLPTFQQKPNFFMARRKKRASVFGGCFFGLLLALIATVPFYGYNSTFVIFYNNGYSKLVIEGNNLRSNEFTVYSDHYPDHNNINPWHTLFVIFALLLTIGAIFALMFCSCFYCIYRVGSRIFSA

SEQ ID NO: 146927 - protein, 99 aa, Heterodera glycines
  Coding regions on vcDNA: vcDNA=SeqID_73350; Strand=+; Position=1-300
MPIAFSCIHSMAELAPKFPFFIWLNKLVAWSTSLLASLSWSKTDKSSDAIKSNMSIRAARKWIYNYGNPQSAIAGVQKPRNFRNPQSAIACSPDEYRMS

SEQ ID NO: 146928 - protein, 82 aa, Heterodera glycines
  Coding regions on vcDNA: vcDNA=SeqID_73351; Strand=-; Position=1 -67,376-557
MSFPLPLRSFEMGICKDWSTRATFQHAYFGPRFAIPILALLLLCQFWLKDRYNNERVGKWRGREKHKSKTKIMQILGGTPPE

SEQ ID NO: 146929 - protein, 135 aa, Heterodera glycines
  Coding regions on vcDNA: vcDNA=SeqID_73352; Strand=-; Position=1-408
MGDASIQRLTDILQQLLNAHQQNAPPAENASQLPTLPDVECFDASQHSGCEIEDWLKRFKFALDCAALNLQDELKVKLLMTKLFGPTFSEYCKSVLPREVTDFNFVETAEKLKALFSRPQSVWIDRYECLCVSAR

SEQ ID NO: 146930 - protein, 307 aa, Heterodera glycines
  Coding regions on vcDNA: vcDNA=SeqID_73353; Strand=-; Position=1-924
  Homolog annotation: Hit_ID=EAL39955.1; Match level="QueryCoverage =58%, HitCoverage=62%, E-value=5e-14, Identity=25%"; Hit description =ENSANGP00000014227 [Anopheles gambiae str. PEST]
MSTGTRSSNRSQRECWRCGGKHSSRECRHQETVCRKCKRNGHLERMCAKHQAWLKKNGGKKEKAVNNIRVGGVFLVKDENQRKKGMIEVPIDVDGTNVDFIADFGTEGTILREDTVRKIGALKLSRCEERALYHDGTTRPFVGKGNATFSFGNRSAFGHFFVSKDGSKNLLGMDMMDRLGLSDSIGLKDKFQTETAKMNGVSKKKVKKFFGKHGRGKKQNFAVGANVIASLGDEPWRAGRVISQKGGTYDVQFSDGTTGEFPAKSVQPYMPDEDENFNFLLDGFGLKSASSGGSVGKHQIGSDGRRD

SEQ ID NO: 146931 - protein, 318 aa, Heterodera glycines
  Coding regions on vcDNA: vcDNA=SeqID_73354; Strand=-; Position=1 -475,915-1210,1498-1683
MLAQVYGTHLGLLHRMRKQWQSANANTKIHQNKNERCQFQKCLDALYEYLFREHIGHNGAVKPIFLYSTYDNSDRCFATVFDDIKCMARVSKIHFNWPFGEDNEERMAMMFDTWESFDEPPLILNESALMGYFKATNAKRSQQKVQQTEQSQHRDGPRAIARAKFEKTMEKMYRKAVENKEKMEQNETNEKIFLLGNGQLLDMEMGQPSSSSLLASSTSSSLASKSADKKSKSADKNLGKKKDAAILHLLVYKVESVIDDEAFLMFVKGQSNFMYVLEYAFDTVTRHNLRQTVDETNKIFYTQKYVKHLGSLHLMRRD

SEQ ID NO: 146932 - protein, 20 aa, Heterodera glycines
  Coding regions on vcDNA: vcDNA=SeqID_73355; Strand=+; Position=1 -44,285-303
MFWAPPACPTRLDSGELKYE

SEQ ID NO: 146933 - protein, 22 aa, Heterodera glycines
  Coding regions on vcDNA: vcDNA=SeqID_73356; Strand=+; Position=1-67
MNTMPSYCIIFFGVLLLAVHFY

SEQ ID NO: 146934 - protein, 286 aa, Heterodera glycines
  Coding regions on vcDNA: vcDNA=SeqID_73357; Strand=+; Position=1 -441,486-648,696-784,838-1005
  Homolog annotation: Hit_ID=AAB62657.1; Match level="QueryCoverage =79%, HitCoverage=20%, E-value=3e-09, Identity=24%"; Hit description =ORF 73, contains large complex repeat CR 73 [Human herpesvirus 8]
MCDFGLFPSISSSNVIPMETSALPDMDELLDRLENEPLQLVVELPAQSVAIKNEFSPNSNSNSDQQNSIIEQEQQQREKQVGVTTCDNNEESDRNLQNIVPKREEKGACLEAHGQIVPEQDKETPIQFQCLRLVHDGQSENRIHTAEECILAFKDGYETNKKNDEDIFDQIDQMAAQINAEELDQEIEETRDEEIVKKSDLESSYYHDTFPMKSQCLEKFVEEMVDSVLQRVLEEAIDVNEKNGQNPTEIKEEMEQCDGETDRGQRKADEAQEARETEAEKGANFE

SEQ ID NO: 146935 - protein, 145 aa, Heterodera glycines
  Coding regions on vcDNA: vcDNA=SeqID_73358; Strand=+; Position=1 -253,311-429,644-709
MSRRSREKRMEEEAQSLLILKADTNQTQNECRIWSVELRSDGFEELVRRELAEVARELCDTEKERREWTIALRRNFHLRIERGRICAEDQFPTLAVSTRGLASLGVDELFLAFHFDPSIFAPNEMRFSDDSALSIVHKGSVNIWP

SEQ ID NO: 146936 - protein, 104 aa, Heterodera glycines
  Coding regions on vcDNA: vcDNA=SeqID_73359; Strand=+; Position=1 -199,427-539
MARLSGCIVAIRETTTVIILSSWALDDIRQIVAGNRNMVGWALDQLSAAADADEEDGVTEVSGGMDVIGVSFLIFDGALRGSEQLSVSLVEDGLVVRLNADLME

SEQ ID NO: 146937 - protein, 111 aa, Heterodera glycines
  Coding regions on vcDNA: vcDNA=SeqID_73360; Strand=-; Position=1 -33,82-189,239-307,383-505
KHVTAVRDNEKGKRNDLNLLASSYLVQLAKRNVKLWELNEFADTKMTKTQSLVKANGTASGGGGGTTRKAVLNDPRQRHIHREELPTMPLHRPRQPPLNGVDRPYAVVEVE

SEQ ID NO: 146938 - protein, 81 aa, Heterodera glycines
  misc_feature (62)..(62): Xaa can be any naturally occurring amino acid
  Coding regions on vcDNA: vcDNA=SeqID_73361; Strand=+; Position=1 -106,156-344
FLCYESPGLSGTVRAGSGRVDTINVCNSTKKTLGNQEHSPYRKGISCSSSVTVHPRCCSGNXTHFSVCEESLRRRYGLAKQ

SEQ ID NO: 146939 - protein, 104 aa, Heterodera glycines
  Coding regions on vcDNA: vcDNA=SeqID_73362; Strand=-; Position=1-315
MHLGNCPWDRLGCSKCIVVAMSKDDESSVDEPTPPPAVVPIVVPAELLVDETFVWCRWLEKRRRRMTADGITSQANSEAAAVARLPTALSWEESWESEQLPPPK

SEQ ID NO: 146940 - protein, 41 aa, Heterodera glycines
  Coding regions on vcDNA: vcDNA=SeqID_73363; Strand=-; Position=1 -55,2154-2224
MALNTSNLMFLIATGFVGEQCCTKWMLNLGTFEHPFSDRTI

SEQ ID NO: 146941 - protein, 195 aa, Heterodera glycines
  Coding regions on vcDNA: vcDNA=SeqID_73364; Strand=+; Position=1 -99,591-735,837-1180
MSELVAECLQFDFSEIPNIFAVFSECLKLKGPNAIRWAQNQCQEKEDEQNASALDLRRMMGDALYKIRFPIIAERDFSDYIFPTGVLDADDALSVFVSYSNSGHTNAKFSIHPRVMQNTGGSRGRLTLDIENFEDFLMEDEGKRESVVKVIRGLPWQFTVTAKGFPEVVVKYLDISIQCNAQNGDFCVLGLIQNF

SEQ ID NO: 146942 - protein, 37 aa, Heterodera glycines
  Coding regions on vcDNA: vcDNA=SeqID_73365; Strand=-; Position=1 -27,126-212
MSKKGCSSGGMFCTPTPLRLYYNNYFGRDEIVNVKKI

SEQ ID NO: 146943 - protein, 168 aa, Heterodera glycines
  Coding regions on vcDNA: vcDNA=SeqID_73366; Strand=-; Position=1-504
MPNFDLAALILTDKKHSFDRCIDQKVVEFLRFNHQIFDEKGTELSLKIYSSQNANVTPIWSVFVREIWPIFATNIRHFAFPNSDHLSKLLFLTSPTILTDLNQLNSIQSVDLFPDVLGDDDGPNAAYCARQALFKWLHTPRKDEKPKRLSCIIYFTSQIKNRINNFKE

SEQ ID NO: 146944 - protein, 152 aa, Heterodera glycines
  Coding regions on vcDNA: vcDNA=SeqID_73367; Strand=-; Position=1 -113,392-667,1096-1165
MEQELSTAVISSAIRENQQQQQPLCSFVKTSFGRRRHCWICSDVLMDIFPFFDHAQLGLKLALISPRFDVLVDTHFNGKNELKIWRPIAIHNMGTTTKIEKLGIFTKFVQFPIPQRPLHNKIRFELLEIDKCKNYFGAKIIVERENAKMREC

SEQ ID NO: 146945 - protein, 127 aa, Heterodera glycines
  Coding regions on vcDNA: vcDNA=SeqID_73368; Strand=+; Position=1 -74,130-439
MEHRPHADEQKRQRARDSTIQRLRCRLQREQVHARRVAGAWTAACNYDGHGTNQGDVNFECARNRPRGRSWGSWQLEMGTFATFVPPENYAFPPPMVNGCQRAGAAMVRSQRTSAPKSTALKRSKTM

SEQ ID NO: 146946 - protein, 128 aa, Heterodera glycines
  Coding regions on vcDNA: vcDNA=SeqID_73369; Strand=+; Position=1-387
MARCPFLYIILIPLLLLVLINFPPILAWILKRDDVLLAYSPNELTTDETKIIGEKQLCPAREWSLEKTFGLPIEPNSEFGKMLPGLSTEFNHALPGIGKSLEYILCTFDKMHCRQVKLASFLETATNK

SEQ ID NO: 146947 - protein, 24 aa, Heterodera glycines
  Coding regions on vcDNA: vcDNA=SeqID_73370; Strand=+; Position=1 -51,607-630
MPFWAESVDGGVVTKIERTPCAIE

SEQ ID NO: 146948 - protein, 41 aa, Heterodera glycines
  Coding regions on vcDNA: vcDNA=SeqID_73371; Strand=+; Position=1 -60,626-688
WGQRCSCCGRSCGCGRKHCLNLLPIVDTCVLKMIHAAWHAS

SEQ ID NO: 146949 - protein, 263 aa, Heterodera glycines
  Coding regions on vcDNA: vcDNA=SeqID_73372; Strand=+; Position=1 -30,465-523,609-750,1049-1153,1381-1547,1656-1736,2122-2325
  Homolog annotation: Hit_ID=CAE74227.1; Match level="QueryCoverage =98%, HitCoverage=13%, E-value=1e-108, Identity=75%"; Hit description= Hypothetical protein CBG21911 [Caenorhabditis briggsae]
FAMRHYAGTVRYNVSNWLEKNKDPLNDTLVSVSNMKNAKNNLLIVELWQNYQTQEEAAVAAKSGGGGKKKGKSGSFMTVSMLYRESLNKLMSMLHKTHPHFIRCIIPNEKKQAGMIDAALVLNQLTCNGVLEGIRICRKGFPNRTLHNDFKVRYGILAAEEARSSTDPKVASGNILNKLVDNKELEVEMFRVGHTKVFFKAGVLAHIEELRDKKMNELITGLQCAIRGYLTKRDAARRKRQWNSYDIIQRNVKSWCAVGSLIM

SEQ ID NO: 146950 - protein, 155 aa, Heterodera glycines
  Coding regions on vcDNA: vcDNA=SeqID_73373; Strand=+; Position=1 -144,624-793,1292-1445
  Homolog annotation: Hit_ID=CAE74227.1; Match level="QueryCoverage =95%, HitCoverage=7%, E-value=8e-24, Identity=37%"; Hit description =Hypothetical protein CBG21911 [Caenorhabditis briggsae]
MKETLAKQEQTRKAVEAEHAKVAEERKKLQEDLERTRKGGSAIESEVMNLNTAKVQLERQLEDAKDRLEEQRQRAEETQRNLKRAEKEKDSLNEQIGSLEHNLKRVEEDKKKMDDRIKENHEAIAQQDEAIAAANKERRRAEEENRRMGEELQAN

SEQ ID NO: 146951 - protein, 96 aa, Heterodera glycines
  Coding regions on vcDNA: vcDNA=SeqID_73374; Strand=+; Position=1 -49,533-774
  Homolog annotation: Hit_ID=XP_393334.1; Match level="QueryCoverage =86%, HitCoverage=3%, E-value=5e-13, Identity=40%"; Hit description =similar to myosin heavy chain 2, muscle - fruit fly (Drosophila melanogaster) [Apis mellifera]
MEKNKKKLESEVHLVEEHIAEMQKQKGDTEMRQQRVEGEIMDLNGKLEEQNGIVGKLQRHLKDRQTRLVELEEELEQERNRQVPTVNYLFLLAFFD

SEQ ID NO: 146952 - protein, 36 aa, Heterodera glycines
  Coding regions on vcDNA: vcDNA=SeqID_73375; Strand=+; Position=1-108
MKLIWLTFLPYFCFAAVEVQYKCELFGDDTALPKSE

SEQ ID NO: 146953 - protein, 35 aa, Heterodera glycines
  Coding regions on vcDNA: vcDNA=SeqID_73376; Strand=+; Position=1 -95,404-416
MEMPICAFLRARKRTISLCGCTSHIQAERKFSSFS

SEQ ID NO: 146954 - protein, 346 aa, Heterodera glycines
  Coding regions on vcDNA: vcDNA=SeqID_73377; Strand=-; Position=1 -276,332-767,807-928,974-1180
MTEIKNKFKHQKIWASVDETTDSRGRYVANLIIGILDGKLHKPHLVAAKFLDKTNHETIARFINDNLRELISADDLLLLVTDAARYMVKAAQGLKIFYPNLIHLTCLCHGLHRVCEEIRGLFPNVDKLIASTKKTFSKAPSRLAKFRERCDLPLPPRPIITRWGTWLNAADYYCQNLNQIGAIIRDFNPSDSDAIRQSQIAFDCSGIRGDLAFIKSHFDILPGAIEKLESRNLTLIESLDLVSDVGNELQLVPGNVGKLVREKFNTVLRNNPGFDRILEIGMVLRGEDVQTRLPPDVIAMFKYAPIQSCEVERSFSAYKNILADNRMSFTPENLEKFLICNTHKKK

SEQ ID NO: 146955 - protein, 119 aa, Heterodera glycines
  Coding regions on vcDNA: vcDNA=SeqID_73378; Strand=-; Position=1 -71,379-513,1252-1405
MCGEWMRTGMGRDGKGAINEQKAKVQNNHKDNRLRANIINYQICKKIVLNKLINVISMASLNLNLIFLKESETKVREHSKIEARECRDGWMRGGMPHCDQWSQCSVGLRRVIYFSHQYK

SEQ ID NO: 146956 - protein, 37 aa, Heterodera glycines
  Coding regions on vcDNA: vcDNA=SeqID_73379; Strand=-; Position=1 -11,966-1068
MSNNLSLYLRDRSCAAANNEAVLWDGDVDIYKYHNLL

SEQ ID NO: 146957 - protein, 167 aa, Heterodera glycines
  Coding regions on vcDNA: vcDNA=SeqID_73380; Strand=-; Position=1-504
MVEKGTEIQTYRNELKSFQDEVDKAKNTTLEHVEKNDLKEAKKSADVAKGIAKQAKSKYSSTLEEYNDKSEKGYIGIVNRLNEALGEHIKRKDIENRQVSEAEKGPQKRERLANEDVQFQYDSIDQKFIVYLSAAVSHIDLSKHLAYVLGFKNTGYFMRKRRIICQI

SEQ ID NO: 146958 - protein, 120 aa, Heterodera glycines
  Coding regions on vcDNA: vcDNA=SeqID_73381; Strand=+; Position=1-362
MAANPTIDELTKLLAKQQKLVEQLLIAQQTNAAPAQSTQLPALSNVECFDLDDQSGKNIESWIDRFVLALDCSSPNIQDQLKVKLVLTELSEGAYNEYSKFCLAKKATEFDFSETSAQLK

SEQ ID NO: 146959 - protein, 1378 aa, Heterodera glycines
  Coding regions on vcDNA: vcDNA=SeqID_73382; Strand=+; Position=1-4137
  Homolog annotation: Hit_ID=XP_318550.1; Match level="QueryCoverage =71%, HitCoverage=99%, E-value=0.0, Identity=43%"; Hit description =ENSANGP00000020240 [Anopheles gambiae]
MAANPTIDELTKLVEQLLNAQQTNAAPAQSTQLPALSNVECFDLDDQSGKNIESWIDRFVLALDCSSPNIQDQLKVKLMLTKLGEGAYNEYSKFCLPKKPTEFDFSETSAQLKSLFAKPQSVWIDRYECLRASKQDDEDFRSFVNRHKRLLRDFDFKKLNEEQFNCLMLLIALKSPKDAELRKRILGKLTADGDKAKYENVVSDLQMFLSTIAEAKAIERPSHSNVLAINRRPFQKREPNKSPTQPTCWRCGGGHEPRCCPHAKATCRKCSKVGHLQNMCARHREWLSKHSRKPTQGKQMNALQLGGISVNALNQPSRLVEAPVDVNGKPINFVFDPGAEITVIDEEAHLQIGRPRLILCSESAKYHDGTECTLLGKGFATFTFGGHTHQGQFYVTKKGSLNLLGIDILDAFGLLDTFRAKVKMAMKVNVVKAGGKDRMKSQIPMKKDTTLLDLQSNFPHVFAEGLGHCTKAKAHLELKADAVPVYCRPRPVPFNTRLIVEAELDRLLAQKVIRPIDHTRWAAPIVVVKKANGAARVCADFSTGLNNALLLNQHPLPLPEDIFSKLNGGRIFSQIDLKDAYLQVELDEKSKELCTIATHKGNFQYLRLPFGVKSAPGIFQSIMDSILADCQFAFAYLDDMIVVSRSHEEHRKHLNEVFKRIGNFGFRIKPDKCFFNQRQIKYLGFVIDKNGRRPDPSKIKAISEMPVPTNVSELRSFLGMINHYQQFVKNMRFLRQPLDELLKQDVAWVWSTECQNAFDKIIEVLKSDQLLTHYDPEKDIIVSADASDYGIGAVISHRFPDGSLKAIAHASCSLSPAEMNYSQIEKEGLALVFAVQKFHKYLFGRHFVLQTDHKPLLTIFGNKKGIKACTANRLQRWALILLAYDFEIEYQNTADFGQADALSRLIAKTPGPEDEFIVATITESPNLATVNAFTAQFPIVHEDIVNATKADNLLQEVKGFILNQWPNKANMSEDILQFHRRREALSFENGCIMYADRIVVPASLQTEVLKMLHRGHPGMKRMKSLARQHVYWPGIDHQIEEVVRKCEPCATEAKAPRKTELNSWPKAEGPWKRVHMDYAGPFFGKMYLIIVDAHSKWPEVFEMRSTGSAATIEQLRSLCARFGLPETLVTDNGTQFSSNEFKEFVKENGINHLFSAPYNPMSNGQAERFVDTFKRACRKLKKEGAQNVVNTFLTSYRTTPNDALPDGKNPAELFLLRKPRTTLDLLRAKPSAPLIRDEAMEKQFNRRFGAKPRKFCLGDKVFARHRQSQSWRAGIVSQCQGVIYEVKFPNDTSNRFHANQMTARHTDDDDHGNEALNIFNDAFGLPLAPPDGPNETALPADQQAAPAQETDEANAERGHVRVDRPQRNRRPPQRYSPS

SEQ ID NO: 146960 - protein, 54 aa, Heterodera glycines
  Coding regions on vcDNA: vcDNA=SeqID_73383; Strand=-; Position=1 -37,304-431
MTNWAPLTMPFRDEGQRFSHHMLYMPLSNLQRRIRLFPVMWPLLSLTMPFELDR

SEQ ID NO: 146961 - protein, 72 aa, Heterodera glycines
  Coding regions on vcDNA: vcDNA=SeqID_73384; Strand=+; Position=1 -84,138-271
GSLALNNFERHKSNSTIKQDEITYRNRIFVNEKRLKILRMCNWPNCAVRDECKARFDEIATQNGVFGITRAA

SEQ ID NO: 146962 - protein, 207 aa, Heterodera glycines
  Coding regions on vcDNA: vcDNA=SeqID_73385; Strand=+; Position=1 -88,991-1526
MCLSRLGQIIYGGLALVTIVLICVSMFTDGWRKLNSSSNATGTVMDFVENPTVNMGLMFCKGPTMGVNGSASADGASVAHNEKELVDVCKEWFLVSSVDQLPAQFVPSPQNKPDWEKFVVGAMVVSLVLACLAFIWNLVTFCACFCHSHVMKPLPGLAGLTAMCLAVALTVFYMKNQQYIRNSRCLNLGIKQCFGFSDDEGQTVRQH

SEQ ID NO: 146963 - protein, 145 aa, Heterodera glycines
  Coding regions on vcDNA: vcDNA=SeqID_73386; Strand=+; Position=1 -136,359-660
MVMCTSSDISGKGLFYTISFNRSVIMHILLIIIYIAIVLVLKFKNVESEEMRVGRRSDQRQINYLLIIHLFAHLIRHNKRAIRTIGPFGLLGDQGPIPKIKTLQSWDNPSPPIPLWHGSSRLTETTNSKNFILEFIELTPNEIAF

SEQ ID NO: 146964 - protein, 44 aa, Heterodera glycines
  Coding regions on vcDNA: vcDNA=SeqID_73387; Strand=+; Position=1 -105,573-602
MKKCMKIRQKCHGIRKSYKKIHQMLKKRKIEMKNLKHSSQIVIP

SEQ ID NO: 146965 - protein, 104 aa, Heterodera glycines
  Coding regions on vcDNA: vcDNA=SeqID_73388; Strand=+; Position=1 -103,277-368,1549-1668
MSEAKKAELDADNEPTNEKTALSEELNDQEILLISTREALHCFYCQKSEVATPTEVLIRKDGTGIEIVEALARRISKSKNWTMSEEEIKTFFENPMADKKQTGR

SEQ ID NO: 146966 - protein, 225 aa, Heterodera glycines
  Coding regions on vcDNA: vcDNA=SeqID_73389; Strand=-; Position=1 -244,679-918,1153-1274,1356-1427
MGSQSHSSAVASSNSGAASSDSGGEKAETEDDELSGGGAAGDDEEDDASPCECVQCEVFGIFVLFGSPRKNSNFGGFDCFLVNPQQGFDVPSNASSAGLDLIGSAATLILSQQQQQQMIRQGDAAEPSADDLLRADFSMPKLREFFECQKAMGVPNFPEDFDEFWLLVVKARLFNVFKYRGPEAYNRIVLKIRDIAHQFRAQVEENEHSDGTENPKRGKKVKKEI

SEQ ID NO: 146967 - protein, 27 aa, Heterodera glycines
  Coding regions on vcDNA: vcDNA=SeqID_73390; Strand=+; Position=1-95
EAKECTGSLSNREILTEYSAKNGFDHF

SEQ ID NO: 146968 - protein, 208 aa, Heterodera glycines
  Coding regions on vcDNA: vcDNA=SeqID_73391; Strand=-; Position=1 -288,330-497,609-776
MPSSLSFPSTFATLPLFSFVRAQLVQPCRPRFRFRCPTSPGLGNGEIGPKRGVFRTPSDRKLPTRKVLENGSWASDGAKYPHFCEPIRKTEVLGVEERRKVQAELALGSRENIASAKVRIECIVEENYKLLPTQEKAEIRDSACGNAVATKKELQQEISKPLWLTYRGRIAHEESDHFQELFLLECTDVMALFSSPRQLALFKRTETI

SEQ ID NO: 146969 - protein, 150 aa, Heterodera glycines
  Coding regions on vcDNA: vcDNA=SeqID_73392; Strand=-; Position=1-452
MKLFPLLLLIILFLIVKIGSEKKKLQQKSFGEIFGEKWQEKEEEKRNELKKREIIGKFYKIKEKIKQKGRKHSAKEWNKIDGKIAKKMGTNRKYIYKWIKEFGLQKNKSYKSKTDEEKIKIVQKFIEMSNEYKQKGKYSPKEWEKNLCGN

SEQ ID NO: 146970 - protein, 189 aa, Heterodera glycines
  Coding regions on vcDNA: vcDNA=SeqID_73393; Strand=-; Position=1-572
KWEEKEGKQRNEKNKREIIEKYYKIKEKIKEKGRKYSEIEWRKIEVKIAKKLGANRQKIYKWIKEFGLQKIKCDEEKRQIIQKFIKMTNEFKQKRKYSRKEWDQNYEEIGKKIGVGYRTMTNWKKQFGISNKRLTEEEKIEKMKIYWQIKKQNPKMSEKEIAKIMKIDRTTISKWKKQLGGEILEDLNG

SEQ ID NO: 146971 - protein, 70 aa, Heterodera glycines
  Coding regions on vcDNA: vcDNA=SeqID_73394; Strand=+; Position=1-295
NARKWTGNGTCEVHEGRLWHLITLISFSETIVGNSRFILLLYVLHNLCMLFYLYKFCTFSIFINLFIRSL

SEQ ID NO: 146972 - protein, 258 aa, Heterodera glycines
  Coding regions on vcDNA: vcDNA=SeqID_73395; Strand=+; Position=1 -33,354-495,538-721,854-1025,1108-1284
  Homolog annotation: Hit_ID=CAE66437.1; Match level="QueryCoverage =99%, HitCoverage=99%, E-value=5e-60, Identity=49%"; Hit description =Hypothetical protein CBG11708 [Caenorhabditis briggsae]
TAGEQRICGERTENNENHTKETYFSHKERMFPELDGTDKRLIPTEQFLMACQGIAEFVGFLGMAFVPVKNDIAGNVHKVRTKFVGFLGMAFVPVKNDIAGNVHKVRTKFETDRKSMEVLQDLVDIDLMENGGKIGTATEGLLWLKRGLEFMLELLKALVRDYKKARTDAKTENLADILNEAYEKTLKRHHNFISKQLFKVVLYAAPRRRTLLLAVAYGHEGLEEICVEHIAELLTNFEANVSALVDYYHSKKLEIPPP

SEQ ID NO: 146973 - protein, 84 aa, Heterodera glycines
  Coding regions on vcDNA: vcDNA=SeqID_73396; Strand=-; Position=1 -178,436-513
KNAQAAKTEIEKMQGREKLSKEELAKKAMHALLAVRDEGAAGQRVEMAWVGEDSDGLFTVVPKESIDKWEVTVLAEINSMEQDD

SEQ ID NO: 146974 - protein, 66 aa, Heterodera glycines
  Coding regions on vcDNA: vcDNA=SeqID_73397; Strand=-; Position=1-199
  Homolog annotation: Hit_ID=XP_340673.1; Match level="QueryCoverage =78%, HitCoverage=9%, E-value=1e-10, Identity=56%"; Hit description =tyrosyl-DNA phosphodiesterase, putative [Trypanosoma brucei] gb|AAQ16032.1| tyrosyl-DNA phosphodiesterase,
SAASPHVKSYVALDAAGECQWLLLTSANLSHSAWGKLEKGGTQLFIRSFELGVLICAKDHLRRQSP

SEQ ID NO: 146975 - protein, 53 aa, Heterodera glycines
  Coding regions on vcDNA: vcDNA=SeqID_73398; Strand=-; Position=1 -69,622-714
MDSDLLNPEPWTQIGILNLILTRPNLQKKHALMFFKIDENTLSAFSIHIEYIF

SEQ ID NO: 146976 - protein, 130 aa, Heterodera glycines
  Coding regions on vcDNA: vcDNA=SeqID_73399; Strand=+; Position=1-393
MQITGTQISGISIIGTQPTSITITCTQTQQSIDFYRITSLGLNSTTFQSLRLKPRHLNHWTQISGISITGTQISGISITGTQTTSIPITGTQISSISITGLNSPAFHLRDSISPYECKIEKMQMTNFLLI

SEQ ID NO: 146977 - protein, 110 aa, Heterodera glycines
  Coding regions on vcDNA: vcDNA=SeqID_73400; Strand=-; Position=1 -145,862-1049
MPRANDFAFAVLACDSLLITAQTSTFSWWIAYLMPDDATILYNSDFIQSLVMGVEAMAFLAAVVPIGHIQSQLRRQCYHWHFPLDVVRCGAYLEHFHEEWTTNEQFFFTK

SEQ ID NO: 146978 - protein, 97 aa, Heterodera glycines
  Coding regions on vcDNA: vcDNA=SeqID_73401; Strand=-; Position=1 -175,337-455
MDVSLCYCIKHDKNELFRANLVSNRTNTLKVGGPKFVKFFSLEKAFVKELRHSKMNYLEMIIRTNFACTFEWETLSISVGNRKRILRRKELNLDLNI

SEQ ID NO: 146979 - protein, 46 aa, Heterodera glycines
  Coding regions on vcDNA: vcDNA=SeqID_73402; Strand=+; Position=1-141
NRLVDQAFQLVDKFCHVQHALQLFDARGHRPTPFTAQRRSGHFMRI

SEQ ID NO: 146980 - protein, 69 aa, Heterodera glycines
  Coding regions on vcDNA: vcDNA=SeqID_73403; Strand=+; Position=1 -168,202-243
MGDVKEYIKLFNTIAEPSGDFGDAMHKIGRISEKAAGLIGLSAPVANLLASIAHTELFSELFKHSYVQI

SEQ ID NO: 146981 - protein, 27 aa, Heterodera glycines
  Coding regions on vcDNA: vcDNA=SeqID_73404; Strand=+; Position=1-82
ESFDALQRTRTIYPPIELTMRISPFSS

SEQ ID NO: 146982 - protein, 61 aa, Heterodera glycines
  Coding regions on vcDNA: vcDNA=SeqID_73405; Strand=+; Position=1 -48,91-225
MIVLSPAFLVHEKLVLPHEEVLLALSEFRRDIFKRLDYLEMKNFHLMRDFKLSQYLTQYTF

SEQ ID NO: 146983 - protein, 123 aa, Heterodera glycines
  Coding regions on vcDNA: vcDNA=SeqID_73406; Strand=+; Position=1 -134,610-813,942-975
MFWPIVAKLYVNETLKKQQMPIQISNFNSTAQIIKQALDQRGSYSFFNNILIGENWSGDEWIFTDFDGSRGFTIINEYGINVYVFRCKSDYVRLLKAKQWLLDHRKQIVSVIDIFKIEQLRII

SEQ ID NO: 146984 - protein, 103 aa, Heterodera glycines
  Coding regions on vcDNA: vcDNA=SeqID_73407; Strand=+; Position=1-312
MTSSPAEQLREATDAAFDSVAKAVEAKYHQREEQKVKQYQEEREEWERRMAETRRKFETERHNFEQKMRMKREQQTEELAQMEQQMDEQRHKHCREREQQQQR

SEQ ID NO: 146985 - protein, 172 aa, Heterodera glycines
  Coding regions on vcDNA: vcDNA=SeqID_73408; Strand=-; Position=1 -121,436-834
DPFSFDILRNKEETNLSKSFPISQRIMRTDSTVHKSTDTLGFGIFEISFLRFGPFHKIQILKDKARKNKNNWQLPWKIFNILFLRCDEPVQKMPSIKSLAERRLKFQHELRWSFDVHENKKLSYEDRIVGRKPQTANSTPTTNSSYSFSGYATAVKKTLPTDGSADSGLNIR

SEQ ID NO: 146986 - protein, 72 aa, Heterodera glycines
  Coding regions on vcDNA: vcDNA=SeqID_73409; Strand=+; Position=1 -191,301-328
MWHYCLNSAYLLFLITLNTISGSVLTRQRRQNAKITAYNEQYAKTMAALSAGAYALSPNECIRRQFRIEMNI

SEQ ID NO: 146987 - protein, 60 aa, Heterodera glycines
  Coding regions on vcDNA: vcDNA=SeqID_73410; Strand=+; Position=1 -89,394-487
  Homolog annotation: Hit_ID=T30894; Match level="QueryCoverage=96%, HitCoverage=18%, E-value=6e-14, Identity=58%"; Hit description =lipase hommolog T08B1.4 - Caenorhabditis elegans
TFPVTFTGHSLGGALAAIAAAKCVALGLRMSNQVTLYTFGEPRVGNAAFASRFDQLVPNR

SEQ ID NO: 146988 - protein, 113 aa, Heterodera glycines
  Coding regions on vcDNA: vcDNA=SeqID_73411; Strand=-; Position=1 -49,635-927
MYKKNKINRSQQYKDECIHLAYADKLDPNKCVADVQKYCEQCARICKERVEEVKHKKRENCEGGGPVKLTNAVNCICKWESVLFVHYCVAPEAVRMALNAAHKYGKIGDNNSR

SEQ ID NO: 146989 - protein, 248 aa, Heterodera glycines
  Coding regions on vcDNA: vcDNA=SeqID_73412; Strand=+; Position=1 -139,184-344,1277-1340,1442-1556,2598-2864
MLGSNRRSRTEQVRNHTHCFPVHHRLLLSPILPYLCAAFNAIRTASDAIYGICQFDRSATFAIFPFLMLYFFNPFFAYSGTLLTIFLNISNTLVWIKLIRGKLGFMELDELLVEEINHPVPPVGLSQFGTALRVSPDRKCNGGASPQEPCLCDRRNSPASFISGDCWLAVYDLLPPSQLGLGIATISLRYDYYVDENFKTRKWALKFMRIQSKIGANGMEMQIVNSVGEELPIPQFDVPPKVTGFECI

SEQ ID NO: 146990 - protein, 43 aa, Heterodera glycines
  Coding regions on vcDNA: vcDNA=SeqID_73413; Strand=+; Position=1 -67,309-373
MLERKKESDNGGGGGGGMHGPLSLGGDVCEETDNFGSGVGGED

SEQ ID NO: 146991 - protein, 80 aa, Heterodera glycines
  Coding regions on vcDNA: vcDNA=SeqID_73414; Strand=-; Position=1 -87,417-572
  Homolog annotation: Hit_ID=NP_501248.1; Match level="QueryCoverage =61%, HitCoverage=9%, E-value=8e-10, Identity=59%"; Hit description =inorganic phosphate family member (4I419) [Caenorhabditis elegans] gb|AAK29824.1| Hypothetical protein F45
VLTKWIVQNGTKDEWAVVFYVSAVVAALPVVVFSMWGSDQPQLWARSSSMKRTQNSIASTITTATTISVKRKECPDTAKI

SEQ ID NO: 146992 - protein, 189 aa, Heterodera glycines
  Coding regions on vcDNA: vcDNA=SeqID_73415; Strand=-; Position=1 -119,464-615,907-1015,1192-1272,1862-1943,2589-2615
  Homolog annotation: Hit_ID=NP_501248.1; Match level="QueryCoverage =92%, HitCoverage=32%, E-value=3e-57, Identity=60%"; Hit description =inorganic phosphate family member (4I419) [Caenorhabditis elegans] gb|AAK29824.1| Hypothetical protein F4
QIIFKIIKYICSAVAIGCITGGRQLGTLFILPVAGALCGNFHFFQNWPLIFHLSSLVAALAAFLWLPIGADKPSKQCCMPNKERLYIESRIACEHIGKRTQSRRVPWHKMARSVPLWVNVFSLICHEYPLVIMLQFLPNYMRDVLELAPTQNGLLSALPILFLLASKWVSSSLSSWISSRLRNPRDFLC

SEQ ID NO: 146993 - protein, 174 aa, Heterodera glycines
  Coding regions on vcDNA: vcDNA=SeqID_73416; Strand=-; Position=1-522
MQFHQNETSDKAHRMEQPQKQEGLQIGALEFVLTMERFPELKGTEGPNEIRKFFKKISSATGGWPENRRISALESKMSGKAQRAFDAAMKHRPKNFNEICRGMEGILSEWDCTEMRAFNELWNEMKRRSDESLDEFAERLYGIVECAYPGLPSNFVDDFAVKHLIRAMENPEIS

SEQ ID NO: 146994 - protein, 59 aa, Heterodera glycines
  Coding regions on vcDNA: vcDNA=SeqID_73417; Strand=+; Position=1 -42,376-513
MDKLNSVETVGMNKTKKRHLGTFYYKKSDIQRSAGLKILVRLLNIFLSSIVLLSCCVKH

SEQ ID NO: 146995 - protein, 144 aa, Heterodera glycines
  Coding regions on vcDNA: vcDNA=SeqID_73418; Strand=+; Position=1 -84,234-584
MNYYFIYKIFALIALHFTFAIPNVVKAALKSDDKFVTFVMSLPHMPKYHDEWKKEILDEIYRTPVAENSYDFEAHLGILFLMKEHWHCVELRKEDGEICRKYRRQALVLYEYFLRVYHQGQRKLQGPRCNSARDEIARDSRARL

SEQ ID NO: 146996 - protein, 77 aa, Heterodera glycines
  Coding regions on vcDNA: vcDNA=SeqID_73419; Strand=-; Position=1 -111,665-789
PCTSSAGQQPRPRTTSSAIGGGGGTADELQQEKKPKMISSDTPIPRKVRRALATDDGGGDKNGAAERQRERRTKFDF

SEQ ID NO: 146997 - protein, 88 aa, Heterodera glycines
  Coding regions on vcDNA: vcDNA=SeqID_73420; Strand=-; Position=1-264
METFGLFCVPFYGCTPFFGQKSLRTTESQCQPMEEAIADMPMDDDEKEDEDDDDIDVESVLVHQKLQQQQQPIASPPPPLICRQLHRL

SEQ ID NO: 146998 - protein, 24 aa, Heterodera glycines
  Coding regions on vcDNA: vcDNA=SeqID_73421; Strand=-; Position=1-73
KKLLGVFSPHRGSRRALCARFLNL

SEQ ID NO: 146999 - protein, 98 aa, Heterodera glycines
  Coding regions on vcDNA: vcDNA=SeqID_73422; Strand=-; Position=1 -220,398-474
MQKVQIQFFKTREKGEKLKVRGQMYFKARPLANGSISWRCTEYKTAKCNGSLQTNDNKKTIAFFKDHTHGPSNVHFVLSHRVVNLIFGPKRHKVGIFW

SEQ ID NO: 147000 - protein, 39 aa, Heterodera glycines
  Coding regions on vcDNA: vcDNA=SeqID_73423; Strand=+; Position=1-157
LFNEYCSKIINECEREVGHQIKDLKYKNSLIVCNCNHLI

SEQ ID NO: 147001 - protein, 18 aa, Heterodera glycines
  Coding regions on vcDNA: vcDNA=SeqID_73424; Strand=-; Position=1-56
PYRDRDLSFSKSGTGNRD

SEQ ID NO: 147002 - protein, 158 aa, Heterodera glycines
  Coding regions on vcDNA: vcDNA=SeqID_73425; Strand=+; Position=1-477
MCAKHQAWLKKNDDRIKDGKATNFVRIGSLMLENGTQPKKLIEAAIGVNGKDVEFVMDMGTEVTVLCKESHRQIGSPKLGHCKEKAILNDGSTRRFLGKGFAKFSFGGQIKKGQFFVSENGSKNLFGTDMMEKFGLLDGFKKNLKGEVHRNISLSERK

SEQ ID NO: 147003 - protein, 45 aa, Heterodera glycines; identical to SEQ ID NO: 124527
  Coding regions on vcDNA: vcDNA=SeqID_73426; Strand=+; Position=1-196

SEQ ID NO: 147004 - protein, 53 aa, Heterodera glycines
  Coding regions on vcDNA: vcDNA=SeqID_73427; Strand=+; Position=1 -7,468-620
MTIVTPLWVGAMDGHFEVCQALVKHRADVDLGAPQFGITPLMAACENTARLDT

SEQ ID NO: 147005 - protein, 84 aa, Heterodera glycines
  Coding regions on vcDNA: vcDNA=SeqID_73428; Strand=-; Position=1 -35,247-313,352-504
MLLALFLLRTTSRFNSRLQLCLDGRLTYKVIFQKVSASRSSLSPILNCTHSKRQFVKTVQRLDSSRGEGDKHRVERQFQMVSQG

SEQ ID NO: 147006 - protein, 32 aa, Heterodera glycines
  Coding regions on vcDNA: vcDNA=SeqID_73429; Strand=+; Position=1-97
LKLSPLLRMINQTKYIFKINGSFGRTSFHAIT

SEQ ID NO: 147007 - protein, 32 aa, Heterodera glycines; identical to SEQ ID NO: 125154
  Coding regions on vcDNA: vcDNA=SeqID_73430; Strand=-; Position=1-248

SEQ ID NO: 147008 - protein, 51 aa, Heterodera glycines
  Coding regions on vcDNA: vcDNA=SeqID_73431; Strand=-; Position=1 -67,584-672
MNDIIHFMKRIHRNENYKIIEVVRDAHCAPQTNRTVYPGWNMGGNRESHDQ

SEQ ID NO: 147009 - protein, 131 aa, Heterodera glycines
  Coding regions on vcDNA: vcDNA=SeqID_73432; Strand=+; Position=1 -69,836-1045,1216-1332
MDFHVILFPSHKKFLSILKNSKYLICLLSTLNDPFCVLYAARAKGQSDLRIPCRPASNGTLIDKRGTTARLFELTFNKHNANEGIASVKTLNKFCAKIYSGSIPRDWREMVGRDPDSGSEEIPLLIIPDEI

SEQ ID NO: 147010 - protein, 147 aa, Heterodera glycines
  Coding regions on vcDNA: vcDNA=SeqID_73433; Strand=-; Position=1 -33,421-536,578-723,827-972
MASSANHSSTVQILIIPLDAEKSLGIDIDLDGTPIRDRDSVGIPLTSVVRVLTLAIPSLALCLLKVNSKSRAVVPRLSMRVPLDAGRHGMRKSDCPLARGLSPGRFPQCAFGGRLSCPIPLQIGQGLRFAMLLHGNGARVGEAIHSQ

SEQ ID NO: 147011 - protein, 201 aa, Heterodera glycines
  Coding regions on vcDNA: vcDNA=SeqID_73434; Strand=-; Position=1 -20,187-310,611-812,1009-1268
MLTNPQKRIQKFFSMEIRPNNNDCLKERFIRLTRYVAYLLFDLMEANETTSLRLSAFSALLSQQHIFDDDETDANGWLAPSRANATRRRKRTGKLVAQLVGIVSTFLDAQFELAYLSDVNDYVIRLREWSASCSESQLSAEGRADPTNAWSHCQAILFLNRIGMHLIDEKTSDELSAAIGRNGAEENEVQCPFEQLDEDDE

SEQ ID NO: 147012 - protein, 245 aa, Heterodera glycines
  Coding regions on vcDNA: vcDNA=SeqID_73435; Strand=-; Position=1 -180,286-468,631-803,1090-1291
  Homolog annotation: Hit_ID=CAE73615.1; Match level="QueryCoverage =94%, HitCoverage=35%, E-value=6e-11, Identity=27%"; Hit description =Hypothetical protein CBG21105 [Caenorhabditis briggsae]
MPKQAEETKMLLERKMRETEMAAQRMAALQHQQQQKQQQQNGITTPGTATVAQQQQQQQQMQQPPPYQEVVENRQQTQQQQMPLANGVGAAAVPLNRPTTAQSPKNNGGTTTPNNNNNNNLRSKFVKFIFSQIVVTSPQQMAPLYFGGCQYEMATTMSDSRTSVAAELQHIFAELEMSRSEYNERNQSLRDRLANFRAELDSLKREGTDTENDRLFAQKVMAGDAFDKFSTLRKVGSLCAIKSSD

SEQ ID NO: 147013 - protein, 84 aa, Heterodera glycines
  Coding regions on vcDNA: vcDNA=SeqID_73436; Strand=-; Position=1 -126,389-517
  Homolog annotation: Hit_ID=CAE73615.1; Match level="QueryCoverage =91%, HitCoverage=12%, E-value=2e-15, Identity=50%"; Hit description =Hypothetical protein CBG21105 [Caenorhabditis briggsae]
MFQSLLDLCVGTHNLYLRRRQPDLLEVQQMKQQADEQRRRRMEEQVRLHREREQRAQAEQERDRYRAELNHLSEQLSAMQVIEL

SEQ ID NO: 147014 - protein, 295 aa, Heterodera glycines
  misc_feature (18)..(19): Xaa can be any naturally occurring amino acid
  misc_feature (83)..(83): Xaa can be any naturally occurring amino acid
  misc_feature (99)..(99): Xaa can be any naturally occurring amino acid
  misc_feature (115)..(115): Xaa can be any naturally occurring amino acid
  misc_feature (131)..(131): Xaa can be any naturally occurring amino acid
  misc_feature (163)..(163): Xaa can be any naturally occurring amino acid
  misc_feature (195)..(195): Xaa can be any naturally occurring amino acid
  misc_feature (235)..(235): Xaa can be any naturally occurring amino acid
  misc_feature (250)..(250): Xaa can be any naturally occurring amino acid
  misc_feature (282)..(282): Xaa can be any naturally occurring amino acid
  Coding regions on vcDNA: vcDNA=SeqID_73437; Strand=+; Position=1-902
  Homolog annotation: Hit_ID=CAE73829.1; Match level="QueryCoverage =92%, HitCoverage=59%, E-value=1e-47, Identity=31%"; Hit description =Hypothetical protein CBG21394 [Caenorhabditis briggsae]
QNQNFAILFLHSTSWVIXXCCSRTKISRDSRPRLDPETRDPKNPRLETKTWPRDSRPKKPKTRERLGPETRDPKNPRLETKTXPRTRDPKNPRLETKTXPRTRDPKNPRLETKTXPRTRDPKNPRLETKTXPRTRDPKNPRLETKTWPRTRDPKNPRLETKTXPRDSRPKKRDSRPRLDPETRDPKNPRLETKTXPRDSRPKKPETRDPKNPRLKTTTWPRTRDPKNPRLETKTXPTRDPKNPRLETKTXPRTRDHKNPRLETQTCPQTQHHLNPRLETQTXPQYSRPLEPETRD

SEQ ID NO: 147015 - protein, 127 aa, Heterodera glycines
  Coding regions on vcDNA: vcDNA=SeqID_73438; Strand=+; Position=1 -180,427-555,611-687
  Homolog annotation: Hit_ID=CAE69974.1; Match level="QueryCoverage =99%, HitCoverage=85%, E-value=1e-55, Identity=52%"; Hit description =Hypothetical protein CBG16372 [Caenorhabditis briggsae]
IPGTTGHLGESGYPGQPGFPGEKGIQGLPGLPGLEGMPGSSGPPGLPGLPGPAGPSFRDGFIIVTHSQTAQVPQCPQDTTKLWDGYSLLYLEGNEKAHNQDLGHAGSCLARFSTMPFLFCDFNDVCK

SEQ ID NO: 147016 - protein, 143 aa, Heterodera glycines
  Coding regions on vcDNA: vcDNA=SeqID_73439; Strand=-; Position=1 -124,211-410,838-945
MVYCEPGDMVQGEVYLLATLIVVIFTLATTVIYIIMAIMLKVIRSDQNNSNNSSQSQIEITRRIFKSLAVIMAVIFCLWFTSCLVVNIVGRGLITSDPSSQFLITRLVDIFQQLPFPCSFPQSSRPQGIPSTDNSSTFFSDKN

SEQ ID NO: 147017 - protein, 106 aa, Heterodera glycines
  misc_feature (3)..(3): Xaa can be any naturally occurring amino acid
  Coding regions on vcDNA: vcDNA=SeqID_73440; Strand=+; Position=1 -97,144-207,286-376
  Homolog annotation: Hit_ID=AAC46611.1; Match level="QueryCoverage =93%, HitCoverage=4%, E-value=1e-26, Identity=61%"; Hit description =a2 (IV) basement membrane collagen
ILXFTKFSSPGSRLEDFRTTPFIECNGARGSCHFFANKFSFWLTTIEHFFANKFSFWLTTIEDQQQFTIPQSQTLKIPQSQTLKAGNQRSRISRCQVCTKTTDKRR

SEQ ID NO: 147018 - protein, 47 aa, Heterodera glycines
  Coding regions on vcDNA: vcDNA=SeqID_73441; Strand=-; Position=1-146
LIFLRKRIPLLTCVYAQFFAPLSSLNSALNLFWISIDRFVALAFPVL

SEQ ID NO: 147019 - protein, 218 aa, Heterodera glycines
  Coding regions on vcDNA: vcDNA=SeqID_73442; Strand=+; Position=1 -95,401-640,995-1135,1195-1374
  Homolog annotation: Hit_ID=NP_499413.1; Match level="QueryCoverage =98%, HitCoverage=54%, E-value=3e-37, Identity=36%"; Hit description =putative protein family member, with at least 5 transmembrane domains, of bilaterial origin (3M82) [Caeno
MRLLICDEELSLFNLNNSLTVALLDTLWRVSTLYNKVHCWLGLFICVFGSLANCVHIFVLSRPAMQKCAVNRLLAIIALCDIATMASYTVFVVRFEFAVDNEEPPLGYDFFWIVFLLAHVVCSIALHTITVYLTVITALIRYKTLKRVSSLWNHENIACPIFVAVAVLTVFLCIPTFLIHSIIPVSAADPITHQNLTLYTVGLAEFKQFDTCLFFKLN

SEQ ID NO: 147020 - protein, 176 aa, Heterodera glycines
  Coding regions on vcDNA: vcDNA=SeqID_73443; Strand=+; Position=1 -81,1124-1316,1441-1695
  Homolog annotation: Hit_ID=NP_499413.1; Match level="QueryCoverage =76%, HitCoverage=40%, E-value=7e-32, Identity=42%"; Hit description =putative protein family member, with at least 5 transmembrane domains, of bilaterial origin (3M82) [Caeno
VGLAEFKQFDTCLFFKLNLWLTGIIFKVIPCVLLLLFTLALLYELEKNSRKRKSMCSGTTLAYRRHSAQSDRTTKILLILLIVFFCTEFPQGILAILNGLFPNDIHQFVYLSFGELLDLLSLINCNTCFIVYPLISSQYRATLRNLADCIRQLRRAGDGKRRPQISGSKFNNCSRY

SEQ ID NO: 147021 - protein, 75 aa, Heterodera glycines
  Coding regions on vcDNA: vcDNA=SeqID_73444; Strand=-; Position=1 -142,213-298
  Homolog annotation: Hit_ID=CAE75465.1; Match level="QueryCoverage =89%, HitCoverage=93%, E-value=6e-11, Identity=47%"; Hit description =Hypothetical protein CBG23465 [Caenorhabditis briggsae]
MKLISMFIFAVLLVGVMVEVSEAQFYGGYWPSLYGGLYGYGSYGSSWSWPYYGYGFYGKRSAGFGPDELKNEKPQ

SEQ ID NO: 147022 - protein, 62 aa, Heterodera glycines
  Coding regions on vcDNA: vcDNA=SeqID_73445; Strand=+; Position=1 -100,636-724
MMLNYPFNRRIGPIGKEKLHLLIKHMFIHRIYLGKCTYDALLFQDRLGNFDEFVTRIGILPH

SEQ ID NO: 147023 - protein, 74 aa, Heterodera glycines
  Coding regions on vcDNA: vcDNA=SeqID_73446; Strand=+; Position=1 -130,374-468
MKFAVVSLLFVMAFFVGIAVIEQCEAQMYGYGMYGGWPYSSYMYPYYMYGGIGKREAGFGGPSGRLPLLARKPN

SEQ ID NO: 147024 - protein, 124 aa, Heterodera glycines
  Coding regions on vcDNA: vcDNA=SeqID_73447; Strand=-; Position=1 -273,667-768
MAIWIVHEHLRQTVRTRRKKPFGLGLVIQCIGTFVGWKFGKRKYRKKAERWTIGQNGRGKSTQIAYFNYHHIPNVVVEHWPNIEQNELHKMLSFDTNKVGIGQVRKKLWPKKLKIRLIKVDWTL

SEQ ID NO: 147025 - protein, 85 aa, Heterodera glycines
  Coding regions on vcDNA: vcDNA=SeqID_73448; Strand=+; Position=1 -21,224-460
MIEGIQAPFLSASSPVNFIITFCVIVQPFVALTVPYELINEFTGERLELIKLNEHGSHMVMIRSPISRDKPNGRNGKRRPLNGNL

SEQ ID NO: 147026 - protein, 163 aa, Heterodera glycines
  Coding regions on vcDNA: vcDNA=SeqID_73449; Strand=-; Position=1 -318,423-596
MSSVHLLLVLLLLQAVLSLPSFTYGKKKKKIEKIITKFNFDGAVIGATNQFEVQIDYDDGIPKAKETVTRGEDGSFTVELPLERSDTVEKLTVTVTSTDKLGGLKRRKKWEINWPDPSKHFVFFMGEFEPENRAPLFLRALFTRELPNKGESIVYLLRCAFVA

SEQ ID NO: 147027 - protein, 195 aa, Heterodera glycines
  misc_feature (7)..(7): Xaa can be any naturally occurring amino acid
  Coding regions on vcDNA: vcDNA=SeqID_73450; Strand=+; Position=1 -43,1041-1158,1204-1295,1345-1584
  Homolog annotation: Hit_ID=CAE72891.1; Match level="QueryCoverage =98%, HitCoverage=16%, E-value=4e-37, Identity=49%"; Hit description =Hypothetical protein CBG20204 [Caenorhabditis briggsae]
ISSNANXCVMNRFVGQFSENKTKIGCCVEAFAESVANVRVLSWILLGTLHAPNQCLPVPIACSGQMADYIHFVLAAPNQCLPVPIACSGQMADYIHFVLAGFADQSKQSVVHMSALFHAFHLCQQSVVHMSALFHAFHLCQLWTIYCEQTAATCRSEAMQILDFWARVTPILQLLSHSKVVSFLLLITSDHLFRS

SEQ ID NO: 147028 - protein, 42 aa, Heterodera glycines
  Coding regions on vcDNA: vcDNA=SeqID_73451; Strand=+; Position=1 -46,134-216
MRKSDFLTVQFGLTKDVADLSMRRLSTIGFIWLSQLLFLDTL

SEQ ID NO: 147029 - protein, 360 aa, Heterodera glycines
  Coding regions on vcDNA: vcDNA=SeqID_73452; Strand=+; Position=1 -168,424-813,871-1395
  Homolog annotation: Hit_ID=CAE61462.1; Match level="QueryCoverage =99%, HitCoverage=100%, E-value=1e-125, Identity=58%"; Hit description=Hypothetical protein CBG05354 [Caenorhabditis briggsae]
MSIELEGRNSAYRFVAYAAVCFSVVEAINECVTLPMEYNYGHHVRRTMQEEINYCKSSARDIWMEVNQIRNIPSAFNGNRTARASGYASGGGGGGGGYASSGGSGGGGGGGYASSGGSGGGAGGYASATSGTSGGGGGGCQPCCNPGPPGPPGTSGRPGRPGKPGSNGMPGGPGKPPSQPCESVTPPPCKPCPGGPPGPPGPPGPPGDGGGPGQPGQPGSDSGAGSPGPKGPPGPPGQPGQPGSPGEPGQPAQSQPIIPGPPGPPGNQTIFFESFILNALLGDSGPPGPPGPPGNPGTDGGAGQPGPKGPPGPPGPPGNDGQPGSPGQPGQPGGQGEKGICPKYCANDGGVFFEDGTRRA

SEQ ID NO: 147030 - protein, 18 aa, Heterodera glycines
  Coding regions on vcDNA: vcDNA=SeqID_73453; Strand=-; Position=1 -46,146-156
MFRTRTFAVWNCFTQENY

SEQ ID NO: 147031 - protein, 22 aa, Heterodera glycines
  Coding regions on vcDNA: vcDNA=SeqID_73454; Strand=-; Position=1-68
IMTLESKNFNAEMRFLSSFLQN

SEQ ID NO: 147032 - protein, 90 aa, Heterodera glycines
  Coding regions on vcDNA: vcDNA=SeqID_73455; Strand=-; Position=1 -24,350-490,699-806
MGMLQNVNHIEFDKTLARLSTNGDYRKAFPSAADLLAFITVNCPNIKAIKVSKQDVALLWSERSDELVSLLLQHVGKVILKKSVGKAYDY

SEQ ID NO: 147033 - protein, 68 aa, Heterodera glycines
  Coding regions on vcDNA: vcDNA=SeqID_73456; Strand=-; Position=1-209
EEEYDEEEEEEGPMMMMTQKKEGEEDNDGELDDGAHHHDTTSPEELQDEETEQFYQQLSVLPAVQIML

SEQ ID NO: 147034 - protein, 289 aa, Heterodera glycines
  misc_feature (20)..(20): Xaa can be any naturally occurring amino acid
  misc_feature (34)..(34): Xaa can be any naturally occurring amino acid
  misc_feature (55)..(55): Xaa can be any naturally occurring amino acid
  misc_feature (69)..(69): Xaa can be any naturally occurring amino acid
  misc_feature (83)..(83): Xaa can be any naturally occurring amino acid
  misc_feature (111)..(111): Xaa can be any naturally occurring amino acid
  misc_feature (132)..(132): Xaa can be any naturally occurring amino acid
  misc_feature (146)..(146): Xaa can be any naturally occurring amino acid
  misc_feature (223)..(223): Xaa can be any naturally occurring amino acid
  misc_feature (230)..(230): Xaa can be any naturally occurring amino acid
  misc_feature (244)..(244): Xaa can be any naturally occurring amino acid
  Coding regions on vcDNA: vcDNA=SeqID_73457; Strand=-; Position=1 -617,681-910
  Homolog annotation: Hit_ID=CAI02740.1; Match level="QueryCoverage =98%, HitCoverage=87%, E-value=3e-38, Identity=40%"; Hit description =hypothetical protein PB300893.00.0 [Plasmodium berghei]
CTSSNHSCTSSSRCTSSNHXCTSSTLSCTSSNHXCTSSNHSCTSSNHSCTSPNHXCTSSNHSCTSSNHXCTSSNHSCTSSNHXCTSSNHSCTSSNHSCTSSNHSCTSSNHXCTSSNHSCTSSNHRCTSSNHXCTSSNHSCTSSNHXCTSSNHFCTSSNHICTFLISCTSSNICCSSFNHCCTSSNICCTSSNHFCTSFNHRCTSNHSCTSSNHNHSCTSSNHXCTSSNHXCTSSNHSCTSSNHXCTSSNHFCTSSNHICTFNHRCTSSNICCSSFNHCCTSSNICCTSS

SEQ ID NO: 147035 - protein, 233 aa, Heterodera glycines
  Coding regions on vcDNA: vcDNA=SeqID_73458; Strand=-; Position=1-702
  Homolog annotation: Hit_ID=CAE70527.1; Match level="QueryCoverage =90%, HitCoverage=56%, E-value=7e-09, Identity=26%"; Hit description =Hypothetical protein CBG17156 [Caenorhabditis briggsae]
MKLCLLIFSIVFLIVKIEIGAEKKKAEQKTFDKIFGEKWEEKEEKRNDQNENDQKKRETVTKFNKIKEKILQKGRKYSKNEWNKLEEKIGKKLGTNRDKIYQWIKEFGLQKNKCYKSKTDEQKIEIVQKFIAMKNEYKEKGRKYSTKEWKKNYAEIGKKIGVSHRVIGQWKKQFGLSGKRISEKEKMKKMKKYWQIKGENPKMSDEKIAKILKINQSTFSKWKKRFGEELNEH

SEQ ID NO: 147036 - protein, 103 aa, Heterodera glycines
  Coding regions on vcDNA: vcDNA=SeqID_73459; Strand=-; Position=1 -123,1238-1426
MEEAIFGIYEKLTEKEKIEKYWQMKGENQKMSDAKIAALDSQKRFDQIFGEKWEEKRNDQNGIGIGYGTIQKWKKQFGMSQRIMKQIHCKLKEKIQAIKRRIK

SEQ ID NO: 147037 - protein, 68 aa, Heterodera glycines
  Coding regions on vcDNA: vcDNA=SeqID_73460; Strand=-; Position=1 -116,174-264
MISSSKFCTNFDQLFNHLRLLCSNDAGAAHYGTELMPIIKENPFFGALCSVMAEEKQKISNFIYKMKL

SEQ ID NO: 147038 - protein, 145 aa, Heterodera glycines
  Coding regions on vcDNA: vcDNA=SeqID_73461; Strand=+; Position=1 -324,397-510
MNDSRIIRGKKFNCSLTWLLERYKLSDKYAIKEKIEVCFLIYFYYIFINFNHFYVKYHGHPKFVFVTAANDFYYPSLRTVIANVKETFGCKQKIIAYDLGTITKNKEWFCSYISKFKKANKRARGKPFLSAHRYFEALRKEIFTI

SEQ ID NO: 147039 - protein, 89 aa, Heterodera glycines
  Coding regions on vcDNA: vcDNA=SeqID_73462; Strand=+; Position=1 -113,368-524
MNWIRCAISNGEFSISVKWWKDGFATPKVTRGKFLCGRMFYWSMTLSFGLTLQWFSIKMISNDFLNRCKTAKLALCKSQAVSDKNGAQH

SEQ ID NO: 147040 - protein, 61 aa, Heterodera glycines
  Coding regions on vcDNA: vcDNA=SeqID_73463; Strand=+; Position=1 -126,828-887
MFYWSMTLSFGLTLQWFSIKMISNDFLNRCKTAKLALCKSQAECTNFCPCTPILSLTEHTH

SEQ ID NO: 147041 - protein, 79 aa, Heterodera glycines
  Coding regions on vcDNA: vcDNA=SeqID_73464; Strand=-; Position=1-266
EGIFKFILYPRKMAISFYEKFYTSQKRLRMRRRAVHNRHFISQRIFIFRGYPRKMAISFFDKFYTHTNALEHDREGGAQ

SEQ ID NO: 147042 - protein, 271 aa, Heterodera glycines
  misc_feature (268)..(268): Xaa can be any naturally occurring amino acid
  Coding regions on vcDNA: vcDNA=SeqID_73465; Strand=-; Position=1 -72,117-272,337-404,450-526,609-813,1137-1190
  Homolog annotation: Hit_ID=NP_504656.1; Match level="QueryCoverage =98%, HitCoverage=59%, E-value=1e-67, Identity=56%"; Hit description =malate dehydrogenase (35.8 kD) (5G996) [Caenorhabditis elegans] gb|AAD14720.1| Hypothetical protein F46E1
NPANTNAINCAKYAASKIPAKNFSAMTRLDHNRAMAMTRLDHNRAMAQVAQKCADGTTVGMVKNVIIWGNHSSTQFPDIRHAKIAKGGSETLAYDAVKDTAWIQDGSETLAYDAVKDTAWIQDQFIKTVQKRGAVIIEKRKLSSAMSAQFIKTVQKRGAVIIEKRKLSSAMSASKAACDHMRDWFFDHMRDWFFGTPSDGRWVSMAVPSDGSYGIPEGLVFSFPVTIEQKEWKIVQGLDLDDFAKQKIDITKKELLAERDEALAACKXWKR

SEQ ID NO: 147043 - protein, 223 aa, Heterodera glycines
  Coding regions on vcDNA: vcDNA=SeqID_73466; Strand=-; Position=1 -186,285-460,513-598,643-797,862-929
  Homolog annotation: Hit_ID=CAE71899.1; Match level="QueryCoverage =93%, HitCoverage=61%, E-value=4e-73, Identity=66%"; Hit description =Hypothetical protein CBG18957 [Caenorhabditis briggsae]
SANRQRGCFWQRSGVLLLVSSAVIVFPFSPIVLVLLDIPPLTEVLTGVHYELVDCALPNLFGVEAVTTEEAAFKDIDYAFLVGAMPRKEGMERKDLLAANVRIFKSQGEALAKFSKPTVKVLVVGNPANTNALICAKYAASKIPAKNFSAMTRLDHNRAMAQVAQKCADGTTVGMVKNVIIWGNHSSTQFPDIRHAKIAKGGSETLAYDAVKDTAWIQDQFIK

SEQ ID NO: 147044 - protein, 57 aa, Heterodera glycines
  Coding regions on vcDNA: vcDNA=SeqID_73467; Strand=+; Position=1 -15,134-292
MFDAMNISLSVRKVMNKKCRHKNYCHFVSITGLILKAVYSRGTSIIKWSFFIETNIK

SEQ ID NO: 147045 - protein, 136 aa, Heterodera glycines
  Coding regions on vcDNA: vcDNA=SeqID_73468; Strand=-; Position=1 -147,419-537,576-720
MYGIGKPFGRKPIFKENQNCEKTKAIHESEGNDEIEKLFPVYASQIKYIGAAFQSFKYFETRRTEIRQIFRIGQKLCKTVDEYKKELFGHDQSHKYCVYTRRGDFANSAWGSNKDFTEQGIEFGFKYLMVIKSFKY

SEQ ID NO: 147046 - protein, 71 aa, Heterodera glycines
  Coding regions on vcDNA: vcDNA=SeqID_73469; Strand=-; Position=1-227
KKNKIIYLIVTNQYNFHHMTSISIDASSSSVICSFWPATPPPSLPFPRTHSSPSPISARQLRPPSDRRCFY

SEQ ID NO: 147047 - protein, 64 aa, Heterodera glycines
  Coding regions on vcDNA: vcDNA=SeqID_73470; Strand=+; Position=1 -137,462-519
MMSNILSSKIPWEKIKYFFAALIFILIFYIINKNEEFSYAGSALFRLSHSESCKANLTDEEYER

SEQ ID NO: 147048 - protein, 1506 aa, Heterodera glycines
  Coding regions on vcDNA: vcDNA=SeqID_73471; Strand=+; Position=1-4519
  Homolog annotation: Hit_ID=NP_508324.1; Match level="QueryCoverage =93%, HitCoverage=56%, E-value=1e-102, Identity=25%"; Hit description= predicted CDS, peptidase family A16 and RNA-directed DNA polymerase and Integrase, catalytic domain and
KIIDRDNGLLRECFDHIKLLGDPFLKQAEEDLLAALPTFDDEQADPNVEEWPVITLLSKAQLILDGLQVYIEARFDTTDAISSRSSSRVSDHGADDENRIHRQRQSTDPPTQAQPANAHQPSNSARADQNLFNQRTPAFPLNLTFPRASNRPTHRSEPHHGHFRQSTSDDDALRVSRIEIPRFSGSAEEWVTFWAAFDFAVHSRQYPAFQKHLLLLQYLEKGSPPRRMVEGYPPSDANYSTVVSILRDRYGDVGNRRDQLNAQLLHLKPARNNLKELRQLQQEIEQICTQLCSLEPEGELSPIANSSLVTNLIKSKLPPPVLLELIRMERESYTSWTARNWREGFATIVTDKEQVDLCVRTFQDMDIQPRERPPERAPPRPGGRSSRPTPPPAPERRYLENTRAFPALAQPVSANGISCSLCEQEGHRPSACQRYTTVIQRRRRLEEQGRCLRCLRQDHVTRDCSRQDRCSKCQANDHHFLLCPSIDPPGRTNLRRENQERNGNASRNVSRATGANAEPVRPRTTPTTTALLVCDEGENIPEALCAAAFDPLPVDSGSFPVPKSTRVAHLMTQTLKASCQGGPPDGIPAFVFHDPGSQSGYISRAMTEKLRPPRLSEHLLRIHTFGDSRPKTVRSAKFAIQLQRLDGGWETLELNVIDEITTKIKALQWDTTDGPLPPNAVLKVVEKAPDILIGIREFWQFFIGRSTLHSGLHLIQTIFGPMVGGEAEFPETPRHTPTIAMLTSHPSNVESFPSSRTVNDFWSLEAIGITDDPNQNDDQVAMQQFSNTVRQLPSGRYSVRLTWREPRPPLPSNWAIAYRRLLSTTKRLQCSPELLDRYSAELTRQMDADIIELTGRDNDEHFLPHHAVINPKKLRIVIDASAHAKGTPSLNDCLHRGPVLLPDLCGILLRFRSATIPVLADVQGAFHAIEVEPEDRRFCKMLWLKNPARPVSGDNLLIYRYKRLVFGATCSPFILAAVLLQHFDKHEHPFAQALAANMYVDNLLIECETEEEAIDKSSIAKQILKDADMNLREFLSHSPNVMGRIPEDDRLDKTPAKVLGLTWDTPSDCITFSLPKDTDITATRRSVLSIIASTFDPLGLVGPCLLPAKRLFQRLWGEGTAWDTPLPETEAETWNQTLSLWQNQTIVVPRHSILGEQSRLQLHVFCDASEHTFAAAVYIRSETADGSEANLIFAKNRLRPRTANQRFTIPRLELLAILVGIRAMRFAEKELRRPIDERHLWSDSQIALSWVKSDEPKAQFEQRRLVEIRQGPPTTFHFIRTDQNPADVATRGCTPAELRTRHIWWKGPEWLTSPETEWPDELTFATPADSPSADPPFEKSETKTLMAKQSPLPPPLIDPARFGTMLTLLGTTILVLQFIGRRRPKWLKIGTSSIPRSGPPTGDSFRAARTFLIRQDQRSSLDGYDKHPTVFNEDGLLCLKTRLLHANGPPTLASPVLLDRHSSLTRLIVQEIHADLRHAGVDWTLTEFLGRYWMPQARRTIRVSLR

SEQ ID NO: 147049 - protein, 172 aa, Heterodera glycines
  Coding regions on vcDNA: vcDNA=SeqID_73472; Strand=-; Position=1-515
ETEWPDELTFATPADSPSADPPFEKSETKTLMAKQSPLPPPLIDPARFGTMLTLLGTTILVLQFIGRRRPKWLKIGTSSIPRSGPPTGDSFRAARTFLIRQDQRSSLDGYDKHPTVFNEDGLLCLKTRLLHANGPPTLASPVLLDRHSSLTRLIVQEIHADLRHAGVDWTLT

SEQ ID NO: 147050 - protein, 1071 aa, Heterodera glycines
  Coding regions on vcDNA: vcDNA=SeqID_73473; Strand=+; Position=1-3214
  Homolog annotation: Hit_ID=NP_507780.1; Match level="QueryCoverage =97%, HitCoverage=65%, E-value=2e-83, Identity=26%"; Hit description =predicted CDS, DNA polymerase type B, organellar and viral family member (5T899) [Caenorhabditis elegans]
MPRRNFCYYINCQNGRRLEDVFGLMSGANIRTDLREYDAVVYVPIVVDYWNRKYATANQRFKVFIFGATGTYRPKFQYGPDNFNIEIPLYHHNDHFDGIRCGVGKAVFGRDYYCFSCECPYDNANDHTLQCKAKCINCGRIGVGRPCRADDNNYYRECTACGKDFMSQDCFNHHLSSNVCRQFNKCKQCGIVWNIRQNRRKGRSGHVCGEKFCYTCKCYHKPERGCFIQQLKTRRPTKYRLIAFDCETTQNTRIEGSGDRRLHSVNFISCHVACTKCITENSWRNSLQAPCGICGRQRTVTFSHRAYERTQTDAQFITPCPMAAFAQWLLSEFDPRYPTMLFAHFGGRFDNIMLFRQFFLNGFCPQMIRRGNKLYEMKIARGEKNPEIIVRDSWNLMPVPLGALPGAFGLNVQDKEFFPHLANVEANYGHILQSLPPKADYLYGGMTPDRQRRFDQWYAEHHHQQFDLCEQLAAYCTNDTHILIEALVAFRTEFLAISDPLERHGCLDDEDDDEEEEEEDNDNAFEVIGGGIDITWEPMTIASASMRHFRLNHLKRDQLAIVPECGYDTTNTQSLVALKFMDWYAKKNGVSIQTAHSPGGEKKIGQYTVDGYIAATDTVIEVNGCHWHAHDHPRHRFQPQTVMANGKTAQRIREDDARRMAFITSQVQQVLVFWECEINAEKRDNDEMKRTFAQYKDSGPIRLKDCYHGGRVGPQRLHYEVPEGWRMKYYDVRSLYPHTNAVTAYPVGHPTRVNIIGEAEQAVDWRRADQVPVRGILKVFVVPPHHIDVPVLPVKFDQRLLFPLCRTCALQHPHGAVNEDYECTHREDDERGWVSTVTSIELEEALRNGYRCTAYYRSVEWDDTQWSDRVFRGYVAEFMAMKTHASGFPDEIGQTEEDQQQFIEECEEKFGIRIEREKMVHNKAKRTIAKLCNNSLWGRFSLRNGLSKTIVTDSPAELRALLDNPAVEVSSIDQLTDECVLVTYAAGNEWVEEHECSNIVLSLWTTSVARLHLLRLMQKVVRAPNSVLIYTDTDSVCFAHREADGCPLETGPHLGDLSDEWPDHELVEFVS

SEQ ID NO: 147051 - protein, 444 aa, Heterodera glycines
  Coding regions on vcDNA: vcDNA=SeqID_73474; Strand=+; Position=1 -620,829-919,964-1587
  Homolog annotation: Hit_ID=NP_001004509.1; Match level="QueryCoverage= 96%, HitCoverage=32%, E-value=5e-48, Identity=28%"; Hit description =si:busm1-180o5.3 [Danio rerio] emb|CAD60788.1| novel protein similar to DNA polymerases [Danio rerio]
MKVFFDDLANERGPLDPRLAYSGGRTGPLRLFAEPSADEKISVFDIVSLYPWVNYDTAYPIGVPTIVRPSAEEMIVNWTKPEHLSYRGLYRVRVIPPRGLRIPVLPMKIDERLLFSCCHRCAALFRKSVTRCAHKCEHSEQQRAFTGNFTHIELEKALEMGYVIDRFWRAWHYDEWSDQVFKGYVRQFIRLKVNRSRKYFIPNYFDRGKFSMRNQLGSNKVITRPQEFYDLVLNHRMEISSIIPISDAAIRVLYKPKKNFIVEHTSSNIVLSLWTTSRARLKLLDYMLQCYNTPGTELLYTDTDSVIVRHKRDLVPVHTGEYLGQMSEEYADYDILTFACGGAKQYAMKMVHKQTKAVKFVQKIRGITFDVNNSQELQFDHFVRKVINYGKEEEQENAATFNYNKIQPTKDNRIITRKQNKKYLPICQKGIISQTLEVLPFGYE

SEQ ID NO: 147052 - protein, 964 aa, Heterodera glycines
  Coding regions on vcDNA: vcDNA=SeqID_73475; Strand=-; Position=1 -2479,2577-2992
  Homolog annotation: Hit_ID=NP_701342.1; Match level="QueryCoverage =67%, HitCoverage=38%, E-value=1e-19, Identity=22%"; Hit description =MAEBL, putative [Plasmodium falciparum 3D7] gb|AAL10509.1| erythrocyte binding protein 1 [Plasmodium falc
MDLAKRVTEQSWKETVKLAANAADIAEKAKTALNRAEQARKRAPNAPHVKKWFDSLSNMENNLRELVEKISQESKKAAEAKRKLDVHYDSKNLNECRKHADMSKQALKNSKNYIAQLTPMYFSTVPEDQLGVNELANRVVTAVNNFLNAELTVPRPVEDPQLPAGQPKQQQEKQMEKLKPTVEKEVGSIIKPPVPKLSDETETKREPTKPTVEKEMEREPVKPPEKELEPESPKKADKELEPMVKQQSTQEDNLLEKAKKEIDQTAQNAALKAEYIRTLVANSKHNRGVAEGRLNTYSGVPQFYDWLDQIVELDKKIDELAKKVGNEPSKVINAKQQFDKPYRMKNLTEARKLIEAAKNAFEVILNYSLEIKQLNNKMHELNDKFTVAVKEKEEEEAKKGAAINIQQEKKLVKEIPQVLKELEREKSQHDINTTAENTETEFPSSEYEIDDSSEKQPERTEQQAEVSYVLKKKEGKLEEEKIETKDDTAINEFPSTEYGIEESETEETEKWSPDQAKQKILKGNEEPFEQPDGQKDEETILVIVTDKKGEVFPSNQYEIEDNYSSSSSSSSFIAQNEPSVTTKGEEGLLTVQIKKLPMTGDNEQKTIQMVPSDFPSYNDDDSRDTIVNELSEEQLASTVLEEDMPKSEPYDVDELPDLPDPQALSAKGRGGDKKGVTSVSDRMKMLMGHQKQQRKAVEFLFNEITQRFYINIGSGVQHVDASSHLAYVLGFENTRLYYNHPAKYLPDLSGGVRQLYVYAPKLVEDTIIGDRMAPLLRVVNVSGTVPLDVPEVIYTNEFFKPIQNKRISEIKIEIQTAFGRYIKFNWASQQEGRGEQQYFVGTRYQRGGGLLQNVARFLMPVASNLLSSASKEGIAAGTRVLGDLSQGKALKESLETHAKQGFENLAGKLQQCGKGGNYGADGRRGQRVSKVKKASGISSSDSIIGRIGTVKRRRNKIMDQLSSP

SEQ ID NO: 147053 - protein, 742 aa, Heterodera glycines
  Coding regions on vcDNA: vcDNA=SeqID_73476; Strand=-; Position=1 -1560,1622-2290
  Homolog annotation: Hit_ID=CAE64509.1; Match level="QueryCoverage =79%, HitCoverage=23%, E-value=7e-17, Identity=21%"; Hit description =Hypothetical protein CBG09244 [Caenorhabditis briggsae]
MENNLRELVEKIFTESKKAAEAKRKLDVHYDSKNLNECRKHADMSKQALKNSKNYIAQLTPMYFSTVPEDQLGVNELANRVVTAVNNFLNAELTVPRPVEDPQLPAGQPKQQQEKQMEKLKPTVEKEVGSIIKPPVPKLSDEKETKREPTKPTVEKEMEREPVKPPEKELERESPKKADKELEPMVKQQSTQEDNLLEKAKKEIDQTAQNAALKAEYIRTLVANSKHNRGVAEGRLNTYSGVPQFNEWLDQIVELDKKIDELAKKVGNEPSKVINAKQQFDKPYRMKNLTEARKLIEAAKNAFEVILNYSLEIKQLNNKMHELNDKFTVAVKEKEEEAKEGAAINIQQEKKLEKEIPQVLKELEREKSQHDINTTAENTETEFPSSEYEIDDSSEKQPERAEQQAEVSYVLKKKEGKLEEEKIETKDDTTINEFPTTEYGIEESETEETEKWSPDQAKQKILKGKEEPFEQPDDQKDEETILVIGTDKKGEEFPSNQYEIEDNYPSSSSSSSFIAQNEASGIMSKKTIQMVPSDFPSYNDDDSRDTTVNELSEEQLAYTVPEEDMPKSEPYDVDELPDLPDPQALSAKGRGGDKKGVTSVSDRVKMLMGHQKQQRKAVEFLFNEITQRFYINIGSGVQHVDASSHLAYVLGFENTRLYYNHPAKYLPDLSGGVRQLYVYAPKLVEDTIIGDRMAPLLRVVNVSGTVPLDVPEVIYTNEFFKPIQNKRISENKIEIQTALDVP

SEQ ID NO: 147054 - protein, 689 aa, Heterodera glycines
  Coding regions on vcDNA: vcDNA=SeqID_73477; Strand=-; Position=1 -628,847-1740,2175-2722
  Homolog annotation: Hit_ID=NP_502797.1; Match level="QueryCoverage =43%, HitCoverage=83%, E-value=2e-50, Identity=36%"; Hit description =HASI (4P602) [Caenorhabditis elegans] emb|CAB16520.1| Hypothetical protein Y57G11C.19 [Caenorhabditis ele
MKHTKKMVMVPETEYIALMNIVKSMGSRGDPIQDEKTSLDSNIHKNLNDKTIGADIKMKRHSWLYKRRRQLKELMENKPQKVIIEGNPSSAIPNVAPYMGIHKIPKIETAVEQENKRQPLRLIRASRKKKSENVFESSADYSSATEGSSSTPIRSQDVKLSQKNFSKIMNIIGKNPDKFGIDMQSGQVLTNFNKPVTGSNYTESLKLLSESQLEQVYYNLNSPASYAGMQKVLAEARKRIPNLKLHDVQKFLHKQRTYTLFKPKRNKFPRLKTVPSGLHTDWQCDLCIMDSLKEHNDGYRYILVCIDVLSRQIYVAEAESKKSEHMIEAFEKVFKKAQVLPNKMYSDSGLEFQAKRMNEYWLSKDIIKHVMYSPHLHAGVVERANRTIKERLYRYFSEKNTHRWVDIIDKIVKNLNNSVNRTTGMRPVDVNFRNATELRNRLYKDMEQQKRIQKFKIGDIVRITKEKGDFSKGYFPNFTDELFKIVRVNPTNPPSYRISDLEGENIKGIQFHSVEHMQKSLNSIIQSAYDVKFPKEKRVKRAAAASADKELEPETRREPDKELSREVPSSKTLDKELIREAPLPATHDIELPRGDEPKPSEKELGRETGPAQLSDKQLGELEGEKPQKEQLPPTPIVDHGEISTIYQERMDLAKRVTEQSWKETVKLAANAADIAEKAKTALNRAEQAR

SEQ ID NO: 147055 - protein, 115 aa, Heterodera glycines
  Coding regions on vcDNA: vcDNA=SeqID_73478; Strand=-; Position=1-348
MERSIQVAVDKELEHETSPAPDKQLEREQPLKLPKTELSGEDFTQEKPPPIPTHTYENELTGEKSKTYTKISESDPQTLLKKAILTTECSWKETVELSGNSTDLTQWIEYVMKAE

SEQ ID NO: 147056 - protein, 123 aa, Heterodera glycines
  Coding regions on vcDNA: vcDNA=SeqID_73479; Strand=-; Position=1 -33,276-403,504-648,698-763
MPSMNTSAENALYLAYRSVGPSADLIVPAVALNLVALVGIMLNGTVLVVTARSNSLRGSANFLMALICFCELVHQIGHSFFLVVVISGTNFVSLLTADLIMTPMIFALNCGLMAMLCAAIDRL

SEQ ID NO: 147057 - protein, 27 aa, Heterodera glycines
  Coding regions on vcDNA: vcDNA=SeqID_73480; Strand=+; Position=1 -38,101-146
MMLKLKLALFYDSVIKIVTFKVETEIV

SEQ ID NO: 147058 - protein, 18 aa, Heterodera glycines
  Coding regions on vcDNA: vcDNA=SeqID_73481; Strand=+; Position=1-56
IAGVVGSSPTERVTFYVL

SEQ ID NO: 147059 - protein, 144 aa, Heterodera glycines
  Coding regions on vcDNA: vcDNA=SeqID_73482; Strand=-; Position=1 -144,196-486
FYFLGSITNNLSFSCQFVSHIVSWYFPIFFIFEYFAQNFRESSRYGDQFIWLDLGTECWGRGFESHRDELPFMFYLALLGGSPPHCRDHWSKESPSPSVKGQGEPEGPVFRGRRNVMPEGTECGRKWDKGPERTSKRGARSSVG

SEQ ID NO: 147060 - protein, 91 aa, Heterodera glycines
  Coding regions on vcDNA: vcDNA=SeqID_73483; Strand=+; Position=1-276
MQPKRLANITPPQTKKQHLSDKLAAAQTIIGGLQPGQSDGAPQWANSLLGFCAEMVGICRELLSMVKEQQNDNMDTRETWRKNADSTLSWS

SEQ ID NO: 147061 - protein, 105 aa, Heterodera glycines
  Coding regions on vcDNA: vcDNA=SeqID_73484; Strand=+; Position=1-354
LFPLHLILRMFVSNSVFLPVSRFFHCRALSAVNLVVHPFVARKCAFLSTPSLSFPFRRQYSSLASATTTGASNDKLNVDKLFEKINFEVRGHDFTVLKSYSLFVM

SEQ ID NO: 147062 - protein, 641 aa, Heterodera glycines
  Coding regions on vcDNA: vcDNA=SeqID_73485; Strand=+; Position=1 -643,1166-1902,2223-2768
  Homolog annotation: Hit_ID=AAL40415.1; Match level="QueryCoverage =36%, HitCoverage=22%, E-value=2e-46, Identity=39%"; Hit description =endonuclease/reverse transcriptase [Branchiostoma floridae]
MRSLNNKLNEFTAIIALKDFELVFVTETWAKEKIPFQPFITNNYKIYEASRSGKNGGGVMILTKTSVNSFSVLSCSKFNCEIQIIQINGAKKLRIVLLYRPPNTSANFTKKILNLIGNYFEENFILMGDFNLNAKDITWTSGTPYAKSEKGNIFCEFFNKYGLFLMTNGPTRGSAWLDLILSSKPDFVNNVLIEDIFSSDHLSTNFSLSFPQNKNVPQISSCPSNPNGPSISDVEFNADEISKILKNLPNRESTSPDEISFRILRNCHLTLSPVISELFRISMDTGKIPEIWKKSIVIPLFKKGDRNDPHNYRPISLTCCLCRVMEKIIAKSIYNFLHLNNLISEHQFGFVKHRSTNTQLITVLEDWYDSIYGKKNIDCIYVDFRKAFDSLPINILINKLHNIGIRGKLLSWLSEFLKDRFYRVKINNKFSNLYPIQSGVPQGSVLGPLLFLIYINDLPQDSQYCQNFKNPLYTYLDQSIQDIHSSYLEYAPEIWNPTYKKDINKLERCQKYFTKIALFKCRLPYIPYEQRLDLFKLQTLEERRKTIDLVQAFKIINGLTHLKKDIFPQFSGHIPYNLRRKVVLKPQSSKTSNSFINRTALIWSKLNKDITDAPSVDSFKKRINKWIELNKNLVCKRAPWT

SEQ ID NO: 147063 - protein, 59 aa, Heterodera glycines
  Coding regions on vcDNA: vcDNA=SeqID_73486; Strand=+; Position=1-180
GHNLLADQFGRIGLTQNNAQTEQLPVTEKSSQMVTGGAMAVKEQPRRNGTMAISQEKVQ

SEQ ID NO: 147064 - protein, 153 aa, Heterodera glycines
  Coding regions on vcDNA: vcDNA=SeqID_73487; Strand=+; Position=1 -126,455-580,891-1100
MRQIRDRVVHLLVQNGLERRESLNVVEKAIHGTSEGPFAERTNAMVIGDTPADLGMGRSAKLGSIVGVLSGIGEHKELNEADHLVNQTLRMTIWTTFGASIPRQPMNNCTTCRRRKNAIFTPIFGAALPNACRAIAAETAASRHWPRHFWAWI

SEQ ID NO: 147065 - protein, 128 aa, Heterodera glycines
  misc_feature (126)..(126): Xaa can be any naturally occurring amino acid
  Coding regions on vcDNA: vcDNA=SeqID_73488; Strand=-; Position=1 -321,1857-1926
  Homolog annotation: Hit_ID=AAN32891.1; Match level="QueryCoverage =91%, HitCoverage=24%, E-value=4e-55, Identity=90%"; Hit description =secretory protein 5D06 [Heterodera glycines]
FEDPILANVKQSQMLIRQKSKGTMDLEMDEFLKLHKQIQGPRQKLVRMEREKMIKEATEKAKVDRRNRMLEREKMWSMKKAGVAAHQPASPAIRGRTQQQQQQKLQPKSIRKNNKNEKIHDNFIGXLS

SEQ ID NO: 147066 - protein, 74 aa, Heterodera glycines
  Coding regions on vcDNA: vcDNA=SeqID_73489; Strand=+; Position=1 -51,145-318
  Homolog annotation: Hit_ID=CAE66326.1; Match level="QueryCoverage =77%, HitCoverage=30%, E-value=7e-14, Identity=63%"; Hit description =Hypothetical protein CBG11577 [Caenorhabditis briggsae]
MESRSRSRLFSKYRALLVRAEDGSALAEYWSCPFAECSAKSAHNVNTVFAEIVREINYVQSAKAKQRHGCCSVI

SEQ ID NO: 147067 - protein, 268 aa, Heterodera glycines
  Coding regions on vcDNA: vcDNA=SeqID_73490; Strand=+; Position=1 -436,496-638,686-913
MRKSIQLPILISMISVFDFVIGMDELKQPLLKKDATDQQSQFELFVEDGTTEEEDMEKAMKTGKTFFWREMVTNWHCKNGKLKKPEEIGFKKSYKELIEFCEHWKMMTTAANAFVKSWERCRNGQKNRQKIDTSSSRSSRKTSKFENPLECLCLKPHFRVGDRELQMSSAMGAIKAVYRDLFKWGDGKSMEIEFKLANENPWKVIQFLVDNSNIEEIKASLTELEKSTAVGTKKFDAFMAKNFPKINLNVRSRDIFSSKFFFNNFASY

SEQ ID NO: 147068 - protein, 102 aa, Heterodera glycines
  Coding regions on vcDNA: vcDNA=SeqID_73491; Strand=-; Position=1 -24,250-534
MRGIWDSAFDKIDNSSYAKCKACNYKVDRGPRKRTSDLERHLKSKHPEHYKQRDEALRKKKEKIEKSDNSQVRHREVLSRNAFSAAQDLFLMIFEKTYRMKI

SEQ ID NO: 147069 - protein, 136 aa, Heterodera glycines
  Coding regions on vcDNA: vcDNA=SeqID_73492; Strand=-; Position=1 -141,188-357,504-603
  Homolog annotation: Hit_ID=AAO33475.1; Match level="QueryCoverage =100%, HitCoverage=100%, E-value=5e-76, Identity=100%"; Hit description=gland-specific protein g5d08 [Heterodera glycines]
MFSSSNLSALFLASSVLAVLIIGIKMDGPTEAKGAAPPNAAGPMGLLLLLNGKQSAANEKGKAPSGESKPNPGQKPSGERRKRDVLGHAGGYVGGWDHPIDSTLDWAKSQWNDANWLADVVNRNGWENTGTPTGGR

SEQ ID NO: 147070 - protein, 66 aa, Heterodera glycines
  Coding regions on vcDNA: vcDNA=SeqID_73493; Strand=+; Position=1 -154,393-439
MLLRRHELRKPRFSSSEAAPVNMHKKNIGKSQLSKMSKNNGETVEGDKMPKIFTVKRKVIGRTMLI

SEQ ID NO: 147071 - protein, 152 aa, Heterodera glycines
  Coding regions on vcDNA: vcDNA=SeqID_73494; Strand=-; Position=1 -99,1223-1526,1774-1827
TDHSDGLIDQGFRDGTSLMVLAQRQQQFPSPQGYFDQNVLTFVRRFYRFFASCSTTLFIRTENVRISEFIVLNIWPMFKDTTIVLDFDGRNFPSNAPIGPVNAQRMSIPSYYWFQLSILPGFSSDDSANASNDQGSSWKGRLSRRAAPHSNA

SEQ ID NO: 147072 - protein, 443 aa, Heterodera glycines
  Coding regions on vcDNA: vcDNA=SeqID_73495; Strand=+; Position=1 -498,863-1696
  Homolog annotation: Hit_ID=XP_308192.1; Match level="QueryCoverage =31%, HitCoverage=35%, E-value=7e-37, Identity=54%"; Hit description =ENSANGP00000021557 [Anopheles gambiae]
MALGTTTAKIIRTDQNYAVVERAVAHFDPKKPLYLATDASDYGVGAILFHKDGNTGKFGVIAYASRTLSPAERNYAQIEKEGRAVIFGVEKFNQYLYGRKFILQTDHEPLKRIFGPKGELPVVTARRLHRWSLKLMNYEFEIEYCSTKNFGYADGLSRLPSPEIDQHEKEVQNLSNECAGNEERIVSDNGPQFASKEFEEFCSKRGIERTLTAPYHPQSNGEAERFVQTFKKGMLLVKKETNWDNELAMNQFLLKYRVTPHSATGRSPAKMMFGRKLRTLLDLVRPSESTKIEGGEEKAKENAEKHGQKYLARAKKNFDRRTWKRSFKTGQRIFARNYRDGSKWMAGQIMSQISPSLFLVRTARVVWKRHLDQLKSDETKPDLESNTDVDSTSSIGDQTEDEKDGGQQTDVEEEPNDPPNLHDPPLRRSVRERRPRQIFDPSA

SEQ ID NO: 147073 - protein, 60 aa, Heterodera glycines
  Coding regions on vcDNA: vcDNA=SeqID_73496; Strand=-; Position=1-183
KTVASRPFLMLLRTFGRFAAQTGASRPFFKFSWGQTGASRPFFKFCWAWAGASRPFFKFV

SEQ ID NO: 147074 - protein, 518 aa, Heterodera glycines
  Coding regions on vcDNA: vcDNA=SeqID_73497; Strand=-; Position=1 -130,169-500,542-626,836-1009,1052-1176,1224-1464,1775-1859,1895 -2063,2677-2772,2967-3086
MVQNNPDVVLESFYHIQQSFAEIDLLNEEITIIITTYSAPTGSGYNLNVFNFFPPKENGRLSVQNTDNYCLFYSIILSKFYQIIGAEEQFRISYAQFRKIYNNQKRQKNYVDELIQNTKIDPNKTSYGVEDLSIVQDFFDREFPGNFLVAAFSKENGLKPIFKGQGPKKYIICIFLENGHWDGTKFPCKNEKIQPKECLICNRYFFNDFCYQNHFKLACKYYRRCIQCDNDYCIRDMHICGSKFCRVCKIRHPKTECCYIKKIIIPKSLPKYRIISYDIECSADNLVDNQKTEFYEHKVVFLSARFTCSDCEGKIENCDICGPGGIRHHTWCTVNRVNPVFEFLKWVLSLKNYETYCYAHFAGKLLPTLPPMEDYCPESMKDDEFERFKEWYYKISELLKKFNLEEQLQIYCGQDTEILLKSILSMRKIFIEITKDSETPNGYDVFKECEVLRKLNPRDNENYDIEMKKYFDSIPDKGGVNYFTPYPVKTPKIIIPKSQDVLWQCPEDIPYDGIHNRM

SEQ ID NO: 147075 - protein, 142 aa, Heterodera glycines
  Coding regions on vcDNA: vcDNA=SeqID_73498; Strand=-; Position=1 -289,334-473
MAPVAPQHFVAGIGPGAPQHFAVGMPPAAPPPLVVGMAPGEHQHFAVGMPPMAPQGAPRPLMGEVNYRPLRGVFEAHRAHPQQRNGRWPVRPPTPGVALRDPRLRRRRQLLEVVPEEDEPAAHRFQNWDHDPPQPPPPGVGA

SEQ ID NO: 147076 - protein, 42 aa, Heterodera glycines
  Coding regions on vcDNA: vcDNA=SeqID_73499; Strand=-; Position=1-130
AWRRDFIGQNVVAESPDVKIEPPDEELVHADHPMPGNRLKMF

SEQ ID NO: 147077 - protein, 265 aa, Heterodera glycines
  Coding regions on vcDNA: vcDNA=SeqID_73500; Strand=+; Position=1 -66,1225-1369,1428-1511,2004-2176,2328-2657
  Homolog annotation: Hit_ID=CAE59001.1; Match level="QueryCoverage =74%, HitCoverage=20%, E-value=4e-32, Identity=38%"; Hit description =Hypothetical protein CBG02276 [Caenorhabditis briggsae]
MMLIQKLAKIRHSGNPWQQQHANVDSVHGYLPVNETWYSMSEAHEYSARIMPGFSTFKAPRDTPLPTFLRGGHIIPRQEPDLTTTASRKKPFQLLIGLKPLACPCKLVAAGEMFWDDGETIVDDFGNHSYYRFEFSTTATHNWTTIVVNRTHNSSEDPLPSLDQIVILGHNFTPNLDTATLNGIPIKLSADFVPEKGALRVESARLIRLDDANTAVWTLSWQNGHKDDDGGHAEGSGANRELSFMIAIYLAATFTTALALIGHWQ

SEQ ID NO: 147078 - protein, 113 aa, Heterodera glycines
  Coding regions on vcDNA: vcDNA=SeqID_73501; Strand=+; Position=1 -149,501-693
MPKMMLQNAAVASDLNEDKNDTTKAKQQQVPRPFISPDLHLNYGIALYYAQFYAKALAQFRRALAIEPHFGQAKHQLDSARQFLFALRDGLHKKGKNCEKFKISHSNFPRDRL

SEQ ID NO: 147079 - protein, 103 aa, Heterodera glycines
  Coding regions on vcDNA: vcDNA=SeqID_73502; Strand=+; Position=1 -201,607-717
MKECSRSKDGGGAGVDKPAVVVVVSVDGDDVEAKSAAAVANKTAENHQKNDDDAEQCLLMIRVINPSRQLLKNGKPLSSLDCAFAAMSIETQQMQMGSRARAE

SEQ ID NO: 147080 - protein, 92 aa, Heterodera glycines
  Coding regions on vcDNA: vcDNA=SeqID_73503; Strand=+; Position=1 -168,225-335
MPPNENSDRPFQQPDNVQPNQQPHQQQPDEDTELRAQIEDAEEDLLLNWWREDPTIIRFLFGHRRAPAIEAALRQRAEREAEILRQYAENQQ

SEQ ID NO: 147081 - protein, 187 aa, Heterodera glycines
  Coding regions on vcDNA: vcDNA=SeqID_73504; Strand=-; Position=1-564
MVLVSVFCGQLLKCPVKLLRDRLNHPEDRALVLKHLIGRKVRTTYNDRNGLTKTFFIAGISAQGAAFLPAYGHLRNPFNINVAAHFYARHRIKLHLPYVPCIVERFSGGGEDRHYPMELLELIDDNMDIDNNNWLGNLFTEIDNNDKQSASNSSSHHTSLRLILEDDDMDIGRNECSQDAAPSSSYW

SEQ ID NO: 147082 - protein, 479 aa, Heterodera glycines
  Coding regions on vcDNA: vcDNA=SeqID_73505; Strand=-; Position=1 -121,186-361,609-771,1075-1334,1754-1992,2157-2635
  Homolog annotation: Hit_ID=NP_493928.1; Match level="QueryCoverage =20%, HitCoverage=12%, E-value=2e-32, Identity=71%"; Hit description =Rap1GAP family member (83.9 kD) (2B519) [Caenorhabditis elegans] gb|AAK71368.1| Hypothetical protein F53A
MAKLLCEELTAERFYPIAFPGGSELILQFDEHVISNTYKFGAIYQKFGQTTEEELFSNDSSNCAAFDEFLSIIGHRVQLRHFDGYRGGLDTVHGQTGTEVPCVHPFAVYHWRRATIAAQAAHWQRHRGHCFPRAEHTLLSGHDREQVQKRATFRTHSGIAAGWTVLKFERAGPILRHGIFGFGGQRDETAATGEAPPPMAKQRAKPSPAQPTAATDEWIGERRNEPNGTVPFGEESIQCETDQPITHSPAGRIMSLVAPMEDCRLSSSASTSSSSGHHFDRPSAVAHPSQMPSHNYHQHHHLLRWRSNAGKMAKTAAERNIKVILDGFRPSSSTFSSTSAMLEASFGCIDQHNHHHRSTPSSPYAAHHQLPPGTVIPFRSSIQHLRHWHGGSDAEDDDDLDDVEIEVEEVLNEADDALRGGAGGGHDSDTGMESMSSADIQPNGAPSVGRRCLNNGAGDAKNGKNAAGALQKRERIAKK

SEQ ID NO: 147083 - protein, 528 aa, Heterodera glycines
  Coding regions on vcDNA: vcDNA=SeqID_73506; Strand=-; Position=1-1584
MAVSVELVRLRRISELPSDLGGVRLVPSQRLSVRPLTMFSEETKRWEAEIGEQCPPQQRRSVVAKTVPLSHVPCQCALPPSCPTTAVPPLPSILRRRVAVPYHRMAKEETKIINGGKETKKTNWENIQSNEATTETKATAEKCEKGEGEKRHQREEQRNVPNCQQLCSWEEFEERVQAVRLRPRGRRTSGTNCWGATGGATGNGCPGAIERKRQHEKAHGEDGRTTNGRKMGDREGREAQNEVLKQQKCWKCHQMGRKCVNCILTIGTGDQQQQRLINQIGRRMPMSDTEDHLAETNAAKREESKKRRRHSVLSIKPILRKLTSTASTSGNADAAATITATEPTTARRRSFFRKNAGDKSHSPEAQRRKNKEGQQAEGGRAPLPWSSSSSSSSSSLLASLAQWADSSPLNEHTLHPTSSLPIDQQRPPRMKSLLGRLLRRNRRQKQTDDEANGVGIGTSETEPKQRNQQQQQLTRPESPARSSSSKAEFVEWQSKYLRLSWMAPKGTKNNDSYHRYKCDQLGASTEEK

SEQ ID NO: 147084 - protein, 27 aa, Heterodera glycines
  Coding regions on vcDNA: vcDNA=SeqID_73507; Strand=-; Position=1-81
MDNKWEGSSDILYTLKSNIKTKENGKQ

SEQ ID NO: 147085 - protein, 447 aa, Heterodera glycines
  Coding regions on vcDNA: vcDNA=SeqID_73508; Strand=+; Position=1 -787,838-1392
MAPLNAIPSGDASPSHSAGPAANHLAHATNDRRRRRTNARRTQRKFLVYPSDQLKMLNNGTERGAKDGKTNKNGTWGRTNHDREEDGIGKNGLMRTEADGAENSWTRETERNGISRIGFDRTEMNGLRTKLNGTEQNGTKTESDGMSFNGKRTEQNRREMNGRRSELEELMTNGTGKLGGQEKRHGNGAEEKQFWGMRMKTKWEDEEEQRNGINNAINGIDEVSTDGQSTAQTETEMKQNGTGWGPHSVTDGLLTEEDAVESATGGQSSQLLLNGQQSQHFGHVAKLHSFWEEMPISSSSLLCMDEEQETEQKQQQHHRRPTTLSPRAVLAAHLPKTVPKSNDYEEESHAIKRQRCTLREQLVGVPSVAAPWEAIAAERLGTRRSKVIMLGDSGERWKENQQRMDDFPMLKVLARRALCSATNTGRTPRCSIRRPMRPSALLTPILT

SEQ ID NO: 147086 - protein, 56 aa, Heterodera glycines
  Coding regions on vcDNA: vcDNA=SeqID_73509; Strand=+; Position=1-172
LDFGTEVLRCPTALEEPIFVLIGNKADQQDENREVAEGEGVQKGGHLANDWCDQWQ

SEQ ID NO: 147087 - protein, 79 aa, Heterodera glycines
  Coding regions on vcDNA: vcDNA=SeqID_73510; Strand=+; Position=1-240
MKSPKWKNNTAQTVEANGNLKRNGKSGANDGKKLNGEAKAEGNVVEAEEEDEEFEGEAEQQEGGGEGVQSDQNIAMGME

SEQ ID NO: 147088 - protein, 70 aa, Heterodera glycines
  Coding regions on vcDNA: vcDNA=SeqID_73511; Strand=-; Position=1 -161,321-372
MAQQMGEATNSLALAPSKGATKPMKRTYALITKETKCNWHILMTFNRGKWTSYSFMRFTMAPVLCREKWP

SEQ ID NO: 147089 - protein, 103 aa, Heterodera glycines
  Coding regions on vcDNA: vcDNA=SeqID_73512; Strand=+; Position=1-312
  Homolog annotation: Hit_ID=CAE56395.1; Match level="QueryCoverage =96%, HitCoverage=12%, E-value=7e-15, Identity=42%"; Hit description =Hypothetical protein CBG24082 [Caenorhabditis briggsae]
MSREKGQFEKGYLPNYGDEILEVDEVLKAIRPVRYKLRDERGEKFKGSFYEQELARVRKDAETSYRIEKVYRKRKRADGSTEMLVKFIGYPEREWVHESQFVV

SEQ ID NO: 147090 - protein, 416 aa, Heterodera glycines
  Coding regions on vcDNA: vcDNA=SeqID_73513; Strand=+; Position=1 -240,342-845,1050-1244,1385-1509,1831-2026
  Homolog annotation: Hit_ID=NP_492253.1; Match level="QueryCoverage =98%, HitCoverage=70%, E-value=2e-78, Identity=39%"; Hit description =insulin-like growth factor binding protein acid labile (68.0 kD) (1I859) [Caenorhabditis elegans] emb|CAB
GNLLRGPRALKELQLDGNRLSAGQLNQLLAEVGTLKRLEANHCGLNDAEVLALNLSKVPQLERIGLAGNNLSEVPSSTLRALALLRTVDLSHNLLRSLGPCAFCGSNISRVFLSHNLLGIGGDLRPIHREAFAETRILELDLSFNQLDGFSSEMLQDAQESLEVLHISGNGRVALEPQLIGTLPRLRALHVADSALGTVPYSLPKAYGQLTLLNLSGNGLDHLPPNLGSMLPHLQVIDLSRNHFSSFPHCPWDCQCAAQPLQLHMLRRLDHKEMLRYDETLCAEPPMLRGQPLHRVQKINDCAILFGANYGISQNTELLLILGALLLAALFLSAFLALLLYFGRESTQKGTYVTGEQNGTPATTATTAKSSLAALAVQNPTAPLFAPSASLATDRLKEPLLLPNSPLSYSSSNTGS

SEQ ID NO: 147091 - protein, 75 aa, Heterodera glycines
  Coding regions on vcDNA: vcDNA=SeqID_73514; Strand=-; Position=1 -50,83-260
MREKLIFSPDILILIVLDRHFEKSLDLDSMLDLDLDFLDKNLGKSRSRKNPGSSRPGSRHGPGFFKICFKKQTNA

SEQ ID NO: 147092 - protein, 313 aa, Heterodera glycines
  Coding regions on vcDNA: vcDNA=SeqID_73515; Strand=-; Position=1 -150,207-651,700-965,1763-1841
RIEICRKNSVTAAEAAPELSVFIDAANSMPFPLPDRPLPSKIRFKRLRVDYIDHSVIAFLRSNHKIFDKSGTKLRMGMLYSDMADDRQPIWDVFVREIWPIFASNIRHLDFIDADHLDNLRRRTSPTILTDLNQLSSIDSVLLLPDAIGDDFDGPNATAGQALNKWLHSPRKDGQPKRFRFIDINEQVSLHLVNTFKEEFMRATTISSVSYEIHFSVHVPTMTIVPFELVNERTQEKLTLAKANELDNIWIMKRCKIGEAAAVQQQKKDENWNYVYFWLYSGTNCIGVETVKKALSTDESEKEREGRSTFGLV

SEQ ID NO: 147093 - protein, 60 aa, Heterodera glycines
  Coding regions on vcDNA: vcDNA=SeqID_73516; Strand=+; Position=1 -76,953-999,1111-1170
METVGLTSTRTYGFSQHEKKTKFIQMHLRIPCRTRAYRTIKKILFLAINYFEHVLEKSGF

SEQ ID NO: 147094 - protein, 548 aa, Heterodera glycines
  Coding regions on vcDNA: vcDNA=SeqID_73517; Strand=-; Position=1 -177,236-278,552-726,1077-1181,1233-1293,1346-1417,1478-1595,1659 -1752,1823-1922,2012-2235,2290-2390,2499-2571,2648-2722
  Homolog annotation: Hit_ID=XP_422040.1; Match level="QueryCoverage =97%, HitCoverage=40%, E-value=5e-92, Identity=35%"; Hit description =PREDICTED: similar to anion exchanger 3 brain isoform [Gallus gallus]
PLFSVVFMFFACFVPAISFGGLMGKYTNEHIGTIEALFAQCICGIIWGLFSAQPLMISGATGPVLIFEGSLYTATGPVLIFEGSLYTFCETLQLDFLTIRFYAGLFIMLIAICIAAVDGSRLLVFVTRFTEDIFAGLISAIFIAESLYSSVAEPNTALLTAIIVFSTFILALLLKKLRESFYLGRHLRRAIGDFGVLISISVVTLIDHLRRAIGDFGVLISISVVTLIDWLVPWLVPDPYLQRLDMPDHINFTNPTSHGLIVTPTCPFPIGMAFVSFIAALLVFILLFVETEITELLLSRKERGCKKGGGMHLLLSRKERGCKKGGGMHWDLVLMGICAFLCSVFGVFGLPWMCAAAVQSLAHCSSLTVMKKTAPGARPEVDCVIEQRITTIGVALLIGLIAFGGSYLRLPLASLFGVFLYLGVMNLCGVQLIQRVVLFFIPEKYFPVTPYTEQMSIWRMSIWRMHLYTWIQLICVFIVYTASVCPGKAKMNAVLMLFIFFRQIILPRIFTAKELQAIDGDDHIDGDDHSDTDEWTSRDYFDNPPITV

SEQ ID NO: 147095 - protein, 154 aa, Heterodera glycines
  Coding regions on vcDNA: vcDNA=SeqID_73518; Strand=+; Position=1 -318,1107-1253
MSTGPVALTLKAKGMSYTRHIYWANSPTDHQRLCREKAPNDAANALGKQRLDGADVLVGVFAHQSAEGNGRHETGEEHENDAKQWKEEPVRSKPSSKWWSIFKTPLLSGTSRQAAMSAASVHEHRFGEETRDDKSGEYCKCCTMCGYEMRYEKM

SEQ ID NO: 147096 - protein, 42 aa, Heterodera glycines
  Coding regions on vcDNA: vcDNA=SeqID_73519; Strand=-; Position=1-230
KGVNFLDNVRSEDVVDEEVTVNRLFISFLFIFSPGEPIHVHF

SEQ ID NO: 147097 - protein, 280 aa, Heterodera glycines
  Coding regions on vcDNA: vcDNA=SeqID_73520; Strand=-; Position=1 -24,149-289,403-666,736-903,956-1201
  Homolog annotation: Hit_ID=AAC46496.1; Match level="QueryCoverage =89%, HitCoverage=44%, E-value=3e-17, Identity=27%"; Hit description =SEC-1 prf||2103308A esophageal gland protein
MSNDVKAKELKTEKNEFEKNLKNATAEMETLRFETDKIMKEKKEQNDRHLIFEQTLKEENKKLVEMLEQTNAKFAQTDHQFTQKLGMINHELIKAREECAKHKNYTDAVTAEAMKTKQETEEALRKAHINFEGTLKALQAELNKEREQRKAQDKECQMAKNMVDQMMSDVSNSQNQLKDAMVSKSAYDDRIQTLQNELNREKDHHMKVMVNAQKQVGELSQELEKALVAYGNLAKQQSNDSAKCVELNARNQKMGEEIRQKHSFGTTAQCLGFGIIWTAN

SEQ ID NO: 147098 - protein, 101 aa, Heterodera glycines
  Coding regions on vcDNA: vcDNA=SeqID_73521; Strand=+; Position=1 -43,520-782
MGTQEQMMREINIGASSAATVAFWCSVFLRLLSSASKLHLISRRFDHIVDEHFKICKNGIEQQIANSIGHLKKMAPTKCKLPIPQNPLPNKFIGFGGVQIM

SEQ ID NO: 147099 - protein, 289 aa, Heterodera glycines
  Coding regions on vcDNA: vcDNA=SeqID_73522; Strand=-; Position=1 -209,261-696,740-903,1108-1168
MALLSDRFDVLVDTHFDGKSELTIWKAIAIRKDKGPKAKLSEWIDGKRVEFPLPDRPLPTKIRFKSLWISYIDHSVLTFLRSNKPIWDRSGIKLELSIWSNKTEDDQRIWDVFTREIWPLFATNIRHLSFHNADALDNLRRRISQTILTDLDQLISIDSGALLREGIADDGPNATAGQALSKWLHTPTKNGQPKQLYRYNYFDPRNPEWVNDFKETFRRATTSVSYHIQFYLRVEPMPIEPFELVNEVTNEKLTLKQSKEYNLVNWLLQRPLSPPAEENEEEADQSNEK

SEQ ID NO: 147100 - protein, 126 aa, Heterodera glycines
  Coding regions on vcDNA: vcDNA=SeqID_73523; Strand=+; Position=1 -140,802-836,1421-1546,1849-1887,2069-2107
  Homolog annotation: Hit_ID=NP_501939.1; Match level="QueryCoverage =100%, HitCoverage=32%, E-value=5e-65, Identity=71%"; Hit description= abnormal ThermoTaXis TAX-6, Chemotaxis to sodium ion NA+ CNA-1, protein phosphatase (60.7 kD) (tax-6) [C
LDRFKEPPAFGPMCDLLWSDPLEDFGNERNSESFSHNSVRGCSYFYSAPNYLDVYNNKAAILKYENNVMNIRQFNCSPHPYWLPNFMDVFTWSLPFVGEKVTEMLVHILNICSDDELMAEGDDTFE

SEQ ID NO: 147101 - protein, 95 aa, Heterodera glycines
  Coding regions on vcDNA: vcDNA=SeqID_73524; Strand=+; Position=1-288
MGKKVAIWRENNSSIDQAAHMNEQKAAMKNSCHSQPDSRNRPFPPEHGPMGTKSAREWRQHQAMHVNVLPQMKEVTAKKEEKEEKKTAHLISPFL

SEQ ID NO: 147102 - protein, 225 aa, Heterodera glycines
  Coding regions on vcDNA: vcDNA=SeqID_73525; Strand=+; Position=1 -177,402-902
MFDMVLNRWPTFSPTNASMDFEQAMVNALRAKHPQCSINFCLFHLVRNMKARLTDEQTHVLINYVGRLRNNGTRTRPLFRPEEWSVYERTMSGTNRTNNFAEAYHRTLQDAIGHGHPTIWKFINILREHQKVIDVDFEHFLAGNAPPPKAKRYRDTDKRILRILQRYNEEKAQPQIENDHQYGQNQNNPNSIIEMLFEQLSNGLLILFVNFICYYILDKTEIFKN

SEQ ID NO: 147103 - protein, 164 aa, Heterodera glycines
  Coding regions on vcDNA: vcDNA=SeqID_73526; Strand=+; Position=1 -277,474-519,807-876,927-948,1002-1080
  Homolog annotation: Hit_ID=NP_501138.1; Match level="QueryCoverage =35%, HitCoverage=7%, E-value=4e-17, Identity=65%"; Hit description =UNCoordinated locomotion UNC-8, degenerin, similar to amiloride sensitive non voltage gated sodium channel
PLGAFSLLHCASRAPTKATVGQIHGIGNPSAGWLPIWERRKRIGTIATEVKEKAGQIGGRKSKVIGLSIQTKCQRDEAERRKKQFVYTNSRKANKEARMEQGPREYETYFTLSDYLEYRTIIEMQLKFEPAPFPAATICNLNAFKLSEVRKFEEIEQGIKLWEK

SEQ ID NO: 147104 - protein, 335 aa, Heterodera glycines
  Coding regions on vcDNA: vcDNA=SeqID_73527; Strand=+; Position=1 -100,149-230,290-347,512-611,671-709,782-905,956-1007,1055-1101,1147 -1239,1296-1398
  Homolog annotation: Hit_ID=NP_501138.1; Match level="QueryCoverage =92%, HitCoverage=30%, E-value=3e-91, Identity=58%"; Hit description =UNCoordinated locomotion UNC-8, degenerin, similar to amiloride sensitive non voltage gated sodium channe
FEFPFHLSFQSLCLCQPISHFCLRIKPGQEIHWRNPNNYTIYPRNPNNYTIYPSTVKPPTSEMEKAFGLEDDLKDRGAITTKTKENLIFLVAGMSTEVRKSLSYGLEEFVLRCSFNSRDCDLKRDFQIQIDPVYGNCDFQIQIDPVYGNCWTFNFNDSVELKNSRAGPMYGLRLLLNVNQSDYMPTTEAAGVRIVVHEQDQEPFPDTFGVRIVVHEQDQEPFPDTFGYSAPVGYSAPVGFVSSFGLKTKILNRLDAPYGKCSDTKILNRLDAPYGKCSDTFRPHGYIYAEHYSPEGCYRNCGCYRNCFQHIILERCGCGDPSEISKGEKNGPINK

SEQ ID NO: 147105 - protein, 49 aa, Heterodera glycines
  Coding regions on vcDNA: vcDNA=SeqID_73528; Strand=+; Position=1-150
GAAKIQVAEKWPGPGPGSRKNPGLDPGPGRALDGSVPPREKFEYLTESC

SEQ ID NO: 147106 - protein, 46 aa, Heterodera glycines
  Coding regions on vcDNA: vcDNA=SeqID_73529; Strand=-; Position=1-325
LKITILAFCHYFFTISTFFGKFFNKNAIKPKNTPLRIDKKNFKKHS

SEQ ID NO: 147107 - protein, 50 aa, Heterodera glycines
  Coding regions on vcDNA: vcDNA=SeqID_73530; Strand=+; Position=1-150
MFWRLNCLAAILFALCCTSSTFWLGSATTDEHNKAPHVDHHKLTETQQYE

SEQ ID NO: 147108 - protein, 54 aa, Heterodera glycines
  Coding regions on vcDNA: vcDNA=SeqID_73531; Strand=+; Position=1-388
ELLVLFDSSMCLLLICKISKILVKFQKSYGQKELKNPVIQTFFALIFLCINKNF

SEQ ID NO: 147109 - protein, 63 aa, Heterodera glycines
  Coding regions on vcDNA: vcDNA=SeqID_73532; Strand=-; Position=1 -23,99-130,249-385
MGENVQAKIFLRKGPSFGGLAGKDECEKAKANEIIDFQKDANTDLAPYLYVKMGFRQGDLVNK

SEQ ID NO: 147110 - protein, 93 aa, Heterodera glycines
  Coding regions on vcDNA: vcDNA=SeqID_73533; Strand=+; Position=1 -152,473-602
MKERNIERERKEELERERVRDEERVRTKDSEKQRKKRDWKKKRRRVKTEKSEKLFINDQNFQFFSQRRLSAPPRPQNSYLFLENGPKSQNLVI

SEQ ID NO: 147111 - protein, 63 aa, Heterodera glycines
  Coding regions on vcDNA: vcDNA=SeqID_73534; Strand=-; Position=1-289
QQGWAEVSLFAFRLSHYSHFLAFRISLFAFRFLARNATFTPLRIGLKSHKIFQNFTYKLANFQ

SEQ ID NO: 147112 - protein, 70 aa, Heterodera glycines
  Coding regions on vcDNA: vcDNA=SeqID_73535; Strand=+; Position=1-210
MKSERKGGLVPSLSSKRQQQSVPSHSVPSTEPSPLASPSLFLASQNVGDKGHQPPQKHVYSELALRNNYQ

SEQ ID NO: 147113 - protein, 171 aa, Heterodera glycines
  Coding regions on vcDNA: vcDNA=SeqID_73536; Strand=+; Position=1 -210,2137-2271,2318-2485
MKSERKGGLVPSLSSKRQQQSVPSHSVPSTEPSPLASPSLFLASQNVGDKGHQPPQKHVYSELALRNNYQKQLRADLADSKEAFEKAMTEHGMVLAELQQQYTKEKKHGELLEKQVTEMSQRLAEKDAQIKQTEGRLKQIGNLEKETEMLRKKAQLTPTVRVIKDELANVK

SEQ ID NO: 147114 - protein, 77 aa, Heterodera glycines
  Coding regions on vcDNA: vcDNA=SeqID_73537; Strand=+; Position=1 -40,446-639
MEVQPAENDIKLPPKIVNDHEIRGIAPVGVLLNAFELNLSAVPDKVFQHDLRFVAEYTNTKEGQAKLQELARGPRNE

SEQ ID NO: 147115 - protein, 89 aa, Heterodera glycines
  Coding regions on vcDNA: vcDNA=SeqID_73538; Strand=+; Position=1 -68,593-746,1168-1215
MRHHHSRGTRKFGRKIEDAELTCRNSCRILQKLSASTADIGTIMSTISLGTYTLLKLEISICSFVVSAVHIATEANKESEELSNDNKNF

SEQ ID NO: 147116 - protein, 49 aa, Heterodera glycines
  Coding regions on vcDNA: vcDNA=SeqID_73539; Strand=-; Position=1 -90,686-743
MADSMFKYDQEEQRMIRNVKPWEQDPHYFKGRVDANTIIVLDAFALPVE

SEQ ID NO: 147117 - protein, 97 aa, Heterodera glycines
  Coding regions on vcDNA: vcDNA=SeqID_73540; Strand=-; Position=1 -51,432-674
MGGNIGGALAVLLIVLVEGDAGLDAVPTRDIVIPDQLVDRVIYNQNLQGSRMIIFCSQFGINTLRAYRDEVAVDGTFEVVRKVGCQINVDLDESTWF

SEQ ID NO: 147118 - protein, 78 aa, Heterodera glycines
  Coding regions on vcDNA: vcDNA=SeqID_73541; Strand=-; Position=1 -47,96-285
MSHNPNEAEREMEKAIFISADCWLEVFGLLPRSQLGLGIAMISRRFDRRVDEHFKTRKWTLENQIVQRLSIPSCRQFL

SEQ ID NO: 147119 - protein, 60 aa, Heterodera glycines
  Coding regions on vcDNA: vcDNA=SeqID_73542; Strand=-; Position=1 -85,368-465
MPTNLVELRERICEEIGYENGTMKLIHKASLDFVLSNDTKKIGFVRTWKKLLYKNPGIVN

SEQ ID NO: 147120 - protein, 51 aa, Heterodera glycines
  Coding regions on vcDNA: vcDNA=SeqID_73543; Strand=-; Position=1 -27,548-676
MGEKFEFGDVITIIFGKKFKRINKRNFTNAFVARGAVFANALVYKVCNNYH

SEQ ID NO: 147121 - protein, 93 aa, Heterodera glycines
  Coding regions on vcDNA: vcDNA=SeqID_73544; Strand=-; Position=1 -87,136-179,231-290,436-526
MVLLLFEGCVVCKNAKMTASLSLRQYMPQGLLKETCAAFVKRPTKALVGVTADSFAYGITLMERLCAEKKTTESEPKENATTPAPVYDMEMLK

SEQ ID NO: 147122 - protein, 416 aa, Heterodera glycines
  Coding regions on vcDNA: vcDNA=SeqID_73545; Strand=-; Position=1 -23,92-195,249-743,811-1071,1328-1546,2034-2182
  Homolog annotation: Hit_ID=YP_082380.1; Match level="QueryCoverage =87%, HitCoverage=43%, E-value=4e-22, Identity=27%"; Hit description =collagen-binding surface protein [Bacillus cereus ZK] gb|AAU19467.1| collagen-binding surface protein [Ba
MNKWSALVLLIALISALDSAVVRQQRAADADASKPEPNNEKPGILDSDKAKPDKSQGTDTEGNNPEKPTESQKVEEDGPNPKKPKESQEVEEDEPNPKKPKESQEVEEDGPNPKKPKESQEVEEDEPNPKKPKESQEVEEDGPNPKKPKESQEVEEDGPNPDEDQLTESQETDEEGQEKPEPNDVEESAPEGPEPPLLKHKTDALAKGEPNSRQKRQGGNPAGGGGGEKTAGGGGGEKTAGGGGGEKTAGGGGGGKTAGGGGGGKTAGGGGGGKTAGGGGGGKTAGGGGGGNETVPGPASVNGTGTETIKPDVPVAPSGQPGVAPSGQPGVAPSGQPGVATGEPIPEPTGEPKKDLPIPDKFDLTLPEVDPSNSSANATRYVTQIEGRKNVSDAKFNGKTAACTPAGVGKNKFYFK

SEQ ID NO: 147123 - protein, 184 aa, Heterodera glycines
  misc_feature (102)..(102): Xaa can be any naturally occurring amino acid
  Coding regions on vcDNA: vcDNA=SeqID_73546; Strand=+; Position=1 -234,378-714
  Homolog annotation: Hit_ID=NP_197482.1; Match level="QueryCoverage =100%, HitCoverage=87%, E-value=2e-36, Identity=41%"; Hit description= proline-rich extensin-like family protein [Arabidopsis thaliana]
PVSLPPPPPPAVFPPPPPPAVFPPPPPPAVFPPPPPPAVFPPPPPPAVFSPPPPPAVFSPPPPPAVFSPPPPPAGFPPLPVPILQHPPASPVLPHPFPGFQXAGPRPDLVHPLPLPGFPLASSDLVHPLPLPGFPLASSDLVHPLPLPGFPLASSDLVHPLPLPGSSSDLVHPLPLPFLWLLRI

SEQ ID NO: 147124 - protein, 330 aa, Heterodera glycines
  Coding regions on vcDNA: vcDNA=SeqID_73547; Strand=-; Position=1 -60,267-349,747-842,905-1027,1255-1451,1773-1858,1989-2078,2406 -2523,2596-2666
  Homolog annotation: Hit_ID=NP_508021.1; Match level="QueryCoverage =99%, HitCoverage=51%, E-value=4e-70, Identity=44%"; Hit description =C Kinase Adapter, NUMb related (65.5 kD) (num-1) [Caenorhabditis elegans] emb|CAB07405.1| Hypothetical pr
KIDNYKCPKNAIFFSFCCLYLQYLGACEVFESRGMSVCESALQHLRVARKRVTKALLYISGDGIRVVDQEHNRGLIVDQTIEKVSFCAPDRSNTIEKVSFCAPDRSNEKGFSYICRDGATRRWMCHGFHATKDSGERLSHAVGCAFTVCLEKKRKRDAETAAYRTAQALAHTVELTRALRTIVAEVEENLRGGKFKKFISIYRTNQAYGSFRQLSISERRSDPQKAILPSIPTMPTVTSVLNASTPRPSGNPSLFERSGSLRAPNSSSTVVVVAAANANDNAVAVESQQQQCQQQIVGMSLHNEPIWMSLHNEPIWEGDVEEEIGIGTTT

SEQ ID NO: 147125 - protein, 33 aa, Heterodera glycines
  Coding regions on vcDNA: vcDNA=SeqID_73548; Strand=+; Position=1 -35,342-408
MGNRGGRKSWKYYKTVLKFIFSITDDNPSISDN

SEQ ID NO: 147126 - protein, 201 aa, Heterodera glycines
  Coding regions on vcDNA: vcDNA=SeqID_73549; Strand=-; Position=1 -39,86-249,291-452,496-670,792-858
NIQMKCIDSTEKENSFGGGAEFGHSLFVSGIEQRFSVFVSPGTASLTAPSLLKLSLVQSSDGSIEFLNFDGNWTTEAQFLIPPLDVEEKHRILVRMCKGIDRLETYQSEQKNEGQIEEKCELKFEWFAASDCKSLLSDDFLIIRRSFPITFRPIMLLSWRTSFLSDRTLFHVDISRKDCVSAAFAVDVFPTFVSLLSLKTD

SEQ ID NO: 147127 - protein, 20 aa, Heterodera glycines
  Coding regions on vcDNA: vcDNA=SeqID_73550; Strand=+; Position=1 -8,608-654,1261-1268
MFGHYATLYFVFCVDSSEKF

SEQ ID NO: 147128 - protein, 165 aa, Heterodera glycines
  Coding regions on vcDNA: vcDNA=SeqID_73551; Strand=+; Position=1 -39,182-292,1278-1336,1409-1483,1577-1790
  Homolog annotation: Hit_ID=NP_493688.2; Match level="QueryCoverage =58%, HitCoverage=18%, E-value=6e-13, Identity=38%"; Hit description =abnormal CATecholamine distribution CAT-2, abnormal catecholamine distribution protein 2 (cat-2) [Caenorh
MVKYEPTEDPKHPGFGDQQYIARRAELNALANGFRHGDSLPFICYTDEENFACSDGPGHELFVAELAAQRSYVDSDYQPVYFVAESIRKAMESIRAYALSMRPQRINIYHPLPRSIQSVPSHALIGKRMGQLQKECTELSQLMDKMKTEEEKGIIPAEERRAVID

SEQ ID NO: 147129 - protein, 162 aa, Heterodera glycines
  Coding regions on vcDNA: vcDNA=SeqID_73552; Strand=-; Position=1 -194,377-671
MSRLALYSINGELLGMHSERQRTITRYSLHDTKNKGKLLSIAITDLPEGTAVNCVAIGLQSGMIRLIEMWTMTVVRDISFQSFHFPVLRWSFTSQFGICLFSLLFANESRRLYAAFANSNVVLCWQVPSLYGAASEEPMTVSRERPCFKVLNPFKCSDSFPL

SEQ ID NO: 147130 - protein, 74 aa, Heterodera glycines
  Coding regions on vcDNA: vcDNA=SeqID_73553; Strand=+; Position=1 -75,555-704
MSPQRQTQMDEGPDILALFVGFGISYNKTLPNGDLHEDTKVELEHGQLGPQIAELPIPTRRHFVAFHRGKRTQG

SEQ ID NO: 147131 - protein, 872 aa, Heterodera glycines
  Coding regions on vcDNA: vcDNA=SeqID_73554; Strand=-; Position=1 -27,75-365,457-582,928-1134,1192-1248,1293-1406,1455-1604,1654 -1775,1819-2014,2113-2166,2227-2421,2471-2543,2597-2685,2731 -2871,2923-2953,3016-3119,3297-3556,3617-3998
  Homolog annotation: Hit_ID=XP_419558.1; Match level="QueryCoverage =81%, HitCoverage=23%, E-value=1e-109, Identity=34%"; Hit description= PREDICTED: similar to lysosomal trafficking regulator, partial [Gallus gallus]
MSMLMELNLDFQYALKIGLHELCLLHFTSIGDFDTDLDLLIKFMHSINIRSPLANLTLEEIGSLTADEILLLQQFSEIKSQFYGKMTERANAAWDRECNLLKFTSDQAITLTCEVAELQNVPRRLLVNWKKESQREWSRANRTLAHLVKELCHPEAPFFSPFFWPIGRVLNTTEGPSRERRRFSDAHYLFPLKFLKSERSKAVESLHNAPMPLDNLLNSGDIQQSHANGLRDMEDPIRMSISATLLQTAFECSGDLVISDQRLYFLGESAKSTQKGVVHAPVTYSWDYDQIKEMHIRFYQLKDTALELFTTTGDAFLVVFASEEDRAVILRMFRTFHLDKLFVDHKAQLKSATQMWRRGTLTNFEYLMVLNKLAGRTFNDLMQYPVFPFVLSDYCSDALDIANPNSYRSSKFYTIYSHIFLPFVNSLVQWEPVLLLKRSLLKLFLSEACQQFRNLTKPMAIQDAHMEKVYAQNYQSLAEEYDRFNQSADSVGSSPKSGFSTVRFGPYHYGSHYSNTGIVAHYLVRVPPYTSVALEYQDNNFDIPDRLFSSMDTTWRLSSSESTTDFKELIPEFFYLYEMLRNGDELELGVRQSGDRVDHVQVPPWCPRGDHRLVFCLIHRHALENRHVTTNLHHWIDLIFGFKQNGENAVRAMNVFHPAIRTYGQMPLQLFDSPHLPHLNPPKCQNQQTTPKCPDPRPSVSVSAGSFREQFHSVVGVKWGDFVGSPEHDGFYFSTPSRFFTSGTKRSLRLSLVHCDQTTAICYGIPESTELIVCYRPDRKGVMLWPLCLFFRFFQDPLRLNNELALCAVVAWGPSNFTDNVLRIKLVYAGHSSKRHFQLSPSSIDVPQQFWERLIDLQSLELVSGCLFVRSQ

SEQ ID NO: 147132 - protein, 96 aa, Heterodera glycines
  Coding regions on vcDNA: vcDNA=SeqID_73555; Strand=+; Position=1 -68,672-894
MCADVLYHCLTVGIVPRLSVSFLGQQNLADSRTFLVALKRPNSRNCSASEIGQKVWNEESQSNRREVGKELDEATDWKKRQPMGRNKAKTLINNVN

SEQ ID NO: 147133 - protein, 57 aa, Heterodera glycines
  Coding regions on vcDNA: vcDNA=SeqID_73556; Strand=+; Position=1 -87,944-1030
MPSSTTVMQAVPTTTTRRTMTMTELTTLIETSGSDDTDYEGELTIIATACAMAILLI

SEQ ID NO: 147134 - protein, 59 aa, Heterodera glycines
  Coding regions on vcDNA: vcDNA=SeqID_73557; Strand=+; Position=1 -124,310-365
MVGHLFGFRFHDQNSNKIQKLKIYFYVCICIFDRFDQLKNKVPYPGSGYLLAHNFLIVS

SEQ ID NO: 147135 - protein, 287 aa, Heterodera glycines
  Coding regions on vcDNA: vcDNA=SeqID_73558; Strand=+; Position=1 -84,174-253,316-414,634-877,1503-1630,1726-1863,2048-2138
  Homolog annotation: Hit_ID=NP_495156.1; Match level="QueryCoverage =38%, HitCoverage=11%, E-value=6e-20, Identity=43%"; Hit description =tbc1 domain family member 2 (103.3 kD) (2G114) [Caenorhabditis elegans] gb|AAC71091.2| Hypothetical prote
MTEDETEDTSTFGSSRIDGYLYKASFEALEQRPFVGQIRRKYWFVLPRDTPVLYWYKSPTDFNCAGRILLTGAAFLYNPREQGIFEIHVDNKCYLLEAPNSRARLDWLSAMQQSRRRHYRREKEDTKEKSSEREGEGADRTNANENDDGDQIQGNLPSTSAAESVPDEELTESLEQLRNRCYELTDDLVVHQQLVKCLKRGVVAAHNQRDALKRCCVDSSTDAEKVEFILERESALAKAQFAISELSRDNETLKEENRRLEAENSSLNITVDAYQESVRTKDELIMK

SEQ ID NO: 147136 - protein, 77 aa, Heterodera glycines
  Coding regions on vcDNA: vcDNA=SeqID_73559; Strand=+; Position=1-235
CLLPVEEPLHYGRKCKIRPNLKHISNLVAQPFPTVNGPPKTAARGTVDDPRTDRRGHQTSLSDAYTQCQFPGGGDGQ

SEQ ID NO: 147137 - protein, 175 aa, Heterodera glycines
  Coding regions on vcDNA: vcDNA=SeqID_73560; Strand=+; Position=1 -77,126-300,477-613,667-802
  Homolog annotation: Hit_ID=NP_495156.1; Match level="QueryCoverage =78%, HitCoverage=15%, E-value=1e-16, Identity=35%"; Hit description =tbc1 domain family member 2 (103.3 kD) (2G114) [Caenorhabditis elegans] gb|AAC71091.2| Hypothetical prote
MPTDEAVGPAESAGSVPTEATAVSGSPSISHFVPSSSFAAFTSPSSYENAGDALKQDDWLLRLAADHQKRSDDIFASIELSNNQNLVEWLQRWDAYLVNHVLQPMSPNPQLKMLVRCGIPNTYRARVWSSLVDFLVGSTKSETGKGYYDCLLRKAQRIQEQSASGTADEDAALKQ

SEQ ID NO: 147138 - protein, 23 aa, Heterodera glycines
  Coding regions on vcDNA: vcDNA=SeqID_73561; Strand=-; Position=1 -64,207-214
MTIRRVKRIPPGLKQASVTTRGA

SEQ ID NO: 147139 - protein, 144 aa, Heterodera glycines
  Coding regions on vcDNA: vcDNA=SeqID_73562; Strand=-; Position=1 -156,607-885
MIGSDQKDAPAAQVLSKWLHTPSANGQSKALYCCNYNGGITNVAEWVNKFKQAFLSATAASSYEINLQLDDPTQLKKFELVNERTREKLLLKKVAPSPDYQHDDCWEMRRRPIVKAAAGKAENCDEWDDLSTIDFELLDNDCIG

SEQ ID NO: 147140 - protein, 102 aa, Heterodera glycines
  Coding regions on vcDNA: vcDNA=SeqID_73563; Strand=+; Position=1 -64,272-516
MHGQGRFRTAIFVPPFSYRRFRQTRSHLIISENTSEKIVKVFGIDIGIGIIVIILRDNIVIDIVVALDETKNPCVGIEILLFLCTNLSLFSFVLITCCWFIL

SEQ ID NO: 147141 - protein, 48 aa, Heterodera glycines
  Coding regions on vcDNA: vcDNA=SeqID_73564; Strand=+; Position=1 -96,417-467
MSPVRKRRYENVPGTKTAVRKRRYENGGTKTAQRTSESNDELMNSRFH

SEQ ID NO: 147142 - protein, 27 aa, Heterodera glycines
  Coding regions on vcDNA: vcDNA=SeqID_73565; Strand=-; Position=1-83
GLHTCTCGVVVKLSTFHNFRLGSIPHL

SEQ ID NO: 147143 - protein, 17 aa, Heterodera glycines
  Coding regions on vcDNA: vcDNA=SeqID_73566; Strand=-; Position=1-66
HKHLFDLFYHVHNLIKI

SEQ ID NO: 147144 - protein, 179 aa, Heterodera glycines
  Coding regions on vcDNA: vcDNA=SeqID_73567; Strand=-; Position=1 -71,122-320,795-1064
MAWKAGMPDCRRLLPLPIAKMNRRWICGDVWMDILPSFEHAQLDLKMALLSDRFDILVDKHFDGKTTKLTIRRTIELKRRKGQKRKYMPMTFRHATTSVTYKICFGVFLSLIEPFELVNEVTNEKLTLTKDGTGEFNWLLERCPIIGETAAVQKQQQKKDENSDANLNKVFFRLYDDIG

SEQ ID NO: 147145 - protein, 53 aa, Heterodera glycines; identical to SEQ ID NO: 143092
  Coding regions on vcDNA: vcDNA=SeqID_73568; Strand=+; Position=1-329

SEQ ID NO: 147146 - protein, 188 aa, Heterodera glycines
  Coding regions on vcDNA: vcDNA=SeqID_73569; Strand=+; Position=1 -26,381-656,713-977
  Homolog annotation: Hit_ID=AAL78214.1; Match level="QueryCoverage =57%, HitCoverage=57%, E-value=6e-17, Identity=38%"; Hit description =putative esophageal gland cell protein Hgg-20 [Heterodera glycines]
MRVQRTVKSFICSDCWLLVFDFLAPSQLGLEIALISRRFDFYVDEHFKTRKWTLGEIRICYKIEENGTKQMHIHHADANPLPIPQNPLPNKIIGFRGIKIVYIDQNVVAFLRRFHRFFSIVQRNWALSRAEVTVEKLTLQQEDEDVWLTRCPIGWDEMKWGNVQDELLNDDPLNAILFLIREDRFDDG

SEQ ID NO: 147147 - protein, 89 aa, Heterodera glycines
  Coding regions on vcDNA: vcDNA=SeqID_73570; Strand=+; Position=1-269
MAFLSRTMTTFNTTTMLLNLALFCQCVHSLVIHPRLRSTSAAVAARQIGSGPETTAAEDEQLQHLIDISRSSDKCKRMRWYGAEAKQML

SEQ ID NO: 147148 - protein, 114 aa, Heterodera glycines
  Coding regions on vcDNA: vcDNA=SeqID_73571; Strand=-; Position=1-344
MALLQIRCWWWGWFRALLECRAVVSPLLPIVAARCLAANSFRRSSAVMRTRRTPGMFRAGFTGQLKAEKKQSCLGPSSSGLSVNSANSLSSSDTLPTLDTAFRCAASVRSLISS

SEQ ID NO: 147149 - protein, 34 aa, Heterodera glycines
  Coding regions on vcDNA: vcDNA=SeqID_73572; Strand=+; Position=1-102
LHLFEQLSFGFILQIGKRRQRKQFDQFKFVDQSK

SEQ ID NO: 147150 - protein, 17 aa, Heterodera glycines
  Coding regions on vcDNA: vcDNA=SeqID_73573; Strand=+; Position=1-66
HKHLFDLFYHIHNLIKI

SEQ ID NO: 147151 - protein, 304 aa, Heterodera glycines
  Coding regions on vcDNA: vcDNA=SeqID_73574; Strand=+; Position=1 -57,119-169,1130-1258,1415-1615,1669-1749,1820-1933,1993-2048,2110 -2335
  Homolog annotation: Hit_ID=XP_395046.1; Match level="QueryCoverage =81%, HitCoverage=20%, E-value=4e-21, Identity=30%"; Hit description =similar to CG11533-PA [Apis mellifera]
MSGKASRMTRNVKTLIPEAQKAADEKTKKEAKALEDTHGKSINIVKLLDKGVLVAPDNSRLNFMVLEFCELTVKKYLSYRPAGPPRRARICQVLLGALKAIYDMHNQGLLHRDLKPENMGILSRADPVTVLYDLGMSRMFTNQLGQVREPRTVVPFKGTVEWASGHALKGREQTRWDDLIAWLYIAVELFDPDVNTESPYPWDNHRINNTKAVRYLKSSYSPAKVLLKNCPRQFYSIHTYLYCGNRLLVPDYAFLADKVGQAMEEIQEQIKSGPVTTQGKQPQQSAASVAISKSSVAQSMVSKR

SEQ ID NO: 147152 - protein, 44 aa, Heterodera glycines
  Coding regions on vcDNA: vcDNA=SeqID_73575; Strand=+; Position=1-133
MASFVINPGGPGGYVIPKRRNATEEEKKKERHGAAAATAEDDAK

SEQ ID NO: 147153 - protein, 101 aa, Heterodera glycines
  Coding regions on vcDNA: vcDNA=SeqID_73576; Strand=-; Position=1 -243,830-892
MALPQFLVRLSSRLSARPPTWRTSPTHCNCDNFDCMQAKTAYRIFQIKQFLSYFINLIPAEDLGEMNSANAFANYFNGILQNAIKEKQSQESVEEKAMASV

SEQ ID NO: 147154 - protein, 20 aa, Heterodera glycines
  Coding regions on vcDNA: vcDNA=SeqID_73577; Strand=+; Position=1 -16,710-756
MDVQIYSNCAEFRIGLRTFK

SEQ ID NO: 147155 - protein, 395 aa, Heterodera glycines
  Coding regions on vcDNA: vcDNA=SeqID_73578; Strand=+; Position=1 -98,142-299,365-459,501-592,751-819,867-951,1061-1193,1352-1663,1776 -1921
  Homolog annotation: Hit_ID=CAE72231.1; Match level="QueryCoverage =90%, HitCoverage=94%, E-value=7e-49, Identity=33%"; Hit description =Hypothetical protein CBG19344 [Caenorhabditis briggsae]
MECIGCLAFRTSFSVLLRPFSSANFGQGARDIGSCHNVSSRHSALLEKALAPFVPRTAKELAEYLAKNVLYHSVGDVLVVHKPYGVGSLGYVQKEFGIFPTTQYKFKDRMDLFNGVKKDDSVTLEDAIPHLKEIFHEPKLHFCTGLKRLFQGESISHSNEHWTAQHMHRALAICISRPPRDEGAVDGYATFQDTSRANEYIFVPSVKIRRRARYGKFAVQGELFYRVLDSQCGLSLLDIHFSKFSRHFPRLILSHLGCPIFGDWIYEQRLLNVDGHPICAEPKDVWRAEAKKFEPSAFLNKIGIGSFGELRPPPPLFFAVYESTLPFFGTTKSERRRTNLVSRTPPPDHFMAMVDLLNFGPSVEKLLMSLELGELEEAEIPPTDKSTKSSGETKF

SEQ ID NO: 147156 - protein, 91 aa, Heterodera glycines
  Coding regions on vcDNA: vcDNA=SeqID_73579; Strand=-; Position=1 -44,120-198,326-478
MRRCKNNLTDEEYERLFPKSADKYVFPTNTNGICVGLGNQMFRFAALYGIGKPYGRKPIYKAYHKCTSEDEREKQMLFPVFASQEKFFVKF

SEQ ID NO: 147157 - protein, 107 aa, Heterodera glycines
  Coding regions on vcDNA: vcDNA=SeqID_73580; Strand=-; Position=1 -169,1583-1737
MIFLKFLLFLTFFAPAPILGLFKALLNFRQNLGDAKACNNEIQITELRVHCHNGNEGSFYSVANSPNSVPDQLFPFVTFWDFGDEIEANFGPNFKFKPGLSKPGQPG

SEQ ID NO: 147158 - protein, 192 aa, Heterodera glycines
  Coding regions on vcDNA: vcDNA=SeqID_73581; Strand=-; Position=1 -54,94-176,235-336,380-473,552-648,1808-1958
NSNGTTNSIDLNGTKGNELAPTDVEELNGKLKKIEQNMTKLQNENENLRAKNAELEQQKQQTLPEVEKLNYSQNWNDVQPKNHWCLNKSASEFFIFKPNYLKAVHRGVENSAKLLFAEFVLVPHFGIVYYEIKIIRRQATKSDTISIGLWSKSAGTHLTDIIAMALFMVTMPMASRDFPPLMRATRSDSGPI

SEQ ID NO: 147159 - protein, 55 aa, Heterodera glycines
  Coding regions on vcDNA: vcDNA=SeqID_73582; Strand=-; Position=1 -71,522-618
MSGIEPLDGSVLSSGTNWAIVTKRDQKKNDAQIQRDGDEFINGITHKGKDGQHLT

SEQ ID NO: 147160 - protein, 143 aa, Heterodera glycines
  Coding regions on vcDNA: vcDNA=SeqID_73583; Strand=-; Position=1 -28,439-530,2384-2600,2763-2857
  Homolog annotation: Hit_ID=CAC21848.1; Match level="QueryCoverage =89%, HitCoverage=62%, E-value=9e-09, Identity=30%"; Hit description =hypothetical protein [Globodera rostochiensis]
MEMENQQQKVSLDQIEHLQNEQKRKDNAVKKELKKIQMKMITFGFAPIKWTKLEGTIVSNFGTYAYSNNGSFTIDGKWMDQKLDAFQENDIVGCGINSATRQIFFTKNGRRQDELFPFVSLLTIGNEIEANFGPHFKFNLATL

SEQ ID NO: 147161 - protein, 426 aa, Heterodera glycines
  Coding regions on vcDNA: vcDNA=SeqID_73584; Strand=+; Position=1 -114,605-821,873-1448,1803-2176
MTKICYSESFSLWLVNNGILLKNAKWRKFLLRKGFINQAQFDQIKPSETDLKWSEKNCENELGIQKVMKLFTDTQCEVHFSVIQKLIGKFPGLTKPFADKAWALPRYRNYALFNAEEQIELYKFIFNSDEKTSHETETKLAMKQLIGMAKEREESLFKTPEIADEIRNAKTQTFTMMALSETFCPSKEWPMDRMLCPLGQYVQFLSEMAKNRPKIEWEAPIWCFAHDINEIFAWVRQILFGKRVEFFKNYLKRETNGKDDEIIRIIREKPGAILRLHNFVQHKLIEELWKDEQIREKLYNVNFFSNKSRLLHNYRRAMAKSSSPIERLGARLAADIAAMANHLSAKFPKVQPHLRAALSSCQSFSPPFASNSNLSSFSELLDVVWVDLRFLYDKSDPTICDERIYKLTIIFVSNYLSGVLVALAIS

SEQ ID NO: 147162 - protein, 287 aa, Heterodera glycines
  Coding regions on vcDNA: vcDNA=SeqID_73585; Strand=+; Position=1 -399,450-670,945-1188
  Homolog annotation: Hit_ID=NP_702308.1; Match level="QueryCoverage =64%, HitCoverage=3%, E-value=2e-11, Identity=30%"; Hit description =hypothetical protein PF14_0419 [Plasmodium falciparum 3D7] gb|AAN37032.1| hypothetical protein [Plasmodium
MGDIKKLFEMNGITFNESGEFITANEIEEKGKNMQRNETKKGKGKKKRKTQKINKKEAKEKKEKQKEKEKKAEENLMEEKEKAEEKTTEKLEENSPENEKELEKMKVKSGKNGNKKSPEFVLLEGNPTEFVEKHKDFIVINCVAEQKSDYEKFCNFIRGKIRSKMNNLMDKIGMKNSKEIEICEIDTEINREETFKIVGELVHREFSINFGKVWLFGIKIPANGNEKLKEHLRNFDIEMKMEYLQQLGLLSVEMDETEIINEFQKLGANVLSTVAKKWFLMDILEEK

SEQ ID NO: 147163 - protein, 16 aa, Heterodera glycines
  Coding regions on vcDNA: vcDNA=SeqID_73586; Strand=-; Position=1-52
YYNYDLVKNMRMSDLG

SEQ ID NO: 147164 - protein, 338 aa, Heterodera glycines
  Coding regions on vcDNA: vcDNA=SeqID_73587; Strand=-; Position=1 -359,418-500,556-672,710-988,1048-1131,2212-2306
  Homolog annotation: Hit_ID=NP_896112.1; Match level="QueryCoverage =28%, HitCoverage=63%, E-value=8e-21, Identity=51%"; Hit description =RNA-binding region RNP-1 (RNA recognition motif) [Synechococcus sp. WH 8102] emb|CAE06529.1| RNA-binding
MYGNVGGVSAVSRPAGGGGAGGHSAGGGGYGGGGGNSAGGGGYGGGGGHSAGGGGYGGGGGGGYRTGGYTGGGGGGGYRGPRTGGNAAVGAPFRRGGKPQRPKKEFVYTDEMRAFYNGFDPGRRERKLTAPPVELISASFKPGEVIQGDVIMSYLRDRLNQEEPKLDVHLDGGESEEPKMEVHLDGAEKDVHLDGVELEEPKMDVHLNDGESEEPKMDVHLNDGESEEPKMDVHLNDGESEEPKMDVHLNDGESEEPKMDVHMNGGESEEPKMDVHLNDDGVEFEEPKLDVHLDDGKPESKLETQLGEINEISVKGFSKSLITNSGSDQRYHSSHQGQ

SEQ ID NO: 147165 - protein, 95 aa, Heterodera glycines
  misc_feature (20)..(20): Xaa can be any naturally occurring amino acid
  misc_feature (34)..(34): Xaa can be any naturally occurring amino acid
  misc_feature (42)..(42): Xaa can be any naturally occurring amino acid
  misc_feature (49)..(49): Xaa can be any naturally occurring amino acid
  misc_feature (55)..(55): Xaa can be any naturally occurring amino acid
  misc_feature (68)..(68): Xaa can be any naturally occurring amino acid
  misc_feature (75)..(75): Xaa can be any naturally occurring amino acid
  Coding regions on vcDNA: vcDNA=SeqID_73588; Strand=+; Position=1-285
  Homolog annotation: Hit_ID=CAD22154.1; Match level="QueryCoverage =100%, HitCoverage=53%, E-value=7e-25, Identity=55%"; Hit description= pherophorin-dz1 protein [Volvox carteri f. nagariensis]
PPLRKGAPTAALPPVRGPRXPPPPPPPVYPPVRXPPPPPPPXPPPPALXPPPPPXPPPPALLPPPPPXPPPPALXPPAPPPPAGRLTALTPPTFP

SEQ ID NO: 147166 - protein, 92 aa, Heterodera glycines
  Coding regions on vcDNA: vcDNA=SeqID_73589; Strand=+; Position=1 -43,796-861,1177-1346
MGENKGQFALIGGGATASKSDDIFVGTAKGKMKPQKALYVAFIVGGVLIVLILALSLLFYLFLCRKRKKGYYAVNEQLASAFAKKVLFYLFC

SEQ ID NO: 147167 - protein, 73 aa, Heterodera glycines
  Coding regions on vcDNA: vcDNA=SeqID_73590; Strand=-; Position=1 -192,998-1027
MSKIHDFCGDELPAQLMSAKNVLTLTYVLKSAFFAQNPTQNTRKWAGDWRLRERDETEDEHFGWRFFLFSSDI

SEQ ID NO: 147168 - protein, 66 aa, Heterodera glycines
  Coding regions on vcDNA: vcDNA=SeqID_73591; Strand=+; Position=1 -108,367-459
MIILHLFLFLSSILCCFGTNGVQRNEHQNVAEVQLNNVIDPNDLSSPGNFVEDDHPPKFFRMDMSK

SEQ ID NO: 147169 - protein, 69 aa, Heterodera glycines
  Coding regions on vcDNA: vcDNA=SeqID_73592; Strand=+; Position=1-208
MSNLDQNRTIILIKLRNGQDKRTSSNYMDLESPGSALSSVRRSDSGKSPKKVPRFAESPASSSRSSALG

SEQ ID NO: 147170 - protein, 85 aa, Heterodera glycines
  Coding regions on vcDNA: vcDNA=SeqID_73593; Strand=+; Position=1 -105,170-322
MFRIPNPNSDKFLDFLIFLFLAASIFYSNLSVWSDNKLRSHFIVSGNTSEKIDNVFGIHIGIGIIVIILGEVIVIDVVIECAVMF

SEQ ID NO: 147171 - protein, 97 aa, Heterodera glycines
  Coding regions on vcDNA: vcDNA=SeqID_73594; Strand=+; Position=1 -11,74-356
MNRRWICNDVWMDIFPSFDRPQLGLKLALLSPRFNSLVDKYFDGKSELPIWRQIVIRRKGIGPEMKLYVEMDYVFVPFPLPDRPLPSKIRFEWLQIE

SEQ ID NO: 147172 - protein, 334 aa, Heterodera glycines
  Coding regions on vcDNA: vcDNA=SeqID_73595; Strand=+; Position=1 -53,106-553,610-884,944-1001,2261-2431
MPDRPLPSKIRSKNLRIGYTDHSVIAFLRSNHQIFDKRGTNLHLRIQSSHTTEGQRIWDIFVREIWPIFSENIRHLGFPHGDQLDHLLRQISPTILIDLNQLVSIHSFGLSPAAFGDDFDGPNSTISAGQALSKWLHSPRNDGQPKRLRCVDYNKQTDLDWVNNFKEHFLRANAISSVSYQILFSVRVPSIQMVPFELVNELTKEKLTLTKANENDWENWIMKRCKIGEAADVQLQKDENWGNNFNNVAIWLFSTDCIGPLSPPSAEEEQEAGQNSEKIQQPEPIQAQNLPAEPDELSPQTPKTVRCSPTPRPVRERRPVVRYSPEPVARRKRK

SEQ ID NO: 147173 - protein, 126 aa, Heterodera glycines
  Coding regions on vcDNA: vcDNA=SeqID_73596; Strand=-; Position=1 -256,302-426
MENKQPEQSVEVAPANPGEELSEANATEEALLAPEEEAKTAPMPAESEVATQSEEKENVPDHHPEELNSCAMESTRLIPPTNHFFAQYCAELVGRLLEKTSQKDGFHLRKELNGIMTKYEAMTIGK

SEQ ID NO: 147174 - protein, 97 aa, Heterodera glycines
  Coding regions on vcDNA: vcDNA=SeqID_73597; Strand=-; Position=1-290
HNGTGTNIGSGTGNSHNGTGTLALRRPWGCPPLVRNVDRRRPRRSRKRTRGPYSDNSDGSAFTLFHGMHGSFDTWGTAGIDEWDQSAQSVHNYGMVG

SEQ ID NO: 147175 - protein, 247 aa, Heterodera glycines
  Coding regions on vcDNA: vcDNA=SeqID_73598; Strand=+; Position=1 -192,910-1127,1180-1399,1649-1762
  Homolog annotation: Hit_ID=NP_502088.1; Match level="QueryCoverage =85%, HitCoverage=35%, E-value=6e-49, Identity=42%"; Hit description =suppressor of var1 3-like 1 (81.2 kD) (4L917) [Caenorhabditis elegans] emb|CAA97429.1| Hypothetical prote
MITGENRLFAVDSDNPSAHTSATIEIMSPEHRIELCVIDEIQMLRDPQRGAAWTRALMGAPADEDGDCVIHFSKKGILDMARRLKFEYKKECAIVFGDLPPEVKREQVKRFNDQNDPCKILLATDAIGMGMNLNIKRVIFTTLKSRDGSLLPAYFVKQIAGRAGRYASAYCTGEAMALDDADAGLLEKLMNEPIDSIDQAGILPSFDQIEQLRNVTFSASPQSLPVLTPFLTRLLSKWSDVILRAMQ

SEQ ID NO: 147176 - protein, 128 aa, Heterodera glycines
  Coding regions on vcDNA: vcDNA=SeqID_73599; Strand=-; Position=1 -167,647-715,1107-1259
  Homolog annotation: Hit_ID=AAH50420.1; Match level="QueryCoverage =94%, HitCoverage=12%, E-value=8e-45, Identity=71%"; Hit description =Methylenetetrahydrofolate dehydrogenase 1 [Homo sapiens]
PVPTDIDISRAQQPKAIGRLAAEVGIAQSELELYGHSKAKVSLAVLNRLKERPNGMYVVVAGINPTPLGEGKSTTTVGLAQSLCAHLGRNTFACMRQPSQGPTFGIKGGAAGGGYSQVAAMGALRGGG

SEQ ID NO: 147177 - protein, 59 aa, Heterodera glycines
  Coding regions on vcDNA: vcDNA=SeqID_73600; Strand=-; Position=1-178
  Homolog annotation: Hit_ID=NP_509362.1; Match level="QueryCoverage =98%, HitCoverage=18%, E-value=2e-12, Identity=67%"; Hit description =dauer or Aging adult Overexpression DAO-3, methylenetetrahydrofolate dehydrogenase (dao-3) [Caenorhabditi
GINVVQSDGEKRHLVGDVNFEEAKAVAGFLTPVPGGVGPMTVAMLVRNTFLQAVCQKLN

SEQ ID NO: 147178 - protein, 55 aa, Heterodera glycines
  Coding regions on vcDNA: vcDNA=SeqID_73601; Strand=+; Position=1 -82,349-434
MFRIFGRFVGTYPIAFLIFSLILASLSDSEPLKKPIPGPGFHVDLDLDFLGKNFE

SEQ ID NO: 147179 - protein, 67 aa, Heterodera glycines
  Coding regions on vcDNA: vcDNA=SeqID_73602; Strand=-; Position=1 -40,510-673
MPGETVPKPYPSQTAFSPVPQRWRKCSGAKSRASERIRPANGAGACCAGRALAASLWSAGDRLGHFV

SEQ ID NO: 147180 - protein, 582 aa, Heterodera glycines
  Coding regions on vcDNA: vcDNA=SeqID_73603; Strand=+; Position=1-1749
  Homolog annotation: Hit_ID=NP_913627.1; Match level="QueryCoverage =80%, HitCoverage=33%, E-value=1e-64, Identity=35%"; Hit description =putative helicase [Oryza sativa (japonica cultivar-group)]
MRWLFVSILVFGQPSNSLELWNKYKDQMYNPQGIISAAIRQAREQEALADIDWRLHFFNSSCLHCGLPDPPNSKAKNINLAVEEAFFGDDDLNMSPGQQNPRQQQNAPPPLNSDQQTVFDAVVKAIQSDPRDPTVPRRFFIFGDGGTGKTFLFGQIINRLRKPPYTYKVLATASTGCAAILLPYGKTAHSTFRLGREVSLDKLPSIPLESFFARRIREAQLIIIDEITMLHNTVIAVIDRVCKEMAIRQHKDLLFGGKTVIFSGDFKQSLPVVPHEGLPAQVTACFQTSPLFGQFTTMKLTINQRLGQGQQAYLQMCRQIGLGETGEHFWIPPQFLVKSREELIDFVYPDFQKLLGNDKELLNRLILAPHIDTCDEINEIMMANVPGQVREYLSSDKPLDERPLDIDEIESEVAALNRRTDSGMPPHRLRLKVGSVVVLLINKSDKEGLINGTRIVLEELGDDRLVGRVINSNAVGGQVKFFIERTRNVYEDKTPGGLKYERLQFPIKPAFAMTILKGQGQTISTVGIDLERDVFSHGQLYTAFSRATDGSNVRVYAPRRETDAQDRVKVLNIVATKMLNLQ

SEQ ID NO: 147181 - protein, 54 aa, Heterodera glycines
  Coding regions on vcDNA: vcDNA=SeqID_73604; Strand=-; Position=1 -72,535-625
MANLLVDRMKLMLSTGDYADVHFLIIPAHRAVLNCGSDVFAAMFRYEANKAAAN

SEQ ID NO: 147182 - protein, 43 aa, Heterodera glycines
  Coding regions on vcDNA: vcDNA=SeqID_73605; Strand=-; Position=1-365
CFAVPRTGMQWMSFNLQEIRLAICGCKKLLGNELFFEVSQTPY

SEQ ID NO: 147183 - protein, 109 aa, Heterodera glycines
  Coding regions on vcDNA: vcDNA=SeqID_73606; Strand=-; Position=1 -129,181-381
MEQDFPHDQLQHFTVHGHQGQQREVHNPVLIWYNGLNHFQTILGPEQLNYPAAHDIVTNQQYVTPAHLLQDAMDVGPSLAGPSVAMQEEEFAEEFLPTKKFCSSDERRI

SEQ ID NO: 147184 - protein, 114 aa, Heterodera glycines
  Coding regions on vcDNA: vcDNA=SeqID_73607; Strand=+; Position=1 -58,467-563,625-787
  Homolog annotation: Hit_ID=CAE57895.1; Match level="QueryCoverage =76%, HitCoverage=71%, E-value=5e-26, Identity=59%"; Hit description =Hypothetical protein CBG00944 [Caenorhabditis briggsae]
IDSRMAFSRALLIVLSASLMKYTEDNCKSEKLREIILETIGLYPHQYSYQARHMKQVSENHMKQVSENRFGNWWSAVIISERGGYGMSAIYDQHQNTRRVEYGQGMSQAKARPG

SEQ ID NO: 147185 - protein, 234 aa, Heterodera glycines
  Coding regions on vcDNA: vcDNA=SeqID_73608; Strand=-; Position=1 -41,208-363,616-762,1465-1648,1712-1885
  Homolog annotation: Hit_ID=NP_871817.1; Match level="QueryCoverage =50%, HitCoverage=29%, E-value=1e-33, Identity=58%"; Hit description =oxysterol-binding protein (1G409) [Caenorhabditis elegans] gb|AAN84853.1| Oxysterol binding protein (osbp
MANSTRGGQQQQQRDGEPSDGDDDEGDAVQRHSDEALLDALRHQFAMLRLDELRERLRHRNCIGGQIQPFSAAFGGRRRTGQCGGESAHWQKGGGTNLHGIRPLTAHQKGGEGNLFLAVLKYYLNSFYPARKTDDAKKPYNPILGEVFRCRWTLPGVPLSASRTAGGPFPGSATNQMTFIGEQVSHHPPISAFYVEHPESGVTCASHIYTESHIAGLTSVGVRNIGRATVRLQN

SEQ ID NO: 147186 - protein, 104 aa, Heterodera glycines
  misc_feature (6)..(6): Xaa can be any naturally occurring amino acid
  Coding regions on vcDNA: vcDNA=SeqID_73609; Strand=-; Position=1 -22,317-494,619-733
  Homolog annotation: Hit_ID=CAE63470.1; Match level="QueryCoverage =100%, HitCoverage=43%, E-value=1e-31, Identity=68%"; Hit description= Hypothetical protein CBG07937 [Caenorhabditis briggsae]
NLLQNXYVGSYAAMTSNGALVAAKTPPEVQREFASLAKVPLVAGTVNRGSELIGAGCCVNDWIAFTGLDTTSAELSVLESIFKLGDAALSAISTDSRDLIESML

SEQ ID NO: 147187 - protein, 177 aa, Heterodera glycines
  Coding regions on vcDNA: vcDNA=SeqID_73610; Strand=-; Position=1 -165,216-272,357-668
  Homolog annotation: Hit_ID=AAG00552.1; Match level="QueryCoverage =97%, HitCoverage=88%, E-value=4e-18, Identity=30%"; Hit description =retinitis pigmentosa GTPase regulator [Mus musculus]
MSAELEKEKKEKEEANARVAELDDRVVKLEKENEDLKKENEQLKQALKADRTKSKRPAESEEKMSRMEQNFLDAERVGGKGGEEDKKKEKGEEAEKDGQVEEMEEDKKKKGEKVEQKEDNETKKEGEKSAEKEGEKNAEKEGEKNAENEGEEEKETEENEAEEDDGQGSKAKRTRFM

SEQ ID NO: 147188 - protein, 47 aa, Heterodera glycines
  Coding regions on vcDNA: vcDNA=SeqID_73611; Strand=-; Position=1-142
AGLSRCSPHCATITARAPPGRPCRRGPWSRHPIGARPPPARLRPLLA

SEQ ID NO: 147189 - protein, 143 aa, Heterodera glycines
  Coding regions on vcDNA: vcDNA=SeqID_73612; Strand=+; Position=1 -159,214-404,467-548
  Homolog annotation: Hit_ID=CAE73738.1; Match level="QueryCoverage =69%, HitCoverage=32%, E-value=1e-15, Identity=43%"; Hit description =Hypothetical protein CBG21264 [Caenorhabditis briggsae]
MPSRTLVRHCIIIRMYTPSFSLVPLGHPAMSDSLANRETPDNLAFLAKMRMTGPGLPGPPGMPGMPGPMGMPGTPAGPGMPGQRGFPGMAGNVGEPGRAGLPGIAGQSGQRQADGGYCPCPPKRKQQRSMLVVGAAKRSLLFP

SEQ ID NO: 147190 - protein, 249 aa, Heterodera glycines
  Coding regions on vcDNA: vcDNA=SeqID_73613; Strand=-; Position=1 -344,747-991,1037-1197
MKIEEAYSSASTSSQRTIEPSQAKQKQKVPTMFTSPAATSNKNEAAKAKWGQKGTQFTLKLAASSKRSAETAQTKGEQKLQKLLLSPKGNEIVQAKWGQKVPGLYTYFEIAIDCGDCFLVGVSPLLNANLGVNLCELPSAIAYKSNGQFCANGDDIIRHDEEKPKSQSEIAYGAGDVVGFGYNANAFFGTKNGELIWTHDNLIRSATNDAKLFPTISFCGFGNAKIKANFGENPFQFDVANYVLTKFLL

SEQ ID NO: 147191 - protein, 112 aa, Heterodera glycines
  Coding regions on vcDNA: vcDNA=SeqID_73614; Strand=+; Position=1 -240,683-781
MMGTNPKSGSRKISWGPDQIPINPKRYWKNDRDEFQVGIPKNFVGSRSNPENPKRFWKNDQESQVRMRKNFVGFLSFNTRKFFAVALTDTAGLLFPKKLLFFKSSFVAARMF

SEQ ID NO: 147192 - protein, 68 aa, Heterodera glycines
  Coding regions on vcDNA: vcDNA=SeqID_73615; Strand=+; Position=1 -155,406-423,630-663
CVKLRPTPNDQFPLHDEMVAVKFCPDRVSPGFGKKHYRKVDCMLYKSTMRQRNVVKLTIAVGSRRKNP

SEQ ID NO: 147193 - protein, 109 aa, Heterodera glycines
  Coding regions on vcDNA: vcDNA=SeqID_73616; Strand=+; Position=1 -285,880-924
MTEELLNVPHLCASFFRLLIFVSDIAAEGIAQSPPQMLDDILRCVKAALDYSFGGDRVRSALEIVNGLAANCVEDSVKKTGKYATMTERLLALVPSGRMGKRNDQNRSS

SEQ ID NO: 147194 - protein, 24 aa, Heterodera glycines
  Coding regions on vcDNA: vcDNA=SeqID_73617; Strand=+; Position=1-72
MRLTCQAMVRKLHAELDYARHFPK

SEQ ID NO: 147195 - protein, 914 aa, Heterodera glycines
  Coding regions on vcDNA: vcDNA=SeqID_73618; Strand=+; Position=1 -1753,1848-2144,2276-2461,2515-2598,2792-2942,3018-3291
  Homolog annotation: Hit_ID=NP_491483.1; Match level="QueryCoverage =26%, HitCoverage=14%, E-value=6e-43, Identity=42%"; Hit description =disco-interacting protein 2 homolog (1F517) [Caenorhabditis elegans] pir||T34061 hypothetical protein F28
MYVLMEHRSPERRPARSVHSVERHRLPLLRGRAVVHSSHPSSPHPAAIRCRYSITPQMSSSATSALLGIEEKRRKTSSGQQPQQQQLRRRQFVRQNGIMATDNEQNDEANNRGKAAEEHHQPNFQQNKSGERAREAVPTNDQQRQQNISNWTPKKLSSSGPSRLRHVQPPPNIKGDQNGPAVSSSKLQKTQAHHYDSSNGCERIDQQQQLRIAVGRQPLKYASSKVRPVKTTMPQQQIEKGGEYGDKAHKNREEEKENTVRKRISNSTPRRTTPNTTRKELQLAVTPNHRQQSDVEVIMMMHNDGRQHKQQQKHQNCNDNNTYEQISWDNCSGNNAISDNNNNNMMRVVVPTRAVAMTEWPPPTDEEPQQQRKRRKAMMELQQKGLSRSKSQSRNNLLLAQQQKASLEHFQMGRSKTATNLAFVAGEYSTLGVDTLSLNRKGGGGPFALLRRGANLRKLSLQRCRPAFSGAQSAVVDLFDALQSDQRREERERAEALPNGQFERIQRELKAFAERRHLALGRRRKVRIAELGLDQLHAQLATKQAKADASSGTVEGYNYSTKMFQRPRKKPLHEYYNDDDAELEADMLPFFAFQNSFVIQTHLCLVSLALANTVDPNAPQSNGQLIVPARGDFPSASTSGASAPPPLPRSIDSVLYKWANTQPKSVAAVQLDSGGKATATLTYSKLLSRANKVAYHLLTRQVTVNTGGVKERVHLCLPDDRVALVFPNSEPIAFLVAFYGCLLAGVVPVPIEVPMPKRDVAGLQQFGFLLGSCVPFSILRRPPSLPPTPSLLPQRVPPAPVQVRVLNATTTHSFTIPRLRTQTMDGLVSIGLSLNTLENRPGIGHCHRWLRMTTRPYIEYTFDREGSIKGVREERTWHFVQFTLSHFSLSGGMVSTSNARPFSSHWVSRRLQGR

SEQ ID NO: 147196 - protein, 38 aa, Heterodera glycines
  Coding regions on vcDNA: vcDNA=SeqID_73619; Strand=+; Position=1 -3,204-317
MFYFLLNKYYSYCIVLPNNIFIIIIGIIMLIVKMVLVN

SEQ ID NO: 147197 - protein, 83 aa, Heterodera glycines
  Coding regions on vcDNA: vcDNA=SeqID_73620; Strand=-; Position=1 -91,309-431,4325-4364
  Homolog annotation: Hit_ID=NP_872018.1; Match level="QueryCoverage =90%, HitCoverage=9%, E-value=5e-33, Identity=90%"; Hit description =HCO3- transporter (2G447) [Caenorhabditis elegans] gb|AAM98009.1| Hypothetical protein F57F10.1b [Caenorha
HILSRTVQSICTTGTVGGTFDYDQTWICALCILNTVQHRHAIARLSHPTNLGRSMQDLRFIIIVIAPSRAKFSKTFFQKKIIY

SEQ ID NO: 147198 - protein, 40 aa, Heterodera glycines
  Coding regions on vcDNA: vcDNA=SeqID_73621; Strand=+; Position=1 -7,141-256
MFAHISMSDHSQMCHQQCQLCKCFAPYGSECGLKMMLITN

SEQ ID NO: 147199 - protein, 170 aa, Heterodera glycines
  misc_feature (163)..(163): Xaa can be any naturally occurring amino acid
  Coding regions on vcDNA: vcDNA=SeqID_73622; Strand=-; Position=1 -63,460-661,991-1239
  Homolog annotation: Hit_ID=NP_495406.1; Match level="QueryCoverage =74%, HitCoverage=65%, E-value=6e-25, Identity=43%"; Hit description =putative protein, with a coiled coil-4 domain, of ancient origin (2H170) [Caenorhabditis elegans] gb|AAA6
DDAFHYFSYGSNLLTERIHVHITGAEFVTAALLPGFELTFFDRSERWQGAIASVERKPSARVWGCVWRVSNALATVLDAQECGYHRMDADPSIPPTSMLCRTYQYSNPDKQHNCPSPHYKHVKLILSQGHFEKFAKIFFLNFSFLNFFFSRGGLGFFFPAINXKNFNLVF

SEQ ID NO: 147200 - protein, 57 aa, Heterodera glycines
  Coding regions on vcDNA: vcDNA=SeqID_73623; Strand=-; Position=1-176
ATENDDHHQTMQHQQQQQNGFDANTGVQLPNVTDFVAGGERRSKTSTRMEAEDGGDQ

SEQ ID NO: 147201 - protein, 214 aa, Heterodera glycines
  Coding regions on vcDNA: vcDNA=SeqID_73624; Strand=-; Position=1 -71,132-272,592-1022
  Homolog annotation: Hit_ID=AAH83030.1; Match level="QueryCoverage =68%, HitCoverage=21%, E-value=2e-29, Identity=48%"; Hit description =Unknown (protein for MGC:97882) [Xenopus laevis]
MNVKRSCHVHGLASWFDVAFDGTNGRTVWLSTAPTEPLTHWYQVRCLIKRPMLVLAGQDVRGSLEMVANDKQSYDMELEMYTDAAAAAIDNDDDGAAQQQHHQRNVLDLKMPYFRYTGQPVAPPPGAHADCPSDQLNLAVNNFLAGGAAGGGMGQQQQQHQQQQEDGEDHEGEQQRRQQRQQYKHHHQQQQRMMHAMKRQQHHHQHHLASSNKA

SEQ ID NO: 147202 - protein, 82 aa, Heterodera glycines
  Coding regions on vcDNA: vcDNA=SeqID_73625; Strand=-; Position=1 -73,643-815
  Homolog annotation: Hit_ID=AAH78292.1; Match level="QueryCoverage =100%, HitCoverage=13%, E-value=4e-22, Identity=60%"; Hit description= Coactivator-associated arginine methyltransferase 1 [Danio rerio] ref|NP_001003645.1| coactivator-associa
MGYMLVNERMLESFMFARKFLRPGGRMFPTRADLHLALFTDDALYAEQQQRAAFWAQQTFHGVALGASAEPALDETVRQPVV

SEQ ID NO: 147203 - protein, 36 aa, Heterodera glycines
  Coding regions on vcDNA: vcDNA=SeqID_73626; Strand=-; Position=1 -46,187-251
MELRNRSKQMSEKGKEIIKLLIDIFCITELEIHLSN

SEQ ID NO: 147204 - protein, 394 aa, Heterodera glycines
  misc_feature (130)..(130): Xaa can be any naturally occurring amino acid
  Coding regions on vcDNA: vcDNA=SeqID_73627; Strand=-; Position=1 -118,1668-1791,1852-2009,2099-2172,2207-2325,2383-2838
  Homolog annotation: Hit_ID=XP_318657.1; Match level="QueryCoverage =82%, HitCoverage=57%, E-value=6e-37, Identity=33%"; Hit description =ENSANGP00000010224 [Anopheles gambiae]
NESLEKLCHKKKKNGWRKLNEVEMQLDKMISQEVRIDESFEKVGGCSSILELLRQKVVVPLQLASNKTTLPSLLYSAPKGILLYGPILLYGPNGCGKTLIARAIAKEVDAYFINFGTSLVGRLWIKNNNXIAIISFFRAEKIQAEKIQPCVIFIDEIGVFSCFCNSLFRNDFQLLKTQFLAQWDDLRCNSNCNVIRNDFQLLKTQFLAQWDDLRCNSNCNVIIIGATNRVLDLDETVLCRFSLETVLCRFSLKVHIPLPDEEAREKLLRKILANENLEADFNYAEVVEATQKMSSSELKEVIRFAFLLRYQQVVKLRSVFFSSESMAEQNICNSNVFIALRSSSVANEGSENEAEKIQIKLSHNDIIRAFHDLKNVSMAPFSESVVTEEVVEVD

SEQ ID NO: 147205 - protein, 170 aa, Heterodera glycines
  Coding regions on vcDNA: vcDNA=SeqID_73628; Strand=+; Position=1-513
MANSPLLLLPILSLSIFCAFLSEIAIGMPSPFKTPEALDRMDGISPVSSAWTSPTISGCSTPEMGAGRANLRRCASIATDRMPTTYHGAGRGRSPPTLSQQMYGRTTALLPGARDGRTIGIFELIDFLGGGFPRLKEARFFPGIRSQCFSAVRIEIRFGRFCYLPKHTHC

SEQ ID NO: 147206 - protein, 64 aa, Heterodera glycines
  Coding regions on vcDNA: vcDNA=SeqID_73629; Strand=-; Position=1 -191,549-552
  Homolog annotation: Hit_ID=NP_495741.1; Match level="QueryCoverage =89%, HitCoverage=11%, E-value=4e-11, Identity=56%"; Hit description =pyridoxal-5'-phosphate-dependent enzyme, beta family and Amino acid -binding ACT (2I557) [Caenorhabditis e
MAELTNEIAKTGASIKDIFHERAWLAANIYSVCVRVICETRGEAHVRELISHLGKKYKQASRER

SEQ ID NO: 147207 - protein, 256 aa, Heterodera glycines
  Coding regions on vcDNA: vcDNA=SeqID_73630; Strand=+; Position=1 -179,225-583,957-966,1360-1581
  Homolog annotation: Hit_ID=CAE61593.1; Match level="QueryCoverage =69%, HitCoverage=9%, E-value=3e-10, Identity=26%"; Hit description =Hypothetical protein CBG05508 [Caenorhabditis briggsae]
MIRKPNSEVGHRRILSKFVNVNKHRFSAQQQQLQHQRTNCIYQRHIGQCAMRLLLNSMVKNSSKNSAVAALMGSLHHQPTSAKSRRQKPMSFFEHILTENGDINRAEGPPPAGGAGQQQKQQQQQQTQTAGGTTQPLQKQQSTALLGGDQRKGSYNKLGDDQMRDHCWIGELGHYSREYHMLWNRIEEEMRENHPYFDRPLFIIARDSKLRRFCRRFVHARWGFDVGAEMGGEAAAVAQMVPDERRRWRWKAAPTI

SEQ ID NO: 147208 - protein, 293 aa, Heterodera glycines
  Coding regions on vcDNA: vcDNA=SeqID_73631; Strand=+; Position=1 -246,306-385,457-616,1112-1210,1395-1463,1522-1746
  Homolog annotation: Hit_ID=NP_741414.1; Match level="QueryCoverage =99%, HitCoverage=17%, E-value=1e-105, Identity=63%"; Hit description= novel Channel type/putative Nematode CAlcium channel (nca-1) [Caenorhabditis elegans] gb|AAM81121.1| Nov
MAKVIADGLFFTPNALVRDFGGVMTVFVYLTSLVFLLLMPKHVEINSVEQFLMICRAMRPLRIYTLVPHIRRVVVELFRGFKEILLVTILMIVVMFIFASFGVQTVGGRLAACNDVNVTRQVIKLKMALKQTFIWDYEFHFYRLIARACSGRKSLSPEWRCTWAVVFIHIYVFSGCMIGLTLFVGVVIANYTENRGTALLTVDQRRWHDLKARLKMAQPLHIPPKPSESATFRRTLYELTMCRLFNQFFAAMVVLNSATLILPWNVEEEEDKHRLLYIVTALSAILNMLFAVE

SEQ ID NO: 147209 - protein, 344 aa, Heterodera glycines
  Coding regions on vcDNA: vcDNA=SeqID_73632; Strand=-; Position=1 -43,438-1429
  Homolog annotation: Hit_ID=AAP30765.1; Match level="QueryCoverage =72%, HitCoverage=51%, E-value=1e-139, Identity=98%"; Hit description= putative gland protein G15A10 [Heterodera glycines]
MGSSQGLYNRSNTGDLTHALRQQRTEDNHISINGQIYSVDGPNVNVGVEGHDLSVNGRVYQNRATEQYLEIIQDKNIRNVIVSVPLSLFSRENITVGQTRHIHAECDGNLYIDQSADDCIRILCVDVKKDAAAKNFWSTSGGFNFRSTSVFYNFSVRGTLHIHNSSLECANIECDASLNVTHSPIERNAQMKCGGSLSIDESPMGNIRLNCDGSLRIEKSKMESSQIDVGGSIGIVESPMGSIGIDCGGSLRIEKSKMEIGNLDCGGSLTIVESPAQSLKLNCGGSLNMKESPMKNVGINCGGSATIKKSKMESGRINCGGSFSIDRTPTGSVRINYGGSRINL

SEQ ID NO: 147210 - protein, 203 aa, Heterodera glycines
  Coding regions on vcDNA: vcDNA=SeqID_73633; Strand=-; Position=1 -226,437-820
  Homolog annotation: Hit_ID=AAP30765.1; Match level="QueryCoverage =100%, HitCoverage=47%, E-value=1e-112, Identity=87%"; Hit description=putative gland protein G15A10 [Heterodera glycines]
MEAGDVDIIRQQHIRYYADIDGRKYPTEGPDYDVLLYGTDLLVDGKLYKNAVPTGYINYINRIEERIPVLGSSGRRSVSLPEIPIGGNSDYINTGHNKHDGKPTFGDTKREEKQKNKQKQQKRGELIGGNFTHINNQNNENIGGTQDIGRIQIGGMPPGGALHLNTGGNRNVGGTQMIGGIKIGKMPTGGTFGLDIGGNRNVG

SEQ ID NO: 147211 - protein, 243 aa, Heterodera glycines
  Coding regions on vcDNA: vcDNA=SeqID_73634; Strand=+; Position=1 -64,164-370,471-695,742-928
  Homolog annotation: Hit_ID=AAP30755.1; Match level="QueryCoverage =100%, HitCoverage=100%, E-value=1e-120, Identity=90%"; Hit description=putative gland protein 29D09 [Heterodera glycines]
MSSLLLSIFPIVFLVCCNAMPNFPCCPGSQQVVAVMSKYIDTFSSAADESTVCSTAKSTVDGIKNELSSRGGCQNGGEAQIVDEIDRQLKNIAKMEINYEDECPYNLGFARAMFDLAAAAAGHAGNGTEWQYMKVQFEQESQAIKAIGQEKNFEVTDVHIGVPSKGVSAHQNVPSPSHVIANVSAHQNVPSPSHVIANRGQHSSVPRKERRTVVIGLRFLRTNKSGGNRIENHFVDMSNIYLK

SEQ ID NO: 147212 - protein, 114 aa, Heterodera glycines
  Coding regions on vcDNA: vcDNA=SeqID_73635; Strand=-; Position=1 -153,226-325,837-925
MPNKFLPYELVFEIVHFIRFHKKWANLNVSRKFDRPLLKRMAQWLIIMKKREEQCKGAAKEILNTIFNLLPQHVRRGAIESLYNALAEIANGNCRLPNFKNLGQMGLRAEDGNY

SEQ ID NO: 147213 - protein, 189 aa, Heterodera glycines
  Coding regions on vcDNA: vcDNA=SeqID_73636; Strand=-; Position=1 -128,175-185,406-534,707-922,1125-1210
MDNANVVNPNPALRPTTTTPAPRKDKDGMATLADRKIVQGHGLETDTKMKCKLRTESENGELNEKLNTKEETECEKTMKCSATFCKANDGALVWNRWSCFPADAKKKACAKEAPNAVNEHRAEWSASKLAEGTDWKCRCRFGANGTEMGNAKFVPSSAPVPKTIRHGNGGGMVLMMAGLIIGKFNDFIK

SEQ ID NO: 147214 - protein, 92 aa, Heterodera glycines
  Coding regions on vcDNA: vcDNA=SeqID_73637; Strand=-; Position=1 -11,78-345
MNRRDVWMDILPSFDHAQLGLKLALLSDRFDVLVDTHFDGKSELTIWRKIKICEGIGPESKLSVRIDDNWVDFQLPDHSLPNKIRFKELQIS

SEQ ID NO: 147215 - protein, 21 aa, Heterodera glycines
  Coding regions on vcDNA: vcDNA=SeqID_73638; Strand=-; Position=1 -55,249-259
MIRRVTTVIRRGTMVIRRDKK

SEQ ID NO: 147216 - protein, 84 aa, Heterodera glycines
  Coding regions on vcDNA: vcDNA=SeqID_73639; Strand=+; Position=1 -59,155-296,1146-1199
MDTGGPSLMGIGYGEPSLMSFYTFLKSLNSLTSFTLPTYNMFNASSLNSIKYPCLLIQNGGTEKQPLGQKCSKNTRKTRFIEFI

SEQ ID NO: 147217 - protein, 60 aa, Heterodera glycines
  Coding regions on vcDNA: vcDNA=SeqID_73640; Strand=+; Position=1 -95,406-442,513-563
MVRIGILGMEVRSLIRDSNRSRIGNPSPGVMSFGVGGYEPMKCLLFPPLQILHFEHSHRS

SEQ ID NO: 147218 - protein, 72 aa, Heterodera glycines
  Coding regions on vcDNA: vcDNA=SeqID_73641; Strand=-; Position=1 -47,1143-1314
MRHASAIQLQEGRSVQKSENGIYNLPNEEKIFSLNQVMRRWHWMNTFGARTESQVIRRGKMGKSLKGQKCSD

SEQ ID NO: 147219 - protein, 41 aa, Heterodera glycines
  Coding regions on vcDNA: vcDNA=SeqID_73642; Strand=-; Position=1 -22,278-381
MLFKPYPALFLQNFGQKMGRLSLFGKWDRTCHEPEKPEPGF

SEQ ID NO: 147220 - protein, 42 aa, Heterodera glycines
  Coding regions on vcDNA: vcDNA=SeqID_73643; Strand=-; Position=1-183
QQMEPAHCHVFSWELNSRTPLCYRFNLGISRRVFSNCELNST

SEQ ID NO: 147221 - protein, 51 aa, Heterodera glycines
  Coding regions on vcDNA: vcDNA=SeqID_73644; Strand=+; Position=1-153
FEQKVENSNFRFSHFWFKLCLNTRKRTEIQHCFNKRSFEPLLAQKCENRKF

SEQ ID NO: 147222 - protein, 157 aa, Heterodera glycines
  Coding regions on vcDNA: vcDNA=SeqID_73645; Strand=-; Position=1 -99,535-571,616-782,1035-1205
MNESAMTEENITYSGSFATTVHYVNTPLANSLNPCFSKYIPPVFDGDYVDIDAIMEINQSEYINKSMLISSNAGREMPKYQSHNATDYIQVYPNATSELRKTDDSLRAPMRRSSSLYDFFVSQQPPVHSLAKKNNEAKYYARNWEFGREVSFRRLRI

SEQ ID NO: 147223 - protein, 471 aa, Heterodera glycines
  Coding regions on vcDNA: vcDNA=SeqID_73646; Strand=-; Position=1 -99,517-559,618-706,757-829,995-1225,1703-1807,1854-2629
MGICRWLGRKEEVSLFDNGLRIESSLKILTDDKQCREHGVLEGVVEGRAMYFVKCHTIPKDNSVIKLNSRSARIHITRYALVIVQEVPPKQRLYLNLEDLSVSPEGAVIGLFWDEILVKTKQYLHQGSQASRMPSLKSSSLGQASSSHQQLLFSPSPLYANEGRQTPSPIFASLYANEGRRPHSQSFDEGEAEPPPLKKKSIEEGPYAIPVDLGSERGGGFSVEDLLIESDPAQSKEDAQDRAFEDLQFIEGTPAQFLNQQLVSEVTHFSPNAAPPGLVKPTSDSPFLTFAENGHHKIGKSLSRKLKRQLTGSYTVRHFDFAVHLNSKKYDGDKSNSISYTRESNESANCGALLPTKPVISMADKAISKQSVENELVNCRRKNEPFVTSSIRIDSAIQRGSERLKWSQRSSTSNSQRESSVEREEHRSHSEESSLCENAVAILATQCGMDETNVKVEEESVRLLKSEEEMY

SEQ ID NO: 147224 - protein, 270 aa, Heterodera glycines
  misc_feature (253)..(253): Xaa can be any naturally occurring amino acid
  misc_feature (257)..(257): Xaa can be any naturally occurring amino acid
  Coding regions on vcDNA: vcDNA=SeqID_73647; Strand=-; Position=1 -182,342-435,477-615,661-746,790-950
  Homolog annotation: Hit_ID=NP_997869.1; Match level="QueryCoverage =86%, HitCoverage=29%, E-value=1e-35, Identity=41%"; Hit description =Unknown (protein for MGC:77063) [Danio rerio] gb|AAH68190.1| Unknown (protein for MGC:77063) [Danio rerio
KIKKINNYYLFPANVGKTSLIDVLVYDRFSDHVPARSGTIQFPREFSEDGVLTQITDYSGRVQSDEELRSMIREANAICVVYSVDDRRSEERVTSYWLPLIQETLGGSNHNVTSYWLPLIQETLGGSNHNCSVLLVANKSDHQNGGDLVKMAPIMNDYLEIETVVECSAKIIKNYLEIETVVECSAKIIKNVSEIFYYAQKAVIYPFRPLFSVEKREVIYPFRPLFSVEKRELSIKCQKAITRIFKVKINHMXFDCXLVKFVIQFQLCDP

SEQ ID NO: 147225 - protein, 106 aa, Heterodera glycines
  Coding regions on vcDNA: vcDNA=SeqID_73648; Strand=-; Position=1 -46,97-217,295-446
  Homolog annotation: Hit_ID=CAE69934.1; Match level="QueryCoverage =90%, HitCoverage=41%, E-value=8e-13, Identity=41%"; Hit description =Hypothetical protein CBG16310 [Caenorhabditis briggsae]
MPAWVAKLVPDWLNHVSHTAPVAFVLVDTLLTCHHAPDRKIGSTVVVALFLFYVGIIISVRLISGHWLYPIFDRLSNQQIVGLLSTAGALFWFLYLIGDGFNMALW

SEQ ID NO: 147226 - protein, 167 aa, Heterodera glycines
  Coding regions on vcDNA: vcDNA=SeqID_73649; Strand=-; Position=1 -86,460-814,958-1020
MRVPLISLSAFHFVFPSLILLTSFLFPVRSSNCFTTRRLPLSQFAQFGHALLCPNSILLLLPLFSRLHLYVITRESKNMDIKSRNMAIKYGPKIAKYGHKMAKISKYGNKWQKCQNMDINFSKLSAKFLQIYWLKLHMRYISKFFDSRKINNKSEIFAFLLIFDIIY

SEQ ID NO: 147227 - protein, 51 aa, Heterodera glycines; identical to SEQ ID NO: 124998
  Coding regions on vcDNA: vcDNA=SeqID_73650; Strand=+; Position=1-155

SEQ ID NO: 147228 - protein, 91 aa, Heterodera glycines
  Coding regions on vcDNA: vcDNA=SeqID_73651; Strand=-; Position=1-275
MEREWEESDWKMKLRMEPRRRNGTETNAENVDGKRWEANGKTNNAQDNGNFYGTKTEEKRNAIPGKRAEEENGIKKEEEGRNEPRMVPKPW

SEQ ID NO: 147229 - protein, 26 aa, Heterodera glycines
  Coding regions on vcDNA: vcDNA=SeqID_73652; Strand=-; Position=1 -13,194-261
MLTIAAASHLGKGLFNILCINYLSNL

SEQ ID NO: 147230 - protein, 88 aa, Heterodera glycines
  Coding regions on vcDNA: vcDNA=SeqID_73653; Strand=-; Position=1 -154,246-358
MTCTFPNVAFLTTVRSEAFYGLTVAASLLGLLSVRGLCFRRNVSNRCVTGEEKELKICRPNALSIKIKSNKKALADCAKMLCPKVDTT

SEQ ID NO: 147231 - protein, 125 aa, Heterodera glycines
  Coding regions on vcDNA: vcDNA=SeqID_73654; Strand=+; Position=1-379
  Homolog annotation: Hit_ID=XP_309989.1; Match level="QueryCoverage =82%, HitCoverage=37%, E-value=4e-15, Identity=35%"; Hit description =ENSANGP00000015194 [Anopheles gambiae] ref|XP_319667.1| ENSANGP00000022407 [Anopheles gambiae]
KNQTEAFQALLQNAQTNPNSVNHSTIYSTINSQLGQFTYNPELDLTFQAWLDRFGPFIQVDGKDLPDAMQVRLLLGKLGQEEYARHAERVLPRLPTDFTLAQTIDKLKILFGETKSIFTRRYECF

SEQ ID NO: 147232 - protein, 305 aa, Heterodera glycines
  Coding regions on vcDNA: vcDNA=SeqID_73655; Strand=+; Position=1 -309,2297-2381,2430-2692,2736-2870,2946-3071
  Homolog annotation: Hit_ID=XP_417027.1; Match level="QueryCoverage =70%, HitCoverage=43%, E-value=4e-68, Identity=56%"; Hit description =PREDICTED: similar to hypothetical protein FLJ22054 isoform 1 [Gallus gallus]
MAFTGIAATLLPAGRTLHNRFGLALDMSNSNIGPRSKAWQELKETDLCICDEAPMINKRAMRTLDEKLKEIMNNGIAFGGKVMLWTGDFRQTLPIQKHATRAEKCYEQKQYKVGLRCAKQIMSNPIYAEHGETLAMKGLILNCMGKHEEAQEIVKKGLTADLKSHICWHVFGLTQRTDKKYDEAMKAYKMALRIEPENMQILRDLSVLQVQMRDFEGYRDSRYKLLELRPSNKMGWIGYASAYHLQGEYAMALGIIKEFKKNNKPTSNVDYENSEILLYEVMVLTEAGRIEDALNKLEENSELHN

SEQ ID NO: 147233 - protein, 58 aa, Heterodera glycines
  Coding regions on vcDNA: vcDNA=SeqID_73656; Strand=-; Position=1-278
QRRGTQVTVGLPNETFRVGRLPPPPFCIIKFFLFLLNEASGRDMKLFLFAFSYHFQRM

SEQ ID NO: 147234 - protein, 222 aa, Heterodera glycines
  misc_feature (36)..(36): Xaa can be any naturally occurring amino acid
  misc_feature (48)..(48): Xaa can be any naturally occurring amino acid
  misc_feature (58)..(59): Xaa can be any naturally occurring amino acid
  misc_feature (135)..(135): Xaa can be any naturally occurring amino acid
  misc_feature (151)..(151): Xaa can be any naturally occurring amino acid
  misc_feature (218)..(218): Xaa can be any naturally occurring amino acid
  Coding regions on vcDNA: vcDNA=SeqID_73657; Strand=-; Position=1-673
  Homolog annotation: Hit_ID=BAB33421.1; Match level="QueryCoverage =82%, HitCoverage=65%, E-value=4e-69, Identity=73%"; Hit description =putative senescence-associated protein [Pisum sativum]
SKNIAILPRRDSDLEAFSHNPSDGSFAPLVYRPSTXTKCLNLRFLSYXAGLLLATGLXXGKTNLSHDGLNPAHVPYWWVNNPTLGEFCFAMIGRADIEGSKSDVAMDAWPPQASYPCGNFSDTSCWKLYTLKDRXATLLRSVFVLKIRIKXAFAFLLYERFPSSLSSLGHLRYALTDVPPQSNSPPDTVIGAGRRATGWPDLTPKWTPLRAHSRFTDXVRNR

SEQ ID NO: 147235 - protein, 141 aa, Heterodera glycines
  Coding regions on vcDNA: vcDNA=SeqID_73658; Strand=+; Position=1-512
FRLGHFLRPKGLRALIPRVFSNASTLVHRQGVPIHELIGLVNHGNTPLTRIPTPPPTLGSASPVLSSPQHLCLRPHLHKSINSPNFFNTQTSCMFYSFRQLPNAGETEATTKVAPQQQPSPFNAEHKRKQALEPRRPRSPQ

SEQ ID NO: 147236 - protein, 41 aa, Heterodera glycines
  Coding regions on vcDNA: vcDNA=SeqID_73659; Strand=-; Position=1-123
MARDKVMKKTHGNYPAPLRILDVVRTGLVDGTQEGYEEETK

SEQ ID NO: 147237 - protein, 392 aa, Heterodera glycines
  Coding regions on vcDNA: vcDNA=SeqID_73660; Strand=+; Position=1 -587,758-949,995-1394
  Homolog annotation: Hit_ID=NP_505267.1; Match level="QueryCoverage =93%, HitCoverage=9%, E-value=6e-34, Identity=30%"; Hit description =regulator of Presynaptic Morphology RPM-1, Synapses of Amphids Defective SAD-3, Synaptic vesicle tag Abnor
DLLPVIRSLLSVVSNALSTSSDTLLTTESVNSRAKESHDEQNLCQFKFDDLSSEAQLDASSRAQMVGCLVDGNCDTFWESGEEERGRTERRLRAANFGPGALLLALFIDNAKDEGFRVGRLSITSPGRREDEAARGDEAVQRGDDEAKHLLDTSLDKVRMHCRLVLITNDGLQLRNFPDGSNVPSMDEKASKFAFGGAQSDAFALFQLLATQVLCDRIAPEGTEDNALRETVLDMVTARGQLMHPLQQFVGTHLANGIQREVQSLRIRRRRNFSYVNALLQLLMRMNSAAAQPIVHAYDHHLLMALSDLWLFASEAVQEKALKAFECLITAGDGGQREGKVPEGTEMGVLAERLLVTVVKVLQIQVKEQRAAAFGTNRGRQQLTKHTIGVSN

SEQ ID NO: 147238 - protein, 276 aa, Heterodera glycines
  Coding regions on vcDNA: vcDNA=SeqID_73661; Strand=-; Position=1 -151,776-1154,1290-1590
MHNDSIIVDLSFRVLSADVPGNAPQPPPHSYSKRIRAFRFTSLSSSFKGFIGQFVISARAFVLLLHCFIASQKPSGDHLAACPATDFACASAQFDKSDQTVRVDQNEQQRMMLVGADQPESVAALVEVHSRCQHSQNADTNRLCAMALVSSAQMQNGKTVTAQRKGACLTAQLRARAQSMPPIAAKAATDNQKEARQTQCVSELLLESESWKEEHRLSTKCASWARRAARQGEGRSERRKRMTKRADSALGWSEMAQCGGTSQARVLTNGKGPIRK

SEQ ID NO: 147239 - protein, 118 aa, Heterodera glycines
  Coding regions on vcDNA: vcDNA=SeqID_73662; Strand=-; Position=1 -193,645-808
MRGKDIGLRRINGKGRHGVRREEKRRDAERGKVPLRRWVGKEKPEPAGGKAKGIWTDLANLFISQIWKSSTNWRNAIEKLWKTGKRNAGNFAKRSVRNCANCDKCHSPKQILREKKGN

SEQ ID NO: 147240 - protein, 173 aa, Heterodera glycines
  Coding regions on vcDNA: vcDNA=SeqID_73663; Strand=+; Position=1 -114,177-309,468-554,1150-1337
MTKMLKQNGGGESAILLPHQPNSSTLIGSSDECDIVIKSPGLRPKHAVIEFYPKTKSFWLRQLDAKNEQQQQQQQQKRRMDSVPPPPPYPYEDTVGPQNLSDNTRQQVLRDESHSAEGTRRPFCPPQTAVKPQTLPTRWPPNAEAIAKCTAAAIIKWSKFNKKLNEKINNQLG

SEQ ID NO: 147241 - protein, 102 aa, Heterodera glycines
  Coding regions on vcDNA: vcDNA=SeqID_73664; Strand=+; Position=1 -113,232-427
MYQRNILDDPVELSRLLRQAERDHFRAAEQMRTLRKIVEKIAAAKKSVSFRDDKAAANTVSTYMSDLISNRGGGCLCNDTSIFIQEVGSIYYLNAFVIATGI

SEQ ID NO: 147242 - protein, 88 aa, Heterodera glycines
  Coding regions on vcDNA: vcDNA=SeqID_73665; Strand=+; Position=1 -140,221-296,1201-1251
MCNTLMESPLTPAECTSMVETIFQGAISISMELTSEDVLCNLVDKNCSEKTYNKTGPISCEYCKIMHAKAKTEWRSEFRKLKESRLIF

SEQ ID NO: 147243 - protein, 234 aa, Heterodera glycines
  Coding regions on vcDNA: vcDNA=SeqID_73666; Strand=+; Position=1 -104,304-448,535-719,802-877,975-1169
MNVFDDPAKLLRLLRQAERGHQKAAEQMRTLRKIVEAEVAVDKGVSFREEVVATNALDLYLLNVLNKTGNGCLCNGTSIFIQQGLTSSFIGGSLGMQIMCSSLTASPITPAECSTMVNTVFQGAVLIALELSSADVFCNLVDKKCNTMTYNNTSPISCAYCRLIHAKAKKVAEHFDSMFSGLKVMCSRLEKQTLNESCKSQVKLLTRKIKQIIEAFLDVDEAELRCLHIFMCKE

SEQ ID NO: 147244 - protein, 17 aa, Heterodera glycines
  Coding regions on vcDNA: vcDNA=SeqID_73667; Strand=+; Position=1 -30,220-243
MIAQNCRKNSTNLRIIH

SEQ ID NO: 147245 - protein, 223 aa, Heterodera glycines
  Coding regions on vcDNA: vcDNA=SeqID_73668; Strand=+; Position=1 -276,562-957
MYSQRIGCRSVMVTDHPLNSNWCYKWTAAGPEKEEGQRYVCSGCRRIKDKKEVPSDTKLPARKRLGESWADSGPKYPHFCQPFSKTELLGVEELSHAEEESAVAVDEGRELPSQPLQLTIELDNAIAGEKANILAFLRTDYDDEQFTTTMSNYYGRIGHLIGFNPVQRNELDEMIIDDDARNLAEQSLDENGLLNADLPFDGLDEIENFARRQARRECYYFNR

SEQ ID NO: 147246 - protein, 298 aa, Heterodera glycines
  Coding regions on vcDNA: vcDNA=SeqID_73669; Strand=+; Position=1 -842,2461-2516
  Homolog annotation: Hit_ID=NP_496808.1; Match level="QueryCoverage =96%, HitCoverage=12%, E-value=7e-37, Identity=33%"; Hit description =integrase, catalytic domain containing protein family member (2N547) [Caenorhabditis elegans] emb|CAB0249
ARQQVRRVLGQCRQCRRLRGMAYPLPTMPPLPMDRVRRRVPFESVGLDFLGPTATLDDSGQRQKAWVLLITCLTTRAIYIDATRDLSAKSFIALLRRFIARRGAPSRILSDNAPTFTIVGKTLGEFGITGDNPLEFADSRGIQWRFTPQHTPWAGGIFERAVQLVKRALQKTLGSCVLDYEGFSTLLAEVEATVNSRPITYVNGNPEEPLPLRPIDLIQENGRLIESTAGILRTERPTTRTTARTTDETMRHSQQRLEHFWRRWHPEYLMALREKAGWNRQMSSICATVGNVPLLTLS

SEQ ID NO: 147247 - protein, 1187 aa, Heterodera glycines
  Coding regions on vcDNA: vcDNA=SeqID_73670; Strand=-; Position=1-3564
  Homolog annotation: Hit_ID=NP_498959.1; Match level="QueryCoverage =56%, HitCoverage=30%, E-value=5e-87, Identity=32%"; Hit description =zn-finger, CCHC type and RNA-directed DNA polymerase  and Integrase, catalytic domain containing protein
MDADKIRPILELPLPSSKKQLQSFLGFMTYYRKFIYGFGSLAAPLFHLIKENTPFVMGEKEQKIVNFLKRKVLEDVVLYFPDFKVAAENALRRFIILTDASKFGISAVLCQPDELKNVRPIYFASRQCNKYESKYCPTELEALAIRFGTRKFSQFITGIPCRVITDHKALIPMFRSKKETGNARVDRWLMEVNARYQLSVEYQPGKQNVVADLLSRVGKQSDTEKMENLLDDCPSEVVVIKKLSIKEIKTNADIEKLDRKEWVEQTKSSELKGIYEFFEKRETPQSINEAQSLMDKINNFALIEQLLYFVDQKTGSFRLFVPEKYRKELIKRRHEGKCAGHLSGKKLWRQLCELYFWPNMMNDCLKFALSCRICAHSRKPRKNEPPMQIVKTLEPLELVCLDILSIGPSESENRYVLVAIDHFTKYLIAVPLTNKNSETVARAFVNEFILVFGTPKRLHSDRGGEFVNETLAEISKLLGVEKTVTSGYDPQANGVTERANQTILNMLRKSTGSNWSWDERLPFIVFCYNTTPSEVTGFSPYQLLFGKPANFPGEQDVNWQTNPNYTIDEETYIQLFRENLKDIISIAVKNSEIAREKSKKYYDKRPNVTENKFSKGDRCMVLFPGSNARSPHKKLLWNNFGPYKIVEISKSSAKVVPVDKRAEPILVPIERLIRVPPELPNISTLPRGKNMYRNVLNALIAPKSWTKKKNDRIGPKKLEIEEGNSNSQLGTIEFLDGAMELDKDESYALTWSSICDGLGHEICSKVKCVDLDPVLETSSEMGQTVVKTPLQALLSAFLFRSGSAVSASAAQELVRLVVKSDPGFELILYEGGRRDNVKSGTFPTVAQMEDIWHIWAKNCVLAREILANSGFSTITVINNGKKMENSLTIQMAVPPALEKLTESEKTGWTTLFDNTGLVLERVRAKLIHNAAIFIDTPRVLVGDSSCHQLLAEMRDQTHFVGVERGPLPMVIRALSDCVLSSNVQAVLICVGRDSLVQSETVDQMMEQCVRLKQMCNRFCSAHVFWIPPPYVRQRDKEFGEFVTRLAQLVPEWFVGVTSTGRSILEIFRHGDTFDTTRVAADGWMSREGVKTLAAWVQSQIASFPGNRELGIRTVRSAVHVVRQNRSGDSGPGDRPPLRSITARSGMGRDDHPVSGQQLRMHPYRGFGRGSMSSVAGGRRFSRWHRWQ

SEQ ID NO: 147248 - protein, 691 aa, Heterodera glycines
  Coding regions on vcDNA: vcDNA=SeqID_73671; Strand=+; Position=1-2076
  Homolog annotation: Hit_ID=NP_510849.1; Match level="QueryCoverage =89%, HitCoverage=45%, E-value=1e-129, Identity=39%"; Hit description= predicted CDS, zn-finger, CCHC type and RNA-directed DNA polymerase and Integrase, catalytic domain cont
MPAPHDKSTLRSFLGALTYYGKFIKQMREIRSPLDELLKKDVPWNWEDEQQKSFEKAKEIMLSDLLLTHFDPKLPIIVAADASKGGIGATISHQFPDKRERVIEHASCTFTTAQQNYSQIEKEALGLVFAVQKFHRMLYGRRFTLLTDHKPLLAIFGSTKGIPIYSASRLQRWALILSNYEFDIKYVNTKAFGNADVLSRLIANYPRPSEDILIANICNDTDCCVNFVFEAKIEQLPITAKIIAEESAKDEILQQISAFTKQGWPQKLDDIKLSPFLPKKAQISEIEGCLAYGERIIIPSSLRNNILKSLHFAHPGIVRMKAIARNHVYWPGIDSEIERVVKQCEECHSAAKNPTKATLQPWKAANGVFERIHIDFAGPCADGQTYLVLVDAYSKWPEVWQMERTSSQLTISMLKSFVHRLGIPKEIVSDNGSQFRSAEFAQFCKEFDIKHTFTPPFHPMSNGAAERFVDIFKRSMKKCRQEGKDWLQKVLLAYRTTPNTALNGHSPDELFLGRRMRTRMTLVHPEKQKLQPTNLENFQQFQGQYIKKMENQFNTKHGAKSTIFQNEEPIYFWNLKNNKAIWLPGKIIEKFGTSPTYRILAPTLGRAIHRHANQIRRRFPIELEDNDQVEENDQTQAQNPPHSPIAHKPQTNRQQTPAAEPVHLRRSGRAKQAPQRLDLDPSKPKYGLIRS

SEQ ID NO: 147249 - protein, 100 aa, Heterodera glycines
  Coding regions on vcDNA: vcDNA=SeqID_73672; Strand=+; Position=1-302
MDAQQLQQILDAALKKSAEVFAAALNIQNQNLNPGSSTTASLAASINARLEKFNYNPEVGQTYDAWLNRYGKIVQQDGASLPEQSKVQLLVGKLNEEEYK

SEQ ID NO: 147250 - protein, 157 aa, Heterodera glycines
  Coding regions on vcDNA: vcDNA=SeqID_73673; Strand=-; Position=1 -134,312-400,501-694,752-786
  Homolog annotation: Hit_ID=NP_609397.2; Match level="QueryCoverage =91%, HitCoverage=18%, E-value=3e-28, Identity=45%"; Hit description =CG5355-PA [Drosophila melanogaster] gb|AAF52942.2| CG5355-PA [Drosophila melanogaster] gb|AAV36957.1| LP0
ISVPDPYRGLENATANATKQFVEEINNISQPYLNATTVRQKLNHSLTKMWNYEIFFTPEFCGGLFYYYHNSGLQNQRVLYQRVLYQTKSLNSTGKVFLDPNTLSKDGTTAVTLESFSDDGTVFAYGISEKGSESVTVKVGQTKHGEGEDLPDQHNDL

SEQ ID NO: 147251 - protein, 42 aa, Heterodera glycines
  Coding regions on vcDNA: vcDNA=SeqID_73674; Strand=-; Position=1 -19,661-770
MSAFIDKSDDDKEGEVPSQTEDNGTGLMSNILKKTAVALALV

SEQ ID NO: 147252 - protein, 63 aa, Heterodera glycines
  Coding regions on vcDNA: vcDNA=SeqID_73675; Strand=-; Position=1 -82,133-242
MKFLILCLFFAVLLKYSISQKPQKGKKESDDDKEDEVPSQTEDNGTGLMSNILKKTAVALALV

SEQ ID NO: 147253 - protein, 114 aa, Heterodera glycines
  Coding regions on vcDNA: vcDNA=SeqID_73676; Strand=-; Position=1 -28,159-474
AALSCSRVLACLFYRLFAAPLSPYPYELYKCPVWQFQLRLGIILQLNGSTKAEEITMSPGITHHWPLAKLSVTFTPSGLPPLPILGNDFIANRSHAALVPEWHSHLHCDSEFAA

SEQ ID NO: 147254 - protein, 295 aa, Heterodera glycines
  Coding regions on vcDNA: vcDNA=SeqID_73677; Strand=+; Position=1 -156,264-372,430-566,615-745,791-934,977-1057
  Homolog annotation: Hit_ID=CAE69571.1; Match level="QueryCoverage =89%, HitCoverage=81%, E-value=1e-90, Identity=62%"; Hit description =Hypothetical protein CBG15783 [Caenorhabditis briggsae]
CVQLSVKEVMLEMSELQSAEGTQKLNSRQPLASCTPSCSCRRLTAQAAHRMGCCCIPGLPGPPGPPGRSGVPGRPGAPGAPGFPGRPPAICEEVTICEEVTPPPCIPCPPGQPGPPGSPGEVGSPGPVGHPGRPGNDGPPGPQGPPQGPPGIQGEHGDIGREGTRGEPGRPAISTPALPGDSGPSGEPGPPGFPGPPGFPGEIGEPGRPGSEGLPGPQGPSGAPGPPGPPGRPGEDGTTGHQGPPGERGICPKYCALDGGVFFEDGHQGPPGERGICPKYCALDGGVFFEDGTRR

SEQ ID NO: 147255 - protein, 523 aa, Heterodera glycines
  misc_feature (223)..(223): Xaa can be any naturally occurring amino acid
  Coding regions on vcDNA: vcDNA=SeqID_73678; Strand=-; Position=1 -84,847-952,1037-1169,1227-1556,2852-2990,3056-3198,3257-3389,3548 -3751,3793-3854,3917-4001
  Homolog annotation: Hit_ID=CAE67763.1; Match level="QueryCoverage =90%, HitCoverage=54%, E-value=8e-92, Identity=43%"; Hit description =Hypothetical protein CBG13338 [Caenorhabditis briggsae]
LIELLFFNSAYRICSNYSPVSINFAVSTFALHDDQFVFVTGSHEHLGNWETGKALKLDKRENGRWRWVGLVNLGADVLKFRYFIGYYLQSEEDKGPVLAVSKWETHSTPRCVMPPVEASTAGICRANLRCVMPPVEASTAGICRANLRDIFGFSGGREFFSDGWVLTDEMHQILMTVSGEALKFYKQKHIREEYRLKMVPFDLRRKSDWKGHKIKLGRNDRKXRGEEGHLATSKITHFSAHFSLSLDAPKFRDQEEFGEPFHNKVDYFMFRTQSVAVEFLAFRLEVYSKFRLEVYSKSDKLVALGYALPSTLHDTFGRTSVPLLTKLGVPVGKVYFSYSYLFIRPLRLPHPNPTMHNCYAKHWKKRSTLEVGHRGMGNSYTKCAVARENTLHSLSSAYKNGADLVEFDVHLTKDKIPIIYHDFHVMVWVAKRLPTAAPPRAAGQRMAKRMMDFYQLAVKDLELKKLRLLHAKRMMDFYQLAVKDLELKKLRLLHLDLDHPSQREQLAQCVILRTIDGSPVHMT

SEQ ID NO: 147256 - protein, 78 aa, Heterodera glycines
  Coding regions on vcDNA: vcDNA=SeqID_73679; Strand=-; Position=1 -14,702-794,1037-1080,1858-1943
MRPGRHDHFTVKCTIYLRNTVLFVDTEIGLPISQRVIFGLQNIDFIEELKIHIIVSFYCVFIVVFFADKLKFVLIYFK

SEQ ID NO: 147257 - protein, 304 aa, Heterodera glycines
  Coding regions on vcDNA: vcDNA=SeqID_73680; Strand=+; Position=1 -108,181-249,562-783,1200-1451,2456-2665,3146-3199
  Homolog annotation: Hit_ID=AAH55680.1; Match level="QueryCoverage =67%, HitCoverage=40%, E-value=2e-16, Identity=31%"; Hit description =Unknown (protein for MGC:66492) [Danio rerio] ref|NP_956104.1| Unknown (protein for MGC:66492) [Danio reri
VHKNIPREKYAEIWKLVENPIVILHDGFIHFNSVQLQLDEEVRFTCQLLGAELALPKKELYDAIEKVLYGLIKQNDDVQQSLSASITLFHTFCLNYERRKAALETIDKYVRNLIEQPNEQKFLKIRMSNKVFEEKVRPVKGALEFLGAIGFRMQKSVPTVVQQPDGTSATVISNEPYLVMTPPNEAYVKALCKQLGEALVQLKTGEPIQLKLFRDAKGIFRETEKFSSVRAFVAEHISFKHGMFNLIPAVPPQKHGRKQLREENNTLKEYGLDQSGVVNFSWDSETQEIITQLPDDQQPVFILQ

SEQ ID NO: 147258 - protein, 161 aa, Heterodera glycines
  Coding regions on vcDNA: vcDNA=SeqID_73681; Strand=+; Position=1 -61,119-279,802-891,948-1121
MSRSNDSINDEITPDQQRQEASEEHRVPMPSNLSPSEEWRLLSARMEELKRMNASGTVKWKPGELICRDGGAETHRNNDSFARMEVELRETKHLCTVTKLELENKALQSEMKQQQMMDELSSVKTQVDKIGQEQQQQKKEQQEKQEEDAKGKYGNIKGILR

SEQ ID NO: 147259 - protein, 346 aa, Heterodera glycines
  Coding regions on vcDNA: vcDNA=SeqID_73682; Strand=+; Position=1 -94,471-821,887-1048,1589-1679,1734-1890,2010-2195
  Homolog annotation: Hit_ID=AAV34698.1; Match level="QueryCoverage =38%, HitCoverage=53%, E-value=1e-24, Identity=43%"; Hit description =IC5 [Globodera pallida]
MENFTAALEEQQKKIGVLENFVGVVKERFGNAGFLLSDMMGAILSSDPDCSLFAKNPIPQENSGIFYYELEILNVRGYISMGLATKAMPLNEFVGRSNGCGYRSDGLFYIDTFCWDYKKAACSRGDVIGLGINLATRRLIFTKNGQRLDPSDLFFPPSADRLFPCVSLGSPGDKIEANFGPNFKFAFLVNYLFGMIKHLIINEWRTVFAKCAVPTTGSAVIFYFEIKVINEKQLTTIGLATKQQTPLAGRIAKRRGIFAYESDGDCSTEGRNRRNRRRQFGDGDTISLLWWIRCLLIRRYSLLFLWVIPATKLRQTLGRTSNSTSPPFSDLIKEEEICWKMAYFVF

SEQ ID NO: 147260 - protein, 426 aa, Heterodera glycines
  Coding regions on vcDNA: vcDNA=SeqID_73683; Strand=+; Position=1-1279
  Homolog annotation: Hit_ID=NP_494149.1; Match level="QueryCoverage =78%, HitCoverage=22%, E-value=4e-48, Identity=35%"; Hit description =predicted CDS, putative protein of ancient origin (2C297) [Caenorhabditis elegans] gb|AAF39854.1| Hypothe
MNLDRVFVNDRSNDNEQNLLYAYVFDNDYEVVESSYDILEEHNYSKRSRMDVVGGESQVSLNSDIGIAGPSRMSDSQFEERRRTEYLKRKRERERMRRENESQNQRVLRLEQMRDRNNSQRSEENAYERQLRLEQQRIRQRVIRQGEINVYAAGSYVNAHEHGLGLMNVRCEFCDALHFVGEKISGRGNSFKDCCHYGKVFVPEIPEQDFPEELRDLFMKFDARHVNFFENVRHLNSSVSFASMNPLRYRYPNNRGPYCFRIYGQVYHRMNLALNPESGDEPAYGQIFIVDTEQAMRAMRQSNVGVDPQLLRTVYEVIRNANPFAEAYVMMKEEEDDEVERARNENREPAEIKLLFETGRQLDRRLGYNVPRANEVAAVYVPGADGEVPDAKIVIRECGKELKILNSIDPMVTPMTYPLFYPRGTL

SEQ ID NO: 147261 - protein, 334 aa, Heterodera glycines
  Coding regions on vcDNA: vcDNA=SeqID_73684; Strand=-; Position=1 -180,1031-1207,1352-1495,1559-1765,1964-2052,2099-2143,2337-2380,2619- 2737
  Homolog annotation: Hit_ID=AAC34582.1; Match level="QueryCoverage =74%, HitCoverage=13%, E-value=3e-09, Identity=24%"; Hit description =interaptin [Dictyostelium discoideum] pir||T14867 interaptin - slime mold (Dictyostelium discoideum)
MDRRHQSADQSDSIKRQLIKECAEMEEQISQLYERRIKQEKQLAEKDEIIKRLESDLCFNHTIKMSEPTKDEQLAKLRKDRIGITAHVEELWEEDAIREKLFEEKDKTIKEMETTNKETKAELSQTKSELNQTKSELNQTKAALRQKEEENDLLKRKLAELQRVPVKFLDSAVAGVSLSALPSSSSVQILSVQKNIFADYELQPNSLVEHYNSCITEAEQELVTIFNQFGREQAEADQTIKQLEERIMEKEAEAKCRICLKHEFEGTGGTNASTKTYRHIGTQTTEVRASNSWTFVILMIVLFGTFAVCCIILYQIRTIQNAVTLHYVRGPPPA

SEQ ID NO: 147262 - protein, 134 aa, Heterodera glycines
  Coding regions on vcDNA: vcDNA=SeqID_73685; Strand=-; Position=1 -186,344-560
MQRASSRSGRRARSQLWKRTWMVSVCVARDREPARSQTPTTVKKSSTTSPSSSSSLSPASALQIYEDAYAYLCKWSRQFSEMDEVIGDWVIFESEPTSEKVRKAHRHFCGATTDDEMNDLYDEIAESQQTLELE

SEQ ID NO: 147263 - protein, 815 aa, Heterodera glycines
  Coding regions on vcDNA: vcDNA=SeqID_73686; Strand=+; Position=1 -223,826-1892,1948-3105
  Homolog annotation: Hit_ID=NP_507780.1; Match level="QueryCoverage =52%, HitCoverage=26%, E-value=2e-27, Identity=25%"; Hit description =predicted CDS, DNA polymerase type B, organellar and viral family member (5T899) [Caenorhabditis elegans]
MARVLDGRAEPLRVGLSVQPPGWDNCFHVPMRPPQQNSAHALAAALETFAKQYDELDLFSADVCFKVSAVWALPGAPVLCGLQAAGGPAHAPARLPGAVPPVSSLWLGRPCAREPGRAPSRCADCLFVFENADCFEAHRRRVDPPPPPGWQHDRRRGRPHRPMCEERRVCARCRQVVWTRHGAHACALNNNVGRQQAAQQQQQCDRCFGIHDAQWTPHFIQPKRAQCQLIVNDAVRPPVPAEGLDGDNDDDDDDDDNDGDADDVDDNDDGGDAEQNRQRRRRRPLRFLFWDVECAQVADENEEGDEGVPARVLKHVPLLVCAEVICERCVAAGVDLEREPDRRAPGCCCGGAAWRDGQHRQWLMRAREDAFSDDDDDNADGGRRWRRPNPRRLRFFHDAATGRSPMAQFADFVLHDGPVNVRTVMLAHNGGRYDVHLLMEELQRRGVRPRRLVATGLRVYTLELGGRNQRSVVAKDSLNFFGCALSKLPAMFGLDGVPDKPFFPYNYIRAENMDVAHVGLPPAADYDPDRMRPAERDAFQRWHAAEQQRRPNRLFVLRRELLRYCANDVRILRRACLRFRHVVGELSGGVEPFLAASTIAGLALAIYRQQHLPRDLMVHTPEGGFLRGRRASAASRHFFALLERLRPQWRGRLRTARWSIGEACVEDDGYRLDALLYRPVPLRPLVIEFNGCFFHGKEGGGLLFLHFFHLPRPRLPRVLPEAPSSVGGRPNRRVAVCQDTAACLGAGAAPRLRGAHGVGVRLPAVAAPPAHPSAAPVHGCVPGGARPDGPAPGRAVRRPSGAVRAPLHVHRARGN

SEQ ID NO: 147264 - protein, 401 aa, Heterodera glycines
  Coding regions on vcDNA: vcDNA=SeqID_73687; Strand=+; Position=1-1206
  Homolog annotation: Hit_ID=NP_001004509.1; Match level="QueryCoverage= 97%, HitCoverage=24%, E-value=1e-42, Identity=31%"; Hit description =si:busm1-180o5.3 [Danio rerio] emb|CAD60788.1| novel protein similar to DNA polymerases [Danio rerio]
MKYRAFPVGLPRVLSAEQLDRVRLPWTSVEQNPYRGFFHCRVLPPRPAELGERHALLPYRTRTGRLTFPLCAACAEWANADKKVQRQHRPVPRCRHRAAQRAWTHAYTDVELNAALQLGYRVLALYEVWHYDRWASLEAGNSLFAGYVDTMLRLKVEASGWPADCQTVEQRARYVARYADREGIRLEAGRVQPNPGLRAVAKALLNSLWGKLAQRAERDDVCYTGSAREFHELLGDPRQDVVDFVHLNEQLDRCVVRRRWPFVRAPDTNNLAVACFVTAHARLHLHGRLEEVRLAGGRMLYCDTDSVYFVRARRPPGPQQHQFLRSEGDAFGQLMREWPGRRIVQFFSAGPKNYGFRHRCAASGGDERAERKVRGLELTYTASQLLPFERMRQLVLNFFGR

SEQ ID NO: 147265 - protein, 241 aa, Heterodera glycines
  Coding regions on vcDNA: vcDNA=SeqID_73688; Strand=-; Position=1 -471,521-775
MDSFGTVAWILRPTAQTTGTAVGSMEYEEEENGTGKLVHSDTATVTTPTTAEFRLEKEAPSSEKDGAEEGSGGHGTLLFIESDDGEEEEEEEDEDIEDTPVATDSPSATTATVVDDSSNTVKGVEQRSSEHSDMTNGTGGGGGSEGAKLLGGGEEEEPVRMPLLNYLCAFNDCSMKELQLLFHSVHARQRMVSHLQQHCRLHTAHLKPAERNIALHCHDLSVQNANRTFACGGYLELTVIR

SEQ ID NO: 147266 - protein, 434 aa, Heterodera glycines
  Coding regions on vcDNA: vcDNA=SeqID_73689; Strand=+; Position=1 -985,1045-1363
MTLKHTVRMLLIPEDVYRRLMDNPSAAAATSSTTCMNKLPTPATPIEHTARKMVAASSKHTNDDERLIHYQQEFKRYQKLLEEEAERPLNVQLSQRTTNALRDTVLQKASPATATPPPARPQRTTPLSRRRGLQHQNQAPSASSSSSTRPTKSSSSNEQQQPLPQQTAAPQKIGDLPKQAEPRIHAAMAYAQQNPGLLGVGGEDGQQILHLAQGAYRPIRGSNLDTLLRYHFVGRHQQQQQPRSSTTTPTASVAKAPPGYKTFVNNARDDLQMWRLLFPDERAAAAGSDSASTVGGQPRRHQPLRGQKKTGAGRLLQPNHHAHKSVQKTSIMVIGSNAVRSLMVESLLDPIYKDERSPACFTSVEPLLREAKRRHPDARLTRAEISRYLAGQRVYTLHRQVRRRFRRLPTLASGLHTDWQADLADFQRLRAQNR

SEQ ID NO: 147267 - protein, 32 aa, Heterodera glycines; identical to SEQ ID NO: 127531
  Coding regions on vcDNA: vcDNA=SeqID_73690; Strand=+; Position=1-186

SEQ ID NO: 147268 - protein, 107 aa, Heterodera glycines
  Coding regions on vcDNA: vcDNA=SeqID_73691; Strand=+; Position=1 -47,194-470
MNGSIENDHEIYFYFLINTYSLNLLKMSLFSKQMSEQIASSIKDNYATFFPNSKEAKFAHKSNTAWDDLTNELNANFGSSVTVKQVKEKWHNMTKDSNRRFVDRKRS

SEQ ID NO: 147269 - protein, 83 aa, Heterodera glycines
  Coding regions on vcDNA: vcDNA=SeqID_73692; Strand=-; Position=1 -12,434-673
MAKIPQIVLVPSIVPVIVTAIALFLATNGPHNWPALWQELINPPSDARHAIRGPSPYSAHVRLSQAGLDMRRAQLMVSDRRQI

SEQ ID NO: 147270 - protein, 28 aa, Heterodera glycines
  Coding regions on vcDNA: vcDNA=SeqID_73693; Strand=+; Position=1 -21,70-135
MFNRFGPRYVFLFLTRELSVYVEFSKNV

SEQ ID NO: 147271 - protein, 287 aa, Heterodera glycines
  Coding regions on vcDNA: vcDNA=SeqID_73694; Strand=+; Position=1 -189,583-909,1269-1616
MRKLSSSKSLKISAKLDGERKNAFLTKPIKSLTDGVQPNVGGPVFSPNVFHEQNEEDKEYEKQTDNYVPFPLYWHAVLEHFDGKVPAKIIANILGRLITALKLCKGNHDYDVITSVIDFDGILTAEHFLALKKTDGPIFQETELRGDIAFIVKKIDVPANTRLAYMSPEQVMHNSYNHSTEEDIVWSLGVILFTMLINRHPLQGMANEHFNLAQQNANNNNRTVDIGTFLANSSEDMLPKWRKMITFYVRSEQELPLEYLKSSVGVGNDHVLLIPVIEVGLYERRDR

SEQ ID NO: 147272 - protein, 248 aa, Heterodera glycines
  misc_feature (15)..(15): Xaa can be any naturally occurring amino acid
  misc_feature (40)..(40): Xaa can be any naturally occurring amino acid
  Coding regions on vcDNA: vcDNA=SeqID_73695; Strand=-; Position=1-749
  Homolog annotation: Hit_ID=XP_479365.1; Match level="QueryCoverage =74%, HitCoverage=12%, E-value=9e-42, Identity=46%"; Hit description =helicase-like protein [Oryza sativa (japonica cultivar-group)] dbj|BAD32013.1| helicase-like protein [Ory
TIGECHVVNHTSSLXNLALLPILGNSVAGKDLVSDRKLPXFGSKSLIEASCHLKNHNYDELSKCAILSPYNTVVDKYNEEILDLLPGEQIYLSIDETDLSKNPVTPEILNSLKCSSIPDHEIKLKKGAMIMLLRNLNVKEGLCNGTRLQVTDLGKHVINCIIKSGDRIGEQTFIPRITLIEEKKFPFLLSRHQFPIKLAFAFTINKSQSQTFSKIGLDFNDDPFSHGQTYVALSRAKSWNDIKIKLSE

SEQ ID NO: 147273 - protein, 338 aa, Heterodera glycines
  Coding regions on vcDNA: vcDNA=SeqID_73696; Strand=+; Position=1 -204,494-682,823-1446
MIQNAFIFSFICFFNKIFFAKNVKPAINLIKYSAIISPPGFYKIAIWDRFEKKKAQQCKNLFEEVEQEFNGKFHAVRRFKYYDGIELEYFAECFENFFIAQTNEDGEFDVNLMGNIGETIFFQIFPLYNNKAPIRSDSFPSTFLQSIHRKPDWRLCVHFEQHFYFLIHKEKKTKIGTMLDNWQRSANANPSDEEAFFLKACLQEIASRIVDTFTKGIKLTNNEISIQRKYWSAFQQMKGHGILAGKLAQIDGMPKLMKDLCRFTVADYEANSADGFEFNDKLLPLAFFCAEFITNGNEKHESILERMKLVKFEKSGEEMNKCRHYLFYHFYFLWNGIN

SEQ ID NO: 147274 - protein, 351 aa, Heterodera glycines
  Coding regions on vcDNA: vcDNA=SeqID_73697; Strand=+; Position=1-1056
  Homolog annotation: Hit_ID=NP_922308.1; Match level="QueryCoverage =47%, HitCoverage=12%, E-value=8e-25, Identity=37%"; Hit description =putative gag-pol polyprotein [Oryza sativa (japonica cultivar -group)] gb|AAP54595.1| putative gag-pol pol
MRRYYGTDFMDFISEQGEEEEIGLNFKQGIVRVGHVQLPMIAAINIECRPIEVRLLQTHTLPPLSDSVGWGRINRNLSPEETFITAEREHDYFPIRVGKCLTSPGATRIVPLRLLNFGNCDIKVHGGSRLAVLEPLSADTHINWLRKCTETEESMLMNDEEWHKFKAESDQIPPEADWTDETLAFPKNGEATKPILERISLKESILSPGGMIKLRQIIETNEFVFVKPGEVGLFKGKTIHRIDLTEVARPCQQRPYRYPVALQPEIERQVKELLRQNVIRPSSSAWASPIVLVRKPDGSYSFCVDYRKLNQLTKRSTYYLPRIQSILDEVTGKKYFSVADWLQWILPHKIG

SEQ ID NO: 147275 - protein, 185 aa, Heterodera glycines
  Coding regions on vcDNA: vcDNA=SeqID_73698; Strand=-; Position=1-558
MGRKEEEKRNEEKKREIISNFYKIKEKIKEKGRKYSTKEWNKINTKIAKKLGTNRQYIAEWIKEFGLQKQIHKNYKSKTDEEKLEIVQNFIEMINEYKQKRKYTRKEWQQNYAEICKKIGVGHGTIYKWKKHFGIRSKITEKEKMEKMKIYWQTKREYPEMSEKEIAKMLKSDRTNISKWKKLFG

SEQ ID NO: 147276 - protein, 198 aa, Heterodera glycines
  Coding regions on vcDNA: vcDNA=SeqID_73699; Strand=+; Position=1 -177,779-1082,1362-1477
MPLTQLRVYVLKCLIATLLSGHANTVAVLQFALNSEKNKMQMHEILRNSMVGYYSQNLEATPASAQQFGGIGSAGSVGAGVNPFVPLKGQGEPRMFGASSSAAASGIANAFTMFRHQHADQQQQMLRSLRSTPGASDFHDFRLTAQIPPSPSNQQQAEFGDDLATAVFSEDIQEEANSYFQQVSFVLNLTITIFHCRP

SEQ ID NO: 147277 - protein, 132 aa, Heterodera glycines
  Coding regions on vcDNA: vcDNA=SeqID_73700; Strand=-; Position=1-476
MNTPTAASSRTPTNVLATPFIPSSQMSMTDVRTPTTTLHGVIPSHHPPPIVGHPAAPIMSAERMALPPGIFSEGRGAFCPAPGNELGVRTEDQILQSKVENILREWISICYTPMAQKDPQHALAYIVQMVLS

SEQ ID NO: 147278 - protein, 121 aa, Heterodera glycines
  Coding regions on vcDNA: vcDNA=SeqID_73701; Strand=+; Position=1-591
QGGVRCLRRCMCADGARTVSDSDSNPAQRRRLSRRRIQKTAAPPSNTIIFNDVQQPTALEGEQSVRQRCQNWRCFRELGFEEIWALWVPFCSVIPWPGILLAQANILTFYCLQDSTKPQRH

SEQ ID NO: 147279 - protein, 198 aa, Heterodera glycines
  Coding regions on vcDNA: vcDNA=SeqID_73702; Strand=-; Position=1 -101,154-210,656-784,1062-1569
FADNYAQVLRERWHLGECGEDILILIVKTPPQMQSTDGPQSSAHSRPNGPFPMLFLSLGPLITSRLHPDFAGHALRHILFDANAQLQHDARPLFKVLNEMLLRMDAEVFGALAPAEFSAGVGTAPSSFVSTPHARHRHSYADGPTVPSRSHIPPWAWSRNLEFNLAIHYGRNSGASRIEARFLSSERCDWPKPRKFEN

SEQ ID NO: 147280 - protein, 153 aa, Heterodera glycines
  Coding regions on vcDNA: vcDNA=SeqID_73703; Strand=-; Position=1 -60,577-679,731-850,1005-1183
MANCLTDGFATRAPQCPCRKIILLQKISFFLPTFAGSVLGLPLCLSLVLGPIRPLPNIVPTIILKLAQQTAVWKQKMNPMNSFHSTDYSYHLKRDFKQMPLLFLGLLIRLLNLVFHLRRHSSKIKIGIPCQNGKCIKIKMAWHLFKNGNSFKI

SEQ ID NO: 147281 - protein, 160 aa, Heterodera glycines
  Coding regions on vcDNA: vcDNA=SeqID_73704; Strand=+; Position=1 -57,264-525,571-734
MEDDEEEEEKGMSLISRANSVAELEHWLQALKVPQTFAALRAEAERWRQTKSAMAGADQRILAQGGAALKEKLRELAQRRGAGDALVAGDAIATDAFEISDKYYAKAIIHTVPPTDLLTQRDFEKLADCFRRSLEIASSRGFSSVVTFRRLLTFDSLKQI

SEQ ID NO: 147282 - protein, 193 aa, Heterodera glycines
  Coding regions on vcDNA: vcDNA=SeqID_73705; Strand=+; Position=1 -267,340-652
  Homolog annotation: Hit_ID=AAC95573.1; Match level="QueryCoverage =78%, HitCoverage=33%, E-value=6e-14, Identity=32%"; Hit description =orf 48 [Ateline herpesvirus 3] pir||T42963 hypothetical protein 48 - ateline herpesvirus 3 (strain 73) ref
MFVLSIGKWFGHFAHRRREETAEREKERRPNEVGREKEEIRKNREEEEEEQNEKGPAEEEENEEEGQSEQKTMEAEKRQKEDEEEEEEESEDRSSTDENDSFALEDGTSSTDPLDSADELFLEASAFAEFTVSEDGSIWEGTGGWGEADDATDAEYETSVEEMLMLRHGTVEGKRSPTPPSKIGTICSSAEDE

SEQ ID NO: 147283 - protein, 469 aa, Heterodera glycines
  Coding regions on vcDNA: vcDNA=SeqID_73706; Strand=+; Position=1 -469,529-1376,1714-1806
  Homolog annotation: Hit_ID=EAL49477.1; Match level="QueryCoverage =92%, HitCoverage=52%, E-value=5e-34, Identity=26%"; Hit description =hypothetical protein 42.t00003 [Entamoeba histolytica HM-1:IMSS]
MAAGVKTIIGGAVEAVIATIIRTTKVEVIRVKLEEDQWMGQNGLKGEEEEEKEKGEQKGVGGREGEKEEEKEEEEQLEEQKGVRGKEEEEQLEEQKGVRGKEEEEQLEVQKGVGGREGTEMHKNGKKEQQQQQKEQMEPKQYLAVYTAQTCIKRAAEKGGKWQKEQNGTAKAGEEDELSIYSDALEEQSAEEADEPKKEERREMEEGGKEKEEEREREEEKERDEGKDMKKREGKELKERMEEEKKGKERRPSKEMAEEQLVNSETSDDECEEEEEEEEEEEEDDEEVEEYTDEEEELCSEMSQVEREIERMRRESVAMVEEREVKTNTPMKMANPRNNSPEKAAGEEAAGRVADKERTPVDVGVYSGWRSTVMDGKDTVEEENDAEDRTETPKPPKKEQQQQQQKYAKTNDFQWPSEARRMTAAEEKPKQRGNEKEEGRVQTNAEPNQRQGDQQFGGGQWQRDARTID

SEQ ID NO: 147284 - protein, 175 aa, Heterodera glycines
  Coding regions on vcDNA: vcDNA=SeqID_73707; Strand=+; Position=1 -124,211-466,890-1037
MVYCEPGDMMQGEVYLLATLIVVIFTLATTVIYIIIGIMLKVIRSDQNNSNNSSQSQIEITRRIFKSLAVIMAVIFCFWFLFALIANILARGLITSDPALQFLIIRLVTQLPLIARAINAPVLYFCSSEYREIIKSEFPWVKFLLCSNNHNPPVVVVSAGPQILNSSNIQQMHHN

SEQ ID NO: 147285 - protein, 336 aa, Heterodera glycines
  Coding regions on vcDNA: vcDNA=SeqID_73708; Strand=+; Position=1 -244,285-1051
MTKIHKKYCEEIGRGQNIENTLNKMENETENLIKNLKKDPKLQEKVQNMVEMELSKNRKLNEKIQNAMERRKVNSFYDLLNAAFQTFFGNCKNCSIMPQKELSGRRKRRMAKHEMGNTSNTANEQNNFSIAGQNLVTQPTDVHNSNETGLELVTHSSDDNDHQNGGTNRVFLNAELPPQNRNLSPTRQILPEDRATPTQTVDHHPANDHHVDIPPVAHANVHELSAEQGHGAIPIAQPARQNQAVNEQIRGLLNQTYNARQGDRIFVCKFSKFIFSLIIGLWVMLWMSIFKEQLQFDISLSGPIAFFILYLFILLSFFPCLFYHVEVHQPTHNQDV

SEQ ID NO: 147286 - protein, 82 aa, Heterodera glycines
  Coding regions on vcDNA: vcDNA=SeqID_73709; Strand=-; Position=1 -44,252-359,612-708
MPVPTVTKRHFVKSIEVFHGDNPLSEPECANLAGFMHQHSPQIDAYLTLHSKELEMKWPMPSKKRAVNTLKLAVVMKFYVRN

SEQ ID NO: 147287 - protein, 78 aa, Heterodera glycines
  Coding regions on vcDNA: vcDNA=SeqID_73710; Strand=-; Position=1 -111,176-301
  Homolog annotation: Hit_ID=CPCYB; Match level="QueryCoverage=89%, HitCoverage=23%, E-value=2e-13, Identity=46%"; Hit description =carboxypeptidase B (EC 3.4.17.2) - broad-fingered crayfish sp|P04069|CBPB_ASTFL Carboxypeptidase B prf||1004229
FGKSAKNGQKKPIMLVDAGIHAREWIAPAVALKFIDSLASDNKYNSILDQLDIYVIPAVNPDGYEHTWTSDRQFCFNI

SEQ ID NO: 147288 - protein, 52 aa, Heterodera glycines
  Coding regions on vcDNA: vcDNA=SeqID_73711; Strand=-; Position=1 -59,346-445
MHTRCIQMRTFLPILTVPKRFSTFWTRIGFGATQLWQIMASKFGNTIIKKVI

SEQ ID NO: 147289 - protein, 42 aa, Heterodera glycines
  Coding regions on vcDNA: vcDNA=SeqID_73712; Strand=-; Position=1 -61,109-176
MPRPGVVCVPGKGHKQIGQTNFARPSNFGGRSEQNDMMNSLN

SEQ ID NO: 147290 - protein, 208 aa, Heterodera glycines
  Coding regions on vcDNA: vcDNA=SeqID_73713; Strand=+; Position=1 -39,102-156,295-488,1070-1171,1476-1586,1653-1778
  Homolog annotation: Hit_ID=NP_494213.2; Match level="QueryCoverage =73%, HitCoverage=32%, E-value=5e-20, Identity=37%"; Hit description =carboxypeptidase A4 (51.9 kD) (2C501) [Caenorhabditis elegans] gb|AAC68743.2| Hypothetical protein Y59C2A
MESHKYQVGRDLNNQNHRLFPTFLDFLRSVRGKKSINIFYPFRAIPTNDSQVLALRHFANLMESSNSRKGTVQFWQHAHTLHSNADIFADSDSAKKIVSYLRLLAENNSDFISFNSIGKSYEGREISYLKFGKSAKNGQKKPIMLVDAGIHAREWIAPAVALKFIDSLASDNKYNSILDQLDIYVIPSVNPDGYEHTWTSDRQFSFNI

SEQ ID NO: 147291 - protein, 53 aa, Heterodera glycines
  Coding regions on vcDNA: vcDNA=SeqID_73714; Strand=+; Position=1-160
MMDFGHWRIGKAFQKNDSNANEQSVEGQHQKETMTAHARLIEDLVNRRFYEPT

SEQ ID NO: 147292 - protein, 50 aa, Heterodera glycines
  Coding regions on vcDNA: vcDNA=SeqID_73715; Strand=-; Position=1 -91,952-1013
MIREKKQEKEDQRMMKSKNKERNKRPKEHISQLVNGGEHQLDGGTTSIIL

SEQ ID NO: 147293 - protein, 289 aa, Heterodera glycines
  misc_feature (268)..(268): Xaa can be any naturally occurring amino acid
  Coding regions on vcDNA: vcDNA=SeqID_73716; Strand=+; Position=1 -38,113-214,572-642,704-728,848-988,1719-1913,2107-2187,2246 -2355,2406-2443
  Homolog annotation: Hit_ID=CAE66493.1; Match level="QueryCoverage =95%, HitCoverage=46%, E-value=7e-97, Identity=63%"; Hit description =Hypothetical protein CBG11773 [Caenorhabditis briggsae]
YELLNRTIVPYEDIWIPDTVLYNSGNMDKKNSEAVMNAIVETGHWRNDGRGAAIQLMFPAIYKLSCKMNVRFFRFFPYDQQNCSFIISSWTHDMATIDYHYTRPKVNMKNFVEDDEWTVISFDFRREELKFKCCARPWAMLYAHLVIRRKPLYYIVNLVVPTSIITVVAVIGFFTPSSSTSERDEKLYLGINTLLTMSLMLLMVTNQMPNTSNYVPLMGWYYMGIIFVIYYMGIIFVIVFGTILATVVLFIHSRKARLQPLPRPLQIXIRKIFKMPFLIIRKIFKMPFL

SEQ ID NO: 147294 - protein, 76 aa, Heterodera glycines
  Coding regions on vcDNA: vcDNA=SeqID_73717; Strand=-; Position=1 -52,112-290
  Homolog annotation: Hit_ID=ZP_00109558.1; Match level="QueryCoverage =97%, HitCoverage=17%, E-value=2e-11, Identity=43%"; Hit description =COG1357: Uncharacterized low-complexity proteins [Nostoc punctiforme PCC 73102]
MTNIGEILTYAGSSFKHVINCNIMVADMSDFQAVNETIKNFFTEDTYPARSFFQVVKLPKSAYVMIDVVAIVQGQS

SEQ ID NO: 147295 - protein, 24 aa, Heterodera glycines
  Coding regions on vcDNA: vcDNA=SeqID_73718; Strand=-; Position=1-72
CTCGVVVKLSTFHNFSPEFNSPLG

SEQ ID NO: 147296 - protein, 111 aa, Heterodera glycines
  Coding regions on vcDNA: vcDNA=SeqID_73719; Strand=-; Position=1 -81,189-300,356-498
MSSKPETLVERMKHLLSSGDDADVLFLHVPAHRAILNSASDVFEAMFRFDTTKNATDNESAGGEAKGPVEVTDIDAHVFKVMLNFIYADDLSELNGDNAMAVLYTGQKISF

SEQ ID NO: 147297 - protein, 410 aa, Heterodera glycines
  Coding regions on vcDNA: vcDNA=SeqID_73720; Strand=+; Position=1 -247,655-693,821-1023,1134-1448,2032-2169,3636-3926
  Homolog annotation: Hit_ID=NP_741456.1; Match level="QueryCoverage =75%, HitCoverage=43%, E-value=2e-68, Identity=46%"; Hit description =nuclear Hormone Receptor (65.5 kD) (nhr-31) [Caenorhabditis elegans] gb|AAC24263.1| Nuclear hormone recep
MPTSSSAHGTAAGFCAVPSPFCSASSSPYQIRDTATSAGTAAIPHLHQGQDGEVMCAVCGDGPAKLHYGVLACYGCKACAVIDVCRFDNDCIVDKFQRNSCRCCRFKRCLEVGMDPKAVRPDRDLTGKQRVPRIRKRALDEELINHMVMIQNLGFESGAFDSLGNDWSRKIPVEARVLLMQLLNIESKVAKGDSAMDRRLNTGVGGITQSTAAQQQNQHQNQPPLPYEPSTATAYNGGKETTTRQQQRELSLRELFEQKPSLNTRRTEMCYEPYRMAQAEELPKIAHRGAIASVDWVESLAELLDTVLLDTQDKPPVQQSDRSNTERIGRPIAQAGPPGGGGGAAEGHHHPGPEHAQLVARGATWRGRTARPCAGHAVPRGQGVAPGAQRSPTLRQSVVAVANNFGAKIE

SEQ ID NO: 147298 - protein, 196 aa, Heterodera glycines
  Coding regions on vcDNA: vcDNA=SeqID_73721; Strand=-; Position=1 -82,297-805
MQNKMNTDFEQILTLLRGQSTTMTDNRVVHDDSRSSNTKSGDVHHQQQNQRVHGNGGGGEQQQQRRQAQAVPPPATQTTVAGPPLLQHFASPYSCNLMMPLSSSANHPAQLQSSSSSSNNNGNRNLGSNNEADEEGDGAEQRPRRHDIAEQQQQRHSNESANNNNKPSSSSSSADGTGDRRRLPITFSPDSADTIL

SEQ ID NO: 147299 - protein, 292 aa, Heterodera glycines
  misc_feature (287)..(287): Xaa can be any naturally occurring amino acid
  Coding regions on vcDNA: vcDNA=SeqID_73722; Strand=-; Position=1 -93,399-475,617-701,745-763,918-1000,1116-1235,1280-1559,1909-1984
  Homolog annotation: Hit_ID=NP_497824.1; Match level="QueryCoverage =97%, HitCoverage=34%, E-value=5e-93, Identity=62%"; Hit description =UNCoordinated locomotion UNC-103, HERG like potassium channel (88.5 kD) (unc-103) [Caenorhabditis elegans
FIFSRLREFIRFYQIPNPLRQRLEEYFQHAWSYTNGIDMNTVLKGFPDCLQADICLHLNRNLLNCCPAFANCSPGCLRALSIRFRTTHAPPTTHAPPGDTLVGDILARLYFIARGSVEIVKDDLVVGICGKDDVFGENPLIYEEVGKANCSVRALTYCDLHVILRDDLLDVGDMYPEFVGDMYPEFAENFCINLVINYKLRDETLTKRRRPTFERQKLQRVSSSARTERRSAPPIGDSRSVIPRPSLKSRLRSDNLEIETRDQSSQNHNSRINPHFSATIFRIRDSXPLFNA

SEQ ID NO: 147300 - protein, 249 aa, Heterodera glycines
  misc_feature (9)..(9): Xaa can be any naturally occurring amino acid
  misc_feature (41)..(41): Xaa can be any naturally occurring amino acid
  Coding regions on vcDNA: vcDNA=SeqID_73723; Strand=-; Position=1 -162,213-244,415-468,521-577,782-866,989-1066,1503-1629,1680 -1708,1780-1838
  Homolog annotation: Hit_ID=NP_497824.1; Match level="QueryCoverage =81%, HitCoverage=22%, E-value=1e-71, Identity=74%"; Hit description =UNCoordinated locomotion UNC-103, HERG like potassium channel (88.5 kD) (unc-103) [Caenorhabditis elegans
NLIKTLLCXRQINIYFLIKNNFQIFQFIILRCILSLLKRHXFCHFQMIAAVPFDLLLVETLLLVETDSDETTTLIGLLKTARLLRLVRVARKVARKLDRYSEYGAAVSDNIMALFCLIAHWLACIWYAIGSAELLHKVITFIVQLARHLNEPYRQNGSLTNGGPSLKSRYVTSLYFTLSTITSIGFGNVSATTDSEKIFTIIMMICGSLMYASVFGNVLMYASVFGNVSASAIIQRLYSGTARYHTEMR

SEQ ID NO: 147301 - protein, 55 aa, Heterodera glycines
  Coding regions on vcDNA: vcDNA=SeqID_73724; Strand=-; Position=1 -99,185-219,470-503
  Homolog annotation: Hit_ID=NP_497824.1; Match level="QueryCoverage =58%, HitCoverage=4%, E-value=6e-10, Identity=84%"; Hit description =UNCoordinated locomotion UNC-103, HERG like potassium channel (88.5 kD) (unc-103) [Caenorhabditis elegans]
MSQNVIMAFAYRIISYFLPLIQVLSLGADVLPEYKLQPSRLNHCTIIHYSPFKGN

SEQ ID NO: 147302 - protein, 126 aa, Heterodera glycines
  Coding regions on vcDNA: vcDNA=SeqID_73725; Strand=-; Position=1-381
MPPGTVPMMMMMMMLCRNHLKCRSVCERSHFVLRTNRTGPIHWALDLCKNVRIYKKEKKNRGNFCMGSNGGKRNNEMYALFLFVSFFSVVYFTFLCLLFSNVINCVLLFWSKIELTSLINELLINN

SEQ ID NO: 147303 - protein, 43 aa, Heterodera glycines
  Coding regions on vcDNA: vcDNA=SeqID_73726; Strand=-; Position=1 -51,702-782
MPVNDVVFSDASAVSVGHKWLNPPKMFTIIIKLKKGPVQKANV

SEQ ID NO: 147304 - protein, 69 aa, Heterodera glycines
  Coding regions on vcDNA: vcDNA=SeqID_73727; Strand=+; Position=1 -101,149-254
KRCEHVNCIEQKPKALALRATLGEVEAASLKLGEPDMPMNEIDRAVEVRLERVQEVKKSMLKEAGLETD

SEQ ID NO: 147305 - protein, 160 aa, Heterodera glycines
  Coding regions on vcDNA: vcDNA=SeqID_73728; Strand=+; Position=1 -396,449-535
  Homolog annotation: Hit_ID=NP_871996.1; Match level="QueryCoverage =100%, HitCoverage=35%, E-value=1e-35, Identity=48%"; Hit description= glycosyl transferase, family 2 (44.3 kD) (2G205) [Caenorhabditis elegans] gb|AAO38632.1| Hypothetical pr
YPLILISDQGIFMQKQALRDMVCTMRERPDIALVTQPPYCRDRGGTFGAALEQVIDSQCPTQLGTQLSHILEVYFGGAHSRIYLASHAFGFVCSTGMSALMVKDIVEQCGGFRQFGAYLAEDYFLGQAFVKGGFRNVISHLPALQNTARPTVRSFHERIC

SEQ ID NO: 147306 - protein, 36 aa, Heterodera glycines
  Coding regions on vcDNA: vcDNA=SeqID_73729; Strand=-; Position=1-110
MKSFILVVLFSFLFMALMMPLVSSEESETKMKSPIS

SEQ ID NO: 147307 - protein, 55 aa, Heterodera glycines
  Coding regions on vcDNA: vcDNA=SeqID_73730; Strand=+; Position=1-168
TRVSYIYVFEPDTVLERGIRPAFISNAARFPDVREGYHFRPPLGWMNDPNGFSKF

SEQ ID NO: 147308 - protein, 178 aa, Heterodera glycines
  Coding regions on vcDNA: vcDNA=SeqID_73731; Strand=-; Position=1-537
MKLGLIFHLIVLLIVLININYVGAEKKKLQQKTFDEIFGEKWEEKEEKQLNEQNKREIIQKYYKIKEKIKQKEGKYSTKEWNKINSKIAKKLGTNSNYIYKWIKELGLNQEIQRSHKSKTDEEKIEIVQKFIAIKMNTNKKENIHRKNGNKIMPKFVRKLELTMEQFAIGRNNLEKMK

SEQ ID NO: 147309 - protein, 15 aa, Heterodera glycines
  Coding regions on vcDNA: vcDNA=SeqID_73732; Strand=-; Position=1 -36,1027-1038
MDSKPQEHIPITNFK

SEQ ID NO: 147310 - protein, 267 aa, Heterodera glycines
  Coding regions on vcDNA: vcDNA=SeqID_73733; Strand=+; Position=1 -64,287-365,436-560,1139-1258,1383-1484,1578-1727,2523-2686
MLQKCHFLADQSDRNASDDRRSSPFSLHQEVIRAYHDRPSTFMDLKIFLHLLTADEQRALLDFISSILVPILFRANRLDPIWAFPMHLLDSVRRLLSRILQINANGSDLAIAMHAQMVANYCWEFFLRTDDYNVLALLLSFLEVLNKQTQCNPLIPVLLCRIYAIFGITWRINELVRQMDIKFIQRVNFAFFQCFVAENFGQFRTAGNYYASMDLKRTIDNREFSAVKVFLSEATLGEMRDGTLKEIVRRERAKCAIAILNYFRSPI

SEQ ID NO: 147311 - protein, 109 aa, Heterodera glycines
  Coding regions on vcDNA: vcDNA=SeqID_73734; Strand=-; Position=1 -37,359-651
MVYLTMVKDEHTGIEPWERRRESQEDDWPTFAALTLAALTFAALTFAAPSQSDTCGATLAAPTLAAPSQKDTCGADTCGAQSKGHLRRRKIQRPQKYFNNLLKLTELLF

SEQ ID NO: 147312 - protein, 78 aa, Heterodera glycines
  Coding regions on vcDNA: vcDNA=SeqID_73735; Strand=+; Position=1-237
MTDQNSEATFAEETRELKAEIGPVFNREKLDKAYKKLAKKYHPDKHKNSAEKTAKFQRLQKANDELKKELLKPEAILF

SEQ ID NO: 147313 - protein, 45 aa, Heterodera glycines
  Coding regions on vcDNA: vcDNA=SeqID_73736; Strand=+; Position=1-136
MMGSPNAARTLDELNKVGHDELKKMATAQRGGDWTGTVTIGGQQF

SEQ ID NO: 147314 - protein, 54 aa, Heterodera glycines
  Coding regions on vcDNA: vcDNA=SeqID_73737; Strand=-; Position=1 -33,114-245
MVVTLDGETAKVLLESTVEIKKGPEYKFFHQWLGNGVLVSDGDHWLRQVSPINS

SEQ ID NO: 147315 - protein, 81 aa, Heterodera glycines
  Coding regions on vcDNA: vcDNA=SeqID_73738; Strand=-; Position=1 -169,471-503,570-613
MLLFFVAVVLLVFVVWRIFAISSTHLRFIRTSNGIYNIPETIPFLGQAHVFPQNSFAWSSFIVEQSNDAVRKGHHLMRWFD

SEQ ID NO: 147316 - protein, 25 aa, Heterodera glycines
  Coding regions on vcDNA: vcDNA=SeqID_73739; Strand=+; Position=1 -41,139-175
MHNSYVGQIGEKGNIFVLEIINFLK

SEQ ID NO: 147317 - protein, 29 aa, Heterodera glycines
  Coding regions on vcDNA: vcDNA=SeqID_73740; Strand=-; Position=1 -20,150-219
MNGNQNRVKKSEYKRGHCFYFHFNRKREE

SEQ ID NO: 147318 - protein, 120 aa, Heterodera glycines
  Coding regions on vcDNA: vcDNA=SeqID_73741; Strand=-; Position=1 -138,721-945
MQRDNETCQMMVKKHCKCGWARCHERRGWNASLCCQAGYDLVCCTLELEENLIANHGQDEHRLPVLKEMAKNEICSDTVQKYCPCESAKCAQRLDDKYEGSICCEKGFDVVCCVGMLNKL

SEQ ID NO: 147319 - protein, 137 aa, Heterodera glycines
  Coding regions on vcDNA: vcDNA=SeqID_73742; Strand=-; Position=1 -104,565-873
MCKMICFSFSQLFVVLVLICPLVSYALAPSNNNSSKMPTSSFFGQNRSVAGIGILGTFSRPGIGAYLSTWIPELSKTNCSYKAMNVCHPFVWGSCVENDVRVNSHPCCMDGYEWRCCTKASRTNKIMCKHKLYWDES

SEQ ID NO: 147320 - protein, 89 aa, Heterodera glycines
  Coding regions on vcDNA: vcDNA=SeqID_73743; Strand=-; Position=1 -81,150-338
MLFNVLFLFFLLIVQILSQGTNPPTCFVPCPANEEFGYKKCNGCEPSCDKLKPEICTKIACPCSCDCKPGIFRNTKTGKCVEKCSYNDN

SEQ ID NO: 147321 - protein, 395 aa, Heterodera glycines
  Coding regions on vcDNA: vcDNA=SeqID_73744; Strand=-; Position=1 -19,68-110,157-215,353-401,452-524,671-866,1158-1215,1271-1441,1511 -1857,1927-2098
  Homolog annotation: Hit_ID=AAK29898.3; Match level="QueryCoverage =73%, HitCoverage=58%, E-value=2e-86, Identity=54%"; Hit description =C-terminal src kinase protein 1 [Caenorhabditis elegans] dbj|BAC76831.1| CSK-1 [Caenorhabditis elegans]
MEADFHAPWFYGSLSREKTEKCLQSCADGTFLIRNSTNYPGDFTLCVACNLRVEHYRIYMVNDHFTCDKEELFDTLTQLVSHYKRDADGLCHRLVCPYISEECQRQRTHIDLVLVEERKKEFEQAALLLSVDHLRLGTVIGHGEFGVKTLKNGMVQDLLAEARFMIGLHHEKLVFLVGVVIEDPRESEVYMLTEFMANGNLVDFLRSRGRHHVDRPRLVQFAQDVAEGMAFLESRNFVHRDLAARNVLLDDRLVAKIGDFGLAQLANQPSKESAKGKFPIKWSAPEALRQNVSDRWHSLAWWHFDAPFLAVHQQKRCLVLWHFALGSVFLWQSALPPNSHPGCAEACRKGISDGPARGHSPADPFPHGRLLAVVARLEAVLRRNFGHFMPTNSLI

SEQ ID NO: 147322 - protein, 234 aa, Heterodera glycines
  Coding regions on vcDNA: vcDNA=SeqID_73745; Strand=-; Position=1 -619,2002-2087
MGGVGTEQPNTTTGEQRCSQSASPKDVGMEQEEEETEEGPVDSKDDDEEGTERGHSADPSAKVGSTLAMALVCLAIHRHALLICQCHTDFAAELSLLRRSASASSPLGPASAEPSTEFVLNSLFARSSPFRLLGSTLLNPIAPTTSSIDNDHSDQRRALSAFAPASKSPVTYPTRHHRFVSTPNGNGTSLRNNGSGNGQPPYLIRRAQLTRADELNECQRINRHFAPGNKFCFE

SEQ ID NO: 147323 - protein, 58 aa, Heterodera glycines
  Coding regions on vcDNA: vcDNA=SeqID_73746; Strand=-; Position=1 -78,283-379
AWHPKRLELLSSGANQTVVRWSYSDSDSIWLPISRFGDIVGDEVNCYDITYSPCGRYA

SEQ ID NO: 147324 - protein, 271 aa, Heterodera glycines
  Coding regions on vcDNA: vcDNA=SeqID_73747; Strand=+; Position=1 -109,172-546,601-667,875-969,1049-1216
  Homolog annotation: Hit_ID=NP_497939.2; Match level="QueryCoverage =71%, HitCoverage=7%, E-value=6e-43, Identity=45%"; Hit description =Beige/BEACH domain and g-protein beta WD-40 repeat (3F688) [Caenorhabditis elegans] emb|CAA86337.2| Hypoth
MYQPCPDRPVHVMKVPLQQSHCAHCGQHLPTIGGTILKIAQNLVFSLNRWNPNFVQVQTQSSGTKVLNAAAASATDKSTAADSSASSTATSQISTSELPITVDPLLVVANPSQKVPKRHLGDQLDQRLTVSWSNFICTVDSSFIIVCGYPDYSFRLIETGNVQVRQVVLGHGNVVTCLACSETSQHLGLLVGDYNLPGEEPSPRAILTGHDSEISAICVSAEHGIVLYGRYPSDAFHTGRHAAHHHLLERQRNGHIGTNQRHSVQQRLLHC

SEQ ID NO: 147325 - protein, 190 aa, Heterodera glycines
  Coding regions on vcDNA: vcDNA=SeqID_73748; Strand=-; Position=1 -127,682-827,1039-1053,1295-1375,2697-2900
MDRWAREYGTHTHSQEQFGPKEAYERMVPVPHGSQFSITEPGATFDSNTMYSDHFQVSPESFTRIERPQQIRPSTALRLSGNMDMVTGYRTEFQNKEFQNKVKPCPAGELVESLKKEDKSDTERTLIKQNYSMQSNGAATGTASAADAGRANTAQMAQANGGIERERKPLESRQIVAQYIKYAVKLERII

SEQ ID NO: 147326 - protein, 23 aa, Heterodera glycines
  Coding regions on vcDNA: vcDNA=SeqID_73749; Strand=-; Position=1 -60,731-742
MRPILLMTVQKKYCFTNEYTNCI

SEQ ID NO: 147327 - protein, 55 aa, Heterodera glycines
  Coding regions on vcDNA: vcDNA=SeqID_73750; Strand=-; Position=1-166
MPAAAPPTPMAEPAPDEGGTGAPANAAGPYPSLSGPRLFVEKPESPVKKSSAIRS

SEQ ID NO: 147328 - protein, 117 aa, Heterodera glycines
  Coding regions on vcDNA: vcDNA=SeqID_73751; Strand=+; Position=1 -78,1901-2038,2119-2256
  Homolog annotation: Hit_ID=CAE72052.1; Match level="QueryCoverage =39%, HitCoverage=6%, E-value=1e-14, Identity=80%"; Hit description =Hypothetical protein CBG19137 [Caenorhabditis briggsae]
MPAQPQPPPPPPPQLPQMPIAPPLRWVALGSQKLDSQAKLLSHVDRAFGLDNLQRLQRWANTGGALDLLKEQFAKIAKNYKPPPALAAITLPPQLDYLLQNPSGGGGGGGLGGIGRK

SEQ ID NO: 147329 - protein, 89 aa, Heterodera glycines
  Coding regions on vcDNA: vcDNA=SeqID_73752; Strand=+; Position=1 -255,1073-1087
MPKTLCSRARPGPGSRPGFFLDPGPGHFSATWIFPGPGFSWILSRKSRSRSNVKKNPGPGPGFFQNTELYFVHLASVPKSAKKRKISFF

SEQ ID NO: 147330 - protein, 55 aa, Heterodera glycines
  Coding regions on vcDNA: vcDNA=SeqID_73753; Strand=+; Position=1 -66,215-316
MEVKFPSFLDVIFSKFKYAHFNFILVSQMIIRISNMLWFSYVLGRFLKTATMGVS

SEQ ID NO: 147331 - protein, 72 aa, Heterodera glycines
  Coding regions on vcDNA: vcDNA=SeqID_73754; Strand=-; Position=1 -141,223-300
MRRKLNYERIWSLTIAQILMKLMAKTLRILIKIPMSKLRKLIAHYVQKNQVDRVFSLLRKKNAKNRFYFIFG

SEQ ID NO: 147332 - protein, 21 aa, Heterodera glycines
  Coding regions on vcDNA: vcDNA=SeqID_73755; Strand=-; Position=1-64
MHPPNFIPKLHGHLQTFLCQQ

SEQ ID NO: 147333 - protein, 33 aa, Heterodera glycines
  Coding regions on vcDNA: vcDNA=SeqID_73756; Strand=+; Position=1-99
MTKSSRNSISSSFLMHLSIDAAKLLAKNISCSL

SEQ ID NO: 147334 - protein, 46 aa, Heterodera glycines
  Coding regions on vcDNA: vcDNA=SeqID_73757; Strand=-; Position=1 -54,917-1003
MKISLIPTTQMFTPKTSRVRIRVRGSKLVEMNIIFVISALENPKGL

SEQ ID NO: 147335 - protein, 69 aa, Heterodera glycines
  Coding regions on vcDNA: vcDNA=SeqID_73758; Strand=+; Position=1 -69,134-273
IEKFLCLTHQNKRTNDNKNNSSDSTLVAILRTVADAVAQPAHFSSSSSMNCDTAVAPVAPLVPGVDTTS

SEQ ID NO: 147336 - protein, 113 aa, Heterodera glycines
  Coding regions on vcDNA: vcDNA=SeqID_73759; Strand=-; Position=1 -53,96-201,286-466
MLSTLEELGAIPCGTQLAFFCGQIVSILPSEKKLTALMTCASCENIAVTEFKKVIKMSILKAQRFVVERFDGSVYHTPLPYEFVVMNFTKIAVVQCASKIADCFEKLTSGCFY

SEQ ID NO: 147337 - protein, 204 aa, Heterodera glycines
  Coding regions on vcDNA: vcDNA=SeqID_73760; Strand=-; Position=1 -102,268-402,789-875,961-1251
MASHTETNKQKVKLSHGEHLYTFDKMSKMERQNFLIKRASHEINAPPAVPTNLNFEIAQAYKTYTSTDGVEELFCWATPRYCADPVFPLNVRMLTSVAFVPFCDVRNAAFGQLCWTSSSQWHVVATVDPSTNGHWMEMRGRTTTQKRSTTVCKARSIVVIHRCGISLMFFDLNRKSPISNTILRSLDCHLRKSEANIWQQIDEF

SEQ ID NO: 147338 - protein, 170 aa, Heterodera glycines
  Coding regions on vcDNA: vcDNA=SeqID_73761; Strand=-; Position=1-513
  Homolog annotation: Hit_ID=XP_214635.2; Match level="QueryCoverage =78%, HitCoverage=13%, E-value=6e-14, Identity=37%"; Hit description =similar to katanin p80 subunit B 1; katanin (80 kDa); katanin p80 (WD40-containing) subunit B 1 [Rattus n
MEKRGEWKKRGMEKEGNGKRGEWKKRGMEKEGNGKRGEWKKRGMEKEGNGKRGEWKKRGMEKEGNGKRGEWKKRGMEKEGNGKRGEWKKRGMEKEGNGKRGEWKKRGMEKEGNGKRGEWKKRGMEKEGNGKRGEWKKRGMEKEGNKKFGTLHEFACHPCAGAMLIFEQKL

SEQ ID NO: 147339 - protein, 228 aa, Heterodera glycines
  Coding regions on vcDNA: vcDNA=SeqID_73762; Strand=+; Position=1-687
MSKRLRSETDELLSANNPDLSILEQRMSRLENLLERLLPVGVGPIPEDPIQRLEKRMEKLENQVTALVLALEKRPISQQQQTPWGCPPDHIIRHINAVVLDSDIIREKSKRAVVEKLPEGIDEKDVVKSIAEKCGVADDLILDEIHRHPEERSESTSQNTRKPRILKIPFASTESRDIFLKKFRMALSNLPNFPKFLSARRDMTQSELSILYNLRSQAYNSNSSCGLF

SEQ ID NO: 147340 - protein, 82 aa, Heterodera glycines
  Coding regions on vcDNA: vcDNA=SeqID_73763; Strand=+; Position=1 -160,528-616
MPWINSILINARSIANKIADLEYLIETNKHQIILINETWLNTRNTITTELTLNARKRTNSRKVNFGFDFFLESLPLLMILRF

SEQ ID NO: 147341 - protein, 534 aa, Heterodera glycines
  misc_feature (8)..(8): Xaa can be any naturally occurring amino acid
  Coding regions on vcDNA: vcDNA=SeqID_73764; Strand=+; Position=1 -184,276-402,476-539,783-864,917-1008,1067-1151,1236-1285,1329 -1403,1533-1609,1700-1874,1958-2011,2123-2249,2425-2602,2792-2832
  Homolog annotation: Hit_ID=CAE75243.1; Match level="QueryCoverage =96%, HitCoverage=82%, E-value=1e-135, Identity=52%"; Hit description= Hypothetical protein CBG23195 [Caenorhabditis briggsae]
DKGQQILXFKCLNFLFLTVTLLPSDSIWLPDTTLYNSLVMKDDDSRRLLNAKLTTNMTRKAVLVEMLYPTAVLVEMLYPTIYKFSCLLNLRYFPYDLQECTMTFSSWTYDNKGIDIDYVPYSDEIGTSNYLENEGWYLLSSTMRREEVKYTCCPNKYTLLKLTLYLRRKPLFYLINLIILYLRRKPLFYLINLIIPTAIITLIAIVGFFTTSSASGTSSASGMREEKVSLGITTLLSMSILMLMVSDQMPTTSTVSDQMPTTSTFIPLIGWFILGMIGVISLGTLASSVFILGMIGVISLGTLASSVVIAVQKRGRLGERLTKRAVRIAKIFGAISYTEVPLHLRKTSEHAEAPPPSASYRPAKLATRLASVRRTTTAQRRQRHRRNRSGLSPNSDKSTEPLDKSTEPLIETGGEDAEKDAMADPTSVASARSSAMPSPRAPPLHSAVKTQPLHSNATVLMPVQRFKSHNAQKFGIFQNLRLSRQLAVKEFEWMATIVERCCFIVFATMFFFLSIGINLLGYWHWANPELAFNN

SEQ ID NO: 147342 - protein, 114 aa, Heterodera glycines
  Coding regions on vcDNA: vcDNA=SeqID_73765; Strand=+; Position=1 -96,253-441,497-528
  Homolog annotation: Hit_ID=NP_505897.1; Match level="QueryCoverage =75%, HitCoverage=15%, E-value=6e-29, Identity=70%"; Hit description =DEGeneration of certain neurons DEG-3, DEgeneration Suppressor DES -2, acetylcholine receptor (64.9 kD) (d
DAAKTQRRPSPASADPFNAFAITDVPLMRLTKDILAPGRYDVRVRPIIDHTKPLKVHISMSLYQIIEVNEPAQNIKMNVWMIQKWHDEMLHDPREYDMINSTILEYDMINSTIL

SEQ ID NO: 147343 - protein, 523 aa, Heterodera glycines
  Coding regions on vcDNA: vcDNA=SeqID_73766; Strand=+; Position=1-1572
  Homolog annotation: Hit_ID=XP_320889.1; Match level="QueryCoverage =68%, HitCoverage=45%, E-value=2e-30, Identity=24%"; Hit description =ENSANGP00000012033 [Anopheles gambiae] ref|XP_313651.1| ENSANGP00000013044 [Anopheles gambiae] ref|XP_314
MADEAKVKLLMTKLNPVAFGEYKRFCLPEEITKFGFSDTKGRLIKLFSHPPSLAIDRYECLRVCREDGENFEIFVNRLKAALRKFRFSELNEEEFKCLVLLTSLKSPSDAKLRQHILARLTTEDTKTTKTAKLFDKVVEDLNTQLKTEAEAKILERPKFKINAVHHSDGQSSPNDAEKGNRSDKNRKFSDISDGKSPPNNCFRCGELHWAQNCPNKTQMCSKCNRRGHIKQQCDKIQAYHQNKRKIVPKINMVNLPVAFKNSGKFSKPLKAKILVNEKPIKFKLDSAADVNVINKAAFKAIGQPKVQYCPEEAQLFDGTRFKFIGRGIANFQFNGTNAEQQFYVAKDGTPNLLGVVTLDRLGFLEQIKRLINASNPNQISSEIPAKIKDKFQRSSAKIRREGAVSSINFDKFRPVLRTPTVTATENFSNYRKFGTKSQPPKIGEIFSRRHKSAAWSPGKINQIRQNSYTPFQDKSHGKIRANQPDKMKENHTGNYLPQIGAIQLCHRGPGDHLRSDPNKLSHV

SEQ ID NO: 147344 - protein, 35 aa, Heterodera glycines
  Coding regions on vcDNA: vcDNA=SeqID_73767; Strand=-; Position=1 -55,112-164
MNYDELSIVKEEAVVKTNENGKIKYKYLVGGMEQK

SEQ ID NO: 147345 - protein, 17 aa, Heterodera glycines
  Coding regions on vcDNA: vcDNA=SeqID_73768; Strand=-; Position=1 -48,145-150
MAIFHLMIMVMRKRETK

SEQ ID NO: 147346 - protein, 100 aa, Heterodera glycines
  Coding regions on vcDNA: vcDNA=SeqID_73769; Strand=-; Position=1 -16,113-193,297-401,523-623
MEKQKEKTLFGRIGELEGQQKHQKQQGEKESNELVGQIRQLKEEQKKYLERVNELEKHQKQMQQERGVSIFKSENLQDEQKRKNNSMEDNNEKQMQMVNK

SEQ ID NO: 147347 - protein, 642 aa, Heterodera glycines
  Coding regions on vcDNA: vcDNA=SeqID_73770; Strand=+; Position=1 -82,139-263,315-428,481-517,586-653,704-850,903-1011,1072-1178,1222 -1304,1372-1420,1508-1672,1825-1962,2020-2120,2224-2304,2353-2443
  Homolog annotation: Hit_ID=NP_501480.2; Match level="QueryCoverage =93%, HitCoverage=96%, E-value=2e-80, Identity=34%"; Hit description =cytochrome p450 2A15 family member (57.7 kD) (4J410) [Caenorhabditis elegans] gb|AAB03125.2| Hypothetical
VFPIFVLCFSFFLAFYNFYYKRRKLPPGPIPLPLVGNILTLIRKPGPIPLPLVGNILTLIRKPGEDAFLEWKRKYGPIYTYWLGEMPVVCVADYKNIVEVFRKGGEEEMPVVCVADYKNIVEVFRKGGEEFTQRQIFVDFTHEFRGTYGIFFYGIFFINGDFWKEQRKFASTVFRQRKFASTVFRNFGLYSNLMEKKILVELSRMFERILVELSRMFERIDRKLAKSESSEIIEISIGSIINCTLFGYGYDNERIDEERIDEFHELLALFDSAFKLAYEKNLGSLFSTLIVCFLKYFRERYEKYFRERYEALMEVSRNLRNFFMKRIQKRAEQIDFKSDEYDDFVEAFLKEKERLSDEYDDFVEAFLKEKERLDGQGIAHSFSMDQLWNICMDQLWNICMDIWIAGQETSETSSTIIAWGMAHLLNNPKSLARVYDELDKVMGDERRLITAGDKARLPYTNATINEFLRISNMIVQNAYRRVFVDVTIGNFQIPKGTCILPQISVVLADDEVFDNPKMFRPERVFDNPKMFRPERFLDENGNFVTCEKLIPFSVGRRKCFAKCFAESMAKMEIFLFTANILNQYRVRFSVGKVLPSIKREMGITIHCPNVRFSVGKVLPSIKREMGITIHCPNFECRVEKRI

SEQ ID NO: 147348 - protein, 162 aa, Heterodera glycines
  Coding regions on vcDNA: vcDNA=SeqID_73771; Strand=+; Position=1 -138,783-914,992-1210
  Homolog annotation: Hit_ID=EAL35225.1; Match level="QueryCoverage =65%, HitCoverage=10%, E-value=2e-09, Identity=39%"; Hit description =hypothetical protein Chro.30409 [Cryptosporidium hominis]
MEEKGETKEGEKEELEEEKEGEEEMEEEEKEVEEEEKEAEEEEREFIAFDFKVDEKDMPATDRAIEKLFDGIDAIYFMENGFKAIAHELEKLSAICSELEIDELERERFKLKRQMQIVSRKMSALIVKNSLSFNRQVENYESVRTNAEHLLRITRRMRRCEE

SEQ ID NO: 147349 - protein, 88 aa, Heterodera glycines
  Coding regions on vcDNA: vcDNA=SeqID_73772; Strand=+; Position=1 -93,175-348
MDAAFAEQTKLFNLERYALLNTANHFLGNTELVSVKLRRHFEGSLCDASRMAILDSLTMRTNPEGTTEQSDERTIDNLPFEQLCQVKV

SEQ ID NO: 147350 - protein, 213 aa, Heterodera glycines
  Coding regions on vcDNA: vcDNA=SeqID_73773; Strand=+; Position=1 -124,294-432,533-722,829-1014
  Homolog annotation: Hit_ID=CAE71390.1; Match level="QueryCoverage =57%, HitCoverage=13%, E-value=2e-20, Identity=40%"; Hit description =Hypothetical protein CBG18297 [Caenorhabditis briggsae]
MDEDKLALKNGQKDDTGGRESENSDKQEEQFAEDNFDTNPLVEKGVMQKSLIDNAFDVFECASQNLNCLLANAEMSAIKFDQFIKVVEFRTFGRQYFGNPCQLIRHTLMDQSRKYIERYHAEKMEEVKMFLESETFTLCPVPVQFTLFDLPEFFFLKELQQKQQNDEQTEEETEQNSVETFVHGKSIRFSVFRHSSEMDTEIFPYSPEQFDES

SEQ ID NO: 147351 - protein, 330 aa, Heterodera glycines
  Coding regions on vcDNA: vcDNA=SeqID_73774; Strand=+; Position=1 -748,799-1023,1349-1368
  Homolog annotation: Hit_ID=NP_608540.1; Match level="QueryCoverage =98%, HitCoverage=61%, E-value=2e-28, Identity=28%"; Hit description =CG2839-PA [Drosophila melanogaster] gb|AAF51469.2| CG2839-PA [Drosophila melanogaster]
MGNIFGKREHGRRRRKSGEEKHEEEEKSGRRNERMGEGEGRDDEEEEEGGNGREEEERQKEEIAQREHQKRREGNSKIPKCPHGFRPMNYPGTRWTFLECVMDEELKLMKRRKKTKRRKQKDKRRRSKRKKRRGNKEWEDEVEEEEAEEQQKRGDERHHRQQSEGDTEVEWETERRKEGTVQHKRKREEEEETVQHKIKRGEEEEEEDETVQHKRKTAEEEEEEDEIVHPKRKRGEEEEEEEDKSAVCPRGSICLNARDDPFGRALCCVKRGKHLKDYKLGMEEMKEEEDKFRKERKDGDEKKRIELATEMPTAAVPMAFKRSTARKKTW

SEQ ID NO: 147352 - protein, 457 aa, Heterodera glycines
  Coding regions on vcDNA: vcDNA=SeqID_73775; Strand=-; Position=1 -13,495-1510,1688-2032
  Homolog annotation: Hit_ID=CAE69590.1; Match level="QueryCoverage =91%, HitCoverage=19%, E-value=2e-85, Identity=43%"; Hit description =Hypothetical protein CBG15812 [Caenorhabditis briggsae]
MGLISVLNPTSGVFRGKYVQDPISLRDALAHGYIQFPSAQPLLALTLTDCIVDGFIDAHAGEFVDRFGSSGERFTLRDALDRQRPLVKDNVRECINTATNQRLTIAEAMLAHALNPRSGKFTDLATRAELSLRQAYDQGLIQKSQTLTEVVEKGLLDTQGHFSDRGNRFTLMEAINSGLLDAEVRHIVSEQDQEVISIGEALERGLLSPDGKIVLGWAADGAHPERQLDLHEAHRQGLLTRRARHTIFDVKGVKNAELGTTLSFNEAVEAGIMQVQEEILDPKLAFSQVQTERVLDQAVRQTLSLSDASRQGLVDSALADILMAPCGLSEGGTEVSLIRAVSKGLVDASKGVVVDPRFQRELSVREAYDRGMFTSLRSAMHLAALLDVHPSLMTPVKKKPYSKKRIQRPGQPALAEDQVKVDERSLALGTTAYWHFFGINKLPRLLDSSTIMAQHLD

SEQ ID NO: 147353 - protein, 243 aa, Heterodera glycines
  Coding regions on vcDNA: vcDNA=SeqID_73776; Strand=-; Position=1 -273,533-700,1144-1433
  Homolog annotation: Hit_ID=CAE69590.1; Match level="QueryCoverage =62%, HitCoverage=7%, E-value=2e-36, Identity=53%"; Hit description =Hypothetical protein CBG15812 [Caenorhabditis briggsae]
AQEQRQAERVEEVHEFQPPPPVIPEMPRITEHEEEPQMFQEVGPEGMYDDDHENPAKDSCPLMCNCYCISLTVMIINLDQNHQVLTASDWKETVTKTQFYEMEGILHKQTGEILTFVEAIRQGLLNLSAGGEFFDIVSGQSVSLDKAVDMGLISENITEILNGRHGIKHPETGQEVTLLEAIQIGLYDPDSRQLRDIKTGELLSLFDSRHICPTDVQHRLIKMGVLKLPPMELEQALKNGPLE

SEQ ID NO: 147354 - protein, 122 aa, Heterodera glycines
  Coding regions on vcDNA: vcDNA=SeqID_73777; Strand=+; Position=1 -213,249-401
MADEQEETQVAPPQPVLHTENVSSFLDLQTEFIKRRDAAIAGKSQSFATEPMHRRTPRNNILAISKEEKAQKAKSEVSTLRAQRIRQNEEAIRKEEQQRAKQQQILQQKAAIYERMAKGERL

SEQ ID NO: 147355 - protein, 36 aa, Heterodera glycines
  Coding regions on vcDNA: vcDNA=SeqID_73778; Strand=+; Position=1 -61,719-768
MADPIDSKYFDFVPATEEQQEPGILKILGLGMGLDN

SEQ ID NO: 147356 - protein, 60 aa, Heterodera glycines
  Coding regions on vcDNA: vcDNA=SeqID_73779; Strand=-; Position=1-180
MEAAQAFEMPKLGLLNYALIWLEGCAEYALIWLEDFAELALIWLDDVQNLSAAADCAKIV

SEQ ID NO: 147357 - protein, 279 aa, Heterodera glycines
  Coding regions on vcDNA: vcDNA=SeqID_73780; Strand=+; Position=1 -469,856-1050,1334-1509
MIRSLKKSKFEGRIKNFKCSLKQTNSEDNRKHSDHFDEKEKLKIIKEFDKRREILKNKNIYNCKQRRLIEREIARELGTYLHKIEEWKREFGLIKRAKKEDKETKLALIEQFDRMKNERKMKKGYKNAEKVGIECEIAKELGTHRNKIYKWKSELLSPPTKKFSMQQRMEIVDTFEKVKELFVKKFNFKPTVEIEEKIVEKFGICRRSIYIWKNIFELRICPKHKYSEAEKLELIEKFDEAKSKNPTISDEELEKMLPVKISTIKQWKRGTKRRKTVKL

SEQ ID NO: 147358 - protein, 91 aa, Heterodera glycines
  Coding regions on vcDNA: vcDNA=SeqID_73781; Strand=+; Position=1 -52,793-1016
MVLLFSVLLFLLSLVKIEIKKQKQICKFRSEGCQTVVRVQHLQQSGPGRSLPWGNLDKLLQRGETSLVMPLTLCRSFRSIRFDIFRHFSAA

SEQ ID NO: 147359 - protein, 21 aa, Heterodera glycines
  Coding regions on vcDNA: vcDNA=SeqID_73782; Strand=+; Position=1-66
VNIDHRPQTQKCLKTVRIDVK

SEQ ID NO: 147360 - protein, 71 aa, Heterodera glycines
  Coding regions on vcDNA: vcDNA=SeqID_73783; Strand=+; Position=1 -69,143-289
MFENFLILTIFCCFANAIAQGQNGYYCQQVGGFYSCISCNEPSLVKLCKIFLPERPLGLKIEMAFFVCLLS

SEQ ID NO: 147361 - protein, 92 aa, Heterodera glycines
  Coding regions on vcDNA: vcDNA=SeqID_73784; Strand=+; Position=1 -189,513-602
MADQKVQSIKDEQQQQIDLTPAAHHPAQQQHITFTFKCHPTNESRGEKAAEDGEAKAMPIGVVILLTVLGVLLVEAIVGFLVFLCISMRKGI

SEQ ID NO: 147362 - protein, 35 aa, Heterodera glycines
  Coding regions on vcDNA: vcDNA=SeqID_73785; Strand=-; Position=1-105
MTDEEKRAVEQRLSRKKKQLKEEETKLQKAWKFVK

SEQ ID NO: 147363 - protein, 87 aa, Heterodera glycines
  Coding regions on vcDNA: vcDNA=SeqID_73786; Strand=-; Position=1 -239,317-341
MFFNFFADLGQQLISISGQTGGQIGRQIVGQVGGQIVKHVGGQILGDIGEVVQCAVPLTSGHSWLAELSQLVVRPSRLGRVKDFNFV

SEQ ID NO: 147364 - protein, 20 aa, Heterodera glycines
  Coding regions on vcDNA: vcDNA=SeqID_73787; Strand=+; Position=1 -22,141-181
MFFQNPIDYSSEKFLLNDFY

SEQ ID NO: 147365 - protein, 58 aa, Heterodera glycines
  Coding regions on vcDNA: vcDNA=SeqID_73788; Strand=+; Position=1 -22,609-763
MLNFQFKAFDYLFFEFYYKLPYVFKYAFEVWLSIKPCRKAVLRSTLKAFGVFTNLDLY

SEQ ID NO: 147366 - protein, 68 aa, Heterodera glycines
  Coding regions on vcDNA: vcDNA=SeqID_73789; Strand=-; Position=1 -63,577-702,1210-1227
MAEEEFCSKLLYDQDDDEKAANSNYRICSNYHPWGIIFKPLRNGGIIGDCGINRDWAIIRAYTAEKIK

SEQ ID NO: 147367 - protein, 257 aa, Heterodera glycines
  Coding regions on vcDNA: vcDNA=SeqID_73790; Strand=+; Position=1 -252,1085-1220,1292-1350,1421-1597,1638-1784
  Homolog annotation: Hit_ID=NP_723849.1; Match level="QueryCoverage =66%, HitCoverage=16%, E-value=2e-42, Identity=50%"; Hit description =CG31811-PB, isoform B [Drosophila melanogaster] gb|AAF53343.2| CG31811-PB, isoform B [Drosophila melanoga
MMEAEHARDLTQTFGVFTLEHCKAMTGRITIQKPRTDAYNAHLPENNHRFGISLTFCERIKSYQMMTSRSVQLDKNHRKRQRNITEIQRFESVHPRIYQIYDLLKKLRSDQSRQAELIEQIQEQVIGIEDAFVNSQEWTIGRTIHEIRVGVIGSEDSCKNSLIHYFLTRNWNWEDAPEGGRFKKEVFIDGLSYLLLIRDEGSREPNIQFAHWFDALLIVFAIESHQSFNAALELHKKVHYFRPLDSTDVPVYLIGMR

SEQ ID NO: 147368 - protein, 96 aa, Heterodera glycines
  Coding regions on vcDNA: vcDNA=SeqID_73791; Strand=+; Position=1-291
ARVDGSALASLCQRPPQQSRQSPATSTLGRLAVHGRLHPLHALLLRIGRPPLCRCRTFDAVGHFIRIQSQQFGHNRCTSPAATQQQQPLCKLQQHQ

SEQ ID NO: 147369 - protein, 56 aa, Heterodera glycines
  Coding regions on vcDNA: vcDNA=SeqID_73792; Strand=+; Position=1-169
TTAQWGADQCGAGGRGGDGGDHVRRADRVLKLLVTGVIVEVGVDRARPMLIHRLSP

SEQ ID NO: 147370 - protein, 44 aa, Heterodera glycines
  Coding regions on vcDNA: vcDNA=SeqID_73793; Strand=-; Position=1 -45,139-228
MSSSCITFLIGATGMNNQPLSSPLCFTWPLSASHSPALPTDAFD

SEQ ID NO: 147371 - protein, 344 aa, Heterodera glycines
  Coding regions on vcDNA: vcDNA=SeqID_73794; Strand=-; Position=1 -63,923-1021,1273-1333,1385-1430,1869-1986,2064-2142,2264-2438,2724 -2906,2973-3064,3214-3287
  Homolog annotation: Hit_ID=CAE69462.1; Match level="QueryCoverage =99%, HitCoverage=99%, E-value=3e-88, Identity=47%"; Hit description =Hypothetical protein CBG15658 [Caenorhabditis briggsae]
NSMNLSQQFFNLLLHFRRHDLVAFVNEHSRLYAEAQISGDYGECIAHYYSVMSKINEYFCGSFHFVPPILPPEPLPVLPVALRQLHLRIGQSLELGPGKHCLDIGCGIGDVIKNLAFTGAHFTGLTIAENEVHIGNANFRSLGIDNNCFLLLGDCTKISIQNESKDAAFALYSLKYMPNLGHIFAELDRVMKPGGKLLIYDLLKTDKFDVSNEKHCKLLSELEFACGMPPLHSRSELLAEADKAGFQLIQANDLQHESGMFYHCFSHSPFFMWLMRSRLTENLIKVAQTSRLTENLIKVAQTLKILPRGFHEFNKIFIRGTVVKIVEAGQLGILSGSEILLFCK

SEQ ID NO: 147372 - protein, 147 aa, Heterodera glycines
  Coding regions on vcDNA: vcDNA=SeqID_73795; Strand=+; Position=1 -219,620-846
NKTGQQLRRTPTKEEKSNSTPEGRKRATQPPRGGKEQLNPRGEEKSNSTPEGRKRATQPPRGGKEQLHPSPEEFFSQIFHGHCSFGTHLFEIESRTNPSAHSQVQGGHIIRVQNSGFGLSQLGSHPLHFLSPGFSFGGHFNPKTISD

SEQ ID NO: 147373 - protein, 100 aa, Heterodera glycines
  Coding regions on vcDNA: vcDNA=SeqID_73796; Strand=-; Position=1 -123,217-396
  Homolog annotation: Hit_ID=NP_505347.1; Match level="QueryCoverage =68%, HitCoverage=43%, E-value=5e-09, Identity=45%"; Hit description =predicted CDS, trypsin inhibitor-like, cysteine-rich TIL region family member (5J532) [Caenorhabditis ele
MFRIPCLILFFVILPLITVQSFHDSDHDDDRDDDRNDGRCMCPPNEKPGDRKCNGCEPSCDNPNPEFCTLMICPPCTCECADGLVRDSISNKCVPKEQCP

SEQ ID NO: 147374 - protein, 94 aa, Heterodera glycines
  Coding regions on vcDNA: vcDNA=SeqID_73797; Strand=-; Position=1 -96,191-379
MFQSPCFFLFLIVLSSCVIGLTAQANDNVRCRCPFNERPGNRKCNGCEPSCANPNPGFCTLRLCPPCTCECANGLVRNLNTNRCVPRRRCPRKK

SEQ ID NO: 147375 - protein, 122 aa, Heterodera glycines
  Coding regions on vcDNA: vcDNA=SeqID_73798; Strand=+; Position=1 -101,269-328,815-1022
  Homolog annotation: Hit_ID=AAG21338.1; Match level="QueryCoverage =50%, HitCoverage=91%, E-value=1e-21, Identity=71%"; Hit description =hypothetical esophageal gland cell secretory protein 9 [Heterodera glycines]
MNCSSAAMLMLLMTIFTVLSNVNEVAAEEHELVSRIKRNGYGYSSGYGGGCSACLPTPPAPPAGAAPTPLTRLPLTPLIPLLPLPIRPTPLLPLPTPLTPLLPPPTRPTRPTPPLPPAPRAA

SEQ ID NO: 147376 - protein, 512 aa, Heterodera glycines
  Coding regions on vcDNA: vcDNA=SeqID_73799; Strand=+; Position=1 -91,151-468,510-720,769-968,1454-2172
MKLINAFEFAVCSILLIAAQLFQVSFSCEIEKINKAIDNLYINLFELQKMDKSQQNYFENDHKNWENILLKIESKLLYSSICTILKSAEMPKNAHKEKDRLKEFLEKYKKLSSEFSDSMLKNCEFWKVWRLVAKNFGKNIKVANGEINFECQNRKIIRRLEGAVEDPFAGDILTGHLNALSQLLTPKKGDEKPIQIGKMREKENNNWDFNGFFKKAKMKSESNIAYLLRKNRVEKNIKGIIEIKQRIEHHFGTQFLEKMEQLRPIEMTFGDYDNIIDDQRLANSYVKFLQKEEAAKLAQQNEAHLLLSTRMFFGQIISIFSMTNSYGKMKTKKRKDVENMKRICAEIETIWNKNFYEICTQIETNSAYSVESISKFWHKLAKLFNKIPFLKKCEKFLIIYEELTLEKTNGLEEFLWRAKDQLMSEHAKNVIRLTVGQSAECQNALSRFLANSLGQMKGAKHRLYKFFTSQFIGITYFDKLLQENANFAQVFRSGDFFIFSDEYYRNSKIIII

SEQ ID NO: 147377 - protein, 478 aa, Heterodera glycines
  Coding regions on vcDNA: vcDNA=SeqID_73800; Strand=+; Position=1 -74,188-519,603-1633
  Homolog annotation: Hit_ID=AAG00551.1; Match level="QueryCoverage =70%, HitCoverage=97%, E-value=4e-39, Identity=31%"; Hit description =retinitis pigmentosa GTPase regulator [Homo sapiens]
MDSDSETDVHTRALFMVDYLAFYQWLKNWQEKLSKRTQPSLEQLLFQIELYLDFLASTTESATGEAAKMEHKQKMLALKTAKDAFFPDEAEVIVIDGRGENTANLLAIKMELLLMHNEIIKGLIENEEHFLDKVKTIFIDQKRLRIMIPRMSQEYQILIDNAKGEKQHGNENKNNGKEDEEEKGEGGEIGDKKRSEKEDERGIEKENEKGIEKENETEKEVKKRSEKEDESIGEKGENGRDEKEKEEKKGKEKVEQKGESEEDEKEKGDKKGGEKEDEKGREKVEQKRGSGGNKKEKEDKTEKGGEEDGKRRDEENEDTKGRDGKAKGDKKEKGGGEDVKERDEKEKEDKKGRENVEQKGGSEEEEKEKEDKKGRKQVEQKGGSGGDKKEKQDKKEKVGDGKRRDEENEDKKGRDGKAKGDKKEKVGEEDGKGRDEKEKEDKKGRENVEQKGGGDEKGGEGGGAENKGCVDSDGEISL

SEQ ID NO: 147378 - protein, 1035 aa, Heterodera glycines
  Coding regions on vcDNA: vcDNA=SeqID_73801; Strand=+; Position=1-3108
  Homolog annotation: Hit_ID=NP_920205.1; Match level="QueryCoverage =96%, HitCoverage=66%, E-value=1e-112, Identity=31%"; Hit description= putative DNA helicase homolog [Oryza sativa (japonica cultivar -group)] gb|AAP52492.1| putative DNA helic
MYEDCNTVFARCHDAKKARLFITFTNNREWPEFKENLHKNGQVFTDRFDMWMRVWSSKIAEFREELYDKKFFGTILGYGESMEFQGRGGPHAHIVAQTDLDAVPYVIQEYIWAHIPSLPDKDDDTPIAKMHREIRETMHMQLHRCSDSWCGPSDPIYGRCKKGFPAPYSKCTILRPDRPAMYFRPSPSDGGAQLEVNGLIYDNSHVVPYNPYILLRYRVHHNVLFAYGNKANIKYALKYPFKGPGHCYVECKEESGNKIGIDEPAQYAKMNFRGATEAYAIVHSMPFARLSHHVVKLAIHLPNQQPIVYRAFQLVSKAQQIQQGELPETQCSAYWKQWQNEWKNDPKFKDILFEKVPERFRWAKDKWVLYKRQQIKRPPIGRIVPVPPSDPERFALYSLMRHFPGDPDHLKMVNGLLCTSFTEAAIMHGLLEDDKIWDKTLAEAALSRWPDQMRWLFVSILVYGQPSNAIELWNKYKDQMYNPQGIITLAQHKVAELEALADIDWRLHSCFNLSCVHFSLPDPPTSIAKNTDAAIEEFFFGDDDLNLPPGQPNPRPQPNTPPPLNSDQQKVFDAVLLAIQSNPKDSTVPRRFFIYGDGGTGKTFLFGQIIRRLRKAPYTYKVLATASTGCAAILLPYGKTAHSTFRLGREVSLDKLPSIPLESFFARRIREAQLIIIDEITMLHNTVIEVIDRVCKEMAIRQHKDLLFGGKTVIFSGDFKQSLPVVPHEGLTAQVTACFQTSPLFGQFTTMKLTINQRLGQGQQAYLQMCRQIGLGETGEHFWIPPQFLVKSKEELIDYVYPNFQQLLGNDKELLNRLILAPHIDTCDEVNEIMMANVPGQVREYLSTDKPLDDRPLDIDEIESEVAALNRRTDSGMPPHSLRLKVGCVVVLLINKSDKEGLINGTRIVLEELGDDRLIGRVINSNAIGGQVRFFLERTRNVYEDKSPGGIKYERLQFPIKPAFAMTIQKGQGQTIRTVGIDLEREVFSHGQLYTAFSRATDGNNVRVHAPNREIDAQGRAKVLNIVATNMLKLQ

SEQ ID NO: 147379 - protein, 53 aa, Heterodera glycines
  Coding regions on vcDNA: vcDNA=SeqID_73802; Strand=+; Position=1 -63,164-262
GLYRTCGVKSKVEWICVQFEQIPSSDVDIDLSDVHPMNIASVVKLYTFLFSIT

SEQ ID NO: 147380 - protein, 83 aa, Heterodera glycines
  Coding regions on vcDNA: vcDNA=SeqID_73803; Strand=+; Position=1 -135,426-542
MSVSNLAAVIAPSLMWPSNYGTHSAAISDAHRQSKAVEMLTRHAHRIIEVDQRVTRPFIDQFSSKVIRGPCWSENNNCSSNTL

SEQ ID NO: 147381 - protein, 200 aa, Heterodera glycines
  Coding regions on vcDNA: vcDNA=SeqID_73804; Strand=+; Position=1-603
MLPLMVQEVFDVNFALDWRTFFDTHPNVPEPTNEHSSVGAIDRGISGTPRPEFCSDSVDGDNKPRRQDAGDSRHAIVGDQRRGAGTLAAVDLSAEDIDDELVEDDDDDENEEVDELLEDDDDDEEEEEEELIMTSAADHRHRHGGQPQLSGGGIAKNGAGEGAAQMPSPAVDEKKQHHHFHSVFDKRLLVDSYCKWREKA

SEQ ID NO: 147382 - protein, 147 aa, Heterodera glycines
  Coding regions on vcDNA: vcDNA=SeqID_73805; Strand=+; Position=1 -49,487-881
MELPHLHAWRLLFTCQKDRFFSLTLTHDERIYFRINKTNHKNSFFVLSWDIHSLAESASLEMGHISFKSKERLVRRMAMVEAVQKARGEIRVEFVLVLVHFVDHELCFDRLGNCCFYQALITANGSYFIKILYNEKIIKFKASYLIF

SEQ ID NO: 147383 - protein, 92 aa, Heterodera glycines
  Coding regions on vcDNA: vcDNA=SeqID_73806; Strand=-; Position=1 -52,263-453,506-541
MHSIVVIFALIITVQSQCSPPNERSKNESPSNEKHHQNASQSNQNEGGVSHSLEKNCPICLDEFEESDGRQNQKNEPIKCGHVFHKQCLDKW

SEQ ID NO: 147384 - protein, 134 aa, Heterodera glycines
  Coding regions on vcDNA: vcDNA=SeqID_73807; Strand=+; Position=1-405
MSCEVNESNEKDYNPADLSFAYLCAYFILKLEQNEDILLKVERVAKEQWMEASLYPANKKKSRAKVQAEEDEKRWGKRTDEAKKALEDKMAEILAKAKEEDERVAKEKEETTKKANERAVVYPGRECPDRRSVD

SEQ ID NO: 147385 - protein, 147 aa, Heterodera glycines; identical to SEQ ID NO: 147382
  Coding regions on vcDNA: vcDNA=SeqID_73808; Strand=+; Position=1 -49,479-873

SEQ ID NO: 147386 - protein, 161 aa, Heterodera glycines
  Coding regions on vcDNA: vcDNA=SeqID_73809; Strand=-; Position=1 -6,576-1053
MEPYFGFGSPSATPVLHHHNNCTTGTIGAGNFPSNTPSTSSDSAAGTIGPVEQQHLQLQYQQQNGGGGCSGVRSLSRHRLVIRDPFDDDCNNNNNNNFVEDEQYSNGNGCLLNGGAHFGMPPSSSASSSASSWFSNNMMSSSAAAQQCRPSAASAPPSLMD

SEQ ID NO: 147387 - protein, 80 aa, Heterodera glycines
  Coding regions on vcDNA: vcDNA=SeqID_73810; Strand=-; Position=1 -69,688-861
MTTAAIFQQLFRKCIIISDTISQYTVHERPEFVAAWDFVGTSAVFVAPPPPAAVPPPLACFFNAGKTSTEKLRAPDEEIK

SEQ ID NO: 147388 - protein, 106 aa, Heterodera glycines
  Coding regions on vcDNA: vcDNA=SeqID_73811; Strand=+; Position=1 -99,630-778,1593-1664
EKSAKLASFFYANSSTQSLSELSTSTTLLYRSGARNFSVDVLPALKKQASGGGTAAGGGGATNTALVPTKSQAATNSGRSCTNDGGTKCVLNPVFCTDEEEGGNTK

SEQ ID NO: 147389 - protein, 72 aa, Heterodera glycines
  Coding regions on vcDNA: vcDNA=SeqID_73812; Strand=-; Position=1 -69,371-469,806-856
MYNKMRTAEWTRQRGQVHCLPKQLLGMPQTVIPIAIHPEMQKQFAVRPLLIDQTMACFRHSSQKGATVLRFC

SEQ ID NO: 147390 - protein, 126 aa, Heterodera glycines
  Coding regions on vcDNA: vcDNA=SeqID_73813; Strand=-; Position=1 -201,769-842,1070-1102,1155-1227
  Homolog annotation: Hit_ID=NP_507972.1; Match level="QueryCoverage =46%, HitCoverage=8%, E-value=4e-12, Identity=53%"; Hit description =eukaryotic membrane protein DUF747 (80.7 kD) (5V59) [Caenorhabditis elegans] emb|CAB62802.1| Hypothetical
HHPQCGVQFAQPIAAHHHDEQQFCGAERGRVQEVRQAQSVPNVVQRCARTFPLNHFVGCCCAAQHDEYTITIAYDVLRTHETDSFSDFSDQVSRRMGFVPIPVVILLIRVICQSVDFENPLSVAAL

SEQ ID NO: 147391 - protein, 445 aa, Heterodera glycines
  Coding regions on vcDNA: vcDNA=SeqID_73814; Strand=-; Position=1 -462,942-1464,1507-1859
  Homolog annotation: Hit_ID=NP_507780.1; Match level="QueryCoverage =63%, HitCoverage=19%, E-value=2e-31, Identity=30%"; Hit description =predicted CDS, DNA polymerase type B, organellar and viral family member (5T899) [Caenorhabditis elegans]
MDGRGQRQRRPICQWRRVCRACGRIAYVATHQCPHDQPADDGICRRCNGPHTVDEPCYIQPIDDGSVRQRASIAVDNDDSDDDEDDEELPLRLCFFDAETSQDTPLQLNNRTVQKHVPLLIVAEVICERCLQAGISVNDGLGRRAPGCVCMTGMRLNGLPAQEFYAPDTMKAEKRAQFHRWHADNNGNGFQLREQLIMYCVNDVAILRESVIRFRQLIADNTQGLDPFLHASTAAGLALATFRRCFLPANRLVHSPEGGYLRGRRASAESQRYIRFFELEHPEAQVQCASWSVGEAHIDDSGYRVDGLWRREAPLRPLAIEWLGCYFHGCPVCFPDRQQQLAAGRTAEDLYERTERRLFELENDHGCEIHKVWACQWTERLRHDPDLKRRYDAVFVPCPLDPRNDALRGGRTEPFKLHHVCSDDEEILCIDIVSLYPYVMVGFFF

SEQ ID NO: 147392 - protein, 70 aa, Heterodera glycines
  Coding regions on vcDNA: vcDNA=SeqID_73815; Strand=+; Position=1 -36,97-273
MRLLKIFICEPWNALNRQQKNDFNYMKLASLMTPPYSHRQALPSCEQWKFILKNEKHYQQKMYAKHKNKK

SEQ ID NO: 147393 - protein, 91 aa, Heterodera glycines
  Coding regions on vcDNA: vcDNA=SeqID_73816; Strand=-; Position=1 -83,126-235,291-370
  Homolog annotation: Hit_ID=NP_491663.1; Match level="QueryCoverage =96%, HitCoverage=49%, E-value=4e-19, Identity=49%"; Hit description =adenine phosphoribosyltransferase (20.2 kD) (1G247) [Caenorhabditis elegans] gb|AAB37633.1| Hypothetical
MDEEKLKNEVANCIRSFPDFPTKDVLFRDIFPLFSNPSLIRSICAHIVTLYRQKIDVVVALEARGFLFGPIVALEMDVPFVPVRKRGKLPG

SEQ ID NO: 147394 - protein, 141 aa, Heterodera glycines
  Coding regions on vcDNA: vcDNA=SeqID_73817; Strand=+; Position=1 -100,402-499,741-966
  Homolog annotation: Hit_ID=AAG60622.1; Match level="QueryCoverage =95%, HitCoverage=16%, E-value=6e-22, Identity=43%"; Hit description =phosphoinositide-dependent protein kinase I [Aplysia californica]
MSDIAGASSSAFSADASSTKKKGDFLFLAELGEGSYSTVYLASERQTSRKFAVKMCLKKKIIKEKKVQQIFRERDILRLLSTPANACPFVVHLFCTFQDDESLFFVLSYAPKKDLMARLKKLQRFSVGQCQFAMAELFLAL

SEQ ID NO: 147395 - protein, 213 aa, Heterodera glycines
  Coding regions on vcDNA: vcDNA=SeqID_73818; Strand=+; Position=1 -302,561-601,1123-1423
  Homolog annotation: Hit_ID=CAA69216.1; Match level="QueryCoverage =96%, HitCoverage=30%, E-value=4e-32, Identity=33%"; Hit description =serine/threonine protein kinase [Drosophila melanogaster]
HIHALDVIHRDVKPENILLREDGHILLSDFGCAKQIIAKRENVAEENGDKTDGQRGDDGQKAEKSADSKSSKKREEEEATKLALRRRCSFVGSGAYVSPEVLNGKEVTGACDWWAFGVTLFQLLVGRLPFSADSEYLLFRQVLALSYKFPDNFPCAAARQLVQALLVLEPTQRIGAAEMGEPTTMRYHPFFDGTVWEGIEKRKSPLFDSAENG

SEQ ID NO: 147396 - protein, 141 aa, Heterodera glycines
  Coding regions on vcDNA: vcDNA=SeqID_73819; Strand=-; Position=1 -101,559-883
MPIPPVVLREFVPGTPLGDWVVSTPTATRTFIDRVDTFCEQIGTMLGTFHAACDRHNFCPPVFRQYAPIMALEHWHFHWREFELQKRTDKLEAKMAKQCAEVFEQFEQKVLGRRSEFEQGISPKREGRKMDISYLNTYIVF

SEQ ID NO: 147397 - protein, 147 aa, Heterodera glycines
  Coding regions on vcDNA: vcDNA=SeqID_73820; Strand=+; Position=1 -158,246-353,750-927
MYSKYFFENFMKFLTIFVFIGIHSSTVAEVIHQLPEDNICAKFTVQFLEEFYQQNSSSPMFGWITAEGDVTLGQQNGTHFGIKCLALALTLAPPNSHRRFIASPWHQQNDQLNNGTNQTADQNVSYIVPLKSAEVRSPQLISVRRQI

SEQ ID NO: 147398 - protein, 452 aa, Heterodera glycines
  Coding regions on vcDNA: vcDNA=SeqID_73821; Strand=+; Position=1 -110,228-260,310-329,641-704,746-960,1120-1270,1324-1518,1572 -1704,1753-1960,2030-2259
  Homolog annotation: Hit_ID=NP_498863.1; Match level="QueryCoverage =100%, HitCoverage=71%, E-value=1e-112, Identity=46%"; Hit description=GTP-binding protein LepA like (3J519) [Caenorhabditis elegans] gb|AAA28191.2| Hypothetical protein ZK12
KSTLADRFLQLTNVISTESDAQYLDKLEVERERGITIKAQTCSMFHKDFMLNLVFEVKRSLITCDGAILLVAANEGIQAQTLFNFHSAFENNLSIIPVINKIDMKANIAKVEEELQQSFGFHADEIFKVSAKTGRNVPKLLEAIIQSFDHFKGALLFVVVKQGILTKHLPIRFFSSPEKEYVVSEIGILHPETTPTNELYPGQMGYIYCGIKSSRDVLVGDTLFHATERIETVKPYVEIGNVKPTVYSGLFPMETTEYERLRNAVESLQLNDPSVNLQMDSSVVFGQGWRVGFVGNLHMEVFGQRLEQEHGELAVFTSPSVKYLAGWYLTMQKHTDKGPSDIVDNEGIRKRRHKGQSQIAICKPSDFPEVPTDVLRFLEPMYLVSIVTPAEYFSNIERLCQNARGEVLETTYIDEKRMILRWRLPLVEIIVDFFDKLKLTTSGFASFDQKDD

SEQ ID NO: 147399 - protein, 291 aa, Heterodera glycines
  Coding regions on vcDNA: vcDNA=SeqID_73822; Strand=-; Position=1 -46,117-177,232-397,532-691,942-1085,1144-1176,1228-1377
  Homolog annotation: Hit_ID=CAE60331.1; Match level="QueryCoverage =95%, HitCoverage=60%, E-value=9e-90, Identity=60%"; Hit description =Hypothetical protein CBG03923 [Caenorhabditis briggsae]
CQMPMSLDLDDDEEEIEKALTAAPERDLVDLAGILGMHNVLNQPQYYNALKGKGQMHNVLNQPQYYNALKGKGQNEETGISFSGVIKAFQPRVVPDEPDNETDVEECTRRLESGDVKLEEVNLNNLKRVSKERIRSMLRAACKSKHLKKLCMANTAISDQEARPLVELIEHSDSLKVLNIESNFISPEMIAKLLRATLQTQSLVEFHAENQRQSVLGNQIEMRQSVLGNQIEMDIMLSVEDDIMLSVEDNDSLLRVGVSLQSMEARNRVGEALERNYERRKSNNTEKQMQK

SEQ ID NO: 147400 - protein, 122 aa, Heterodera glycines
  Coding regions on vcDNA: vcDNA=SeqID_73823; Strand=-; Position=1 -217,822-971
  Homolog annotation: Hit_ID=NP_491734.1; Match level="QueryCoverage =100%, HitCoverage=28%, E-value=2e-34, Identity=56%"; Hit description= tropomodulin (tmd-1) [Caenorhabditis elegans] gb|AAB52440.3| Tropomodulin protein 1, isoform a [Caenorha
YYAEEKTLAAPKQPLAKRAGGVGGLTSGAGNCGGEKYYGRDLSNYDDKDIEGLLSNLNTDELEELNNDFDPDNSLLPPSQRCRNQTDKKPTGPFKREKLLQYLEEKAKSEKDWEEAVPFAPG

SEQ ID NO: 147401 - protein, 136 aa, Heterodera glycines
  Coding regions on vcDNA: vcDNA=SeqID_73824; Strand=-; Position=1 -96,661-799,1680-1853
  Homolog annotation: Hit_ID=CAE57738.1; Match level="QueryCoverage =97%, HitCoverage=41%, E-value=2e-22, Identity=44%"; Hit description =Hypothetical protein CBG00749 [Caenorhabditis briggsae]
MLLLASWLFLLPIFLIVQPAPNVSAWTTVAPTPNIYSTDKVAEQRPAAADTLLLVSTIDGYMNAIDAHTGAHKWRFHEGPLLSSPVSIQRGFTFIPNPRDGQLYLVVEGRLSKLPFTIPHLVRVSPCRSSDGVFYA

SEQ ID NO: 147402 - protein, 183 aa, Heterodera glycines
  misc_feature (182)..(182): Xaa can be any naturally occurring amino acid
  Coding regions on vcDNA: vcDNA=SeqID_73825; Strand=-; Position=1 -26,1001-1103,1409-1498,1625-1755,2027-2116,2161-2236
  Homolog annotation: Hit_ID=CAE71154.1; Match level="QueryCoverage =97%, HitCoverage=24%, E-value=4e-55, Identity=58%"; Hit description =Hypothetical protein CBG18010 [Caenorhabditis briggsae]
RTGEEGRLRFLGNEFGHPEWLDFPREGNNQSYHYCRRQWNLADDLTLRYKYLNAWDRAMNHLEMDSEFLSHGHAYVSWKHDGDKLVVFERAGLVFILNFHPEKSFGDYKIGVEMSGVYCLALNSDQSEFGGHNRLKQDQCYHTFAEGYAGRKNHLCVYYAGRKNHLCVYIPSRVAIVLKKKXT

SEQ ID NO: 147403 - protein, 163 aa, Heterodera glycines
  Coding regions on vcDNA: vcDNA=SeqID_73826; Strand=-; Position=1 -111,320-384,716-807,1140-1349,1627-1640
MRILLIIWRESFSESHYLLHRKLAELLASDVQNVEKVPTEEPAEYEGRLLVWTRTVLKRPEHGQQVSIWEQDITEFFLPNANKADSFQLDFLTNYYGIIQQLFGFQFNVGIMETSSWDFSLSIFRALPTIKKFAISQSATPTISQWHNLGYEKIVGAMPVKIF

SEQ ID NO: 147404 - protein, 143 aa, Heterodera glycines
  Coding regions on vcDNA: vcDNA=SeqID_73827; Strand=+; Position=1 -279,485-540,609-707
TGEENENQGGQQQGGGGTNNGRGNNRGNENGGQNGNGQQQQQPPAGGATCTNRATGCDVAYCGNTDFARAHCAGTCRSFLNECSHLASVPDPSVACGNPAGDCAMNPNVCSDDVLAVCGCPRKCGRCSDHTTYIMQGKCRNVL

SEQ ID NO: 147405 - protein, 693 aa, Heterodera glycines
  Coding regions on vcDNA: vcDNA=SeqID_73828; Strand=+; Position=1 -386,432-495,828-992,1434-1649,2795-3593,3645-3895,3950-4150
  Homolog annotation: Hit_ID=NP_056197.1; Match level="QueryCoverage =96%, HitCoverage=29%, E-value=5e-52, Identity=34%"; Hit description =HECT domain containing 1 [Homo sapiens] gb|AAP13073.1| E3 ligase for inhibin receptor [Homo sapiens]
MAVVTKLCSKIEPTDANIGECSRNLGDLLEHDDERVAECALRCFAAMTDRFVRRQMDPMALASPSRLVAHLFDLIGSSSTAHENAPTELSSNGENCRIRKRSSAFISMVFSLFVNLCKSSFALTEEILSSSKLVPALKMVLNGKDERCINVDPNFVDDVGQTLLNWCSAFGTSDMVIYLCDKGADPNKGQRSSSLHYAACFGRVENSLTVGVRRTTLTLIRKCVFHISAKAFFEITEAKMNTNGEENGNFVESLVGVLMGVFESKENNLDAKQQALMNEEIAVHADNSTPSPTVEILHRHNAPNTEEELSPSNHGDGANSPQFDNELVEAATTIANVLGVQIVQDVSESSCELNQQQQRQPQNSAKDGSEDVWTVEEKVFYRWKDWRLIRSKDSLFLWCDAVALELRWFGFVCHPIILFHSDGSNGWLRFLMNGRLSTLYSSGTPEYGADNAENRTEFVEKLLKARATVPAGSQTKSVLSVPRSVTLEIQSGNWNLASPEVGTLLLTNREGTQQKMVVKEDLPGFIFETTRHQKHLFSADSTLGHDFVTGWAARGGGRRLRYFKLEVQKQKVYELAQEIWDAYLKKARDEPRELVLEVQKFSNLLCKLTKSIAKMEEKDSCANSTEELRTILAKIRDILIDERLLSVFEISVSGLVPSFLGFIEQVHLNRSGVLAKSFAEVFDLFINNSIPIL

SEQ ID NO: 147406 - protein, 209 aa, Heterodera glycines
  Coding regions on vcDNA: vcDNA=SeqID_73829; Strand=-; Position=1-817
  Homolog annotation: Hit_ID=NP_501120.1; Match level="QueryCoverage =100%, HitCoverage=7%, E-value=6e-51, Identity=50%"; Hit description =hect domain containing protein 1 (4H900) [Caenorhabditis elegans] gb|AAB00699.1| Hypothetical protein C34
AECALRCFAAMTDRFVRRQMDPMALASPSRLVAHLFDLIGSSSTAHENAPTELSSNGENCRIRKRSSAFISMVFSLFVNLCKSSFALTEEILSSSKLVPALKMVLNGKDERCINDSLRFIDLLIVLLCEGRSAISKNRVLLNDSVAPPAFDKTHRNLIDAIRLRDTDALIDAVENGTVDPNFVDDVGQTLLNWCSAFGTSDMVIYLCDK

SEQ ID NO: 147407 - protein, 914 aa, Heterodera glycines
  Coding regions on vcDNA: vcDNA=SeqID_73830; Strand=+; Position=1 -82,314-438,483-1277,1323-1542,1595-1794,1870-2071,2314-2537,2580 -2810,2852-2914,2959-3033,3221-3439,3486-3563,3616-3689,3973 -4018,4063-4173
  Homolog annotation: Hit_ID=CAE61812.1; Match level="QueryCoverage =69%, HitCoverage=26%, E-value=1e-124, Identity=37%"; Hit description= Hypothetical protein CBG05779 [Caenorhabditis briggsae]
MENTARTKGSLQIRKVCFIMEKHPNYCAETRQNVPGSSHNSSSQIQNIGSNLRVKLGNYAEVFRNMMQQVLESGENSDIYDVDEFDNDIYEDELHFIECDGISSIFSSANLIHFSDCEHPGSDHGGGISISSDSSSIADRFAEHVQNIGSTSVSTGPLGTSGGGANAASSMFSDATTALQSQIESFSSVASAFRRQFSTSSTSANQSIIPNTGASRADAFAAIRAAIERSENIIPSLPIDVIIGSSPVNEGRNHRWRQALLDEFNAFIPPSMGSQSDGRQRSNEEGNCGRAARTMANKTAIQPGGWNDDFVLRRQFGALIPAFDPRPGRTNVNQTQDVKLPDSIQFCTYRRKGSLIREEPKGGGTSSTAKEKSPIRLFIKMTGKDQVKNEEEELVELKDDDSSLFRYVQDLLVTSQKCGQSPNVFSADANSLIWENTFTLIYSVNENEAAECPTEDTEKAMTNNLDETNPLVEQALNVIKILHELSRSISNFDQIIGVEVTFPTLPEESFHSTKLSQKLCQELTDPLVVSAKALPNWCNYLAASNMAGLRREDHYPEYRIGRVKHERIKVHRSAELFLENAVKVLKFHALRKAILEIEYFGEEGTGLGPTLEFFSLVAAEFQRRDLCMWHCEDSVLENEANDQKGGGFIGSKPTGFYVHSNVGLFPAFWPSGSNERVLNLFQIFGIFIAKAIQDNRLVDLPLSKTFLKLITSPKLASGDGPSIESVLDFSDFALIHPEKVESSPHINCLINYSAHLLDLSLTFAVNAPARCFPYECVELIPNGASVEVNGSNVELYVKRLVDFHLNEGIREQLFMFRFGFDLVFPLSSLTCYSTSELQTLISGEQSPRWTREDLLRYSEPKLGLTVVRKVGSGDGSYPSVNTCVHYLKLPEYSSAGILRDRLLAATAEKGFHLN

SEQ ID NO: 147408 - protein, 70 aa, Heterodera glycines
  Coding regions on vcDNA: vcDNA=SeqID_73831; Strand=-; Position=1-213
MAKDKMPIKEEGITNLLVLEEKFDQIFAGIRCKKHRKKEKQRDKMDKEKRKERTKLAKHWDKWRNLLLLL

SEQ ID NO: 147409 - protein, 42 aa, Heterodera glycines
  Coding regions on vcDNA: vcDNA=SeqID_73832; Strand=+; Position=1-128
MPAFVLGFQTKVPIFALQVLSFSRGRPLKNKAKPTAVAKEQT

SEQ ID NO: 147410 - protein, 85 aa, Heterodera glycines
  Coding regions on vcDNA: vcDNA=SeqID_73833; Strand=+; Position=1 -53,339-543
MIKYSFTSSQMSSARTLRHSLHFVLSVLLLLALANVLTVNATPLTILTREISPEAVANKLLASFPEGLDHMEEQHLREARFFGQR

SEQ ID NO: 147411 - protein, 181 aa, Heterodera glycines
  Coding regions on vcDNA: vcDNA=SeqID_73834; Strand=-; Position=1 -101,149-593
MVTSLAFVPLEDLTPALAALEDHLPGELEGVLDWFVINYVGRLRNNGTRTRLLFRPEAWSVYERTMNGTDRTNNFAEAYHRTLQHAIGQGHPTIWKFINILREHQKVIDVDFEHFLAGNAPPPKAKRYRDTDTRILRILHRYNEEKTQPQIDDDHQYGQNQNNRNLIIEMLRGISSLYQMD

SEQ ID NO: 147412 - protein, 190 aa, Heterodera glycines
  Coding regions on vcDNA: vcDNA=SeqID_73835; Strand=-; Position=1 -366,408-614
MDNFEIKSQRNYKKLEHNGCLYVFHKLNADWNVKFWRCEHQHGEFKCRGRIHSTLNDVVLKTIGEHTCRHSAANVVAQKIVTGIKRRAAETMETPAAIRAHTLHQIPTPVMASIPTKNATKKLVKRVRHEIELPPPVPRTLQELELPEQYRIYKRTEEAQELFLLADSTPSVPNIHNAQSTFAYSIWCAT

SEQ ID NO: 147413 - protein, 31 aa, Heterodera glycines
  Coding regions on vcDNA: vcDNA=SeqID_73836; Strand=+; Position=1-95
MEPQKFSLRMPRRTSSTNCHFPNYVDIWTHY

SEQ ID NO: 147414 - protein, 25 aa, Heterodera glycines
  Coding regions on vcDNA: vcDNA=SeqID_73837; Strand=-; Position=1-77
SKSSLTTAQKNMFFVRFRPRGAQEK

SEQ ID NO: 147415 - protein, 82 aa, Heterodera glycines
  Coding regions on vcDNA: vcDNA=SeqID_73838; Strand=+; Position=1 -141,416-520
  Homolog annotation: Hit_ID=XP_415066.1; Match level="QueryCoverage =98%, HitCoverage=9%, E-value=1e-17, Identity=53%"; Hit description =PREDICTED: similar to topoisomerase III beta [Gallus gallus] emb|CAG31872.1| hypothetical protein [Gallus
MQYRYCDFDNNYVSLGPCQTPTLAFCVRRHDAIGQFKPQPYWVVQAEVELPNGGQSLTLEWCRTRQFSREAAQTLLDKMKVS

SEQ ID NO: 147416 - protein, 60 aa, Heterodera glycines
  Coding regions on vcDNA: vcDNA=SeqID_73839; Strand=+; Position=1 -136,747-793
  Homolog annotation: Hit_ID=CAE60587.1; Match level="QueryCoverage =76%, HitCoverage=3%, E-value=6e-11, Identity=63%"; Hit description =Hypothetical protein CBG04223 [Caenorhabditis briggsae]
MAAYFTHCDIQPVHKILTLRTAANLSFKNKQMRHCASFCRRCIELGGGNWARDVVEFDDF

SEQ ID NO: 147417 - protein, 26 aa, Heterodera glycines
  Coding regions on vcDNA: vcDNA=SeqID_73840; Strand=-; Position=1-80
MFTPEGCVLDLANKIYGHFGIVDNVK

SEQ ID NO: 147418 - protein, 104 aa, Heterodera glycines
  Coding regions on vcDNA: vcDNA=SeqID_73841; Strand=+; Position=1 -183,345-476
MGQMLGVAVALGAWFFMDRSIRRCEMRAVMSREEKPPIKHLLALHGRSDLVDCFYNILEKKNTKAMESVKQQLSDLGLDHVSDAFVEGYKRVEMDNKSKNKYFN

SEQ ID NO: 147419 - protein, 19 aa, Heterodera glycines
  Coding regions on vcDNA: vcDNA=SeqID_73842; Strand=+; Position=1 -54,113-118
MSFPWSRSSNTNTGKHLNK

SEQ ID NO: 147420 - protein, 104 aa, Heterodera glycines
  Coding regions on vcDNA: vcDNA=SeqID_73843; Strand=-; Position=1 -82,739-971
MQLEKDEIVPNIVDCQKPEMVNCTHFTIFYNLKVKIYHFPRHMKLKQSKVSRRFSIGQNCEEMAKDWGQIEEDEKIGDEYDQSADNNGQVFLADFFVGRINAKI

SEQ ID NO: 147421 - protein, 44 aa, Heterodera glycines
  misc_feature (40)..(40): Xaa can be any naturally occurring amino acid
  Coding regions on vcDNA: vcDNA=SeqID_73844; Strand=-; Position=1-138
HIYKLGWTVGYGVHAWLGNIWPSFVILKHTKHYQLSSVVXGESA

SEQ ID NO: 147422 - protein, 89 aa, Heterodera glycines
  Coding regions on vcDNA: vcDNA=SeqID_73845; Strand=+; Position=1 -84,425-610
MFNPSFAIPFIIIICLLFPLSLSKTNLSRKKYEAHLGIVYFLRKNWQCEKLRRSLKKNTKNIASIWAFCTNICSDKTSDFPALSQNLCL

SEQ ID NO: 147423 - protein, 76 aa, Heterodera glycines
  Coding regions on vcDNA: vcDNA=SeqID_73846; Strand=-; Position=1 -82,203-351
MPEGTECRRKWDKGSERTAKRSARSSVGVFFSPNPLKMGEPFNVTAIAQSVQSLDGLECPWVRVPPGELHFCIWRK

SEQ ID NO: 147424 - protein, 175 aa, Heterodera glycines
  Coding regions on vcDNA: vcDNA=SeqID_73847; Strand=+; Position=1 -356,474-645
HKFVFPKWQLYARFSPLVLGFGIEPLAYKTFKLLDANEGDARNGSVINYEILLKCNISPHKNENYVIGSEFYQHIGGEAGFIIQVKLYDIEMARLCYEDEYGNENSISIKIRKNTRLLRLLLSNENFIRTFIVEKSSFIKLMNSNLICEVMLKLLIYYHIQKSMSKLARAQIAAG

SEQ ID NO: 147425 - protein, 41 aa, Heterodera glycines
  Coding regions on vcDNA: vcDNA=SeqID_73848; Strand=+; Position=1 -30,205-300
MHHLKTLPLLWDVRDRDRAGKASVITNPTPGSQPISGNDKH

SEQ ID NO: 147426 - protein, 336 aa, Heterodera glycines
  Coding regions on vcDNA: vcDNA=SeqID_73849; Strand=-; Position=1-1011
  Homolog annotation: Hit_ID=AAO53180.1; Match level="QueryCoverage =82%, HitCoverage=91%, E-value=4e-21, Identity=28%"; Hit description =hypothetical protein [Dictyostelium discoideum]
MNFLIFTFIFLYIVNVCNGMHNILNSTDYDSNYNKPNHTNDNDQNNQNDHSNGLAINYYNNLLINNDRSAQNQPDNNNYYYQPNLDNLTQNLHTFDNLSTNNGDNYDEMGQNGINNNNNNNILDKVSTQSADFNSYFNNFVPNWHTSDTLVTNNGNNYDEMGQNGISINNENGPGNNLDSNFIDLTSNLDNIGILANTNNDNNSGHNPNGINGALKIGTSRDRNRMPSRAPSSSVGTLKRKRSRRRDPSRQTTTIHIDKQNFRQAVQEATGGPFKPSMMQNMKNLLPPPHGLTLTLPGMRTTRKQLMDILFKISKKKIIKKSYKLSNSKNQVFFLF

SEQ ID NO: 147427 - protein, 205 aa, Heterodera glycines
  Coding regions on vcDNA: vcDNA=SeqID_73850; Strand=+; Position=1 -42,353-448,495-674,718-816,872-949,993-1106,1240-1248
  Homolog annotation: Hit_ID=S16366; Match level="QueryCoverage=94%, HitCoverage=84%, E-value=2e-87, Identity=46%"; Hit description =collagen alpha 2(IV) chain precursor - pig roundworm sp|P27393|CA24 _ASCSU Collagen alpha 2(IV) chain precursor
MTAISEDVFVWAKKGAQGPPGSAGIKGDRGPVGMPGFAGNDGTPGRPGEAGPPGPPGWDGCNGTDGFMGLPGVHGPAGLPGFPGQPGTDGPKGEPALGYAGAPGEKGDGGVPGVPGLPGTPGRDGFPGEKGDRGDVGLPGPRGPPGEPGLPGNPGIGTVGPKGDPGEQGLVGLPGPPGPAAYGLGAKGTIVGPEGHPGHKGDKQY

SEQ ID NO: 147428 - protein, 24 aa, Heterodera glycines
  Coding regions on vcDNA: vcDNA=SeqID_73851; Strand=-; Position=1-118
LTHRPLRRKNQLNCTWSPKLTRRV

SEQ ID NO: 147429 - protein, 65 aa, Heterodera glycines
  Coding regions on vcDNA: vcDNA=SeqID_73852; Strand=-; Position=1 -71,586-711
YPGHAEKDPVVSPDDALSGPEDRSEQMESGIVEEKQQKSTASAPSQEDETVQQQNGSENSVERME

SEQ ID NO: 147430 - protein, 105 aa, Heterodera glycines
  Coding regions on vcDNA: vcDNA=SeqID_73853; Strand=+; Position=1 -88,555-784
MEEKNTEIRGHMCRTLVKSRKCNYHWQLDEESMSVDFSTKSLSVAIREAKHVLEMVVDEEENLRDEMVTKSVDSLAIPLFILGKKWHFIRRIDQKGERQRPKGRR

SEQ ID NO: 147431 - protein, 103 aa, Heterodera glycines
  misc_feature (75)..(75): Xaa can be any naturally occurring amino acid
  Coding regions on vcDNA: vcDNA=SeqID_73854; Strand=-; Position=1-340
NELMHFLMEIVKLLYTFLFIFADASRHFQLFVEQKENILDPREQHKELMEVGENGIESAKPVTEVKLNYCTRKNXGGGGGQPQNQNQFEVFQRWRSNEYLQVL

SEQ ID NO: 147432 - protein, 105 aa, Heterodera glycines
  Coding regions on vcDNA: vcDNA=SeqID_73855; Strand=+; Position=1 -157,1124-1284
MCRSANGQYLWDQLERQKRLLVEPKDKREVPALFREFDAAVRENRPSVGKSGETNGQQIEQNAKPTNDENTARNSICRTAIKWGQTGTTAAANDGQRGRIATDFK

SEQ ID NO: 147433 - protein, 69 aa, Heterodera glycines
  Coding regions on vcDNA: vcDNA=SeqID_73856; Strand=-; Position=1-210
TGGSAVFLNYDMNRNVALGPSFSPPALWPRCQCSNSAMGNVRLFCPLLSISVFSVRSASPWNLRTALVR

SEQ ID NO: 147434 - protein, 978 aa, Heterodera glycines
  misc_feature (374)..(374): Xaa can be any naturally occurring amino acid
  Coding regions on vcDNA: vcDNA=SeqID_73857; Strand=+; Position=1 -350,388-1304,1366-2772,2812-2976
  Homolog annotation: Hit_ID=XP_318550.1; Match level="QueryCoverage =99%, HitCoverage=99%, E-value=0.0, Identity=40%"; Hit description =ENSANGP00000020240 [Anopheles gambiae]
IERHVRLNGKVHKMVVDSGSKLTIVRKLIWVKLGQPFLTETKLKGRSFTGNIFTFMGKFKVQAALDDVPLDLECFVIDSRDTLDLMGLPWIRAFEAPTTKWCNFVNRKCCRQSLMDLQNTFPKIFEETMDLQNTFPKIFEETLGLCTKIRAHLKIKENSSPVFCAARPIPIGVKQEVDKELDRLIDMGVLKKTDYSSWAAPIVAVRKANGKVRLCFDFSTGLNAALEPHHHPLPRPEQLFAQLSGAKVFSQIDFKDAYLQIAVDEQSRKFLGVNTHRGLFECSRLAFGIKSAPGIFQWVMDQLSNGIPGVLGYMDDFIIASRSIKEHYRTLYQFFQRIQEFGFHIQLGKCKFLVQQIKFLGQIVTPNGIKPDSXRTKALQDMPQPHDVSTLRSFLGAINYYGKYIKNLHEIRAPLDSLLKKGAKWEDTGTSEILTIIVTADLTIIVTADASNKGIGATISHRFNDGKEKVFQHAARTLTKTEQAYSQIEKEGLGLIFAIQKFHQFIFGRKFILRTDHRPLLGIFGSKSGIPIFSASRLQRWALILLNYDFSIEFVRTDCTGQADALSRLISDQRSCSKDEDVVIAQLLADTEADVAHVFNTQTEQLPLTAREIAEAQLSDPLIREVLECTMGRWPNKGLNPEIKPYFTVRNNLSIISDCLVFNGRTIIPQALRDRILKALHLAHPGIVRMKSLARELVYWPSMDADIESLVKSCVPCQEAAKQPTKHPLQPWPSTTSVFERVHIDLAGPCSNGKTYLVVIDTYSKWPEIFQLNNTSSHSVISQLQWLFDRYGVPKTLVSDNGPQFSSSVFKEFCKNNGIKHIFSPPYHPQSNGAAERYVDYFKRQLKKCSGDRNWLSKSLLYRSTPIAERSPAELFLGRKLRTKLSLMRPETIPKQQHHEHTSKMKFKIGEQVQFLNYRNGKTFKIGEQVQFLNYRNGKTLWLFGRIVSNKGLIYEIRSPQLGNRIVTRHANQIRTTM

SEQ ID NO: 147435 - protein, 80 aa, Heterodera glycines
  Coding regions on vcDNA: vcDNA=SeqID_73858; Strand=-; Position=1 -105,753-890
  Homolog annotation: Hit_ID=NP_075965.1; Match level="QueryCoverage =97%, HitCoverage=18%, E-value=3e-09, Identity=38%"; Hit description =lipocalin 7 [Mus musculus] dbj|BAB20596.1| ARG1 [Mus musculus]
MMREIMTNGPIQVQVDWYVDAYLYGQNSTQVNVYMHTIVNQTDKGDYQEGSLKLIGWGEESTDKGELVKYWFGVNSFGTE

SEQ ID NO: 147436 - protein, 198 aa, Heterodera glycines
  misc_feature (6)..(6): Xaa can be any naturally occurring amino acid
  misc_feature (21)..(21): Xaa can be any naturally occurring amino acid
  misc_feature (186)..(186): Xaa can be any naturally occurring amino acid
  Coding regions on vcDNA: vcDNA=SeqID_73859; Strand=+; Position=1 -40,690-816,938-1014,1097-1147,1199-1244,1314-1369,1617-1680,1730-1819
  Homolog annotation: Hit_ID=NP_508210.1; Match level="QueryCoverage =95%, HitCoverage=82%, E-value=1e-56, Identity=59%"; Hit description =translation Initiation Factor 4E eIF4E (24.6 kD) (ife-4) [Caenorhabditis elegans] gb|AAF98601.1| Initiati
CFLHNXNEEIVRQIKKLTFVXPDVPLREDEHLLEHSYVFSYFMRPQGKFDPEDYAMYVQPVSKISSVEQFWQVYRFIKRPSDIAEKVDFHLFKEGVKPVWEDPWEDPSNRNGGKWILRLKKGLSLKKGLSSRIWENLLLAMIGEQFLVGDEVVGAVCSVRNQEDIVSLRNRIVSLRNRPDSPVPLXRRTLRRVLNLNK

SEQ ID NO: 147437 - protein, 95 aa, Heterodera glycines; identical to SEQ ID NO: 130305
  Coding regions on vcDNA: vcDNA=SeqID_73860; Strand=+; Position=1-350

SEQ ID NO: 147438 - protein, 209 aa, Heterodera glycines
  Coding regions on vcDNA: vcDNA=SeqID_73861; Strand=+; Position=1 -269,320-488,909-954,1010-1155
  Homolog annotation: Hit_ID=XP_392684.1; Match level="QueryCoverage =99%, HitCoverage=71%, E-value=3e-41, Identity=46%"; Hit description =similar to ENSANGP00000022132 [Apis mellifera]
MASQVDRVLIYGGRGALGTALVEHFHSKNIVGSKQPNQFKEFIHWAMLLVCPSIQWVISVDLASNEMASHNILVDPLQGVQEQEHSVLAGVDGALGGEKLDAVLCVAGGWAGGNAAHKDFVKNADLVGLNVSIPKMAFPIGRCGVKASDSTPGMIGYGMAKAAVHQLVRSLADAKAAGLPEGTCSFALLPVTLDTPMNRKWMPKADHSS

SEQ ID NO: 147439 - protein, 63 aa, Heterodera glycines
  Coding regions on vcDNA: vcDNA=SeqID_73862; Strand=-; Position=1 -97,318-412
MLNISAYFYCSSLCFQLFIHRIMINLPSVQLKIEKIVVVEFVPRPFIIFKRFMWLFLVDGDIK

SEQ ID NO: 147440 - protein, 73 aa, Heterodera glycines
  Coding regions on vcDNA: vcDNA=SeqID_73863; Strand=+; Position=1 -129,254-346
MTNNEMAEQSAFQSKLMLLRLKKVTHLPIDTDIKGNGEKEAEFTLTDFTSIMMYLILENIWDNRSIDVMAIED

SEQ ID NO: 147441 - protein, 185 aa, Heterodera glycines
  Coding regions on vcDNA: vcDNA=SeqID_73864; Strand=-; Position=1 -187,727-795,897-1027,1498-1668
MNTYYHVHFLKHSNNQRPADGATGNMNGAETGKSRTASSSFSGSSESVPNSGGRNYDEAHEQESESNIDPVYLALKEATEKYGNKAGKNRRFSQNIGCGGAGTGDSTTTPSSCSRNLSQASLLDSGTFSPLQKYIRKLVQFNVLSITQCLITSPTFTLFFICLIQSQLSFTHENLLFVYFPFDGS

SEQ ID NO: 147442 - protein, 217 aa, Heterodera glycines
  Coding regions on vcDNA: vcDNA=SeqID_73865; Strand=-; Position=1-651
MKSARRRASIGHLSNWHVDRCQPTTQNSLRHHRTVLDQLIDDDDSSAYKPVGRHSSILCQPVHRLFLDKNGSGDRSAKLQQDGGVGSGVDTVKQQRQQRYYYSSQPNSRKTSDKYRSNNDDGGGSGTYGSVGNSPRHMPSQPAVTLSRLARTLPSAIVPAIASLRGTVTASCAMGMLQQQQNRRPVTARTGCRLRQHSLQTFPLQPLQKRSEPQPVG

SEQ ID NO: 147443 - protein, 91 aa, Heterodera glycines
  Coding regions on vcDNA: vcDNA=SeqID_73866; Strand=-; Position=1-273
MKLTINQRLGQGQQAYLQMCRQIGLGETGEHFWIPPQFLVKSKEELIDYVYPNFQQLLGNDKELLNRLILAPHIDTCDEVNEIMMPNVPGQ

SEQ ID NO: 147444 - protein, 100 aa, Heterodera glycines
  Coding regions on vcDNA: vcDNA=SeqID_73867; Strand=-; Position=1 -162,980-1120
MLKRSPNDFRPLFRLNDPEQLKEERRAEKAQNQAIRQQQNHGGRPGRRKGEKMEVVLPYIHDKFERLSEQIESERDAIRQKVSAKRNNPKKGERRTFALI

SEQ ID NO: 147445 - protein, 41 aa, Heterodera glycines
  Coding regions on vcDNA: vcDNA=SeqID_73868; Strand=-; Position=1-129
TKNKGSFMNISIGSLLRKRTKTSQQILLINLDDSKRLCYRF

SEQ ID NO: 147446 - protein, 250 aa, Heterodera glycines
  Coding regions on vcDNA: vcDNA=SeqID_73869; Strand=-; Position=1 -82,229-493,758-1021,1071-1212
MSPIVFTFIFHLITSPTNALPGLNFFKSIYIDVCCELQFLYSPYGKARNTLLDEFYLSYFTAKNEGIRQKFKSKIEIYTHLYILRWKLDQNKIILLDENMPKGLNGYRKHKANLANIQFFFARYELFDEAMCLLLRLKFELLRLLNSQNLPYNKIERIFDHKECENEKRAKAIVDEFSEQIKEFLLSDLLHSLGQRQKLLKYFGDLSTQKNRRELGEAQMNFIDLLGSVRVAMICDWQMKELATLCEQIP

SEQ ID NO: 147447 - protein, 82 aa, Heterodera glycines
  Coding regions on vcDNA: vcDNA=SeqID_73870; Strand=-; Position=1 -139,756-865
MQQNVERDGHQIWLEMPIISPIFPEKNVANRIDVTTAKQIKDEFVNDECTLCDNWGYKLCDFAYLFLLICYEERGSKISFLR

SEQ ID NO: 147448 - protein, 36 aa, Heterodera glycines
  Coding regions on vcDNA: vcDNA=SeqID_73871; Strand=+; Position=1 -79,103-132
DREIWARPGPGLFGWENREKSREFPGPGQNWSKPGP

SEQ ID NO: 147449 - protein, 116 aa, Heterodera glycines
  Coding regions on vcDNA: vcDNA=SeqID_73872; Strand=-; Position=1 -13,1055-1246,1517-1662
MRFLENGGNYDDEAIMRILNKIERLNKSEETTKKGETDRNENEENGKKEAEKRRHKMEEVKKAMTVLWRRNFFDAHFGHFNSQVLFVMLTKVFLLFPGDVSVPFLVEKFYLIYSIW

SEQ ID NO: 147450 - protein, 55 aa, Heterodera glycines
  Coding regions on vcDNA: vcDNA=SeqID_73873; Strand=+; Position=1 -126,581-622
MNRESTKPFLYMPVNKILTVNTMFGHNYVMKMLVGESKCVKKDYNYTECVCGKLW

SEQ ID NO: 147451 - protein, 118 aa, Heterodera glycines
  Coding regions on vcDNA: vcDNA=SeqID_73874; Strand=-; Position=1-357
AFANASSPANFIVVILSMLSFDGDDSVVPFDLTNEFTREQLALKRTDYCYRLLLVRCPIVRDTDKWAKWEEEAIDWQFNHQWNIIDIQINNERKMGQMLIKKCEIVAFLDVSRNDGPK

SEQ ID NO: 147452 - protein, 215 aa, Heterodera glycines
  Coding regions on vcDNA: vcDNA=SeqID_73875; Strand=-; Position=1 -14,74-349,410-764
  Homolog annotation: Hit_ID=AAL78214.1; Match level="QueryCoverage =68%, HitCoverage=77%, E-value=7e-10, Identity=26%"; Hit description =putative esophageal gland cell protein Hgg-20 [Heterodera glycines]
MAKAIFISGDGWLCVFDLLEPSQLGLGIALVSHRFDFYVDEHFKTRRWALKAMEIKAKFEADGTNGWEIVNCAGKPLPIPQKALPKKIVGFKDISIKYIDQNAIAFLHRFRQLFTSRPINLAIYTGGDRTLEFILRKFWPMIAKSICAMHLYARIFYRLRQFMPSILNDCPSLRIINSFSDGFFAEFPCDDSANASNGQAFAKWLFTPRPDNVPK

SEQ ID NO: 147453 - protein, 35 aa, Heterodera glycines
  Coding regions on vcDNA: vcDNA=SeqID_73876; Strand=-; Position=1 -87,851-871
MDNQQGKDDVLSSNAFAYQQIVGPQNITACLWSLL

SEQ ID NO: 147454 - protein, 197 aa, Heterodera glycines
  Coding regions on vcDNA: vcDNA=SeqID_73877; Strand=-; Position=1 -152,465-568,634-774,1169-1365
MEAAPVEGNNSTMNNNTGTFYAQQQLHNSSNSWNSQTPQYYIEPLHSYFADSSYFGQPSSMLGGSASLDSLNAYGHFGPLFAGQQEIEYSANFSTAFSAFITGGIEAAAPMQYHQQHHHHMVGHHHQSAALGGGGDFLMGSLVVHPLPSQQLAAAATAADRECISCGGRLYEAESVRVDARGYSNQSINQSINKTII

SEQ ID NO: 147455 - protein, 49 aa, Heterodera glycines
  Coding regions on vcDNA: vcDNA=SeqID_73878; Strand=-; Position=1 -30,75-194
MTVLLLKFSKRQRKCRPIWHCLPLANSLINGQNLPPPLFGTFKAMATMA

SEQ ID NO: 147456 - protein, 59 aa, Heterodera glycines
  Coding regions on vcDNA: vcDNA=SeqID_73879; Strand=-; Position=1 -64,136-252
GGAPNNVVALPRTGGSYPATAIRQKREHTPMASAPFVGPLLPNVAAAADELSRHYSMWI

SEQ ID NO: 147457 - protein, 46 aa, Heterodera glycines
  Coding regions on vcDNA: vcDNA=SeqID_73880; Strand=+; Position=1 -135,459-464
MISTFRAPTVCIYVKRKTILDLLSQQQCFDKELILLCCARNIILSV

SEQ ID NO: 147458 - protein, 121 aa, Heterodera glycines
  Coding regions on vcDNA: vcDNA=SeqID_73881; Strand=-; Position=1 -121,543-787
MEIDMIIAPYIYLLLLCLNTFNFYELNNGRLFWHFFSSFVMDKHFDGKSELTIRNLIKISKMRTNATVFVEKRRFPLPKYPLPRLHSHTERGRKDEQPRRGRTSPSSRRLQLPSSIDLALH

SEQ ID NO: 147459 - protein, 315 aa, Heterodera glycines
  Coding regions on vcDNA: vcDNA=SeqID_73882; Strand=-; Position=1 -11,71-310,360-795,861-1121
MNRRWVCNDVWMDIFLHLDHAQLGLKMALLSPRFNALVDKHFDGKSELPLLRQIRIAKKGTKLSVATKSNPLPIKIRFINLRIEYIGHSVIEFLRSNRQIFEKGTHMDLYLDLDNLHYDNKGIVQPIWNFFAGEIWPIFVPNIRHLIGHHLGDLRCHISPTIFTDCNQLNSIVSDNLLPAAIADDGPNATARQALTKWLNTPTKNGQPKQLICCGSASETNECVVNFKKEFLRANSSASYIIQFKTYTSIAQFELVNGRTKEKLTLKAEDDDDHVYTHINCVLERCQIGRTIQWEDKKTDKLNNVIISLYGNCIG

SEQ ID NO: 147460 - protein, 156 aa, Heterodera glycines
  Coding regions on vcDNA: vcDNA=SeqID_73883; Strand=-; Position=1 -81,256-393,441-509,568-750
  Homolog annotation: Hit_ID=CAE60301.1; Match level="QueryCoverage =86%, HitCoverage=36%, E-value=5e-40, Identity=52%"; Hit description =Hypothetical protein CBG03886 [Caenorhabditis briggsae]
MSRVHSSPKPNVLLMLLSNGTVWLNYRVFESYSFNTATVTIDWLPLAAVTLQTAEISASDFELTHTKHYKHTEYYKAGEWYRLTVEVGFRRRYGYYVYANMYINVFLSWIAFCISLKALPARVILSVNTLMSLCLQAIIGKYQCQNARSDHFSLAM

SEQ ID NO: 147461 - protein, 208 aa, Heterodera glycines
  Coding regions on vcDNA: vcDNA=SeqID_73884; Strand=+; Position=1 -119,170-331,616-767,1000-1055,1227-1339
  Homolog annotation: Hit_ID=CAE57408.1; Match level="QueryCoverage =97%, HitCoverage=45%, E-value=8e-56, Identity=54%"; Hit description =Hypothetical protein CBG00362 [Caenorhabditis briggsae]
AREMQARATIKLVFCIAYAILFLLGSLGNGSEMIKCQFPLLVIVMICLVIVMICNVLSTLSRNRRKTSRKMLMASAEHVFIYVLGQFIPVQCFFLRLIPLSGLSIVDLFVILHLPLLIFEMREGQWPFGEFMCKLYWFGESVNKLLSSFLMTVLSWDRYLAVCSPIKSMNPSVAITVLISCSAFATLLLYPVLKEATVLRVNKLTGVP

SEQ ID NO: 147462 - protein, 31 aa, Heterodera glycines
  Coding regions on vcDNA: vcDNA=SeqID_73885; Strand=-; Position=1 -3,150-242
MPLTDFTSIMMYLILENIWDNRSIDVMAIED

SEQ ID NO: 147463 - protein, 63 aa, Heterodera glycines; identical to SEQ ID NO: 130392
  Coding regions on vcDNA: vcDNA=SeqID_73886; Strand=+; Position=1 -97,317-411

SEQ ID NO: 147464 - protein, 181 aa, Heterodera glycines
  Coding regions on vcDNA: vcDNA=SeqID_73887; Strand=+; Position=1 -47,97-372,424-599,833-879
  Homolog annotation: Hit_ID=AAL78214.1; Match level="QueryCoverage =59%, HitCoverage=56%, E-value=5e-12, Identity=32%"; Hit description =putative esophageal gland cell protein Hgg-20 [Heterodera glycines]
MSHNPKKAEKEMEKAIFISADCWLEVFDLLPPSQLGLEIAMISHRFDRRVDEHFKTRKWKLGYMKIRSKIGQNSANEMIIVNSNGKELPIPQIPLPNKVMAFRSIAIFFFDENVITFLGRFQRFYDICETMLYIRAENVRILEFIVLNTLPTLKDTIKNRLPRPLQCIFGCFFSCFFRNLL

SEQ ID NO: 147465 - protein, 68 aa, Heterodera glycines
  Coding regions on vcDNA: vcDNA=SeqID_73888; Strand=+; Position=1 -157,395-444
MKKKVGKFDLKFVNELKEMVKTIDENDGQKLEKVKELVKKILEMFEEKKKAYEICSISRKESGRLLII

SEQ ID NO: 147466 - protein, 24 aa, Heterodera glycines
  Coding regions on vcDNA: vcDNA=SeqID_73889; Strand=+; Position=1 -25,427-476
MLRPALSQFSLTRIPVKSALIPSY

SEQ ID NO: 147467 - protein, 61 aa, Heterodera glycines
  Coding regions on vcDNA: vcDNA=SeqID_73890; Strand=-; Position=1 -168,449-466
MNFVWLLFTVLPLFVMVPCTEMLHCELMLLDVTETDPPPADFPLFLPSQSSLPFTRIYSIF

SEQ ID NO: 147468 - protein, 148 aa, Heterodera glycines
  Coding regions on vcDNA: vcDNA=SeqID_73891; Strand=-; Position=1 -361,451-536
MFCQLLLFGFLLAISIVTVCAAKREINLSIYPPPISNDYNYRIKICCNQNSNSGAAVEVPSSLHQQKLIAEHTLCGTKNSEQNVNEGQFPENGKNGINQSRYQENKGCQMSHPLNNFFLKKKIAENLKKAGQVVYILALSERLGLESL

SEQ ID NO: 147469 - protein, 23 aa, Heterodera glycines
  Coding regions on vcDNA: vcDNA=SeqID_73892; Strand=+; Position=1 -60,836-847
MKIYFPSHYMHMHKKIFSDNKML

SEQ ID NO: 147470 - protein, 93 aa, Heterodera glycines
  Coding regions on vcDNA: vcDNA=SeqID_73893; Strand=+; Position=1 -181,626-725
MAVVQVTFDNAVIWKCPPKTPLGLREAPGHWQNVGQNGAGCPLHRFRCAFGWLTDVQLQRHTDIDWSTYMQHVGVYEDGQRNYTQIRGDTGPI

SEQ ID NO: 147471 - protein, 879 aa, Heterodera glycines
  Coding regions on vcDNA: vcDNA=SeqID_73894; Strand=-; Position=1-2640
  Homolog annotation: Hit_ID=CAE56861.1; Match level="QueryCoverage =25%, HitCoverage=15%, E-value=5e-12, Identity=23%"; Hit description =Hypothetical protein CBG24691 [Caenorhabditis briggsae]
MAWDNSCQVFGQEWKGKIYGPVGLEDVPVKTNVISAEAQFESWLRNLTERFGQTLTKLRAKEYWKDCHLQSKRVLVVSNQEAAELVAKEFEEEGSSWFVHFGDKPLREKMFPANWNIKIIFNLELRREEREELEVFKEDIKDMARAGLEVHLATRKNARLPREFEEFAEMQGCGIYQYEKIGELAAAIRGTPANTGTNPESGESAQKSTTGWRRAVTKSLTGLTMLVMLLITLLQPMMINGQVIRPERNGRWIPVNPFGRPLRMEELVGFAEPTVPRMSLDKRGQITPTLPTTAADMSIAHIREWYKKARMQTSGTTQTSAATTTVRTSTSASTVMTTLRTPETTVTTRTTTKTKGVTTQPQRKTTNQEPRMDSRRRQWTQTPSRHWTDRIRATTEGPSQASAMPTTTKPNPTEGTVTDETKPAVRRLNRELEEVHRGADPIYWCAHKGSSLWRIPDADKSPFCKPPPGLTSQWKRLTISLYMPYRKPQEVKKAYRCAIKRTKEYFYTNLLGDQFVRTEKEFLPVQKRICMAMIEQHKCPYEDKPMTPIEGGGWSSNNPLNEEFPGRFSSLISGERESVTLNCFVEKATLFYRPHNFELISPLYSHLEDCNYLTGNCNMADNTTLNWETECNESCKPCDYHFVESMDGEHTGSTDWAGGTWISKSKEQALTFSKEAKMETACNGKPIRLSDQSFGILEDEYLKIVNDRGLGKRAIQEEQLAAQLTAGQLATSRSIAQLFSKECRRSSRGGNPTIQARRLLRRKDVMARWLNEDTMQIFSCAEFSMQNVEYQAVNNCYRYIPVQIRIDKKTLNAFLDPELHILTASSPFADCGNFCYHYLQLSQSNWIKIDTRSATDAIDRVYIRIFSVMVICSGPIKKE

SEQ ID NO: 147472 - protein, 53 aa, Heterodera glycines
  Coding regions on vcDNA: vcDNA=SeqID_73895; Strand=-; Position=1 -84,437-514
MAEMQKSYGQNRLLLAIWCSAPSFFEPNSGAYKLAVLSEPISCGSLMRNDFEN

SEQ ID NO: 147473 - protein, 91 aa, Heterodera glycines
  Coding regions on vcDNA: vcDNA=SeqID_73896; Strand=+; Position=1-276
MNRSNSFRLFSSVGSCRYSNRFWYGIGGRLHLKKAPGQSDSGQSDSEDNRTEVDNWTVDNRTVKYKIDKKIPVAAMDRLCHIKKKQNRQIN

SEQ ID NO: 147474 - protein, 108 aa, Heterodera glycines
  Coding regions on vcDNA: vcDNA=SeqID_73897; Strand=+; Position=1 -37,701-990
MTLHPISYRLYHYFCHFGSPRIGDYAKKKGKGENQLRERKNEKERKKSVKETVNDKRKAIGKKEKALQRRSQAKKRAKKEKQLKIFTSMASSEGELSTWRDSDFPASN

SEQ ID NO: 147475 - protein, 87 aa, Heterodera glycines
  misc_feature (14)..(14): Xaa can be any naturally occurring amino acid
  Coding regions on vcDNA: vcDNA=SeqID_73898; Strand=-; Position=1 -182,239-283
  Homolog annotation: Hit_ID=NP_741820.1; Match level="QueryCoverage =62%, HitCoverage=7%, E-value=6e-21, Identity=85%"; Hit description =potassium channel, KvQLT family (77.4 kD) (kqt-1) [Caenorhabditis elegans] gb|AAK39192.1| Potassium channe
PPLSPPPLLFPLCXFTSPNLGILGSGFALKVQQHQRQKHLIRRRVPAARLIQCLWRHYCSMPESRSLATWKVSMPESRSLATWKVHL

SEQ ID NO: 147476 - protein, 304 aa, Heterodera glycines
  misc_feature (20)..(20): Xaa can be any naturally occurring amino acid
  Coding regions on vcDNA: vcDNA=SeqID_73899; Strand=-; Position=1 -78,1323-1462,1526-1616,1686-1764,1807-1854,1908-1963,2332-2451,2500 -2611
  Homolog annotation: Hit_ID=CAE65763.1; Match level="QueryCoverage =98%, HitCoverage=35%, E-value=3e-93, Identity=63%"; Hit description =Hypothetical protein CBG10852 [Caenorhabditis briggsae]
LMLLPPPSFSVLFNRLISFXSSADQNRKMSLVGKPLVYKNYSTDQRFRRVQSKMHNFLERPRGWKAASYHLAVLVMVLLVMVLTCLALSVFSTMPEFEEQSTLILYYIEIIFVFWLAIEYEIIFVFWLAIEYICRVWSAGCRSRYRGIAGRIRFATSAIAGRIRFATSAYCIIDIIVITASLIVLCMGAREIIVITASLIVLCMGAREQMFAASAIRGLRFFQILRMLRIDRRAGTWKLLGSVVWAHRQELLTTLYIGFLGLIFSSFLELLTTLYIGFLGLIFSSFLYLCEKSNDKYTTFADAL

SEQ ID NO: 147477 - protein, 100 aa, Heterodera glycines
  Coding regions on vcDNA: vcDNA=SeqID_73900; Strand=+; Position=1-303
MAVRPLLPSSCHFPRHFAVLPNPRAHLPRPCLISNDRPHRLAGVVQFGFPSLANESSHNATNSLLVKSDTAKRKEGVEQRRRHQKTMRKLQKTKARPMRN

SEQ ID NO: 147478 - protein, 99 aa, Heterodera glycines
  Coding regions on vcDNA: vcDNA=SeqID_73901; Strand=+; Position=1 -96,793-991,2300-2304
MPSSLNSNKKRNANYQGTSSVKEIDESLIETTLHGLGSKRRILEDFRDFLSLRNRRSFVGDGLNPSDTMPKMIDRMTEELKLKGMAKTKEKSVEAAAKV

SEQ ID NO: 147479 - protein, 232 aa, Heterodera glycines
  Coding regions on vcDNA: vcDNA=SeqID_73902; Strand=-; Position=1 -69,128-267,355-436,589-704,841-1006,1222-1308
  Homolog annotation: Hit_ID=NP_741946.1; Match level="QueryCoverage =99%, HitCoverage=75%, E-value=4e-74, Identity=62%"; Hit description =glutamate-gated chloride channel family member (XR331) [Caenorhabditis elegans] gb|AAM69067.1| Hypothetic
SGLWDQLEVVFKFRRLYGFYILQAFMPTYLSVFISAFMPTYLSVFISWIAFWIQTSALPARITLGVSSLMALTFQFGNIVKNLPRVSYVKALDIWMFGCMGFIFLSLVELAVVGFFDKLEARKRRTQRTKEFLMVNSDSEQQWLSRMKGTNGGSMDNGTAKSVTLKVSGTRERKTSRPRWKRSMAEDGEEDSWYMLNGEFIDDLSAKMFPALFIAFNACYWFYYICLSSGAN

SEQ ID NO: 147480 - protein, 245 aa, Heterodera glycines
  Coding regions on vcDNA: vcDNA=SeqID_73903; Strand=+; Position=1 -356,479-546,596-645,905-964,1035-1188
  Homolog annotation: Hit_ID=NP_502599.1; Match level="QueryCoverage =71%, HitCoverage=11%, E-value=4e-43, Identity=55%"; Hit description =GRAM domain and RabGAP/TBC domain containing protein, possibly N -myristoylated (4O242) [Caenorhabditis el
SMTWSIFTSHVFFHYIFKTTSMGACIYFFAEMTNNFTHLYSLFFTRFSNCHFLNVTPNLMALGIPYELKAHVWGVCSGALVEMRINEGEYAALLRRSRHNSAAFSELTMDEIERDLHRSLPEHPAFQSAAGIDALRRILTAYAVRNPTIGYCQAYAVRNPTIGYCQAMNIITSVLLLYAPEELAFWLLVAVCERLLPDVCERLLPDYNTKVVGALVDQKFSSLITHFDRIIPIIFVVPPPPPPPP

SEQ ID NO: 147481 - protein, 87 aa, Heterodera glycines
  Coding regions on vcDNA: vcDNA=SeqID_73904; Strand=+; Position=1 -117,215-361
  Homolog annotation: Hit_ID=NP_502599.1; Match level="QueryCoverage =94%, HitCoverage=9%, E-value=2e-12, Identity=39%"; Hit description =GRAM domain and RabGAP/TBC domain containing protein, possibly N -myristoylated (4O242) [Caenorhabditis ele
MLRENAEIIVRARDEGEALVALNEFTDKITDSTVKNSTQIFIGDLIGKSYKHFADTFTNETIEKLRLKHRLKVVQNLEDSQVGNCTI

SEQ ID NO: 147482 - protein, 76 aa, Heterodera glycines
  Coding regions on vcDNA: vcDNA=SeqID_73905; Strand=+; Position=1 -80,551-701
MLSSVPIFNTLLMEMMMMMMLLLLVVISIHLYLLLLLMLTRVYTVICSVPLFSFSSFSLIYNNCQSSVSLLRVVYF

SEQ ID NO: 147483 - protein, 46 aa, Heterodera glycines
  Coding regions on vcDNA: vcDNA=SeqID_73906; Strand=+; Position=1 -125,265-280
MDIFDEFIVVDEKAFNGLKAEDCNSSAAGVNVYVPPAWRSRRCIET

SEQ ID NO: 147484 - protein, 104 aa, Heterodera glycines
  Coding regions on vcDNA: vcDNA=SeqID_73907; Strand=+; Position=1 -105,362-500,1128-1198
MQIASGSGVGGTTERDAGSDRVLRSATKAELMKLQITVTNSAPNVPTIIRTLEGERSYRVKAVLASYTHTNGKTAYFLDWLRSWAVGRIYKKLFGSGTGTRAKR

SEQ ID NO: 147485 - protein, 116 aa, Heterodera glycines
  Coding regions on vcDNA: vcDNA=SeqID_73908; Strand=-; Position=1 -205,253-398
MKRRVATLATAPAEQHKIIGPESPKPHEETPKNVEPKDELATKKRKVDDRELWKLAKGKFLLTTYLCHDDWNRLYNNQQKVKRLEGDRFAFGFEMCEECVWANCRATDLLAPMKKK

SEQ ID NO: 147486 - protein, 184 aa, Heterodera glycines
  Coding regions on vcDNA: vcDNA=SeqID_73909; Strand=+; Position=1-555
MVLVSTFCAQLLNCPVKSLRDRLNHPEDRALVLKHIIGRKARTTYNDRNGLTKTFFVTGISVHGAAFLPAYGQLRNPFNINVAAHFYARHRIKLHFPYAPCIIERFSGGGEDRHYPMELLELIDDNMDMDINNNEHWLGRLFTEIDEKQSSSNSSDTTMRLVFEGDMDEDSGRNECSQSTVPLY

SEQ ID NO: 147487 - protein, 1380 aa, Heterodera glycines
  Coding regions on vcDNA: vcDNA=SeqID_73910; Strand=-; Position=1 -630,677-1348,1397-1894,1968-2251,2300-2700,2752-3094,3142-3713,3759 -3950,4000-4095,4145-4275,4326-4649
  Homolog annotation: Hit_ID=NP_001004509.1; Match level="QueryCoverage= 71%, HitCoverage=65%, E-value=4e-96, Identity=28%"; Hit description =si:busm1-180o5.3 [Danio rerio] emb|CAD60788.1| novel protein similar to DNA polymerases [Danio rerio]
MQNQPPKHPFLFSIDQILSVPSKKPRRGFLINELLGEVLQEGGGSSSSSSKSAKEYVKKLDSTVEHVPRFQYSKVKSRFSIEDVPEANPEGLLAGIFQYCLDAAMEESRGRGIEPTHLGCMISSPLLTGGDIPIPVRQITDNTVNTILNQFTKVAQSKQQQNVTLWGEPFTVVVTTVDRSGLPGRRVLKGGARRSLAPVHHRVTETCLIKICNPDGHCLFYALQATMVAKTCGWPRWRFYDYLHSRRGQQGCLRRDALQLMQQIGVRTGRNTYDAEICVPRVVDHWNNTQQQQRFAVFIFGSSGQYKPLYKYINDHYDTPIVLYLNNQHFDGVQKLHGLFGQPYCLDCEKPYERPSRHLNSCKARCLLCSRVGPAFPCVPLGGFFHQCAGCNKKFRNNGCLQHHLASNFCAKSKQCKDCGVIWDTRVHNRDGRKGHKCHETYCQLCNTFHNPERGCFIQPIEPKEQDPYRIVAFDLETMQHQPVDPQQPEKREHQPNFIAARVACPECIESGNWRRVTAGCRICGPHRTVAFCHRPFEDTRVDKRVVADNPLQAFVDWLIFQLPAKYDTYAYSHFGGRFDMVLVFRELFRIGFNPEMLRRVRKQKRRNPNIVFRDSFNLMPCALAALIPSYGLDVEDKPFFPHLANRPENYGREIHPTPEDYLASGMMPSKRQKFDEWYAEHRHEPFKLDEALASYCTNDVEILMAALVAFRREFFEISRRQDYVDGIDDKENHDGIDVLRECMTIAGACMRHFRTNHLPDEHLAIVPERGYDNAQNQSLLALRFFHWYAKEHGVQVQTAHAAGGEKRIGPYSLDGWIEAERRAIEVNGCTCHGCKRCYPNDNMLLPNGKTAGQVRERDSKRMEFLRGKVNRMDVYWECEIHRMLERSKEMRKAFDDYVDDGPLVIRDAFMGGRTGPLKLLRKAGPGEKISYYDFTSLYPYINFTTRYPIGQPNVHVLNQEVDWRSAADNPYPLALLKVWVVPPRRVDVPVLPVKVGERLCFPLCITCAKEHPTGGVNPNYHCEHNDRQRGWVSTCTSIELNEALDEGYLVTKVFRVLEYEQSDDKLFRPYIAEFMAQKIQASGFDNSIRGDAEKEQQFVRECAEQFDITIDPTKMAVNKGKRSLAKLCLNNLWGRFSLRNFGLAQTLITDDPATLAEYLDNKSIEVTSIDELDEQHILITYLQKKDWVDEHSCSNIVISLWTTSAARLVLLKAMQKVFRSPGSDLLYTDTDSLILVHPEERCPLKTGPHLGQFTDEYPDHDIVEFCSGGAKQYGLCLRRKGAEEGAQLEHVLKVRGLTLNYDVINNQGMRYENFKEEVVRYATSGEYEPISITYPNFLRANIREGGRVVSVPLQKCYRPFVGKGIIGANFNVLNFGHTL

SEQ ID NO: 147488 - protein, 62 aa, Heterodera glycines
  Coding regions on vcDNA: vcDNA=SeqID_73911; Strand=+; Position=1 -175,558-571
MHFIFLIIFIAFKIESGKIRPNFGEIFGNAWDNNKREEKAIKIEQNEQNDNSATVDQMEKFE

SEQ ID NO: 147489 - protein, 128 aa, Heterodera glycines
  Coding regions on vcDNA: vcDNA=SeqID_73912; Strand=+; Position=1 -226,595-755
MNLWLLLFLIIFIAFGIESGKIRPNFDEIFGGEWDKNESEKMLIKIEQNEPNVKSQAAVDQMGEEIGSGPNDQKKTQNKYSNEDKLRKMRKYRKIKENNPKISDKIIAEKLGISFSTLNKWKTVSFSN

SEQ ID NO: 147490 - protein, 236 aa, Heterodera glycines
  Coding regions on vcDNA: vcDNA=SeqID_73913; Strand=-; Position=1 -550,595-755
MNLWLLLFLIIFIAFGIESGKIRPNFDEIFGGEWDKNESEKMLIKIEQNEPNVKSQAAVDQICEEMGTDPNDQQKREIIRKFEAIKEKLKERGKYQRKDRHKIDVKIGKLLGTNRNKINKWKKELNLNKKNFYEDKKKEFIERIDEFKYLYGQGKQKKFAKELGISERVFIKWKKELVPNYYKTQNKYSNEDKLRKMRKYRKIKENNPKISDKIIAEKLGIPFATLNKWKTVSFSN

SEQ ID NO: 147491 - protein, 168 aa, Heterodera glycines
  Coding regions on vcDNA: vcDNA=SeqID_73914; Strand=-; Position=1 -222,652-935
MARLVCFATIANRVGLLCDHDTVPVCFATMAHISVCFATMIWKASPDLLSPRDACGWAAQWWRHEFLIVAGQQPMPSKQHAKRKKEQERYQRQMEKSVSPGRSPVPDGSADENGVASHPGTTTPNISALQLSTPASSIGSKRRGRPPKAGAESIMTSQHSVSSADTQI

SEQ ID NO: 147492 - protein, 37 aa, Heterodera glycines
  Coding regions on vcDNA: vcDNA=SeqID_73915; Strand=+; Position=1 -84,822-851
MVAKRTGTCTNLIMVAKQTDKICKQIKNSHFDNLRPL

SEQ ID NO: 147493 - protein, 42 aa, Heterodera glycines
  Coding regions on vcDNA: vcDNA=SeqID_73916; Strand=-; Position=1-128
MDILPSFDHAQLGLKLALLSPQFDALADKHFDGPTNFCINSA

SEQ ID NO: 147494 - protein, 53 aa, Heterodera glycines
  Coding regions on vcDNA: vcDNA=SeqID_73917; Strand=+; Position=1 -139,336-358
MMRRGTKVIKRGTIVIKRGRTVIRRGTTVIRRGTTVIRRGTTVIRRELGLFKN

SEQ ID NO: 147495 - protein, 209 aa, Heterodera glycines
  Coding regions on vcDNA: vcDNA=SeqID_73918; Strand=+; Position=1-630
MPNSPPPSKRPRRFFIEELLREPFNQLSPPRKSPKDYVKLLNSETELVPKFQWLKNKSNFIIENVPANPEALLIGIFQECMDEAMNACCAFENSSENTLRASIPFWCLQQLLVWLYQRSDVVFYRSTVWFTSEGGYLRGRRASAESRRYIRFFELENPGAQVQCADWSVGESNIEDTGYRVDGLWRREPPHRPLAIEWMGCYYHGVLSS

SEQ ID NO: 147496 - protein, 60 aa, Heterodera glycines
  Coding regions on vcDNA: vcDNA=SeqID_73919; Strand=-; Position=1 -79,136-218,776-796
  Homolog annotation: Hit_ID=CAE61959.1; Match level="QueryCoverage =80%, HitCoverage=3%, E-value=5e-13, Identity=58%"; Hit description =Hypothetical protein CBG05959 [Caenorhabditis briggsae]
MEKDLERYYNDFKRPPFAPTFHPTDEEFADPISYVAKIKPQAQQFGLIKIIPPPNLDSIN

SEQ ID NO: 147497 - protein, 25 aa, Heterodera glycines
  Coding regions on vcDNA: vcDNA=SeqID_73920; Strand=-; Position=1-76
MEPFQRFFAIVCVLIAYGMFESVQS

SEQ ID NO: 147498 - protein, 125 aa, Heterodera glycines
  Coding regions on vcDNA: vcDNA=SeqID_73921; Strand=-; Position=1 -95,148-216,263-346,669-797
  Homolog annotation: Hit_ID=NP_508392.2; Match level="QueryCoverage =99%, HitCoverage=33%, E-value=2e-30, Identity=46%"; Hit description =beta-lactamase-like family member (XC734) [Caenorhabditis elegans] gb|AAB52649.2| Hypothetical protein F5
LSENQIAPPAVDYVVITHGHPDHAGNTNDFPDAVHFQGFMSHYRTKFNFSNLFENVKHQLTENVALISTPGHTSEDISVVVTAEDLSRPMMWRPLAWNDEVQSHNRRMILCTADYVVPGHGKMFH

SEQ ID NO: 147499 - protein, 149 aa, Heterodera glycines
  Coding regions on vcDNA: vcDNA=SeqID_73922; Strand=-; Position=1 -185,727-835,874-1029
  Homolog annotation: Hit_ID=CAE68351.1; Match level="QueryCoverage =40%, HitCoverage=31%, E-value=7e-09, Identity=54%"; Hit description =Hypothetical protein CBG14084 [Caenorhabditis briggsae]
TVDAKSWDGSVEKVTTLKLSTSSSSAPATAADRSTSTADRSIQKQLFGRIIIEEQKPNQTNRKIEFNDDEKEQSFFYQVQGNNDGGIGQSANIEILREVIMIKGYARQLDADYVFVASITLIRDGAKIILVDTGMGTDINGRTDLIRSW

SEQ ID NO: 147500 - protein, 204 aa, Heterodera glycines
  Coding regions on vcDNA: vcDNA=SeqID_73923; Strand=+; Position=1 -105,687-1196
MDMSSQRKVHADEGRRLAKVIKSISGQLNGTIANEHFWCFLKIHHKILRKSLKILEIFLWETTGAGNDLLPHFFNQFMETSAKTGHNVHDVFAELSRRLVKACDPQRRLRPASANGSGGGGRKSAAAAEADGGIPLKLANNANDDEGGMAEQYQQQQALSLFGHWHFWHGDSPLCGGVAHGIRTLSEGKNIRVAIRAATEFQGP

SEQ ID NO: 147501 - protein, 48 aa, Heterodera glycines
  Coding regions on vcDNA: vcDNA=SeqID_73924; Strand=-; Position=1 -62,701-785
MVDKMTDNVHNSFCWVQLAIISRRNSEEAHADRPNRNVYVLRCQKRQL

SEQ ID NO: 147502 - protein, 177 aa, Heterodera glycines
  Coding regions on vcDNA: vcDNA=SeqID_73925; Strand=-; Position=1 -58,601-974,1097-1198
MGVSQKTIKIILCVADQNGHLINAQSSVKISKPTLERYMAKIKKSLGAAYFVANQNRVADWYDNYNTAKEIRLDLMEFLETEIDLHNRNVEGHNWWQMFENSLPNLTQYINNHKHPAMDASEHFKWASNLDFLCAAKLFKLNVIVLVDQDPEYKSVFIYYDGSGHFEAILNPIPTAD

SEQ ID NO: 147503 - protein, 302 aa, Heterodera glycines
  Coding regions on vcDNA: vcDNA=SeqID_73926; Strand=+; Position=1 -100,483-782,1414-1753,2381-2550
TGIASEDTVNFEDQLRLSSYNAFKEIFFRYKWKYDAWKVQHGRNKITKSVWAIKYDQLKDDQIADKVINAMALAADQLAETIKKMKNPWKKPTEEELRRGKKGKAEKQTEITQAEKQTSGKQMVFLFGDRPTPADASLFAHLVQLFETPLKIPKLENHIKTVKEQSNHAQHVLLQYVEEIKEQIGWEQMKHSSEKAVENPFNFEWVEDAKKMEKYNGKFLGRRDKNKYNKCTYVVPFLINQGGQQIRMARNSDFRVPTSDIFGVGIPTSDFRKFLGHRNCDFRLPKFLMKSRNFSEFFFSKN

SEQ ID NO: 147504 - protein, 209 aa, Heterodera glycines
  Coding regions on vcDNA: vcDNA=SeqID_73927; Strand=+; Position=1-630
MIEFDGMFMVFPGAERMHEREEFGADNEEEKEEEENEDEEDDGNITEIREEKVKTEKSEQSIRMRTPKREKKKGAAENTGKKLSAGGEKKTEKKMLRKDSSGSGSSRRQERPGNEQNPEGQEMQTVYNEQELKSFAMYFEEKTWTTLMNKQMLFEVQYMYSMGLYVVFGYSHGLLGQCYCMASSSAQSYPYRVFSTMFYVIHVHLPYLL

SEQ ID NO: 147505 - protein, 123 aa, Heterodera glycines
  Coding regions on vcDNA: vcDNA=SeqID_73928; Strand=-; Position=1 -139,500-569,2209-2371
  Homolog annotation: Hit_ID=P15846; Match level="QueryCoverage=73%, HitCoverage=32%, E-value=2e-41, Identity=96%"; Hit description =Tropomyosin, muscle gb|AAA30103.1| tropomyosin
KIVELEEELRVVGNNLKSLEVSEEKALQREDSYEEQIRNLSARLKEAETRAEFAERSVQKLQKEVDRLEDELVHEKERYKAISEELDSTFQVNNDCMRKRGQSFHPFGGAFRLLICSVNGCER

SEQ ID NO: 147506 - protein, 151 aa, Heterodera glycines
  Coding regions on vcDNA: vcDNA=SeqID_73929; Strand=-; Position=1 -174,942-1223
MGMTDNPSNGTCQGRGGRGRTEPPHCVGGGGLGTHGGPTENRHSKVGGGEQSSGRSGTRPQIDGDAFAGGRRTRKHFGGASGGSESDRGGRGPQIRRGERREATVEGETDRRDALGQCLCQWLIWLMAMPMANMANGNANGKYRQCQWQHF

SEQ ID NO: 147507 - protein, 106 aa, Heterodera glycines
  Coding regions on vcDNA: vcDNA=SeqID_73930; Strand=+; Position=1 -140,719-901
AATNADYCEEDNLYTVQCDQRPKLAPIVLKVNGKDIVVPAEEYIIDDWVLGALFLNAYCTMFDYDKGQVSFASSKDTIPYRDGEEFNASLHVHSRQILLHEHKEEL

SEQ ID NO: 147508 - protein, 50 aa, Heterodera glycines
  Coding regions on vcDNA: vcDNA=SeqID_73931; Strand=-; Position=1-333
DLTHHSPSLITDDFETKFGILIIIDLFYLCFCPSHEPAIVDHGFSPIICM

SEQ ID NO: 147509 - protein, 529 aa, Heterodera glycines
  Coding regions on vcDNA: vcDNA=SeqID_73932; Strand=-; Position=1 -116,161-199,248-298,375-466,947-1031,1128-1217,1364-1479,1647 -1808,2050-2197,2315-2475,2644-2822,3064-3130,3326-3551
  Homolog annotation: Hit_ID=NP_509897.1; Match level="QueryCoverage =100%, HitCoverage=45%, E-value=0.0, Identity=59%"; Hit description =guanylyl cyclase (gcy-9) [Caenorhabditis elegans] emb|CAA91488.1| Hypothetical protein ZK455.2 [Caenorhabd
NFQVITMESCNRLSGVEHGAFLHYLRNASVYFGPGCNNEMNVIGRLASRWNVMNVIGRLASRWNVPIIAPIIAHLSGDDALSDRTIFDFDTLGSVALTSATEMARAALTLLQLYGWKQIGLVKASINFERLSLHSLKNFLKDSQIEINVEIELDPYMTADEIIATGKLKLLRNRARIIIVEMGMDLHSSRNFMIAAHRSHMKTNDYVYLIPWLAHMHDHYPWEATNIEKQETKTAFDDTIVITAHGYDKKFIEEFEHRFNKVTGIISSYYATLSYMSLYDALFLYGLAVRDSVEESRNQNIFLDGRYIWKKMTARQFIGVTGQVLMNNKAIRVPSYATYHVKNGTMRIVVELTARLSDKHKCALSENDCSEHVAHETMSHYWGSYDGYMPSDMPKCGFDGNLCDYTNIYITIGVLAFLAVSIPLGYLLYLKEKERMLYDMTWRIPREQIRLLEEKSGSLHSKTLSHDSSSLGGSLGSAAKANARLSAKQAMSNGVKCAYKRYSQMRSLSFNKNELKRLKELKLMENENL

SEQ ID NO: 147510 - protein, 170 aa, Heterodera glycines
  Coding regions on vcDNA: vcDNA=SeqID_73933; Strand=+; Position=1 -256,1055-1102,1745-1953
MHTVAAASWATHLNLAPPAESIGQMLSKGEGQMKQQQQTVMANNNNNKSRKVPKRRSPSSDALTRCSAAPADAAGANGGAGHWTPAKQLKNVHKNVMELAAGPPLDLQIDQPTTKFADSTTTTKTTTAHVPPIISQLVGTDSSSSSSSSSNNITEQHKLDANGGKIKKII

SEQ ID NO: 147511 - protein, 171 aa, Heterodera glycines
  Coding regions on vcDNA: vcDNA=SeqID_73934; Strand=+; Position=1 -266,2611-2860
MFLRRTVNAWHFAHCLKNVPRTLSCYVLLLLIIHWDRYKVFWWAAQPAGQQQQQQSQAPGTAPTTPQAQNGAGGRDHVFIYSSFLYNRRFNGQILLAHDCFYEYRHSAQFIGLIDWDDLLVPSRHFATLPEAFAAASAAHPDTAYFLVNKLEASFEEQLGTVFLWGKKRYL

SEQ ID NO: 147512 - protein, 327 aa, Heterodera glycines
  Coding regions on vcDNA: vcDNA=SeqID_73935; Strand=-; Position=1 -161,418-542,2731-3427
MELFSDAVSLPARLLLVHSDPLPSLPVHSAPNDANGPLLLPANVHFQKPTRLKKISLIKPFFGFAFVINPFSGRCVNGLCPIGYVCNSNDFCCAVDLLHVKLLSVIAIQFFPYLQINTNITTSGTLNEGSGGGTGTAAPGQNNTNGDITGGSSAAAAVAGNVHRCQSPIMEAEVAEDTSNKMFPSHEQSQQLQQQPQGVKKESVGSSNSTTSSTRVASVVHPIETTKDSKPKPSVKDNTTISPQALNSMLSGSPLITTPSIAPQQRHAPGDYTDAAVTGGKTRGGVPHHLHQYQQQQVVPHQPMLNHRHPAGSPPSVAATAVEGTTM

SEQ ID NO: 147513 - protein, 88 aa, Heterodera glycines
  Coding regions on vcDNA: vcDNA=SeqID_73936; Strand=+; Position=1-267
MAMGKELEQAKESQKQKRGTKMEEVAECHADNETEATKGPTEYLEEREGRKGKRREGKRRRTPSEAAAEEDRRSGRRSECNGQRGLSD

SEQ ID NO: 147514 - protein, 96 aa, Heterodera glycines
  Coding regions on vcDNA: vcDNA=SeqID_73937; Strand=-; Position=1 -46,102-160,212-261,405-531,585-593
MTLLVIACLAIAVFSGSSIANRHSFVEHYDATNIQKIREVFLSLNRKRVLKCCAIPCRTILCHGSRGPAAKNTNSTLANSHGWLREKNVWHKMPIW

SEQ ID NO: 147515 - protein, 205 aa, Heterodera glycines
  Coding regions on vcDNA: vcDNA=SeqID_73938; Strand=-; Position=1 -115,383-452,507-589,1100-1227,1274-1334,1714-1751,1831-1954
  Homolog annotation: Hit_ID=AAL78216.1; Match level="QueryCoverage =57%, HitCoverage=35%, E-value=4e-63, Identity=97%"; Hit description =aspartic protease precursor Hgg-33 [Heterodera glycines]
DPTSEFGGEITIGGTDQRRFVAPITYTPVTHKAYWQFKMDSISGGNGKLACQNGCQAIADTGTSLLAGPKNDIEKIQKHIGAIPLFHGEYMISCERIPTLPDVTINIGGKAYTLKGKDYVLKMTSMGKSICLSGFMGIDLPERVGELWILGDVVTTRCLMWAKVIIPIEPQVRDCVRGGALCFDHSNGVDDSDQQMVEGDFVMTD

SEQ ID NO: 147516 - protein, 19 aa, Heterodera glycines
  Coding regions on vcDNA: vcDNA=SeqID_73939; Strand=+; Position=1 -26,73-106
MPSNSQPRRPSIRHAWSLQ

SEQ ID NO: 147517 - protein, 101 aa, Heterodera glycines
  Coding regions on vcDNA: vcDNA=SeqID_73940; Strand=+; Position=1 -171,795-929
MPSSAAQQMNTASNARQYDEQHNQEHLSIDAKLQKQDSGLNLLPPELQRNMTVMSDESVFEREKRMVVLLVNNQQDKPSQLAVIDVDFQSPGFSRVKKKDN

SEQ ID NO: 147518 - protein, 103 aa, Heterodera glycines
  Coding regions on vcDNA: vcDNA=SeqID_73941; Strand=+; Position=1 -100,149-243,999-1028,1160-1226,1417-1436
MAVHMRHALAFTTEWGDLDKILCQTPNIKPPKMGSQDLLQNDDFLETFGNKVNVWDMRRRTLFQTVYLYSIGKLNKTGLFSADRVVKFSSVTVGEWPVKLVYK

SEQ ID NO: 147519 - protein, 170 aa, Heterodera glycines
  Coding regions on vcDNA: vcDNA=SeqID_73942; Strand=+; Position=1 -21,148-231,654-802,1225-1483
  Homolog annotation: Hit_ID=NP_502691.1; Match level="QueryCoverage =95%, HitCoverage=25%, E-value=5e-10, Identity=29%"; Hit description =selenium binding protein like (52.4 kD) (4O819) [Caenorhabditis elegans] emb|CAA19490.1| Hypothetical pro
MDDQHLYVFLGGIVYRTMGILHGDKMPLGKDSAMRSYNTERRFFAGRPFEGGPARLQLSLDGRRLFVSNGFLRNWDEHFFPQLMDEVFSTKQVHIDPVGTNPMKLDPNIGINFEPDEQQQQQQHSVNDHRKRGGGGGDKNGPATQPQQQQQHFYAREMRFLNGDSTSDLL

SEQ ID NO: 147520 - protein, 75 aa, Heterodera glycines
  Coding regions on vcDNA: vcDNA=SeqID_73943; Strand=-; Position=1 -178,236-285
DFNEHGAKPRSRINTAYDIILITCDHKNEKAVHGKRHISLPDIVIDAATPKMDEKSTAEVHFKIGEFIFKFKYLP

SEQ ID NO: 147521 - protein, 125 aa, Heterodera glycines
  Coding regions on vcDNA: vcDNA=SeqID_73944; Strand=-; Position=1-378
MMDSSSNNTTNNGGSSSNANSVMPSPLSRHNLPPGLGLGFGLGGGGVGGGAPAPPPSLVSGMGLANRGGGGGAGDDAEQQQQQGGRPGSNAGPGQQNGRGPSPQGVCVLFGLTVKLYNNSAPSES

SEQ ID NO: 147522 - protein, 60 aa, Heterodera glycines
  Coding regions on vcDNA: vcDNA=SeqID_73945; Strand=+; Position=1 -53,508-637
MVLILGNDPSLTTKLRIGNFLFITKYLFHFFVGGNPRLKSGIRCPFIAYLNGDDLAPRIK

SEQ ID NO: 147523 - protein, 98 aa, Heterodera glycines
  Coding regions on vcDNA: vcDNA=SeqID_73946; Strand=-; Position=1 -90,134-218,302-422
  Homolog annotation: Hit_ID=AAO33475.1; Match level="QueryCoverage =100%, HitCoverage=63%, E-value=2e-13, Identity=46%"; Hit description= gland-specific protein g5d08 [Heterodera glycines]
MAMLIIGIKMDEHNAKGAIAQPNLEPLGLLFSFPGQKMEANGNNAKDEEKQPPKGNQKKKPNKKPFLIKLQRGGRGKRDVLGNDDGFAGGWDHPIDST

SEQ ID NO: 147524 - protein, 17 aa, Heterodera glycines
  Coding regions on vcDNA: vcDNA=SeqID_73947; Strand=+; Position=1-66
HKHLFDLFYHIHNLIKI

SEQ ID NO: 147525 - protein, 65 aa, Heterodera glycines
  Coding regions on vcDNA: vcDNA=SeqID_73948; Strand=+; Position=1 -119,207-285
MPMIFMPNIGILYRLISLQICTLVSSYSCTFEGFVWTAYAQSYSKFDLKLFIIPSVMDVSNHYAQ

SEQ ID NO: 147526 - protein, 295 aa, Heterodera glycines
  Coding regions on vcDNA: vcDNA=SeqID_73949; Strand=+; Position=1 -88,710-1508
MLIKKGSNTKLIRSLLHGDLISPFWLGTRDPEETCGMCHNSLCSGIEEHSNCAAITLADLHPAFAVMDKLRNVKIETLGELISLMIAKDVPIAQIRNWATNRNTHGPDFLLKFSSNLSPSSQEFISIISLWIDRCDFAFHNLQASGCKKIKFLIPKENKGYPFQKAIENAIEDVKARSVLGLSKVIRSPFIVFSDSVGEVMKNKLEAEIFLERSYTALSNEIVTTYFGEEVKEILIMAGTDDIIGNVPIEETKKAIKKISFHLSKFSIKTFIIPHAYSFQKNQGHMKNFLICWMK

SEQ ID NO: 147527 - protein, 114 aa, Heterodera glycines
  misc_feature (23)..(23): Xaa can be any naturally occurring amino acid
  Coding regions on vcDNA: vcDNA=SeqID_73950; Strand=-; Position=1 -31,1448-1661,2100-2198
  Homolog annotation: Hit_ID=XP_424077.1; Match level="QueryCoverage =96%, HitCoverage=25%, E-value=1e-34, Identity=68%"; Hit description =PREDICTED: similar to ornithine--oxo-acid aminotransferase [Gallus gallus]
MASGFGTFLPLFLLKRLLIFHHXQAAISDPNCAAFMVEPIQGEAGVIVPSPGYLQCVRQLCTKYNVLFIADEVQTGLGRTGKMLCCEHDGVRPDIVTLGKAHSGGLYPISAVLA

SEQ ID NO: 147528 - protein, 27 aa, Heterodera glycines
  Coding regions on vcDNA: vcDNA=SeqID_73951; Strand=+; Position=1-83
NSALVLIWQKIKPFFLRTHWCSIHLTK

SEQ ID NO: 147529 - protein, 91 aa, Heterodera glycines
  Coding regions on vcDNA: vcDNA=SeqID_73952; Strand=-; Position=1 -255,968-987
  Homolog annotation: Hit_ID=AAH77314.1; Match level="QueryCoverage =98%, HitCoverage=20%, E-value=9e-28, Identity=61%"; Hit description =Oat-prov protein [Xenopus laevis]
KGCRVWDVNGKEYFDCLSGYSALNQGHCHPRLVETMQRQCQQLTLTSRAFFTDALGHYEEYVTKLFGYQRVLPMNTGGTNKSPNCRLTTKK

SEQ ID NO: 147530 - protein, 205 aa, Heterodera glycines
  Coding regions on vcDNA: vcDNA=SeqID_73953; Strand=-; Position=1 -462,1774-1926
MKRSTRNASKRENKKSRSSDSLRQEKQQEKSQNCIKKIDEYTTSSKKFQLLRSKSKFVVQNIDQCDNPTKELEECIKSSINEAIEDAKRTLGGADKAGVVISSEMLDQGDIIVPITPISSNVADAVFNQFIKVEQSVARKSLNIYGTPFVITVTGCIFPETSGKIAEAEARSSKLKKPEVFEAEAEVSPSPGPETCATNPLARFK

SEQ ID NO: 147531 - protein, 37 aa, Heterodera glycines
  Coding regions on vcDNA: vcDNA=SeqID_73954; Strand=+; Position=1 -49,108-169
MSDNVFALLDDFDIENIDPSLNFANDDWMEEIGESVT

SEQ ID NO: 147532 - protein, 66 aa, Heterodera glycines
  Coding regions on vcDNA: vcDNA=SeqID_73955; Strand=+; Position=1 -11,79-268
MNRRWICNDVWMDIFPSFDRPQLGLKLALLSPRFNALVDKHFNGKSELTIWRTIEIRRKDKGPEPK

SEQ ID NO: 147533 - protein, 82 aa, Heterodera glycines
  Coding regions on vcDNA: vcDNA=SeqID_73956; Strand=-; Position=1 -149,1025-1124
MDFDLLIKKLQYVIRKSGPFRKMKRGKAKDKQQKHGNDLIKSGADQQRNRLLIRTSFSRWPEEVKKSGFLNTFLNNFLKQKL

SEQ ID NO: 147534 - protein, 1108 aa, Heterodera glycines
  Coding regions on vcDNA: vcDNA=SeqID_73957; Strand=+; Position=1-3327
  Homolog annotation: Hit_ID=NP_508324.1; Match level="QueryCoverage =99%, HitCoverage=46%, E-value=3e-77, Identity=25%"; Hit description =predicted CDS, peptidase family A16 and RNA-directed DNA polymerase and Integrase, catalytic domain and Z
MSGVIRSKIPLLNRVIKKEIESAKTKLEEGKFEYDQNNTDECLRVFNKTKEIIQKIEPNFEKLKTLHKKWQNLMRKMDKEQWNTEWKIQKIFREKHDYLKTIKETDEILDTLKDIKLEVKRRLKVIKAKPSSDTDQEDESNDDEEENEDEEIEEEDEEEKEYDSDQEDDSPELTSNDQTNRKQTPFVNYRSRIKLPPQTLTHFSGKFSQWPSFWDDFKSSVHNDPNLENIQKLKYLRGLLHDEPYRIVSPYPLTNKNYPIIVKLLKSRYGNPQLIRENLHSELRNLRKPNESTSELRRFILFIDRIILQLQSQGEEINHPQIKQSIETKLPFNIRLKLREKFKLYSTKELMNFLNSHTQAREDIERMEDSNRQIRNFPPHRPPQNRPQRQSYPNYSQPQLKANHRNHQNLPLSPYPITSALTTKSKPVRLAEFKPKPSQPKPQTKIKFCRFCERDNHLSKECKIYSTTEKRSNRARELKLCLNCLKKGHHLRECKSSFSCFNCKSKHNTLLCTRKQNQYNQREKFTKVNVTQNPEEFEETQTFMSMDSDQNQKIIQNDEEELLMTTEAPVLNPDQNKTQNEVIFFDNGSQKSYITDECADSLQLPTIEEKLLAISTFNQNKPKIISSRLVKIGIKTLNGEIEYVTLQTVEKITEKMVNRETVDIFKNKIPINHAYPQILIGIDHSWHFMLPNSQIQILPSGFYSIDTKLGKILSGKGTIEDTNVNLVKEKRKKDETNEILQKFWELENIGITDSPHLTDEDAALIHFDKNVIFEENRYHIRWPYKRETPNLPTNFGLCLGRLRNVVKQLIKNKQLESYNKILQEQMDTNVNEIADFKSKNLIHYLPHHPVIKESSNTTKIRPVFDASAKLRGSNSLNDEIHQGPKLLPDLCGMILRFRLKNFVLLGDLEKAFLRVGLNETDRDTTRFLWVNQSYLDEINQKYREIEMRDVELRRFTRIPFGVNASPFLLTAVVNLHLSKTDEMFEKFKTQQIDKELCLNGKEKQFKELCTELKENAYVDNFVMMCDDENEIKFKHYWSKEIFKLASMNLREFVSNHEQSNKEIQKLEGSEIPKVTKMLGIKWNVDTDELELQIKIPLMSRETRQKGKF

SEQ ID NO: 147535 - protein, 582 aa, Heterodera glycines
  Coding regions on vcDNA: vcDNA=SeqID_73958; Strand=+; Position=1-1746
  Homolog annotation: Hit_ID=NP_502915.1; Match level="QueryCoverage =99%, HitCoverage=62%, E-value=2e-85, Identity=35%"; Hit description =predicted CDS, integrase, catalytic domain containing protein family member (4Q923) [Caenorhabditis elega
MNLREFVSNHEQSNKEIQKLEGSEIPKVTKMLGIKWNVDTDELELQIKIPLMSRDTTKRQILTMIAKNFDPMGWLSPVILKYKLFFQKLWRSNKDWDDKLNDEEIREWNNISNTDEISIPRSPFTSQNLKCASLHLFSDASELAYATAAYLHANNKTDLLFAKTRLTPLKGLTIPKLELLGLLIAARAVKFIVKESKLKFETICIWCDSKCVLSWLKCKKNLPIFVKNRVEEIKRIVSEFHITFYYVKSADNPADLASRGTTMNEMKYNELWWKGPKWLKLGKENWPAHSFYTPEQNDSLYDDNIMEIENTQTNLVKMDYQGFIEWKKCNSWDKVTRICQILLKFVFFTLKDSPEFKTKFKIQKFQNELSLKFMAQKMLIRIIQKEMEPNNEEERQLGIYRDNDNILKCGGRLKNAQIKATNPIFLPRTHFGTHLIIMDHHQRNLHAGTMTTLAEIRKTYWIPKGRRIVDQIRKQCFYCKRYNAKPYQQPKMPQLPKSRVQITEPFQNVGLDYMGPLQVKSFTEKCWIILFTCCTTRGIHLELVTSLSVQHFLNAFRRFISRKGTPKNIWSDNASQLKLASK

SEQ ID NO: 147536 - protein, 86 aa, Heterodera glycines
  Coding regions on vcDNA: vcDNA=SeqID_73959; Strand=-; Position=1 -152,460-568
MAKMVFLSPRSLWIDAKYPFRKTPTREALVPRSMPIACEFRGIILCELEICGILTGFPITLPEIFFNGLYQKGKKYLATLTKNSKS

SEQ ID NO: 147537 - protein, 60 aa, Heterodera glycines
  Coding regions on vcDNA: vcDNA=SeqID_73960; Strand=-; Position=1-239
ILVISFCFWWGAWNSGIMRTRPIWQVKQRLLTSQKVRCRDETNQHCLPRGTRHGPPKEWI

SEQ ID NO: 147538 - protein, 54 aa, Heterodera glycines
  Coding regions on vcDNA: vcDNA=SeqID_73961; Strand=-; Position=1 -121,1163-1206
MDKISEFFRTSYPGVHFSKTTRTRLIINVIFFDGFVFFPKSVNEFVGHESDLRF

SEQ ID NO: 147539 - protein, 262 aa, Heterodera glycines
  Coding regions on vcDNA: vcDNA=SeqID_73962; Strand=-; Position=1 -158,202-265,317-501,741-888,979-1134
  Homolog annotation: Hit_ID=CAE68867.1; Match level="QueryCoverage =99%, HitCoverage=42%, E-value=1e-63, Identity=46%"; Hit description =Hypothetical protein CBG14830 [Caenorhabditis briggsae]
FSSNNIFKVHRLMLVLVFLKSLTLLFHGVNFYFVSVYGHERELWAIIYYVTHLLKGALLFGTIILLKGALLFGTIILIGSGYTFFKQFLSDRDRRLFIFVQFLSDRDRRLFIFVLPLQILANIAMIILEESEFSDQRYLFWLEMFTFLDIVCCMSILLPILWSIAFLTECAAKTTDGKAAFSLERLRLFRRFYLHVIAYIYTTRGAKFTLEYFLPDEKRWVSEAAAELASLFFFCLVGAKFRPRKSNPYLRINLEGGDVEAG

SEQ ID NO: 147540 - protein, 215 aa, Heterodera glycines
  Coding regions on vcDNA: vcDNA=SeqID_73963; Strand=-; Position=1 -259,308-451,560-670,713-846
  Homolog annotation: Hit_ID=CAE68867.1; Match level="QueryCoverage =99%, HitCoverage=33%, E-value=3e-36, Identity=38%"; Hit description =Hypothetical protein CBG14830 [Caenorhabditis briggsae]
RGRELANGVQTNPHLCQLQQQDQGIDSLFFVFDFTAQRLVVVRSGHIKSIKLCTNLSRQGQKKDIKFNICHGFALFSCPYSEDGETRNSTSSVVASSGGFLSHLFGGSSSSNDLKLPYFDYLPIGLHNGQYSTQFAVRFNEQQKGFFFLFFHNCFNYREHGYSDRVAVDLAAIIVEKNVNSFLSVVDIPKPSLYVYFAFLFALATILWANLLCKS

SEQ ID NO: 147541 - protein, 151 aa, Heterodera glycines
  Coding regions on vcDNA: vcDNA=SeqID_73964; Strand=-; Position=1-454
MQQKSFDEIFGEKWEEKEMENHQKKSEIIQKYYKIKENIKQKGRKYPKKEWNKIERKIGRKLGTNRNKIYEWIKELGLNQKPNKCYKSKTDEETLEIVQMFIAMKNELKQKGKHSKKERRQREGRLIEKETDCERKKEREIERKKEKRGSE

SEQ ID NO: 147542 - protein, 459 aa, Heterodera glycines
  Coding regions on vcDNA: vcDNA=SeqID_73965; Strand=+; Position=1 -114,260-420,633-675,790-882,945-1022,1082-1182,1238-1355,1407 -1554,1601-1716,1776-1871
  Homolog annotation: Hit_ID=NP_505613.1; Match level="QueryCoverage =96%, HitCoverage=61%, E-value=3e-88, Identity=41%"; Hit description =solute carrier family 23 member 2 (5K638) [Caenorhabditis elegans] emb|CAB01641.1| Hypothetical protein C
DSPVDSNNSDNNSSVVQRKLYKADENPPWPLTLLFGLQQVMVSVSVLVSIPFLISDEVCPGQDRDQLRVRLIAGTFVVCGLGTILQTALGLRLALLQGVAFAYIPSVRAYMNLEGNRCNATIHDFVPAEVYENKLAIIQGTLVVVSVLKVLVGIQGTLVVVSVLKVLVGATGFIGKMTKYIGPMTVSSLYIGPMTVSSLLILLMVESVTITVKRMEQHWISLIMAVALFATVLYLPRVNVPMAVALFATVLYLPRVNVPCPAYVNGKFSFVGFNVFGQFPYLTAILFSWFLCWLMTVFELIPPYLTAILFSWFLCWLMTVFELIPKDSVARTDKNGTMMAIQNAPWARVPLPGQFGMPKFNVGLFMAFIVQFGMPKFNVGLFMAFIVSGLTTMFEAVGNYHAVARVSEERPPPSHAINRGIVAEGLGERPPPSHAINRGIVAEGLGCLIAALIGPCVGI

SEQ ID NO: 147543 - protein, 51 aa, Heterodera glycines
  Coding regions on vcDNA: vcDNA=SeqID_73966; Strand=+; Position=1 -22,182-315
MTLPMFVDVYAFPGPLQRTVEAIPLLKYMPFMPKQKKANANLRNGFGENKF

SEQ ID NO: 147544 - protein, 183 aa, Heterodera glycines
  Coding regions on vcDNA: vcDNA=SeqID_73967; Strand=+; Position=1 -168,214-307,464-753
MEANSGSLSASLQAAEAEIGSLKEMIKLQNEKMKDMRHCFVNFRSWLDQLEAWASDNKETKFVRPDTRKRALLDDSPEMPATSNAASAAERKMRGAGDWLFKASTPQKKWWRRKWDVQFWTTTKFFFKIYLPKIERHPTPPACDGFVVQPTPYTVGLAPRLRKMNGVGSMGMCRESILLRESN

SEQ ID NO: 147545 - protein, 172 aa, Heterodera glycines
  Coding regions on vcDNA: vcDNA=SeqID_73968; Strand=-; Position=1 -408,650-760
MPTSTFGDRSGTNLELTLCSSDNDDDEHPIWDVLAREIWPIFAPSIRHLGFFDDEQFDALCRRISPTILTDLDQLVSINFDQLILVIADDGQNGTSPGQVLSEWLHTPRKDGQPKRLFCEELDGEGNIAWLNSFKEQMVKVSRYSINDSNNLPLIAFPTLDDINLRWHFSKN

SEQ ID NO: 147546 - protein, 199 aa, Heterodera glycines
  Coding regions on vcDNA: vcDNA=SeqID_73969; Strand=-; Position=1 -144,200-339,397-709
MEAQRVISGIKRRAEQTMEPPATIRSLALQNVATPVLAQLPTKQATKQRYQNDPTFAEMARCVTSLAFLPIGDLTPGIIALDMALPDELTPVLDWFIMNYTGRLKHDGSRTRPRFDPNIWSVYTRTLQSDDRTNNHSEAANRRLQCAFACSHPSIWRFIDLLRKDQKLSDDDFAKCSTGQEPPQKAKKYRNADRRILTM

SEQ ID NO: 147547 - protein, 101 aa, Heterodera glycines
  Coding regions on vcDNA: vcDNA=SeqID_73970; Strand=+; Position=1 -210,356-451
MLWQQSLIRPLLMGPCVAPHFATSLRMLTTQEAIAAGMAQAIGTTRPTETEGTDGAGCKTLRPTCGAGQVVTIHVILANGDTDFGNYDLVPSRWIAMPKGS

SEQ ID NO: 147548 - protein, 35 aa, Heterodera glycines
  Coding regions on vcDNA: vcDNA=SeqID_73971; Strand=-; Position=1-107
MSSWRNVRTPSFSIELQGRPGNGDIEIQKTVQMSP

SEQ ID NO: 147549 - protein, 130 aa, Heterodera glycines
  Coding regions on vcDNA: vcDNA=SeqID_73972; Strand=+; Position=1 -244,1476-1625
  Homolog annotation: Hit_ID=CAE66662.1; Match level="QueryCoverage =80%, HitCoverage=24%, E-value=4e-12, Identity=33%"; Hit description =Hypothetical protein CBG12000 [Caenorhabditis briggsae]
GMNWDRFSSELDDSLLNDSTTLKVKKAFWSAKQLLREKLGKREDEHIVAADAELDTHLQTFRQIRDSTQKLLNLMETHQREILNVSIGSAMEDQRRSHTTDGVSKPDKLNTSRPSSARRRQLSAGSDNTE

SEQ ID NO: 147550 - protein, 125 aa, Heterodera glycines
  Coding regions on vcDNA: vcDNA=SeqID_73973; Strand=+; Position=1 -265,2613-2723
MKRVRELLRFEDDAMIGMAQPADQVRLKCPAATSSESIGLNLLKHSSSSTANLLDDLQHGWDSIGCSSAALNDLEHKKKNAETKSQLNYFAFVGLRDAVPSTLQAVAQRPDQRGHHGESAAGQVP

SEQ ID NO: 147551 - protein, 142 aa, Heterodera glycines
  Coding regions on vcDNA: vcDNA=SeqID_73974; Strand=+; Position=1 -55,144-295,339-458
  Homolog annotation: Hit_ID=CAE61217.1; Match level="QueryCoverage =91%, HitCoverage=23%, E-value=5e-31, Identity=56%"; Hit description =Hypothetical protein CBG05011 [Caenorhabditis briggsae]
GGGGIPKLNTFRPSLSPPWLGDVKGMLGDVKGMADRIITMRSQLRDLLAKAGSKRNWDHIVNQIGMFCFTGISPEQVDRLAKEFSIYLTRDGRISVAGIPEQVDRLAKEFSIYLTRDGRISVAGISSKNIDYLANALHEVTK

SEQ ID NO: 147552 - protein, 122 aa, Heterodera glycines
  Coding regions on vcDNA: vcDNA=SeqID_73975; Strand=+; Position=1 -92,238-514
MAVGLALLLPIILLATTLNPLYQHIHPYLKYPLLHTGNSSPSHDAFATDIYAMVGSQQQQQYHLLPTQQLKHNGNKQYTTQQQQQQQFTSPYATSNYGYHELTHPPAYSMSMVGGGGTGQRR

SEQ ID NO: 147553 - protein, 291 aa, Heterodera glycines
  Coding regions on vcDNA: vcDNA=SeqID_73976; Strand=+; Position=1 -41,495-630,683-931,1060-1248,1525-1785
  Homolog annotation: Hit_ID=NP_509907.1; Match level="QueryCoverage =52%, HitCoverage=16%, E-value=1e-10, Identity=29%"; Hit description =putative protein, with at least 5 transmembrane domains, a coiled coil-4 domain, of bilaterial origin (XM
MLHREHFRQAVHIGSIWLSLAFISVFGLLAALAMLFGANVSHLVCRPLEEPLQRPDFLSLLDRFVHLYGLDRPSSVSPHKSSPSAADHFSLDQLFSANRRPADLISECAQKHTLYTMLGLDKKFKLIGREGLQDDYQYLVNRQRSIMDNLSSHQLIDEALSRGIVPDDPRLSARQWHFFSGPMRDALQRLGQVRMPEWNSSDVEQFCAQPKRFALEGVVAGLRQLSQQAQAEANNSGVDGEKPAGTVASNFSELDAVIHFLEELRPDTASERNSDLMAFTRDESDQTVLRC

SEQ ID NO: 147554 - protein, 235 aa, Heterodera glycines
  Coding regions on vcDNA: vcDNA=SeqID_73977; Strand=-; Position=1 -21,195-322,986-1216,2856-3183
MVAAIDPFYEQYANKGLIASEILINGIISVICLTGICLNFCLVYVTIKTKSLHSPCKTLIALFAFCSSFLLFGTSIKFFVFLFGINYILLKHCFFIQLLPLIGSSIAVSLQLGIGIDRLFGVMFPLWYKSRGKYTSFKGIIAFCCIKLAFFCFVTYSGSAAHWEKWTQNGQLNLNLNFVFGSFRPVMCHLGDPAHQPETAYYTDINALISYCAEFVCYALIWLIIWRRTAQSHSV

SEQ ID NO: 147555 - protein, 182 aa, Heterodera glycines
  Coding regions on vcDNA: vcDNA=SeqID_73978; Strand=-; Position=1-546
  Homolog annotation: Hit_ID=AAB97874.1; Match level="QueryCoverage =89%, HitCoverage=50%, E-value=1e-19, Identity=45%"; Hit description =surface antigen [Trypanosoma cruzi]
MAHPKMTLPKMANPKVAPLRMTHPKMTLPKRANPKAAPPRMAHPKMTLPKMANPKAAPPRMAHPKMTLPKRANPKAAPPRMAHPKMTLPKMANPKLSVILRQQIYQINQPLVIFTKVPQNPFQLEHRKASTAQKVPRRQTRPKSMEQIETNPAKLTAANPFTKTLAFCIFEHFYCSKKQLVK

SEQ ID NO: 147556 - protein, 799 aa, Heterodera glycines
  Coding regions on vcDNA: vcDNA=SeqID_73979; Strand=+; Position=1-2397
  Homolog annotation: Hit_ID=XP_318550.1; Match level="QueryCoverage =98%, HitCoverage=78%, E-value=0.0, Identity=42%"; Hit description =ENSANGP00000020240 [Anopheles gambiae]
MTTHAVNSISLLKTAVLFNKKPVEFHLDTGSDIVVIDQLTHEYVGRPPIEKCNEIGKAFDGTKISFIGKGFGTFKFGKIEVEQTFYVAKAGSLNLLSCKMMDLFGLLDELKLKISNPAVNACHANGKKAENLIPNEATQIAGTEVKIQGLEKAFHEIFSEELGHCLKEKAHLALKDDARPVYRKARPVPYNSLEVVESELSRLEKMNVIKKVEHLEWAAPILIVKKADGSARLCIDYSTGLNDALLDCQYPLPIPEDIFATLNGGKIFSQIDLRDAYFQVELDENSKNLCGLATHKGNYRMERLPFGVKSAPAIFQSIMDKMLAGLEFAIAYLDDIIIVSKSIPEHTNHLKEVFGRIQAYGFRVKLAKCKFFRDQIKYLGQIIDKNGRRPDPAKIYAISQMPAPNDIPSLRSFLGMVNHYQQYVKNMRFIRKPLDDLLKKEIDWSWSEGCENAFRKIKEILASDLLLTHYDPKMDIIVAADASELGIGAVIYHKFPDGNIKAIAHASKSLAPAEKNYSQIEKEGLALVFAVQKFHKMIYGRHFTLQTDHKPLVSIFGSKKGIRQCSANRLLRWSLILLAYDFTIEYINTKDFGQADALSRLIAKGNEPEDEKIIAMINAETDFETNFDNTISKLPLKFSDLIAASERDENIFQVQKFVKNGWPNEKAMDKENQIVRDLCRRKEELSTEKGCLMYGERVVIPKVFHSKILKLLHKGHPGMKRMKQLARQYVFWPKIDQDIEDFVRECVPCQAAAKAPIKTNLQSWPKTTGPWQRVHMDFAGPFFGKYFLIVVDSFSKYPE

SEQ ID NO: 147557 - protein, 76 aa, Heterodera glycines
  Coding regions on vcDNA: vcDNA=SeqID_73980; Strand=-; Position=1 -124,754-860
  Homolog annotation: Hit_ID=CAA74206.1; Match level="QueryCoverage =100%, HitCoverage=38%, E-value=4e-11, Identity=83%"; Hit description= serine proteinase [Heterodera glycines]
MSKLCMTILLLTIGYNSFSLSAEHFSYFSECGISDFEPEFPKKLFVSYGSANASNQQHKSGVEAIKYHPKSQHFRI

SEQ ID NO: 147558 - protein, 17 aa, Heterodera glycines
  Coding regions on vcDNA: vcDNA=SeqID_73981; Strand=+; Position=1 -4,731-780
MDVSRSYAAKISFKGFI

SEQ ID NO: 147559 - protein, 142 aa, Heterodera glycines
  Coding regions on vcDNA: vcDNA=SeqID_73982; Strand=-; Position=1 -89,366-705
MIAFFFLNFSQFANNGPTAADDEVHFNNFFKNFFGSFLSVTEMACSVLRYSILIVLLCFVYGNNEENSQKTIQKEAGTEHKNDKHIIDDDYLDDEFWDKLSPIINLPKIDGVEFVGNHFKHTEQKKHDYTHEGKIQIYLFIT

SEQ ID NO: 147560 - protein, 201 aa, Heterodera glycines
  Coding regions on vcDNA: vcDNA=SeqID_73983; Strand=-; Position=1 -111,170-478,636-821
MYYNNNSNNSQHHDDDAFGGDAQQFMDGQQMSSQQQQVATEPHQFRQQHNNRSSGGEQFNSPVSSQERLHQMVLFSSAATAAAGGAAASSSATNGGSNSGTMNGGGRGCVASSQNGSSTTNNNNNSTTSRGARRMPSSALATASTSSLRGISDAELVGRLQTARERLQDALDMIDSLQRELSVRQQLQLRGGGRNVCYDDE

SEQ ID NO: 147561 - protein, 172 aa, Heterodera glycines
  Coding regions on vcDNA: vcDNA=SeqID_73984; Strand=-; Position=1 -28,239-729
MRNFCQNLTVGIIRYDSIKWSQKGNQQKKFKCDYSADEEEEGIDVNDDEHHHHQQQQQVMFNDGDEEGEEQGRPVDHHPQNVHDEHGRQHVVVSSGGCAKRSGGDASALALAPPPPLPMYREEWEETDSAEATALRLHKRGRVRNMTSADEASKTQPIAHNGGRNGCPHPIF

SEQ ID NO: 147562 - protein, 47 aa, Heterodera glycines
  Coding regions on vcDNA: vcDNA=SeqID_73985; Strand=+; Position=1 -26,333-450
MHKKHNIIRWAAENLLESRDRGIDHETRGREFVPMLKTLRIGLETEE

SEQ ID NO: 147563 - protein, 60 aa, Heterodera glycines
  Coding regions on vcDNA: vcDNA=SeqID_73986; Strand=-; Position=1 -98,151-236
  Homolog annotation: Hit_ID=NP_872153.1; Match level="QueryCoverage =100%, HitCoverage=21%, E-value=2e-21, Identity=81%"; Hit description= lactate/malate dehydrogenase and Lactate/malate dehydrogenase precursor (29.1 kD) (5G996) [Caenorhabditi
EGMERKDLLAANVRIFKSQGEALAKFSKPTVRVLVVGNPANTNALICAKYAASKIPAKNF

SEQ ID NO: 147564 - protein, 105 aa, Heterodera glycines
  Coding regions on vcDNA: vcDNA=SeqID_73987; Strand=+; Position=1 -166,210-263,325-377
  Homolog annotation: Hit_ID=NP_510569.1; Match level="QueryCoverage =100%, HitCoverage=18%, E-value=8e-37, Identity=72%"; Hit description= nadh dehydrogenase, General Anaesthetic Sensitivity abnormal GAS-1 (54.6 kD) (gas-1) [Caenorhabditis ele
DSMESLIHHFKFFTEGFQVPPGAVYVPTEAPKGEFGVYLVADGTSKPYRCYIRAPGFAHLSKFAHLSKIHDISYMHLIPDIVAIIGTLIVAIIGTLDLVFGEVDR

SEQ ID NO: 147565 - protein, 114 aa, Heterodera glycines
  Coding regions on vcDNA: vcDNA=SeqID_73988; Strand=-; Position=1 -116,176-341,388-450
  Homolog annotation: Hit_ID=NP_493106.1; Match level="QueryCoverage =100%, HitCoverage=29%, E-value=5e-41, Identity=67%"; Hit description= gdp-mannose family member (1M874) [Caenorhabditis elegans] emb|CAB04494.1| Hypothetical protein F56H6.5
MWMILQQDSPDDFVIATGRNYTVRHFVELAFKEIGETIIWEGEGVDEVGREKEKGTLRVRVNPKFYRPTEVELLIGDPSKAKKQLGWEPKVEIEELVKEMVASDIELMKKNPMA

SEQ ID NO: 147566 - protein, 38 aa, Heterodera glycines
  Coding regions on vcDNA: vcDNA=SeqID_73989; Strand=+; Position=1 -70,258-304
MGLAMGTVAEQIPFVQILTQVLFVILPFNEPKFDKFNA

SEQ ID NO: 147567 - protein, 104 aa, Heterodera glycines
  Coding regions on vcDNA: vcDNA=SeqID_73990; Strand=+; Position=1 -64,563-813
MCPWGWASSPPTNRCTFPWVTFFQVLSPRPGPVLDPFAWRPSGVGHLCRRALSLAPTPVDGQPKLSVRYQRLFCAARLALQNGINGVRLCLLQMEKIGEKYVKN

SEQ ID NO: 147568 - protein, 337 aa, Heterodera glycines
  misc_feature (8)..(8): Xaa can be any naturally occurring amino acid
  misc_feature (15)..(15): Xaa can be any naturally occurring amino acid
  misc_feature (17)..(17): Xaa can be any naturally occurring amino acid
  misc_feature (23)..(23): Xaa can be any naturally occurring amino acid
  Coding regions on vcDNA: vcDNA=SeqID_73991; Strand=-; Position=1 -173,234-332,427-560,832-943,1209-1277,1322-1380,1596-1691,2635 -2764,2971-3039
  Homolog annotation: Hit_ID=NP_491709.1; Match level="QueryCoverage =91%, HitCoverage=36%, E-value=1e-84, Identity=50%"; Hit description =tyrosinase family member (82.2 kD) (1G477) [Caenorhabditis elegans] gb|AAB52481.1| Hypothetical protein C
LNLIQINXALLKLYXKXLTLMNXLIAGILAAELAPIAATPYQCMDLGCLCKYLNGTVEGSNSCQEGSNSCQLADNQPLKKSVRKEYRMLSDEERIKFHAAHAAMNAIKKSGEYDKIAGLHAAFGQSGAAHAGPAFLPWHREFMKRMEIALRQVDPSVSLPYWDSSLEAQLPTPGDSYMFTKDFMGDTDEEGNLVTGPFAGWRTLTGTPNVIRHVGQGGKGFTENETGTPNVIRHVGQGGKGFTENEIQWFLNQQQIDKVLGYSSPQPGVFIYIIFLNLQVTHGNVHLFVGGDMSDTSTSANDPLFFLHHSFVDCIWEQWRVARQNRNDREMTYPMDN

SEQ ID NO: 147569 - protein, 30 aa, Heterodera glycines
  Coding regions on vcDNA: vcDNA=SeqID_73992; Strand=-; Position=1-90
MSDVDPCAKAPTKALRIVCTQLHRWDKNAR

SEQ ID NO: 147570 - protein, 106 aa, Heterodera glycines
  Coding regions on vcDNA: vcDNA=SeqID_73993; Strand=-; Position=1 -235,487-572
MNCKLAFLFVFLCFTYLNVAKCEEKHEKSAINNKNNGISNSNNNNGTTSSTNDHAEKTEKKVAKNEEKVPTEDESAEDDMDLGFLDKNLVPGKPRKNLVQEKARQI

SEQ ID NO: 147571 - protein, 173 aa, Heterodera glycines
  Coding regions on vcDNA: vcDNA=SeqID_73994; Strand=-; Position=1 -142,562-680,996-1122,1189-1322
MAKLLHFVPPSSDHKMPVFFQIEDPEFSKLITSNHWLSPSENDPRMWRKSERCDMYGKDCYRVKGLLKKLDALIGCKRMKRASSNETVPSLANEGLGCYDLKPSETLLCDCDIVCDKHELQQRLDARKENQSRIWESVPGIGRINSAEILNRSRDQYFGTGPGKYYRRRDFEH

SEQ ID NO: 147572 - protein, 125 aa, Heterodera glycines
  Coding regions on vcDNA: vcDNA=SeqID_73995; Strand=+; Position=1 -269,935-1045
PTWSFTGSTEIRSIYSGEAKVYDLKKFVFNAGTTELNYAIHLNEVCEQGWAKLGLALEAEAEGEAQFLFEAEVRSSKPKKPEVFEAEAETGQDQVLMSRFSRDTDPDLLGLESRKTTCPCIILKS

SEQ ID NO: 147573 - protein, 110 aa, Heterodera glycines
  Coding regions on vcDNA: vcDNA=SeqID_73996; Strand=+; Position=1-333
MAHTYVTELAGGIPSARGTKYSYTYESRVEEEGNNELLEQSQRRREETDEEEMKQQQPITELRREEEEHELGRELRRGEDGTERHCTSTQKVGREAERSTIDLIGQCQIK

SEQ ID NO: 147574 - protein, 63 aa, Heterodera glycines
  Coding regions on vcDNA: vcDNA=SeqID_73997; Strand=-; Position=1 -95,441-537
MGCASTVSDKTEKCQFNTTKCDDPFEGCVFSTFFQDVKWVLGLTENGLSRGEPKNNLSVNKNI

SEQ ID NO: 147575 - protein, 367 aa, Heterodera glycines
  Coding regions on vcDNA: vcDNA=SeqID_73998; Strand=+; Position=1-1104
  Homolog annotation: Hit_ID=CAE58680.1; Match level="QueryCoverage =50%, HitCoverage=42%, E-value=5e-12, Identity=30%"; Hit description =Hypothetical protein CBG01854 [Caenorhabditis briggsae]
MEPVTVSKSNAEPVTVSKSKAEPVTVPKSKAEPVTVSKSKAEQETVSKSKAEPVTVSKSKAEPVTVSKSKAEQETVSKSKAKRSVGPPNSVARPNVLTRKIKSAAAVPQFNVESDSAWITISPKKSGRKSTVVEAVEQLNPPSPMKNEEPKQKVIEKQQKKSRKSAKIRTDSIYVGTVIENTMGTDKQNEKKAIDVQNDKASTDKQIHKVGTYRQNDKISDGKDAKVDTDTQSAKSGINGLNAKVGTDGRSDKAVIVAKNAKFGTNGESDKLGIGGLNAKVGADGQNYKIGTDAKSAKVGTNGERDKLGIGALNAKVGADRQSDKVGTDKQNAKNAFDETWEESIAMKDKGKAEKVQEIDFDYFIWM

SEQ ID NO: 147576 - protein, 93 aa, Heterodera glycines
  Coding regions on vcDNA: vcDNA=SeqID_73999; Strand=+; Position=1 -148,465-598
MSKICMTGTNFIRNNLVLHRRVNSCQSSTAGDEQKKTIEQKNNGTSDGEGPSQRESTRRPSLGDLLNARRKSEADRESMDTLWEPMNEGIFRF

SEQ ID NO: 147577 - protein, 60 aa, Heterodera glycines
  Coding regions on vcDNA: vcDNA=SeqID_74000; Strand=+; Position=1 -13,56-225
MIILCLGDKHKTYKNTFCEIDEHLRRFRWERGLVKPIFKSKALTLNGTSFTQAKTLGLQI

SEQ ID NO: 147578 - protein, 233 aa, Heterodera glycines
  Coding regions on vcDNA: vcDNA=SeqID_74001; Strand=-; Position=1 -86,241-461,1286-1432,1874-2119
MCEGRTEHGQLDGRRTKAKKAPHFLVTFLCAAVPLLIYAITAFLLLLSLFLLRLRPAICLHPNSAPLLPQAEANSAEFSSHCPPNLWTAWNCAQFDEHNWPTESNSTSKGQNEANETALFKKINATDKKDEGQKVLLLLKQKQRQHFGEEKTDSTVSVEHFSTENGEEKDESGRLSSETSSGAEEKEEAKKNSSEANGEGKGKEREETEGGGQREGGDEEEEEKGENSTNCGN

SEQ ID NO: 147579 - protein, 20 aa, Heterodera glycines
  Coding regions on vcDNA: vcDNA=SeqID_74002; Strand=+; Position=1-61
MNDQSKPIKKGKCEWSEERK

SEQ ID NO: 147580 - protein, 61 aa, Heterodera glycines
  Coding regions on vcDNA: vcDNA=SeqID_74003; Strand=-; Position=1-184
PVRHRMAPEGGTQRQQQKRSGRKGTIREAAVEEEEAEDENSIGKAENGKEWEKRRNREREL

SEQ ID NO: 147581 - protein, 89 aa, Heterodera glycines
  Coding regions on vcDNA: vcDNA=SeqID_74004; Strand=-; Position=1 -151,651-769
MTAIILCILIAPICHTIALETINNPLPAAEQMIGNDYRTQTTISIGAAYYDFSRFQLNIGRITLRNVTTVLAESEAKKLRKSRGPSLVK

SEQ ID NO: 147582 - protein, 118 aa, Heterodera glycines
  Coding regions on vcDNA: vcDNA=SeqID_74005; Strand=+; Position=1 -85,139-278,658-789
MKSIFLILFAFFHVLPNLVDAGNCLSGTAMSWDAYCQSLGENECHAKVITPCKLSDNGQCVIKRSIGTVTINDNSKIWKDSCHRRQNERCTNSRFEPCVWQVNDCVFFGTMFTFTTQR

SEQ ID NO: 147583 - protein, 81 aa, Heterodera glycines
  Coding regions on vcDNA: vcDNA=SeqID_74006; Strand=+; Position=1-332
YCPSLDFDNLSLTPELNRSLVGVISCHHQTFSIFSIPLQCGNHSAYLSACGNQRKPPNPSSAPARCWQVKPCTRPINPQWW

SEQ ID NO: 147584 - protein, 157 aa, Heterodera glycines
  Coding regions on vcDNA: vcDNA=SeqID_74007; Strand=+; Position=1-474
MKKTGQRKRKVSGMATAAGEKEQKEEKKEDEKKGAEEELQQQLPVNAGTEGTNEGKAEVGEETDGAETTEEAKKEMGAAPGEMVEDETEGREDVCKKGNSESADAGLEVEQLKKMLRDSGQMPTDNAPLPLPRWVKGCGAFKRKYKKIYDNMIKINN

SEQ ID NO: 147585 - protein, 148 aa, Heterodera glycines
  Coding regions on vcDNA: vcDNA=SeqID_74008; Strand=+; Position=1 -225,663-786,838-932
  Homolog annotation: Hit_ID=NP_500306.1; Match level="QueryCoverage =100%, HitCoverage=23%, E-value=7e-41, Identity=54%"; Hit description= acetolactate synthase homolog (69.3 kD) (4E27) [Caenorhabditis elegans] gb|AAC17553.2| Hypothetical prot
KAFNDRVQCHVDRQFHEAFAATEFGPLPVRVPTPDGAQLATVAQLLAKAERPLLLMGSQAMLPPVEPNTLVDTVNSLGIPVYLGGMSRGLLGADSPIQMRQNRKLALKEADLVILAGSVCDFRLSYGKNFSPNTKIVTINRSEEQMLK

SEQ ID NO: 147586 - protein, 207 aa, Heterodera glycines
  Coding regions on vcDNA: vcDNA=SeqID_74009; Strand=+; Position=1 -259,848-1053,1414-1552,1789-1811
  Homolog annotation: Hit_ID=NP_500306.1; Match level="QueryCoverage =99%, HitCoverage=32%, E-value=3e-70, Identity=62%"; Hit description =acetolactate synthase homolog (69.3 kD) (4E27) [Caenorhabditis elegans] gb|AAC17553.2| Hypothetical prote
NSDAFAFPQNHDVFWQSAVAVQADVALTLVGLRTEMVARGWKSPCGWAELLREREAETEAKNAKRMAQRPADGHMNPLVLLDAMNKVLPKDAILVADGGDFVGSAAYIVRPGGPLQWLDPGAFGTLGVGAGFALGAKAVYPQRPVVIIYGDGSSAYSLMDFDTFVRHKLPVIGIIGNDACWTQIAREQVPVFKTAVACDLDDTHYEQ

SEQ ID NO: 147587 - protein, 1092 aa, Heterodera glycines
  Coding regions on vcDNA: vcDNA=SeqID_74010; Strand=+; Position=1-3279
  Homolog annotation: Hit_ID=NP_491240.1; Match level="QueryCoverage =98%, HitCoverage=82%, E-value=0.0, Identity=39%"; Hit description=zn- finger, CCHC type and RNA-directed DNA polymerase  and Integrase, catalytic domain containing protein fa
MALKSINSASLIKIKVLLNGRIVKFILDSGAEINVIDEETYRLIGQPKIWECAERGRMFDGTEKSFIGKGEGHFEFQGVKFKENFYVAEKGLMNLLSVQTMDAFGLLDGIKAKINSPINLCSAGEELRGKTHAPIKSNKVAGKRNKDAEKEINQLKQEYTNVFKTELGLCKKVKAHLELNANARPIYRKARPVPYNAKEAVDGELDRWEKMGVIGKVEHTEWAAPILVVKKADGSARLCIDYSTGLNNALKDHQHPLPLPEDIFATLNGGQYFSQIDLRDAYLQVELDEASKKLCAIATHRGNYEVKRLPFGIKTAPGIFQSIMDKMLADFDFATAYLDDIIIVSKDQKKHSEHLKKMFSRFQEWGFRVKREKCSFFQDEIKYLGQIIDKNGRRPDPSKITAINEMPEPMDVSSLRSYLGMVNHYQQFIKNMRFVRKPLDDLLKKDAEWNWSDKCKNAFDKIKKILSSKLLLTHYDPQKEIVVAADASDQGIGAVISHKFPDGTMKAIAHASSALTPAEKNYSQIEKEALAIIFAVQKFHKMIYGRKFTLLTDHKPLLAIFGNKKGVRQCSANRLLRWSLILLAYDFNIEYVNTNDFGQADALSRLIAKGKDAEDRVIANTCVDSEVESILIGTIEKLPIKFQNIVESSKSDPNIKKVMKFIRNGWPQNVGNENVEIRIFHQRKEQLSITKDCLMYAERVVIPTQHRAKILQLLHKGHPGMKRMKQLAREYAYWPKMDQEIEQFVENCQPCQNESKAPTKTHLQSWPKTTGPWQRVHIDYAGPFFGKEYLIIVDAYSKYPEVFEMPTKSTISTIEKLRYLFSRHGLPETLVSDNGTQFTSHEFAKFTNINGIKHLFSAPYNPMSNGQAERFVDTFKRTFRKLKGEGAPSKSIVETFLVSYRTTPNDSLEESKSPAEMFLGRKPRTTLDLLKPTPTQPIERNEEMEQRFNRRYGTKIREFAVGDKVFAKHRISQNWKFGEVSKKRGVIYDVDFRDEPSGRFHANQLRPRHTHDETDHLQIFLDAFDIGKQTDRQIANELEAQDEPNQSAQEQGLENDLSQSDNDESVAEEADQQVQPRRYPQRNRRAPQRYSP

SEQ ID NO: 147588 - protein, 20 aa, Heterodera glycines
  Coding regions on vcDNA: vcDNA=SeqID_74011; Strand=-; Position=1-61
YCSSINIYLLIVFLKPSDRT

SEQ ID NO: 147589 - protein, 135 aa, Heterodera glycines
  misc_feature (27)..(27): Xaa can be any naturally occurring amino acid
  misc_feature (31)..(31): Xaa can be any naturally occurring amino acid
  misc_feature (134)..(134): Xaa can be any naturally occurring amino acid
  Coding regions on vcDNA: vcDNA=SeqID_74012; Strand=-; Position=1 -115,1406-1495,1912-1956,2585-2740
  Homolog annotation: Hit_ID=CAE63542.1; Match level="QueryCoverage =54%, HitCoverage=65%, E-value=1e-10, Identity=38%"; Hit description =Hypothetical protein CBG08024 [Caenorhabditis briggsae]
IGRQIPRTNQHSLVTAGLGMNDQSDTXDRDXFYCTIIRCCNLSPSVLANANKFLSDRPQLIDCPRCKVHGFTELKHVIGLFTWVSFLVLLITGLFVLPLFFLWVPFFIDTFKDVEHRCPNCKTHIGTFRRLGKXS

SEQ ID NO: 147590 - protein, 158 aa, Heterodera glycines
  Coding regions on vcDNA: vcDNA=SeqID_74013; Strand=+; Position=1 -128,509-620,1475-1711
MLHSEWTLSMVVNRPEILKWPGLDPALGKWTEGTPFFRHYRFRCAVKASEKEVEKAVDECYMEHNVVNVQHKRCECMGNNGPDLYGQKNPKYGRNGAVTKDPQTKDPQTKDPQTRDPQIQRTHGQRTHKDRGPTDKGPTDKGPTKTEDPRTKDPQNNN

SEQ ID NO: 147591 - protein, 117 aa, Heterodera glycines
  Coding regions on vcDNA: vcDNA=SeqID_74014; Strand=-; Position=1-354
MNCTATAKTIGMRAGVEVQLGKPHNHDPSPTRCEAAKINRSVRNTALSSRGNMPRTVVNECLAGASNEVIASLPLIPSMEKAVSRVRHAAGVNFKYQNTRRYRDTSGTIYFRPNLFL

SEQ ID NO: 147592 - protein, 162 aa, Heterodera glycines
  Coding regions on vcDNA: vcDNA=SeqID_74015; Strand=+; Position=1 -124,180-544
MAKRTLLRKRQTKNARHTHENKREERRTKMAKATKARLAKKTASQSNPNAEMPQQDEAGPSTSAASAEEAMEPPPPTPGPVPTPEMDEEILEFDDPPPSTPATPIGDLVPFPSTPTAPMERGTASGKSSSTPIKWRPFSRRNGAKKFAKRWHIWGKSKFSPK

SEQ ID NO: 147593 - protein, 113 aa, Heterodera glycines
  Coding regions on vcDNA: vcDNA=SeqID_74016; Strand=-; Position=1 -162,466-645
  Homolog annotation: Hit_ID=AAQ93010.1; Match level="QueryCoverage =81%, HitCoverage=24%, E-value=3e-14, Identity=31%"; Hit description =cytochrome P450 CYP4C39 [Carcinus maenas]
MACHPDFQDKLRAEIADHFGVATQGETELELTASDVNKLPYLDRCLRETMRMFPVWPRHWEFDPDNFLPERMAKRSPYDYLPFSAGPRNCLGVEQGRKRKILAHVKVLNLLLQ

SEQ ID NO: 147594 - protein, 107 aa, Heterodera glycines
  Coding regions on vcDNA: vcDNA=SeqID_74017; Strand=-; Position=1 -87,1538-1727,2077-2123
MKKGPDYKFFHHLLGNGVLVSDGDHWLRQVVEDRIRINEANGGIRKDGLMHSEGSLYKGKIMAFLDFLLTLREERKLNTEQVREQVDAFMFGGHDTIAHGMMWSVYT

SEQ ID NO: 147595 - protein, 149 aa, Heterodera glycines
  Coding regions on vcDNA: vcDNA=SeqID_74018; Strand=+; Position=1 -94,566-786,1042-1176
KFHSQAVDRKSAIFSYLHNVSAIFFTSFSSTGPWSRTCASARKRGPKSGRTSLTCRCGNWAKSLAICGITFRRPKKRCTTTSMSRTKSPFLILLFSDLYKKRDRTIEYEKAMKQYNAAYSQYMASKSRVKSAHQQHQQVEFWWKGKTGR

SEQ ID NO: 147596 - protein, 22 aa, Heterodera glycines
  Coding regions on vcDNA: vcDNA=SeqID_74019; Strand=+; Position=1 -18,345-394
MFKKLIEMLKKVCAERPRVDQQ

SEQ ID NO: 147597 - protein, 103 aa, Heterodera glycines
  Coding regions on vcDNA: vcDNA=SeqID_74020; Strand=-; Position=1-312
MWYHKRIGASNPNAEPAVQLPVAGPRNTVEEPICGADGQGSQHTRMLLPPGGFNAVPFAGAQDTVGDRERTRWRLLSCSVINRNDDQAQRAKNSTHYEMAFVN

SEQ ID NO: 147598 - protein, 1190 aa, Heterodera glycines
  Coding regions on vcDNA: vcDNA=SeqID_74021; Strand=+; Position=1 -260,311-515,561-2528,2967-3196,3245-3856,3915-4212
  Homolog annotation: Hit_ID=NP_507780.1; Match level="QueryCoverage =89%, HitCoverage=68%, E-value=2e-41, Identity=25%"; Hit description =predicted CDS, DNA polymerase type B, organellar and viral family member (5T899) [Caenorhabditis elegans]
MRDCETRVAGGGGKAAFNLFASRQDQHGPAAAQLLTRAGIDVNRDLYTLDDVQHLQQWINIEHGVGQIRLVVFEKEQEYRIVFKGEGLAAKFNLCLVLERSHFNYIGRVEQLFDVPNYCIDCERRADARYHASGCKVVCRLCLRYGPGYPCQTEQLPNGGSTARKCGDCLFIFPNDGCYNYHLANYAPAPMDGRGQRQRQPICQWRRVCRACWCIAYEGKHQCPRDQAADDDGNCRRCNGPHSVDEPCYIQPVDADSVRQRASIAVDNDDSNDDDDDEDELPLRLCFFDAETSQDRPLQLNNRTAKKHVPLLIVAEVICERCLQAGIGVNDGLGRRAPGCVCMTGLVRGQLLRQWSSPPFVNAAGDNSPAPFGAPAFNQRRFFFHSFDNEGADPVDQFLDFLLHHGPKKAHTVCIAHNGGKYDFHLVLEALHRRNHPPKHLCTTGLKIYSMRLCGRHQRRVTFKDSINYFFCALDALVKSFEVPDHLATVKPFFPYLYIRRQHLLQRLIGLPAQEFYSPGTMKSDKRAQFLQWHANNNNNPGSRFQLREQLVMYCVNDVAILRESVIRFRQLIADNTQGLDPFLHASTAAGLALATFRRCFLPANRLVHSPEGGYLRGRRASAESQRYIRFFELEHPEAQVQCASWSVGEAHIEDSGYRVDGLWRREAPLRPLAIEWLGCYFHGNFAVCLFFLFKSTKLGCPVCFPDRQQQLAAGRTAEDLYERTERRLFELEHDHGCEIHKVWACQWMERLRHDPDLKRRYDAVFVPFPLDPRNDALRGGRTEPFKLHHVCSDDEEIVCIDIVSLYPYVMVWDYDEWDGTLFSSYVNTFVGLKVQATGWPEACETDEQRQAFMDEFERTEGIRLDSTKMEFNPGLRLIAKTLANSLWGKLAQRVGQTEIRYTRTPAEFFALLDDPTVDKLDFVHVSEHMDRCVVRKRPEFARAPPTNCLPVAAFVTSYGRLHLYDYMEQVLAIDGAELLYCGTFVCHIFRGQAHLLDTDSIYYVNKMGGPCVAEGEALGQMKREHIDRRIVEFVAGGPKNYGIRHTARDGTDERANLKIRSFRLSYAAQQLLNFDAMKELTLSTYNIDGQIDDALDNEDLYVYGGGEHRAIRVNFPQIDRNVYADLYTHEAHKDYRPFYAKGRVRPGMQTRPFGYVEDEGPPNDGQRTQRRKRNFVDQDPTQPGHSGWF

SEQ ID NO: 147599 - protein, 198 aa, Heterodera glycines
  Coding regions on vcDNA: vcDNA=SeqID_74022; Strand=-; Position=1 -161,795-1230
  Homolog annotation: Hit_ID=P26355; Match level="QueryCoverage=71%, HitCoverage=68%, E-value=2e-11, Identity=33%"; Hit description=TATA -box binding protein (TATA-box factor) (TATA binding factor) (TATA sequence-binding protein) (TBP) (Transc
MDLILATDWINNAYPEMDLEDANKVNKEPTKKQEEEAEDPSWISLIDEEMKREPRFHAIIMRIRTIAGKTVAALVFQSARVVLTGVPHPSSASKMAARVLRRIQHTQSITLDIHQLRVVNIVGVQTYPQRISVERLQNTLGGIYYPTIFPALRCKLLNGVTCLVYISGKVIVTGAKSLDIVHQSFTNLSNIVPEYFRK

SEQ ID NO: 147600 - protein, 80 aa, Heterodera glycines
  Coding regions on vcDNA: vcDNA=SeqID_74023; Strand=-; Position=1 -127,193-308
MDLEDANKEKKELTKKQEEEADDPSWISLIDEEMKREPLAPIGTPKSVVALNAVAPSRSWTISASGSNAVPMNCMCFSKA

SEQ ID NO: 147601 - protein, 302 aa, Heterodera glycines
  Coding regions on vcDNA: vcDNA=SeqID_74024; Strand=+; Position=1 -195,378-1091
MKGSQIITINKCFLETLCNAKKAKALIRGASDEQLLCLVEICLNILKGRVPLRPRHLNKLKAHAQHTKRYLLVPEEIYHSLASPPPSDGTPIGLVRTRIKQIKNDDAINEAERAVKYEQEVKRLNKLTKDEDERPVGVKLENLSDVVDAMPKPVNVTRPIVVSTRRHLKVGRARKENVEQLEDTDDDDYQNPRSSSSNKRQPTQTEILKLIYKNAQSLGVSEEGQVLRAGGRPFITSSVDDIVSHLLNKDKRGQNKEPTAFKEFVERARQNPLLSRHLFPEGQSGKGIYKNTPLKFKPSLWI

SEQ ID NO: 147602 - protein, 127 aa, Heterodera glycines
  Coding regions on vcDNA: vcDNA=SeqID_74025; Strand=-; Position=1 -161,617-838
MAAKKAKGETVAVTANAIVNSGGTTTTALTSAETAVEEQSITASTSSAGRQQQSFQRSGTDGDASCRFGHLRLRRLLSEAFSVEERQRHKAFVGQFSSIGSLGARPEAWLCDEFLTSLSGGRSMISG

SEQ ID NO: 147603 - protein, 154 aa, Heterodera glycines
  Coding regions on vcDNA: vcDNA=SeqID_74026; Strand=+; Position=1 -229,429-574,644-733
MNVDHLQRTSRRKLADEIAAVIKRDRSRSASRASLERISREVRHKFAHYTPQKKQQLPRQNKSVDPEDALLILGLVGDEALHSVWRRLEQLWKCMPDADQILQQLEHHFVNNWLLDSGKIDELKQRQSDQREEHDEFDQPEEETDELSLINVID

SEQ ID NO: 147604 - protein, 48 aa, Heterodera glycines
  Coding regions on vcDNA: vcDNA=SeqID_74027; Strand=-; Position=1 -12,92-226
MGVLHVFICISGQVAKPFYFHYLSRWFNSLMEQKIFYIFFTIILIEFN

SEQ ID NO: 147605 - protein, 36 aa, Heterodera glycines
  Coding regions on vcDNA: vcDNA=SeqID_74028; Strand=+; Position=1-135
MTRKDFRFPTFLGSEFRLPKFLMKSRKFFKFFFSKN

SEQ ID NO: 147606 - protein, 86 aa, Heterodera glycines
  Coding regions on vcDNA: vcDNA=SeqID_74029; Strand=-; Position=1 -142,396-514
MHQILPTEPIFLPTDGFAGQPPTVRLECLLSFTLMAPVRSLAVVQLKSEIALKMKMVIDDETFKSQCHIRDQRTGANSFFHFLNVS

SEQ ID NO: 147607 - protein, 33 aa, Heterodera glycines
  Coding regions on vcDNA: vcDNA=SeqID_74030; Strand=+; Position=1 -94,410-417
MKQYFKTKGKNPEISDKRIAIELKIGAYTLIDN

SEQ ID NO: 147608 - protein, 196 aa, Heterodera glycines
  Coding regions on vcDNA: vcDNA=SeqID_74031; Strand=-; Position=1 -133,233-354,407-448,534-824
  Homolog annotation: Hit_ID=AAR25653.1; Match level="QueryCoverage =98%, HitCoverage=27%, E-value=4e-80, Identity=52%"; Hit description =Calcium channel, alpha subunit protein 1, isoform e [Caenorhabditis elegans] gb|AAP84337.1| T-type voltage
MAKGIRSLLDTVGEALPQVGNLGSLFFLLFFIFAALGVELFGRLECSEEHPCDGLGEHAHFKNFGMAFLTLFRIATGDNWNGIMKDALRDDCDPSDNCERNCCVDPILAPCFFVVFVLISQFVLVNVVVAVLMKHLEESNKRDEATDAKAAEEEKAARVARETDAETEELLEEEAEIEAEEALEEADEQQLGEELL

SEQ ID NO: 147609 - protein, 351 aa, Heterodera glycines
  Coding regions on vcDNA: vcDNA=SeqID_74032; Strand=-; Position=1 -900,1633-1788
  Homolog annotation: Hit_ID=NP_608540.1; Match level="QueryCoverage =76%, HitCoverage=64%, E-value=3e-25, Identity=33%"; Hit description =CG2839-PA [Drosophila melanogaster] gb|AAF51469.2| CG2839-PA [Drosophila melanogaster]
MTFGNYVLFNLLVAILVEGFQESKEEEKRQLEEEAQRRAEEEERERKTELEVLIAETTSPEFLDKRKECSCGQNNLHAVREQLMVRGEQTKRTAEEEEEKGRRKKPSEERRDRERTEDEDERRMKPSEERRYRGKVTEEEDEGEERRNWGKGTEEEDEGEERRNWGKGTEEEDERRMEPPEERRDRGKWTEEEEEKRKTTKGEKRKRMEEEEEGGRRMKPTEERWKRERTEEEEERKDMGIKYTKNSERIRTILKKREESSKEPCSSISFHPHSADEKNKNNRRSAPPQCSAAEAFLSSQVASVSPQIIPLFPRGVFAVSFAPGQFPQGAVPPTDWAQVVRLRHSLLHVCH

SEQ ID NO: 147610 - protein, 148 aa, Heterodera glycines
  misc_feature (139)..(139): Xaa can be any naturally occurring amino acid
  Coding regions on vcDNA: vcDNA=SeqID_74033; Strand=-; Position=1 -87,141-279,718-891
  Homolog annotation: Hit_ID=AAM51535.1; Match level="QueryCoverage =85%, HitCoverage=9%, E-value=3e-23, Identity=47%"; Hit description =Calcium channel, alpha subunit protein 1, isoform b [Caenorhabditis elegans]
SHSLADQSLTPSFQNANPFFSLQNANLFLFSILGMNLFGCKFCKFSILGMNLFGCKFCKIEENWRGESVKRCERKNFDSLLWALTTVFQVRTQNEVNAELLLQAKNVPSYGHCERANFDSFLTAFLTVFQVINQLNDSXHAFNTFAFI

SEQ ID NO: 147611 - protein, 172 aa, Heterodera glycines
  Coding regions on vcDNA: vcDNA=SeqID_74034; Strand=-; Position=1 -104,145-264,312-606
MENSNQEIKTKRNKQKLEHEGALYVLHQLSDGPQRILIFARSSISEWTGVMKNVYADGTLFGAAFFSQIYILLAKLLLVHIQLSSASLTQFDVSKSQLMRTSHDASLELPPANAPKYRAADARILRLLQGYNAINNNPAHQNDHNYHANVNVNPDNINHLLVGVSRNYEMRP

SEQ ID NO: 147612 - protein, 94 aa, Heterodera glycines
  Coding regions on vcDNA: vcDNA=SeqID_74035; Strand=+; Position=1-285
MTLSEKRPQQAPRQFPPQMALFRSDSLRNYTVLCQLCHGKTKPRQEESKERTSDRYYQPMQTALSAEAGIANGFERFFNGQPPLRKKRGEDEDK

SEQ ID NO: 147613 - protein, 134 aa, Heterodera glycines
  Coding regions on vcDNA: vcDNA=SeqID_74036; Strand=-; Position=1 -102,506-808
MDETHCQQQLTDQTSRSRCASSEEGADLLILETMDRHYQLRKLSPRDTLCMAFLLSINWDRHLTIFFDLNGETQQRGGTDMAETIGEELAKMVEGQRKVDKEEEERESHKERAKRPEDTNGGNSVNCKMEVTDE

SEQ ID NO: 147614 - protein, 44 aa, Heterodera glycines
  Coding regions on vcDNA: vcDNA=SeqID_74037; Strand=+; Position=1 -60,408-482
MRTYCKGFAPDITWAVENITKNHLLYSSPNLTHPGAMCFQFFEI

SEQ ID NO: 147615 - protein, 101 aa, Heterodera glycines
  Coding regions on vcDNA: vcDNA=SeqID_74038; Strand=-; Position=1-6,47- 346
MKKKPEDAHFLLLPPSDFGVGKHDNESAKKNKMDKERMDNRAKTFAKEQKPKNTKKRANEWNAEKANKATNKLMRKMAEEKTKMANAMLYPTKGKKDAMYR

SEQ ID NO: 147616 - protein, 148 aa, Heterodera glycines
  Coding regions on vcDNA: vcDNA=SeqID_74039; Strand=-; Position=1 -85,647-1008
MKNEMSKFFGENIVNFANAIKINFAAPYENFDLLHSLSEYSPTVYEVIKMAKILGNIENDGQILVLRSDSQIFHFILKYLANSTAEESANQTKFAIKYSFCFLAQFVEELLKKAMKVNELKELLNIELIGEAIESFVEKKEQKCANKK

SEQ ID NO: 147617 - protein, 190 aa, Heterodera glycines
  Coding regions on vcDNA: vcDNA=SeqID_74040; Strand=-; Position=1 -106,792-875,1124-1506
MGSYETYLEPREMLTKAVAAAGIEPEAFVTLKHGEIILKNPDFQVQSWKKVQLKFSKHKSRNPMNFIFLVLLSEYSPTFDELIKMANFFANIDDDGHILGIASDFKTLEIVMKFLKKPYYFNSNPKVPDQHLPCIMAYFVEEFLKKAMAENHYLVFFGIESNGMVIENFAEKKERMCGDKRCNLFSYHFH

SEQ ID NO: 147618 - protein, 213 aa, Heterodera glycines
  Coding regions on vcDNA: vcDNA=SeqID_74041; Strand=+; Position=1 -10,105-374,510-820,1044-1094
METRITEEWQEIAFTPQGVTPPIAPLLDDYFIISDKDIIYAGKEVRTQLKCNDQNSAQNFECILGTDACKECWLNRTKSEEELVQCECEDSTFEIECNLCKAKQVAPLKGCYECTTGGRLNYTCSTNWGENIAEIKCPGNLIFLAKCNKNGETQIDVLPFTKSKINMDCEVICPGGKTSLKIKGELMYIPVNERKYQSFQFPLSAEGCMASRA

SEQ ID NO: 147619 - protein, 411 aa, Heterodera glycines
  Coding regions on vcDNA: vcDNA=SeqID_74042; Strand=+; Position=1-1236
MNGHYYPLGGLVFQGYQDELNYFEDFFKLEMDKSDMEIMPQMGLGNEEVTEGENRITIHLDNNSSREWVLEFKNMGENGLKIIGKGKFKAVLNFVCLAICTLALLNGVHGMDRQPNGQKVPSESADDFEDFEMQQWQSELRDLQQIETAESTSGLNTVATNTGTNNQEVSLATDTVMVVPISEPSHQVRDIIENPVVDTNVQCVVEKMGTTRQLSIPTNLDLLNWAQIHRFLPPPNIMLKAQQVSPNVPLDQRPSTSANNIGNPNVSASCAPSCSSIQCGKYGKAIRNWDGRVARPVQTDLCRRERSAPYFRPRPILAAPHQQPRMVANPPFPVESIPPIHVPSGIRREFLRRMSQETDHFFGLAQLVGEWNPTLATLFLALETFCRAILQLCVTEGGDHPVFSRPECRRR

SEQ ID NO: 147620 - protein, 130 aa, Heterodera glycines
  Coding regions on vcDNA: vcDNA=SeqID_74043; Strand=-; Position=1-393
MVDQSNKAKERPSLLEEPFIIDITAIESKCAKPKMAGKGRNDFNIDYRIADGATYELLNNDNLCLFRSFEMLRMKFILAQQRFSEYKRDERKQLEGVHALCRGCNIDINLPFYSIEEYGESIQANNLFIN

SEQ ID NO: 147621 - protein, 102 aa, Heterodera glycines
  Coding regions on vcDNA: vcDNA=SeqID_74044; Strand=-; Position=1 -132,192-368
MSQYSDNSLPPTLDGPYSPVGDDGTELMDEAPPLDEVMKRLPISVVPSDNNERKAQKEPSITRELEAELFNGDGFTCLSAAQAEAGRFKGVVVNNTSYKIII

SEQ ID NO: 147622 - protein, 67 aa, Heterodera glycines
  Coding regions on vcDNA: vcDNA=SeqID_74045; Strand=-; Position=1 -77,272-398
MVIRRGTKVIRRGTNLMKRYKCDLKRLVKNIENNVKSHRKIIYTGRIRTYRPHPTEDDSESPITQGF

SEQ ID NO: 147623 - protein, 47 aa, Heterodera glycines
  Coding regions on vcDNA: vcDNA=SeqID_74046; Strand=+; Position=1 -87,255-311
MKLGLHWHATSMPSASMGGPICLPLLTDGNSIIFEIVPVPTYPWSKN

SEQ ID NO: 147624 - protein, 538 aa, Heterodera glycines
  Coding regions on vcDNA: vcDNA=SeqID_74047; Strand=+; Position=1 -27,2631-3293,3921-4853
  Homolog annotation: Hit_ID=NP_500013.1; Match level="QueryCoverage =99%, HitCoverage=37%, E-value=1e-117, Identity=42%"; Hit description= predicted CDS, polyprotein family member (4B673) [Caenorhabditis elegans] gb|AAC02594.1| Hypothetical pr
NKPKKRNKSVKRIIGMASFYRRHIPNFSTIVEPLTRLTRKNMTFLWEDEQKAAFSKIKEILSQEPSLSFPNYSKPFHIFTDASIVGQAGILMQKNEFGTFSAISYCSRTLSASERKWPPVQIELGAIIYSLREFKPYIFMSDVELHTDHKPLAYLLKKAEAHPNLARWLIELQSYQIKIVHISGKQNSLADALSRAQENITVKEVQDLDELEDIAEFPICLNLSIDQRLLSNCYLKFGGCTELVSDDATAFTSEFFREFCSLLYINKKYAVPHWSQGNAATERTFRTFNNILSKYVTKEQPDFDEFLDYANFCYNTSVHSTTHETPYFLMFGRDPIFCIDQIIDPRIREPIAFTDETEFKQKLVTSLRRAWKITAELHAEAQEKMKIQYDKTMRTPNLKIGDRVLLRNYDGKRNTSKKFHFPWKGAFRIIEIEGIYATITSCNSPQANPRRVHINQLKKCYENLGGPACTSPRLSSEERNSLAELEADEIHNLPGHSHPTDIPKHSFSLIVILMMKYANEPNIDNNEVKTSLTPQNMV

SEQ ID NO: 147625 - protein, 26 aa, Heterodera glycines
  Coding regions on vcDNA: vcDNA=SeqID_74048; Strand=-; Position=1 -33,128-175
MLINKLSRIDLKQLNFLLCLMNIIFN

SEQ ID NO: 147626 - protein, 144 aa, Heterodera glycines
  Coding regions on vcDNA: vcDNA=SeqID_74049; Strand=-; Position=1-435
EDREATTKILDHLEVKAEPTAVFLLGRYDPQRTTPRPLKVVMPTPTHQHMALGGWKRERARLRSQQNLARLFVRPALIKEQLMKKFEERLRKRQKTPASLAFATEISKTANDQVPVVAKGPNQKEASEDISKPPGVFDQTIRML

SEQ ID NO: 147627 - protein, 40 aa, Heterodera glycines
  Coding regions on vcDNA: vcDNA=SeqID_74050; Strand=-; Position=1 -74,253-301
MTHTTIGGPRGLKVILITEPISMANDERFSDEKFSDERFS

SEQ ID NO: 147628 - protein, 70 aa, Heterodera glycines
  Coding regions on vcDNA: vcDNA=SeqID_74051; Strand=+; Position=1-210
MQENNSSSDEEGQLLSSSSGNEEAANQELIQFIEFKSKRGASLLARNGFEYQFERNSALVDNVEYWKCVK

SEQ ID NO: 147629 - protein, 116 aa, Heterodera glycines
  Coding regions on vcDNA: vcDNA=SeqID_74052; Strand=+; Position=1 -71,134-267,421-565
  Homolog annotation: Hit_ID=AAH82574.1; Match level="QueryCoverage =99%, HitCoverage=26%, E-value=3e-24, Identity=46%"; Hit description =Unknown (protein for MGC:105188) [Mus musculus]
PIVLCFIGIDGAGKTTIVKALQGEDFGTVHSTVGFSRAELRVKKYRITVYDLGGSARIREIWPIYFAEVFGVVFVLDASAASRISENKKMVDSLVGLPDLLGKPILFLLNKKDLSG

SEQ ID NO: 147630 - protein, 117 aa, Heterodera glycines
  Coding regions on vcDNA: vcDNA=SeqID_74053; Strand=+; Position=1-354
MENGEKQEREEGARESRGRGGTTEESGKENREIGTAEGSGRKSRGGGTAPEESTRKTKGGERRGGRERTAEESGREAQAVQQGTVEIEMRPTPRAESSRGGSTHGRNAIDVMTTVGS

SEQ ID NO: 147631 - protein, 75 aa, Heterodera glycines
  Coding regions on vcDNA: vcDNA=SeqID_74054; Strand=-; Position=1-642
WGQCHSMPPPHLKPSLYKWRLSLAIDRRFVLHSLREQNVAAEEHKYPFIRIIEWINNKRKYLGKGRIFLKKSVKI

SEQ ID NO: 147632 - protein, 314 aa, Heterodera glycines
  Coding regions on vcDNA: vcDNA=SeqID_74055; Strand=-; Position=1 -783,886-1046
  Homolog annotation: Hit_ID=XP_345960.1; Match level="QueryCoverage =82%, HitCoverage=98%, E-value=2e-25, Identity=32%"; Hit description =similar to hypothetical protein [Rattus norvegicus]
MDARKMGAKESGVKEAESREADAKEADVKEAESREADAKEADVREADAKEAKMDAREMGAKESGVKEADVREADAMEADYKEANSMEANIKEAAESREADAREADSKEAGAKEADAKEAGAREARVDVKEAGAREARVDGKEAQVGAKEVGAREAQVGAKEAQVGAKEAQVGAKEVGAREAQVGAKEVGAKEAQVGAKEVGAREAQVGAKEADAKEVGAREAQVGAKEVGAREAQVGAKEAQVGAKEAQVGAKEVGAREAQGVFPPLPSPPNGNRGGQPVIFLANRKKLTFIQPCQGDLCGSALQTPPPPLPSE

SEQ ID NO: 147633 - protein, 54 aa, Heterodera glycines
  Coding regions on vcDNA: vcDNA=SeqID_74056; Strand=-; Position=1 -47,336-450
  Homolog annotation: Hit_ID=NP_490930.1; Match level="QueryCoverage =98%, HitCoverage=15%, E-value=1e-12, Identity=58%"; Hit description =eukaryotic translation initiation factor 2 (1C643) [Caenorhabditis elegans] gb|AAK27873.2| Hypothetical p
MKKKAGSYEVFTKAVNDPSVFDECEIEAKVRAKLVEEIQKKLTPKALKIRADIE

SEQ ID NO: 147634 - protein, 55 aa, Heterodera glycines
  Coding regions on vcDNA: vcDNA=SeqID_74057; Strand=+; Position=1 -60,1342-1449
MAEFAHRAGAPLECLCMALKTMITHDRAVKYLKKEPVLDLLVTRATAKPSTEVQM

SEQ ID NO: 147635 - protein, 25 aa, Heterodera glycines
  Coding regions on vcDNA: vcDNA=SeqID_74058; Strand=-; Position=1 -63,203-217
MCKQNEDLYFSCHKFNIFPPKKWVK

SEQ ID NO: 147636 - protein, 297 aa, Heterodera glycines
  Coding regions on vcDNA: vcDNA=SeqID_74059; Strand=+; Position=1-894
  Homolog annotation: Hit_ID=PIHUB6; Match level="QueryCoverage=91%, HitCoverage=94%, E-value=1e-26, Identity=32%"; Hit description =salivary proline-rich phosphoprotein precursor PRB1 (large allele) [validated] - human sp|P04280|PRP1_HUMAN Ba
MGKIIVCTIFCGVLAATVIGLKPRGPPYHKGQERFGPPPNGQHSPGKFGPPPPNSSDLPSPESSSDASARKKRIPFGFRPHGLPPNGQHSPGKFGPPPPNSSDLPPPESSSDASARKKRSPFGFRPHGLPPNGQHSPGKFGPPPPNSSDLPSPESSSDASARKKRIPFGFRPHGLPPNGQHSPGKFGPPPPNSSDLPSPESSSDASARKKRIPFGFRPHGLPPNGQHSPGKFGPPPPNSSDLPPPESSSDASARKKRSPFGFRPHGLPPNGQHGLGKFGPAPCNSSDLPPLSSTDSE

SEQ ID NO: 147637 - protein, 26 aa, Heterodera glycines
  Coding regions on vcDNA: vcDNA=SeqID_74060; Strand=+; Position=1-80
MKASFGRWADRMKECFGDGTFSLAPP

SEQ ID NO: 147638 - protein, 191 aa, Heterodera glycines
  Coding regions on vcDNA: vcDNA=SeqID_74061; Strand=+; Position=1 -147,280-409,567-865
MYELAMRLRREIQSRAMLQRRSAALSVAYQTMQIDMDEPNICYEPTEYEDDQLLLAADGIERFAGDGAGEDGADRMAVTDFEMVDMQAEEQQIAAAAAAAAAARPLRTRVVITKEDVAQQLLQAEARLALLDADAHMVPPLVDEDILRESLNHKRFDMAWLLIKLDLRITNNFDNFKSVKKTIFSSSGNSS

SEQ ID NO: 147639 - protein, 76 aa, Heterodera glycines
  Coding regions on vcDNA: vcDNA=SeqID_74062; Strand=-; Position=1 -111,1095-1214
MKENNEWQNGHAHFDKPTESECHFAPGHRVQHTARDTNFCGTETGPVPNSQVFRKRFCYRNAGLSLEPMCRKPTAN

SEQ ID NO: 147640 - protein, 60 aa, Heterodera glycines
  Coding regions on vcDNA: vcDNA=SeqID_74063; Strand=+; Position=1 -48,1145-1276
MITAGKRINLEDLCDPRFVDTELAKQRRESPFAYTYRIACRMLNTVPWCEMALTFRWLIK

SEQ ID NO: 147641 - protein, 33 aa, Heterodera glycines
  Coding regions on vcDNA: vcDNA=SeqID_74064; Strand=-; Position=1 -36,176-241
MSKNGERKLILLEGMEDYEEKKKIEEKMKFIFI

SEQ ID NO: 147642 - protein, 162 aa, Heterodera glycines
  Coding regions on vcDNA: vcDNA=SeqID_74065; Strand=+; Position=1 -63,165-261,331-376,568-664,928-1017,1239-1310,1357-1379
  Homolog annotation: Hit_ID=AAK54043.1; Match level="QueryCoverage =100%, HitCoverage=47%, E-value=5e-59, Identity=65%"; Hit description= G protein alpha subunit 3 [Strongyloides stercoralis]
MATLLHGMQRLNIPFHNPRIENEAMIIMEVVNHGKESEPLSDELAHAIKTLWADRNIREKVYPRGQEFHFLESVDRIAKPDYRPTEQDILLSRIKTTGIIEVKFKMKTVDFRVFDVGGQRSERKKWIHCFEDVNAIIFITAISEFDQVLFEDETTNRMVESM

SEQ ID NO: 147643 - protein, 100 aa, Heterodera glycines
  Coding regions on vcDNA: vcDNA=SeqID_74066; Strand=-; Position=1 -100,272-472
MTDSKNDEFNAKGQMVCPPMLNFCLKMSCASAVDSGHVKGCANMDMCAGRGDPHFEVARRDPRCKFDCCTGNLCNGALGTHPSLGSGGAVLVPLVIAILA

SEQ ID NO: 147644 - protein, 75 aa, Heterodera glycines
  Coding regions on vcDNA: vcDNA=SeqID_74067; Strand=+; Position=1-375
LISSQKSCQLKTAKKAEFSKFFISTFFYSSKFSVIFSRLIEPVKSFRMISRLFDLVNNFKSYIDSKLAQTELARS

SEQ ID NO: 147645 - protein, 32 aa, Heterodera glycines
  Coding regions on vcDNA: vcDNA=SeqID_74068; Strand=+; Position=1-98
MTALNKMAAAYNTSVLPPPPLNTMCMNMRVCD

SEQ ID NO: 147646 - protein, 23 aa, Heterodera glycines
  Coding regions on vcDNA: vcDNA=SeqID_74069; Strand=-; Position=1 -52,310-329
MVFLIEKIFVKICFIFQGIAILH

SEQ ID NO: 147647 - protein, 75 aa, Heterodera glycines
  Coding regions on vcDNA: vcDNA=SeqID_74070; Strand=-; Position=1 -61,373-539
MAPSSLFPMVSLAFIVSMANALECWHGVHNVTAKTSNIPIKSEAEQGKCPDQLNNCAKIDCKYKGQRSFLYEKDH

SEQ ID NO: 147648 - protein, 93 aa, Heterodera glycines
  Coding regions on vcDNA: vcDNA=SeqID_74071; Strand=-; Position=1 -103,252-347,424-506
MLPIHGLVSSLYSVFGVVFCSNASLNYFIGSCGAALFAAESSANLFLALDRLVETFSPKYNQILFSVLNFYGKKNMNSDYLKTDRDAWCLLDR

SEQ ID NO: 147649 - protein, 149 aa, Heterodera glycines
  Coding regions on vcDNA: vcDNA=SeqID_74072; Strand=-; Position=1 -424,1239-1264
  Homolog annotation: Hit_ID=CAA29284.1; Match level="QueryCoverage =93%, HitCoverage=83%, E-value=4e-14, Identity=38%"; Hit description =mature eggshell protein [Schistosoma mansoni] sp|P06649|EGG1_SCHMA Eggshell protein precursor (Chorion pro
DYGGECDGGRGQFGYAGGCDGGRGQFDYGGGCDTERVQFDYGGGCDRGHGQFDYGGGCDGGRRQFDYGGGCDRERRQFDYDGACDRGHGQFDYGGGCDRGRGQFGYGGGCDGGHGQFDYGGGCDGERGQFDYGGDRKQLSYEHRELRKK

SEQ ID NO: 147650 - protein, 63 aa, Heterodera glycines
  Coding regions on vcDNA: vcDNA=SeqID_74073; Strand=-; Position=1 -84,134-224,467-483
MPKLAIFCYSKSDCAVLAELFNSHMKVNTIGPLFSNSLRGKKEHLMTNLDKKMMEVDNAYQEM

SEQ ID NO: 147651 - protein, 195 aa, Heterodera glycines
  Coding regions on vcDNA: vcDNA=SeqID_74074; Strand=+; Position=1 -106,159-320,365-684
  Homolog annotation: Hit_ID=CAD38523.1; Match level="QueryCoverage =89%, HitCoverage=69%, E-value=4e-67, Identity=66%"; Hit description =secreted glutathione peroxidase [Globodera rostochiensis]
MKNFLTFLAFFLIVPCFKADNEKNKAAPRVFAEHPGPKLVDETTRWSKCQADQNLTIYDFEVETLDGKFTNLEKYKGQIVLLINVATFCAFTQQYLDFNPMLERNRANGVPLTILAFPCNQFHLQEPAENHEILNGVMHVRPGDGWKPHSNLHIHGKLEVNGANAHPLFDFLRDSVLFFDAANKGRSPGVRGISK

SEQ ID NO: 147652 - protein, 47 aa, Heterodera glycines
  Coding regions on vcDNA: vcDNA=SeqID_74075; Strand=-; Position=1-143
KKFGTSYLGTRTHFAENKNTFLKNPWVLYPPTKFHLEIPRTPGDLPL

SEQ ID NO: 147653 - protein, 98 aa, Heterodera glycines
  Coding regions on vcDNA: vcDNA=SeqID_74076; Strand=+; Position=1 -75,470-529,613-696,748-825
  Homolog annotation: Hit_ID=CAD38523.1; Match level="QueryCoverage =82%, HitCoverage=32%, E-value=3e-24, Identity=62%"; Hit description =secreted glutathione peroxidase [Globodera rostochiensis]
MWDSNLRGQKGKAGAQPPHHRTTQTCPQTVPVLGIKESMFYNPITVSDITWNFEKFLIDANGVPRFRFHPTNWSHGKEVQKFIDQLSAEQKKEPVKKA

SEQ ID NO: 147654 - protein, 18 aa, Heterodera glycines
  Coding regions on vcDNA: vcDNA=SeqID_74077; Strand=-; Position=1 -47,78-87
MKMQVNASADELRIAQLT

SEQ ID NO: 147655 - protein, 47 aa, Heterodera glycines
  Coding regions on vcDNA: vcDNA=SeqID_74078; Strand=+; Position=1 -49,736-830
METEEKKQMTWTDNVPDGVGPFRFIGTADSKNLYFFIKLAFLVQNYY

SEQ ID NO: 147656 - protein, 54 aa, Heterodera glycines
  Coding regions on vcDNA: vcDNA=SeqID_74079; Strand=+; Position=1 -91,169-242
MSFCCCGNHQSHKQSVSILNHLKHLRKIFDCTVFFEFENFFGILQINITNIILQ

SEQ ID NO: 147657 - protein, 451 aa, Heterodera glycines
  Coding regions on vcDNA: vcDNA=SeqID_74080; Strand=+; Position=1 -241,332-477,2010-2285,2346-2766,2814-3086
  Homolog annotation: Hit_ID=AAL78214.1; Match level="QueryCoverage =38%, HitCoverage=91%, E-value=5e-18, Identity=30%"; Hit description =putative esophageal gland cell protein Hgg-20 [Heterodera glycines]
QNFHRFEVLVFQSPIVRIMLEILNITVFMVNINYFTITFFKCFLIWHSVTQELSSRKHMYFQISNFAGMISMFIGSYSSYFFAALPYRRLLPTLLVRAKVRRRHLRHSRHGAEHIAQFRPIATFGGGTIFICGDCWLLVFDFLAPSQLGLEIALINRRFNCIVDEHFKTRKWKLGCMRICHKIGENGTKQLQIVNSNAKPLPIPQNPLPNKVIGFRHIQIHYIDQNVIAFLRRFHRRIFDVCSMVLYIHTDNDRILDYFLLNIWPMFRHSMRLMNLNSISLRRLRQLAGPSLLSDCPSLRFVSFNEAILPAFPPDESVNASDGQALAKWLFTPRPDGQFKWFRGFVNSPDQWSPTMEQLKTAFSNASSPITYRISLAFSSTSIDSVVPFDDLINEVTGEKLTLEQNDTNDCWLSRCPIAWDYRKWKNLSDGIFDQMNPIDILISDGGFDDG

SEQ ID NO: 147658 - protein, 78 aa, Heterodera glycines
  Coding regions on vcDNA: vcDNA=SeqID_74081; Strand=+; Position=1 -58,217-395
MVPSISHDPAKLPSSAVAQFYICFVLCVEMLFVSLLATFCFQPSRCAFFDKQRKRNAKDNANGECAEDGYEPLNDDHT

SEQ ID NO: 147659 - protein, 191 aa, Heterodera glycines
  misc_feature (190)..(190): Xaa can be any naturally occurring amino acid
  Coding regions on vcDNA: vcDNA=SeqID_74082; Strand=+; Position=1 -69,704-837,1390-1526,1815-2023,2344-2370
  Homolog annotation: Hit_ID=NP_492377.1; Match level="QueryCoverage =93%, HitCoverage=19%, E-value=7e-39, Identity=42%"; Hit description =SUPpressor SUP-17, metalloendopeptidase ADAM 10 (101.6 kD) (sup-17) [Caenorhabditis elegans] emb|CAB09416
TIRFLDTVKFKIYYLALFEKINGLSKYVDHYETLSYQPVVDRQKRSLETDHEDTQTDVDLHFRSHNRTFHLKLRPLDFTNSLFTDDHIIDVDGVHHTHLIRPNRFLYEGQIVGDSTSFVHGTLLDGIFDGFIFTGDGRTFTVEKAARYFDIGQRPAHFHSFIYADEEINHKRFRRTKREADELGFKLLGXL

SEQ ID NO: 147660 - protein, 34 aa, Heterodera glycines
  Coding regions on vcDNA: vcDNA=SeqID_74083; Strand=+; Position=1-103
MKLLFTPMFFSVILQTILLLLLVQHVNGGRDRVQ

SEQ ID NO: 147661 - protein, 83 aa, Heterodera glycines
  Coding regions on vcDNA: vcDNA=SeqID_74084; Strand=+; Position=1-453
SIYGNFGFRNFLILRIYEHFGPRNSDFYYFISLVFRFLKVLELRFQKFEPRNFLGLGSRFPKIYLNVGLHCLLYCLKNKSLIK

SEQ ID NO: 147662 - protein, 47 aa, Heterodera glycines
  Coding regions on vcDNA: vcDNA=SeqID_74085; Strand=-; Position=1 -125,209-227
MWDTSIMAWATHNALRLTWFCQECNLRNPETFEFSSAGQSRSISKCE

SEQ ID NO: 147663 - protein, 468 aa, Heterodera glycines
  Coding regions on vcDNA: vcDNA=SeqID_74086; Strand=-; Position=1 -151,787-1190,1255-1386,1436-1588,1640-1731,1779-1863,2076-2465
  Homolog annotation: Hit_ID=CAE73337.1; Match level="QueryCoverage =86%, HitCoverage=70%, E-value=9e-25, Identity=23%"; Hit description =Hypothetical protein CBG20766 [Caenorhabditis briggsae]
MEPSSKAAFDAMVQCVIRQYGRFCPLPAQDGTANCVDGILSQRENVADNGVNGDNFLPPPPSLNIPQKESELTPKFREASEYFEKSVDIAQDPCNNFYEYACNAFDEITHFDRISIQNLITLATELRANNVHQQVKRGTDTRKSNGDRHEKVERGQTRESRTGNRHEKANPFGLCANDYDVVKVGIEPIQKAKLAFEKCTFLMHHQNQVIVQADLPREKFFLFQKKSRLDFPVFAGQTMDWPSREELSKALGALSGSVMVDTLISFFVDTNWADPNSEEMPYALFVDQPTLAFDPYYYSPEVFPIVSHQMERIVDEVLTEMANYLGVEYARKDLNAAVQEVIAFERLLANNFLVSDAIRENDLGSRFNLFTVSDAQLRFPFLNWSLFLRELAQNAPQIVQEKLRQPNFRFAIAEPTLLAKLGDDLGPGNKHNLTANQLLNYLYFRMILFYSPYIPQAFTGKNGKRNSN

SEQ ID NO: 147664 - protein, 50 aa, Heterodera glycines
  Coding regions on vcDNA: vcDNA=SeqID_74087; Strand=+; Position=1 -115,420-457
MGSSQRGPSNWRTNESFGGNTSEQLGAERGVTLEERGQSQPKPKIRHPFS

SEQ ID NO: 147665 - protein, 304 aa, Heterodera glycines
  misc_feature (5)..(5): Xaa can be any naturally occurring amino acid
  Coding regions on vcDNA: vcDNA=SeqID_74088; Strand=-; Position=1 -143,208-362,412-517,564-727,813-908,971-1125
  Homolog annotation: Hit_ID=NP_502104.1; Match level="QueryCoverage =98%, HitCoverage=78%, E-value=1e-48, Identity=40%"; Hit description =adenosine kinase (37.4 kD) (4L974) [Caenorhabditis elegans] emb|CAB03230.1| Hypothetical protein R07H5.8
AKSNXTLFFHKRHLREGEILNLDFAIFYPGGSAQHKLAVFQWVLNGADRAIFFGSVGDDSEAEMLLEKTVETGVEAKFQRIEGVRTGKCVSLINATNRSLCACLGAASFSLCACLGAASFFSLDFLHLPENAKLIDTAKFFYSSAHFFTVCPEAIKHLATKANEAHFFTVCPEAIKHLATKANELERPFLFNLSADYIPGKFKKELNEIMPFVDILFGNEMEAFAYAKANELKTDHLHQIALFLTEIKRKKTGGKTGGRIVLITRGEKPLIVAQNGTIKEFPVISVDKVDNGAGDAFCGGSFCA

SEQ ID NO: 147666 - protein, 107 aa, Heterodera glycines
  Coding regions on vcDNA: vcDNA=SeqID_74089; Strand=-; Position=1 -156,235-637
  Homolog annotation: Hit_ID=XP_392633.1; Match level="QueryCoverage =84%, HitCoverage=4%, E-value=5e-10, Identity=35%"; Hit description =similar to mKIAA1112 protein [Apis mellifera]
MQWAKSVHAYLFDQTIVLCRRDVLRRHQLVFKERMALNGVTVQELHDGKEPITGASLRNAFKVSSQARDYVFSCPDAATKGLWLEALRERPRPQPPTPAERRLAMLM

SEQ ID NO: 147667 - protein, 576 aa, Heterodera glycines
  misc_feature (398)..(398): Xaa can be any naturally occurring amino acid
  Coding regions on vcDNA: vcDNA=SeqID_74090; Strand=-; Position=1 -130,183-250,362-433,477-665,706-913,968-1117,1182-1330,1443 -1590,1633-1732,1781-1873,1942-2035
  Homolog annotation: Hit_ID=YP_046862.1; Match level="QueryCoverage =97%, HitCoverage=93%, E-value=1e-139, Identity=48%"; Hit description= putative permease [Acinetobacter sp. ADP1] emb|CAG69040.1| putative permease [Acinetobacter sp. ADP1]
KTNSPPEGANCVPSLDPSLCNDDLKPLQSQHWNTYNIFAVWMTDVHSVAGYLTAGSLFALRVHSVAGYLTAGSLFALRLSGWQVLIALILGILIVHFCCNWVAKPSQVTGVPYPVINRAIFGIRGAVTGVPYPVINRAIFGIRGANVPALLRGSIAIAWYGVQTFLASRALIVVLLKFFPSLVFLHNVFSHGFVGLSPLGWCCFGFMSLAQAHNVFSHGFVGLSPLGWCCFGFMSLAQAVLFWMGMEAIRKFIDWAGPAVYVAMLLLAVYLVANAGVHNLSLNLSGDPLPFVDSLPSMFSADPLPFVDSLPSMFSAVALVVSYFSGPMLNFGDFSRYAKSWKAVKLGNFLGLPINLPINFLFFSLLTVLITSATFPVFGRLITDPIEVVEQIGNRILXLGRTDLQIATVGINIVANFISPAFDFSNLAPNYISWRGGGMITAIASVLLTPWNWYNNPAAIHFALGIYNNPAAIHFALGILGALIGPLHGILVSGYFIVRKQKVKQKVWVPDLYSRDVDGRYWFSNGFNPNALGALLLQVILPKISLLLQVILPKISTAFGSLHLFSWFVGCFFGFG

SEQ ID NO: 147668 - protein, 42 aa, Heterodera glycines
  Coding regions on vcDNA: vcDNA=SeqID_74091; Strand=-; Position=1-126
REFPGAEMGRRRRESRRPRHVQQKQKVGRRCGGGGRRSRALP

SEQ ID NO: 147669 - protein, 280 aa, Heterodera glycines
  Coding regions on vcDNA: vcDNA=SeqID_74092; Strand=+; Position=1 -111,157-569,647-962
MELSYLEAIQNGVCRADLIAEAQNIWSQMLSADELLVKVDPGAFLRLSSSLFHSALGLDYPLTNSLEANIVVCLKKCSNEMGSQNGCDSLYCASVGVLLRMSGQSVIKLNFRNSPRIVPNILGMAFLVIWRIVRAPKMRWLKHSALNLVVQLFDLLSAHLATFCQILPGDVCRAIDNLEILLKQLTKNSAIRCGECCEKVFRSLYDLPMPSPSFNLEEIWSIETKISGKKETQAQKIGWHLGWSLLLSFGTDESQLSWASLLSLSDECLANSLVGVSNAK

SEQ ID NO: 147670 - protein, 171 aa, Heterodera glycines
  Coding regions on vcDNA: vcDNA=SeqID_74093; Strand=-; Position=1 -361,515-611,883-939
GEFSIYLELRSSANKKQVPEPCHNRKDDGCGGFGSWSPANFDDSSRRNFQFVLRRMPNIGREQRTEGTTAGGRKVDQLRAGTEPRDIRKHGIGLLPAERGGNAQEPRADQRNVQKPNSDRDVRKLVQTQQKVETVYRKTKRTLFKDEPLPPDVGTQIAAEQCQVILVKCRK

SEQ ID NO: 147671 - protein, 79 aa, Heterodera glycines
  Coding regions on vcDNA: vcDNA=SeqID_74094; Strand=+; Position=1-237
  Homolog annotation: Hit_ID=CAE71479.1; Match level="QueryCoverage =93%, HitCoverage=19%, E-value=2e-25, Identity=67%"; Hit description =Hypothetical protein CBG18398 [Caenorhabditis briggsae]
LANEIARRVRIFCWILTGKQNHQKRAIHVKATWAKRCNKFVFMSSEDDPTLPAVNLNISEGRWRIKKYFKKFVYAYQNY

SEQ ID NO: 147672 - protein, 157 aa, Heterodera glycines
  Coding regions on vcDNA: vcDNA=SeqID_74095; Strand=-; Position=1 -177,2161-2250,2303-2404,2457-2563
SESGSCLESTGGGMTFILLMSPSAMSGLTPGEPSSTCGSATSNEPADSEKNHMEEDNRSRRGAEQLKKRREERKAQTEKARQAYLAKKTVQYQQIDDEEGEAEMEQQEMGQAEQVEETYDHAMDFDFQLDNYVQMSQNLTIDDQLPPAWDATAEVGV

SEQ ID NO: 147673 - protein, 33 aa, Heterodera glycines
  Coding regions on vcDNA: vcDNA=SeqID_74096; Strand=-; Position=1-99
MDIYGAGQPATHDFGEIVNYDDWQQWDNGWGGQ

SEQ ID NO: 147674 - protein, 114 aa, Heterodera glycines
  Coding regions on vcDNA: vcDNA=SeqID_74097; Strand=-; Position=1 -301,372-415
MYSNISSSGWVSSDHPQQQIGNFYSYDADPTLSPNGGGYNAYFDYPNQQPAASSSNSNFVPLGSGRPFPHTISQHAQLSFSDNSNANFVPLGSGHFLPERVKRGGNTSADGTPQ

SEQ ID NO: 147675 - protein, 296 aa, Heterodera glycines
  Coding regions on vcDNA: vcDNA=SeqID_74098; Strand=+; Position=1 -113,182-287,361-595,683-845,986-1054,1102-1202
  Homolog annotation: Hit_ID=CAE72026.1; Match level="QueryCoverage =93%, HitCoverage=93%, E-value=1e-74, Identity=47%"; Hit description =Hypothetical protein CBG19108 [Caenorhabditis briggsae]
IFAFIRFSPTLRFIGGGEQRSWKDEDGVEVEIIKKIPDSKCKVKSEAGDESKCKVKSEAGDELEQYFKLTDKEGKLIGSNFGQKPYKFVLGHGQAIRYKFVLGHGQAIRPMDNAMRGMCVGEQRRVTIPAEALAENERPQGVGEEQAMHYFVELKSIFRAVPGEKWMEDDGLSIEVTHKIVTHKIEEDKCRRAEPGDFIKQHYTVHLQDGSYVDSSHDRGATFDFTLGMGQVIKGMDRAMTGMCEGERRKLIIPPTLAYGENGYGENGRPPAIPPNSQLHFQIELQKLVKKDEEKE

SEQ ID NO: 147676 - protein, 160 aa, Heterodera glycines
  Coding regions on vcDNA: vcDNA=SeqID_74099; Strand=+; Position=1 -359,967-1090
MGRKNVKTAKKEPTTSSADDNVLLKTEETELDRNDRAESSPSTATQPAMMPKEMYNFCKVWQKQIQNKQKQIMKYVLFLFQSILEIEEKGNVNLTRLKGNTKFSQLLRDNPMFDDSVDIRAKLREFLNSHTDELFEGQIQYLHKEIKNTQKSIEQKVKSH

SEQ ID NO: 147677 - protein, 394 aa, Heterodera glycines
  misc_feature (392)..(392): Xaa can be any naturally occurring amino acid
  Coding regions on vcDNA: vcDNA=SeqID_74100; Strand=-; Position=1 -289,476-599,647-795,849-902,951-1063,1118-1257,1318-1512
  Homolog annotation: Hit_ID=NP_496076.1; Match level="QueryCoverage =97%, HitCoverage=97%, E-value=8e-64, Identity=38%"; Hit description =SQuashed Vulva SQV-8, defective SPErmatogenesis SPE-2, 1 3 -glucuronyltransferase (41.1 kD) (sqv-8) [Caeno
EIHFDLLEMTIEKCFITLCILTLFQFCFYTTKIMELSATSRQLEAEIFSMRRKREALQGEIDNLVRAKVRREGKAEKVEEGRGQLMTIISKINLSLPPIFFITPTSRRVAQKADLTRLGQTLVPVANLFWIIVEDSEHPSPFIGQMMDSEHPSPFIGQMMGRLGIVGIHLAATTPSEWKNKFPKGVAQRNAALNWLRENKAAEKRGVVYFGDDDNENKAAEKRGVVYFGDDDNAYDWAYDWRLFAEMRSISQIGIWPVGIVDQMITEYPLIGSNSKVFGFNSKKVFGFNSKWKRQRPFPIDMASFAVNISRILTNAGGGFSYQTPRGYLESESHFLISLNVTIDEFEAKANNCTKVFVWHTRTEPTPLLAEETAKFASGGGLDETEKDAVGXQM

SEQ ID NO: 147678 - protein, 153 aa, Heterodera glycines
  Coding regions on vcDNA: vcDNA=SeqID_74101; Strand=-; Position=1 -90,127-273,320-412,981-1037,1148-1219
  Homolog annotation: Hit_ID=NP_500253.1; Match level="QueryCoverage =100%, HitCoverage=39%, E-value=4e-33, Identity=63%"; Hit description= spastic paraplegia 3A homolog, atlastin, putative guanylate-binding protein, similar to ARL-6 interactin
MDTQGMFDSVSTFKNCATVFALSTMVSSVQELHPFFHSFASQIFNINKTIQEDHLQHLQLFTEYARLALDEYNNSKPFQSLLFLVRDWSFPYDAEYGPIGGQRILDKRLKAYFEVFSKAELPEPKTILNATAEANHLAAVVSAKAVYMREMEE

SEQ ID NO: 147679 - protein, 24 aa, Heterodera glycines
  Coding regions on vcDNA: vcDNA=SeqID_74102; Strand=+; Position=1 -49,595-620
MREKKEHNIIQYKNRKKFSQIWKQ

SEQ ID NO: 147680 - protein, 54 aa, Heterodera glycines
  Coding regions on vcDNA: vcDNA=SeqID_74103; Strand=-; Position=1-167
PSPPFTPFFLSSFPVCPNFLIISSINHSSFATSFIPPRPPHLSARRTFAADVQS

SEQ ID NO: 147681 - protein, 45 aa, Heterodera glycines
  Coding regions on vcDNA: vcDNA=SeqID_74104; Strand=+; Position=1 -47,385-444,892-922
MSFTLRLPFLFHPKVAIICCLLSLKCADQFPDFRRRKNYYCRFLA

SEQ ID NO: 147682 - protein, 309 aa, Heterodera glycines
  Coding regions on vcDNA: vcDNA=SeqID_74105; Strand=+; Position=1 -83,357-1203
  Homolog annotation: Hit_ID=AAC95573.1; Match level="QueryCoverage =93%, HitCoverage=46%, E-value=6e-44, Identity=30%"; Hit description =orf 48 [Ateline herpesvirus 3] pir||T42963 hypothetical protein 48 - ateline herpesvirus 3 (strain 73) ref
MKGWVLLDICELVLKPRKQGWYQDFGRGYDRAWCESLGKKKEKDRQEEEAEEQGEEEEEEEEEHRPEEERQEQERQEQERPEEERQEQERPEEERPEQERQEQERPEKERPEQERQEQERPEEERQEQERPEEERPEEERQEQERPEEERPEQERPEEQERPEEERPEGERPEEEDRPEGELPEGERPEGERQEKQRQEDGEEEDGDDDDDDDDDDNEDGAVRCKVILRRGGEGDDDDSAGGNSGGNGAKDGGGGDGEKKGNDGKKQEERGGGGEKANEQYKNGSTETAGKASEPYEEAKVQTILSGKK

SEQ ID NO: 147683 - protein, 181 aa, Heterodera glycines
  Coding regions on vcDNA: vcDNA=SeqID_74106; Strand=-; Position=1 -153,330-479,538-780
MPFFETPLNTNGNLLQMVGHSLFAQFVLVMILLSNEAVGLWFTRRASVPNSVKAIFRRRTASAIIFISALVSYSVWSCTAVLHGLCINLHFEPSNAPLFTLLLNIVLFCSSIIELNILNSRFRRGRLCNFEASPYTLNNLWLWIERERAHLRFVIRAFFGLNDDQQQRQNDHQMFGQNDDQ

SEQ ID NO: 147684 - protein, 120 aa, Heterodera glycines
  Coding regions on vcDNA: vcDNA=SeqID_74107; Strand=-; Position=1-361
  Homolog annotation: Hit_ID=AAP30769.1; Match level="QueryCoverage =100%, HitCoverage=61%, E-value=5e-62, Identity=99%"; Hit description= putative gland protein G16H02 [Heterodera glycines]
RPIFLLPIICASGVVCVFHTLSVANWLSDWWISADQSLDLDWLIIFTSAITFQAISMLVFSLKHLMIFKLLRPFTFKFAAIAFFDSQIQNIPLIVALIIASTAAESELFLKGGSKSFLFP

SEQ ID NO: 147685 - protein, 282 aa, Heterodera glycines
  Coding regions on vcDNA: vcDNA=SeqID_74108; Strand=+; Position=1 -229,282-412,875-1042,1099-1264,2563-2716
  Homolog annotation: Hit_ID=NP_502443.1; Match level="QueryCoverage =67%, HitCoverage=40%, E-value=2e-30, Identity=39%"; Hit description =GRP1 binding protein GRSP1 like (4N593) [Caenorhabditis elegans] emb|CAB03207.1| Hypothetical protein F07
MPAARVADRSPMAHLPLRESARGAQQQQQQGKEQQQQQQQQNQQQQNHHKECDGEEAEQEQNQLRKNNNNGKLIVVADKSAEQCQREREMCAKLMQRRDQLEEQLIARVDELKDICIAEGDLVGQLPTEIYKCLLPGEIEPTVKRRVGTTFKFPQEVLRIRRRNSKDSASGGGEPNEERQMTQLEAEIELNRRIVAAAERLAKDKSVNKSVRKKRRKDLHLAAQRLRGLEKVPSRRASSGGGASAGGSVQSTNSATTAADDGAATTADSRTAEMPRQDSSSH

SEQ ID NO: 147686 - protein, 87 aa, Heterodera glycines
  Coding regions on vcDNA: vcDNA=SeqID_74109; Strand=-; Position=1 -12,810-1061
MGVWVGTGSFVSPARMEEISNEITELMDQRTVKVKKFLKEHEVKEIMRINPTCRQFRCRREGQRRTKRNIGVQRRRHGEGTVRGGGK

SEQ ID NO: 147687 - protein, 173 aa, Heterodera glycines
  Coding regions on vcDNA: vcDNA=SeqID_74110; Strand=-; Position=1 -228,1252-1545
MRRKNMLIHIIYNPNDDLLYRHLFELVDIDKALCALISSDRMINNLKEYVMWTQKELLKDKMFDDVTTSGLMRSMKYLIARSFESRKQCYENENKILLNLRVYFRLFGAIERQISSRKTEDTVKEIGNNTTVEMEWAILYNFVHDFFEKMKQFVKIVAEVGIEQAKQRQCKNL

SEQ ID NO: 147688 - protein, 205 aa, Heterodera glycines
  Coding regions on vcDNA: vcDNA=SeqID_74111; Strand=-; Position=1 -38,88-534,577-665,747-790
MCCKKLKKPNSDSLIASAILRDGLLDRTYQIIHDKQCKGVPLEQLAAEQIDRSQRRDLVQCSINPKSLWREVFLFIKTRIFFVKGSYRAREHDVAEDIEIEDISGISFNYPNWQSVRSSYYRRRRNHLGDCSDPFNVPERLQLNKRGSIKLLLKKKISEEDMWLRFRDKELGVMLFISHSQIKAASHCKVLGFVMLVSSYFWRKF

SEQ ID NO: 147689 - protein, 60 aa, Heterodera glycines
  Coding regions on vcDNA: vcDNA=SeqID_74112; Strand=-; Position=1 -74,239-347
MKKTENFQLPYDFASIMHYTTQMDGENRIIPFNRFYERTAGQPRLSFKDTLLLNKIYCPG

SEQ ID NO: 147690 - protein, 69 aa, Heterodera glycines
  Coding regions on vcDNA: vcDNA=SeqID_74113; Strand=-; Position=1 -87,401-523
MGTKSTFLVSFDSPICYLLTCKIAKNLVEEHVQIPSGDPLKAGDTLFSKMDAQEMYDQRKEGNAWIVVN

SEQ ID NO: 147691 - protein, 186 aa, Heterodera glycines
  Coding regions on vcDNA: vcDNA=SeqID_74114; Strand=-; Position=1 -194,866-1016,1058-1273
MPPPANTSASIGWRLTFRLALPNFRSMSPHHFTKSVVAKWKRKLTFSICQQIIRKREMSSMHAKRYKVCRKFSFKMEDLLQAHLFVPIFFIDFSSDRASTIRGAGKELTINLAKKKNSLSSVLNSIMEESWNGTLAKSLHFIPPENGYIEIFFQVSELHYSKLITREEDLEPYRNNPNIVKTLLKT

SEQ ID NO: 147692 - protein, 81 aa, Heterodera glycines
  Coding regions on vcDNA: vcDNA=SeqID_74115; Strand=-; Position=1 -126,890-1006
  Homolog annotation: Hit_ID=NP_497051.1; Match level="QueryCoverage =87%, HitCoverage=59%, E-value=2e-13, Identity=43%"; Hit description =putative secreted or extracellular protein precursor (13.5 kD) (2O980) [Caenorhabditis elegans] emb|CAB05
MPMPSFARLRLFPLFFLLLLSTNSECDWWDNFVNGAHEKIVGAADWLRDKAGPTVREKFNGAKQTLQDPETHEKVQEWVEE

SEQ ID NO: 147693 - protein, 118 aa, Heterodera glycines
  Coding regions on vcDNA: vcDNA=SeqID_74116; Strand=-; Position=1-358
LLNNYIGQPRPNGTWSQPLFPPEQWNVYTRTLNGEERTNNHAEAEHHRLQGAFNCRHPSIWHFIDVLRREQKGTDGKYASFLAGLEPPRKAKKYQAADERLIILEFLRGISRNYHMNP

SEQ ID NO: 147694 - protein, 35 aa, Heterodera glycines
  Coding regions on vcDNA: vcDNA=SeqID_74117; Strand=-; Position=1-106
  Homolog annotation: Hit_ID=XP_453849.1; Match level="QueryCoverage =100%, HitCoverage=71%, E-value=4e-11, Identity=80%"; Hit description= unnamed protein product [Kluyveromyces lactis] emb|CAH00945.1| unnamed protein product [Kluyveromyces la
MPRRVTTDAHEWSNDIPTVPIYYLAKPQPRERAWK

SEQ ID NO: 147695 - protein, 347 aa, Heterodera glycines
  Coding regions on vcDNA: vcDNA=SeqID_74118; Strand=-; Position=1 -100,153-269,311-450,497-599,780-870,925-1039,1101-1178,1255 -1349,1918-1986
  Homolog annotation: Hit_ID=CAE62553.1; Match level="QueryCoverage =99%, HitCoverage=67%, E-value=5e-62, Identity=43%"; Hit description =Hypothetical protein CBG06663 [Caenorhabditis briggsae]
AMDGRAYTDEESWSNVLVECGVNNDQLRERYHQIYHLVTIYHLVTAADGAQSFYQLANNQARTEAMEEAIELDKNTREAWIGHQCLSIIDNAWIGHQCLSIIDNSNCCSFEEKISKLIADVCERLDIPILDRLASNSKNRKWLVSKIDNRKWLVSKIDAFLQMKKEEFLIEDDYLSTEGSTLQVRLRSRSQNGKYTYTLTTRTFEDADGKKVETRKQLDVETRKQLDRREYQSYLKLLDRSRQSIHKKRVCFVFGNVYFNLDIYIAPYFNLDIYIAPLPPALMYNENQLMILETYTTRPIGDPEPRLPDFLEIEREITMESAYSIQSSSEYSSKSNKLIGTVKVRDQ

SEQ ID NO: 147696 - protein, 156 aa, Heterodera glycines
  Coding regions on vcDNA: vcDNA=SeqID_74119; Strand=+; Position=1 -88,145-309,362-442,646-782
MEFHCSTVLLPDTADELANDVLNALCFGRVASLSHMASMLDDRFKPIQIVRPFRDISSRELEAMHNIERDECSEPVLASCRKESVDESNCKNKCDGSLQALTEDFISELRTDEYSDDDWKTTHTWNEKICQICSQLIAGSGPKFKESIQCIISALL

SEQ ID NO: 147697 - protein, 221 aa, Heterodera glycines
  Coding regions on vcDNA: vcDNA=SeqID_74120; Strand=-; Position=1-663
MTIDGDKGSTSEWPTDFWSKILADDQRHMNLAFERTQSMGSASAGLIGMDQQHVDLGFGRSNQFGTDQRHMNLAFERTKSMGSASAGLIGMDQQHVDLGFGRSNQFGTDQRHMNLAFERIKSMGSASAGLIGMDQQHVDLGFGRSNQFDTDKQLMDLGFGRTQTMGSASAGQIGMDKQHVNLGFGRTQSMGSASAGLIGMDQQHVDLGFGMSNQLDTDKQH

SEQ ID NO: 147698 - protein, 26 aa, Heterodera glycines
  Coding regions on vcDNA: vcDNA=SeqID_74121; Strand=+; Position=1-81
NVFAVGGCSGPGQHLANAESVQFDGH

SEQ ID NO: 147699 - protein, 1003 aa, Heterodera glycines
  Coding regions on vcDNA: vcDNA=SeqID_74122; Strand=-; Position=1-3009
  Homolog annotation: Hit_ID=NP_491240.1; Match level="QueryCoverage =90%, HitCoverage=68%, E-value=0.0, Identity=42%"; Hit description=zn- finger, CCHC type and RNA-directed DNA polymerase  and Integrase, catalytic domain containing protein fa
MVAQIKNSRANQRPKPRQATDQTIQPFYVAKSGSLNLLGTPAMEAFGFLEEIRRMINPAQINQISSNDADKIQQFVEILPQKYEQIFSDGLGYCSKMKANLVLKEGANPTFKRARPVPYSTLPIINAELDRLEKMNVITPVEHTDWPAPILVVKKANGTARLCADFSTGLNDSLQLNQHPLPLPADIFATLNGGKFFTKLDLSDAYLQIELDGTSKKLCTIATHRGHYQYERLPFGVKSAPGIFQSVMDNMLSDFPFALAYLDDVIIVSATFDQHCQHLNQIFTRISEWGFKVRMDKCSFFKNEIKYLGVIIDQNGRRPDPSKITAIAEMRIPSNVSELRSYLGMVNYYQEFVRNFRFIRQPLDELLKKDAKWDWSPKCQNAFTKIISMLQSELALTHFDPNLPIIVAADASQHGIGGVISHKFANGSIKAVSHFSRSLTPAEQNYGQIEKEALALVEAVKRFHKMIFGRKFTLLTDHQPLKKIFGNKDGVPKHSHNRLVRWPLILTAYDFEIQYVKTDKFGQADALSRLISVQKSKSDDDEVIIASFEVESALDRNLINNVNHLPITFKNLAQETANDQALQQIRQFVKNIWPEPKNFQPIEGLDEAKFIQFYRRRDEISIVKDCLMFGDRTVIPKSLQKQILKMLHQGHPGVKRMKSLARMYVYWPLMDAEIEAFVQKCTSCAAVAKNPIKTTLQSWPKSDGPWKRIHIDYAGPFHGKMYLIVVDSFSKYPEIFEMNSTNASATISKMRSLIAHYGIPETIVSDNGTQFQSHQFEGFVKSNGIDHIFTAPYMPQSNGQAERMVDTFKRAFAKIKGEGVDGNVLDTFLLTYRTTPSDTLDGKCPAELFLGRKPRIGLELLRPPLSIPIVKDDKMEDQFNRKHGAKFRSFEIGQLVFTRRHNSAEWRHGKIIDKKGVIYTVELPNNSRGRFHANQIRARQIPDEDIEDPLDVINGTFGLPIPLRDQNLAEVPPSNQSPPVRRYPIRNRRPVDRLQIDPSRSSY

SEQ ID NO: 147700 - protein, 304 aa, Heterodera glycines
  Coding regions on vcDNA: vcDNA=SeqID_74123; Strand=-; Position=1-913
  Homolog annotation: Hit_ID=XP_320889.1; Match level="QueryCoverage =88%, HitCoverage=32%, E-value=2e-60, Identity=44%"; Hit description =ENSANGP00000012033 [Anopheles gambiae] ref|XP_313651.1| ENSANGP00000013044 [Anopheles gambiae] ref|XP_314
MFRGSTLFRRKAVQIHRTRDRHLPIQRIQTIQPFYVAKSGSLNLLGTPAMEAFGYLEEIRRMINPAKINQISSNDAAKIQQFVEILPQKYEQIFSGGLGFCSKMKANLMLKEGANPTFKRARPVPYSTLPIINAELDRLEKLKVITPVEHTDWSAPILVVKKANGTARLCADFSTGLNDSLQLNQHPLPLPADIFATLNGGKFFTKLDLSDAYLQIELDVESKKLCTIATHRGHFQYERLPFGVKSAPGIFQSVMDNMLSDFPFALAYLDDVIIVSATFDQHCQHLNQIFTRISEWGFKVRMDK

SEQ ID NO: 147701 - protein, 50 aa, Heterodera glycines
  Coding regions on vcDNA: vcDNA=SeqID_74124; Strand=+; Position=1 -41,133-244
MNRNVKKAQKIAKRTGEKGINFWFSNFKNQGITVSPAVPICAAGKIFWKL

SEQ ID NO: 147702 - protein, 19 aa, Heterodera glycines
  Coding regions on vcDNA: vcDNA=SeqID_74125; Strand=+; Position=1-57
MENGNGIEKRGLVVEDGDG

SEQ ID NO: 147703 - protein, 263 aa, Heterodera glycines
  Coding regions on vcDNA: vcDNA=SeqID_74126; Strand=+; Position=1 -85,210-281,337-407,550-600,1312-1422,1472-1509,1570-1799
  Homolog annotation: Hit_ID=CAE73050.1; Match level="QueryCoverage =82%, HitCoverage=42%, E-value=3e-51, Identity=50%"; Hit description =Hypothetical protein CBG20420 [Caenorhabditis briggsae]
PVLSSPSSAAISKLTSSAFSSVLDNGVIGDPQVDCLEDRVRLTFRTQRPFTGRIFVKGMVENDKCVNNYQQKGQRIFVKGMVENDKCVNNYQQKGQTKVDFELTNGQCNMRRSRKLGPEQRGVEQSVTIIISFHDIFITKVDRAYRCTCFYMEADKVVTNRFDVSMEADKVVTNRFDVSMMPTTELVDTMMPTTELVDTARMPMCTYTVRIPTLFGVAVKWGRSSETEFPPIFGFVLMPFMISFGFILHAFLLSFVLNCAFDP

SEQ ID NO: 147704 - protein, 311 aa, Heterodera glycines
  Coding regions on vcDNA: vcDNA=SeqID_74127; Strand=+; Position=1 -440,953-1128,1424-1496,1543-1789
MFIFCFTLCCLVSLAFGTLLNVGIENVPDQIVINANQLTPLTYHLLKILENLMGIVPKRHSSINFRIIPAVDIPLVEMVYSGRLNVQKILGEIAENFEKNADLAQIFEHFLMFADGYYQPVQTGDVNHHKQEENASRPRELEFHYIFFISQVTPVPHSKLRAVFSQFCIGQSDGFKPVLGEWTTNWATNNFNQNLDQKIHIKFSTEIVNTDGGIFLTKIDKLWPQRTFKKKRIFCGALNVSAAKIQEILDQLAASTEYAYNSIKSPDGNNAFTKMLMHKLASVAGDHQLNISQIQWFSGKKLVPNFARCKI

SEQ ID NO: 147705 - protein, 82 aa, Heterodera glycines
  Coding regions on vcDNA: vcDNA=SeqID_74128; Strand=-; Position=1 -11,79-314
MNRRWICNDVWMDIFPSFDRPQLGLKMALLSPRFNALVDKHFDGKSELTIWRTIEISKDKGPEPKLSVQMDDKSLPFPLPDD

SEQ ID NO: 147706 - protein, 23 aa, Heterodera glycines
  Coding regions on vcDNA: vcDNA=SeqID_74129; Strand=+; Position=1 -8,436-499
MTSDETFGHQLVKLFFQKINKFG

SEQ ID NO: 147707 - protein, 133 aa, Heterodera glycines
  Coding regions on vcDNA: vcDNA=SeqID_74130; Strand=+; Position=1 -123,174-452
MEEQPIWDVFVREIKDGQPKRLRCDNYYEQTDLDWINNFKEHFLRANAISSISYEIHFYVQVSSMLMMPFECVVNESTKEKLTLTKANENKLDNRWIMKRCKIGNKTAAVQQHKEGDCNNVFFWLFADINYIW

SEQ ID NO: 147708 - protein, 46 aa, Heterodera glycines
  Coding regions on vcDNA: vcDNA=SeqID_74131; Strand=-; Position=1-141
ARSLRNDCLTAAKFLLNNGRKKEGKNGTSAEHCADRRVLMIKMTSH

SEQ ID NO: 147709 - protein, 33 aa, Heterodera glycines
  Coding regions on vcDNA: vcDNA=SeqID_74132; Strand=-; Position=1-131
AASRPRTGALRPFFKFCWAYTGASRPFLNLLGY

SEQ ID NO: 147710 - protein, 104 aa, Heterodera glycines
  Coding regions on vcDNA: vcDNA=SeqID_74133; Strand=+; Position=1-315
MPPSENFSNISLDINDLEARPLPEPQQPEQQQAELLIQIVDVEEALLFNVHEGEERREEEEEDEEDEEEEEEEDFVQFEELMRLHAEYVAQIFNEIDDDEINNE

SEQ ID NO: 147711 - protein, 1160 aa, Heterodera glycines
  Coding regions on vcDNA: vcDNA=SeqID_74134; Strand=+; Position=1 -406,450-2178,2300-2748,2798-3111,3161-3232,3626-3832,3878-4181
  Homolog annotation: Hit_ID=NP_507780.1; Match level="QueryCoverage =57%, HitCoverage=49%, E-value=9e-33, Identity=25%"; Hit description =predicted CDS, DNA polymerase type B, organellar and viral family member (5T899) [Caenorhabditis elegans]
MANRNPFSIESVHEMRNRPRNTRGEVAQVRFVPLEQVQRPDRVLEMLVEQLFARVLGDRPPPSLIGLQLHPPTFENPFTIALRPPEQNNPAAIADYIQRLNDQSAAGIDLTAGTTLTKVLAVWPMHDDRTENGREGACSWDHEHSVVHTVNSLVRIRNPNDRLCLARAVLIGLKDHRSRQYQNTRAGQQMFKNYVGQQRFHGPEARHLLRRAGIKTNKNMYTLDDVRQLQQWVDERYEEAQIRLTVFEKERQYRIVYKGASGRAARFNLCLLLENAHFHYVGRIEQLFRCTSYCVDCERRVTRWYHPQECKVVCRLCLRYGADYPCQQQQFANGRNSKHFCTQCQFVFPNLDCYNYHLSNRAPANLDGRSGRAFRSICEWRRVCRTCGGIVYINFQHVCPPSVRQQQQQQQQQQFASLCHQCGGPHAEDGPCFIQPMDGRRVFGQTRRQQKQQQQQQQSSVENCLNGNDDAADKEDDTDDDNDAEGESQHGAGGGGHRRQASQKTIRYCFFDAETSQDRPLQLRTQIAQKHVPLLIIAEVICERCIADGITIYGGIGKKANGCVCGMPSGPRGRLWCSPPFRNAPNDDTEMPTNITYNPRRLFFHCFEDATKNPVDQFLDFLISTGPRKSHTICLSHNGGKYDMHLVLEALHHRNLPPKRICTTGLKIYSMSLKGNLQRQITFKDTLNFFFCELDALPRTFNLPNEIATAKPWYAYEGAVAKFQLREQLIIYCANDVAILRESVLKFRQLIMENTMGLDLFVIASTGAALALATFRRCFLSRNKLINTPEGGYLRGRRASAESARYIRMYELMNPGEHVQSAQWTVGEAHVEDSGYRLDGLHVRLPPLRNIAIEYMGCFYHGCPKCFPNDRQQTLAGGRSAEELYERTQRRLWELEHTHGFELHVVWGCELKKSLRANPVLRQMYNDAFVPRPLDPREDALRGGRTEPFTLQHICTNDEEIVLIDIVSLYPYVMKAFDFPVGNPRVLTREVWHYDEWDAEMFRGYMNTFVGMKVQASGWPTGCESEERRDDYIDEFERAEGIRLDRGKIANNPGLRMVAKLLANSLWGKFAQRVGRTEVRYASSPSEFHCLLDDPSIEVLDFHHVSPHLDRVVVKTKADFSKAPATNCLPIAIYVTSYARLHLYSYIEKVVQLGHKLLYC

SEQ ID NO: 147712 - protein, 67 aa, Heterodera glycines
  Coding regions on vcDNA: vcDNA=SeqID_74135; Strand=+; Position=1-205
YIEQVLSGASPRFDMVEFSQDGSWSFCQSPDTMLDTDSEDEEADTTASPSTDEGLQKQMPIEKIIIK

SEQ ID NO: 147713 - protein, 101 aa, Heterodera glycines
  Coding regions on vcDNA: vcDNA=SeqID_74136; Strand=-; Position=1 -233,488-560
MTRRKTVAVTEQNCSYVAPADVQNVPPGDPQYGDGFMYYKTNDNDTLYSCEGKNKTRVKMGREYFSQFRGGTAFHSILNVGLVKLAIQTETNGTEDDWEGF

SEQ ID NO: 147714 - protein, 36 aa, Heterodera glycines
  Coding regions on vcDNA: vcDNA=SeqID_74137; Strand=+; Position=1 -82,887-915
MTHNFFQFHFYPKFLSDSWVTYREEWIDAKIKKDQE

SEQ ID NO: 147715 - protein, 404 aa, Heterodera glycines
  misc_feature (402)..(402): Xaa can be any naturally occurring amino acid
  Coding regions on vcDNA: vcDNA=SeqID_74138; Strand=+; Position=1 -1193,2734-2762
  Homolog annotation: Hit_ID=XP_318550.1; Match level="QueryCoverage =98%, HitCoverage=40%, E-value=4e-64, Identity=34%"; Hit description =ENSANGP00000020240 [Anopheles gambiae]
MLSRLIANYPRPPLDILIAKICTETTFHGTILQSRIDQLPVTATEIAEMTQKDEILQKVAKFSKEWSQKCNDPDLAPFFPKRNEILQIENCLLYQNRVIIPTVLRDRTLKALHMAHPGIVRMKALARQHVYWPGMDSAIEKLVKSCEECQIAHKAAPKTLLSPWNATKRPFQRVHIDFAGPCQGPCLSTLLDSFSKWPEVYQMNTMTSKATISVLRLIIHRLGIPEEIVSDNGRQFRSSEFSEFCKEFGIRHTFTPPFHPQSNGQVERFVDTFKRAMQKCSKKKNWAEKMLLSYRTTPNSAINGHSPDQLFFGRKLRTQLFLTHPTGKVNETIDKTIFHQKQEKYRTKIAQNFNEKHGVKSNEFLPTDPVLVLNYQHGKAYWLQGTVIERLNNSLYVVNNAXRI

SEQ ID NO: 147716 - protein, 309 aa, Heterodera glycines
  Coding regions on vcDNA: vcDNA=SeqID_74139; Strand=-; Position=1 -585,656-997,1301-1303
  Homolog annotation: Hit_ID=CAD26968.1; Match level="QueryCoverage =96%, HitCoverage=95%, E-value=7e-53, Identity=36%"; Hit description =transposase [Meloidogyne chitwoodi]
MDKIRLRQLLLYEFRKNSTPTQALRNICKSEGNDALSLSTVKRWFTKFREGNEQLEDEPRSGRPPSLDSDDLEQHVQQHPCSSSRQLAAEFGVHQTTVLNYLHQLGFINKKGAEVPHTLTQQQKHQRVVTCTELLARLSAGMQLCQLITCDEVGLSQQQNGTKTMAEAKRIERADPQASSTCTEGIAVRLVVFIRRVHDQIRRPPFSAKFRGGVLLHDNARPHVALSTQQKIEQLRWAVLPHPPYSPDISPCDYYLFRSMEHFLRGKEFADQNEVENALDDFLDRKMISFIKRGLKCCPNDGGGSLIKM

SEQ ID NO: 147717 - protein, 64 aa, Heterodera glycines
  Coding regions on vcDNA: vcDNA=SeqID_74140; Strand=+; Position=1-196
GELIITVNIVHEKHYERLKKVIAHGGEFIERIVYHTNKDLTKMNNNNNNVFEQLFVAIMNVIIY

SEQ ID NO: 147718 - protein, 237 aa, Heterodera glycines
  Coding regions on vcDNA: vcDNA=SeqID_74141; Strand=+; Position=1 -211,986-1488
MAMGGNMANYGMMPTQYPNNGPTFGHTMANYGMVLGATLGNIAENVFERGKELVAKMNNNGNQHPFSGMPGIMVENNTNNNSNYGNMPSLVVGVDSTVEYSVNVRSRMVEDIGIEVQGVAQWPKKLLAKLFEEELFEGLLYKKGTGANRGIGPSMARIPHWEAMLGLSPQTKVNLIGWLAFKKKIITEIKLATKCQANSWKIYDVLNSRNVAKIFTNFWGSYFIILGMKSHKNPKKA

SEQ ID NO: 147719 - protein, 19 aa, Heterodera glycines
  Coding regions on vcDNA: vcDNA=SeqID_74142; Strand=-; Position=1 -43,215-231
MCGRNSLYLSGMGRVKNCL

SEQ ID NO: 147720 - protein, 31 aa, Heterodera glycines
  Coding regions on vcDNA: vcDNA=SeqID_74143; Strand=+; Position=1-94
MRKAKCETPKNANNAKGEMRKAKPRPIPDRY

SEQ ID NO: 147721 - protein, 190 aa, Heterodera glycines
  Coding regions on vcDNA: vcDNA=SeqID_74144; Strand=-; Position=1-573
MPSSTSGSVLSSGATAQPIISDDESTLKIVNKTLFQGKQPNSTVRFEDVEKVFGELIRLEEGVSRTIRQVNRKANNVQNHLGTLANEVNVGFQTFTAEISKVAGKVKSLENLNSANKNIQQATAVTQPLVPHHAHPPVQQLGHQTGQRPNQNQQSSSSDDEDDQQRNALSFQSVNMIIDAYPMALERLQG

SEQ ID NO: 147722 - protein, 62 aa, Heterodera glycines
  Coding regions on vcDNA: vcDNA=SeqID_74145; Strand=-; Position=1-187
MKGKALALNALHGARIRQSMTKEQLAERRKLIEQCAKKRKEDAEDWIIYANQVILRSDIDTF

SEQ ID NO: 147723 - protein, 92 aa, Heterodera glycines
  Coding regions on vcDNA: vcDNA=SeqID_74146; Strand=+; Position=1 -171,614-721
  Homolog annotation: Hit_ID=AAH84978.1; Match level="QueryCoverage =96%, HitCoverage=10%, E-value=1e-27, Identity=61%"; Hit description =Unknown (protein for MGC:86390) [Xenopus laevis]
MSLRNVRDNEEKESAFRGICLMVNCNPQGVAAAFIFLCDAIASWQTPSEELRFMFGRIIYAFKSQVGEENWNNFVAQIPEPLKQRLGTQYQL

SEQ ID NO: 147724 - protein, 222 aa, Heterodera glycines
  Coding regions on vcDNA: vcDNA=SeqID_74147; Strand=-; Position=1 -77,125-275,478-636,917-1091,1306-1409
MDKILLLFPILVIVIGLIAADKCNNFPRLNFRSLQQQRKVRESRRCAMPTSRVMFGLETGPYDNATYFVHFLIKNQNGLMSRCSGVLFNPSLVLTCAHCWDEAAKDGDGSIAYAGIEDGQSVEESVSKKVLGFVLHPAFRLLNGAAFDLAVVAVLPFELVPGKLGTIGFPRFEPVYTSSQWVDCQIAGSGQSFTKSGDRCENTKRRLYMTGILTSLSCCNDA

SEQ ID NO: 147725 - protein, 64 aa, Heterodera glycines
  Coding regions on vcDNA: vcDNA=SeqID_74148; Strand=+; Position=1 -87,229-336
MKRLECENQRILMHFLTIFSAKLLSPVQNIIYAFKSQVGEENWNNFVAQIPEPLKQRLGTQYQL

SEQ ID NO: 147726 - protein, 169 aa, Heterodera glycines
  Coding regions on vcDNA: vcDNA=SeqID_74149; Strand=-; Position=1 -150,988-1091,1151-1406
MSRCSGVLFNPSLVLTCAHCWDEAAKDGDGSIAYAGIEDGQSVEEGVSKKGKPLGHKFPMGTICFRGHSDAACAGDSGSGVVCKYEPTGDRVLVGVLRAGSHCCAKNGLRLNEPGESNIVPLDVARRSWISRVALHHFRCGSLTPPCAPAMAFAARASIQYDDPEHAYL

SEQ ID NO: 147727 - protein, 70 aa, Heterodera glycines
  Coding regions on vcDNA: vcDNA=SeqID_74150; Strand=-; Position=1 -59,371-524
MTTAWLRCEMTLTHRSMGDDPRLNFRSLQQQRKVRESRRCAMPTSRVMFVRKLALMTTRRTLFIFSSKTK

SEQ ID NO: 147728 - protein, 81 aa, Heterodera glycines
  Coding regions on vcDNA: vcDNA=SeqID_74151; Strand=-; Position=1 -99,165-311
METGRLFFNLLRRGYITGDRQINGDWHIKRVYTTSILTSACFSRFPVALPGPGPELFKIREPGPGPWMTGNSRPGPGPAAL

SEQ ID NO: 147729 - protein, 30 aa, Heterodera glycines
  Coding regions on vcDNA: vcDNA=SeqID_74152; Strand=-; Position=1 -31,519-580
MTKIYHFLASVFDKGIVQRKSTLFATPTSE

SEQ ID NO: 147730 - protein, 170 aa, Heterodera glycines
  Coding regions on vcDNA: vcDNA=SeqID_74153; Strand=+; Position=1 -341,389-510
  Homolog annotation: Hit_ID=NP_507026.1; Match level="QueryCoverage =75%, HitCoverage=33%, E-value=2e-32, Identity=51%"; Hit description =transporter family member (5Q507) [Caenorhabditis elegans] emb|CAB60295.1| Hypothetical protein T10C6.6b
TLGHRSPIILLMLVLSVPLLFIYSGLGSSRVEHVIGMSLLGVTISGPYNLIVGTIAIDLGSQQALANNAEALSTVTGLIDGIGSAGSALGQLFVPLIQNELGWIWVFHFFILMNFLSSMCLIRRFFHDARLNFLSSMCLIRRFFHDARLISLSFAPRQNSSARERAADFE

SEQ ID NO: 147731 - protein, 141 aa, Heterodera glycines
  Coding regions on vcDNA: vcDNA=SeqID_74154; Strand=-; Position=1 -308,925-1042
MGEKNAIISPGLLLRNFCQMALASLGFPFRLLPTLRAKSSRKNLHKLRHCPWSANEKNGTKKRSERRQIEATESVDERKRRFNWRIHLRKSPIEMPKVTLGLNSVIRNQRLVLLPTTILPRSKRKGNEPSVVEETTDKAHG

SEQ ID NO: 147732 - protein, 39 aa, Heterodera glycines
  Coding regions on vcDNA: vcDNA=SeqID_74155; Strand=-; Position=1 -105,162-176
MNATVKSNREKGIKRTARIHTKELACEALDKHILFAFFK

SEQ ID NO: 147733 - protein, 371 aa, Heterodera glycines
  Coding regions on vcDNA: vcDNA=SeqID_74156; Strand=+; Position=1 -496,2291-2480,2548-2739,2784-3021
  Homolog annotation: Hit_ID=NP_503359.1; Match level="QueryCoverage =32%, HitCoverage=17%, E-value=1e-25, Identity=45%"; Hit description =SQuashed Vulva SQV-6, putative xylosyltransferase (sqv-6) [Caenorhabditis elegans]
APRQDPARRDGRRRNGKPSEAKATGQKRRKKKPGRKTANSAPRQGKQEGEPRRPPGPPRPTTQQPPPGPPQGPGRPKRPPNAQPRDAAEARRHRHRRPARASRRRRPHETRTRGPHGPHPRPGPKGRDRRGQRTRNYAGGLHVEVGTNSATKGPIAAPLEVNEGAEFRDFLGENWQYEDGTTDRLAKSAQNRIQSTACKVQLRNFLHDIAFKRHWPVKEIAKNCDDLFEVPSAANALKFRPFSPGTSHVKILFLLQLNGRDSRQLRRLFRSLFLPRHFYFVHVDSRREFMLKEMLKVEESLRAEGFANFRVAKRRMATIWGGSNLLDLFLWTVAETLGETNSNWAQWDYIVNLSETDMPILSVEELEQNLA

SEQ ID NO: 147734 - protein, 187 aa, Heterodera glycines
  Coding regions on vcDNA: vcDNA=SeqID_74157; Strand=+; Position=1 -160,209-384,441-537,1411-1437
  Homolog annotation: Hit_ID=NP_503359.1; Match level="QueryCoverage =78%, HitCoverage=20%, E-value=6e-37, Identity=52%"; Hit description =SQuashed Vulva SQV-6, putative xylosyltransferase (sqv-6) [Caenorhabditis elegans]
RNLPVNLRLDGGSDWVVVHRDLALFAISDSLLPSQLRLLFSSVLLPLETFFHTLALNSDFCRRIVRRNLLALNSDFCRRIVRRNLRFTNWRRRQGCRCAPLKSVVDWCGCSPLAVSANELGKLSLNHSQSKFHFFGRKFDSAVDIASQSKFHFFGRKFDSAVDIAPIAFVERQSLRFRIALLSFPVF

SEQ ID NO: 147735 - protein, 164 aa, Heterodera glycines
  Coding regions on vcDNA: vcDNA=SeqID_74158; Strand=+; Position=1-493
MFLSGKDDESSISAIDRKLWQGKTTIKISDLEKAQNDMGKLEDGVNRAFRCLNRSLNQKVNWVKDVVANTNANFETLKVQFETLTERVDMLEQDSDGTDSGGTVSITNLNRASRAPFVTPMGNAQPNQVVPNQVPIHQLSSEDEDDGPTLFDLNMLSSGPTVGS

SEQ ID NO: 147736 - protein, 102 aa, Heterodera glycines
  Coding regions on vcDNA: vcDNA=SeqID_74159; Strand=+; Position=1-309
MVRGFRPFSGSMRRDNNKEEEEDEAALAIGEEAARSNLAKETGQATLDAIIVTVLDILRTIAINAVPISEEIPTNRSVKEDGQISNLANLRDNGKIGRILLT

SEQ ID NO: 147737 - protein, 204 aa, Heterodera glycines
  Coding regions on vcDNA: vcDNA=SeqID_74160; Strand=-; Position=1-655
  Homolog annotation: Hit_ID=CAE73289.1; Match level="QueryCoverage =91%, HitCoverage=22%, E-value=3e-19, Identity=27%"; Hit description =Hypothetical protein CBG20708 [Caenorhabditis briggsae]
MLQMTPSECKQMAENGKCSLGLLINDSGLSHTDKKLDLSPRMWLIGSFSWSTVSTENCYLFKTKIMSQHGSTIMLSPLGSVNNCQFKAGQCEMEDKTLLMWDTHTTRACEFSKIGTWKGLQLDNIWISDEVSFRLTFLNNTKKVNSCGLNLIKSEEGFAVQDLPSDDSNESSKRSRKTRSLESWVTESEMNSKLGYLDEQVREM

SEQ ID NO: 147738 - protein, 567 aa, Heterodera glycines
  Coding regions on vcDNA: vcDNA=SeqID_74161; Strand=+; Position=1-1702
  Homolog annotation: Hit_ID=CAE56152.1; Match level="QueryCoverage =45%, HitCoverage=30%, E-value=6e-26, Identity=28%"; Hit description =Hypothetical protein CBG23765 [Caenorhabditis briggsae]
MDCQVENELAKESSSESPACGPETKTNIPKTSNWERPSVRSKVASLMFITFMLVGMILPFTTANMPHLPMHPLVCQTQNGGKIWQLPAVTGCSKLSIDHSKAPVVRTFDVFSPNLFEHSADAWACRKVRKSVRKYTSITNVTIQETLEPLMLQMTPSECKQMAENGKCSLGLLINDSGLSHTDKKLDLSPRMWLIGSFSWSTVSTENCYLFKTKIMSQHGSTIMLSPLGSVNNCQFKAGQCEMEDKTLLMWDTHTTRACEFSKIGTWKGLQLDNIWISDEVSFRLTFLNNTKKVNSCGLNLIKSEEGFAVQDLPSDDSNESSKRSRKTRSLESWVTESEMNSKLGYLDEQVREMLTISFSQTIKSICDYMLETRRWAATALLSDPTTFARKLFQSGKLVAKVAGPELIKVWPCIELQGHDYEFAKIGNSADSEFECFDKIPIKFRVKDNKRMAFIDPRTMILSSDARLAPCSEYRKQLIFVRGSLYEVDQIDAQVKQVNANRIDGFSLNLSLAPTYARHSFLHIALVNVSDFIGQFYDANLARENELTFQIKSEDAIVTKKSRTMGA

SEQ ID NO: 147739 - protein, 67 aa, Heterodera glycines
  Coding regions on vcDNA: vcDNA=SeqID_74162; Strand=-; Position=1 -25,133-311
MDTCVKENDFLRFDQSKRMENQSKFAYFESAQATILRPPKNYLKSAEIWLSEKQCAGFRYEIAAMLC

SEQ ID NO: 147740 - protein, 71 aa, Heterodera glycines
  Coding regions on vcDNA: vcDNA=SeqID_74163; Strand=-; Position=1 -147,637-705
MHFGTVLSLPLPLFLVVCFSTAAHIAHFNANAEQQNAIEWNAKRDRICEKQKMTDKGTIAWKIAEGRAAFV

SEQ ID NO: 147741 - protein, 136 aa, Heterodera glycines
  Coding regions on vcDNA: vcDNA=SeqID_74164; Strand=+; Position=1 -96,314-488,885-1024
MESQQQLMFNTSMGSSTNNNNNNIFGHSMQRLTSPDESPLDHVNVHQQYAVSTYANNEQQQQQLLLSPSPPKRSASFTDMCASYQQMNIQDFIKSIYINNWLILCIELDPDGPQPKISLANQQQSAAHFAAFKGIN

SEQ ID NO: 147742 - protein, 32 aa, Heterodera glycines
  Coding regions on vcDNA: vcDNA=SeqID_74165; Strand=-; Position=1-150
APEVKRESKNFPNYKKVKNSLMCNHAKMATRK

SEQ ID NO: 147743 - protein, 155 aa, Heterodera glycines
  Coding regions on vcDNA: vcDNA=SeqID_74166; Strand=-; Position=1-468
MFIAVFLPQMPHSALPPLPDNRLSRSFNTASVLLTCLNAHCQRVVQPFNNFLCDACFEAQKRELTRTLIGGGGHHNAALAAASSAANISATAISNGGGGEGGNNKGTAIIIIRANDDDDDQNRSGGRKNNATKHDSNISTTTNSHRLHCDISTTC

SEQ ID NO: 147744 - protein, 127 aa, Heterodera glycines
  Coding regions on vcDNA: vcDNA=SeqID_74167; Strand=-; Position=1-384
MVEHEFVEPDSAVDNRRKRALDAARKIVCVEKGGVAWKMVEEGKEESEEKEEEKQQQEKDENGWPTENRTWEQQQAVLGKVSIWRDYFRNGTNSTSAFVYAAGQQINQQDGSLRSIMAKFLMRDNQS

SEQ ID NO: 147745 - protein, 45 aa, Heterodera glycines
  Coding regions on vcDNA: vcDNA=SeqID_74168; Strand=-; Position=1-136
VYESLECVHVFCARAHFVSAHHCVLVDTILRNAKAEELATIPFGG

SEQ ID NO: 147746 - protein, 134 aa, Heterodera glycines
  Coding regions on vcDNA: vcDNA=SeqID_74169; Strand=+; Position=1 -157,224-471
MSRNSLNNFASLWPPTVAGCPMAIITPKFPEQNASYNVNTFTFQTIVNELKTENPNNRQMVFEEIEYLHKFEHYAVILCLSTTIEFYRTNCGYQKSKIRQKLFNWAKSEENSEKLDNYQLITQSERKTKCKMTK

SEQ ID NO: 147747 - protein, 222 aa, Heterodera glycines
  Coding regions on vcDNA: vcDNA=SeqID_74170; Strand=-; Position=1 -256,740-1152
MYEADLNIKRFKLDKIRTKNWECKKVKKTHAAICNEWKKRWTSLTVYLAYYREFGRHKMGTKIEKALRRERGAMAQLANKMAKQIEETGMLDHLAVKPHFKASADGSMLTFTESISQCFSAYNALFLAEKFKFCQFYSCLFGIGGPKKAQIQPISEFINEKECVFVNGWVRAYQRFKRIGDNEPKMGARNLLSSIVLQIENDEPIPEEKLSLIPFHFPASAQ

SEQ ID NO: 147748 - protein, 56 aa, Heterodera glycines
  Coding regions on vcDNA: vcDNA=SeqID_74171; Strand=-; Position=1 -55,133-248
MVIRIAAILPIIFVYGMERYPDTTNKRDNLAMKKKQQGNLSYLYSIGEDEKVLIDY

SEQ ID NO: 147749 - protein, 73 aa, Heterodera glycines
  Coding regions on vcDNA: vcDNA=SeqID_74172; Strand=-; Position=1 -53,105-273
MPIRCLTRQRHKHCLCNVLCAPNFHLTFAHLACVEHIEHILDCYRQLLEDNSLNNSAFLQQQKLITLPSSPFS

SEQ ID NO: 147750 - protein, 245 aa, Heterodera glycines
  Coding regions on vcDNA: vcDNA=SeqID_74173; Strand=+; Position=1 -127,460-668,856-1015,1304-1447,1528-1625
MPTDKFDAINFSEWKILYESIRQFFDYCDFLKSNADAVLFYEDDYRREEFEHFAFKPQFFYPNGDTMPISDAMRKIVEGFNIILKKGLAKINFFSKKELPQINFINRQICTKVLAWTYSIKKAENIQLAKSTLHIVKLHILISGFHNFTFDLPYPPIDENEMGEFENDLISNGFIGNRQNNTEDNIEENDEDLYWIWAYKMMLDTIEEGNDNKEPMALIDNGIRYSLVMDVLKKEWFDELNDYDN

SEQ ID NO: 147751 - protein, 79 aa, Heterodera glycines
  Coding regions on vcDNA: vcDNA=SeqID_74174; Strand=+; Position=1 -144,225-322
NDLISNGFIGNRQNNTEDNIEENDEDLYWIWAYKMMLDTIEEGNDNKEPMALIDNEIRYSLVMDVLKKEWFDELNDYDN

SEQ ID NO: 147752 - protein, 139 aa, Heterodera glycines
  Coding regions on vcDNA: vcDNA=SeqID_74175; Strand=-; Position=1 -141,480-547,638-735,2038-2120
  Homolog annotation: Hit_ID=XP_392550.1; Match level="QueryCoverage =59%, HitCoverage=2%, E-value=2e-20, Identity=56%"; Hit description =similar to CG12021-PC [Apis mellifera]
LQLTGDWVQVQIVHLPNEAEGLGFGIVGGHSTGVVVKSIIRGSVADKDMRLRPGDRILQIGHISTQGLNSQQVAALLRQQQVAALLRQQEAVVQLVVVRPIQLQDSEQDTPLCWTMATRAALSADTLDEQVQTRLEAFS

SEQ ID NO: 147753 - protein, 757 aa, Heterodera glycines
  Coding regions on vcDNA: vcDNA=SeqID_74176; Strand=-; Position=1 -1025,1434-2682
MRLIDWLNNKFVTNPWHNRTKHKNGNSISNNGYHHHQYNGTALHSNGGNNKCFAGVMPFSTIRPDGTLCHPFGISSSIPWMPHTRSQMPPLFGTVSPSNNTSRRPWEAAKRLLRAVPLRLSRKASETASHSSSFSEDPFGGGGDRGGTPIWLLRDPAPVAPRTGQRVGVDFAATQRRRTESPRALRRSVRDLRLSRRRRRSGFAQFSAFGWQQQQDGGERHNAERTTVGMDDVLRHKTDRLNQPAKWREDNTAPRKLAIIQMANERQIGTNPTERQDECQKTGLLQHDGTEEKAENGNQSRIKSAFDAVPPKNAVMLNFATELQQRMAEHMKAQYAKKGAVLHTPLSSAHSSGRLSVRWANSVDTPNNLNSSSKNIGQHQQQQSKLALPTDTHSVTTSRKGCQKSASVRSAVEPRVDEERCRRLCNTTPSSRRSSARALLCTGSALIGWRRMTIPDRLELPPPAPTASKCLRLEPPQMERFGSCERWAPPPLVERKRFNLLNKRHGTAGGGCCDSCGSSTWCCPSRRFCRGCASDSRRWWPLINQWQQQLHSVVARPFISSNSAVRKPAQQQKQQLIVGLSSEEKAAADGYAGGVIAMPAEGPKAVPDRVLVIQHDDYAVDDGQQGHHDRDEAVHHDSYESDESVTSADGTDEKATETEQHDADHHYHQVQAEQPLLMPSSEFHQRNLLLLSVIRLLLRRKLTKTAETSTNDRSEYNRLAAERLARAVVNTAQDERWIERRRKRKERERQRIVEARK

SEQ ID NO: 147754 - protein, 158 aa, Heterodera glycines
  Coding regions on vcDNA: vcDNA=SeqID_74177; Strand=-; Position=1 -135,201-300,826-881,996-1181
  Homolog annotation: Hit_ID=CAE70223.1; Match level="QueryCoverage =31%, HitCoverage=3%, E-value=5e-10, Identity=50%"; Hit description =Hypothetical protein CBG16703 [Caenorhabditis briggsae]
LHAVLRQSQVHGRLSVLAERLLGPAFGGPQIPHQCSLRCGFGQISPNCRRRSSPWPIPRAQLRPELVVKPGPGFAQQHDSPSAHPLAAPGMAVVRDVCNNPLTKEPKLDSAVRIVSEWTELDNEIKRLLTSSSNNRSAVGKPQDDETAFDDDEKHEEL

SEQ ID NO: 147755 - protein, 137 aa, Heterodera glycines
  Coding regions on vcDNA: vcDNA=SeqID_74178; Strand=-; Position=1 -158,433-542,742-890
  Homolog annotation: Hit_ID=NP_509268.1; Match level="QueryCoverage =91%, HitCoverage=8%, E-value=2e-58, Identity=79%"; Hit description =UDP-glucose ceramide glucosyltransferase-like 1 (XI114) [Caenorhabditis elegans] gb|AAF99954.1| Hypothetic
TGQSYDRINIFSLASGHLYERFLRIMMLSVLKNTKHPVKFWLLNNYLSPQFRESLPVMASHYGFDYQLIEYKWPSWLHQQTEKQRVMWGYKILFLDVLFPLDVKKIIFVDADQIVRTDLMQLMEYDLEGAPYVSDCG

SEQ ID NO: 147756 - protein, 317 aa, Heterodera glycines
  Coding regions on vcDNA: vcDNA=SeqID_74179; Strand=+; Position=1 -295,789-1330,1555-1668
MDVVFGGSSTTNGSGAGGGATKIGRTGAGAADCSSGDESNESERSDAPTNTGAGTGAGAALTERRTKRKQQKKGEENEHEEGKNTLKAMFPTILRRKSDACWCPSASSLSLPFIHQHPLNPHPITFANHESEAAAMVISKNNSRRHNTMASAHPGVKTEPKTRATAAASSPCCIKRESCCGGADMPEKRSNNSRMARTENAGADGAGAERKCRVSAGFSVQELQLQRHEQCMLQQQKRIDQLLLELGRSQSALNQHQKMLEDAERRMVEEGGQTGGGMEYWLSQLENGRREFAQQQQQLDKQMDVQKVLCKRDQQMK

SEQ ID NO: 147757 - protein, 168 aa, Heterodera glycines
  Coding regions on vcDNA: vcDNA=SeqID_74180; Strand=-; Position=1 -422,483-567
MANPNNFIAMITTHKRTSIGSTVSRRCGSNLNKSLILLPLFLFSNCLAFFRANAISSVSYQIRFTIRVPSMQIVPFELVNEWTKEKLTLAKANENDWRIDWIMKRCKIIGETAAFHWKDGNWDNNCNRVFFYLFCANNCIGSLSPPPEEVKEKAGQSITNGASYADNE

SEQ ID NO: 147758 - protein, 186 aa, Heterodera glycines
  Coding regions on vcDNA: vcDNA=SeqID_74181; Strand=-; Position=1 -279,331-613
WICNDVLMDILPSFDHAQLGLKLALLSPRFNALVDKHFDGKRELTIWRTVEIHHKDKGSGPKLSVVFDDRAVEFPLPDRPFSCKIRFKHLQIEYIDHYVIAFLRLNHQIFDKRGINLELWNPSSHTMDVQPIWDVLAHEILPIFSANIRHLGFNSGDHLDNLRRLISPTILTELNQLNSIHSFDLF

SEQ ID NO: 147759 - protein, 271 aa, Heterodera glycines
  Coding regions on vcDNA: vcDNA=SeqID_74182; Strand=-; Position=1 -110,323-764,1160-1423
MDTEAGKAQLYANNTVPFPLPERPLPRKIRFQALEILYIDHSVIEFLRANKQIFDNKGTNLVFKLSSYLSGKEDGRTIWQFLCREIWPIFTPNIRQLGFYNGDHLVNLRRLISPTILTDLNQLNPLDSGELFPAGVADDGPNATAGQALTKWLHTPTVDGQPKELYCSDHVWGFKFDWIKTFKEEFLRSTTPASYYILLHLCSMPEKPFELVNEQTQEKLSLAKIEGNVLISYWLLKRWPIAGGETAQRKDENGNKLNNVRFLIRGINCIG

SEQ ID NO: 147760 - protein, 341 aa, Heterodera glycines
  Coding regions on vcDNA: vcDNA=SeqID_74183; Strand=-; Position=1-1026
  Homolog annotation: Hit_ID=NP_502797.1; Match level="QueryCoverage =98%, HitCoverage=94%, E-value=2e-55, Identity=35%"; Hit description =HASI (4P602) [Caenorhabditis elegans] emb|CAB16520.1| Hypothetical protein Y57G11C.19 [Caenorhabditis ele
MGKTVESQLEQVYYNLNSPASYAGMQKVLAEARKRIPNLKLHDVQKFLHKQRTYTLFKPKRNKFPRLKTVPSGLHTDWQCDLCIMDSLKEHNDGYRYILVCIDVLSRQIYVAEAESKKSEHMIEAFEKVFKKAQVLPNKMYSDSGLEFQAKRMNEYWRSKDIIKHVMYSPHLHAGVVERANRTIKERLYRYFSEKNTHRWVDIIDKIVKNLNNLVNRTTGMRPVDVNFRNATELRNRLYKDVEQQKRIPKFKIDDIVRITKEKGDFSKGYFPNFTDELFKIVRVNPTNPPSYRISDLEGENIKGIFYDQELVKTVAAEQTTHRAEILKSRVRNGVKQHFVR

SEQ ID NO: 147761 - protein, 63 aa, Heterodera glycines
  Coding regions on vcDNA: vcDNA=SeqID_74184; Strand=-; Position=1 -83,337-445
MTWHGVIFCVVPLNISSISIAPLLFFTSTEYHNAFTKEWARLRALFVGLQPSNTIFATTVEIF

SEQ ID NO: 147762 - protein, 111 aa, Heterodera glycines
  Coding regions on vcDNA: vcDNA=SeqID_74185; Strand=-; Position=1 -36,87-214,582-753
MHFSEANPIIFALFLQYKDEQPCWPIISCALLLSIIAFFGLIFNTALIYVTVRARTLISPTNRLLAFNAALEIAHQSSYFTFLFLSLTGQTFIDYKMAVKIGTLSIIGYNV

SEQ ID NO: 147763 - protein, 102 aa, Heterodera glycines
  Coding regions on vcDNA: vcDNA=SeqID_74186; Strand=-; Position=1-309
MSKEYKQKRKYSPKEWKQNYAEICKKIGVGIGTIENWKRKFGICNKLTKNEKLEKIKIYLQIKSENPKMSDKEIAKTLKIDRKSISRWKNQFGEEILENLNE

SEQ ID NO: 147764 - protein, 78 aa, Heterodera glycines
  Coding regions on vcDNA: vcDNA=SeqID_74187; Strand=-; Position=1 -21,132-347
MQEVIGTAIAFALLSNGRCLNSILFLLNFPSSKNSPLCWRSDHHGGYVHFSADRSLRLSQIGVHFRRSDQHNGHHFWL

SEQ ID NO: 147765 - protein, 312 aa, Heterodera glycines
  misc_feature (246)..(246): Xaa can be any naturally occurring amino acid
  misc_feature (257)..(257): Xaa can be any naturally occurring amino acid
  Coding regions on vcDNA: vcDNA=SeqID_74188; Strand=+; Position=1-947
  Homolog annotation: Hit_ID=NP_508324.1; Match level="QueryCoverage =99%, HitCoverage=12%, E-value=4e-43, Identity=35%"; Hit description =predicted CDS, peptidase family A16 and RNA-directed DNA polymerase and Integrase, catalytic domain and Z
KLPTNFAMTYSQLKANLNRLRSKPDLLELYHKTILDQDDQGSVEKTDPGSKQKGQKIHYLPHHAVVKETSGRTKLRIVYNANAKSGNNPALNECIEKGVNEYNDLTSIQLWRRLKNILIGSDIANAFHQIELAPEDRYCVRFLWVENPFNPYSLVHYRFKRVTFGVICSPAQLALTIKIHLEKYDHPLIKQLIQNIYVDKLIVSITDKKEFKIVYKMIKQIFCEAGVDVREFLSNDLNKIQKLPKXDRIEKETVKLXGIWWNFREDEFIIKMPKFETSTKLSQIAKTFDPCGITAPIILAAKLFCQEIENGK

SEQ ID NO: 147766 - protein, 59 aa, Heterodera glycines
  Coding regions on vcDNA: vcDNA=SeqID_74189; Strand=+; Position=1 -138,343-384
MESSKKYSSLCNSCMGKTGKRASLEKNEKDQKFKKNNSEGKPIKELRRKTCRNPIERVV

SEQ ID NO: 147767 - protein, 46 aa, Heterodera glycines
  Coding regions on vcDNA: vcDNA=SeqID_74190; Strand=+; Position=1-141
LPTTDRRPRDGTTDAITETTRDGIGTTAEDDETEALTLKNGFHFVK

SEQ ID NO: 147768 - protein, 118 aa, Heterodera glycines
  Coding regions on vcDNA: vcDNA=SeqID_74191; Strand=+; Position=1 -182,237-341,708-779
FVHNFRELIFTKKFYNSEKLVLRPPQIDAFWVHFTRHYKGRDKPVQLSTDYLTILHLSKDIEANSTKGYNDKLLTQFDGQLGNGSAFLNDSKIIKVHVLKRTIFVKRKGGCFARKLIF

SEQ ID NO: 147769 - protein, 156 aa, Heterodera glycines
  Coding regions on vcDNA: vcDNA=SeqID_74192; Strand=-; Position=1 -243,375-416,504-686
PPYALPPYPSSPSLMCLLLSLLLLFLSPFISLPLFVPFSLALPSPQKRCPSPLFRQSRSSPPPNGTSPHYSTPIHFFAITQDCQFVLARPDQLGQLPSLSVSSSVSDCAPSRINLLWSLNSPVPSLLLLQQRAHKLCLLPIEVPFSVIAHSTELFR

SEQ ID NO: 147770 - protein, 103 aa, Heterodera glycines
  Coding regions on vcDNA: vcDNA=SeqID_74193; Strand=+; Position=1-312
MIAQSVPNIGHYYDEEEVMEDEEEYSYEEIDEEEEEEEEEVEKEEKRTVAARALPAAQLAEDGGQNGTAQGNEIGGQIQWRDKGLSALIALELIIWHFLISWD

SEQ ID NO: 147771 - protein, 263 aa, Heterodera glycines
  Coding regions on vcDNA: vcDNA=SeqID_74194; Strand=+; Position=1-792
KIKEMEAAKKQIEVEESAEEEGRILKEKARKTEEQKRGQKAKKDGEKWGRTEEEGPKRDGKHCLMRSYVAYYNYPREGSDQSMECPEEARKREENLKMKTVEERDHAFRSFVNADTSLDGRAKVGQRFARNLLAPVERDIIRNPGIPPEGRGFCQSATGWQGLPHPEGRNNWHATGWQGSRKRAWNMSPIRSSPVGATMEEKIERVRSLLFECTHTLRDVVDEMNAKKKKEEEMNKERTRETDEGREHGKKEGSEKSEGTKDK

SEQ ID NO: 147772 - protein, 26 aa, Heterodera glycines
  Coding regions on vcDNA: vcDNA=SeqID_74195; Strand=+; Position=1-80
LTSVVLVFGILIVPCFVVPSAVIGEY

SEQ ID NO: 147773 - protein, 74 aa, Heterodera glycines
  Coding regions on vcDNA: vcDNA=SeqID_74196; Strand=+; Position=1 -95,427-556
MVFSDIELTFVTADAVRLVQDKKVWTVIGTDGALLLKHFVIPFSDVEAELCNVRQLRVVPVQGNESRVLDVLVI

SEQ ID NO: 147774 - protein, 34 aa, Heterodera glycines
  Coding regions on vcDNA: vcDNA=SeqID_74197; Strand=+; Position=1 -45,1137-1196
MFNKCDLINENIHFLPPFFGIQEVVLNLEIVSYD

SEQ ID NO: 147775 - protein, 1763 aa, Heterodera glycines
  Coding regions on vcDNA: vcDNA=SeqID_74198; Strand=-; Position=1-5289
  Homolog annotation: Hit_ID=NP_920205.1; Match level="QueryCoverage =67%, HitCoverage=72%, E-value=1e-85, Identity=25%"; Hit description =putative DNA helicase homolog [Oryza sativa (japonica cultivar -group)] gb|AAP52492.1| putative DNA helica
MPSNKRNLRAKRQERYQRQMEQSVSPDRSPVPDGSADENGVASHPGTTTPNIGALQLSTPASSIGSKRRSMPPKAGAEPFRASQNSVSSVGTQIASATQNDESSPRNKKGKIDDFDRPISALEAIALTPVSTQRSGGRPAKKRGGPGRGKANDSMGESSSMDQSSEAGINAAVLPNVPEKINFSTVQINFATTRNLACKIWKWGATALYECDARRSGPRFIETCWNDLAQFLNDAFIVEYLAYLASISQRKVVVVDPAVWQMGIDRVIEYKNMTFGYDPNVPAEVILLPLHFPGHWTLIVHDVQCGTHFADSLPTPYGRLDVQLTDKIIKIISDILPSTVLTGIFNAVNLTVQHDGNSCGYFVCLYAESWLMNNRTFVLPDLSINYEKKRILWHINELYGSDNVPYHPREGVPTPCPIVYLHADEVQSTSKAAEPMELDEPDDIMIIEPQTSGKAANAILTQCQVAGENQADTLGLVSESCVPQEPIAQADDAIFVRPKTPPRRSVRIGRRQSASISRSSSPAPKRRTSENVPGQVTPLTKRCHLVHKGWCCAAAAAKHYPEYTDSGRLGEKKCSHCGALLFPHENSSLCCRQGRVVLPKLNPHPKELAKLLVDENQSREGKEFVRHMSRYNNLLQFASVSAGNKPCPAGGPMAVILNGEFHRRISSMQAGTTQIPGFGQLYILDPVEAMEQRRKNPTFTGEKITNEEEFVQGHQLNDKTLEILEQMIQAHHPAAQAYKQAHEQLTELLQQQNQEELRFFRMTLLNERRAPAGLKDPKLHPHQIITPSTGEGMFAIHADPTGAPPPKGIWVENKQGQLNEIAPFSPWTDSLTYPLIKPLGDDGYTTGIKYAKPSSRKRKGAQNASGLFDSEAESDNESCETQSIASSDAGSVADSDAESVASASSAYGRIDKSKRFISLRDYCKYRLAIRDENVELKYHHILSCGGGLGQRWILDQAAKIDWQVATFLRRPDMDLRISTPKNLLQYLVNQYNRQQARQNPNAQQKTVDDIGSVVRLSEHNVNSLQYWKKMYEDCNTVFARCHDAKKARLFITFTNNREWPEFKENIYKNGQVFTDRFDMWMRVWTSNIAEFREELYEKKFFGTILGYGESMEFQGRGGPHAHIVAQTDLDAVPHVIQEYIWAHIPSLPDKDDDTPIAKIHREIRETMHMQLHRCSDSWCGPSDPIYGRCKKGFPAPYSKCTVLRPDRPAMYFRPSPSDGGAQLEVNGLIYDNSHVVPYNPYVLLRYRVHHNVLFAYGNKANIKYALKYPFKGPGHCYVECKEESGNKIGIDEPAQYAKMNFRGATEAYAIVHSMPFARLSHHVVKLAIHLPNQQPIVYRAFQLVSKAQQIQQGELPETQCSAYWKQWQNEWKNDPKFKDILFEKVPEQFRWAKDKWVLYKRQQIKRPPIGRIVPVPPSDPERFALYSLMRHFPGDPDHLKMVNGLLCTSFTEAAIMHGLLEDGKIWDKTLAEAALSRWPDQMRWLFVSIMVYGQPSNAIELWNKYKDQMYNPQGIITPAQHKAAELEALADLDWRLHSCFNLSCVHFGLPDPPNSIAKNTDAAIEEFFFGDDDLNLPPGQPNLRPQPNAPPSLNSDQQKVFDAVLLAIQSNPRDPTVPRRFFIYGDGGTGKTFLFGQIIRRLRKAPYTYKVLATASTGCAAILLPYGKTAHSTFRLGREVSLDKLPSIPLESFFARRIREAQLIIIDEITMLHNTVIEVIDRVCKEMAIRQHKDLLFGGKTVIFSGDFKQSLPVVPHEGLTAQ

SEQ ID NO: 147776 - protein, 159 aa, Heterodera glycines
  Coding regions on vcDNA: vcDNA=SeqID_74199; Strand=+; Position=1 -92,138-238,301-403,551-734
  Homolog annotation: Hit_ID=CAE67927.1; Match level="QueryCoverage =96%, HitCoverage=78%, E-value=1e-34, Identity=45%"; Hit description =Hypothetical protein CBG13527 [Caenorhabditis briggsae]
MTLQWTVVAFILYAEIATIIVLLLPWVRPTMWKKVFNSRVVHKLKQFSNVYAYAFIFVLILLFVDATREVRKYSHVDTTREMVGRVAEADAVVHMRLFRIISRIVTLLARCAHLELAAEAAMKQAEGAGKAAQTLLGKVKLKQKWTDNDENFDWFRRAM

SEQ ID NO: 147777 - protein, 147 aa, Heterodera glycines
  Coding regions on vcDNA: vcDNA=SeqID_74200; Strand=+; Position=1-444
MVRKKQKLITDDCAPSTSNDQRTNDGFKAPGQKSGQLIETVQSSVQKRSETIHNSIELQSKEKSTERRCLKRKRLQMEEVIDLDDLPDEFFSPSISNEKIKEYDRNRKISRFQMNEEQRKLERELNLTVVQSRRFFYISVLNYCLFV

SEQ ID NO: 147778 - protein, 167 aa, Heterodera glycines
  Coding regions on vcDNA: vcDNA=SeqID_74201; Strand=-; Position=1 -126,318-422,470-707
  Homolog annotation: Hit_ID=NP_496711.1; Match level="QueryCoverage =98%, HitCoverage=69%, E-value=1e-37, Identity=47%"; Hit description =cdp-diacylglycerol-inositol 3-phosphatidyltransferase (24.8 kD) (2N28) [Caenorhabditis elegans] emb|CAB60
SGSRFGAMLDQLTDRLTFLGVLMTLCHYYPTKMLFFQFVAFLDIAAHWMHLHATDLTGKETHKGSKNPILNVYYTSKTCLFWMCFGNETCLFWMCFGNELFYGLLFVNHFWAGPGLLGIHFVPLLACVVCPVALAKSAINVLHLVTASQTVAEHDREKRGYLVQQSV

SEQ ID NO: 147779 - protein, 276 aa, Heterodera glycines
  Coding regions on vcDNA: vcDNA=SeqID_74202; Strand=-; Position=1 -102,148-382,984-1102,1805-1942,2378-2475,2785-2923
MSANSVPHSRGWSLNSRTLAIATALGLGSALIYWFYRCRNRNDCEQKSVSILQKAEKKKAQGVEAYRRKDFKEAIRLFGDAIDELRKVGKEFSDQVDEAKIGELMSLCENNNDYLDLTFMENVSKESRNTYHVELDRVAEATISPLLNEIIQVTLTDLVESESLSNEENYKIDETAKQRCHQLVEEGLRINPKNVDPLFAMLLHNNQIVLEACKKTLEKMPNCAYAIYLLGLVDMSDRLDLSQVVQSMENAMRKAIEADPNYWEPYRIMGKICGEK

SEQ ID NO: 147780 - protein, 105 aa, Heterodera glycines
  Coding regions on vcDNA: vcDNA=SeqID_74203; Strand=-; Position=1 -11,58-362
  Homolog annotation: Hit_ID=NP_496711.1; Match level="QueryCoverage =61%, HitCoverage=28%, E-value=2e-10, Identity=52%"; Hit description =cdp-diacylglycerol-inositol 3-phosphatidyltransferase (24.8 kD) (2N28) [Caenorhabditis elegans] emb|CAB60
MAESVGIKRCAPLGLREGSVDNETVRLPPYDFVPVSVGCPPPVRPSDENVFLFYPNLLGYVRILLAFGALFAMSYEEKPWSAALLYFASALLDAFDGYLARKFNQ

SEQ ID NO: 147781 - protein, 62 aa, Heterodera glycines
  Coding regions on vcDNA: vcDNA=SeqID_74204; Strand=-; Position=1-229
HHRPTPPKCKAMSDFLPFSWTVLLPLIGLLRITKAEIWRTDKRKKGKSDVSLKTIQTQIRLC

SEQ ID NO: 147782 - protein, 83 aa, Heterodera glycines
  Coding regions on vcDNA: vcDNA=SeqID_74205; Strand=-; Position=1 -186,513-649
GTNFSTSQYETADVGVGNQKSICFFVNADTPTIRSYMSSFRRHQKEETLRKEWGKKRESIVKFYKKERKSALRYLKKRAQEKR

SEQ ID NO: 147783 - protein, 103 aa, Heterodera glycines
  Coding regions on vcDNA: vcDNA=SeqID_74206; Strand=+; Position=1 -201,255-365
MVNSGMFYDELGLREFTVKILLLYVLKQFLFEVAPPGPALKNKLDKFVDRKLNECVARVEKLVNNKKDEVKDLAEHLEASDGWHLNEEQIHQFFKRRNANASP

SEQ ID NO: 147784 - protein, 63 aa, Heterodera glycines
  Coding regions on vcDNA: vcDNA=SeqID_74207; Strand=-; Position=1 -135,183-236
MKERTAKKKQIDVEDDSRFMDLAKNPMFREMRKKEHKVQIDDKHKEPFSFLASIGRVYTSDHE

SEQ ID NO: 147785 - protein, 225 aa, Heterodera glycines
  Coding regions on vcDNA: vcDNA=SeqID_74208; Strand=-; Position=1 -161,326-492,668-907,1306-1415
  Homolog annotation: Hit_ID=NP_498455.1; Match level="QueryCoverage =86%, HitCoverage=12%, E-value=3e-36, Identity=42%"; Hit description =notch Signaling pathway Homolog (nsh-1) [Caenorhabditis elegans] gb|AAD34660.1| Notch signaling pathway h
MEVMRGISWDEVCELRKKHRKRGDDFYTSNVGLNGCVKHSIAFIFGLGIDNANGDHHLPAGLGMSRMYCINKPNTGRSPRYETMDELAQRFTAVQNLAHAEKLWKEQFNAWEQMCHHRFFYGKCSTEVKGTFCEIGRRMRTYFVLSGSLICMWPELEQILSTDGKGGKRSLRRRMQIVRVRTDSKQRIVVWLDAILGCTIRAPNLGPHELFFIQCKRRAEATAGK

SEQ ID NO: 147786 - protein, 28 aa, Heterodera glycines
  Coding regions on vcDNA: vcDNA=SeqID_74209; Strand=-; Position=1-87
EHIGRLVKLEGEHVHSEQLLLLHRLSHL

SEQ ID NO: 147787 - protein, 28 aa, Heterodera glycines
  Coding regions on vcDNA: vcDNA=SeqID_74210; Strand=+; Position=1-85
LTSQKFIHKILSIHLVISRNTNQKFHNV

SEQ ID NO: 147788 - protein, 142 aa, Heterodera glycines
  Coding regions on vcDNA: vcDNA=SeqID_74211; Strand=-; Position=1 -21,695-885,1089-1285,2699-2716
  Homolog annotation: Hit_ID=NP_498808.1; Match level="QueryCoverage =97%, HitCoverage=24%, E-value=7e-51, Identity=67%"; Hit description =GTP-binding protein like (3J337) [Caenorhabditis elegans] pir||S44605 C02F5.3 protein - Caenorhabditis el
RLGPSDWQKTLLEKELEAVGIRLNKRPPNIYFKKKNGGGLKFTHTVPLTHCHEKLIQTVLHEYKIFHTKYLNSPCFSIDELIDVIQGNRVYIPCLHIYNKIDQISLEEVERLARLPHSIVISCELSLNLDDMLEKVCQYLRG

SEQ ID NO: 147789 - protein, 139 aa, Heterodera glycines
  misc_feature (25)..(25): Xaa can be any naturally occurring amino acid
  Coding regions on vcDNA: vcDNA=SeqID_74212; Strand=-; Position=1 -24,274-344,485-521,579-598,645-711,763-845,1243-1276
  Homolog annotation: Hit_ID=NP_001379.1; Match level="QueryCoverage =94%, HitCoverage=28%, E-value=3e-30, Identity=59%"; Hit description =developmentally regulated GTP binding protein 2 [Homo sapiens] sp|P55039|DRG2_HUMAN Developmentally regul
SSWEEGDAAQQQQNFPSFGKSTFLXTVTTTESVAASYEFTTLTCIPGVIEIPGVIEYEGANIQLLDLYEGANIQLLDLPGIIEGAAQGKGRGGQVISVAKTRGGQVISVAKTADLILMMLDATKGEIQSYLAEKFFKNF

SEQ ID NO: 147790 - protein, 41 aa, Heterodera glycines
  Coding regions on vcDNA: vcDNA=SeqID_74213; Strand=-; Position=1 -42,603-686
MSENFDVGRGNVPEARTEQPVPGGSAALEGASVAGNHFFVT

SEQ ID NO: 147791 - protein, 98 aa, Heterodera glycines
  Coding regions on vcDNA: vcDNA=SeqID_74214; Strand=-; Position=1 -84,209-421
MRFSGSLYFQRIVKIIWLKKFVASFSRTRIREKNSKIFPRQRLRCEEFQFKNKFFVHLCEHDHCVGAQLPHGSPHFVGCLLGPYRLGNDIGFLAYPTL

SEQ ID NO: 147792 - protein, 188 aa, Heterodera glycines
  misc_feature (156)..(157): Xaa can be any naturally occurring amino acid
  misc_feature (169)..(169): Xaa can be any naturally occurring amino acid
  Coding regions on vcDNA: vcDNA=SeqID_74215; Strand=+; Position=1 -28,1404-1523,2085-2192,2291-2333,2388-2434,2495-2672
  Homolog annotation: Hit_ID=NP_495794.1; Match level="QueryCoverage =76%, HitCoverage=17%, E-value=9e-47, Identity=64%"; Hit description =protein tyrosine phosphatase receptor type (2I778) [Caenorhabditis elegans] pir||T23738 probable protein-
YRICSFYMPSWIREKAYVVTQSVRSKQASNEMWRTVWELGSNTMVMLTKIFDFMRVMCLQYWPQTHFQFGEIHVETLETRTYAHFVIRTFRLRKTGGPGEEERIVKHFHFTEWELEERIVKHFHFTEWELNSNSFPYISAFVELRRRVRHGWKSEXXVSGRCQKCNFSXISSTNPTLHVVEAHKKLAT

SEQ ID NO: 147793 - protein, 88 aa, Heterodera glycines
  Coding regions on vcDNA: vcDNA=SeqID_74216; Strand=+; Position=1 -18,60-159,737-885
  Homolog annotation: Hit_ID=NP_495794.1; Match level="QueryCoverage =92%, HitCoverage=11%, E-value=2e-26, Identity=65%"; Hit description =protein tyrosine phosphatase receptor type (2I778) [Caenorhabditis elegans] pir||T23738 probable protein-
MVEVAARTGQLDVYEYGRTLANSRQHLIDTVDQYIFIYDVLCEAVLCNIQPIGMHQLKNRSGMYKARKDRELMEVQDSHENKANTMKY

SEQ ID NO: 147794 - protein, 294 aa, Heterodera glycines
  misc_feature (3)..(3): Xaa can be any naturally occurring amino acid
  misc_feature (18)..(18): Xaa can be any naturally occurring amino acid
  Coding regions on vcDNA: vcDNA=SeqID_74217; Strand=+; Position=1 -91,162-322,956-1009,1101-1274,1583-1642,5636-5734,6088-6206,6825 -6897,6985-7010
  Homolog annotation: Hit_ID=NP_495794.1; Match level="QueryCoverage =93%, HitCoverage=42%, E-value=1e-113, Identity=65%"; Hit description= protein tyrosine phosphatase receptor type (2I778) [Caenorhabditis elegans] pir||T23738 probable protein
KSXPYYSLLINIQSLNSXAFESTKLQKIQKTHSLQLLLMLHSLQLLLMLTAPLRIGDCAGGHRLENRGKNRDVMVVPPDHSRPYLQTLHGESKDYTYINAVEVDGFTRKSEFIVTEWPKVPTLDSFWTLIFDHNVHTVISLTNQPSDVKQFPQFVHNKGKRNYGPFTVEVVNYQQYPGLQSHMVKISKRTFMISEIMASGASQQQLEAEVRLCCIIQVKMWPIENKVPLSTTALIEVLKMTRSWRKRAPDRPEQRPTIVMSHNGVSRCGIFIAANVCIDQMEMDHEVDVFHAVK

SEQ ID NO: 147795 - protein, 29 aa, Heterodera glycines
  Coding regions on vcDNA: vcDNA=SeqID_74218; Strand=+; Position=1-87
MLTDYRICSNYSPVSINTAVSNYPLYSEE

SEQ ID NO: 147796 - protein, 97 aa, Heterodera glycines
  Coding regions on vcDNA: vcDNA=SeqID_74219; Strand=-; Position=1 -133,175-335
MADQFVQPETAEEQQVKAKKPRVDERFLWKITRGQFVLAIRLCSEDWNNLFHNKDKTRRLEDGRVAIGFEMCEECARINCCVSDMIADQKKKPKTTE

SEQ ID NO: 147797 - protein, 179 aa, Heterodera glycines
  Coding regions on vcDNA: vcDNA=SeqID_74220; Strand=+; Position=51-590
MVLAIEFCAQILGCSPKSLRDKLNHPEDRVKALKELVGKKVRTTYKDRNGMQKTFFVDGISDKGAALTPAYGRLRQPYNINIAAHFYARHRIKLHLPYVPCVVEKYSGSGEDRYYPMELLEIVDEDYTIKERWLGKLFTEIEEIPVKRLGRVEEVEEIDDNDDDDGGRYECSQPSYVYW

SEQ ID NO: 147798 - protein, 126 aa, Heterodera glycines
  Coding regions on vcDNA: vcDNA=SeqID_74221; Strand=+; Position=1-381
MSEDGQITLGLDVFECCPPTAPPFPWPWVPVTIRAESKDSNERVDCVSPSTLYILNSSYGPVFGSVSKSFTCAFSPSSVEECCAELVVPSLLRSLPICLPPLGVHFGGAPAESVCVQWHHRLPQVG

SEQ ID NO: 147799 - protein, 143 aa, Heterodera glycines
  misc_feature (63)..(63): Xaa can be any naturally occurring amino acid
  misc_feature (74)..(74): Xaa can be any naturally occurring amino acid
  misc_feature (102)..(102): Xaa can be any naturally occurring amino acid
  Coding regions on vcDNA: vcDNA=SeqID_74222; Strand=-; Position=1-469
  Homolog annotation: Hit_ID=ZP_00357698.1; Match level="QueryCoverage =79%, HitCoverage=52%, E-value=2e-10, Identity=37%"; Hit description =hypothetical protein Chlo02002738 [Chloroflexus aurantiacus]
PLSSIFDFSLSLFLPWLSLFHPFPSFYFLCFLNSLFASVFFSNFLSYCSLFSLFYRRNFFKIXSLTFIETPSSXVKSFCFSFIIYTYIFLFNFEFFHFFILXFYIFSFYDLFVRFVVLSLFCQSSHISIHFVFFIAFCAFGCV

SEQ ID NO: 147800 - protein, 78 aa, Heterodera glycines
  Coding regions on vcDNA: vcDNA=SeqID_74223; Strand=+; Position=1 -75,591-752
MALHRKFTLANANAIETDAEKSRPKITENLEKIQKITFEAKKLRRKRAFFNRTSLIYGAAFGDLCEKTETNKDLWPLS

SEQ ID NO: 147801 - protein, 53 aa, Heterodera glycines
  Coding regions on vcDNA: vcDNA=SeqID_74224; Strand=+; Position=1-162
ITENLEKIQKITFEAKKLRRKRAFFNRTSLIYGAAFGDLCEKTETNKDLWPLS

SEQ ID NO: 147802 - protein, 167 aa, Heterodera glycines
  Coding regions on vcDNA: vcDNA=SeqID_74225; Strand=+; Position=1 -128,234-443,514-679
MYLKFHNVYPCWNFIIAALAINAVAMFGMVSNFSVIWVTYRTKTLRGTANFLIALCSFFDMLHEHGHLLFLYTALSGQNFLPISSAVRFCSVSLFGVGGIAVSIAFTGLDRLFPRRVKPLPYLSAITLLCLASSVCTLIGYYKKNNETPEFMVTGTFSDLVSVGIFL

SEQ ID NO: 147803 - protein, 597 aa, Heterodera glycines
  Coding regions on vcDNA: vcDNA=SeqID_74226; Strand=-; Position=1-1791
  Homolog annotation: Hit_ID=NP_507780.1; Match level="QueryCoverage =44%, HitCoverage=19%, E-value=2e-15, Identity=25%"; Hit description =predicted CDS, DNA polymerase type B, organellar and viral family member (5T899) [Caenorhabditis elegans]
MEPRKRSSNFSIDHILSAPKKPRQGFLINELLGVVHFLGSVQQGEGTSKQAKDYVKKLENSIEHMAKFHYVKVKSKFTITDLPSTPEALLAGIFQHCIDEAIVESRERNIEPTHLGCMISSPLLEGGDIPIPIRQMTNNTLDTILNQFKKVAQSKQQKNVSLWGEPFTVTITTLDRNGLPSKRRVNGGARRPVKTAVHHRINDQCLIKIRNNDNHFCLFYALQATMVDKTCNWPRWKFFDYVNDRKGQQGQLHHDAVELMQQVNAPMDLDGYDADTFVPHVVDHWNNTQRQHRFAVFIFGSLGQYKPLYKYIDNIYDTPLLLYFNEDHFDGVQKQGGLFGKPYCLECERPYDKMSTHNKTCKARCVLCSRVGPAFPCPSSTGFIKKCKECNKKFTNNGCYQHHLQSGYCKRSKKCKDCGAVWDVHDNTQKGRKGHVCGERFCKMCNNYHNTERGCYIQPIEPKERDPYRIVAFDLETMQHTPSVKPEKREHLPNFIAARVACPDCIENESWREASGGCEVCGPSRTVAFCQRRFTETTVNKQVVAENPLEAFVSWLINDLPLAYDTYAFSHFGGRFDMVLVFRELFKRGYNPDMLRK

SEQ ID NO: 147804 - protein, 228 aa, Heterodera glycines
  Coding regions on vcDNA: vcDNA=SeqID_74227; Strand=+; Position=1 -210,253-447,494-726,999-1047
MKRTNFNNALPMSEKKPKLRRRLPAELNSELISFVPLICLFANVKRTPIGPVCYQFECFRSRRQKNFEYLKGVIALFDVMFEEKRTPKKKKVGRLHLQEELPHDLSRNELLHYLCYGRLGTNLFETYFVMSQATNSIAIGNLFGLLLDFAMSSPTPWHMKRPICCGIFFRQHLPWILQQPMNVMLSHGFFPEVRSDGFEFFWLFNPHLKKYAGNDDTMTDGIFWAKLS

SEQ ID NO: 147805 - protein, 90 aa, Heterodera glycines
  misc_feature (55)..(55): Xaa can be any naturally occurring amino acid
  Coding regions on vcDNA: vcDNA=SeqID_74228; Strand=-; Position=1-303
STGYREAIPDFFGLPINLGASVRGDCPENKKIDFFKCPFGVLKHLWGAKIQRRIXVQAIGKLFPKDSVSPYIWAQSGRGDCPENKKIDFF

SEQ ID NO: 147806 - protein, 99 aa, Heterodera glycines
  Coding regions on vcDNA: vcDNA=SeqID_74229; Strand=+; Position=1 -11,75-363
MNRRWICNDVWMDIFPSFDRPQLGLKMALLSPRFNALVDKHFNGKSELTIWRSIEIHKGKGPEPKLSVWMDDESNNVVEFPLPDRPLPSKIRFDSILIR

SEQ ID NO: 147807 - protein, 144 aa, Heterodera glycines
  Coding regions on vcDNA: vcDNA=SeqID_74230; Strand=+; Position=1 -212,537-759
MPMVPFELLNEWTKEKLTLTKANELDNSWIMKRCKIIGESAAVQQQKKDDNWDNNCNNVFIWLVAGTNCIGALPNSFFCSCAVNANGAIRIGERMDKGKADICQSKGIGQHLDNETMQNYWGDRGGSLGRRKLGQQLEHCDHLA

SEQ ID NO: 147808 - protein, 94 aa, Heterodera glycines
  Coding regions on vcDNA: vcDNA=SeqID_74231; Strand=+; Position=1 -206,268-346
MPMVPFELVNEWTKEKLTLAKANELDNIWIMKRCKIIGETAAVDWKDGNLDNNCNRVFIWLSYGIKSIGPLSPPPEEVEEEAGQSITKGPSADK

SEQ ID NO: 147809 - protein, 102 aa, Heterodera glycines
  Coding regions on vcDNA: vcDNA=SeqID_74232; Strand=-; Position=1-309
MLIFELNYEYHQKQQQQKQEVQAVQQQQQILMGIEMKIDNSKNGETRKEVEKMEGNSIGEGGGETEEKERKRKIRRKNEEEKRERNSSKSKLFNFAGANIAN

SEQ ID NO: 147810 - protein, 47 aa, Heterodera glycines
  Coding regions on vcDNA: vcDNA=SeqID_74233; Strand=+; Position=1 -46,708-805
MQMTKRRTALSTPKQGPGLLLFNPSKKGLLIGGGLLPERGLQIADLR

SEQ ID NO: 147811 - protein, 327 aa, Heterodera glycines
  Coding regions on vcDNA: vcDNA=SeqID_74234; Strand=+; Position=1 -191,248-380,426-619,674-1138
  Homolog annotation: Hit_ID=NP_506513.1; Match level="QueryCoverage =96%, HitCoverage=52%, E-value=6e-74, Identity=50%"; Hit description =TRNA Methylase (58.3 kD) (trm-1) [Caenorhabditis elegans] emb|CAB00881.1| Hypothetical protein ZC376.5 [C
MDGAESVILQCATEKGNGVGPSVAADCEANKLAEVTEGLARITATAEGGETFYNRVQEFNRDLTVVVLRAFAAEIPNEKEPKTEEEGPKAKQRKMDEGKAPEANAAQSQPRAFSVLDALSASGLRAIRFALEVPNVTRVVANDFSEKAFEAIRRNVQLNGVQDKVEAVFSDAIDLMMAHRKFGKRFHAVDLDPYGSASAFLDAAVQAVMDGGEQNGPQYTWNELFKGLLMVTCTDTAILCGNTPEACFNKYGSVPLRHKSCHELVPPALAALPMPSLKALRILLRAIDAHANRHKRYIVPLLSVSVDFYVRCFVRIRSGAAMAKDSV

SEQ ID NO: 147812 - protein, 41 aa, Heterodera glycines
  Coding regions on vcDNA: vcDNA=SeqID_74235; Strand=-; Position=1 -50,656-686,874-918
MFSQKAENRRNVEQAHFRNLYCKTQKSAKSRTTLMSLRMFK

SEQ ID NO: 147813 - protein, 41 aa, Heterodera glycines
  Coding regions on vcDNA: vcDNA=SeqID_74236; Strand=+; Position=1 -16,459-568
MREKVAQATTIGSEQLFSVALMCLTIVDQNLRLNMPKCSFF

SEQ ID NO: 147814 - protein, 156 aa, Heterodera glycines
  Coding regions on vcDNA: vcDNA=SeqID_74237; Strand=-; Position=1 -150,364-684
  Homolog annotation: Hit_ID=NP_490685.1; Match level="QueryCoverage =58%, HitCoverage=91%, E-value=5e-12, Identity=39%"; Hit description =transposase (1A616) [Caenorhabditis elegans] gb|AAB54166.1| Hypothetical protein F53G12.11 [Caenorhabditi
KTIANAIELRLKQAEEQKNLVLATILDPRFKTIYLDSSRLNQYKDWLISEATSPSPSALETRQKAEVEVNEYLRDQKIKSRADPALYWEVNSQKWPLIGAVVRKFLSPPATSSESERLFSTAGLISDDLRKSLQAANLAKLLFLHHNLLLTGFSIE

SEQ ID NO: 147815 - protein, 83 aa, Heterodera glycines
  Coding regions on vcDNA: vcDNA=SeqID_74238; Strand=+; Position=1 -23,99-327
MCLTRSHCYLINPSFGPLQMSDVQENASHFRNSSLIFPLTSSLATRAGRKWIYNYGNPQSTIAAIFSVAEIRNYGCPKTPQFP

SEQ ID NO: 147816 - protein, 132 aa, Heterodera glycines
  Coding regions on vcDNA: vcDNA=SeqID_74239; Strand=+; Position=1 -77,560-881
MAKESLRAMQEQVQETAMKLHDAEMSLINVEEECSFLRQRCADFETQMGRQRDDYDALLVKYNSSKTAPPPPPSPSPPFALDAQKEESSEESKRKRWWWANRNNITAASAGDDADDDGIETGGGNANAGRRR

SEQ ID NO: 147817 - protein, 193 aa, Heterodera glycines
  Coding regions on vcDNA: vcDNA=SeqID_74240; Strand=+; Position=1 -175,679-860,1379-1457,1514-1658
  Homolog annotation: Hit_ID=NP_741283.1; Match level="QueryCoverage =97%, HitCoverage=42%, E-value=5e-33, Identity=37%"; Hit description =one twenty two protein (58.9 kD) (4A876) [Caenorhabditis elegans] gb|AAC19192.1| Hypothetical protein F29
IKIVRNPEDDERLAYVNFERPECAKSVRRSLLPRLQKMLGRNIGVDPAGVIRDQEGGDGKFIPDRYNRAVMAAADRSPPPGGPSAAGPVPLRRAATPPMQQPRRPPPRRMEMPVFRKPTTVEQALSAREGQHNKPMRPGEYRCQLGYGKTQPCTSLIIGGLGPWASEDLLEKAFCDYGEIASIQYDGGTHGFI

SEQ ID NO: 147818 - protein, 178 aa, Heterodera glycines
  Coding regions on vcDNA: vcDNA=SeqID_74241; Strand=-; Position=1 -277,375-517,573-689
MDQSNGFYDREEDKVKLIIDLTTVDEPKVDKFNLDQSNSKGALFMEIEKVSEFAREIFWSERKSETVHIGGFPWKILAQIGKKKEALTKMRNAETWSCKCSATLRIVSLKSGVSDFRRKLDDHVFDNKNRGWGFNFISFAELMNPSKGFYDQSEDKVTLAIDVTVKEAKRRTKHKCPI

SEQ ID NO: 147819 - protein, 376 aa, Heterodera glycines
  Coding regions on vcDNA: vcDNA=SeqID_74242; Strand=-; Position=1 -81,589-682,1055-1213,1266-1375,1452-1604,1676-1814,1994-2388
  Homolog annotation: Hit_ID=BAA91345.1; Match level="QueryCoverage =67%, HitCoverage=52%, E-value=9e-30, Identity=32%"; Hit description =unnamed protein product [Homo sapiens]
MSNSIQSISVRMKHLLSTGEYADVKFLIILAHQIVLKSASKVFEAMFRFDSKNAKADNARFNLFQLAFANCPVVVEIPDVEAAAFKVILSFIYADDLSELNGDNAMGVLCAADKYNIPDLVLPSSQIPISELRNVFLAYAQARLFDFEEYCNDCLDYIDKNADALLKTEEFLQIDQKLLCEILGRDQLQISGEISIWNAALRWADEKCRENGIECSSGNRRSVLGPALFKIRFPNIHEEDFAKCVVPSGVLTVEEVLGVYQFNSHPFLYLRGVPGLYSLKFPSHGRIFNWNKARGNRRGTLSMEIEKMSEFAGESVGRSRYSDAVYINGFPWEIQAEITKGIDEKKYLGFYLWYDAKEGPILITILKIYATEKGAN

SEQ ID NO: 147820 - protein, 532 aa, Heterodera glycines
  Coding regions on vcDNA: vcDNA=SeqID_74243; Strand=-; Position=1 -24,2588-4009,4151-4316
  Homolog annotation: Hit_ID=NP_920591.1; Match level="QueryCoverage =98%, HitCoverage=35%, E-value=1e-95, Identity=37%"; Hit description =putative retroelement [Oryza sativa (japonica cultivar-group)] gb|AAP52878.1| putative retroelement [Oryz
LSQKLGRIHKIDLIPGSLPFHCRPYRYPPETQKEIERQIKMMLDQNIIRESESEFASPIVMVPKADKKSWRFAIDYRALNKMTKKRVFHLPNIQELLDLMGAKKFYTCMDLQQGFMQIPVAEEDIEKTAFISHLGIFEFITMPFGLTAAPDTFQRVMNSLRRRLTAAMLIYLDDIIIGSETEENHLTDIKNFLLLLKKVGLKLKLEKCHWGMSEIRYLGFLLSEKGVRIDPKQVEVVQNFKAPKSLTELKSLLGALTYFRRFIHNFAHIARPLQTLTRKIEENWGPEQEHAFQTLKQMLTTVPVLQSPRFGRTFTIECDASKKAIGAVLLQENGPVAYISRALNRHETNYPSIEREALALVYAVKEFSPYIVGSGVTKVITDCSALTGMMKAKELKGRLEKYQVTLQSFELEITYRPGKKNKVADFLSRYNIPGNEKDCEPKLEENSDEFEFQPKILSAKNINENLIAKNDGILNENNGAIYFVKGKENMEKPKLIIPHSLRQKLFLIFHSEGHFGFEKTWHEIKKRFYWIG

SEQ ID NO: 147821 - protein, 38 aa, Heterodera glycines
  Coding regions on vcDNA: vcDNA=SeqID_74244; Strand=-; Position=1-116
DILNFLILSFSLLSSDHCSPVNVSPGGGPFFSLIETLY

SEQ ID NO: 147822 - protein, 157 aa, Heterodera glycines
  Coding regions on vcDNA: vcDNA=SeqID_74245; Strand=+; Position=1 -97,154-279,337-446,887-1025
  Homolog annotation: Hit_ID=AAH85850.1; Match level="QueryCoverage =97%, HitCoverage=40%, E-value=2e-13, Identity=29%"; Hit description =Unknown (protein for MGC:94566) [Rattus norvegicus]
QIPAHKALLMAASDVFEAMFAYDSQNGTMAGNSPSNPVEVIDICAVPFKAMLRFIYTNKLSVLDGQNAMAVFYAAKKYAIIGLIEAFADFPIAKLPNVFLAFAQARLLQENALRWADERCRQNGIECSGENRRKMLGPILMAIRFPLMAQDEFLKII

SEQ ID NO: 147823 - protein, 100 aa, Heterodera glycines
  Coding regions on vcDNA: vcDNA=SeqID_74246; Strand=+; Position=1 -111,193-384
MSNQNEVPQLRAKRENHGQSGLSVQALVELLLCFFLPPAAVAIHGGPSFKMHILLNVLLCILGLACPPSFALTPLFRMDPRHSPRRLVLFHQHQLILNGG

SEQ ID NO: 147824 - protein, 34 aa, Heterodera glycines; identical to SEQ ID NO: 124987
  Coding regions on vcDNA: vcDNA=SeqID_74247; Strand=-; Position=1-103

SEQ ID NO: 147825 - protein, 70 aa, Heterodera glycines
  Coding regions on vcDNA: vcDNA=SeqID_74248; Strand=-; Position=1-603
MLVISGWQTLVQGRQDGEESVWSTDRCPPPRSGSSQATRDQPGQLITSQILRLTKINRPPFSAQTTRNEA

SEQ ID NO: 147826 - protein, 44 aa, Heterodera glycines
  Coding regions on vcDNA: vcDNA=SeqID_74249; Strand=-; Position=1-190
CNFIKNGENLNLIGNVPPLRRSIQKIFVCLHSILIHFSHKNVLI

SEQ ID NO: 147827 - protein, 48 aa, Heterodera glycines
  Coding regions on vcDNA: vcDNA=SeqID_74250; Strand=-; Position=1 -48,1013-1111
MASQLTATFGVSLVLQGVFGVADHESDIHCDQFRTPDPNSNKKSKIKI

SEQ ID NO: 147828 - protein, 120 aa, Heterodera glycines
  Coding regions on vcDNA: vcDNA=SeqID_74251; Strand=+; Position=1 -80,203-292,339-531
QAMNYQQSVQQQLGGGMSAQQQQQQARPQNPASAAVPQNMSPNVAPSPQQQQQMYQMPMYNHTNAGGTPFSPHNVYNQQMMTPQMASQQQFPPNAPATPATPQMSQSIGTPLSVHNIQQP

SEQ ID NO: 147829 - protein, 230 aa, Heterodera glycines
  Coding regions on vcDNA: vcDNA=SeqID_74252; Strand=+; Position=1 -70,757-1068,1466-1720,1887-1939
  Homolog annotation: Hit_ID=NP_508493.1; Match level="QueryCoverage =90%, HitCoverage=20%, E-value=2e-46, Identity=46%"; Hit description =SMAll body size SMA-11, Sensory Neuron Specification SNS-8, serine/threonine kinase (91.3 kD) (sma-11) [C
MLMDRGRQTEAESRRLFQQIVSADFGFSNYHQPGQLLSTWCGSPPYAAPELLLAQEYDGRQSDVWSLGVILYILVGLFFEKNNGQNAKNAIIIKQVTAGFPFPGDSVDKLKRAVLSDHLKIPFWVSVECADLIRKMLIVQPAKRCTLQYITQHKWFTCDMPEHIKQQLLVPQLSSSAAATTVDNQQENRAPYTVGGGGGRAVQQQQQQLDPTVLIFMQQHTGWSDEQIIE

SEQ ID NO: 147830 - protein, 141 aa, Heterodera glycines
  Coding regions on vcDNA: vcDNA=SeqID_74253; Strand=-; Position=1-426
MGGDGGMVLLLGRLHIGTAGDDGAARAAPRVLAVQLQIGATAAHNCVQRHGRRCCACGAAATEDKRRCHHGGRNSTVTTTITITTTAGATGGGNNAGAGGGSSRGGGCNRFRLANVGQTAQQQCVRAKHGRLVVVAQHFLF

SEQ ID NO: 147831 - protein, 151 aa, Heterodera glycines
  Coding regions on vcDNA: vcDNA=SeqID_74254; Strand=+; Position=1-458
  Homolog annotation: Hit_ID=CAG83749.1; Match level="QueryCoverage =95%, HitCoverage=32%, E-value=1e-13, Identity=40%"; Hit description =unnamed protein product [Yarrowia lipolytica CLIB99] ref|XP _499823.1| hypothetical protein [Yarrowia lipol
PTNNCCTLLITVLPLLITVEPLLITLLIAVVPLLFTVVPLLITVEPLLITLIIAVIPLLITVVPLLITVEPLLITLLIDVVPLLITVEPLLITVVPLLITVVPLLITVEPLEPLLITLLIDVVPLLITVEPLLIAVVPLLSTVKNYVFKAF

SEQ ID NO: 147832 - protein, 154 aa, Heterodera glycines
  Coding regions on vcDNA: vcDNA=SeqID_74255; Strand=-; Position=1 -210,338-592
MPLALCRSFPSPLMAPFLFPPNGLGGLCQTRGRTDAPNNVAKSLRTVDQEAEQIQELLRRRNSPVDPRDRPDVWNEGAQIERLLHERQNAFMADDERVEDEFAEGRVPQIVEPAQGTCPGLKKHARIQRKRREWRTLMKAERKRKAVATDPGCV

SEQ ID NO: 147833 - protein, 110 aa, Heterodera glycines
  Coding regions on vcDNA: vcDNA=SeqID_74256; Strand=-; Position=1 -78,681-785,834-983
MVENLCASLPGPVGNGPYDTEMCQFLADFFPDLIDICVEMLPETTNHEMAVLMRDLWNFLKSLFSMSSSPTSLHSSDVRPMPPPSPNRMDALTSVNQCTKKTLTHNCFSR

SEQ ID NO: 147834 - protein, 302 aa, Heterodera glycines
  Coding regions on vcDNA: vcDNA=SeqID_74257; Strand=-; Position=1 -65,299-573,677-850,929-1038,1089-1222,1264-1413
VPQRSPIPMDSAPIGARRGQSLANLVSLVIAVLPQLCQHRQQSSGELGLMSAAILLALADARRFGTEWDQFVMATDASGSTDPKNGSKVVENVLTLIRWQQTAPEDSPIRHLGISLPDLRGQLQDALLGWTLDYVDSLLQQSGGTEDIFLESQNGSSVGAPSLRVLDTFYSLMCIIVPQVQLPLRYHNKLLTKICALIVSMLRLVDRSHWGTPADGVDFVCRCFAISGKIFTAQIGASKTHLLAALMDEVFGSYDKLFSTDCGSGDKHCFNPSVGGCRDVGARFNFDAFRCLDFLNTDKKKE
